United States Patent 9,061,059 (MODIFIED POLYNUCLEOTIDES FOR TREATING PROTEIN DEFICIENCY) - sequence listing, part 64

SEQ ID NO: 122754 - DNA, 1179 bp, Artificial Sequence
  Description of Artificial Sequence: Synthetic coding sequence
atgtcggcccaggctcaaatgcgcgcaatgctcgaccagttgatggggacatcgcgcgacggcgacaccacccggcagaggatcaagttcagcgacgaccgggtttgcaaatcccacctgctgaattgttgtccacatgatgtgctcagtggcaccagaatggatctgggagagtgtctgaaagtgcacgacctggctctgcgcgcagactatgagatcgccagcaaagaacaggacttttttttcgagttggacgccatggaccatctgcagtcatttatcgcagactgcgataggcgtaccgaagtggctaagaaaagactggcagaaacccaagaagaaatctcagctgaggtggccgcaaaggccgaacgtgttcatgagctcaacgaagaaattgggaagttactggctaaagtcgaacaacttggtgccgaaggcaatgtagaggagtcacagaaggtgatggatgaagtggagaaggctcgggccaaaaaacgggaggctgaggaggtgtaccgaaactctatgcccgccagtagtttccagcagcagaaactcagggtttgtgaggtctgtagcgcatatttggggctccatgataatgacagaaggctggctgaccatttcgggggaaaacttcacctgggctttatcgagattagagagaagcttgaagagctcaaacgtgtggtggccgaaaaacaagagaagcgtaaccaggagcgcctgaaaaggcgagaagagagggagagagaggaacgtgaaaagctgagaagatcccggtctcattccaaaaatccaaaaaggtcaagaagtcgagaacaccggcggcaccggagtcgcagtatgtcacgggagcgaaagcggagaactcggtccaagtcaagagagaagcgccacagacacagatcccggagcagctcaagatctaggagccggtcccaccaaagatctcggcatagttcaagagatcgctcccgagagcgcagcaagaggcgctcctctaaagaaaggtttcgcgaccaggaccttgccagctgcgacagggataggtcttcccgcgacaggagcccacgcgatagagaccgtaaggacaaaaagcggtcatatgagagtgcaaacggaaggagcgaggaccgtcggtcttccgaggaaagagaagcaggtgagatatag

SEQ ID NO: 122755 - DNA, 1170 bp, Artificial Sequence
  Description of Artificial Sequence: Synthetic coding sequence
atggtcatccactcacagctgaagaaaattcagggggcgagcgagagaatgggcgatacaacaagacaacggatcaaattttccgatgaccgcgtctgtaagagccacctcctgaattgctgccctcacgacgtgttgtctgggaccaggatggatctgggcgaatgtttaaaggtgcacgatttagccctcagggctgactacgaaatagcgtctaaggagcaggattttttttttgagttggacgcaatggatcacctgcagagttttatagccgattgtgatcggagaacagaggtcgctaaaaagcgcctcgccgagacccaggaggaaatttctgctgaggtggcggccaaagcggaacgggtccacgagctcaacgaagaaattggaaaactcctggccaaagtagagcagctgggagccgagggtaacgtggaggagtcccagaaggtcatggatgaagtagaaaaagcccgcgccaaaaagcgcgaggccgaggaagtgtacaggaacagcatgcccgccagctcgttccagcaacagaagctcagggtgtgtgaagtgtgctccgcctacctgggactacacgacaatgacagaagattagccgatcacttcggggggaaactacatctgggctttatcgaaatccgggaaaaattggaagagctgaaaagggtcgtggcagaaaagcaagagaagagaaatcaggaacgcctgaagcggagagaggaacgcgaaagggaggaacgcgagaaactccgcagaagcagatctcactccaaaaatcctaagcgttcgcgcagtagggagcatagacgacaccgatcgcggtcgatgagtcgtgagaggaagaggcgcaccaggtcaaagtcacgggaaaaaaggcatcgccatcgtagtcggtcctcctccagatccagatcgcgatcacaccagcgatcgcgccactcttcaagggaccgtagcagagagcgatctaagcgccggagttcgaaggagcgattccgcgaccaggacctcgcatcttgtgacagagaccggagttccagagacagaagtccccgcgaccgggaccgaaaggataagaagcggtcctatgagtcagctaacggtagaagtgaggatcggcggagctccgaggagcgggaggctggagagatctag

SEQ ID NO: 122756 - DNA, 1377 bp, Artificial Sequence
  Description of Artificial Sequence: Synthetic coding sequence
atggcggccctgggctctccttcgcacaccttccgaggtcttctgcgtgagctacggtatctctccgcagctaccggcagaccctatcgggatacagccgcctaccggtacctcgttaaggcgttccgcgcccaccgagtcaccagtgaaaaattatgcagggcccagcatgagttacatttccaggccgcaacttacctttgcttgctgagatccatacggaagcacgttgcactccaccaggagtttcacgggaaaggtgatactacccggcagcgaatcaagttctctgacgaccgcgtgtgcaagagccatctgttaaactgctgcccacacgatgtccttagcggcacgaggatggacctgggagaatgcttgaaagttcacgatcttgcattgcgcgcagactatgagatagcctccaaagaacaggacttcttctttgagctcgacgcaatggaccatctccagtcttttatcgccgactgcgataggagaaccgaagtcgctaagaaacggctggctgagacacaagaagaaatatccgccgaagtggctgcaaaggccgagcgggtgcatgagctgaacgaggaaattggtaaacttcttgccaaagtggagcaactgggtgcagagggcaatgtggaggaatctcagaaagtgatggacgaggtcgagaaggctagagctaagaagcgggaagcagaagaagtgtaccgcaactctatgccggcctctagctttcagcagcagaagctgcgcgtttgtgaagtgtgtagcgcatacttgggactacatgataatgacagacggcttgccgaccactttggggggaaacttcaccttggctttattgagatccgcgaaaagctggaggagctgaagcgcgttgttgcagaaaaacaggagaaaaggaatcaggagcgattgaagcggcgagaggagcgcgagagagaagaacgagagaaacttcgaagatcccgtagccactcaaagaaccccaaaaggagccgctctagagagcacaggagacacaggagcagaagcatgagccgcgaacgcaagcgaagaactcgcagtaaatctagagaaaagaggcaccggcaccgcagtaggtctagctctcgctccaggagccgctcacatcagaggtcccggcattcatccagagacaggagtcgtgaaaggtcaaaacgaagatcctcaaaagaacgattcagagaccaagacctcgcatcctgtgacagagatcgttccagcagagacaggtctcctagggaccgcgaccggaaggacaagaagaggagctacgaatcagccaatggcagaagtgaggataggaggtcctcagaggaacgggaagcaggagaaatctag

SEQ ID NO: 122757 - DNA, 1179 bp, Artificial Sequence
  Description of Artificial Sequence: Synthetic coding sequence
atgtccgcacaggcacagatgcgcgctatgttggaccaactgatgggaacttcccgtgatggggatactacccgtcaacgcataaagttttctgatgacagggtttgcaagtcccatctgttaaactgttgcccacatgatgttttgtcagggacccgaatggacctcggtgagtgcctcaaggtccatgatctagccctgcgagcagactatgagattgctagcaaagaacaagactttttctttgaactcgatgcaatggatcacctccaatcctttatcgccgactgtgatcgacgaacggaggtggccaaaaagcgtctggccgagactcaggaggagatatctgctgaagtcgctgccaaagcagagcgagtccacgagttgaatgaggagatcggaaagctcctcgctaaagttgagcagctgggggcggaggggaacgtagaggaaagccaaaaagtgatggatgaagtggaaaaggccagggcaaaaaagcgagaagcagaggaagtttacaggaattctatgcctgcttcgtccttccaacaacaaaaactgagagtgtgcgaggtgtgctctgcatatctgggactccatgataatgacagacgcctagcagaccattttggaggcaaactgcatctgggcttcatagagattcgggaaaaacttgaagagctcaagcgcgtagtggctgaaaagcaagagaagcgtaaccaggagcggctgaagagaagagaagagagggaaagggaggaaagagagaaacttagacgatcccgaagccactctaagaatccaaaaagaagtaggtctcgggagcatagacgccatcgctcacggtccatgagtcgcgaaagaaaaagaaggactcgttccaagtccagagaaaagagacatcgacacaggtcaagatcttcttctaggtcgagaagccgatcccaccaacgcagccgtcatagcagtcgggaccggtcacgcgagaggtccaaacgccggagctctaaagaacggttcagggatcaagacctcgcttcgtgtgacagagaccgctcaagtcgcgatagatcaccacgagaccgcgatcgcaaggataagaaacggtcatacgagtctgctaacggacgctcagaagacaggaggtcttctgaggagcgggaagccggtgaaatttag

SEQ ID NO: 122758 - DNA, 252 bp, Artificial Sequence
  Description of Artificial Sequence: Synthetic coding sequence
atgagtgcacaggcacaaatgagagccatgttggaccagttgatgggtacttcccgcgacggaagcatgtatctttgcctgcccaccagcatctgcaagggggtgtccgagagaccacggattcgacaggccgagatccagttggtcaacgaatccaattcagtaatgacggaatatgcgcgtgtaaccttcagtacggtcgtgctgatgatgagctttctcgaactggagtggattctggaaaatgtgtag

SEQ ID NO: 122759 - DNA, 1299 bp, Artificial Sequence
  Description of Artificial Sequence: Synthetic coding sequence
atgatcagtgcagcacaactgttggacgagcttatgggtcgagatcgcaatctcgctcccgatgaaaaacgctctaatgtccgctgggaccacgaatccgtgtgtaagtactacctttgtggcttttgccctgcagaattatttacaaacaccaggtctgatctgggcccttgcgagaagattcatgacgaaaacctgcggaaacaatatgagaaatcctctagattcatgaaggtcgggtatgagagagattttttgcggtacctgcagagcctgttggccgaggtggagaggcgaatccggagaggccacgcacgcctggctctttcccagaaccagcaaagcagcggagccgcaggccccaccggcaaaaacgaagagaaaattcaagtgctgactgataagatcgatgtgctgttacagcagattgaggaactcgggagtgaaggcaaagttgaggaggcccagggaatgatgaagctggtggagcagctaaaggaagaaagagagctactcagatctaccacttctacaattgagtcgtttgccgcgcaagaaaagcagatggaagtttgtgaggtgtgcggcgcgttcctaatagtgggggacgcccaatcccgggtcgacgatcatctcatgggcaagcaacacatgggatacgcgaagattaaggcgacagtagaagaattgaaggagaagttgagaaaacgcacagaggaacccgatcgtgacgagagactgaagaaggaaaaacaagaaagagaggaacgcgagaaggagcgggagagagaacgcgaagaacgagagcggaaaaggcggcgggaagaagaggagagggaaaaagaacgcgccagggatcgcgagcgaagaaagcggagcaggagtcgctcccggcacagtagtcgtacctctgatcggaggtgctcaaggtcacgcgaccacaagcgctcaagaagccgggaaaggaggagaagtcggtctagagaccgcaggcggtcccggagtcacgatcgaagcgaacgcaaacaccgttcccggagcagggacaggcggaggagtaaaagtagagaccgcaagagctataagcacagatctaaatcacgagatagggaacaggataggaaatccaaagaaaaggagaaaaggggatctgacgataagaaatcatccgtaaagagcggctcaagagagaaacagtcggaggacacgaataccgagagcaaggagtccgacaccaagaatgaagtgaacgggaccagcgaggacattaaatcagaaggcgatacgcagtctaactag

SEQ ID NO: 122760 - DNA, 240 bp, Artificial Sequence
  Description of Artificial Sequence: Synthetic coding sequence
atgatttcggccgcccagctactggacgagctaatgggccgggatcggaaccttgcgcctgatgaaaagcgtagcaacgtgaggtgggaccacgaatcagtctgcaagtattatttgtgtgggttttgccctgcggagctgttcaccaacacccggagcgacttggacgtgttcggcagaggcgataacataagggatgttagcaagtttctggaggacgataagtggatggaagagtag

SEQ ID NO: 122761 - DNA, 1299 bp, Artificial Sequence
  Description of Artificial Sequence: Synthetic coding sequence
atgatcagtgcagcccagttgttggacgagctcatgggcagagaccgcaatctcgcccctgatgaaaaaaggagtaacgtccggtgggatcatgaaagcgtgtgtaaatactatctgtgcggtttctgccccgcggagctcttcaccaacacacgcagtgatttgggaccatgtgaaaaaatccatgatgaaaacctccgtaaacagtatgagaagtcatccagatttatgaaagtgggctatgagcgggactttctcagatatctccagagtcttctcgcagaggtggaacgcaggatcaggaggggccacgcccgcttggctctttctcagaaccagcagagtagtggtgcggccggccctactggcaaaaacgaggagaagatacaggtgctcactgacaaaattgacgtactcctgcagcagatagaagagctggggagtgagggtaaggttgaggaggctcaggggatgatgaaactggttgagcagctaaaggaggaaagggagttgctccggagcacgactagcacgatcgagagtttcgctgctcaggaaaagcagatggaggtctgcgaagtttgcggcgcctttctgattgtcggcgatgcccagtctcgggttgacgatcacctgatgggtaaacagcatatggggtacgcaaagataaaggctaccgtcgaggagttgaaagagaaacttagaaagaggactgaggagccagatagggacgaacggctgaaaaaagaaaagcaagaaagagaggagagggaaaaggagcgggagcgtgagcgagaggagcgggagcgtaaaaggaggcgggaggaagaggaaagggagaaagagcgcgctagagacagagagcgtaggaagcggtcacggagccggagtcggcattcttctcggacatcagaccgtcggtgttcccggtccagggatcacaaacggagcaggagccgtgaacgacgacgcagtcggagccgggaccgccgccggagcaggagtcacgaccggagtgagaggaaacatcgatctcggagccgagatcggaggcgcagtaaaagtagggacagaaaatcttacaaacacaggagtaagtctagggatcgcgaacaggatagaaagtccaaagagaaggagaaaagagggagcgacgacaaaaaatcctccgtcaaaagtggcagccgagaaaagcagagtgaagacaccaacaccgaatctaaagagagcgacaccaaaaatgaggtgaacggaacttcagaggatatcaagagcgaaggggacacccagagcaactag

SEQ ID NO: 122762 - DNA, 711 bp, Artificial Sequence
  Description of Artificial Sequence: Synthetic coding sequence
atgatttccgcagcacaactcctagatgagttgatgggccgggataggaacttggctccggatgagaaacgatctaacgtgaggtgggaccatgagagtgtgtgcaaatactatctgtgtgggttctgtccagcagaactgttcactaacacccgaagtgatctcggcccttgtgagaagatacacgacgaaaaccttaggaagcagtatgagaagtcttcacgttttatgaaggtgggctatgagcgcgacttcctaagatacttacagagcctgcttgccgaagtggaaagacgaataagacgcggccacgctcgactcgccttatctcagaaccagcagagcagtggggccgctggccctactggtaagaacgaggagaaaatccaggtgctcaccgataagatcgatgtcttactacaacagatcgaagaattaggctctgagggcaaggtggaggaggcacagggaatgatgaaattggtggagcagctgaaggaggagcgtgaactcctgcggagtaccacatctacaatcgaatcgtttgccgcacaagagaaacagatggaggtttgcgaggtgtgcggagccttcctgatcgtaggcgatgcccaaagtagggttgatgatcatctgatggggaaacagcatatgggttacgccaaaattaaggcaaccgtcgaggagaaaaagaagaagaaaaagaagtag

SEQ ID NO: 122763 - DNA, 1071 bp, Artificial Sequence
  Description of Artificial Sequence: Synthetic coding sequence
atgaaagtgggctacgaacgggactttctgaggtatctccagtctctgctcgctgaggtcgagcggcgcatccggagggggcatgctaggttggcactcagtcagaatcaacagtcatctggagcagccgggccaaccggaaaaaacgaggaaaagatccaggtcctgacagataaaatcgacgtacttctgcaacaaatcgaggagctgggctcggagggtaaggtcgaagaggcacaggggatgatgaaactggttgagcagctgaaggaggagcgggagctgctacgtagcaccacgtccacaatcgagagtttcgccgcccaggaaaaacagatggaagtgtgcgaggtttgtggtgcatttctgattgtgggggatgctcagtctagggtcgacgaccacttgatgggcaagcagcacatgggttacgcaaaaataaaagccacagtagaagagctgaaagaaaaactgcggaagaggaccgaggagcccgacagggatgaacggctcaagaaggaaaagcaggagcgtgaagagcgggagaaggaaagggaaagggagcgggaagagagggagcggaagcgcagacgggaggaagaagaacgggagaaagaacgcgcccgggaccgggaacgaagaaaacgtagccgctcccggtcccgccacagctctcggacatcagacagacggtgctcccggtcccgcgaccacaaaaggtcccgttccagagaacgtagaaggagccgctcacgggatagacgaagatcaagatctcacgaccgctccgagagaaagcataggtcccgatcgcgtgaccggaggcgtagcaaatcacgagacagaaaaagctacaagcacaggtccaagtccagagatcgggagcaggaccgcaagagcaaagaaaaggagaagagaggctcggacgataaaaaatcgtcggtgaaatcaggaagtcgcgagaaacagtcagaagatactaatacggaatcaaaggaaagcgacactaaaaatgaggttaacggtacaagtgaggacatcaagtccgagggcttgtttgtcacagtgtag

SEQ ID NO: 122764 - DNA, 1017 bp, Artificial Sequence
  Description of Artificial Sequence: Synthetic coding sequence
atgtccctgtcagccttcactttgtttctcgcactgatcggaggcaccagcgggcaatactatgattacgactttcccctgagcatttatggccagtctagccctaactgcgcccctgagtgtaactgccctgaaagttatcccagtgcaatgtattgtgatgagttgaaacttaaatcagtgccaatggtcccccccggtataaaatatctctacctacgaaacaatcagatcgaccacatcgacgagaaggcctttgagaatgtgactgatttacagtggctaatcctcgaccataacctgttggagaatagcaaaatcaagggtagagtcttctctaaattgaagcaactcaaaaaactgcatataaaccacaataacctgaccgaatcagtcggccctctccccaagagcctggaagacctccaactgacacacaataaaatcactaaacttggcagcttcgaagggctggtgaatctaacgtttatacatctgcaacacaaccggctcaaagaagacgccgtttcagccgccttcaaagggctgaagtccctggagtacttggacctgagcttcaaccaaatagcccgactcccctccggcctgcccgtgagtctgctgaccctctatttggacaataataagatcagcaatattccagatgagtattttaagcggtttaatgccctgcagtatctgcgcctgtcccacaacgagctggccgatagcggtatccctggcaatagcttcaacgtaagctcactcgtggagttggatttaagttacaacaaactcaagaatattcctacggtaaacgaaaacctcgaaaattattatctcgaggtcaatcagctcgagaaattcgacattaaatcgttctgtaagattttgggtcccctatcatactcaaagataaagcacctccggctggacggaaacagaatcagtgaaacatccctcccccccgacatgtacgagtgccttagagtggccaacgaggtcacacttaattag

SEQ ID NO: 122765 - DNA, 2100 bp, Artificial Sequence
  Description of Artificial Sequence: Synthetic coding sequence
atgaaacagcgcttcagtgcgttacagcttctgaagttactgttgctcttgcagccgccattacctagggcactacgggaggccctatgccctgaaccttgtaactgtgttcccgatggtgccctgcgatgcccgggcccgacagctggtctcaccaggctgagtctagcctacctgccggtgaaggtgatcccaagtcaggcctttcgcggcctgaatgaggtgattaagatcgagattagccagatagacagcctcgaacgcatagaagcgaatgcttttgataacctcctgaatctgagcgaaatattgattcagaacactaagaatctccgatacatcgagcccggggccttcatcaatttaccgcgtcttaagtacttgtcaatctgtaacaccgggattcgaaagttccctgacgtgacgaaggttttcagttccgaatcgaacttcattctcgaaatttgtgataacctgcacatcacaaccataccaggaaatgcctttcaaggcatgaacaacgaaagtgtcactttgaagctgtacggcaacgggttcgaggaggtccagagccacgcctttaatggcacgacgctgacctcactggagctcaaggaaaacgtacacctggagaagatgcataatggcgcattcagaggtgccacgggtcctaaaacgctggatatttctagcactaaattgcaggctcttccttcttatgggctggagtcaattcagagactgattgccactagttcttatagtctgaagaagctaccatctcgagaaacattcgtgaaccttctggaggcaactctgacgtacccatctcattgttgcgccttcagaaatttaccaacaaaggaacaaaacttctcccacagcatttctgagaatttctctaaacaatgtgagtcaactgttcggaaggtgaataacaaaacactgtactcttcaatgctagctgaatctgaactgtccggctgggattacgagtacggcttttgcctgcccaagacacctcggtgtgcccccgagccagatgcgtttaatccgtgcgaggatataatggggtatgacttcctccgagttctcatttggttaataaacattcttgcgatcatgggcaacatgactgttttattcgttctgctgacctcccggtataagctcaccgtccctagatttctcatgtgcaacctctcattcgccgacttctgcatggggctttacctgcttctgatagcatcagtggattcacagacaaaaggtcagtactacaatcatgcaatcgattggcagacaggcagtggctgctcaactgccggattctttacagtctttgctagtgagttgagcgtctatactttgaccgtgataaccctcgagcgctggcataccattacctatgccattcacttggaccagaaactcagattaaggcatgctatactgattatgttgggaggctggctgttttcttcactgattgctatgctcccacttgtgggcgtgtctaattatatgaaagtgtctatttgtttcccaatggatgtcgagaccacactgagccaggtttacattctgaccattcttatcctgaacgtggtagcatttttcatcatttgcgcttgctacatcaagatatatttcgctgtgcggaatccggagctcatggcgaccaacaaggacaccaagatagccaagaaaatggcgatcctcatcttcactgactttacgtgtatggcacctatcagttttttcgccattagtgccgcatttaaggtgcctctgatcaccgtgaccaacagcaaggtgttgctggtcctattttatccaattaacagctgtgcaaacccctttttgtatgctatattcactaagactttccagcgggacttcttcctcctgttatctaaattcggatgttgcaaacgacgggccgaactgtatcgccggaaagatttctccgcctatactagtaattgtaaaaatggctttacaggcagtaataagccttcccagagcactctgaagctcagcacccttcactgccagggcaccgctctgctggataaaacacggtacactgaatgttag

SEQ ID NO: 122766 - DNA, 1914 bp, Artificial Sequence
  Description of Artificial Sequence: Synthetic coding sequence
atgaagcaacggttctccgctctgcagctgctgaaacttttactgctgctccaacccccacttccacgagccctgagagaggctctgtgtcctgaaccatgcaactgcgtgccggacggagcccttagatgcccggggcctacggctgggctgactcggctgagtttagcctatcttcctgtcaaggttatccccagtcaggctttccgaggattgaacgaggtcatcaagatcgagatcagccagatcgacagtctggagagaattgaggctaacgcatttgacaacctgctcaacctttctgaaattttgatccagaacactaaaaatcttaggtatatcgagccgggagcattcattaaccttccaagacttaagtacttgtctatctgtaacaccgggatccggaaattccccgatgtgacaaaggtcttttcatcagaaagcaacttcatcctggagatctgcgataatctccatataaccaccattcctggaaatgcttttcaggggatgaataatgagtccgtgactcttaagctgtatgggaacggcttcgaggaggtccagagccatgccttcaatggcacgaccctgacaagcctggagctgaaggaaaacgtgcacctagagaaaatgcacaacggggcgtttcgcggtgcaacagggccgaagaccttgcaaaacttttctcatagtatcagcgagaatttttctaagcaatgtgaatctactgtaaggaaggtgaataataagacgttatattccagcatgctggccgaatctgagctgtcaggatgggattatgaatacggattctgtttgcctaagactcctcgctgtgcccctgagccggatgcctttaacccctgtgaggacatcatgggatacgattttctgcgcgtgctgatttggctaatcaatatattagcaattatggggaatatgaccgtcttgttcgtcttgctgacctctaggtataaactcacagttccccggtttctgatgtgtaacttgagctttgctgatttttgcatgggactgtatctcctactgatagcctcagttgatagccagaccaagggtcagtattacaaccatgctattgactggcaaaccggctcgggttgctcaacagcaggcttttttacggtttttgccagtgaactatcagtctatacacttacagtcattacgctggaacgctggcacaccatcacctacgcaattcacctggaccagaagctgagactgcgccacgctatcttaatcatgctcgggggctggctattctcaagtctaattgccatgctcccactggtcggagtcagcaactacatgaaggtgtcgatctgcttccctatggacgtagagacaaccttgtcgcaagtttacatacttactatcctgatactgaatgtggttgcttttttcataatttgcgcatgctatatcaaaatttatttcgccgtgaggaacccagaactcatggccaccaataaggatacaaagatcgcaaagaagatggcaattctgatctttaccgatttcacctgcatggcacctatcagcttctttgcgatcagcgctgcttttaaagtccctctcatcaccgttacaaattccaaggttctactggtgctgttttatcccattaattcttgcgctaacccattcctgtatgccatcttcaccaaaacctttcagcgcgatttcttcctgctcctctctaaatttggttgctgcaaacggcgagcagaactttataggcggaaagatttttcagcttacacctctaactgcaagaacggctttaccggttcaaacaaaccatcacagtcaaccctgaaactgagtacccttcactgtcaggggactgcccttcttgacaagacccggtatactgagtgctag

SEQ ID NO: 122767 - DNA, 978 bp, Artificial Sequence
  Description of Artificial Sequence: Synthetic coding sequence
atgaaacagaggttttctgcactccagctgctgaagctgctacttttgctgcagccccccttgccccgggccttgagggaagcactttgccccgaaccctgtaactgcgtgccggacggagcactccgctgccctggaccgaccgccggcctgactcgcttatcattggcgtatttaccagtcaaggtgattcccagtcaggctttccgtgggctgaacgaagtgattaagattgaaattagccagattgattctttagagcggattgaagctaacgcattcgataacctgctaaatttgtccgaaatacttatccagaatacaaagaacttgagatacatagagccaggagcttttataaatctgcccagattaaagtacctctccatatgcaacaccgggatcagaaagtttcccgatgttaccaaggtctttagctccgagtccaatttcatcttagagatttgcgacaatctccatattacaactattcccggcaatgcattccaggggatgaacaatgaatcagtgacattaaagctgtacgggaacggatttgaggaagttcagagtcatgcattcaatggtacaacactcaccagcctcgagctcaaggagaacgttcacctggagaagatgcataacggggcgttccgcggagccacaggtccaaagacgctggatatttcaagcacaaaattgcaagccctgccgagttacgggctcgaatcgatacaaagactgatcgccaccagcagttactcccttaaaaaactcccgtcgcgcgagactttcgtgaatcttctcgaagccaccttgacttacccgtctcactgttgtgcatttaggaacttgcctaccaaggagcagaacttttctcatagcatctctgaaaacttttcaaagcagtgcgaatcaacagtccggaaagtcaacaataagacactgtccaagccgagaatcaatgggtaccagtag

SEQ ID NO: 122768 - DNA, 990 bp, Artificial Sequence
  Description of Artificial Sequence: Synthetic coding sequence
atgaaacagcgatttagcgctttacagttactgaagctgctgttgctgctccagcccccactgccaagggccctacgggaggctctgtgtcctgagccctgtaactgtgtaccagacggcgccctaagatgtcctgggccaacggcaggcttgactagacttagcttggcatatctgcccgtgaaagtaatccctagtcaagccttcagaggcctgaatgaggtgattaagattgagattagccagattgactcccttgagagaatcgaagccaacgcttttgacaacctgctgaatctaagtgaaatcctcatacaaaataccaagaacttgcggtacattgagccgggagcatttatcaacctgccacgattaaagtacctctcgatttgcaacactggaatccgcaaatttcccgatgtgaccaaagtattttcctctgagagtaatttcatcctcgagatttgcgacaatctccacatcaccactatccccgggaatgcgttccagggcatgaacaacgagagcgtgacactgaagctgtatggcaacggattcgaagaagtgcagtctcacgcattcaatggaactacgctgacatcactcgagctgaaggaaaacgtgcacctggagaaaatgcataatggtgcttttagaggggccacagggccaaaaactctcgacatctctagcacaaagcttcaggcgctcccttcctacggtctggaaagtattcagagacttattgcaacctcgtcatactccttgaaaaaacttccatcacgcgaaacgtttgtgaatcttcttgaagctacgcttacctatcctagccactgctgcgccttccgtaacctgccaacaaaagaacagaattttagtcactcaatcagcgaaaacttctctaagcaatgtgaatctaccgtgaggaaagtgaataacaagacgcttctgctgcatggagcactgagcgcagcgcatagcctttcctag

SEQ ID NO: 122769 - DNA, 2019 bp, Artificial Sequence
  Description of Artificial Sequence: Synthetic coding sequence
atgaagcaaaggttcagtgctttacagcttctgaagctgctcctactgctccagcctccgctacctagggcattgagggaagctctctgcccagaaccatgcaactgcgtgccggatggcgctctgagatgccccgggcccactgccggcctcactaggctctctctggcctacctccccgtgaaggttatacccagtcaggcttttcgtggacttaatgaggtgattaagattgagatttcccagattgatagccttgaaagaatcgaagccaacgccttcgataacctccttaacctgagtgagattctgatccaaaatacaaaaaatctccgatatatcgagcctggcgctttcattaatctacccagactcaagtaccttagcatctgtaacaccggaatccggaagtttccagatgtcaccaaggtattctcatctgaaagcaattttatccttgaaatttgcgacaatcttcatattacaacaatcccaggcaacgcatttcagggcatgaataatgagagcgtcactctcaagttgtacggaaacggatttgaagaagtgcagtcacatgcctttaacggcacgacgctaacttcccttgaactgaaggaaaacgtgcatctggaaaagatgcacaatggcgcctttaggggggccactggccctaagacattagatatttcttctacaaagctgcaggctttacccagctacgggttggagtcgatccaacgactgattgcaacctcatcgtactctcttaagaaactaccatcaagggagacctttgtcaatcttctcgaagccacactgacatatcccagccattgctgtgccttccgcaacctcccaacgaaagattatagctccatgttggccgagagcgagctgtcaggctgggactacgaatatggcttttgcctaccgaagacccctaggtgcgcccccgaacctgatgcatttaacccatgcgaggatatcatgggttacgacttcttaagagtcttgatctggcttattaacattctcgctattatgggaaacatgaccgtcctgttcgtcttgctcactagccgatataaactaaccgttccccggttcctgatgtgcaacttatcgttcgctgatttctgtatgggattgtatctcctgctgatcgcatctgttgatagccagactaaggggcagtattacaatcatgccattgattggcagactggctctggctgctcgacggctggtttctttaccgtgttcgcatccgagctgtctgtttacaccttgactgtaatcacactcgagaggtggcacaccatcacctatgccattcatctcgaccaaaagctccgtctgaggcatgctatcctgatcatgctcggcgggtggcttttctcttcactgatcgcaatgctccccttggtcggggtctcaaactatatgaaagtgagtatttgcttcccaatggacgtggaaactacacttagtcaggtgtatatcctaaccatccttatcctgaatgttgtcgccttcttcattatctgtgcttgctacatcaagatttattttgccgtgcggaaccctgaactcatggcaactaataaagacactaagatcgccaaaaaaatggcaatcctcatattcaccgactttacatgtatggcccctattagtttctttgccattagtgcggctttcaaggtgcccttaattacagtgaccaattcaaaggtgttgttggtgctgttttatccgatcaatagttgtgctaaccccttcctctatgccatcttcactaagacattccagcgcgacttttttctcctactctccaagttcggctgttgcaaaaggagagccgagctgtatagaagaaaagattttagcgcatatacgagcaactgcaagaacgggttcacaggcagcaataaacctagccagagcacactcaaactgtccacactgcactgccagggaactgcgcttctggataagacgcggtacaccgagtgctag

SEQ ID NO: 122770 - DNA, 396 bp, Artificial Sequence
  Description of Artificial Sequence: Synthetic coding sequence
atgacgcccctactcactctgattttagttgtgctgatggggctgccgctggctcaggccctagactgccacgtgtgcgcttacaatggagataattgttttaatcccatgaggtgtcctgccatggtcgcctattgtatgacaaccaggaccagcgccgcagaggcaatctggtgccatcagtgcacaggcttcggcggttgtagccatggatccaggtgcctgagggatagcacccattgcgttaccaccgctacaagagtgctgagcaacaccgaagatctgcctcttgtcactaaaatgtgtcacatcggctgtccggacatccctagtctcggactgggaccttacgtttccatcgcctgttgccagacatccctctgcaaccatgattag

SEQ ID NO: 122771 - DNA, 351 bp, Artificial Sequence
  Description of Artificial Sequence: Synthetic coding sequence
atgaccccattgctaacgcttatcttggtggtgctgatggggctacccttggcacaggccctggattgtcacgtgtgcgcttataacggagacaactgtttcaaccccatgagatgtcccgctatggtagcttattgtatgactacacgcacgtactacacccctacacggatgaaagtcagcaagtcttgcgtgcctagatgcttcgagactgtttatgacggatattctaagcacgcgtctaccactagctgctgtcagtatgacctctgcaatggaacagggctggcgacccccgcaaccctagcactagcacccatactactggcaaccctgtggggactactctag

SEQ ID NO: 122772 - DNA, 351 bp, Artificial Sequence
  Description of Artificial Sequence: Synthetic coding sequence
atgacgcccctgctgaccctgatcctggttgtgctgatgggcctgcctctggcacaggcccttgattgtcatgtgtgtgcgtataatggggacaactgtttcaaccccatgaggtgcccagcaatggttgcctactgtatgacaacaagaacttattacactcctactaggatgaaggtttctaagagttgtgtgccccggtgtttcgaaactgtatatgacggatatagcaaacacgcatcaacaacaagttgctgccagtatgatctatgcaacgggacgggcttagccacccctgcaaccctagccttagctcctatactgctagcaactctgtggggcctcctgtag

SEQ ID NO: 122773 - DNA, 351 bp, Artificial Sequence
  Description of Artificial Sequence: Synthetic coding sequence
atgacacccctgctgaccctcatcctggtggttttaatggggctccccctggctcaggccctagattgccacgtatgcgcgtataacggggacaattgcttcaaccccatgcgctgtccagctatggtggcttactgtatgaccactcggacgtactatacaccaacccgtatgaaggtgtcaaaatcctgtgttccccgatgttttgagactgtgtacgacggatatagcaagcacgcaagcacaacctcttgttgccagtatgatctgtgcaatggcaccggcttagccaccccagcaaccctggctctggcccccattctgctggccacactgtggggactgttgtag

SEQ ID NO: 122774 - DNA, 249 bp, Artificial Sequence
  Description of Artificial Sequence: Synthetic coding sequence
atgacccctctattgacccttatcctcgtggttctcatgggtttgcctctggcacaggctctggattgtcatgtttgtgcgtacaatggcgacaactgtttcaatcccatgaggtgccctgctatggtagcctactgcatgaccaccagaacctattacactccaacgcgcatgaaagtctcaaaatcctgtgtgcccaggtgcttcgagacagtatacgatggttattccaaacacgccagcacatag

SEQ ID NO: 122775 - DNA, 255 bp, Artificial Sequence
  Description of Artificial Sequence: Synthetic coding sequence
atgacccccctcttgacgcttattctggtcgtcttgatgggcctgcctctagcccaagccttagactgccacgtctgcgcctacaatggcgacaactgctttaaccccatgaggtgccccgcaatggtggcttattgcatgactaccaggacatattacacacctacaagaatgaaagtctcaaagtcctgcgtgccacgctgcttcgagacagtgtacgacggctacagcaagcacgcctctactacctcgtag

SEQ ID NO: 122776 - DNA, 1041 bp, Artificial Sequence
  Description of Artificial Sequence: Synthetic coding sequence
atggatcccgcccggaaagccggcgcccaggctatgatatggaccgcgggctggctgttgcttctgctgcttagaggcggcgcccaggctttggagtgttactcctgcgtgcagaaggctgacgacggttgctcacccaacaagatgaagacagtaaaatgtgcccctggggttgatgtgtgtacagaagccgtgggcgccgtggaaacaatacacgggcaatttagccttgccgtcagaggctgtgggtccggcctgccagggaaaaatgatcggggcctggacttacacggccttcttgcttttattcagctgcagcagtgtgcacaggatagatgcaacgccaagctgaatctgacatccagggccctggatccagctggcaatgagtccgcctacccacctaacggggttgaatgctatagctgcgttgggttatctagagaagcctgccaaggaaccagccctcctgtagtgagctgttacaacgcgtcagaccacgtatataaaggctgcttcgacggtaacgtaaccttgaccgcagcgaacgtgacagtttcgttgcctgtgcgtggctgtgtccaggatgagttttgtactagagatggggtgaccggtcctggtttcacactgtctgggagctgctgtcagggctcccgctgtaacagtgatctgcggaacaaaacatatttctctcctagaatcccgcccctggtgagactccctcctcccgaaccgaccacagttgcatcaacaacatcagtgactaccagtacttccgcgcccgtgaggccgacaagtaccaccaagcccatgcccgcacctacctcacagactccaagacagggagtcgagcacgaagccagccgggatgaggagccccgattgaccggcggagctgccgggcaccaggatagaagcaactccggccaatatcctgccaaggggggacctcagcagccccataataagggatgtgtcgcgcctacggccgggctggcggcgcttttgctcgcagtggctgccggcgtgctgctttag

SEQ ID NO: 122777 - DNA, 885 bp, Artificial Sequence
  Description of Artificial Sequence: Synthetic coding sequence
atggaccctgccagaaaagcaggggctcaggcaatgatctggacggctggctggctgctgttactgctgctcagagggggcgctcaggccctcgaatgttatagttgtgtccaaaaggcagatgacggatgtagcccaaacaaaatgaagacggtcaagtgcgctcctggtgtagatgtctgtactgaggccgtaggggcagtggaaaccattcacggacagttctctcttgccgtgcgcggatgtggatctgggcttccaggcaaaaatgacagaggacttgaccttcacggactcctggcgttcatccagttgcagcagtgtgcccaggaccgctgtaatgcaaagttaaatctgacgtctcgagcgttggaccctgccgcagccgctaacgtaacagtcagtctcccagtgagaggctgtgtgcaagatgagttctgcacaagagacggggtcacagggcccgggttcacccttagcggcagctgctgtcagggaagtcggtgcaattctgacttacggaataaaacttatttctcaccaaggatccctccgcttgtacggctgcctccgcccgaaccaaccacggtggcgtccacaacatcggtgacaacatccaccagcgcccccgtcagacctacctcaacgaccaaacccatgcccgctccaacctcacaaactcccaggcagggcgtggaacacgaagctagtcgggatgaggaaccccgactcaccgggggagccgctgggcatcaggatcggagtaacagcgggcagtaccctgcaaagggcggccctcagcaaccccacaacaaaggatgtgtcgcccccacggctggcctggcagccctgctactcgctgtggcagcaggcgtgctgttgtag

SEQ ID NO: 122778 - DNA, 516 bp, Artificial Sequence
  Description of Artificial Sequence: Synthetic coding sequence
atggaacctgggccagccctggcctggctgctgctactgtcactgctggctgactgcttgaaagccgctcagagccgcgatttcacagtgaaggacattatctacttacacccctctacgactccctacccaggggggttcaagtgctttacttgcgagaaagctgctgataattacgaatgcaataggtgggcccccgatatttactgcccccgagagaccaggtactgctacacccagcacactatggaggtgactgggaacagcatttcagtgaccaaaagatgcgtcccgctggaagagtgtctgtccacgggttgtagggattccgagcatgagggccataaggtttgcacgtcatgttgtgaaggcaatatttgtaatctgccgctgccaaggaacgagacggacgcgacctttgctacaacaagtcccattaaccaaacaaatggtcaccctcggtgcatgtccgtcatcgtgtcttgtctgtggctttggctgggcctgatgctgtag

SEQ ID NO: 122779 - DNA, 516 bp, Artificial Sequence
  Description of Artificial Sequence: Synthetic coding sequence
atggagcctggccccgctttggcctggctgctcctgcttagcctgctagctgattgccttaaggcagctcaatcacgggattttaccgtcaaggatatcatctacctgcacccttcaacgactccctatcctggggggtttaagtgtttcacatgtgagaaggccgctgacaactacgaatgtaaccgatgggccccagatatctattgtcccagggaaacgcgctattgttacactcagcatactatggaagttacaggcaatagcatttccgtaactaagcgctgcgtcccactcgaggaatgtctgagtaccggatgccgagactctgagcatgaaggacacaaggtgtgcacttcgtgttgtgaggggaatatctgcaacctgccgttaccaaggaacgagaccgatgcaactttcgctaccacgtcacccattaaccaaacaaatgggcatcctcgctgcatgagcgtgatcgtgagctgcctctggctgtggctcggtttaatgctgtag

SEQ ID NO: 122780 - DNA, 162 bp, Artificial Sequence
  Description of Artificial Sequence: Synthetic coding sequence
atggaacctggccctgctctcgcatggttgctgttgctgagtctcctcgccgactgcctgaaagccgcacaatccagggatttcaccgtgaaggatatcatatatttgcacccttctaccactccttaccccggagggttcaaatgcttcacatgtgagtag

SEQ ID NO: 122781 - DNA, 969 bp, Artificial Sequence
  Description of Artificial Sequence: Synthetic coding sequence
atggctcggtgctttagtcttgtgctgttgctgacctcgatttggaccacacggctactggtccaaggttctctgcgggccgaggagctttccattcaagtgtcctgccggatcatggggatcaccttggtcagcaagaaggctaaccagcaactgaactttacagaagctaaggaagcgtgtagacttctgggcctctcattagcaggcaaagaccaggttgaaactgccctcaaagctagcttcgagacatgcagctacggatgggtaggagatggctttgttgtgatcagtagaatatctccaaatccgaaatgtggcaaaaacggggttggggtactcatctggaaagtgccagtgagcagacagttcgccgcctattgttacaactccagtgatacctggaccaattcctgtatacccgagattattacaactaaggatcccatctttaatactcagaccgccacccaaacaaccgagttcatcgtcagcgacagcacatattctgtagcctctccgtactccacgatcccagcacctaccacaacccctcctgcacctgcctcaacgtctattccacggcgcaagaaactgatctgtgtaacggaagtcttcatggaaaccagcaccatgagtacagagacagagccctttgtcgagaacaaggcagccttcaagaacgaggcggctggattcggaggcgtgcctaccgccttgctggtcctggcccttttgttcttcggggctgcagccgggcttggattttgctacgtgaaacgctatgttaaggcatttcccttcacaaataaaaaccaacagaaggaaatgatcgagacaaaggtggttaaggaagaaaaggcgaacgacagcaacccaaatgaggaatcaaaaaaaaccgacaagaacccagaagaatccaaatcaccttcaaaaaccacagtccgctgtctcgaggctgaggtatag

SEQ ID NO: 122782 - DNA, 387 bp, Artificial Sequence
  Description of Artificial Sequence: Synthetic coding sequence
atgagaacagcactcctgctgctcgctgcactggccgtggccaccggcccagcactaacactacgatgtcatgtctgcacttcttcctccaattgcaagcattccgtcgtgtgtcctgcaagttcccgcttctgcaaaactactaataccgtggaacctctgcgcggcaatctggtcaagaaggactgcgcagaatcctgtactccatcatacaccctgcaagggcaagtctccagcggaacctcatcgacccagtgctgtcaggaagatctctgtaacgaaaaactgcataacgccgctcccacacgaactgccttggcccacagtgccctcagtttgggtctggctttatctctcctggccgtgatcctcgctccatccctttag

SEQ ID NO: 122783 - DNA, 396 bp, Artificial Sequence
  Description of Artificial Sequence: Synthetic coding sequence
atgaagatctttctcccagtgctgctggctgctctgctcggagtcgaacgcgcaagttcactcatgtgtttctcttgtctaaatcagaagtcaaatctctattgtctgaaacctacaatttgtagcgaccaggataactactgcgtgaccgtctcggcgtctgccggcataggcaacctcgtgacattcgggcattctttgtccaagacctgttcacccgcttgccccattcctgagggcgtcaacgttggcgtggcctccatgggaattagctgttgtcagagctttctttgcaacttttctgccgctgatggtgggctgcgggcctcagtgaccttacttggggcgggactactgctcagtcttttgccagctcttctcaggtttggcccatag

SEQ ID NO: 122784 - DNA, 396 bp, Artificial Sequence
  Description of Artificial Sequence: Synthetic coding sequence
atgaagattttcctccccgtgctcctggcggccctgctcggggtggagcgggctagctctctgatgtgcttctcatgccttaaccagaagtctaacttgtactgcctcaaacctacaatctgtagcgatcaggacaattactgcgtgaccgtgagcgctagcgccggcattggcaacttggtgacgttcggtcacagcttgtcgaagacgtgctcgccggcatgccccatccctgagggtgtgaatgtgggcgttgcgagtatgggaatttcgtgctgccaaagttttttgtgcaactttagtgcagcggacggcgggttgagagcctcagtgaccctccttggcgccggactgctgttaagtttactgcctgccctgcttaggtttggaccatag

SEQ ID NO: 122785 - DNA, 267 bp, Artificial Sequence
  Description of Artificial Sequence: Synthetic coding sequence
atgaagatttttttacctgtattattggctgccctcctcggcgttgagcgggcatcttctttgatgtgcttctcttgcctcaatcagaagagcaacctctactgcctcaagcctacgatttgcagcgaccaggacaactactgcgttaccgtcagtgcaagcgccggaattggtaacctggttacctttgggcacagcctgagcaagacctgctctcccgcatgtcctataccagagggcgtcaatgtgggcgtggccagcatgtag

SEQ ID NO: 122786 - DNA, 396 bp, Artificial Sequence
  Description of Artificial Sequence: Synthetic coding sequence
atgaagatcttcctccccgtgctgttagcggctttgctgggagtcgagcgggcaagcagtctgatgtgcttcagctgtcttaaccagaaaagcaacctttattgtcttaaaccaacaatttgcagtgatcaagataactattgcgtgaccgtgtcagctagtgcaggaatagggaacctcgtgacctttggccattccctgagcaagacttgctcccccgcctgtcctattcccgagggggtgaatgtgggggtggcttctatgggcattagctgctgtcagtcttttctctgcaatttcagcgctgctgacggtggactcagggcgtcagtgaccctgctgggagctggccttctgctttctctgctccccgcacttcttagatttggcccttag

SEQ ID NO: 122787 - DNA, 396 bp, Artificial Sequence
  Description of Artificial Sequence: Synthetic coding sequence
atgaagatctttcttcctgtcttactggccgccctgctgggggtagaaagggcttcgagtctgatgtgcttcagttgcctgaaccagaagagcaatctctactgccttaagcctaccatctgtagcgaccaggacaactattgtgtgactgtgagtgcctccgcgggaattggcaacctggttacattcgggcatagtctgtccaaaacatgctcccccgcctgtcccatacccgaaggcgttaatgtcggggtcgcctcgatgggcatctcatgttgtcagtctttcctttgcaatttttccgcagctgatggcgggctcagggccagtgtgaccctactgggcgcaggcctgctcttatccctcttgcccgcactcctaagattcggtccttag

SEQ ID NO: 122788 - DNA, 396 bp, Artificial Sequence
  Description of Artificial Sequence: Synthetic coding sequence
atgaagatttttcttccggtcctcctggcagctcttctgggcgtagagagggccagcagccttatgtgcttttcatgcctgaaccagaagtctaacttgtactgcctaaaacccaccatttgctctgaccaagacaactattgtgtgacagtctccgcctcagccggtattggcaacctagtaaccttcggccacagtcttagtaagacttgttctcccgcctgccctattcccgagggcgtgaacgtcggagttgcttcaatgggaatttcctgttgccagtccttcctgtgcaatttcagtgcggcagacggcggcctgcgagccagcgtgactctcttgggtgccggactgctccttagcctgctacccgctctgttgagattcggaccctag

SEQ ID NO: 122789 - DNA, 396 bp, Artificial Sequence
  Description of Artificial Sequence: Synthetic coding sequence
atgaagattttcctgcccgttctgttggccgcactcctcggcgtggagcgcgccagcagtcttatgtgtttctcatgcctaaaccagaaatcgaacctgtattgtttgaaaccaacaatatgctcagaccaagataactattgtgttacagtgagtgcttctgccgggataggcaacctagttacattcggacacagtctatctaagacgtgctcaccggcctgccctatacccgaaggagttaatgtgggggtcgcctcaatgggaatctcttgctgtcagagttttctgtgtaatttctctgcagccgatggggggctgcgggcctcagtcaccctcctgggcgccgggcttctcttgtcactcctgcctgctctgcttcgatttggcccatag

SEQ ID NO: 122790 - DNA, 396 bp, Artificial Sequence
  Description of Artificial Sequence: Synthetic coding sequence
atgaaaattttcctcccagttttgctggcagcgctactgggtgttgagcgtgctagttctcttatgtgcttcagttgcttgaatcagaagagtaatctatactgcctcaagccaaccatatgtagtgaccaagataactattgcgtgaccgtatccgcaagtgccggaatcggcaacctcgttactttcggtcattccctatcaaaaacctgcagtcctgcctgtcctattcccgagggggtaaatgtgggcgttgcctccatgggaatctcctgttgtcagagttttctttgcaacttcagcgccgccgacggcggactaagagcatccgtgactctactcggtgctggactcctcctatctttactgcccgcactccttagattcgggccctag

SEQ ID NO: 122791 - DNA, 402 bp, Artificial Sequence
  Description of Artificial Sequence: Synthetic coding sequence
atgaaaccacagtttgtgggcattctgcttagcagtctcctgggcgccgcattgggcaatcgaatgcggtgttataattgtggaggctctccctcatcctcctgcaaggaggccgtgacaacttgtggagaaggacgaccccagcctggtcttgaacaaatcaagttaccaggcaatcctccagtgaccttgattcatcagcaccccgcttgtgtagctgcacaccactgtaaccaggttgaaacagaatccgtgggagacgtaacttacccagcgcaccgggattgttatctgggcgacctatgcaatagcgccgtggcaagccacgtcgcccccgccggaatcctcgcggcagccgccacggccctgacttgcctcttaccagggctctggtccgggtag

SEQ ID NO: 122792 - DNA, 525 bp, Artificial Sequence
  Description of Artificial Sequence: Synthetic coding sequence
atgaagccccaattcgtcgggatcctgttaagctcacttttaggggctgccctgggaaataggatgcggtgttacaactgtggtggatctccctcaagcagttgcaaggaagccgtaacaacatgcggcgaaggcaggcctcaaccaggattagaacagatcaaactgcccggaaacagacggtgcttcctccgtggattaaaaatcccactgggcagtttaaaatcgcacctcttatgtccaagacggcaggtccttaaacctggcgtgcaacacccctcattcatactatcgctgtcccccagcgacctggattctcctacctcctcactccgacgtagcccatccctgcagagcagcggtgatcgggtgggcgggaggagggatctttcttcccctcaaggtctgctacccggaagacccgtccagcagcggaggggaaagccgtgcggtccttgtcggcatttcggctgctccagttatcgtcctgacctatccctggccagaacagtcgaacgcatctag

SEQ ID NO: 122793 - DNA, 402 bp, Artificial Sequence
  Description of Artificial Sequence: Synthetic coding sequence
atgaagccccagttcgtcggcattttgctgtcctcgctcctgggggccgcgctcggaaatcggatgcggtgttacaattgtggcggctccccttcttcttcttgtaaggaagccgtaacaacatgtggggagggcagacctcagcccggactggagcaaattaaactcccgggaaatccccccgtgaccctcattcaccagcaccctgcctgtgtagccgcccatcattgtaaccaggtcgagactgagtcagtcggggatgtgacataccctgcacaccgcgactgctacttaggcgacctctgtaacagtgccgtggccagccacgtcgcccccgccggaattcttgccgcggcagccacagcactgacctgcctgctgcccggactctggtccggttag

SEQ ID NO: 122794 - DNA, 1149 bp, Artificial Sequence
  Description of Artificial Sequence: Synthetic coding sequence
atggctgtgctgttccttctcctcttcctctgtggaactccgcaggcggctgataatatgcaggccatctacgttgccctaggggaggccgtcgagctcccgtgccctagtccgcctacattgcacggggacgaacacctgtcttggttctgtagtcctgctgctggtagctttacaacgctggtggctcaggtacaggtggggagacccgccccggatcccggtaagccaggacgggagtcacgcttaagactgctggggaattattcattgtggttggaggggagcaaagaagaagacgccggacgctactggtgcacggtactgggccagcatcataattaccagaactggcgcgtgtacgacgtgctggtgctgaagggctctcagctcagtgctcgggccgccgatggaagcccatgcaacgttctgctgtgctcggtggtgcccagcagacgcatggattcagtgacgtggcaagagggcaagggacctgtgcgcggccgggtccagagcttctggggatccgaggcagcgcttctgctagtgtgccccggagaaggcctatctgaaccacgaagccgcaggcccaggattattaggtgtctcatgactcacaataaaggtgttagtttctcgctagcagccagtatcgacgccagccccgctctttgcgccccttccaccggatgggacatgccctggatactgatgctgctgctgactatggggcagggagtcgtcatcctcgcgctgtcaattgtcttgtggcgtcagagggtgcgcggagctcctggccgaggcaaccgcatgcggtgctacaactgcggcggttcccctagcagcagttgtaaggaggccgtgacgacttgtggagaaggaaggcctcagcccggcttagagcaaattaaactgcctgggaacccccccgtgacactgattcatcagcatcccgcttgcgtggctgcccaccattgtaatcaggtagagactgagagtgtcggtgatgtcacttatcccgcgcacagagattgctatctgggcgatttatgtaactccgccgtagccagtcatgttgccccagcagggatcctggctgccgccgccacagcgcttacctgtctgctccctggcctgtggtcgggctag

SEQ ID NO: 122795 - DNA, 402 bp, Artificial Sequence
  Description of Artificial Sequence: Synthetic coding sequence
atgaaaccacaattcgtcggcatactcttgtcaagcctacttggcgcagccctcggaaacagaatgcggtgctataattgcgggggctcaccttcaagctcatgtaaggaagcagttacaacctgcggggaaggcaggccacagccaggtctggagcagatcaaactccccgggaatccgcctgttacattgatccaccagcatccagcttgcgttgcggcgcaccattgtaaccaggtggaaaccgagtccgttggagacgtcacttaccccgctcaccgcgactgttacctcggcgatctgtgtaactccgccgtggcatcacacgtagccccggcgggcatcctcgctgccgcagcaactgccttgacttgcctgctgcccggcttatggtctgggtag

SEQ ID NO: 122796 - DNA, 402 bp, Artificial Sequence
  Description of Artificial Sequence: Synthetic coding sequence
atgaagccacagttcgttggcatcctgttatcctctttactcggggccgccctaggaaacaggatgagatgttacaattgtggcgggagtccttcaagctcatgtaaggaagccgttaccacttgcggagagggcaggcctcaaccgggattagaacagataaaactgcctggcaatccacctgtgaccctgatccaccagcaccctgcctgtgtggccgctcaccattgcaaccaagtggaaacagaatcggtgggggacgtgacctatcctgcacaccgggactgctacctgggggatctctgcaatagcgcggtagccagccatgtggctccagccgggattctggccgctgccgctactgcgttgacatgccttctcccagggctgtggagcgggtag

SEQ ID NO: 122797 - DNA, 1149 bp, Artificial Sequence
  Description of Artificial Sequence: Synthetic coding sequence
atggctgtgctgttcctgctgctttttttgtgcgggacgccacaggccgccgacaacatgcaggcgatttacgttgcactgggtgaggcagtggaactgccctgccctagcccacccacccttcacggtgacgagcacctcagctggttctgctcccctgccgccggttctttcacaactttggttgcccaggttcaggttggccgaccagcacctgacccggggaagcccgggcgcgagtctcggcttaggctgctgggcaattatagtctttggctggagggatcaaaagaagaggacgcaggacgctactggtgcgcggtgctggggcagcatcataactatcagaattggcgggtgtacgatgtcttggttctcaaaggatcccagctgagtgccagggccgctgacggctccccatgtaacgtgttactatgttccgttgtgccgagccgcaggatggactcggtcacgtggcaggaagggaaaggtccagttaggggacgggtccagtctttctggggctcagaagccgctttactcttggtgtgccctggcgaggggttgtcagaacctagatctaggagacctcgcattatccggtgtttgatgacccataataagggagtgtcattctccctggctgcatcaattgatgcatcaccagctctgtgcgccccgtcgaccgggtgggacatgccatggatactgatgctgttgcttacaatgggacagggcgtggtgatacttgctctctccatcgttctatggcgccagagggtgcgtggcgcccccggacgcgggaataggatgcggtgctacaactgtgggggaagcccctcctctagctgcaaggaggcagtgaccacatgcggggaaggaaggcctcagcccggactggagcagattaaactacccggcaatcctccggtgactttgatccatcagcacccggcctgcgtggcagcacaccactgcaaccaggttgagaccgaatccgtgggggatgtcacttaccccgcgcaccgggactgctacttaggtgatctctgcaactcggccgtggcctcccacgtggcccccgccggaattctggccgccgccgcaacggccctgacatgtctcttgcctggcctctggagcggctag

SEQ ID NO: 122798 - DNA, 402 bp, Artificial Sequence
  Description of Artificial Sequence: Synthetic coding sequence
atgaaaccccagtttgtgggcatcctccttagttctctgctcggtgcggcccttggaaatcgaatgcgctgctataattgtggtggcagcccttcttcgacctgtaaagaagcagtcactacctgtggcgagggccggccgcaaccaggtctggagcaaatcaaactccccggcaaccctccggtcacactcatccaccagcatccagcctgcgtagccgcccatcactgcaaccaggtggagaccgagagtgtgggggacgtgacgtaccctgctcatcgagactgctatctgggcgacctgtgtaactctgcggttgccagccatgttgcaccggcagggattttggctgccgccgcaaccgcactcacatgcctcctgcccggactgtggtcagggtag

SEQ ID NO: 122799 - DNA, 402 bp, Artificial Sequence
  Description of Artificial Sequence: Synthetic coding sequence
atgaagccccaatttgtaggcattctactgagctccttactcggcgctgcactaggcaatcgtatgagatgttacaattgtggaggaagcccatcctcaagctgcaaggaagccgtcaccacgtgcggggaaggaaggccgcagcctgggctagaacagatcaaactccccggaaacccacctgtgactctgatccatcagcaccctgcctgtgtggctgcacatcactgtaaccaggtggaaacggagtcagtgggcgatgtgacataccctgctcatcgggactgctacctcggtgacctgtgtaacagtgccgttgcgagccatgttgcacctgccggcattctcgcagccgccgctacagccttgacttgtctgctgccaggcctatggtcaggctag

SEQ ID NO: 122800 - DNA, 402 bp, Artificial Sequence
  Description of Artificial Sequence: Synthetic coding sequence
atgaagccacagttcgtcggtattctgctttcgtctctcttgggcgcagccctcggcaatcgaatgcgctgctataactgtgggggcagcccgtcttcatcatgtaaggaagcagtaacaacttgtggcgaaggcaggccccaaccagggctggagcaaatcaagctgccaggcaaccccccagttaccctgatccatcagcatccagcttgtgtggctgcacatcattgcaaccaggtggagactgagtctgtgggagacgttacataccctgcccatagggattgttacctgggcgatctctgcaattcagccgtcgctagtcatgtagcccccgccggcattctcgccgccgccgctactgctctgacttgtctgctgcccggactgtggtccggatag

SEQ ID NO: 122801 - DNA, 525 bp, Artificial Sequence
  Description of Artificial Sequence: Synthetic coding sequence
atgaaaccgcaattcgtgggaatccttctgtccagcttgctgggagcggcgcttgggaaccggatgaggtgttataactgcggtggcagcccttcgtcctcctgcaaggaggccgtgacgacgtgtggtgagggtagaccccagccagggctcgagcagatcaaactgcccggaaatcgacgttgttttctccgcggcctgaagatcccattagggtctctgaaatcacatctcttatgtccaaggagacaggtgctcaagcccggcgtgcagcacccctcgttcatcctgtccctgagccccagtgacctcgatagcccgacaagctcgctgaggcgctccccttctcttcagtctagtggcgatcgggtgggcggacggagggatctgtccagtcctcagggtctgctgcccggtagacctgtccagcagcgacgcggtaagccctgcggcccctgcagacactttggttgttcatcctacaggccggatctgagtctggcaagaacagtagaacggatttag

SEQ ID NO: 122802 - DNA, 486 bp, Artificial Sequence
  Description of Artificial Sequence: Synthetic coding sequence
atgctggcaccccaacgaacgagagccccatctcctagggccgctcctaggccaaccagatctatgctgccggcagccatgaaaggtctgggcctggctttgttagccgtgctcctatgttccgctcccgcgcacggactctggtgccaggattgtacccttacaactaactctagccattgcacccccaaacagtgccaacccagtgacactgtctgcgccagtgtgcggatcaccgatccgagttcttccagaaaggaccactcagtaaataagatgtgtgcctcctcatgcgacttcgttaagcgccattttttttctgattatctcatgggcttcatcaattcaggtatattgaaggtagacgtggattgctgcgagaaagacctgtgcaacggcgccgccggggctggtcactctccgtgggctcttgcaggaggcctactgctctctttggggcctgctctgctctgggctggtccctag

SEQ ID NO: 122803 - DNA, 486 bp, Artificial Sequence
  Description of Artificial Sequence: Synthetic coding sequence
atgctggccccccagaggacacgcgccccctcaccacgggcagcccctaggccaaccagatctatgctcccagcggcaatgaagggcctgggcctagccctgcttgctgttcttctttgcagcgccccagcacatggactttggtgtcaggactgtaccctgacaactaactcatcccactgtactcccaagcagtgtcagccaagtgatacagtgtgtgccagcgtgcgtatcacagaccccagttcttctcgtaaggatcactctgtcaacaaaatgtgcgccagtagctgtgatttcgttaaacgtcatttcttctctgactacctgatggggtttatcaactcaggaattctgaaagttgacgtggactgttgcgaaaaagacttatgtaacggggctgcgggggcgggacactccccctgggccctcgctggagggttgctgctgtcccttgggcccgccctgctgtgggccgggccttag

SEQ ID NO: 122804 - DNA, 423 bp, Artificial Sequence
  Description of Artificial Sequence: Synthetic coding sequence
atgttgccagccgccatgaaaggcctaggcctggcattgttagccgttcttctgtgctctgcacctgcacacggcctctggtgccaggattgcaccttgactacaaattccagccattgcactcctaagcagtgtcagccgagcgacacagtgtgcgcatcggtccgtattactgatccctcctcttcaagaaaagatcattccgtgaacaagatgtgcgcgtcctcctgcgattttgtcaagagacacttcttttccgactacctgatgggatttataaactctggcattctaaaagtggatgtcgattgctgtgaaaaggacctatgtaatggggccgcgggcgccggacactcgccttgggctttggcaggcggacttcttctctcactaggccccgcgcttctgtgggctggcccctag

SEQ ID NO: 122805 - DNA, 1971 bp, Artificial Sequence
  Description of Artificial Sequence: Synthetic coding sequence
atggtagccccgaagtctcatactgacgactgggctccaggtcctttttcttccaaaccccaacggagccagttacagatatttagttctgtgttacagacatctcttctcttcctacttatgggactgagagcaagcggcaaagacagtgcaccaactgtggtatcgggcattctcggcggatctgtaacactacccctgaacatctcagttgatactgagatcgaaaatgtgatatggatcggtcccaagaatgccttggcatttgccagacccaaggaaaatgtcaccattatggtcaagagctacttaggccgcctggatatcaccaagtggagctacagcttgtgcatatctaacctgactttgaacgacgccggtagctataaagcccagattaaccagcgtaatttcgaagtgaccacagaagaggaatttacactgttcgtctacgaacaattgcaagagcctcaggttaccatgaagtcggtcaaagtaagcgagaactttagttgcaacattaccctgatgtgcagcgtgaagggagcagagaaatctgtgctgtactcttggacccctcgcgagccacacgcctccgaaagtaacgggggctccatccttacagtgagtaggactccctgtgatcctgatttgccctacatatgtactgcacagaatccagtgtcacaacgaagcagcctgccggtccacgttggccagttctgcacagatcccggcgcctcaaggggtgggactaccggggaaaccgtggtcggagtcttaggagagcccgtgactcttccgctcgctctgccagcctgccgggacacagaaaaagtggtgtggttatttaatacatctatcatttccaaggagcgggaagaagccgctaccgccgatccactgattaagagccgtgatccttacaaaaatagagtttgggtgtccagccaggactgttctctaaaaatcagccagctgaagatcgaggatgcaggaccttaccatgcatacgtctgtagcgaagcttctagcgtaaccagcatgacccatgtaacattgctcatctatcgacgcctccggaaacctaagattacttggtccctgcgtcattcagaggacggaatctgccgcatctccctcacctgctccgtggaggatggaggtaatacagttatgtacacgtggacccccctgcagaaagaggcagttgtgtcacagggggaaagtcacttgaacgtgtcttggaggtcttcagagaaccaccctaatctcacttgtactgctagcaaccccgtaagcagaagctcccatcagtttcttagcgagaatatatgttctggaccagaaaggaacactaagttgtggataggactgttcttaatggtgtgccttctgtgtgtcggaatcttctcttggtgcatctggaaacgtaaggggcggtgctcagtgcctgccttttgctcaagtcaggccgaggcacctgccgatacacccgagccaaccgcaggccacaccctttatagcgtcctgagccagggttatgagaaattggacacccctctccgaccagccaggcagcagcctaccccgacctcagactcatctagcgatagcaatctcaccactgaggaagatgaggataggccggaagtgcacaaacccatctctggtaggtacgaggtgttcgaccaggtgactcaggaaggagccggacacgaccccgctcctgagggacaggctgattatgacccagtgaccccttacgtgaccgaggttgaaagcgtcgtcggtgaaaatacaatgtatgcgcaggtttttaatttgcagggaaagacccctgttagtcagaaggaggaaagcagcgcgacaatttattgttctatccgcaagcctcaagtagtcgtgcccccaccgcaacaaaacgacctggaaatccccgaatcacctacatacgaaaactttacctag

SEQ ID NO: 122806 - DNA, 1566 bp, Artificial Sequence
  Description of Artificial Sequence: Synthetic coding sequence
atggtcgcccccaaaagtcacaccgacgattgggcacccggtcctttcagttcaaaaccccagaggagccaactccagatcttcagttcagtcctccagacaagtctactgtttctgttgatgggtttacgagcatcaggaaaggacagtgcacctaccgtcgttagtgggattttaggcgggtctgtaacattacctctgaacatctccgtggacacggaaatcgagaacgtgatctggatcgggccaaagaacgctctggcctttgctcggcctaaggaaaacgtgaccattatggttaagtcttacttaggccgactggacatcacaaagtggtcctacagcttgtgcatctccaacttgacactgaatgatgctgggtcgtataaagcccagatcaatcagcgaaacttcgaggtgacgacggaggaggagtttaccctgttcgtctatgaacagctgcaggagcctcaggtgaccatgaaaagtgtgaaggtgagcgaaaacttcagctgtaacatcacactgatgtgttcggttaaaggtgctgaaaagagcgtcctctattcctggacgcctagggagccacacgcgtccgaatcaaacggcggatcaatcctgactgtgtcccggaccccctgtgatccggacctcccctacatctgcactgcacaaaaccccgtctcccagcgctcgtcccttccagtgcacgtgggccaattctgcaccgaccccggcgcatctcgtggagggactactggggagaccgtagttggtgtcttgggggaacccgttactctcccactggccttgccggcctgtcgagataccgaaaaggtggtttggttatttaacacatcgattatatccaaggagcgtgaggaggcggctaccgccgatccgctgatcaaatctcgcgacccctacaagaaccgggtgtgggtcagctcccaggactgctccctgaagatttcccagctgaaaatcgaagatgcggggccttatcatgcctacgtttgctccgaggcttcaagcgtgacaagcatgacacatgtcacgctattgatatacaggcctgagcgaaacaccaagctttggattgggctttttttgatggtctgccttctgtgtgtgggaattttttcatggtgcatatggaagagaaaagggcgctgtagcgttccagctttttgctctagtcaagcagaagctcccgcagatacacccggctatgaaaaactagacacacctctgaggaaacctattagtgggcgctatgaagtcttcgatcaagtgacgcaggaaggcgccggacatgatccggctccggagggccaggctgattatgatcccgtcactccatacgtgactgaggtagaatctgtcgtaggcgagaataccatgtacgcgcaggtcttcaatctgcaggggaagactcctgtaagtcagaaggaagagtcatccgcaacaatttactgtagcatcagaaaacctcaggtggttccccccccccagcaaaatgacctggaaatacccgagagtcctacatacgaaaacttcacatag

SEQ ID NO: 122807 - DNA, 813 bp, Artificial Sequence
  Description of Artificial Sequence: Synthetic coding sequence
atgacccacgtgacacttctgatttatagaaggctcagaaaaccaaagatcacttggagtctgcggcacagtgaagatgggatttgtcggatttcacttacctgttccgttgaggatgggggaaatactgtgatgtatacatggaccccgctgcagaaagaagctgtggtgtcccagggcgagtctcacctaaacgttagttggcggtcttcagaaaatcaccctaacttgacttgtaccgcctcgaacccggtcagtcggtccagccaccagtttctgtcagaaaatatttgctcaggtccagagcgaaacacaaagctctggatcggccttttcctgatggtttgtttactttgtgttggtatatttagctggtgtatttggaaacggaaagggcgctgctctgttcctgccttctgcagcagtcaagctgaggcaccggccgacactcccgggtatgaaaagctggacactccccttcggcctgcccgccagcagcccacccccacttctgacagctcgtcagacagcaatctcacaaccgaagaagacgaagatcgcccagaggtccataagcccatttctgggcgatatgaagttttcgaccaggtgacccaggagggcgctgggcacgatccagcccctgagggtcaggcggactacgacccagtcacaccatacgtgactgaagtggagtccgtcgtaggcgaaaacaccatgtacgcacaggtgttcaatcttcaggttgtgcccccaccccagcagaacgatcttgagattcccgaatctcctacttatgaaaattttacatag

SEQ ID NO: 122808 - DNA, 813 bp, Artificial Sequence
  Description of Artificial Sequence: Synthetic coding sequence
atgacccatgtgacgctcttgatttacagaagattgagaaaaccaaaaatcacctggagccttcgccactctgaggatgggatttgccgaatatctctaacttgcagtgttgaggatgggggcaacacggttatgtacacctggactcccctgcagaaggaagctgttgtgagccagggcgagtcccatcttaacgtctcatggcgcagtagcgaaaatcatccaaacctgacatgtaccgccagcaaccccgttagccggagctctcatcagtttctctctgaaaacatctgctccggtccagaacgtaacactaaattgtggattggcttatttctcatggtttgtctcttgtgcgtgggcatcttttcttggtgcatttggaagcgcaagggtcgatgctcagtgcctgccttctgctctagtcaggctgaagcccccgctgacactcccggatacgaaaagctggacacacccctccgacctgcacggcagcagcccactcccacaagcgattcctccagtgatagtaatctcacgacagaagaagacgaagaccgccctgaggttcacaaaccaatttccggaaggtatgaggtttttgaccaggtgacccaggaaggcgcaggccacgacccagcaccagagggccaagctgactatgaccctgtcacaccctacgtcactgaggtggaatcggtagtaggggagaatacaatgtacgcccaggtgttcaacctacaggtggtgcccccaccgcaacagaatgacctcgagatccccgagagccccacctatgagaattttacttag

SEQ ID NO: 122809 - DNA, 1968 bp, Artificial Sequence
  Description of Artificial Sequence: Synthetic coding sequence
atggtggcgcctaagagtcacaccgacgattgggcccctgggcctttttctagtaaacctcaacggagccagctgcagatatttagctctgttctccagacaagtttgctgttcctgctaatggggctccgcgcgtctggcaaggattccgcaccaaccgtggtgtccgggatcctgggtggcagcgtaacacttcccctgaatattagcgtagatacagagatagagaatgtaatatggatcggaccgaaaaacgctctagccttcgcgcggcctaaggagaacgtgacgataatggttaaaagctatctggggcgccttgacattaccaagtggagttacagtttgtgcatctctaatctcacccttaatgatgccgggtcttacaaggcccagattaaccagcggaattttgaagtgaccacagaagaggaattcacacttttcgtgtacgagcaactgcaggaaccccaggttacaatgaaatcggtgaaagtgtccgagaacttctcttgcaatatcacactgatgtgtagcgtcaagggcgccgaaaaatcagtgctgtactcatggacaccccgcgagccgcacgcatctgagtccaatggcggctccatactgacggtgtcgcggactccttgcgatcccgatcttccgtatatttgtacagcacagaatcctgtctcccaaagatcttctcttcccgtgcacgtgggacagttctgcacagatcccggcgcctctcgtggcgggacaactggtgaaactgtggttggtgtgctaggagaaccagtgaccctcccgctggccctccccgcatgccgcgacacagagaaggtcgtgtggctgtttaatacaagcattatctccaaggaacgagaagaagccgccacagcagaccctctcataaagtcaagggacccgtacaaaaatcgggtgtgggtgtcaagccaagactgctctctgaaaatatcccagctgaaaatagaggacgccggcccttaccatgcctacgtgtgttccgaagcctcatctgtgacaagcatgacacatgtgactctgctgatctatcgtagacttagaaaaccgaagataacctggagcctgcgacactcagaagacggcatctgcaggatctcactcacatgctctgtggaagatggaggaaacacagtgatgtacacctggactccactgcagaaagaagcagtggtgagccagggcgaatctcacctcaacgtgtcctggagatcatcggagaaccatcctaacctgacctgcaccgccagcaaccctgtgtcaaggtcctcacatcagtttttgtccgagaacatttgcagcggtcccgagcgtaacaccaaattgtggattggtctgtttcttatggtttgtctcctgtgtgtgggcatattcagttggtgcatctggaagcggaaggggaggtgtagcgtgccagcattctgcagtagtcaagccgaggctccagcagatactcctgagcctacggctgggcatacattgtactccgtactcagccaaggatacgagaaactcgatacacctctccgtccggcacggcagcagccaacccctaccagcgactcgagctctgattcaaacctcaccacagaagaagatgaagacagacctgaggtgcacaagccgatctccggcagatacgaggtgtttgaccaggtgacccaagaaggtgccggccatgaccctgcccctgagggccaggctgattacgacccggtgactccatacgtcaccgaagtagaatcggtggtgggtgaaaatacgatgtatgcacaagtgtttaaccttcagggcaaaactccagtctcccagaaagaagaatcttcagccaccatctactgttccatcagaaagcctcaggtcgtgccaccaccacagcaaaatgatctggaaatccccgaatctcccacttacgaaaattttacatag

SEQ ID NO: 122810 - DNA, 1116 bp, Artificial Sequence
  Description of Artificial Sequence: Synthetic coding sequence
atggtcgcaccaaagtctcacactgacgactgggcaccaggcccatttagctctaaaccacaacgcagtcagttgcaaatcttttcctccgttcttcagaccagtttactgtttctcctaatgggacttcgggcaagcggcaaagattccgcacccacagttgttagtgggattcttggcggctcagtgaccctgcccctgaacatctcagtcgatacggaaatcgaaaatgtcatttggattgggcctaaaaatgccttagccttcgccagaccaaaggaaaacgtcacaatcatggtgaagagctacctcggtaggctggatataacaaagtggtcttactccctttgcatctctaacctgacactgaatgatgcaggctcgtacaaagctcagattaaccagcggaatttcgaggtgacaacagaagaagagttcacactgtttgtgtacgaacagctccaagagccacaagtgaccatgaagtctgtgaaggtgagtgaaaatttctcttgtaacataacgctcatgtgcagcgtcaagggggccgagaagtcagtgctgtatagttggaccccacgagaaccacatgcgtctgaatcgaatggtggcagtatactgacggtgagccggacaccttgtgaccccgacctcccctatatatgtacagctcaaaaccccgttagtcagcgaagcagtcttcctgtccacgtcggacagttttgcacagaccctggtgcctcacggggcggcactactggtgagaccgtggtgggcgtgctcggggagcctgtgacgctgcccctggccctccctgcatgtagggatactgagaaggttgtgtggctgtttaacacttctatcatcagtaaggaacgagaggaggccgctactgcagaccctcttataaaaagtagagacccgtataagaatcgggtatgggtttccagccaggactgctccctgaaaatctcccagctgaaaatagaggatgctggcccatatcatgcctatgtctgctcagaggccagtagtgtcaccagtatgacacacgttactctcttaatatacagagagtctttggggagagcccccataacaagatttctgctttag

SEQ ID NO: 122811 - DNA, 1809 bp, Artificial Sequence
  Description of Artificial Sequence: Synthetic coding sequence
atgggcctgagagccagcggcaaggattccgcacccaccgtggtgagcggaatcctggggggctctgtcacgctgccactcaacattagcgtcgatacagagattgagaacgtgatctggataggtccaaagaatgctttagcctttgcgcgacccaaggaaaatgtgaccataatggtaaagagctatctcggcaggcttgatattacaaaatggtcatacagtttgtgtataagtaacttgacacttaacgacgcgggaagctacaaggcccagatcaatcagcgtaactttgaggtcaccactgaagaggaattcacacttttcgtttacgagcagctccaggaacctcaggtgaccatgaaatctgtgaaggtctctgaaaacttttcctgtaacattactttaatgtgtagtgtgaagggtgcagaaaagtcagttctttatagctggaccccacgcgagccacacgcctcagaatcaaacgggggcagtatccttaccgtatcacggacaccttgcgaccccgatctgccctatatttgtactgcccaaaatcctgtaagccagcgttccagcttgcctgtccacgtgggtcagttctgtacagatccaggagctagcagagggggtactacgggagaaactgtggtgggcgtgctaggagagcctgtcacccttcctttggcattgcccgcttgtagggacacagagaaggtggtctggttgttcaacacatcaattattagcaaagagcgggaggaggcagctacggccgatcccctcattaaatcaagagatccttacaagaacagagtctgggtatcctcccaggattgctctctgaaaatcagtcagctgaagattgaggatgctgggccgtaccacgcttacgtatgttcggaagctagctctgttactagtatgacgcatgtgaccctcctcatttataggagacttagaaagccaaagattacgtggtcactcaggcacagtgaggacgggatttgccgtattagcctgacctgtagcgtcgaagacggtggcaatacagtaatgtatacatggacaccattacagaaggaggccgttgtgtcccagggggaaagccatctcaatgtgtcttggagaagttctgagaatcatccaaacttaacctgcaccgctagcaatcccgtgagccgcagcagccaccaattcctcagcgagaatatctgctccggacctgaacggaacacaaaattgtggatcggcctgttccttatggtgtgcctcctgtgtgtcgggatattcagttggtgcatctggaaacgcaagggacgttgttctgttcccgccttctgctcctcacaggccgaagcccctgccgacacacccggctatgagaagcttgatacccctcttcggccagcccgccagcagcctacacccacctcggatagctcgtctgacagcaacctgaccacagaggaagacgaagatcgccctgaggtgcataaacctatttctgggagatacgaagtcttcgatcaggttacccaggagggggcaggccacgaccccgcccccgaaggccaggccgactacgatcctgtgactccatatgtgacagaggtcgagagcgtcgttggcgaaaacactatgtatgcccaggtgttcaacctccaggggaaaacccctgtgtcacagaaggaggagtcttcagctaccatctattgttccattaggaaaccgcaggtcgtggtcccccctccccaacagaacgacctggagatcccagagtcccccacatacgaaaactttacctag

SEQ ID NO: 122812 - DNA, 582 bp, Artificial Sequence
  Description of Artificial Sequence: Synthetic coding sequence
atggtagcgcccaaatcacacaccgatgactgggcaccaggtcccttctcttctaaaccccagaggagtcaactacaaatcttttcctccgtgctgcaaacctcattgttgttcctgctgatgggcctccgtgcttctgggaaggactccgcgcctaccgtcgtgtccggcattcttgggggatccgtcactctcccgctgaatatatctgtcgatactgagattgaaaatgttatctggattggacccaagaacgctctcgcttttgcccgccccaaagaaaatgtgacgatcatggtgaagagctatttggggcggctagacatcactaaatggtcatactccttgtgtatttcaaacctgacactgaacgatgccggtagttacaaggcccagatcaatcagaggaatttcgaggtgacaacagaagaggaatttacactgttcgtgtatgcaccatttatagaaaaattgagcgtacacgtgatcgagggagatcatcggaccctgttggaaggatctggcctggaatcgataatctctacgctggctgaaccacgcgtgtctgtaagggaggggtag

SEQ ID NO: 122813 - DNA, 1581 bp, Artificial Sequence
  Description of Artificial Sequence: Synthetic coding sequence
atggggttgagggccagcgggaaagatagtgctccaacagtggtgtctggtatcctaggcggatcagttacactgcccctgaacattagcgttgatacagagattgaaaacgttatctggataggacccaaaaacgccctcgcctttgcgcggcccaaggagaacgtgacaatcatggtgaaatcctatttgggcagactcgatattactaaatggtcttactccctgtgcataagcaatcttacgttgaacgatgctggctcttacaaggcccaaatcaatcagcgtaactttgaggtgactaccgaagaagagtttacacttttcgtctatgagcagctgcaggaaccccaggtcacaatgaaaagtgttaaagtgtcggaaaacttttcctgcaacataacacttatgtgctccgtcaagggagcggagaaatctgtcctctactcgtggaccccccgagaaccacacgcctcagagtcgaatggaggatctatacttactgtcagcaggacaccatgcgacccggacctgccttatatctgcacagctcagaaccccgtgagccagcgcagttcactgccggtccacgtgggacaattctgcacagatccgggcgcaagcaggggagggactaccggggagaccgtggtgggcgtgctcggggagccagtgacccttcccttggcgctgcctgcttgcagggacaccgaaaaagtggtttggttgttcaatacaagtataatcagtaaagaaagagaagaggccgccaccgctgatccactgattaaaagcagggatccctataagaatcgcgtctgggtgtcttcccaggattgttcactcaagatttctcagctgaaaattgaggacgccggaccgtatcacgcctacgtttgcagtgaagcgtcctccgttacaagtatgacacacgttactctgctcatttatcgcccggagaggaatacgaaactgtggatcggcctcttccttatggtctgtctgctgtgtgtaggaattttctcctggtgcatctggaagaggaagggaaggtgttctgtgccagctttctgctccagccaggcggaggcacctgctgatacacctgagcccacggcgggacacactctctatagcgttctatcccaaggctatgaaaaactggatacgcctttgcgcccagctcggcagcagcctacccccacatcagacagtagttccgatagtaatctgacaaccgaagaagatgaagatcgaccggaggtgcacaagcctatatcaggccggtacgaggtctttgatcaggtcacccaagagggagccggccatgacccagcacctgagggccaagccgattacgaccccgtaaccccttacgtgactgaagtggaaagcgttgtgggcgaaaacaccatgtacgcgcaggtattcaatttgcagggaaagactcctgtgtctcagaaagaggagtcctcagcaaccatttactgctctattcggaaaccccaggttgtagtgccaccaccgcagcagaacgacttggaaattcccgagagcccaacgtacgagaattttacatag

SEQ ID NO: 122814 - DNA, 1884 bp, Artificial Sequence
  Description of Artificial Sequence: Synthetic coding sequence
atggcgagagggtcagtgtctgatgaagaaatgatggagcttcgagaggcattcgctaaagtagataccgacggtaacggctacattagcttcaacgaactgaacgatctctttaaagctgcatgtctcccattgccaggttacagggtccgcgagattacggaaaatctaatggccacaggagatctggaccaggatggaagaatcagcttcgatgagtttatcaagatctttcatgggctgaaatctaccgatgttgctaaaactttccggaaagccattaataaaaaggaaggtatatgtgccatcgggggtaccagtgagcagtcaagtgtcggaacacagcattcttatagcgaagaggagaaatacgcatttgtgaattggataaacaaagcactggagaacgaccccgattgtcggcacgttatccccatgaaccctaatactaatgacctgttcaatgccgtgggcgatggaatagtgctgtgtaagatgatcaacctgagtgtcccagataccatcgacgaaagaacaattaacaagaaaaaacttaccccttttactatacaggaaaatctgaacctcgcactaaactctgcctccgctattggatgtcacgtagtaaacataggagccgaggatcttaaagaaggcaagccctatctagtccttgggctcctgtggcaggtgattaagatcggcttattcgccgatatcgaactgtcaaggaatgaagcactcattgccctgctgcgagaaggcgaatcacttgaagaccttatgaaactttcccccgaggagctccttcttagatgggctaactaccatctggagaacgcaggctgtaacaagataggaaatttttcaaccgacattaaggacagtaaggcctattaccacctactcgaacaggtggcaccaaagggcgacgaggaaggtgtgcctgccgttgtaattgacatgtctggacttcgagagaaggacgacatacagagggccgagtgtatgctacagcaggctgaacggctcggatgccggcagttcgtgactgccaccgacgtagttagaggcaaccctaaactgaatctggcgttcatcgcaaatttatttaatcgataccccgccctccataaaccagagaaccaggacattgactggggggccttggagggggaaacccgcgaagagcgcacattcagaaattggatgaatagcctgggcgtgaacccacgcgtgaaccatctgtattctgatctttctgatgcattagttatcttccaattgtatgagaagatcaaagtcccggtggactggaatcgggtgaataagcccccctatcccaagctgggaggaaacatgaagaaactcgaaaactgcaactatgctgtggaactaggaaagaaccaagcaaagttcagtcttgtcggaatcggaggccaggatttgaacgagggtaatcgaaccctgacactcgcgctgatatggcaactgatgcgaagatacacactcaatatccttgaagagatcgggggcgggcagaaggtaaacgacgatatcatagtgaactgggtgaatgaaactctcagagaggctaaaaaatcttcttctattagtagtttcaaggaccctaaaatctccacgtcgctccctgtactcgaccttatcgacgcaatccagcctggttctataaactacgacctactcaagacagagaacctgaatgacgatgagaaacttaacaatgccaaatatgcgatctcaatggctcggaaaataggagctcgtgtgtatgccttaccggaagacctggtagaggtgaaccccaagatggtcatgaccgtgttcgcttgcttgatgggaaaaggaatgaagcgggtgtag

SEQ ID NO: 122815 - DNA, 1884 bp, Artificial Sequence
  Description of Artificial Sequence: Synthetic coding sequence
atggctcgaggttccgtatctgacgaagaaatgatggaacttagagaagcgttcgccaaagtggatacggatggaaacggatacatatcttttaatgaactgaatgacctatttaaagccgcctgcctgccgcttcccggctaccgggttagagaaattactgaaaacctaatggccacaggcgaccttgaccaggatggccgcataagctttgacgagtttatcaaaatattccatggcttaaagagtacagatgtggcgaagactttccgcaaggcaattaacaaaaaagagggaatttgcgctatcggcggaacatctgaacaatcatccgtgggtacacagcattcctattccgaagaggagaaatacgcttttgttaattggatcaataaagccttggagaatgaccccgattgcaggcacgtaattcccatgaacccaaacacaaatgacttattcaacgctgtcggcgacggcattgttctgtgtaaaatgatcaatcttagtgtccccgatactatcgacgaaaggacaattaataaaaagaaactcactccctttactatccaggagaatctgaacctagctttaaatagcgcgtctgctatcggatgtcacgtagtaaacatcggggcggaagacttgaaagagggaaaaccgtatcttgtgctgggactgctgtggcaggtgatcaaaataggtctgttcgcagatattgagttgtccagaaatgaggcgctgattgcactgctgagagagggggaaagcctcgaggatctcatgaagttgtctccggaggagctcctgctgcggtgggcaaattaccatctggagaatgctggatgtaataagattggaaatttcagtacggacattaaggatagcaaagcgtattaccacctactcgaacaagtcgctccgaaaggggacgaggagggagtgccagccgtcgttatcgatatgagtggccttagagaaaaggacgatattcaaagggccgaatgtatgctgcagcaggcagaacgcttgggatgtaggcaattcgtgactgccaccgatgtggtgaggggcaaccccaaactcaacctggcctttatcgcgaacctgttcaacaggtacccagccctacataagcctgagaatcaagatattgattggggtgccctagaaggggagacccgtgaagaacgaacgtttaggaactggatgaacagcctgggcgttaacccaagagtgaatcatctgtactccgatctgtctgacgcgctggttatcttccagctctatgagaagatcaaagtcccggtagattggaatcgggtcaacaagcccccctatcccaagttgggagggaacatgaaaaagttggagaactgtaattacgccgttgaactgggcaaaaatcaggctaagttcagcctggtcgggatcggcggccaagacctgaacgaagggaatcggactctcaccttagcccttatctggcagcttatgaggagatatactctcaacattctggaagagattggtggcggccagaaggtgaatgatgacattatcgtcaactgggtcaatgagacattgagagaggccaaaaagagctcgagtatcagctcttttaaagacccgaaaatctctacaagtctgccagtgctggaccttattgacgcaatacaacccggctccattaactacgacctgcttaagacggagaacctgaacgacgacgaaaaacttaataacgcaaaatatgctataagcatggctcgcaagattggcgcaagagtgtatgcgcttccagaggatctcgtcgaagttaatccgaagatggtgatgacagtgtttgcctgcctgatgggtaaggggatgaaacgagtttag

SEQ ID NO: 122816 - DNA, 741 bp, Artificial Sequence
  Description of Artificial Sequence: Synthetic coding sequence
atggcccgcggctctgtgtcggacgaggagatgatggagttgagggaagccttcgctaaggtggacacagacggaaacggatacatctccttcaatgagttgaacgacctattcaaggctgcctgtctcccccttcccggttaccgcgtccgcgagattacagagaacctgatggcaacaggagatctggatcaggacgggcgcatctctttcgatgagttcattaagattttccacggcttgaagagcacagacgttgctaagacctttagaaaggccattaacaaaaaggaaggaatctgcgctatcggaggcacgtctgaacaatcatccgtgggcacccagcatagctatagcgaggaggaaaagtacgcatttgtgaactggatcaacaaagctctcgaaaatgatccagattgtcgacacgtgatccctatgaatcctaatacgaatgatctgtttaacgcggtcggcgatggcatagttctgtgtaagatgatcaatctgagcgtcccggataccattgatgagaggacaattaataaaaaaaagctcacaccgttcactatccaggagaacctgaatctcgccctgaattctgctagcgccattggatgccacgtcgtgaatatcggggccgaagatctgaaagaggggaaaccttatctggtccttggactactgtggcaagttattaagattggactcttcgccgacattgaactgtctaggaatgagtag

SEQ ID NO: 122817 - DNA, 591 bp, Artificial Sequence
  Description of Artificial Sequence: Synthetic coding sequence
atgtgtgctgaagacggggatagtaagttctcaatgagtatttcgatgaactctcccttcctcgagattctacatctggagaattgcaattatgcagtcgaactgggcaagaaccaggccaagtttagccttgttggtattggcggccaagacctcaatgaaggcaatcggacgttaactctggcactaatctggcaacttatgaggcgctacacactcaatatcctggaggagataggaggcgggcagaaggtgaacgacgatataatcgtgaactgggtgaacgagactctccgcgaagccaaaaagagcagctccataagcagtttcaaggaccctaaaatctctactagtctccccgtgctggatctcatcgacgccatccagccgggatccatcaactatgatctgttgaaaactgaaaatctgaatgatgatgagaaactgaataacgcaaaatatgcaatcagcatggccagaaagattggcgctagggtgtacgctctacctgaagacttggtggaggtgaaccccaagatggtgatgacagtattcgcatgtctgatgggcaagggcatgaaacgggtgtag

SEQ ID NO: 122818 - DNA, 201 bp, Artificial Sequence
  Description of Artificial Sequence: Synthetic coding sequence
atggccagaggctccgtaagcgacgaagaaatgatggagctgagagaggccttcgcgaaggtagacactgatggcaacggctatatcagcttcaacgaactcaatgacctcttcaaggccgcatgtttaccccttcctggctatcgggtcagggagataactgagaacctgatggccacgggggatttggatcaagactag

SEQ ID NO: 122819 - DNA, 1602 bp, Artificial Sequence
  Description of Artificial Sequence: Synthetic coding sequence
atggcacttcgcaatgtaccattcaggtccgaggtcttgggatgggatccagattccctagccgattactttaagaagctgaactacaaagactgtgagaaggccgtgaagaagtatcacattgatggtgccaggtttctgaacctgacagaaaatgatatccagaagtttccaaaactgcgtgtgcctatactcagtaagctcagccaggagatcaacaaaaatgaagagcgtaggagcatttttacaaggaaaccccaggtgccccgttttccagaagagacagagtcccatgaagaggataacggcggttggtctagcttcgaggaggatgattatgagtctcccaatgacgaccaagacggcgaggacgacggggactacgagtctccaaacgaggaagaagaagcgcccgtggaagatgatgccgattacgagccaccgccgtcaaacgacgaagaggcgcttcagaattctatcctgcctgctaaaccgttcccaaatagcaactctatgtacatcgatagacccccctccggtaaaacgcctcagcagccccccgtgcctccacagcgcccgatggcggctctgcctcccccccccgctggacggaaccacagcccgctgcctcctccacagaccaatcacgaagagccctcccggagccgaaaccataagacagctaagctcccggccccctccattgacagaagtacaaaaccaccattggatcgctccttggctcccttcgaccgggaaccttttaccctcgggaagaagcccccgttctctgacaagcccagcattcccgcaggtcgttccttaggagagcacctgccaaaaattcagaagcctcctctgcctcctacaacagaaagacacgagaggagcagtcccctccctggcaagaagcccccagtgcccaaacacggatggggcccggatagaagggaaaacgacgaggatgatgtacaccagcgccctcttccgcagccagccctcctccccatgtcaagtaatactttcccgagtcgcagtactaaaccttctcctatgaatcctctgccaagctcacatatgccaggtgcctttagcgagagtaactcatcttttccacaaagcgcaagcctgccaccttacttctcacaggggccgtcaaatcgaccccccattagagctgaaggcaggaactttccattaccactccccaataaacctcgcccgccgagccccgcagaggaagagaacagcctgaacgaagaatggtatgttagctatatcacacggcctgaggctgaagcagccctccgtaaaatcaaccaagatggcacctttttggtaagagattcaagcaagaagacaacaaccaacccttacgtgctcatggtgttatacaaggataaagtttataatatccagatcaggtaccagaaagagagccaagtatatctgctgggaactgggctacggggtaaagaagacttccttagcgtgtctgacattatcgattacttcaggaagatgcctctgctgctgatagatggcaagaatcgaggctccagataccaatgcactttgacccatgcggccgggtatccatag

SEQ ID NO: 122820 - DNA, 1578 bp, Artificial Sequence
  Description of Artificial Sequence: Synthetic coding sequence
atgtgggaagcacaattcctggggctcctgttccttcagccactgtgggtggccccagtgaagccccttcaaccaggagccgaagttcctgtggtatgggcccaggagggggcccctgctcagcttccttgttcaccaacaattcctcttcaggatcttagtctcctgcgacgggcaggcgtgacctggcaacatcagcctgactcaggccctcccgccgctgctccaggtcatccgctggcccctgggcctcacccagctgcaccttcctcctggggtcctcgaccgcgaaggtacactgtgctatcggtcgggccgggcggtctgagatctggtcggcttcctctgcaacctagagtacagctggacgagagagggcgtcagcgtggcgatttttctctgtggttaaggccggctagaagggcagatgctggcgaataccgcgctgcagtccacctcagagatagagcactcagttgtagactcaggttacgacttgggcaggctagcatgactgcctccccccccggtagtctccgggcatctgattgggtcatcctgaattgctcattctctcgcccagataggcccgcttccgtgcactggttccggaacagaggccagggccgggtgccggtacgcgaatctcctcatcaccaccttgccgaaagcttcctctttctccctcaggtgtcgccgatggattcaggcccttggggctgcatcttaacttaccgtgacgggttcaatgtatccatcatgtacaatctgacggtgctgggcctagaacccccaactcctctcacagtgtatgctggtgctggctcgcgagtcggactgccatgcaggctgccggctggagtgggaaccaggagttttctgaccgcaaagtggactccccccgggggtggcccggacctcctcgtaacaggagacaatggcgattttactctcagattggaggacgtgtcccaggcacaggcaggtacctacacatgtcatattcatctgcaggagcagcaattaaatgccacagtcacattggcaatcatcaccgtcacacctaagtccttcggcagcccgggaagtctgggtaagctgctttgcgaggttaccccagtatctggccaggaaagatttgtttggagctctcttgatactccttcccaacgatcttttagcggcccttggctcgaggcccaggaggcacaactgttaagccagccttggcagtgccagctgtaccaaggagaacgcctgctcggcgcagctgtgtactttaccgagttgtctagccccggagctcagcggtcaggcagagctccgggcgccctgcctgctggacacctcctcttattcctgatcctgggggttctctccctgctgttgctggtgactggcgcgtttgggtttcatctttggcgacgccagtggcgcccacgtcgcttctctgcccttgagcaagggatccatccccctcaggcccagtcgaaaatagaggaacttgagcaagagcctgagcccgagccagagcctgaacccgagccagaaccggaacccgaacctgaacaactgtag

SEQ ID NO: 122821 - DNA, 1020 bp, Artificial Sequence
  Description of Artificial Sequence: Synthetic coding sequence
atggccgaagcatccagtgatcctggcgcagaggaaagagaagagttgctcgggcccacggctcagtggtcggtggaagatgaagaagaagctgttcatgaacagtgccaacacgagagggataggcaactccaggcccaagatgaggagggagggggccacgtgcctgaacgtccaaagcaggagatgttgctgtcactgaagccgagcgaggcccccgaactcgatgaagacgagggcttcggcgactggtcacagaggccagagcagaggcaacaacacgagggtgcccaaggagcactggacagtggggagcccccccagtgcagaagtcccgaaggtgaacaggaagaccgaccaggcctgcatgcttacgaaaaggaggattctgacgaggtgcacctggaagagttgagtcttagcaaggaagggcccggccccgaggacacggtgcaggacaacttaggtgcggcaggggccgaggaggagcaggaagagcaccaaaaatgtcagcagcctcgtacccctagccccttagtcctcgagggcacaattgaacagtcatctcccccactgtcaccaacaactaagttgatcgaccgcaccgaatccttaaatcggagtatcgaaaaatccaacagcgttaagaagagccagccggacctaccaattagtaaaatcgatcagtggcttgaacagtacacccaagccatcgaaacagccggtagaaccccgaagctcgcgcgtcaagccagtatagagctcccttccatggccgtcgcatccaccaagtctcggtgggagacaggcgaggttcaggcccagtccgcagccaaaactccatcttgcaaagatatcgtggccggtgacatgtcaaaaaagtccctgtgggagcagaagggaggatctaagacctcctctaccataaagtctacaccttctggaaagagatacaagtttgtggccacaggccatgggaaatatgaaaaagtgctagtcgaaggtgggcctgctccttag

SEQ ID NO: 122822 - DNA, 834 bp, Artificial Sequence
  Description of Artificial Sequence: Synthetic coding sequence
atgctgttgtccctgaagccttctgaggccccagagctggacgaagacgaagggttcggagattggtcacaaagacctgaacaaaggcagcagcatgaaggggctcagggggcgttggacagcggggaaccaccacagtgcaggagtccggagggcgagcaggaagacaggcccggtctgcacgcgtacgagaaggaagactccgatgaggttcaccttgaggagctgagcctttccaaagagggccctggccccgaggacaccgtgcaggataacttgggagctgctggcgcagaggaagagcaagaagaacaccagaaatgtcaacagcccaggaccccatcccccctggttttggagggtaccatcgagcagtcatcacctccactgtcccctacaaccaaactgattgatcgcaccgaaagtctcaaccgctctattgagaagagtaactctgttaaaaagtcacaacctgacctgccgattagcaagattgatcagtggcttgaacaatacacccaggccatcgagaccgctggaagaacccccaagctggcgcgccaggccagtatcgagctgccctccatggctgttgcgtctaccaagtctcgttgggagacgggagaggttcaagcccagtcggccgctaaaaccccttcatgcaaggacatcgtcgcgggagacatgtcaaaaaagtcattgtgggaacaaaaagggggttccaagacatcgagcaccatcaagagtactccttctggtaagaggtataagtttgtggctactggccatgggaaatatgaaaaagtgttagtggagggtggccctgcgccttag

SEQ ID NO: 122823 - DNA, 834 bp, Artificial Sequence
  Description of Artificial Sequence: Synthetic coding sequence
atgctgttgagtctgaaaccaagcgaggcccctgaactggatgaggacgaagggttcggcgattggtcacagaggccagaacaacgccagcagcacgaaggagcccagggagctctggactccggagagccccctcagtgcagaagtcctgagggtgagcaggaagacagacccggcctacatgcctacgaaaaagaggattccgatgaagtccatctggaagaactgtctctctccaaagagggacccgggcccgaggacacagtccaagataatcttggtgccgcaggggcagaggaagagcaggaggagcatcagaagtgtcaacaaccaaggacaccctcgcctctcgtgctggaaggcactattgagcagtcatccccaccactctcccccaccaccaaactgatcgaccgcacagagagcctgaatcggagcattgagaagagtaacagcgtgaagaagtctcagcccgatttgcctatcagtaagatcgatcaatggctggaacagtatacccaagctatcgagaccgctggccggactcccaagctggcccggcaagccagcatcgagctccctagcatggccgtggcatccacgaaatccaggtgggagacaggtgaagtgcaggctcaaagcgccgctaaaactccttcttgtaaggatattgtagccggagacatgagcaaaaaaagcctgtgggaacagaagggtggatcaaagacaagcagtaccattaagagcaccccttcgggcaagcgctataagttcgtcgccaccggacatggtaagtatgaaaaagttctcgtcgaaggggggcctgctccttag

SEQ ID NO: 122824 - DNA, 669 bp, Artificial Sequence
  Description of Artificial Sequence: Synthetic coding sequence
atgctactgagtttgaaaccaagtgaagctccagagctagatgaagatgaaggcttcggggactggagccagcggccagagcagcgtcagcagcatgagggcgcacagggcgccctggactcaggggaaccaccacagtgccgttcacccgagggcgaacaagaggaccggccgggcctgcacgcatatgaaaaagaagattctgacgaagtgcacttggaagagttaagcctttcgaaggagggcccaggcccagaggatactgtgcaagacaatctcggagctgcaggagcggaagaggagcaggaggagcaccagaaatgtcagcagcctcggacccccagccctctggttctggagggcacaattgagcagagcagccctccccttagccccacaactaagctgatcgataggactgaaagcctaaacaggagtatcgagaaatctaatagcgtaaagaagtcgcagcctgacttgcccatcagcaaaatcgatcaatggctggagcagtatacccaggcgatagagacagctggccgaacgcctaaactcgcacggcaggcctcaattgaactcccaagtatggctgtggcgtctacaaagtctcggtgggaaacaggagaagtccaagcgcagtccgctgccaagacaccttcttgtaaatag

SEQ ID NO: 122825 - DNA, 183 bp, Artificial Sequence
  Description of Artificial Sequence: Synthetic coding sequence
atgctgctgagcttaaagccaagtgaagcccccgaacttgatgaagatgaggggtttggggattggtcccagcgtccggaacagaggcagcagcacgagggagctcagggagccctggactctggcgaaccccctcagtgtaggagccctgagggggaacaggaggacaggcccggcttgtag

SEQ ID NO: 122826 - DNA, 669 bp, Artificial Sequence
  Description of Artificial Sequence: Synthetic coding sequence
atgctgctgtccttgaagcctagcgaagctccagagctggatgaggatgagggatttggcgactggagccagcgtcccgagcaaaggcaacaacacgagggggctcaaggagcgctcgatagcggggagcctccacagtgtcgctcaccagaaggcgagcaagaagacagacctgggctgcacgcctatgagaaggaagattccgacgaagtccacctggaggaactcagcctgtccaaagagggtccaggccccgaggacacagtccaggacaatctcggagccgcaggtgcagaggaggaacaggaagaacaccaaaagtgccagcagccccgcaccccttctcctctggtgttggagggtaccatcgagcagtcttctccccccctctcacctacaactaagctgattgaccggacagaatctctcaatagaagcatagaaaagagcaacagcgtaaagaaaagccagcccgatctgcccatatccaaaattgaccagtggctggagcagtacacacaggccatcgaaacggctggcagaacaccgaaactcgccagacaggccagcatcgaacttcccagtatggctgtcgcctctactaagtcaaggtgggaaactggggaggtgcaggcgcagagtgcagccaagacgccctcttgcaaatag

SEQ ID NO: 122827 - DNA, 381 bp, Artificial Sequence
  Description of Artificial Sequence: Synthetic coding sequence
atgctgctcagccttaaacctagcgaagcacccgagctcgacgaagatgaggggttcggcgattggtcccaacgtccagaacagaggcagcaacatgagggggcccagggcgcactggacagtggggaacctccccagtgtcgctcaccggagggcgagcaagaagacaggccgggtctgcatgcctacgaaaaagaggactccgacgaggtccatttggaagaactctcgctgtcgaaagaagggcccggcccggaagacactgtacaagataaccttggcgccgctggcgccgaagaggaacaagaggagcatcagaagtgccagcaacctcgaactcctagccccctggtgctggagggaacaatcgagcaatcgtag

SEQ ID NO: 122828 - DNA, 195 bp, Artificial Sequence
  Description of Artificial Sequence: Synthetic coding sequence
atgctgctgtcactaaagccttcggaggccccagagcttgacgaggacgaaggcttcggagattggagtcagcgcccagaacagcgccagcagcatgaaggcgctcagggcgctctcgatagcggcgagccacctcaatgtcgatccccagagggagaacaggaagataggcctggcctgcacgcttacgaatag

SEQ ID NO: 122829 - DNA, 1404 bp, Artificial Sequence
  Description of Artificial Sequence: Synthetic coding sequence
atggcccctatttggagcccgccaggcagggtttccgggtgtcatctgtcctccggccctgcccctggatctgcagtaggcccctggcttggcacgccccacccatccctgccactgcccctcgcccctcacaaacctcccccccctgggcttcccggatctgccgggcagacctcactgcctgctcaacgggagtgtgtgtttccgggcgacgcagctgttcaccaggagttgtgtggcctaggcttcgaggagtgtctcggctctataccacaggcccatcaatgttacctgaccaatggtcccaagagaaggaagtgcagcccgcggcggcgtgggagagcccccgcttggctttgtggcggtagccccccatgtcaccagggactggggcacgaacacccctccagcggaccatccaccaattgttccccccgtcctactgcccaatggtcagtggaagatgaagaggaggccgttcacgaacagtgtcagcatgagcgagatagacagctccaggcccaggacgaggagggaggtgggcacgtgcccgagaggcccaagcaggagatgctgctcagtcttaaaccatcagaggcccccgaactagacgaagacgaggggtttggagattggagccagcgacccgagcagaggcagcagcacgaaggggcccagggcgcacttgactctggggagccacctcagtgtagaagtccagagggcgaacaagaagacagacctgggctccacgcttacgagaaggaagacagcgatgaggtgcatctggaggagttgagcctgagcaaagaggggcccggcccagaagatactgtgcaggacaatctcggcgccgccggcgccgaggaagagcaagaagagcatcagaagtgccagcaaccacgaacaccatcgccactggttctcgagggcactatcgaacagtctagcccgccactttcccccacgaccaagctcatcgataggactgagagcctgaatcgatctattgagaagtctaatagtgtgaaaaaaagccaacctgatctgcccatttccaagatcgaccaatggctggagcagtacacgcaggcgatcgagaccgccggccggactcctaagctcgccaggcaagcctccatcgagcttccttccatggctgtcgcgagtactaagtccaggtgggagaccggtgaagtccaggcacaatcggcagccaagacccctagttgtaaggacatagtggcaggggatatgtcaaaaaaatctttatgggagcagaaaggcggttcaaagacttcctcaacaatcaaatctaccccaagcggtaagcgatataagtttgttgccaccggacacggaaagtacgagaaggtgctagtcgagggtggacccgcgccatag

SEQ ID NO: 122830 - DNA, 618 bp, Artificial Sequence
  Description of Artificial Sequence: Synthetic coding sequence
atgacgccccccgaacgcttgttcttgccaagagtatgtgggactaccttgcaccttctactgcttgggctgctgctcgtgctcctccccggtgcccagggtttaccaggagtcggattgaccccttctgccgctcagaccgctcgccagcatccaaaaatgcaccttgcacattcaaatctgaagccagcagcccacctcattggtgacccttctaagcagaactctcttctctggcgcgcaaataccgatcgcgccttcctccaggacggtttctccctcagcaacaactcactcctagtccccacttctgggatctacttcgtgtactcccaggtggtgttctcaggtaaggcctattcccccaaggcgacttcctcccccttgtacctcgcacacgaagtgcagcttttttcttctcagtatccttttcacgttcctctactttcgtcccagaagatggtgtacccagggcttcaggagccgtggttgcactccatgtaccatggagccgcattccagctgactcagggggatcagcttagtacacacacagatggcatcccccatctggtgttgtcaccatccactgttttcttcggtgcctttgctctgtag

SEQ ID NO: 122831 - DNA, 618 bp, Artificial Sequence
  Description of Artificial Sequence: Synthetic coding sequence
atgacaccgcccgaacggttattcttgcctagggtttgcgggactacactccacctcctccttctgggactcctgctggtcctactgcccggcgcacaaggcctccccggagttgggttaacgccatctgctgcccagacagcccgtcagcatcctaagatgcacctggctcactctaacctgaagccggccgcacacctaattggggacccatcgaagcagaattccctgctctggcgcgcaaatacggacagagctttcctacaggatgggttttccttgtccaacaatagtttactggtgccgaccagcgggatctatttcgtttactcacaggtggtattctccgggaaggcttactcaccaaaggccacttcatctcccttataccttgctcatgaggttcaactcttttcatcccaatatccgttccatgtgcctctgctgagttcccaaaaaatggtctatccaggtctgcaggagccttggctgcatagtatgtaccatggcgccgcctttcagttgacacagggggatcaactgtcaacccacactgatggcatcccacacctggtactgtcgccatctacggtgtttttcggcgcattcgctttatag

SEQ ID NO: 122832 - DNA, 618 bp, Artificial Sequence
  Description of Artificial Sequence: Synthetic coding sequence
atgacacccccagaacgcctgtttctcccgagggtgtgtggaactactctgcaccttttgcttctggggttgttgctggtcttgttgcccggggcccaggggcttcccggggtcggtcttactccgtcggctgcccaaacagctcgacaacatccaaaaatgcacctcgctcatagcacattaaaaccagccgctcacctcattggagacccaagtaagcaaaactccctgttgtggagggccaacacggacagggctttccttcaagacggcttttcgctgtcgaacaattccctactggtcccaacttccggaatatactttgtctactcacaggtagtcttcagcggcaaagcctacagcccaaaggccaccagctctcctctatacttagcccatgaggttcagcttttctcctcccaatacccattccacgtccctctgttatcttcccagaaaatggtgtatcccggcttgcaggagccctggctgcactctatgtatcatggggcagcctttcagctgacgcaaggagaccagctgtctacacacacagacgggattccgcatttggttttaagtccttctactgttttttttggcgcctttgcgctctag

SEQ ID NO: 122833 - DNA, 618 bp, Artificial Sequence
  Description of Artificial Sequence: Synthetic coding sequence
atgacgcctcctgagagattgtttctgcccagagtttgtgggacgacattgcatttgctgttgctgggactcctgctggtgctcttacctggagcccagggattgcctggagtcggattgacacctagtgccgctcagaccgcaaggcagcatcccaaaatgcacctggcccactccactctaaagcccgcagcccacctgatcggcgatccaagcaaacagaactccctgctctggcgggctaataccgatagagcatttctgcaagatggctttagtctgagtaacaattctctgctggttccaacctcaggaatctactttgtttactctcaagtagtgtttagcggaaaagcttactctcccaaggccacgtcgagccccctgtatctggctcacgaagtgcagctcttctccagtcagtacccattccatgtgccactgctgagcagccagaaaatggtgtacccaggcttacaggaaccttggttgcacagtatgtatcacggtgcagcatttcaattgacacagggagaccagctgagcacacacaccgatggtatccctcatctggtccttagtcccagtacagtgttcttcggtgcttttgccctgtag

SEQ ID NO: 122834 - DNA, 618 bp, Artificial Sequence
  Description of Artificial Sequence: Synthetic coding sequence
atgaccccacctgagcgcctgttcctgccaagagtctgcggcacaactctgcacttactgctgttggggctactgttggtgctactgccgggagcgcaaggcctccccggggtgggactgacacctagtgccgcccagacagctcgccagcaccccaaaatgcacctggcccattcaactctcaagcccgccgcccacttgataggcgatccctcaaaacaaaattcccttctctggagggcaaacactgatcgcgcatttctccaggatgggttcagtctgtccaacaattcgcttctagtccctacttctgggatctacttcgtgtacagccaggtggtcttctctgggaaggcctactcgcctaaagcaacatcgtcccccctgtatttagcacacgaggtgcagctttttagttcacagtacccttttcatgtccctttgctgagctcccaaaagatggtgtacccggggcttcaggaaccctggctccatagcatgtaccacggagctgcgtttcaactcacccagggggaccaattgtctacacacactgacggaatccctcatcttgtgttgagtcccagtacggttttctttggcgcgttcgcactctag

SEQ ID NO: 122835 - DNA, 618 bp, Artificial Sequence
  Description of Artificial Sequence: Synthetic coding sequence
atgacaccacctgagcgtctttttctccctagagtccgagggaccactcttcatttactgctgctgggtctgctcctggtgttgctgccaggagcacaggggctgcccggcgtaggcctgactccatcagccgcacagaccgcacggcagcaccctaaaatgcacttagcacacagcaccctgaagccagcggcccacttgattggagatccatctaagcagaatagccttctttggagagctaatactgacagagcatttctgcaggacggatttagtctttccaacaactccctgctagtgcctacttctgggatttatttcgtctacagccaggtcgtgttctctgggaaggcgtatagccccaaggccacctcatccccactctatttggcccatgaagtacagctgttcagtagccagtatcccttccatgtccccctgctgagcagccagaagatggtgtaccccggcctccaggaaccgtggttacattccatgtatcacggtgctgcctttcaactcacacagggcgatcagttgagtacccacacagacggaattccacatctggtgctctcaccatccacagtgttcttcggggcgttcgccctgtag

SEQ ID NO: 122836 - DNA, 618 bp, Artificial Sequence
  Description of Artificial Sequence: Synthetic coding sequence
atgactccccccgagcgtctattcctgccgcgggtctgcggcactactcttcacctgttacttcttgggctgctcctcgtgctgctcccgggggcccagggcctgcccggagttggacttaccccctccgccgcccagacggccagacagcacccaaaaatgcatcttgcccatagcacacttaaacccgcagcccatctaatcggcgaccctagcaaacaaaatagcctcctgtggcgtgctaacaccgatagggccttcctgcaggatggattctccttatctaacaacagtctgctggtgccaacctccggaatctatttcgtctactcccaggtggtgttttccggcaaagcctactcgcctaaagccacctccagccctctgtacctggcacacgaggtgcagctgttttcctcacagtaccccttccacgtgcccctgctttcctcccagaagatggtctatcccggactgcaagagccatggcttcattcaatgtatcacggcgccgccttccagttaacacagggtgaccaattgtctacacataccgacggcattcctcatctggtcctgtccccatccacggtatttttcggagctttcgccctgtag

SEQ ID NO: 122837 - DNA, 417 bp, Artificial Sequence
  Description of Artificial Sequence: Synthetic coding sequence
atgaccccgcctgaaaggctgtttctgcctagagtgtgcggtacgaccctgcatttactcctgttagggctgcttctggtgctgttacccggtgcccaggggctgcccggcgtcggcctaaccccatctgctgcccagaccgcgagacagcaccctaagatgcatctggctcactctacgctgaaacccgcagcccacctgattggggacccttctaaacagaactcgctgctgtggcgcgcaaataccgatcgggcctttttacaggatggctttagcctcagcaataacagcttactcgtacccacctctggtatatactttgtctattcacagggatccagtccgccgttgctatggccttttcagcagctgaagtcctctttaattaagtctcccgagctgtctaagaagtag

SEQ ID NO: 122838 - DNA, 618 bp, Artificial Sequence
  Description of Artificial Sequence: Synthetic coding sequence
atgactccaccggaacgtctgttcttacctcgggtgaggggaacaacccttcacctattattgttggggctgttattagtgttactgccaggagctcaggggctgccaggggtggggctcaccccgtctgccgctcagactgcacgccagcatccgaaaatgcatcttgcgcattccactctgaagcccgcagcccacctgatcggagaccctagcaagcaaaattctctgctgtggcgagccaataccgaccgagccttcctgcaagacggcttctctctgtctaataactctctcctggtgccgacctccggcatctactttgtgtactcgcaggttgtcttcagcgggaaagcttacagccccaaagccaccagcagccccctttacctggcgcacgaggtgcagctgtttagcagccagtacccattccatgttcctctgctgtctagtcagaagatggtctaccccgggttacaagagccttggttgcactctatgtaccacggcgcagcattccaactaacacaaggggatcagttgtcaacccatacagacggaattccacatctggttttgagcccatctactgtctttttcggggcgttcgccctctag

SEQ ID NO: 122839 - DNA, 618 bp, Artificial Sequence
  Description of Artificial Sequence: Synthetic coding sequence
atgacacctccagaacgtctctttttacccagggtacgggggacaaccttacacctgctcctcctagggctgttgctcgttctcctgcctggtgcccagggactcccaggtgtgggattgactccatctgctgcccagacggcacggcagcaccccaagatgcatctcgctcattctaccctgaagccagctgcccatctgatcggtgacccatctaaacagaacagcctcctctggcgtgccaacacagaccgggcttttctacaggatgggtttagcctctccaataatagcctgctcgtgccaactagcggaatctatttcgtgtactcacaggtagtgttcagcggcaaggcgtattctccaaaagcaacttcatcccccctgtatttagcacacgaagtgcaactgttttcatcccagtacccatttcatgtgcctcttctttcatcccaaaagatggtttatcctggtctacaggagccctggctccattctatgtaccacggcgctgcttttcagttaacccaaggagaccagcttagcacgcacaccgatggcattccccacctcgtgctctccccttctacagtttttttcggcgccttcgcactgtag

SEQ ID NO: 122840 - DNA, 618 bp, Artificial Sequence
  Description of Artificial Sequence: Synthetic coding sequence
atgacacctccagagcgcttattcttgcctcgggtctgcgggaccacacttcacctcctgctgctggggcttttactcgtgctacttcctggcgcccaagggctccctggtgtcgggctgactccctccgcagcccagacagcccggcagcacccgaagatgcatttagcgcattcaactctcaagcccgctgcgcatctaatcggggacccgagtaagcaaaatagcctcctctggcgggcaaataccgatagggcgtttctgcaggacggtttcagtctgagtaataatagcctcctggtccccacgtccgggatatatttcgtatatagccaggtcgtgttttcaggaaaggcttactctccaaaggccactagctcacctctttaccttgctcacgaggtgcagctgttttccagccagtatcctttccatgtcccactgctcagctcccagaagatggtctacccaggacttcaggaaccctggctgcacagcatgtaccacggcgctgctttccagctcacacagggagaccagctcagcacccacaccgatggtatcccgcatttggtactttctccgtccacagtgttcttcggcgcttttgcgctttag

SEQ ID NO: 122841 - DNA, 618 bp, Artificial Sequence
  Description of Artificial Sequence: Synthetic coding sequence
atgaccccacctgagcgactgttccttccccgagtgtgtggaaccacactgcacctacttctactgggcttactgctggttttgcttcctggcgcgcaggggctgccaggcgtcggacttacaccaagtgccgcccagacagcccggcagcaccctaagatgcatttggcacacagtaccctaaagcccgctgctcatcttattggggacccctcaaaacagaatagcctgctgtggcgggcaaatacagacagagcgtttttacaggacggtttttctctctctaacaacagtctgctggtccctacatcaggcatatacttcgtgtactcacaggtggttttctctggtaaggcttacagtccaaaggcaaccagcagtccactttaccttgcgcatgaggtccagttgttcagttcccagtacccctttcacgtccctctgctttcatcccaaaaaatggtgtacccaggactgcaggagccatggctacattccatgtaccatggcgcagccttccaactcacgcagggtgatcagctgagtactcacactgatgggattcctcacctggtcctgagcccgtctacagtttttttcggcgctttcgcactttag

SEQ ID NO: 122842 - DNA, 618 bp, Artificial Sequence
  Description of Artificial Sequence: Synthetic coding sequence
atgacaccacccgaacgcctctttctgcccagagtgcgtgggaccaccctgcatttgctgctactgggcctactgctcgtactcttgcctggcgcccagggcctccctggtgtaggtcttactccatctgcggcccagactgctcggcagcaccccaagatgcacttggcccattctaccctgaagccagcagctcacttgatcggagaccccagcaagcagaacagcctgctctggagggctaacactgatcgtgccttccttcaggatggtttcagcctctcgaataacagcctacttgtgcctacatcaggaatatatttcgtttattcacaggtggttttcagcggtaaagcgtactcccccaaggccacctctagtcctctgtatttggctcatgaggtgcagctgttttcgtctcagtaccctttccatgttcctttgttgagttcccagaaaatggtttatcccggtctgcaggagccctggctgcactctatgtatcacggagcggcatttcagcttacccagggagatcaattgtccacacacactgatgggatcccacacctcgtcctatcacccagcacagtttttttcggcgcctttgcactctag

SEQ ID NO: 122843 - DNA, 417 bp, Artificial Sequence
  Description of Artificial Sequence: Synthetic coding sequence
atgacacctcccgagcgcctctttctgccaagagtgagaggcactacgttgcacctgttgttactaggccttctcctggtgttgctgcccggagcacaaggcctacccggcgtagggctgacccccagcgccgctcaaacagcccgtcagcaccccaagatgcacctggctcatagcacactcaaaccggccgcccacctgataggggaccctagcaagcagaactcacttctctggcgtgcaaataccgatcgtgctttcctgcaggacggcttcagcctcagtaataacagcctgctagtacccacctcaggcatttattttgtttattcccagggctcctcaccacctctgctgtggccttttcagcaactgaagtcgagcttaatcaagtcgccggaactaagcaaaaagtag

SEQ ID NO: 122844 - DNA, 474 bp, Artificial Sequence
  Description of Artificial Sequence: Synthetic coding sequence
atgacccctccagaacggctctttcttccccgagtgtgtggcacaacactgcacctgctcttactgggcttgctgcttgttctcttacccggcgcccaggggttacctggggtggggttaacaccgtcagcagcacagactgctagacagcatcctaagatgcacctcgcccattcgaacttgaaacctgctgctcacttgattggagacccctcaaagcagaacagtttgctgtggcgggcgaacacagatagagcctttctccaggatggattttccctgagtaacaatagtctgctggtgcctacatccgggatttattttgtttacagtcagttaccagaagacggcgtgtcccgcgctgcaggcaccctggccgctctggatgttccgagaggctgtgtgcccgctcaccccggccgtcctgccatccatcctcatcgatggcacccaccacccagtccacaaccatag

SEQ ID NO: 122845 - DNA, 417 bp, Artificial Sequence
  Description of Artificial Sequence: Synthetic coding sequence
atgaccccgccagagcggctatttctccccagagtctgcggcacgacgttgcacctcctcttgctcggcctcctgttggtgctcttacccggggctcaagggcttcccggcgttggtctgaccccctcagcagcccagacagcccggcagcaccctaaaatgcatctggcccactccaccttgaagccagctgcgcacctcataggagaccctagtaaacagaacagcttgctgtggcgtgcaaatactgacagagccttcctgcaggacggattctcactgtctaataacagcctgctggtgcctacaagcggcatctacttcgtttacagtcagggctcaagtccaccactcctttggcccttccagcagctgaaatctagtctgattaagagtcctgagctgtctaaaaaatag

SEQ ID NO: 122846 - DNA, 417 bp, Artificial Sequence
  Description of Artificial Sequence: Synthetic coding sequence
atgacaccacccgaacgcctgtttctcccacgagtctgtggaaccactcttcacctgctactgctgggactcttgctggtcctcctgccgggggcacaaggactacctggtgtggggctcactccttctgctgctcagactgcacgccagcaccccaagatgcatttagcccattctaccctcaaacctgctgcacacctaatcggcgatcctagcaaacagaattcgctgctctggagagcaaacacagaccgggctttcttgcaggacggcttcagtcttagtaataatagcttgctggtccccacctctggaatttacttcgtttactcccagggctcctctccaccccttctgtggccatttcagcaactgaaaagctcactgatcaagtcgcctgaactgagtaaaaaatag

SEQ ID NO: 122847 - DNA, 417 bp, Artificial Sequence
  Description of Artificial Sequence: Synthetic coding sequence
atgacgccaccggagcgattattcctgccccgggtcagagggaccaccttacatctacttttgctaggcctgctgctggtcctattgcccggagcccaagggttacctggtgtaggacttaccccatcagccgcacaaaccgctcggcaacatcccaagatgcatttagcacactccacgctgaagccagctgcgcacttgattggcgatccctctaagcagaactcactgctgtggcgagcgaacactgatcgtgcctttctgcaggatggcttcagtttgagcaataattccctccttgtccctacctctggcatctatttcgtctattcgcagggatcctctccaccactcctgtggccctttcagcagttgaaaagttccctgataaagagccccgaactgtctaaaaaatag

SEQ ID NO: 122848 - DNA, 735 bp, Artificial Sequence
  Description of Artificial Sequence: Synthetic coding sequence
atgggtgcccttggcctggagggtcgcgggggccgacttcagggacgcgggtctctgctgcttgccgtggccggggccacttctctggtcacacttcttctcgcggtcccgatcactgttctggctgtcttagcactggtgcctcaggaccagggaggattggtgactgaaaccgcagaccctggggcccaggcccaacaggggcttgggtttcaaaagctccctgaggaggagcccgagaccgacctgagtcccggcttgccggccgcccacttgatcggcgcacctctgaaaggccagggtctggggtgggagacaaccaaggagcaagccttcctgacctctggaactcaattcagcgacgcggagggcctggctttgccacaggacggtctctactacttgtattgtctggtggggtaccgaggacgggccccacccgggggcggtgacccccagggccgcagtgttactttaagaagtagcttatatcgtgctggcggagcgtacgggcctggaacaccagagctactgctggaaggggccgaaacagtgactcccgtgctggatccggccagaagacagggttacggccccctgtggtacacatccgtaggtttcggggggcttgtgcagttgcgcaggggggagcgcgtttacgtgaacatctcacatccagatatggtcgacttcgcgagaggcaaaacatttttcggtgctgtgatggtgggatag

SEQ ID NO: 122849 - DNA, 735 bp, Artificial Sequence
  Description of Artificial Sequence: Synthetic coding sequence
atgggagccttgggcttagaaggacgcgggggacgcctgcaaggccgaggctcactactcttggccgtggccggagccacatcgcttgtgaccctgctcctcgccgtgccaatcaccgtcctggccgtgctggctttagtgccccaggaccaaggcggccttgtgaccgagactgccgatccaggcgctcaggcgcagcaaggtcttggcttccagaaattgcctgaggaagaacccgaaaccgatctctctcccggtcttcccgcagcccacttaatcggcgctccccttaagggacaaggccttggatgggagaccactaaggagcaggcttttttaacatctggtacccagttctctgatgccgaggggctggccctgccccaggatggcctctattacctgtattgcttggtggggtatcggggcagggcccctcctggcgggggggatccgcagggccgctcggtcactctaagatcgtcattataccgcgccgggggcgcctacggccccggtacccccgagctgttgttggagggtgccgaaacagtcactccagtgctagacccagctagaaggcagggatacggccctttatggtacacctcggttggttttggaggcctggtccaactccgacgaggcgagcgcgtgtatgttaatattagtcacccagatatggtggatttcgccagaggcaagacatttttcggcgccgtgatggtagggtag

SEQ ID NO: 122850 - DNA, 735 bp, Artificial Sequence
  Description of Artificial Sequence: Synthetic coding sequence
atgggcgcacttggcctggaggggagaggcgggcggttgcagggcagaggatcactcctgctggccgtggccggtgcaacgtctctggtgacgttgctgctggccgtccctattacagtactggcagtcctcgccctcgtgccacaggatcaggggggactcgttacggaaacagctgatccaggcgcccaggctcagcagggcctggggtttcagaagctgccagaggaggagccagagacggatctgtcacccggtctcccagccgctcacctaatcggtgcccctttaaagggccagggcctaggttgggagactaccaaggaacaggcctttttgacaagcggcactcaatttagtgatgctgagggtttggcactgccccaggatggcctgtactatctctactgcctcgtggggtatagaggacgagcgcctccaggcggaggcgatcctcagggacggtcagtcacattgaggagctccttgtatagagccggaggagcgtacggtccgggcacaccagagctcctgctcgaaggcgctgaaactgtaacgcctgtgcttgaccccgctaggagacagggatacgggccgctctggtacacaagcgttggcttcggaggactagtgcagctgaggcggggagaacgggtctatgtgaatatatctcaccctgacatggtggattttgctaggggaaagacctttttcggcgcagtgatggtgggctag

SEQ ID NO: 122851 - DNA, 735 bp, Artificial Sequence
  Description of Artificial Sequence: Synthetic coding sequence
atgggggcccttggcctcgaggggcgggggggacggctgcagggaaggggctccctgcttctggccgttgccggggcgacctcccttgttacactgcttctggcggtgcccatcactgttctggccgtgctggcccttgtgccacaggatcagggcggcttggtgaccgaaacggccgacccaggtgcccaggcacagcaaggcttaggattccagaagcttcccgaggaagagcccgaaacggatctgtcacctgggctgcctgcagctcacctcatcggagccccactcaaagggcagggcctgggatgggaaaccacaaaggaacaggctttccttacgtcaggcactcaattttccgatgcagagggactcgccctgcctcaggacggtctatattatctttactgccttgtgggctatcgaggtagagctccacctggcgggggagaccctcaggggcggagcgtcacactccgaagtagtctttaccgcgcggggggagcgtacgggcctggaacaccagagttgctcttggaaggcgctgaaacagtgaccccagtgctcgatcctgcgcgtcgccagggttatggacccttatggtatacgagcgtgggattcggcggacttgttcagttgcgtaggggtgagcgggtgtacgtcaatatctcccatcctgatatggttgattttgcccgaggtaagactttttttggcgctgtgatggtaggatag

SEQ ID NO: 122852 - DNA, 735 bp, Artificial Sequence
  Description of Artificial Sequence: Synthetic coding sequence
atgggtgccctgggcttggagggtaggggaggaagactccagggacggggtagcttgctgctagcggttgcaggagcaacatctctggttaccctgctgctagcagttccaattactgtcctagcagtccttgccctggtgcctcaggatcagggagggctagtgaccgagaccgctgatccaggagcgcaagcgcagcagggcctcggcttccaaaagctgccggaggaggagcctgagaccgatttaagcccaggactaccagccgctcatcttatcggagctcctctgaaaggccagggtctgggatgggagacaactaaggaacaggcgtttctgacatccggaacacagtttagcgacgccgaaggattagccttgccccaggacggactgtactatctttattgcctagtcggctataggggccgtgctccccctgggggaggggatccacaggggcggtccgtgaccctcaggtccagcttatatcgagccggcggtgcctacggacccgggacccctgaattactgttggaaggcgcagagacagtcacccccgtcctagaccccgcacgccgccagggatatggacccctgtggtataccagcgtcggcttcggagggctggtgcagctaagacggggagagagggtttacgtcaacatttcccatccagatatggtcgactttgccagaggaaaaacattcttcggcgccgtgatggttggctag

SEQ ID NO: 122853 - DNA, 735 bp, Artificial Sequence
  Description of Artificial Sequence: Synthetic coding sequence
atgggggccttaggccttgaggggcggggaggccgcctgcagggccgcgggtcactcctgttggcagtggccggcgcaacctctctggttactctcctcttggctgtccctatcaccgttctcgctgtgctggctctcgtgccccaagatcagggcggactcgttacggagacggcggaccctggtgcccaagctcagcagggcctcgggttccagaagttacctgaggaggagcctgaaaccgacctaagcccaggcctgcccgccgcacacctgatcggcgccccactgaaagggcaggggttggggtgggaaaccacgaaggagcaggcgttcctcacatctggcacccagttcagcgacgctgaaggactagcgttacctcaggatgggctctattatctctattgcttggtcgggtataggggtcgggcaccgcccggcggtggcgaccctcaaggcaggagtgtaacactccgctcctccctctatcgcgctggcggggcatacgggccaggaactcccgagttactgttggaaggcgccgaaacagtcacgcccgttctggacccggcccgccggcagggctatgggcccctgtggtatacatctgtcggatttggcgggctcgtgcagcttcggcgcggagaaagggtctacgtcaacatttcgcaccctgacatggtggatttcgctcgggggaaaaccttttttggggctgtcatggtcggctag

SEQ ID NO: 122854 - DNA, 234 bp, Artificial Sequence
  Description of Artificial Sequence: Synthetic coding sequence
atgggcgcacttggcttagagggccgcggagggcgcttacaagggaggggtagcctactcctggcagtggctggcgccacttcgctggtcaccctgctccttgcagtacctatcacagttttggccgtccttgcccttgtccctcaggatcagggtggactaggatttagatcttgccagcgacgctctcagaagcagatatctgccccaggctcccagctacccaccagctag

SEQ ID NO: 122855 - DNA, 735 bp, Artificial Sequence
  Description of Artificial Sequence: Synthetic coding sequence
atgggagcactcgggttagagggtcgagggggccgactgcaaggcaggggctctcttctccttgctgtagccggcgccacatccttagtcacgttgttgctggctgtgcccattactgtactggccgtgctggctcttgtgccgcaggaccagggagggctggtcaccgagactgccgacccaggcgcccaggcccagcaggggctcggttttcagaagctgcctgaagaagaaccggagacggaccttagtccaggcctgccggctgctcatctcatcggtgcccccctgaaaggccagggtctgggatgggagacaaccaaagagcaagcctttctgacctcaggcacccagttttccgacgccgaggggcttgcgctcccacaggacggtttgtactacttatattgtctagtggggtaccgcgggagggcgccccctggcggtggagacccccagggccgcagcgtcaccctcagaagcagtctttacagggccggcggtgcgtatggacctggaacccccgagctgctcctggaaggagccgagacagttaccccagtgctggatcctgcacgtaggcagggctatggtcccctctggtacacgagcgtcgggttcgggggcctggtgcagctgcggcggggggagcgggtgtacgtcaacataagccatccagatatggtggactttgccagaggtaaaaccttcttcggtgcagtgatggtcggctag

SEQ ID NO: 122856 - DNA, 735 bp, Artificial Sequence
  Description of Artificial Sequence: Synthetic coding sequence
atgggcgccttaggcttagaaggtcgcggcggcagacttcagggtaggggctccctgctgctggctgttgccggagcaacgtctctagtgacactactgctcgctgtgccaataacagttctggccgtgctcgcactagtacctcaggatcagggcggtctcgtgacagaaacggctgatccaggggcccaggcccagcagggcctgggcttccagaagcttcccgaggaagagccagagactgatctgtcgcccggcctcccagccgctcatcttattggcgcgccactcaagggccagggattgggatgggagaccacaaaagagcaggccttcctgaccagcggcacccagttttccgatgcagaaggcctcgccctccctcaggacggtctctactacttatactgtctggtgggctacagggggagggcaccccccggcggcggggatccccaggggcgcagtgtcacactgcgcagctctctgtacagagctggtggtgcctacgggccaggaactcctgaactgctgctcgagggcgccgaaacagtgacccctgtccttgacccggctcgaaggcagggctacggtccgctgtggtacacatctgttggttttgggggcctggtgcagctgaggaggggagaacgcgtttacgtgaacattagtcaccccgacatggtggatttcgctagaggaaagaccttcttcggcgcggtgatggtgggttag

SEQ ID NO: 122857 - DNA, 276 bp, Artificial Sequence
  Description of Artificial Sequence: Synthetic coding sequence
atggctgcatcctctagggcccaagtgctgagtctgtaccgggcgatgctcagggagagtaagcggttttcagcttacaattacaggacgtatgcagttcgacggattcgagacgcctttagagagaataagaatgtgaaggatccagttgagatacagacactggtgaataaagccaagcgtgatctgggcgtcataaggaggcaagtgcacatcggtcaactttactccaccgacaagctcattattgagaaccgcgacatgcctagaacttag

SEQ ID NO: 122858 - DNA, 393 bp, Artificial Sequence
  Description of Artificial Sequence: Synthetic coding sequence
atggcagcctcttctcgcgcacaagttctttcattatatagagccatgctccgagaatcaaagagattctctgcctataactataggacgtacgccgtgaggaggattagagacgctttccgcgagaataagaacgttaaggaccccgtggagattcagactttggtgaacaaggctaaacgagaccttggggtaatccgacgccaaatggattcccacagcgtagcacaggccggggtccattggaacgacctctcttcactgcagccactacctccgtggtttaaacagttttcttgcctctcccttccgtctagttgggactacagacgtaccccgccccgtttggccaacttctgcatcttatcccgggatgtaatttcactctactag

SEQ ID NO: 122859 - DNA, 291 bp, Artificial Sequence
  Description of Artificial Sequence: Synthetic coding sequence
atggccgccagcagcagggcccaggtgctgtccttataccgggccatgctacgagagtctaagagattttctgcctataactatagaacctacgccgtacgtcggatacgggacgcctttcgcgaaaacaaaaacgtgaaggatcccgtggaaattcagactttggtgaataaggccaaaagagatttaggcgtgattcggcgccaagtggctgagcagggcactgccgccaggagaaagagcggcaatagcagtcgctctctgggcaaaccatgcactagttggccgtag

SEQ ID NO: 122860 - DNA, 2559 bp, Artificial Sequence
  Description of Artificial Sequence: Synthetic coding sequence
atgctctcggggaagaaggccgctgcggctgctgcagccgctgcagcagccgccactggaacagaagccgggcccggcactgccggtggctcagagaatggctctgaagtagccgctcagccagctggcctcagtggccccgccgaagtgggacccggggccgttggggagcgcaccccgaggaagaaagaacccccaagggccagtcctcccggcgggctggctgaaccgcctggctccgccggaccacaggccggaccgaccgttgtgccggggtccgccacacccatggagacaggcattgcagagacccccgagggcagacgtacatccagacgaaaacgcgctaaagtagagtatagggagatggatgaatctctagctaatcttagcgaagatgaatattactccgaggaggagaggaatgcaaaagctgaaaaggagaaaaagctacctcctcccccaccccaagcccctccagaagaggagaacgaaagcgagccagaggaaccgtctggagttgaaggagcggccttccaaagtcgactgccacatgacaggatgacttcccaagaggcggcttgtttccccgatattatttccggaccacaacagactcagaaggtcttcctctttatccgcaacagaacactgcaattgtggttagacaaccctaaaattcaactgactttcgaggcaacactgcagcagttagaggcaccctacaattctgatacggtgctggtgcatcgcgtgcattcgtatctagagcgccacggactgattaacttcgggatctataagcggattaagcccctgcctacaaaaaagacagggaaggtgataatcattggatctggggttagcggcttggccgctgcccggcagttgcaaagctttgggatggatgtgaccctgttggaggctagggacagagttgggggacgcgtcgcaacctttaggaaaggaaactatgtggccgatctcggagccatggtcgttacaggtttaggcgggaatcccatggccgtggtgtctaagcaggtgaacatggagctggcaaagatcaagcagaagtgccccctctatgaggctaatggtcaagcggtgcctaaagagaaggacgagatggtcgaacaggaatttaatcggctgttagaagccacatcgtatctgtcccaccagctggacttcaatgtgctcaacaacaagccggtcagcttgggccaagctctggaggtggtgatccagctccaggaaaaacacgtcaaggacgagcagatcgagcattggaagaagattgttaagacccaggaggaattaaaggaactgcttaataaaatggtcaacctgaaggagaagatcaaggaactgcatcagcagtacaaggaggcctcagaggtcaagcccccaagagacattacagccgagtttctggtgaaatcaaagcatcgcgatttgactgccctctgtaaggaatatgatgagctagcagagacccagggcaaactagaggagaaactccaggaattagaagccaacccacctagcgacgtctacctgagcagccgtgaccgccagatcttggactggcactttgctaacctggaatttgccaatgctacgcccttgagtactctatcgctgaagcattgggatcaagatgacgatttcgaatttaccgggagccatctgactgtgcgcaacggatatagctgtgtccctgtagccctcgctgagggcctggatataaagctcaatactgccgtgcggcaggtgaggtacacagcttcaggttgtgaggtcatcgcagtcaacacccggagcacttcgcagacgtttatatacaagtgcgacgctgtgctctgtactctgccacttggagtgcttaagcaacagccgccagctgtgcagttcgtcccgcctctcccggagtggaagacatccgcagtccagagaatgggcttcggtaacctcaataaggttgtgctgtgctttgacagggttttctgggacccaagcgtaaaccttttcggacatgtgggctcaaccactgcgtcacggggcgaactcttccttttctggaatctctacaaagctcccatcctgctggccctggtagctggcgaggcagccgggataatggagaacatctcagatgatgtaatagtcggacgttgccttgccattctgaaggggatcttcggaagtagtgccgtgccccagcctaaagaaacggtggtaagtcggtggcgggcggacccatgggccaggggtagctactcatacgtggccgccggttccagcgggaatgactacgatctgatggcacagcctattacgcctgggccaagcatacccggggcccctcagccaataccccgactctttttcgccggcgagcacactatccggaactaccctgcgacagtccacggagccttattaagcgggttaagggaggcagggcgcatcgcagaccaatttctcggcgctatgtacacactcccacgacaagccacaccaggagttccagcacagcagagcccgagtatgtag

SEQ ID NO: 122861 - DNA, 2631 bp, Artificial Sequence
  Description of Artificial Sequence: Synthetic coding sequence
atgttgtcggggaagaaagccgcagcagctgcagcggcagcagcagccgccgcgaccggtacggaagcaggtccagggacggcgggtggtagcgaaaacggctccgaggtggccgcgcaacctgccgggctcagcggcccagccgaagtggggccaggagccgtcggggaaagaacacctcggaaaaaagaaccaccccgcgcgagtccaccaggcggcctggccgaacctcctggttcagcgggacctcaggcagggcccaccgtcgtgccgggcagcgccacacccatggagacagggatcgcagaaaccccagagggacggcgcacttccaggcgtaaacgcgcaaaagtggaataccgggaaatggacgaaagccttgccaatctgtcggaggatgagtattactccgaagaggaacgtaacgctaaagcggaaaaagagaaaaagcttcctcctcccccgccgcaggcaccacccgaagaagaaaatgagagcgagcccgaggagccctctggccaggcaggcggacttcaggacgattcctctggcggatatggggatgggcaagcttcaggcgtggagggcgcagctttccagtcccggctgccacatgacagaatgacctcccaggaggctgcttgctttccggatattatctctggaccgcagcagacccaaaaggtctttctttttattcgaaaccggactctgcaactctggcttgacaatcctaaaatacagcttactttcgaagcaactctgcaacagctggaggcaccctacaactcggacaccgtattagtgcaccgagttcattcctaccttgagaggcatgggctgatcaactttggcatctacaagcggattaagcccctgccaacaaaaaaaacggggaaggttattattattggtagtggcgtcagcgggctcgctgctgcaaggcagctgcaatccttcggaatggatgtcacccttctggaggcacgcgacagggttggtggcagagtggcaactttccgcaagggtaactatgtggccgatctgggagcaatggtcgtcacaggactcggcggcaatccaatggccgtcgtgtcaaagcaggtaaacatggaactcgccaaaatcaagcaaaaatgccccctctacgaggctaacggccaggcggaacggattatagtccctaaagaaaaagatgaaatggtcgagcaagaatttaataggcttctggaggccacttcctatctgagccaccagctggatttcaacgtgctcaataacaagcccgtatctctgggacaggcgctcgaagtggtgatccagcttcaagaaaaacatgtaaaggacgagcagatagagcattggaagaagattgtaaaaacccaagaagagcttaaggagctattaaataaaatggttaacttgaaggaaaagatcaaagagctccaccagcaatataaggaagcctcggaagtgaaacccccacgggatataacagcggaattcctagtcaagtccaagcaccgggatctaaccgccctgtgtaaagaatatgatgaacttgccgagacccaaggaaagttggaggaaaagctccaagaactggaggctaatcctcccagtgatgtctacctctcatcccgagaccggcagatcttggactggcactttgcaaatctcgagtttgccaacgcaacaccactgtcgaccctgagcctgaaacactgggaccaggacgacgattttgagttcactgggagtcatctgaccgtcagaaacggctattcttgcgtgcccgtagctctggctgaaggtctggacatcaaactaaacacggcagtccgtcaggtcaggtacaccgccagcggctgcgaagtgattgccgttaatacaagaagcacctctcagacattcatttacaagtgcgatgctgtgttgtgcacactgcctttgggcgtgctgaagcagcagccacctgccgtgcaatttgtcccacctttgcccgagtggaagacaagtgccgtgcagcgtatggggtttggcaacctgaataaagtggtcttatgcttcgatcgggtgttctgggacccatcggtgaatttgttcggccacgttggctctactacggcctccagaggagaactattcctcttttggaatctctacaaagcacctatcctgctggctctcgtggctggcgaggccgctggcataatggaaaacatatccgatgatgtgatcgtaggacgatgcctcgcaatcctcaaaggcatcttcgggtcaagcgccgttccccagcccaaggagactgtcgtgtcgagatggcgagcggacccctgggccagagggagttactcttacgtcgctgccggcagttcagggaatgattacgaccttatggcccagcctattacacccggcccatctatccctggcgcccctcaacccatcccacgcctgttcttcgcaggcgagcacacaattcgcaactaccccgcaacggtacacggggcccttctcagtgggctgcgtgaggcagggcgtatcgctgaccaattcctgggtgccatgtatactctacctcgccaggccactcccggggtgccagcccaacagtcaccttccatgtag

SEQ ID NO: 122862 - DNA, 2631 bp, Artificial Sequence
  Description of Artificial Sequence: Synthetic coding sequence
atgctcagtggcaaaaaagccgctgcagcagctgcggctgcagctgccgcggccactgggactgaagctggaccagggacagcagggggaagtgagaatggaagcgaggtcgccgcacagcccgcggggctgagcggaccagcagaggtgggtcccggtgccgtaggggaacggactccgagaaaaaaagagcctccacgggctagccctccaggtggcctggcagagccacctgggagtgcgggcccacaagcaggtcccacggttgttcctggttccgctactcctatggagaccggcattgctgagacccctgaaggtcgccgcacgtcaaggcgaaagcgcgccaaggtggaatacagagagatggacgagagcctggcgaatttatccgaagatgagtattatagtgaagaggagaggaatgccaaggccgagaaagaaaagaagctgccgccaccccccccacaggcaccccctgaagaggaaaatgagtccgaacccgaagagcccagcggccaggccggcggtctgcaggacgacagctcaggcggttacggtgacggacaggcttccggagtggagggggccgcttttcagtcccgtttgccacacgatcgaatgaccagccaagaagctgcttgtttccccgatatcatttccggaccccagcagactcagaaagtgttcttgttcatccggaatcgcactctgcaattgtggctagacaatcccaaaatacaacttacatttgaagccacattacagcagcttgaggcaccctacaatagtgacaccgtgttagtacacagagtccactcctatcttgagcgccatgggctcattaacttcggcatttacaagcggataaagcctctgcccactaagaagaccgggaaagtcataattatcgggagcggcgtgtctggcttagctgcagcaagacagctgcagtcctttggtatggatgtgaccctgctggaggcccgagaccgcgttggcggcagagtggccacttttagaaaaggaaattacgtagcggatttgggcgctatggtcgttaccggactgggagggaaccccatggccgtggtgtcaaaacaagtgaatatggagcttgcaaaaattaaacaaaagtgtcctttgtacgaggccaacggacaggccgatacggtgaaggtaccgaaggagaaagatgaaatggtcgaacaggaattcaacaggttgcttgaagccacttcttatctgagtcatcagttggatttcaacgtgctcaacaacaagccagtatcactgggtcaagcactcgaggtcgtcattcagctccaggagaagcacgtcaaagacgaacagattgagcactggaagaagattgttaaaactcaggaagagctaaaggagcttctaaataagatggtgaacctcaaggagaaaatcaaagaactgcaccagcagtacaaagaggcctctgaggtcaaaccgccccgcgatattacggccgaattcctggttaagtccaagcatagggaccttacggccctgtgcaaggaatacgacgagctagccgagacacagggtaagctggaagagaagctgcaggagctcgaagctaaccccccaagcgacgtttacctctcctctcgagaccgccagattctggattggcactttgccaacttagagtttgctaacgccacccccctgtcaaccctgtcgctcaaacattgggatcaggacgatgacttcgagtttaccggctctcacttgactgtgcgtaatggatacagctgtgtgcccgtagctctcgcagagggcttggacatcaaactgaacacggccgttagacaggtgcgctataccgcctccggctgcgaggtgatagccgtgaacactaggtctacctctcagacgttcatctacaagtgcgacgccgtgctgtgcaccctgccactgggagtactgaagcagcagccgccagctgttcagttcgtcccccccctgccagagtggaaaacatccgctgtccaacgcatgggttttggcaatctgaataaagtggtgctgtgctttgatagagtgttttgggacccttcagtgaatctatttggacacgtcgggagtacaaccgcatcaaggggcgaactgttcctcttctggaatttgtacaaagcccccatattgctggccttagtggctggcgaagccgcaggaatcatggagaatatcagcgacgatgtgatcgtgggaagatgcctggcgatcctgaagggaatcttcggctccagtgcagtccctcagccaaaggagacggtggtgtccagatggcgcgctgacccctgggcgcggggcagctacagctacgtggccgccggttctagcggtaacgattatgaccttatggcccagccgatcacccccggcccaagcattcccggagccccccaacctatacctaggctcttcttcgctggtgagcacactatcaggaattacccagcaactgtccatggcgctctgctgagtggcctgcgcgaggcaggaaggattgcagatcagttcctgggagcaatgtataccctcccaaggcaggcaacacccggagtacctgcacagcagtctccgtcgatgtag

SEQ ID NO: 122863 - DNA, 1773 bp, Artificial Sequence
  Description of Artificial Sequence: Synthetic coding sequence
atggctacgccaagaggcaggactaagaaaaaggcctcttttgaccacagcccagatagcctgcctttgaggagctccggacgccaggccaagaagaaagccacagagacaactgacgaagacgaggacggtggctccgagaagaagtatcggaagtgcgagaaggccggctgcacggcaacctgtcctgtttgctttgccagtgcatcagagcggtgtgcgaagaacggatacacctccagatggtaccatctgtcttgtggagagcacttttgcaatgagtgttttgatcattactaccggagccacaaagacggatacgacaaatataccacctggaaaaaaatctggactagcaatggcaaaaccgaaccctctccgaaggcctttatggcggatcaacagttaccatattgggtccagtgcaccaaacctgaatgcagaaagtggagacagttgaccaaggaaatccagctcacccctcaaatcgccaaaacataccggtgcggcatgaaacctaacacagccatcaagcccgagacgtcggatcattgctccctgccagaggacctcgaggccctcacccctcagaagtgcatccctcatataattgtccgtggtttggtgcgtattagatgcgttcaggaggtggagcgcatcttgtacttcatgacacggaaaggtctgatcaacactggcgtgcttagtgtcggggcagatcagtaccttctgccaaaagattaccacaataagagcgtgatcattatcggcgctggtccagccgggctggcggcagccaggcaactgcataactttgggatcaaagttacagtcctcgaggccaaagataggatcggcggacgtgtttgggacgacaagagttttaagggggtgactgtcggtaggggcgcccagattgtgaacgggtgcattaataacccagtggccctaatgtgcgagcaagttagtgctagaagctgggaccacaatgagtttttcgctcagttcgctggtgatcacactctgctgacacctggttacagcgtgatcattgagaaactggctgaggggttggacattcaactcaaatcacctgtacagtgtatcgactattccggcgacgaagtgcaggttaccacaactgacggaacaggatacagtgcccaaaaggttcttgtgacggtcccattagcgctgcttcaaaagggagccattcagttcaaccccccgctgagtgagaagaaaatgaaggcgataaacagtttgggcgctggcatcattgagaagatcgctctgcagtttccgtaccgcttttgggactcaaaagtgcaaggagcagacttcttcgggcacgtgccgccatcggcgtctaagcgagggcttttcgccgtgttttatgacatggacccccagaagaaacattcggttctcatgtccgttatcgccggcgaagcagtggctagcgttaggacactggatgataaacaggtactccagcagtgcatggctaccttgcgcgagctgtttaaggaacaggaggtcccagacccaacgaaatactttgtcactcggtggtctaccgatccttggattcagatggcttactcgtttgtgaaaactggcggtagcggcgaggcttatgacataatcgccgaggacattcaaggcacagtgttcttcgccggggaggcaaccaatcgacactttccccagacagtcacaggcgcgtacctgtcaggggtgagagaggcctcgaaaattgctgcattctag

SEQ ID NO: 122864 - DNA, 2463 bp, Artificial Sequence
  Description of Artificial Sequence: Synthetic coding sequence
atggctaccccaagaggccgtaccaaaaagaaggcctcttttgatcattccccagattcattaccactcagatctagtggtcgtcaagcaaaaaaaaaagcaacagaaactacagacgaagacgaggatggcggcagcgaaaaaaagtatcgaaaatgtgaaaaagctggatgcaccgctacatgcccggtctgtttcgcatcggccagtgagaggtgtgctaagaacggctatacttccaggtggtaccatctgagctgcggcgaacacttttgtaatgagtgctttgaccactactatcggagccataaagacggatatgacaaatacacgacctggaaaaagatttggacttcaaacggcaagactgaaccgtccccgaaagcatttatggcagatcagcagctgccctattgggtgcagtgcacaaagcctgagtgtcgtaagtggagacagctgaccaaagaaatccagctgacaccacaaatcgccaagacctacagatgcgggatgaaaccaaacactgcaataaagccggaaacatccgaccactgctcccttcctgaggacctgagggtactggaggtgtccaatcactggtggtattccatgctcatcctcccccctcttcttaaagacagcgttgccgctcctcttttatcggcatactaccctgattgtgtcggtatgagtccatcatgcacgtcaaccaatagggctgccgcaacagggaacgcatctcccggcaagctggaacactcaaaagcagcactttctgtccacgtgccgggaatgaaccggtattttcaacctttctaccagcctaacgagtgtggcaaggcactgtgcgtgcgtcctgacgtcatggagctcgacgagctgtacgaatttccagaatatagcagggatcctacaatgtacttggcactccgcaaccttattttggctctgtggtacaccaactgcaaagaagccctcactccccagaagtgtatccctcacatcatcgttcgggggttagtgagaattcggtgcgtgcaggaagtggaacggatcctctactttatgactcggaagggattgatcaacactggagtgctaagcgtgggagccgatcaatacctcttgcccaaagactaccataataaaagcgtgattattattggagcagggcctgccggcctggccgcggctagacagttgcacaattttgggataaaagttaccgtgctggaagcgaaagatcgaatcggtggaagagtgtgggatgataagtccttcaagggagtgaccgtgggccggggcgcccaaattgttaacggatgcatcaacaatccagtagccttaatgtgtgagcagctggggatatccatgcataagttcggtgaaaggtgcgacctaatacaagagggagggcgcattacggaccccacaatagacaagcggatggattttcacttcaacgcattgcttgatgtggtatccgagtggagaaaggacaaaactcagctgcaagacgtgcccctgggcgaaaagattgaggaaatctacaaagcttttatcaaagaatcggggatacaattctctgagctggaaggacaagtgctccagttccacctgtccaacctggagtacgcttgtggcagtaacctgcaccaggtcagtgccaggtcctgggaccataatgaatttttcgcccagtttgccggggaccatacattgttaactcctggctattctgtgattatcgaaaagcttgcagagggtctagatattcagcttaaatcccccgtgcagtgtatcgattacagcggcgatgaggtccaggttaccaccaccgacggtaccggctactcagcccagaaggtcctggtaacggtgccgctggccctccttcagaagggcgctatccaattcaaccccccactgtctgagaagaaaatgaaggctatcaacagcctgggcgcaggaatcatcgaaaagatcgcccttcagttcccatacagattttgggacagtaaagtacaaggagcagattttttcggccatgtgcccccctccgccagcaagaggggactgttcgccgtattctacgacatggacccccagcacagtgttctgatgtcagtgatcgccggcgaggccgtggcctccgtgcggactctagatgacaaacaggtgctgcagcaatgcatggcaacgctgcgagaactgttcaaagagcaggaggttcctgaccctaccaagtactttgtgacaaggtggagtacagacccgtggattcagatggcctacagctttgtgaagaccgggggtagcggggaggcctacgacatcattgccgaagatatacaaggcacagtcttctttgcgggtgaggctaccaaccgacactttccgcagacagtgactggggcttacctgagcggagtgcgggaggcctctaagatagctgcattctag

SEQ ID NO: 122865 - DNA, 2472 bp, Artificial Sequence
  Description of Artificial Sequence: Synthetic coding sequence
atggctaccccgaggggcagaaccaagaaaaaggcatcgtttgatcattctcccgactctctaccgctgcgaagtagcggccggcaggccaaaaagaaggcgacagagacaaccgacgaggacgaggatggcgggtctgaaaagaagtatcgcaagtgcgagaaagcaggttgcaccgccacctgccctgtttgtttcgctagcgctagcgaaaggtgcgccaaaaatgggtacacatcaaggtggtaccacctcagctgtggagaacacttctgtaatgaatgctttgaccactactaccgttcccataaagatggctacgataagtacacaacctggaagaagatctggacatccaatggaaagacagaaccttctccaaaagcattcatggccgaccaacagctcccctactgggtccagtgcacgaagccagagtgtcggaagtggcggcagctcaccaaagagatccagcttacaccgcaaatcgctaagacctacaggtgcggaatgaagcccaacactgccatcaagccagagacatccgatcattgttctcttccagaagatctgcgggttctcgaagtatcaaaccactggtggtactcaatgctgattctgccccccctgctaaaggattcagtggccgccccactgctcagcgcttactaccccgactgcgttggaatgagccccagctgcacctcaaccaacagagctgcagcaactggtaacgcgtccccgggtaagctggaacattctaaagcagctcttagtgtgcacgtgcctggaatgaacaggtattttcagcccttctaccaacccaatgagtgcggcaaagccttatgtgtgcgccccgacgttatggaactagacgagctttacgaatttccggagtacagccgcgacccaacgatgtacctcgcccttcgtaacttgatcctggccctgtggtatactaattgtaaagaggctctcacaccacagaagtgcattccacatatcattgtgaggggtttagtgagaatccggtgcgtccaggaagtggaaagaattctgtacttcatgactagaaaagggctgatcaataccggagtgctgtccgtcggggctgaccagtacttgctgcctaaagattaccataataaatctgtcattataataggggcgggccccgccgggctggccgctgcacgccaactgcataatttcggcataaaggtgactgttctcgaggcaaaggaccgaatcggaggtcgtgtctgggacgataagtctttcaaaggcgtgaccgtggggaggggcgcccagatagtgaacggttgtataaacaaccccgtggctttgatgtgcgaacagctggggattagcatgcataaattcggagagagatgtgacctcatccaagagggcgggcggattacagatccaactattgataaaaggatggacttccattttaacgccctgttggacgttgtcagtgagtggcggaaagacaagacccagctgcaggacgttcctctcggcgaaaaaattgaggaaatctacaaagctttcattaaggaaagtggcattcaattcagcgagctggaagggcaggtcctccagtttcacttgagcaacctggagtatgcatgcggctctaatttgcaccaggtgtctgctagaagctgggaccacaacgaatttttcgctcagtttgctggggaccatacactcctgacccctggatatagcgtgatcatcgagaagctggcagaagggctcgatatccaactaaaatccccacaggttcaatgtattgactactcaggtgacgaagttcaggtaacaacaactgacggaacgggttattctgcccagaaggtgctagtgaccgtgccactggctctcttacaaaaaggcgccatccaatttaacccgccactgagcgaaaagaagatgaaggctatcaactccctcggcgccggcattatcgagaaaatcgccttacagttcccttatagattttgggattccaaggttcagggggctgacttcttcggtcacgtccctccaagcgccagcaaacgcgggttgttcgcagttttctacgatatggatccccaaaagaagcacagtgttttaatgtctgtgattgccggggaggctgtcgcctcagtaaggacactcgatgacaagcaggtcttacagcagtgcatggcaactctgagggagctcttcaaggaacaggaggtgcctgacccaaccaagtactttgtaacccgctggagtacagacccctggattcagatggcttattcatttgtcaaaaccggtggctcaggagaagcatacgacattattgcagaagacatccagggaacagtgttcttcgcaggcgaggctacaaatcgccactttccacagactgtgacgggggcctacctgagtggtgtacgtgaggcctctaagattgcggctttttag

SEQ ID NO: 122866 - DNA, 1776 bp, Artificial Sequence
  Description of Artificial Sequence: Synthetic coding sequence
atggctactccacgcgggaggaccaagaaaaaagccagctttgaccactcaccagactctctgccattaagatcgtccggtcgacaggcaaagaagaaggcaactgagacaacggacgaggatgaggacggaggtagtgagaagaaataccgcaaatgtgagaaggctggatgcaccgccacctgtcctgtttgtttcgcgagcgcttctgaacggtgtgccaaaaacggttacacttctcggtggtaccacctgtcatgtggagaacatttctgcaacgagtgttttgaccattactaccggtcacacaaggatggctacgacaagtacacaacgtggaagaaaatttggaccagtaatgggaaaaccgaaccaagcccgaaggcgttcatggccgatcagcagctgccgtactgggtgcagtgtactaagccagagtgcagaaaatggcgccagctgacaaaggagatacaattgaccccccagatagccaagacctacaggtgtgggatgaagccaaacactgctatcaaacccgaaacttctgatcactgtagtttaccggaagacttagaagccttgacgccccaaaagtgcattccccatatcattgtacgtggactagtcagaatccggtgtgtgcaggaggttgagagaatcctgtatttcatgactcgaaaaggattaataaataccggcgtgttgagtgtaggagccgaccaatatctattgcccaaagattatcataacaaatcagtcattatcattggggctggtccagccggccttgctgcagcaaggcagctccacaattttggcataaaagtgacggtcctggaggctaaggacagaattgggggacgcgtgtgggacgacaagtccttcaagggcgtgacggtgggacggggggcccagatagtgaacgggtgcattaacaaccccgtggccctaatgtgcgagcaggtgtctgccaggagttgggaccataacgagtttttcgcccaattcgctggtgaccacactctcttaacccccggctattcagtcatcatcgaaaagctagcagagggcctggatattcagcttaagagcccccaggtccagtgtatcgactactccggcgatgaggtacaggttacaactactgatgggaccggctattccgcccagaaggttctagtaacggtgccactcgctctacttcagaagggggccatccagttcaatcctcccttgagcgaaaagaaaatgaaagcaattaatagccttggagccggcattatcgagaagatagccctgcagtttccataccggttttgggattccaaggtgcagggggctgacttcttcggacacgttcccccttcagcgtcaaaacggggcttgttcgcggtgttttacgatatggatccccaaaagaaacatagtgtgctgatgagtgtcattgctggggaggcagtggcctccgtgcgcacactggacgataaacaggtgctgcaacagtgcatggcaacgctgcgcgagctttttaaggaacaggaggtgcctgatccaaccaaatattttgtgaccaggtggagtacagatccatggatccagatggcctactctttcgtgaaaacaggcgggagcggagaagcctatgatatcatcgccgaggatatacagggcactgtttttttcgcaggtgaggcaaccaaccgacattttccgcaaaccgtgactggggcatacctgtcgggggtgagggaagcctctaaaatcgccgcattctag

SEQ ID NO: 122867 - DNA, 1923 bp, Artificial Sequence
  Description of Artificial Sequence: Synthetic coding sequence
tagtgcagccttccagaggatcttagagtgttagaggtttctaatcattggtggtacagcatgctgatcctgccccccctgttgaaggattctgtggccgctcccctcctgtccgcctattaccccgactgcgtgggaatgtcaccatcctgtactagcactaacagagcagctgctaccggcaacgcctctccagggaaactcgagcactctaaagcggcgctcagtgttcacgttcctggcatgaaccgctatttccagcccttttaccagcctaacgagtgtggtaaggccttatgcgtaaggcctgatgttatggagcttgacgagctctacgagtttcctgagtactctcgcgatcctaccatgtaccttgctctacggaacctaatcctggctctgtggtacactaattgcaaggaagcccttaccccccagaaatgcattcctcacataattgtgcggggactggtacggattcgctgcgtgcaagaggtggagaggatcctctacttcatgacacgcaagggtctgatcaacaccggtgtgctcagcgtcggggcggaccagtatttgctgcccaaagactatcataacaaatccgtgattatcatcggagctggcccagccggcctagccgctgccaggcagctgcataacttcggcattaaggttacggtgctagaggcaaaggatcggatcgggggaagagtttgggacgataagtccttcaagggggttacagtgggccgtggagcccagattgtcaatgggtgcatcaacaacccagtggcactgatgtgcgagcagctcggcatctctatgcataaattcggggagcggtgcgaccttatccaagaagggggacgaatcactgatccgaccatcgacaaacggatggactttcacttcaatgcccttctggacgtcgtgagcgagtggaggaaggacaagactcaactgcaagacgtaccactgggagagaagattgaggaaatttacaaggccttcatcaaagagagtggtattcaattttctgagctggagggccaggttttgcaattccacttaagcaatctggagtacgcatgcggatccaatctacatcaagtcagcgctcgctcctgggatcacaacgagtttttcgctcaattcgcaggtgaccatactcttctcacacccggttactctgtgatcattgaaaagctcgcagaggggcttgacatccagctgaagtctcctcaagtccagtgcatagattacagtggcgacgaagtacaagtgaccactaccgacggaaccggctatagcgcccaaaaagtgctggtcacagttcccctggccctgctgcagaaaggcgccatacaatttaacccaccactgagcgagaagaaaatgaaggccattaactctttaggagcaggaatcattgagaagatcgcgcttcagttcccttaccggttttgggactcgaaagtgcagggtgcagacttcttcggacatgtgccgcctagcgctagtaaacggggtctgttcgctgttttttatgatatggaccctcagaaaaagcactccgtgttaatgtccgttatcgctggcgaagctgtggcatccgtcaggacactggatgacaaacaggtcttacaacagtgcatggccacgttgagagagctgttcaaagaacaggaagtcccagatccaacgaaatactttgtaaccagatggtccacagatccctggattcagatggcatattcattcgtgaagactggaggttcaggcgaagcttacgatattattgccgaggacattcagggcaccgtcttttttgcgggagaggccactaacagacatttcccccagacagtaacaggagcttacctctcaggtgtgcgcgaagcctctaagatagctgccttttag

SEQ ID NO: 122868 - DNA, 342 bp, Artificial Sequence
  Description of Artificial Sequence: Synthetic coding sequence
atgagcgtcattgctggcgaggccgtggcatccgtcagaaccctcgatgataagcaggtgttacagcagtgcatggccacattgcgcgaactgtttaaggagcaggaggtgccagacccaactaaatatttcgtcaccagatggtcaacggatccctggatccagatggcctactcatttgtgaaaacgggaggatccggtgaagcttacgacatcattgctgaggatatccagggaactgtcttcttcgctggggaagccacaaatagacactttccccaaacggttacgggtgcttatctgagtggcgtgcgcgaagcatcaaaaattgctgctttttag

SEQ ID NO: 122869 - DNA, 3966 bp, Artificial Sequence
  Description of Artificial Sequence: Synthetic coding sequence
atggtacttaccctgggcgagtcatggccggtgcttgttggccggcggtttctctccctcagcgcagccgacgggtctgatggaagccacgacagttgggacgtggagcgtgtggccgagtggccatggctcagcgggacgatcagagctgtgtcccacacagacgtcacaaagaaggatcttaaagtctgcgtggaattcgacggcgaatcttggagaaagagacgctggatcgaggtctatagtcttctacgccgggccttcctggtggaacataatctggtgttagccgagcgcaagagcccagaaatctccgaacggatcgtgcaatggcccgccatcacctacaagccactccttgacaaggccggtcttggttccatcacctcagtgagatttctcggcgaccagcagagagtgttcctcagcaaagacctcttaaagccaatacaggacgtgaactcactgcgactctctctgaccgataaccagatcgtgagcaaggagttccaggctctgatcgtcaaacacctggacgagtctcacctcctgaagggggataagaacctggtgggctccgaagtcaagatttacagcctggatccatcgacacaatggttctctgcaacagtgatcaacggcaacccagccagcaagacccttcaagtcaattgcgaagagatcccagccttgaagatagtggacccttccctaattcacgtggaggtggttcatgacaacctggtgacctgcggaaatagtgccagaataggggccgtgaagcgaaagagttccgagaataatggcacactggtatcaaagcaggccaaaagctgttccgaagccagcccgtcaatgtgccccgtgcagtctgtcccaaccacagtatttaaagagattctgctcggatgcactgctgctactccgccatcaaaggacccccgtcagcagtctacacctcaggctgccaatagccccccaaaccttggagcaaaaattcctcagggctgccataaacagtcactgcctgaagaaatctccagctgcctgaataccaaaagcgaggcgctccgaaccaaaccagatgtctgtaaggccgggctcctctctaaaagttcccagatcgggaccggcgacttgaaaatactgaccgagccaaaagggtcatgcacgcagccaaagaccaatactgatcaggagaatcgcctggagagcgtgccacaagcgctcacaggcctgcctaaggagtgtctaccgaccaaggccagctccaaagctgagctggagatcgccaacccccccgagctccaaaagcacctggaacacgcgccctccccctctgatgttagcaatgccccagaagtgaaagcaggagtaaattctgacagccctaacaattgcagcgggaaaaaagtcgaaccaagcgccctagcctgtcgctcacagaacctcaaagagtcatctgtcaaagttgataacgagtcctgctgttctcggtccaataataaaattcagaatgcaccaagccgtaaatcagtgctgaccgaccctgcgaagctaaaaaagctgcagcagtccggtgaggcatttgtgcaggacgactcctgcgtgaatatagtcgcccaacttccaaagtgcagagagtgtcgcctggatagcctgcgcaaagataaggagcagcagaaagactccccagtcttttgtagattcttccactttcggcgtctgcagttcaacaagcatggagtgctgcgagtcgagggctttcttaccccgaataagtatgacaacgaggctatcggattatggctgcctctgaccaaaaatgtcgtcggtatcgacctggacacggctaaatatatcctcgccaatattggcgaccacttctgccagatggtgattagcgagaaggaagcgatgtcgacaattgagccgcaccggcaggtagcttggaaacgcgccgtgaagggagttcgcgagatgtgcgacgtctgcgacactaccatatttaacctgcactgggtgtgcccgagatgtggattcggagtgtgtgtcgactgctatcgcatgaaaagaaagaactgccagcagggggctgcctataagacctttagctggctcaagtgcgttaaatcccaaatccacgaacctgagaatctaatgcctactcagattattccaggcaaggccttatatgatgtcggggacatcgtacattctgtgagagccaaatggggaatcaaagctaattgcccatgctctaatcgccaatttaagctgttctccaagccagcgtctaaagaagatctgaagcagacaagcttggctggggagaagccaactctcggtgccgtactgcagcagaatccctctgtgctggagcctgccgcagtgggcggagaggctgcttcaaagcctgctggcagcatgaagcctgcatgccccgcatctaccagtcccctgaactggttggcagacttgacctccggcaatgttaataaagagaataaggagaagcagccgaccatgcccatcttgaagaacgagatcaaatgtctccctccactcccgcccctgtcaaaaagttccaccgtgctccacacctttaattcaactattctgacaccagttagtaacaacaacagcggctttcttaggaatttgcttaattcatctacgggcaagactgagaacggcctgaagaataccccaaaaatattagatgatattttcgcatctctcgtccagaataaaaccacatctgacctcagtaagagacctcaggggttaactattaagccctcaattctgggcttcgacaccccccactactggctgtgcgacaaccggctcctgtgtctgcaggaccctaacaacaagtctaactggaatgtgttccgcgagtgttggaaacagggacaaccagtgatggttagtggggtgcatcataagttgaacagtgaactttggaaacctgagtctttccggaaggagttcggggagcaggaggtggatcttgtgaattgtcgcacgaacgagatcattacaggcgccactgttggtgatttttgggacggattcgaggatgtcccaaatcgcctgaaaaacgaaaaggaacctatggtgctcaaactgaaggactggccacctggcgaagattttcgggacatgatgccctctcggtttgacgacctgatggccaatatcccactgcctgaatacaccagacgcgacggcaaattgaatttagcctcccgcctcccaaattactttgtcagacccgacttaggcccaaaaatgtataacgcttacgggctaattacacccgaagaccgtaagtacggaaccactaacctgcatctggatgtcagtgatgccgccaacgtgatggtgtatgttgggataccgaagggacagtgcgagcaagaggaagaagtgctcaagacaatccaggatggggactccgacgagctgacaatcaagaggtttatagagggtaaggaaaaaccaggagccctttggcacatctacgccgcaaaggataccgagaaaatcagagagttcctcaagaaggtttccgaagaacaggggcaggaaaatcccgccgaccacgacccaattcatgatcagagctggtatctggacaggtcactacggaaacgactccaccaggaatatggggtccaaggatgggccatcgttcagtttttgggcgatgtcgtgttcatccccgcgggcgccccccatcaggtccataacttatatagctgcatcaaagtggctgaggattttgtgtctcctgagcatgtcaaacactgcttttggctcacccaggaattcaggtacttgagccagacacacaccaaccatgaggacaagctgcaagtcaaaaacgtgatataccatgccgtcaaggatgcggtcgcaatgctcaaggccagtgagagcagctttggcaagccatag

SEQ ID NO: 122870 - DNA, 3966 bp, Artificial Sequence
  Description of Artificial Sequence: Synthetic coding sequence
atggttctcaccctgggcgaaagctggccagtgcttgtagggcgtcgctttctgagtctgtcagccgccgacggcagtgacggaagccatgactcctgggatgtggagcgcgtcgccgaatggccttggctgtccggaacaatccgggccgtaagtcacacggatgtcactaagaaagatcttaaagtgtgcgtagagttcgatggagaatcatggcgcaaaagacgttggattgaagtatacagcttgctccgccgtgcgtttcttgtcgaacataacctggtactggccgagcgaaagtccccagagatctcggagaggatcgtgcagtggcccgctataacgtacaagccactgctcgataaagcaggactagggtccataacgtccgtccgcttccttggagaccaacagcgagtcttcctcagcaaggatctcctcaagcctatacaggacgtcaacagcctgagactctctttgacggacaatcaaatcgtaagcaaagagttccaagcgctcatcgtcaaacacctggatgagagccacctgttaaagggagataaaaacctggtcgggagcgaagttaaaatatacagcctggatcccagtacccagtggttttccgctactgtaatcaacggaaacccagcatctaagacgctgcaagtgaactgcgaggagataccagcccttaagatcgtcgatcctagtctgattcatgtggaggtcgtacacgataacctggtcacttgtggtaacagcgcacgaatcggggctgtcaagcggaagtccagcgaaaacaatggcacccttgtatcgaagcaagccaagtcttgctctgaggcctctcctagcatgtgtcccgtgcaatccgtgcccacaacagtgtttaaggaaattcttttagggtgcacagcagcaacgccaccttcaaaagaccctagacagcaatctacaccacaggctgctaattcgccaccaaacctcggagctaagataccccaaggttgtcacaagcagtcactccctgaggaaatctctagctgtctgaatacaaagtcagaagctttgaggactaagcctgacgtgtgtaaagctggtttactgagcaagagctcacaaattggaaccggggatttgaaaatactgacggagcctaaggggagttgcacccagcccaagacaaacaccgaccaggaaaacaggctcgaaagcgtgccgcaggctctcaccggcctccccaaggagtgcctgcccacaaaagccagctcgaaggctgagttggaaattgcgaatcctcctgagctgcaaaaacatctggagcacgcgccttcacctagtgatgtgagcaatgctccagaggtgaaggccggagtcaattcggattcccctaacaactgttcgggcaagaaggtcgagcccagcgcattggcctgccgttctcagaacttgaaggagtcgagtgttaaagtagataacgaatcctgttgcagtaggtccaacaacaaaatacaaaatgctccaagccggaagtccgtgctgaccgacccagcgaagcttaagaaactgcagcagagcggcgaggcgttcgtccaggacgactcttgcgtcaatatcgtcgcacagttaccaaagtgtagggagtgcaggcttgactctctgagaaaagataaagaacagcagaaagactcccccgtattctgcaggttcttccactttcggaggctgcagtttaataaacatggggtgctcagagtggaaggctttctgacacccaacaaatacgataacgaggccatcggactgtggttgccactgacaaaaaacgtggtggggatcgacttagacacagctaagtacattttggcgaatataggcgaccacttctgtcagatggtgatttcagagaaggaggcaatgagcacgattgagcctcaccgccaggtggcatggaagcgggctgttaagggagtcagggagatgtgtgatgtctgtgacaccaccatcttcaacttacattgggtgtgccctagatgcgggttcggagtgtgtgtcgactgctatcgcatgaaacggaagaattgccagcagggcgcggcctataaaacctttagttggctcaaatgcgtgaagagccagatccacgagcctgaaaatctaatgcccacccagatcattccgggaaaagccttatacgacgtgggagatatcgtgcactctgtgagagctaagtggggcatcaaggccaattgcccatgttccaataggcaattcaaactgttttcaaaacctgccagtaaggaagatttaaagcaaacaagtctcgccggcgagaaacccacgctgggcgccgtgctacagcaaaatccgtcagtactcgagcccgctgccgtaggtggtgaggcggcgtctaagccggctggatctatgaaaccagcttgtcctgcaagcacatctcccctgaactggttggcggatctgacatctggcaacgtcaataaggagaataaagaaaaacagcctacaatgccgattctgaaaaacgagatcaaatgcctgccgccactcccaccgttgtctaagtcatctaccgtgctgcacacgttcaattctactatcttaactcctgtgtcgaataataactccggatttctccgcaaccttctgaattcatcaacgggaaaaacggaaaatggcctcaaaaacacccccaaaatattggacgacattttcgcgagcctggtgcagaacaagacaacctctgacctgtccaaacgcccacagggtttgacaattaaaccgagcatactgggatttgacacgccccactattggctatgtgacaacagactactctgcctgcaggatcccaataacaagagcaactggaacgtgttccgagagtgctggaaacagggccagcctgtcatggtgagcggggtacatcacaagctgaacagcgagctctggaagcccgagagttttcgcaaagagttcggggaacaagaggtggatcttgtgaactgtcggaccaatgagataattacaggagctactgtcggagacttttgggatggctttgaagatgtgccaaataggctgaagaatgagaaggaaccaatggtgctgaagctcaaggactggcccccaggagaggatttccgcgatatgatgccctcaaggtttgatgacctgatggccaacatacctctccccgagtatacgcgccgcgacggtaaacttaatctggctagtcgactaccaaactacttcgtccggccagacctgggccccaagatgtacaatgcctatgggttaattactcccgaagatcgaaagtacggaacgactaacttacatctggatgtaagcgatgccgccaacgtgatggtgtacgtgggcattccgaaaggtcagtgtgagcaagaggaggaggtcttgaaaactattcaagacggcgactccgacgaactcacgatcaaacgcttcattgaaggcaaagagaaacccggcgcactgtggcacatctacgctgctaaggacactgaaaagattagggagttccttaaaaaggtatccgaggagcaaggacaggagaacccggccgatcacgatccaattcacgatcaaagttggtaccttgaccgtagtttgagaaagagactgcaccaagagtacggcgtccagggctgggccatcgtccaatttctgggagacgtggtgttcattccagctggggctccacaccaagtgcataacttatattcatgcattaaggtcgccgaggatttcgtgagcccagaacatgtcaagcattgtttctggctcacccaggagttcagatatctctcccaaacccacacaaaccacgaggataagctccaggttaagaacgtgatctatcacgcagtgaaagacgcagtcgcaatgctgaaagcatccgagtcaagctttgggaagccctag

SEQ ID NO: 122871 - DNA, 3966 bp, Artificial Sequence
  Description of Artificial Sequence: Synthetic coding sequence
atggtgctgaccctgggggagtcctggccagttctggtcggccgacgatttctgtcactgagcgcagccgacggctctgatggatcacacgacagttgggacgtcgagagggtcgcggaatggccctggctcagcgggacgattagagctgtgtctcacacagacgtgactaaaaaagatcttaaggtgtgtgtcgagttcgacggagaatcgtggagaaaacggagatggattgaggtgtattcactgctgcgccgcgcatttctggtggagcataatctcgtgcttgctgagaggaagtctccggagatcagcgagaggattgtgcaatggcccgctatcacttacaaacccctgttagacaaagcgggactgggctcgatcactagtgtacgatttctcggcgaccagcagagggtttttctctctaaggatctgttgaaaccaattcaagacgtgaactcactgcggctgtcattgacagataaccagatcgtgtcaaaggaattccaggctctcatcgtgaagcacttagacgagtcacatcttctgaaaggcgacaaaaatctggtggggtcagaggttaaaatctattccctcgaccctagcacacaatggttttccgcgaccgtgattaatggaaaccccgcgtctaaaacgcttcaggtgaactgcgaagagattcctgccctgaagattgtagatcccagcttaatccatgttgaagtggtccacgacaatctcgtgacatgtggcaactccgcccggatcggtgctgtaaaaaggaagtcctctgagaacaatggaacactggtatctaagcaggcgaaaagctgctcggaagcctcacccagcatgtgccccgtacagagtgttccgaccaccgttttcaaagaaatcctccttgggtgtaccgccgcgacaccaccttctaaggacccgagacagcagagcaccccacaagcggcaaatagccctcctaacctcggcgctaagatcccccaggggtgtcataagcaaagcctgcctgaagaaatttcatcctgtcttaatactaagtctgaagctcttcggactaaaccagacgtctgtaaggcagggttgctgagtaagtccagccagatagggacgggagaccttaagattctaaccgaaccaaaggggtcttgtacacagccaaaaacgaacacagaccaggaaaatagactggagtccgtcccacaagccctcaccggactcccaaaggaatgcctgcctaccaaggccagttcaaaggctgaactggagattgccaatcctcctgagctccagaagcatcttgagcacgcaccctctccctccgatgtgtctaacgctcccgaggtgaaagccggcgtcaatagtgacagcccaaataactgcagcgggaagaaggttgagccttctgccctcgcctgcaggtcccagaacttaaaggagagctcagtcaaggtggacaacgagagttgttgtagcaggtcgaataacaaaatacagaatgctccaagtcgtaagagtgtcctgaccgaccccgccaagctgaaaaagctccagcagagtggagaggccttcgtgcaggatgactcttgtgtgaacatcgttgcacagctcccgaagtgtagagaatgcagactggattccttgaggaaagacaaggaacagcagaaagacagccctgtgttctgccgtttcttccacttcagacggcttcagtttaacaagcacggtgtgttgcgagttgagggcttcctgacgccgaacaaatacgataacgaggcaattgggttgtggctgccgcttacgaagaacgtggtcgggatcgacctagatacagctaagtacatcctggctaacataggggaccacttttgccagatggtcattagtgagaaggaagctatgtctaccattgaacctcaccgacaggttgcatggaagagagcagtaaagggtgtgcgagagatgtgcgatgtgtgtgacacgaccattttcaatctgcattgggtctgccctaggtgcggctttggcgtgtgtgtagattgctaccgtatgaaaaggaaaaattgtcagcaaggcgccgcttacaaaacgttcagctggctaaaatgtgtcaagagccagatccacgagcccgaaaatttgatgccaacccagattatcccagggaaggctctctatgatgtcggcgatattgtgcacagcgtcagagcaaagtggggcatcaaagccaactgtccttgttcgaatcgacagttcaagttgttctctaagcccgctagcaaagaggacttgaaacagacctccttggccggggaaaaacctactctcggggccgtactgcagcagaacccttctgtactcgagcccgccgctgtcggaggcgaggccgcttccaagcctgcaggtagtatgaagcccgcatgtcccgccagtacaagccccttaaactggctcgccgatctgacatctggcaatgtcaataaagagaataaggagaaacagcctacgatgcctattctgaagaacgaaattaaatgcttgccccccctgccccccctcagcaaaagctccacagtcctgcataccttcaacagtacaattttgacaccagtgtccaataataactcaggctttcttcgcaaccttttgaattcctcaactggcaagactgagaacgggttaaaaaacacacctaagattcttgatgatatctttgcctccctagtccagaataagacaacatccgacctgagcaagcggccccagggcctgacaataaaacctagcatcctaggatttgataccccacattactggctgtgtgacaataggctattgtgcctacaggaccccaataataagtcaaactggaatgtttttagggagtgctggaaacagggtcagccagtgatggtgtcgggggtgcaccataagctgaatagcgagctgtggaaacctgaaagttttcgcaaggagtttggagaacaagaggtggacctcgttaattgtcgcactaacgaaattattactggtgcgacagtaggcgacttctgggacggatttgaagacgttcctaatcgattgaaaaatgaaaaggaaccaatggtgcttaagctgaaggattggccccccggcgaggattttagggatatgatgccatcgagattcgacgatctgatggctaacataccccttccagaatacactaggagggacggaaagttaaacctggcttcccgtcttccaaattattttgtgagacccgacttgggacccaaaatgtataatgcttatggacttatcacgccagaggacagaaaatacggcacaacaaacttgcacctagacgtgagcgacgccgcaaatgtgatggtctatgttggcatacccaaaggacagtgtgagcaggaggaggaggtcctcaaaacaatacaggacggagactccgacgagctcacgatcaagagattcattgagggtaaggagaaaccaggggcactgtggcatatctacgcagcgaaagacacagaaaaaatcagagagtttctaaaaaaggtgagtgaagaacagggccaggaaaatcccgccgaccacgacccaattcatgaccagtcctggtatcttgatcggtccctccgcaaacgcctccaccaggagtacggtgtgcaaggatgggctatagttcagttcctaggtgacgtggtgttcattccagcaggtgcacctcatcaggtacacaatctttattcttgtatcaaggtggccgaggactttgtaagcccagaacacgtgaagcattgcttctggctgacacaggaattccgctacctgtcccagacgcatacgaatcacgaggacaagttgcaggtaaagaatgtgatttatcacgccgtgaaggatgccgtcgctatgcttaaagcgtctgaaagtagtttcgggaagccttag

SEQ ID NO: 122872 - DNA, 513 bp, Artificial Sequence
  Description of Artificial Sequence: Synthetic coding sequence
atggtactgaccctaggagaatcatggcccgtgctggtcggccgccggttcctcagcctgtcagcagccgacggctctgacggttctcatgactcctgggatgtagagcgtgttgccgagtggccgtggctgtctggaacgattcgtgctgtgtcacatacagatgtgactaagaaagatctaaaggtctgcgtagagttcgacggagaaagctggcgcaaaagacggtggattgaagtctacagcctactccgccgggcctttctggtagaacacaatctggtactggccgagcggaagtctcctgagataagcgagagaatcgtacaatggcctgccattacctacaaacccctcctggataaggctggcctggggtccataactagcgtcaggttcttgggggatcaacagagggtctttctgtcgaaggatctgttaaagccgatacaggatgtcaattccctccgtctgtctcttacagataatcagattgtcagtaaggagttttag

SEQ ID NO: 122873 - DNA, 2136 bp, Artificial Sequence
  Description of Artificial Sequence: Synthetic coding sequence
atggtgctaacactgggagaaagttggcctgtattggtgggccggcgctttctttcgctgtccgccgccgacggcagtgacggctcacatgactcttgggacgtggaaagggtcgctgagtggccgtggttatccggtaccattagggctgtaagccacacagacgtaaccaaaaaggatctcaaagtctgcgtggaatttgatggtgaaagctggcgcaagagaaggtggatcgaggtttactccctgttgagacgtgcttttcttgtagagcataatttagttctggccgaaaggaagagtccagagattagcgaacgcatcgtgcaatggcctgccataacatataaaccccttctggacaaggctggcttgggtagtatcacatctgtacgcttcctgggcgaccaacagagagtattcttaagtaaagacctgctaaagccaatccaagacgtaaatagtctgcgactgtccctcacggacaatcagatcgtcagtaaagagtttcaagccctgatcgtgaagcacctggacgaaagccatctgctcaagggcgacaagaacctcgtggggtctgaagttaaaatctatagcctggacccgagtacccaatggtttagcgcgacggtaataaacggtaaccctgcttctaaaacactccaagttaattgcgaggagataccagccctaaagatcgtggatccctctctcatccacgtagaggtggtgcatgataacctggtcacttgcggaaactccgccaggattggcgccgttaaacgcaaatcaagcgagaataacggcaccttggttagtaagcaggctaaaagttgtagcgaggcttctccttctatgtgccccgttcagagtgttccaaccaccgtattcaaagagattctactcggctgcaccgcggcaacgcccccgtcaaaggatcctcgacaacagtcgacccctcaggctgcgaactcccctcccaaccttggtgccaagatccctcagggatgtcataaacaaagcctgcctgaagagatcagtagctgtttgaacacaaagtccgaagcactgagaacaaaacctgatgtgtgcaaggcgggtctgctctccaaatcaagtcagatagggactggtgacctgaaaatcttgacagagcctaaagggtcctgtacccaacctaagactaacactgaccaagagaaccggcttgaatctgtcccgcaggccttgaccggactgccgaaggagtgcctgccaacaaaagctagctccaaggctgagttagaaattgccaacccccctgagttacagaagcatctggagcatgcacctagtccaagcgacgtgtccaatgcccccgaggtgaaggccggagttaatagcgactcaccaaataactgtagtggcaagaaagtagagccaagcgctctggcgtgccgcagtcagaacctcaaggagtcaagtgtgaaggtagacaacgagtcatgctgttctaggtcaaataataaaatccagaatgcacccagtaggaagagtgttctcactgaccccgctaagttgaagaaattgcagcaaagcggtgaagccttcgttcaggatgattcatgtgtgaatattgtggcccagttgcctaaatgtagggaatgccggctggatagtctcaggaaggataaggagcagcaaaaggactctccggttttctgcaggttcttccacttccgtagactgcagtttaataagcatggcgtcctccgagtcgaagggttcttgaccccaaataagtatgacaacgaggcgatcggcctctggctccccctgaccaaaaacgtggtgggtattgacctcgacacggccaagtacatactggctaatatcggcgaccacttctgccagatggttatcagtgaaaaagaagccatgagtacaatagaacctcaccgacaggtggcttggaagcgggccgtgaagggagtccgggagatgtgcgatgtgtgtgacacaacaatctttaacttacactgggtttgccctcgctgcggcttcggggtttgtgtggattgttaccggatgaagaggaaaaattgtcaacagggcgaaaatagatttgattccccacccgctcccctccattcgtag

SEQ ID NO: 122874 - DNA, 366 bp, Artificial Sequence
  Description of Artificial Sequence: Synthetic coding sequence
atggtgctgacccttggggagtcgtggcccgtcctcgttggccggcggttcctgagtctctccgctgctgacgggtccgacggctcacatgacagctgggacgttgagagggtcgccgaatggccatggctgagcggcaccatcagagcagtgagccacacagacgtcactaagaaggacctgaaggtttgtgtggaattcgatggagagtcttggagaaagcgacggtggatcgaagtatactcgctgttgagacgcgcttttttggtggaacacaatctggttcttgctgaacgcaagagccccgagatttctgagagaatagttcagtggcctgcaattacatataaacctctgctcgactag

SEQ ID NO: 122875 - DNA, 3984 bp, Artificial Sequence
  Description of Artificial Sequence: Synthetic coding sequence
atggtgttgacgctcggcgaaagctggcctgtgctggtgggtcggagatttctttctctttccgctgccgatgggtccgatggcagccacgattcttgggatgtggagcgggttgctgagtggccttggctttctgggaccattcgagcagtgtctcacaccgatgttacaaagaaagatttaaaagtgtgcgttgaatttgacggagagagctggcgcaaacgacgctggattgaggtctacagccttttaaggagagcctttctggtggaacacaatcttgtactcgccgagcggaaatcccctgagatttcagagcgcatcgttcagtggcccgcaatcacctacaagcccctattggacaaagcaggactcgggtccattacaagtgtccgcttcctgggcgatcaacagagggtattcctcagcaaagacttgctgaaaccaattcaagacgtgaatagcctgcggctctctctcacagacaatcagatcgtctcaaaagagtttcaagcactgattgttaagcacttggacgagtctcatctcctcaagggcgacaagaacctcgtgggcagcgaggtcaaaatctacagtctggacccttctactcagtggttttctgctactgtgattaacggcaatccagcatcaaagacactgcaggttaactgcgaggagattcccgcattgaaaatagtggatccttccctgattcatgtcgaagtagtgcatgacaacctggtgacgtgcggcaacagtgcccgcataggtgccgtcaaaaggaagtcatccgagaataacggtacactggttagcaagcaagccaagtcctgttccgaggcgagcccttccatgtgcccagtgcagtccgtcccaactaccgtctttaaggaaattcttctgggatgtacggctgccacgcctccgtcaaaggacccccgccaacagtcaaccccacaggccgccaattcaccgccgaatcttggagccaaaatcccccagggttgccataaacagagcctccctgaagaaatttcatcctgtctgaatactaagtccgaagctctgcgaaccaagccggatgtctgtaaagcgggcctgctcagcaagagctcccagattgggacaggcgacctgaaaattcttaccgagcctaaaggcagttgcactcagcccaagacaaacactgaccaggagaataggcttgagtcagtgcctcaagccctgactggtttgccgaaggaatgtcttcctaccaaggcaagcagtaaggcagagctggagatagcgaatccgccagagcttcagaagcacctggagcacgcgcccagtcctagtgacgtgtccaacgctcctgaagttaaggccggtgtgaattcagactctcctaataattgctcgggaaagaaggtggaaccgtctgccctggcgtgtcgctctcaaaatctaaaagagagctctgtaaaggtggataacgagagctgctgctcccgcagcaataacaaaattcagaacgctccatcgcggaagtccgtcctaacggatcctgccaagttgaagaaactgcagcaaagtggagaagcatttgtgcaggacgattcatgcgtcaatattgtggcccagttacccaagtgtcgcgagtgccgactggattcactgagaaaggacaaagaacagcagaaagatagtccagtcttctgccgctttttccactttcgacgtttacagtttaataaacacggcgtgctcagagtagagggtttcttgaccccaaacaagtacgacaatgaggcaatcgggctctggctgcccctcacaaaaaacgttgtaggaatcgatctcgacactgctaaatatatcctggccaacataggcgatcatttctgtcagatggttatctcagagaaagaagccatgagtaccatcgagccgcaccgacaggtggcctggaaacgggcggtcaaaggtgttagagaaatgtgtgatgtctgtgataccactatctttaacctacactgggtgtgccccaggtgcggattcggcgtgtgcgtggactgctatcgcatgaagcgaaagaattgtcagcagggggcagcctataagaccttctcttggttgaagtgcgtgaagagtcaaatacacgaaccagagaaccttatgccgacacagattattccaggaaaggcactttacgacgtaggcgacattgttcactctgtgagggccaaatgggggataaaagctaactgcccctgttctaatcgacagttcaagttgttttctaagccagcatcgaaggaggatctcaaacagacatccctggcaggagagaaaccaactctgggggccgtgctgcaacaaaatccgagtgtgctcgagcctgctgctgtgggaggggaagctgcctccaagccagctggctcaatgaagcctgcgtgcccggctagcacatcacctctgaattggctggccgatctcacctcaggcaacgtcaataaggaaaacaaagaaaagcaacccactatgcccattctcaagaacgaaattaaatgcttaccccccctcccacctctctcaaaaagctcaacagtccttcacaccttcaattccaccatcctaacacccgtgagcaacaacaacagcggcttcttgcgcaacctgttgaacagctcaacaggaaagacagagaacgggcttaaaaatacacccaaaatcttagatgacattttcgccagcctggtgcagaataagaccacgagtgatttatccaagagaccccagggcttgactataaaaccaagcattctggggttcgacacaccccactactggctctgcgacaatcgactcttgtgtctacaggaccctaacaataagtccaattggaatgttttccgggagtgctggaaacaaggccagcccgtgatggtgtctggcgtgcatcacaagttgaattccgagttgtggaagcccgagtcttttcggaaggagttcggcgagcaggaggtcgacctcgttaactgtcggacaaatgagataataaccggcgctaccgtgggcgatttctgggacggatttgaagacgtgcctaacagactgaagaatgaaaaggagcctatggtgctcaagctcaaagattggccacccggggaggatttcagggacatgatgccatcccggtttgacgacctgatggccaatatacctctgccagagtacacccgccgcgatggaaagctgaatctggccagcagattacctaattactttgtacgtcccgaccttggacctaaaatgtataacgcgtatggcctcatcacacctgaggatcgcaagtatggaactacaaacctgcacctggacgtgagcgacgctgccaatgtgatggtgtatgtcggaatccccaaaggtcagtgcgagcaggaggaggaagtgctgaaaactattcaagacggcgactccgacgaattaaccatcaagcgattcatcgaaggtaaggagaagcccggggcactctggcacatctacgccgccaaggacacggagaaaataagggaattcctgaaaaaagtttcagaggaacagggacaagagaatccggccgaccacgatcccattcacgatcagtcgtggtacttggaccgcagtcttcgtaaaagactgcatcaggaatatggcgttcagggctgggctattgttcaatttttaggcgatgtggtgttcattccggccggagctccacatcaggtgcacaatttgtactcttgcattaaagtcgctgaggatttcgttagtcctgaacatgtcaaacactgtttttggctgacacaggaattcagataccttagccaaactcatacaaatcatgaagacaagctccaggttaagaacgtgatctatcacgctgtaaaggacgcagtggccatgttaaaggttaatcccgtgctggctaacctgaacctgcctgctcactggaaatag

SEQ ID NO: 122876 - DNA, 3810 bp, Artificial Sequence
  Description of Artificial Sequence: Synthetic coding sequence
atggtgctcactctcggggaatcatggccggttctggtgggtcgtagatttttgtctctctcagccgctgacgggagcgacggcagccacgactcctgggacgtagagcgtgtggccgaatggccctggctcagcggcacaatccgagcggtgtcccatactgacgtgactaagaaagacctaaaaacatacaagcccctgctggataaggccggactgggatccatcacgtctgttaggtttcttggcgatcaacagcgcgttttcttaagcaaagacctgttgaagccgatccaggatgtcaacagcttacgcctgtctctgactgacaatcagatagtgtccaaggagtttcaggctttgattgtcaagcacttggacgaatctcacctcctgaaaggagacaagaatctagtggggtcagaggtgaagatctattctctggaccccagtacacagtggttcagcgctactgtcattaacgggaacccagctagcaagaccttgcaggtaaattgcgaagaaatacctgctctgaaaatagtcgatccaagcctgatacacgtggaagtagtgcatgacaacctagtcacatgtgggaacagcgctcgtattggggccgttaaacgaaagtcgagcgaaaacaatggtactttagttagcaagcaggctaaaagctgttctgaggccagccccagtatgtgtccggtgcaatctgtgccaacgacagtattcaaagagatccttctgggctgcaccgcggccacaccaccctctaaggacccgaggcaacagtctacccctcaagcagcaaattctccccctaatctcggagccaagatcccccagggctgccataagcagagtctgcccgaggaaatctcctcttgtctgaacaccaagtctgaagccctcaggaccaagccggatgtgtgtaaagccggactgctctccaaaagctctcagataggaaccggcgacctgaagatcttgaccgagcctaaaggaagttgcacccagccaaaaacaaacacagatcaggaaaatcggctagagtctgtgccccaggcactgacgggtctcccaaaagagtgtcttccgacaaaagcttcgagtaaggcggaattagaaatcgcaaatcccccagagctgcagaaacacctggagcatgctccatcgcctagcgatgtttccaatgcacctgaagtgaaggccggagtgaactctgactcccctaacaactgctctggcaaaaaggtggaaccgtccgctcttgcatgtaggtctcagaacttgaaggaaagctcagtaaaagtggacaatgagtcctgctgctcccgttcaaataataagatccaaaacgccccctcaagaaaatccgtcctgaccgatcccgctaaattaaaaaagctgcaacagtccggagaggcctttgtgcaagatgacagctgtgtcaacatcgtagcccagctccccaaatgccgggagtgccggcttgattctttgaggaaggacaaagagcagcagaaggactctccagttttctgcaggtttttccatttccgtcggctacagtttaataagcatggagtacttagagtggagggatttctgacaccaaataagtacgacaacgaagcaatcgggctttggttgccccttacaaaaaacgtggtgggcatagaccttgacactgctaagtatatcttagctaacattggagatcatttttgtcagatggtgatctccgaaaaggaggccatgtcaaccatcgaaccacacagacaggtagcatggaaacgggcagtgaaaggcgtgcgggagatgtgcgatgtttgtgatacaacaatcttcaacctccactgggtgtgccctcgatgcggcttcggagtgtgtgtggattgctaccgaatgaagcgcaagaactgccagcagggggccgcatataaaactttctcatggctgaagtgcgtgaaatcccagattcacgaaccagagaatctaatgccaactcagattataccaggcaaagccctttacgacgtgggtgatatcgtgcactcagtaagggccaaatgggggatcaaagctaactgcccatgcagcaacagacagttcaaattgttttctaagcctgcttctaaagaggaccttaaacaaaccagtctggccggagaaaagccgaccctgggcgccgtgctgcagcagaatccttccgtgctggaacccgccgctgttgggggggaagccgcctccaagccagcagggtcaatgaagcccgcgtgtcctgccagcacttccccactgaattggcttgccgatctgacttcaggcaatgtgaacaaagaaaataaggaaaaacagcccacgatgcctattctgaaaaatgaaatcaagtgtctccccccgctgcctccactctctaagtcaagtacggttctgcacacgtttaattccacaattttaactcccgtgtctaacaataatagcggtttcctccggaatctcttgaatagctcaactggcaaaaccgaaaacggacttaaaaacacccccaaaattttggatgacattttcgcctctctcgtccagaataaaactacaagcgatctctctaagagaccacaggggctgactattaaaccctccattctcggctttgacacccctcattactggctctgcgataatcgcctactgtgtctgcaggaccctaataacaagtcaaattggaacgtgtttagagagtgttggaaacaggggcagcctgtgatggtaagtggagtccatcataagctgaactctgaactctggaagccagaatcattccggaaagagtttggagagcaggaggtggatcttgttaactgcagaactaacgaaattatcactggggccaccgttggcgacttctgggacggcttcgaagatgtccctaataggctgaaaaacgaaaaagagcccatggtactgaagctcaaggattggccgcccggggaagatttccgggatatgatgccttcccggtttgatgacctgatggctaatatccctctaccagaatatactagacgggacggtaaactaaacttggccagtaggctacccaactacttcgtgaggccagatttaggccccaaaatgtacaacgcttacggcctgatcacccccgaggatagaaagtacggaaccactaacctccatcttgatgtgtcagatgctgcaaatgtgatggtgtacgtgggcatcccaaagggtcagtgcgagcaggaggaggaggtgttgaaaaccattcaggacggcgattccgacgagctcaccatcaagaggttcatcgaggggaaggagaagccaggagccctgtggcatatctatgcagcgaaagacaccgagaagatcagagaattcctcaaaaaagttagcgaggagcaaggccaagaaaatccagccgaccacgaccctatacatgatcagtcctggtaccttgatagatcgttgcgcaaacgtttgcaccaggagtatggcgttcagggctgggcgattgtccagtttctcggcgatgtggtatttatccctgcaggagccccacaccaggttcacaatctttatagctgcattaaagtggcggaggacttcgtgtcccctgaacacgttaaacattgcttttggttaactcaagagttcaggtatctttcccagacacacaccaatcatgaagacaagctgcaggtgaaaaacgtgatataccatgccgtcaaagatgcagtagctatgctgaaggcatctgagtctagttttgggaagccctag

SEQ ID NO: 122877 - DNA, 5286 bp, Artificial Sequence
  Description of Artificial Sequence: Synthetic coding sequence
atggctgatgccgcggcaagccctgtgggcaaacggttgctcttgctgttcgcggataccgcagcttccgccagcgcaagcgcccctgctgctgcagccgccagcggcgacccggggcctgcgttaagaacacgggcctggagggctggcactgtgagagctatgtcgggtgccgtgcctcaggatctcgctatcttcgtagaatttgacgggtgtaattggaagcagcattcgtgggtgaaggttcatgccgaggaagtgattgttctacttctggagggaagtctcgtctgggccccccgggaggatccagttttgcttcagggaatccgcgtcagcatagctcagtggccagctttaacttttacgccccttgttgataaactaggactcgggtccgtcgttcctgtggagtatttgctggatcgcgagctcaggttccttagtgacgctaacgggctgcatctgtttcagatggggaccgattcgcaaaaccagattctgctcgaacacgctgcccttagagaaaccgtgaacgccctgatctccgaccaaaaactgcaagagattttcagccgcgggccgtactctgtacagggacaccgcgtgaagatctaccaacctgagggagaggagggatggctgtacggtgtcgtgtcacaccaggactctattactcggctgatggaagtgtctgttactgagtccggtgaaatcaagtcggtcgatccccgattgatccacgtgatgttgatggataattctgccccccagagcgagggcggaacactcaaggcagtcaaatcctcaaaggggaaaaagaagagagagtcaatcgagggaaaggacgggcggcggagaaagtcagcatcagattccggttgcgaccccgctagtaagaagctgaagggcgatcgcggagaggtggactcgaacggctctgacggtggcgaagcttcccggggtccttggaaaggcggaaatgcctccggcgagcctggcctcgatcagagggccaaacaaccgccatctacctttgtacctcaaattaacagaaacattcgcttcgccacatataccaaggaaaatggcaggaccttagtggttcaggatgaaccggtgggaggcgatacaccggctagctttactccgtattctaccgccaccggccaaacacctctggccccagaggtgggcggggcggaaaacaaggaggcgggaaagaccttggagcaagtgggccagggcattgtggcgagtgcagcagtggtcacaacagccagcagcacacctaacactgtgcgcataagcgacacaggactggctgccggaaccgtccctgagaaacagaaggggtcaaggagtcaagcttccggcgaaaacagcaggaactccatcctcgcttcatcaggctttggcgctccactgccatcttcatcacagccactgactttcggctcggggcgctcccagtcaaatggggtcttggctacagagaataagcctctaggatttagcttcggctgtagcagtgcccaggaggcccagaaagataccgatctgagcaagaatctgttttttcaatgtatgagtcagactctccctaccagtaattacttcacgactgtctctgagtcccttgcagatgactcctcttcccgcgattctttcaaacagtccttggagtcactgtccagtgggctctgcaaaggccggtcagtcttgggcacagacacgaaacccggctctaaagctggctctagcgttgatcgcaaagtgcccgccgagtctatgcctaccctcacacccgcctttcctcggagcctgttgaacgcgcggacacctgagaatcacgagaatttgtttctccagccccccaagctgtctagggaggaacccagcaaccctttccttgcctttgtggaaaaggtggaacatagccccttcagttcattcgccagtcaggcctccggcagctcctctagcgcaaccactgtgacatctaaagtggccccgtcctggccagagtcccacagtagtgctgacagtgccagtctcgcaaaaaaaaaaccgctcttcattactaccgactccagtaagctggtatccggggtgctgggatccgctctgacttccggaggaccgtcgctgtccgccatgggtaacggtagaagctcatccccaaccagttcacttactcagcccatcgaaatgcccacactcagtagcagccccaccgaagaacgccccaccgtcggcccaggacagcaggataaccctctcctgaagacatttagcaatgtcttcggccgtcatagcggaggatttttaagttcccccgccgactttagccaggagaacaaagctcccttcgaggccgtcaaacggttctcacttgacgaaagaagtctggcatgccgtcaggattccgattccagcacgaatagtgatttgtccgacctctccgatagcgaggagcagctgcaggctaaaactggactgaaagggattcccgaacaccttatgggaaaactggggccaaacggcgagagatctgcagaacttctgctcgggaagtctaagggtaaacaagcacctaagggtagacctaggactgctcccctcaaagtagggcaaagtgttcttaaggacgtgtctaaggtcaaaaagctaaaacaatcgggtgaaccgttcctccaagatggatcatgcattaacgtggcccctcacctgcacaaatgcagggagtgtaggctcgaacgataccgaaaattcaaggagcaggaacaggacgactccacagtggcttgccggtttttccatttccggcggctcatcttcaccaggaagggcgtactgcgcgtagagggattcttgagccctcagcagagcgatcccgacgccatgaatctgtggatccccagcagcagccttgccgagggcatcgacctcgagacctccaagtatattctagctaacgtgggagaccagttttgccagcttgtgatgtctgaaaaggaagcaatgatgatggttgagccccaccagaaagttgcatggaagagagccgtgagaggcgtccgggagatgtgtgacgtctgtgaaactactttattcaatatacactgggtgtgcagaaagtgcggcttcggcgtctgcctggactgctatcgtctcagaaagtcaaggcctagaagtgagactgaagagatgggcgatgaagaggtgttctcctggctcaagtgcgcaaagggtcaaagccacgagcctgagaacctcatgcccacacaaattattcccggaactgctctgtacaacatcggagacatggtgcatgctgcaagagggaaatggggcatcaaggccaactgcccctgtatttcacggcagaacaagtccgtgttaagaccagccgtcactaacggcatgagccagttaccatctatcaatcctagtgcctcgtcagggaatgagacaacctttagcggcggaggtgggcctgccccagttacaactcccgaacctgatcatgtacctaaagcagacagcactgacattcgatcagaggaaccgcttaagacggattccagcgccagtaatagtaatagcgaactgaaagctatcaggcctccatgtcctgatactgcgcctcctagcagcgccctccactggctggccgatctggcgactcagaaggctaaggaagagacaaaggaggcaggctcgcttcggagtgtgttaaacaaggaaagccatagtccctttggactcgacagctttaatagcaccgcaaaagtgtccccactgactccaaaattgtttaactcactacttctgggaccgaccgccagcaacaataaaaccgagggttcttcccttcgcgatctgctgcactccggtcccggaaaattgccccagacccccctggacacgggaatcccattccctccagtgttctcaacatcttctgccggagtcaagtctaaggcctccctgccaaactttttggaccatatcatcgccagcgtggtcgagaataaaaagacatctgatgcctccaagcgcgcctgcaatctgaccgacacccagaaggaggtgaaagaaatggttatgggccttaacgtgcttgaccctcatacaagccactcctggctgtgcgacggccggctcttatgcctacacgatccaagcaacaagaacaattggaaaatttttcgagagtgttggaagcagggccagcctgtgctggtctccggtgtccacaagaagctgaagtcggaattatggaaacctgaggcgttttcccaggagttcggagaccaggatgtggacctggtgaattgcaggaactgtgccattatttctgacgtcaaggtgcgcgacttctgggacggcttcgagataatttgcaaacgactgcgttctgaagatggccagcccatggtgctgaagctaaaagattggccaccaggtgaagacttccgcgacatgatgccgacacgatttgaagatctaatggaaaatctaccattgccagaatacaccaagcgtgacgggagactcaatctggcaagccgtttgcctagctattttgtacgacctgatctcgggcccaaaatgtacaacgcctatggcctgatcaccgccgaggatcgaagagtgggaaccacaaatttgcatctggatgtgtccgatgctgttaatgttatggtgtacgtggggattccaattggagagggggcccacgatgaggaagtgcttaagacaatcgacgaaggcgatgctgacgaagtgaccaaacaaaggattcatgacggtaaagaaaagcctggagccctctggcacatctatgctgcaaaagatgcggagaaaatccgggagctcctgcgtaaggtgggggaggaacagggacaggaaaacccccctgaccatgacccaatccacgaccagtcatggtatctcgaccagaccctcaggaagagactttatgaggagtacggagttcaaggctgggccatcgtacaatttttaggcgacgcagtgttcatccctgcaggggcgccccatcaggtccacaacctctattcttgcataaaggtggccgaggacttcgtaagtcctgagcacgtcaagcattgttttcggctgactcaggagttcagacacctgagcaatacccacacaaaccatgaggacaaactacaggtcaaaaatatcatctaccatgcagtgaaggatgctgtaggaaccctgaaggctcatgagtctaaacttgcaagatcctag

SEQ ID NO: 122878 - DNA, 4254 bp, Artificial Sequence
  Description of Artificial Sequence: Synthetic coding sequence
atgggtgcaatggagataaatcggaatattagattcgccacctatacgaaggaaaatgggcggactctcgtcgtgcaggatgaaccagtggggggggatacacccgcctctttcaccccctatagcactgcaaccggccagacacctttggcccccgaggtggggggagctgaaaacaaggaagcgggaaaaaccctagagcaggtgggacagggaatcgtggccagtgcagcagtagtgacaaccgcatcctccacgccaaacaccgtgaggatttccgacaccggcctcgccgcgggtacagttccagagaagcagaagggctctaggtcacaggcctctggagaaaactccaggaacagtatactggctagctctggattcggcgcaccactgccgagctctagccagccactgacctttggctcaggacggtctcagtctaacggagtcctggctacagagaataaaccgttgggtttttcattcggttgtagttctgctcaggaggcacagaaagacactgacctgagcaagaatctttttttccagtgcatgagccagaccctcccaacttctaactactttacgaccgtgagcgagtccttggcagatgattcatctagtagggattcttttaagcagtccctggagtccctatctagcggcttgtgtaagggtaggagtgtcctgggaactgacaccaagcctggttcaaaggctggatcatctgtcgaccgtaaagtacctgcggaaagtatgcccacactgacacccgcgtttccccggtcactgctgaacgcgcgaactccagaaaatcacgaaaacttgttcttgcaacctcccaagctgtctcgagaggagcccagtaatccattcctcgcctttgtcgagaaagtggagcactcaccgttctctagctttgcctctcaagcaagtggatcctcaagctcagctacaactgtcacttcaaaagtggcaccatcttggccagaatcccactcgagtgccgacagcgcaagtctcgcaaaaaagaaacctctgttcatcaccacagatagttcaaaactagtgtccggcgttctgggatctgccctcacttccggtggtccttctctcagtgctatggggaacggacgcagctcctccccaacatcatccttgacacagcccatcgaaatgccaactctcagctcgtctccaaccgaggagagaccaactgtgggccctggacagcaagataatcccctgctgaaaacctttagtaatgtgtttggccgccactccggggggtttctcagtagcccagcagatttcagtcaggagaacaaggcccctttcgaagcagtgaaaaggttttccttagacgaacggagtttggcttgccggcaggattctgacagttccaccaatagtgatctatctgacctgtccgattccgaggagcagctgcaggccaaaacagggttgaaggggattccagagcacctgatgggaaagctaggtcctaatggagagcgatctgcggaactgctgttgggaaaatctaagggaaaacaggcccccaaagggaggccaaggactgcacctcttaaagtggggcaatcagtgctgaaagatgtgagcaaggttaaaaagcttaagcagagcggagagccttttttacaggacgggagctgcatcaatgttgcacctcacctgcacaagtgccgggagtgtaggttagagcgctatcggaagtttaaagagcaggagcaggatgactctacagtcgcttgtaggttttttcatttcaggcgactgatcttcacccggaagggtgttctcagagtggaaggcttccttagtccccaacagtccgatcctgatgccatgaacctatggattccctcatcctccctggcagagggaatcgacctggagacaagcaaatacattctggccaacgttggcgaccagttttgccagctggtcatgtccgaaaaggaggcaatgatgatggtggaaccacaccagaaagtagcgtggaaaagggcagtgagaggggtccgggagatgtgcgacgtgtgcgagacaacactgttcaacatccactgggtgtgccgcaaatgtggtttcggagtttgcctcgactgctaccgccttcggaaaagcagacccagatcagagacagaggaaatgggtgacgaggaggtgttctcttggctgaaatgcgccaaggggcagagtcacgagcccgagaacttgatgccaacacagattatccctggcaccgcgctctacaacatcggcgatatggtgcacgccgcgcgggggaagtggggcatcaaggccaattgcccctgtatctcaaggcagaacaagtccgtactgagacctgctgttacaaatgggatgtctcagctccccagcattaatcccagcgcttcctctggcaatgagaccactttctccggcggtggaggacctgcacctgtgaccaccccggagcctgaccatgtccctaaggccgatagcactgacatcagatccgaggagccccttaaaactgactcctcagccagcaactccaatagcgagctcaaggcaatccggccaccttgcccagacactgctcccccctctagtgctttgcactggctggccgatttggccactcagaaagcaaaggaagaaactaaagaagccggctcactccgtagcgttcttaacaaggagagccattctcctttcgggctcgactcatttaactcaaccgccaaagtttccccgctgacaccaaaactctttaacagtctcctcctgggacctactgcctctaacaataagaccgagggttcctccctcagagacttgttacactctggccctgggaaattaccgcagacgcccctggatactggtattccattcccacccgtattcagcacctcctctgctggcgtgaaatctaaggcgtctctcccaaatttcttggatcacatcatagcctctgtcgtcgagaataagaaaacctctgatgcatcgaagagggcatgcaatctcaccgatactcagaaagaagtgaaagagatggtcatgggcttgaatgtgctggacccacatacaagccattcttggctgtgtgatggtagactcctgtgcttgcacgacccaagcaataagaataactggaagatctttcgtgagtgttggaaacagggccagccagtactggtctccggagtgcacaagaagctcaaatccgagctgtggaagcctgaggcattttctcaggagttcggcgaccaggacgtggatctggtgaattgtaggaactgtgccatcatctcagacgtaaaggttagagacttctgggacgggttcgagatcatctgtaagagactgagatcagaagatgggcagccaatggtgttgaagctgaaagattggcctcctggagaggactttcgcgacatgatgccaactcggttcgaagacctcatggaaaatttaccgcttccagagtacactaagcgcgatggtcggctcaatttggcatcccgacttccctcttacttcgtccggcctgaccttggaccgaaaatgtataacgcctatggccttatcacggcagaggataggcgagtggggaccaccaatctacacttagacgtgtcggatgcggtaaatgtgatggtgtatgtgggtattcctattggggaaggggcgcacgacgaagaggtgctcaaaacaatcgacgagggcgacgccgacgaggtgacgaagcagcgaatccacgatggcaaggagaaaccgggtgctctgtggcatatctatgctgctaaggatgccgagaaaataagggaactcttgcggaaggtcggggaggagcaggggcaggagaacccccctgatcacgaccccattcatgatcagtcgtggtacctggaccagactctacgaaaaagactttacgaagaatacggcgtgcagggttgggccatcgtgcagttcctaggggacgcagtgttcatcccagccggtgcccctcatcaggtgcacaacctctactcatgtatcaaggtagccgaggactttgtgtcacctgagcatgtgaagcattgctttaggctcacccaggagttccgacacctgagtaatacccataccaaccatgaagataagttacaggtgaaaaacatcatctatcacgctgtgaaagacgcggtggggacactcaaggcacacgaaagcaagctagcacggtcctag

SEQ ID NO: 122879 - DNA, 2382 bp, Artificial Sequence
  Description of Artificial Sequence: Synthetic coding sequence
atgaatctttggatccccagctccagtttggctgagggaattgacctggaaacctcaaagtatatactcgctaacgtcggggaccagttctgtcaactcgtgatgtccgagaaggaggccatgatgatggtcgagcctcatcaaaaggtcgcttggaaaagggcagttcgtggagtcagggagatgtgtgacgtatgcgagaccaccttgttcaatattcattgggtctgtcggaagtgcggattcggggtgtgccttgattgctaccgcctccgtaagtcacggcctcgcagcgagactgaggaaatgggcgacgaagaggtgtttagctggctgaagtgtgcaaagggccagagccacgagcccgaaaaccttatgccaacgcaaatcatccctggaacggctttgtacaatatcggtgacatggttcatgccgccaggggcaagtggggaataaaggcaaactgtccctgcattagcagacagaataagagtgtccttcgaccggccgtaaccaacggaatgtctcaactgccatcaattaatcctagcgctagcagcggaaatgaaactacctttagtggcggaggtggccccgctccagtgacaactcctgagcccgatcacgttcctaaagctgattcaacagacattcgatcggaggagcccctcaaaaccgacagctccgcttccaatagcaattctgagcttaaggctatcagacctccatgcccagacacagcaccgccgtcatccgcgctacactggctggcggatcttgctactcagaaggctaaggaggaaacaaaagaggccggttctcttcgatccgtcctaaataaagagagccattctccttttggactggatagctttaatagcactgctaaggtgagtcccctgactcccaaacttttcaacagcctactcctggggcccactgcatctaataacaagacagaaggtagtagtctccgtgacctcctgcactctgggcccggcaagctgccccagactccactcgacaccgggatcccgttcccacctgtttttagcacatccagtgccggggttaagtctaaagcctctttacctaactttctggatcacataatcgcttctgttgttgaaaacaagaagaccagtgatgctagcaaaagagcctgtaacctgactgacacccagaaggaggtgaaagagatggtgatgggcttgaatgtactcgatccacacacatcacactcctggctgtgcgacggacgtctgctgtgcctgcacgaccccagcaataaaaataattggaaaatatttcgagaatgttggaaacagggtcagccggtcctcgtgagcggggttcacaaaaagcttaaatcagaactgtggaagcccgaggcgttttcacaggagttcggcgaccaagatgtcgatttggtgaactgtaggaactgtgccatcatcagcgatgttaaggtcagagacttctgggacggctttgaaatcatttgtaagaggctgcgcagtgaagacggccagcccatggttctgaagctgaaggattggccccccggcgaagactttcgggatatgatgcccacacggtttgaggacttgatggaaaatttgccactgcctgaatataccaagcgcgacgggagactcaacttggcaagccggctgccgagctattttgtgcggccagacctcggtccaaagatgtacaatgcctacggactcattaccgcagaagatcgacgggtggggactaccaatctccacctcgacgtcagcgatgctgtcaacgttatggtctatgtcggaatccctatcggcgaaggagcacatgatgaggaggtgttgaagacaatcgacgaaggcgatgccgatgaagtgaccaaacagagaatccatgatggcaaagagaagccgggcgccctctggcacatttacgcagcaaaagatgcagagaagatccgcgagcttcttcgaaaggtgggcgaagagcagggtcaggagaaccccccagatcacgatccgatccacgatcaatcatggtatttggaccaaacgctgcggaagcgactttacgaggagtatggcgtgcagggttgggcaatagtgcagtttctgggagatgcagtgtttattccggcaggggcccctcatcaggtccataatctctatagttgcattaaggtcgccgaagatttcgttagccctgagcacgtcaagcactgcttcaggctgactcaggaatttaggcacttgtcaaacactcacactaaccacgaggacaagctgcaagtcaaaaatatcatttatcacgccgtcaaggatgcagtggggactctgaaggcccatgaatctaaactcgccaggtcatag

SEQ ID NO: 122880 - DNA, 4656 bp, Artificial Sequence
  Description of Artificial Sequence: Synthetic coding sequence
ggctggaggtggctctacggcgtggtgagccaccaggatagcattaccaggttgatggaggtctccgtgaccgagtccggtgagattaaatctgtagatcctaggttgattcatgtgatgttaatggataactccgctcctcagagtgagggcggtacccttaaagccgttaagtcatctaagggcaagaaaaagcgggagagtatcgagggaaaagacggaagaaggcgcaagtcggccagcgattcagggtgcgatccagcctcaaagaagctgaagggggatagaggcgaggttgattccaacggtagcgatggcggtgaggctagtcggggcccctggaaaggagggaacgcaagcggcgaacctggtctggaccaacgggcgaaacagcctccgtctacctttgtccctcagattaacaggaacatccgtttcgccacatataccaaggagaatggtaggactttggttgtacaagacgagcctgtgggaggcgacactccagcttcatttacaccctattctaccgcaactggacagactcccctggcccccgaggtgggaggagccgaaaacaaggaggcaggcaagaccctcgagcaagtggggcagggtatagtagcaagcgcggcagtggtgactacggcttccagcactccaaataccgtccgcattagtgatacggggttggctgcaggaactgttccagaaaagcagaagggctcacgcagtcaggcaagtggcgagaactcacgcaactccattctcgcgtcctccggcttcggagcccccctcccaagttccagtcaacctctcacattcggctcgggccgctcacaatcaaatggggtccttgctacagagaataagcccttaggcttttcttttggatgtagcagtgctcaggaagcacagaaagatacagacctgtcaaaaaatttatttttccagtgcatgagccagactctcccaactagcaactacttcacaactgtgtctgagagcctcgcagacgatagttcgagcagggacagttttaaacagagtcttgagagcttatcctccggcctctgcaagggcaggagtgtcttgggcactgatacgaagcctgggtctaaagctggttcctcagtggacagaaaggtgccagccgaaagcatgcccacgctgacacccgccttcccccggagcctgttgaatgctcgcacaccagagaatcacgaaaatctctttctccagccaccaaagctgagccgggaggaacctagtaatccctttcttgcctttgtcgagaaggtggaacatagcccattctcatcttttgccagccaggcttccgggagctctagttctgctactacggtcacttctaaagtggccccctcatggcctgagagccactctagcgctgattctgcttctctggcaaagaagaaacccctcttcatcacaaccgactcgagtaagctggtaagtggcgtgctgggaagtgccctgactagcggagggccatccctcagcgcaatggggaacggccgatccagcagtcctacttctagtttgacgcagccaatagagatgccaacgttgagttcttctcctacagaagagcgaccaaccgtcgggccaggccagcaggacaacccccttctgaaaacattctcaaacgtcttcggacgccatagtggaggctttctctcatcccccgctgatttcagtcaagaaaataaggccccatttgaggccgtaaagagattttctctggatgagcggagcctcgcctgtcgtcaggacagcgattctagcactaattcagatctaagcgatctttctgattccgaggagcaactacaggccaagacaggattaaagggcatacccgaacacttgatgggaaagctcggaccaaacggagagcgtagcgcagagcttttactcgggaagtcaaagggaaaacaagctcctaagggccgtccgaggacggctcctttgaaggtagggcagagcgtgttaaaggacgtctcaaaagtgaagaagctgaaacaatcaggcgagccttttctccaagatggttcctgcataaacgtagcgccacacttgcataagtgcagagaatgccgcctggagagatacaggaaattcaaggagcaggagcaggacgacagcacagtcgcgtgtaggttctttcactttcgcaggttgatttttaccagaaaaggcgtgctgcgagtagaaggatttttgtcccctcaacaaagcgatccagatgctatgaacctctggatccccagctctagcctggcggagggcatcgaccttgagacatcaaaatacattttggctaacgtgggagaccagttctgtcaacttgtaatgagcgagaaagaggcaatgatgatggtcgagccccaccaaaaggtggcatggaaacgggccgtcaggggggtcagagaaatgtgtgatgtttgtgagaccacgctattcaacattcattgggtttgtagaaagtgtgggtttggggtatgtcttgactgctataggctgagaaagtcccgcccacggagcgaaacagaggagatgggtgacgaggaggtgttttcttggcttaagtgtgccaaaggacaaagtcacgagcccgaaaatttgatgcccacgcaaattattccgggaaccgcgctgtataacatcggagacatggtccacgcggcaaggggaaagtggggaattaaagccaattgcccctgcatttcccgtcagaacaaaagcgtgctgcgaccagctgttactaatggaatgtcgcagcttccctccatcaatccatcagcgagctctggaaacgagactaccttttcgggtggcggaggcccggcacctgtaaccaccccggagcctgatcacgtgccaaaggccgatagtactgacattcgcagcgaggaacctctgaaaacagattcgtctgcctcaaacagtaattcagagttaaaggcaattcggcctccctgtcccgatactgcccctccctcatcagctttgcattggttggcagacctggccactcagaaagcgaaggaggagaccaaggaggctggctcactgaggtctgtgttgaataaagaatcgcacagccctttcgggctggattccttcaatagcactgctaaggtctctccgctgactcctaagcttttcaactcactactacttggtcctaccgcttccaataacaaaacagaagggagttctctgcgagatctgttacattccggcccagggaaacttccacaaacccctctagacaccggtatcccattcccacccgtgttctcaacttctagcgctggcgtgaagtcaaaggctagtcttccgaacttccttgatcacattatagcatccgtggtcgagaataaaaagacgagcgacgccagtaaaagggcctgtaatctcacggatacacagaaggaggtcaaggaaatggtgatgggactgaacgtcctggatccccatacaagccattcttggctgtgtgatggtaggctcctgtgtctccatgacccgtccaacaagaacaattggaaaatttttagggaatgctggaaacagggacagccagtgttggtgtccggagtccataaaaaactcaagagcgagctgtggaagcctgaagccttcagtcaggaattcggagaccaggatgtggatcttgttaactgccggaactgcgctatcatcagtgatgtgaaggtgcgcgacttctgggatggtttcgagattatttgtaagaggttgcggagcgaggacggacagcccatggtattgaaactcaaagactggccacctggagaggattttagggatatgatgccaacacgcttcgaggacctcatggaaaatttgccactgccagaatacacgaaaagggacgggaggctcaacttggctagtaggctgccctcatactttgtaagacctgatctgggtcccaaaatgtacaacgcctatggccttatcacagcggaggaccgccgagtgggcacaactaacctccaccttgatgtgtctgacgcagtcaacgttatggtgtatgtcgggattcccatcggagaaggcgcccacgacgaagaggtgcttaagactatagacgagggcgacgcagatgaggtcactaaacagcgcatacacgacggtaaggagaaaccaggtgcactgtggcatatctatgcagccaaggatgctgaaaagattagagaattgttaagaaaagtgggcgaagaacagggtcaagagaatccgcctgatcacgacccgatacatgaccagtcttggtacctggaccagacattgagaaagcgcctctacgaggaatacggcgtgcaaggttgggctatcgtgcagttcctcggggacgccgtcttcattcctgcaggggctccccatcaggtccacaacctatactcctgcatcaaggttgccgaagacttcgtcagcccagaacatgtgaaacactgctttaggttgacgcaagagttcagacacctgtcaaatacccacaccaatcacgaggacaaattacaggtgaaaaacatcatatatcatgctgttaaggacgcggtgggcaccctgaaagctcacgaatctaaactagcaaggtcctag

SEQ ID NO: 122881 - DNA, 2148 bp, Artificial Sequence
  Description of Artificial Sequence: Synthetic coding sequence
atggcaggggttggacccggaggctacgcagctgagtttgttccacctcctgaatgtcctgtctttgagccctcttgggaagagtttacagaccctctttcttttataggtcggatacgccctcttgctgagaaaaccggaatttgcaaaattcgcccccctaaagaatatgcactatccggttggaatttgaataatatgccagtgctagagcagagcgtacttgcccatatcaacgtcgacatttccggtatgaaagtgccttggctgtatgtgggtatgtgtttctcctcattctgttggcatattgaggatcactggagctactccataaattatctgcattggggggaacctaagacgtggtatggagtcccctcccacgccgcagagcagctggaagaggtgatgagggaattagcccctgagctgttcgaatcgcagcccgatctccttcaccaactggtgaccatcatgaaccccaacgtgctgatggagcacggcgtgccagtgtataggaccaaccagtgcgctggcgaattcgttgtgacctttcctcgcgcttaccactctgggttcaaccagggatacaattttgctgaggccgttaacttctgtaccgctgactggttacctattgggcgccagtgtgtgaatcattaccgtaggctccgaagacactgcgtcttttcccacgaagaactcatctttaaaatggccgcagaccctgaatgtctggacgttggtctcgccgcgatggtttgcaaggagctgaccctgatgacagaggaagagacccggctgagagagtctgtggttcaaatgggagtcctgatgagcgaggaagaggtgttcgagctagtgcccgacgacgagcgccaatgtagcgcatgtcgaacaacgtgcttcctctcagccttaacctgtagttgcaacccagagaggctagtctgcctttatcacccaaccgatctttgtccttgtcccatgcaaaaaaaatgtctccggtatcggtatcctttggaggacctaccatctttgttgtacggagttaaagtcagggcccaaagctacgatacatgggtgtctcgcgtgaccgaggcactctccgcaaattttaatcacaagaaggacctgattgagctacgggttatgctggaagacgctgaagatcgtaaatatccagagaatgacctattccgaaagcttcgtgatgccgtgaaggaggctgagacctgcgcgtcggttgcacagctgttactctctaaaaagcagaaacacaggcagtcacctgactcaggtaggactaggactaagctgaccgtggaggagctaaaggccttcgtccaacagcttttctcactaccatgcgtaataagccaagcgcgccaggtcaaaaacttgctcgacgacgtggaggagtttcatgagcgagcccaggaagccatgatggatgagacgcccgactccagtaagttacagatgctcatagatatgggatcctccttatacgttgaacttccagaactcccaaggctcaagcaggaattgcagcaggcacgctggttggacgaagtgcggctgacactctctgatccacagcaagttaccctggatgtgatgaaaaaacttatcgatagtggagttggactcgcaccgcatcatgccgtcgaaaaagctatggccgaactgcaggaactgcttacagtctctgagcgatgggaggagaaggccaaagtttgccttcaggctcggccccggcacagcgtagcgagcctggaatccattgtcaacgaggcaaagaacatccctgcctttttgccgaacgtgctcagcctgaaagaggccctccagaaggccagagaatggacagctaaagtcgaagctattcaatcgggctccaattacgcttacctagagcagcttgagtccctatccgctaaaggccggcctatccccgtgaggcttgaagccctaccccaggtggaaagtcaggttgctgctgcgcgagcctggagagaaaggactgggagaacatttctcaagaagaattcctcccacacactgctccaagtgctaagtcccagaacagatataggagtgtacgggagcggcaagaacaggcgcaaaaaagtgaaggagctgtag

SEQ ID NO: 122882 - DNA, 4911 bp, Artificial Sequence
  Description of Artificial Sequence: Synthetic coding sequence
atggccggcgtggggccaggggggtacgcagctgagttcgtgccaccaccagaatgcccagtgttcgagccttcttgggaagaattcacagaccctctgagcttcataggcagaatccgtcctctggccgaaaaaacgggaatctgtaagatacgaccacccaaggattggcagccacctttcgcatgcgaggtgaaatccttccggttcacaccaagagtccagcggctcaatgagctggaggccatgacacgggtgcgcttggactttctggaccagcttgccaagttttgggagcttcaggggtccacgctgaaaattccagtggtggagcggaagattcttgatctgtatgccttatctaaaatcgtagctagcaagggaggctttgagatggtgacaaaggagaaaaagtggtcgaaggtcggctctcgcctgggatatctgccaggaaaagggactggatcgctgctgaagtcccactatgagagaatcctgtacccatatgagctctttcaaagtggtgtgagtctgatgggggtccaaatgcccaacctggacctgaaggagaaggtggaacctgaagtcctttcaactgatactcaaaccagcccagaacctgggacacgaatgaatatccttccaaagaggactagaagagttaagacccaatccgagtcaggagacgtctctcgtaacaccgagctcaagaagctccaaatctttggcgccggcccgaaggtggtgggactagctatgggcaccaaagataaagaggatgaggtaacccgacgacgcaaggtaaccaatcgatccgacgcattcaacatgcagatgcggcaacggaaaggaacccttagtgtaaactttgttgatctgtacgtatgtatgttctgtggccgtgggaataacgaggataaattacttttgtgcgacggatgcgacgattcctaccacacattctgtctcattccaccactacctgatgttccaaaaggcgactggcgatgccctaagtgcgtcgctgaagaatgtagcaagccacgtgaggccttcggtttcgaacaggccgttcgggagtataccctacagtcctttggggagatggcagacaacttcaagagcgactacttcaacatgcccgttcacatggtgcccacggagttagttgaaaaagaattttggcgcctcgtgtcatctatcgaggaggatgtgattgtggagtatggggccgacatttcatccaaagatttcgggagcggcttccctgtcaaggatggccggcgaaagatccttccagaagaagaggagtacgctctgtctgggtggaatctgaacaatatgcctgtgctggagcagagtgtgcttgctcacattaacgtggatatcagcggcatgaaggtgccttggctgtatgttggcatgtgcttttcgtccttttgttggcatatcgaggaccactggagctatagcattaactatctccactggggcgaacccaaaacttggtatggggtcccgagccacgcggcagagcagctcgaagaggtgatgagggaactcgcacctgagttatttgaatcccagcccgatctgctccaccagctggtgacaatcatgaaccctaatgtcttaatggagcatggcgttccagtttataggaccaaccagtgcgccggggaattcgttgtcacgtttccaagagcataccactcaggctttaatcaaggctacaattttgccgaagctgtcaacttctgcactgcagactggctgccaattgggcgtcagtgtgttaatcactatagaaggttaaggagacattgtgtcttctcccacgaggagctgatttttaagatggctgcagacccagagtgcctggatgtggggctggctgccatggtgtgcaaggaattaacattaatgaccgaggaagagacacgattgcgagaaagcgtcgtgcaaatgggcgtgctgatgtccgaagaggaggttttcgaacttgtgccggacgatgagcgtcaatgctctgcttgcaggacgacttgttttttgagtgcgctgacgtgtagctgcaaccctgaacgtctggtttgtttatatcatcccacagatctgtgcccatgcccaatgcagaaaaagtgtctccgctaccgctacccccttgaggatctgccatccctcttgtatggggtgaaggtcagggcccagtcttacgatacgtgggtcagccgggtgaccgaagccctgtctgccaacttcaatcataaaaaggacctcatcgaactccgcgtgatgttggaagatgctgaagaccgcaaataccctgagaacgacttatttcgaaaactcagagacgccgtgaaagaagctgagacctgtgcttcagtcgcacagttgttgctgtctaagaaacagaagcacaggcagagccctgatagcggccgaacgcgtacaaagttgacagtcgaggaactcaaggcattcgtgcaacagctgttcagtctcccttgtgttatctcgcaggctaggcaggttaagaatctccttgacgacgtggaggaattccatgaaagggctcaggaagctatgatggacgagacacctgactcatcaaagctccagatgctgattgacatgggaagttctctctacgtagagctgccggagctaccccgactgaagcaggaactgcagcaggctaggtggttagatgaagttaggcttactctttctgatccacagcaggtaacgcttgatgtgatgaaaaagctaatcgactctggtgtgggactggccccacaccacgcagtagagaaagcgatggccgagcttcaagagttacttactgtgagcgaacgatgggaagaaaaggctaaagtttgtctccaggcaagacctagacacagtgtggcttcgcttgagtccatagtcaacgaggccaagaacattcccgccttcttgccgaatgttctgagcctgaaggaagcgctacagaaagcccgtgagtggactgcaaaggtggaagctatccagtccggtagcaattacgcatatcttgagcagctcgagagcctctccgccaaaggaagaccaataccagtgcggctcgaggctttgcctcaggttgagagccaggtagcagctgcccgagcatggagagagaggaccggccggaccttccttaaaaaaaactcttctcacaccctactgcaagtgctgtccccccgcactgacatcggcgtctacggcagcggcaagaaccgaaggaagaaggtaaaggaactaatcgaaaaagaaaaggagaaagatttggatctggagccgttgtctgacctggaggagggtctcgaggaaaccagagatacagccatggtcgtcgccgtgtttaaagagcgcgagcagaaagagatcgaggcaatgcactccttacgggctgccaacttagcaaaaatgactatggtggacaggatagaggaggtgaagttttgtatctgcaggaagactgcgagcggtttcatgttacagtgcgagctgtgtaaagactggtttcacaacagttgtgtgcctctgccaaagagtagctcccagaagaagggctcctcttggcaggcaaaggaagtgaagtttctttgtcccctctgtatgcgctctcggcgacccagactggagacgattttgagcctgctcgtctccttgcagaagttgcccgttagactgccggagggcgaagcattgcagtgtctaacagaaagggccatgtcgtggcaagatcgcgccagacaagcacttgcgacggacgagctaagctcagctttggcgaaattatccgtactcagtcagaggatggtcgagcaggccgcaagagaaaagacagaaaagattatcagtgctgagttgcaaaaagcagcggcaaatcctgatctgcaaggacacctgcctagcttccaacagagcgccttcaaccgtgtcgtgagctcagtctcatcctccccgcggcagactatggattatgacgatgaagagacagattctgacgaggatatcagagagacatatggatatgacatgaaggacacagctagtgtgaagtcatcatctagtctggagccaaacctattttgcgacgaagagattccaatcaagtccgaggaggtggttactcacatgtggaccgctccgtcattttgtgcagagcacgcttactcctcagctagtaaatcatgtagtcagggttcgtcaaccccacggaagcagcccaggaagagtccactcgtcccaagaagccttgagccccccgtgctggagctcagtcccggagctaaagcccaacttgaggaactgatgatggtgggagacttactggaggtgagtctcgatgagacgcagcacatctggcgcatcctccaggcaacccaccctccctccgaggaccggttcctccatataatggaagatgatagcatggaagaaaagccactgaaagtcaagggcaaggatagctctgagaagaagaggaagcggaagcttgagaaggtggagcagttattcggagaaggcaagcagaagtctaaagaactgaagaagatggacaagccaaggaaaaagaagctgaagctaggcgccgacaaaagcaaggaactgaacaagctggccaaaaagctggccaaagaagaggagcgcaagaaaaaaaaggaaaaggccgccgctgccaaggttgagctggtcaaagagtccactgaaaaaaagcgggagaaaaaggtgttggatattccctctaagtacgactggagcggggcggaggaatctgacgacgagaatgctgtctgcgctgcccagaactgccaacggccctgtaaggacaaaggcgtcgtcttcgtaacagaggaggaaaagaacaaaaagtattag

SEQ ID NO: 122883 - DNA, 3150 bp, Artificial Sequence
  Description of Artificial Sequence: Synthetic coding sequence
atggcaggcgtgggtccgggaggctatgccgctgagttcgtgccccccccagaatgtccggtgttcgagcctagttgggaggagtttaccgatccactctcctttatcggtcggatacgccctctagcagagaagacaggcatctgcaagattaggccacctaaagactggcaaccacctttcgcgtgtgaggtgaagagttttcgcttcacccctagagtccaaagactaaacgaattggagatcgtggcatctaagggcggttttgaaatggtgacgaaagaaaaaaagtggtccaaagtcggttctcgactaggctacttgccaggtaaagggactggatccctcctgaaaagccactatgagaggatcctctacccctacgagctgttccaaagcggcgtttctctaatgggtgtccaaatgcccaatcttgaccttaaggaaaaagttgaacccgaggtcttatccacagacacccagacttcaccagagcccggaacacggatgaacatcctccccaaaagaactcgccgagtcaaaactcagtccgaatcgggagacgtatccagaaacaccgagcttaaaaaacttcaaattttcggggcaggaccaaaagtagtgggtttggcgatgggaacaaaagataaagaggacgaggttacacgaagaagaaaagtcacaaaccgatctgatgcatttaatatgcagatgcgccagcggaaaggcacactgagcgtcaacttcgttgatctctacgtgtgcatgttttgcggacgcggtaacaatgaggacaaattactcctctgcgacggatgcgatgacagttaccatactttttgcctgatccctccacttccagatgtgccaaaaggggattggaggtgtcccaaatgcgtggccgaagagtgcagcaaacctcgggaagctttcggctttgaacaagcggtgagagagtatacgctgcagtccttcggagaaatggcagataattttaaatcagactacttcaatatgcccgtgcacatggtgcccacagagctagtggaaaaggagttttggagactggtgtcctcaatcgaggaagacgtcatagttgaatacggggctgatatcagctcaaaagatttcggatccggcttccccgttaaggatggccgacggaagatcctacctgaagaagaagaatatgccctctccggctggaacttgaacaatatgccagtgctggaacagtccgttctcgcgcatatcaacgtggacatttccggcatgaaggtcccttggctctacgttggaatgtgcttttcgagtttctgctggcatatcgaagatcactggtcatactcaattaattacctgcactggggggagcccaagacatggtacggagtgcccagtcacgctgccgaacaacttgaagaggtaatgcgagaactggcccctgagttattcgagtctcagccagatctactccatcagctagttactatcatgaatccgaatgtcctcatggagcacggagtgcccgtgtaccggaccaatcaatgcgctggggaatttgtcgtaacatttcctagagcctatcactcgggttttaatcagggctacaattttgcagaggcggtcaacttctgtaccgctgactggctgcctatcggccggcagtgcgttaatcactaccggcggctgcgcagacactgtgtctttagccatgaggaacttatatttaagatggctgccgatccagagtgcttggacgtaggactggctgccatggtctgcaaagagcttaccctcatgacagaagaggagacccgcctaagggagagcgtggtccagatgggcgttcttatgtctgaagaggaagtttttgagctggtgcccgatgacgaacggcaatgcagcgcatgtcggacgacttgctttttaagcgcccttacatgcagctgcaatcctgagaggctggtgtgcctgtaccacccgactgatctatgcccttgcccgatgcagaaaaaatgtcttaggtaccgttatccgttagaagacctgccgagtctgctctacggcgtaaaagtcagggctcagtcttatgatacctgggtgagccgagtaacggaagctctatcagctaatttcaaccataaaaaggacctgatcgagctgagagtgatgctggaagacgccgaagacaggaaataccccgaaaatgacctgttcagaaagctccgcgatgctgtgaaggaggcggagacctgtgccagcgtggcacagttgctcctgtctaagaagcagaagcatagacagagcccggatagtgggaggactcgtaccaagctgactgtagaggagcttaaggcctttgtccagcagctgttctcattgccctgtgtgatctcccaggcccgccaggtcaagaacctcctggatgatgtagaagagtttcatgagagggctcaagaggccatgatggatgaaacccctgattcgagtaaactgcagatgcttatcgacatggggtcatcactgtatgtagagctgccagaactgcccaggctcaagcaggaactacaacaggcccgatggctggatgaggtgcgcctgactctgtcggatccacaacaggtcacactggacgtgatgaagaagctcattgatagcggtgtggggctggccccacatcacgccgtggagaaggccatggcggaactccaagagctcctgaccgtctctgaacgctgggaagagaaggctaaggtgtgtttacaggccaggccgcgacatagcgttgcaagcctggaatcgatcgtcaatgaggccaaaaatatacctgcatttctcccaaacgttctgtctttgaaagaagcacttcagaaggctcgcgaatggacagcgaaggtggaagctatccagtccgggagtaattacgcctatctggaacaactcgaatccctttccgcaaaaggtcgacctattcctgtgagactggaagcgctgccacaggttgagagtcaggtcgctgcagctcgggcatggagagagcgtactggccgaacattcctcaagaaaaattcatctcacaccctgctgcaggttttgtccccaagaacagacattggcgtctacggatccggaaagaatagaaggtag

SEQ ID NO: 122884 - DNA, 5073 bp, Artificial Sequence
  Description of Artificial Sequence: Synthetic coding sequence
atggctggagttgggccaggaggatacgcggcagagtttgttcctcctcccgagtgccccgtcttcgagccaagctgggaggagtttacggaccccctgtcgttcatcggcagaatacgtccactcgcagagaagacaggaatttgcaaaataagacctcctaaggactggcaacccccctttgcatgtgaagtcaagtcttttagattcactccacgtgtccagcggctaaatgagctagaggcaatgactcgggtgaggcttgattttctggaccaattggcaaagttttgggagctgcaggggagcaccctgaaaattcctgtggtggagcgcaagatattagatctttacgcattatccaaaattgttgcttccaaaggcggtttcgagatggtgacgaaggaaaaaaagtggagcaaagtgggttctcgtctcggctacctgcccgggaaaggcacggggtctcttctgaagagtcactacgaacgcattctgtatccctacgaactgtttcagagtggcgtcagtcttatgggcgtacagatgccgaatttggatctgaaagaaaaggtcgagcccgaggtcctctctactgatacccaaacgtcaccagaaccaggcaccagaatgaatatcctccccaaaagaacaaggcgcgttaaaactcagagtgagagtggagacgtttctaggaatacagagcttaaaaagttacagatttttggcgccggcccaaaggtggtgggtctagcaatgggaacaaaggataaggaggacgaggtgacccgccgcagaaaggtcacaaataggagtgatgcctttaatatgcagatgcgccagcgcaagggcaccttgagtgtgaatttcgtggatctctacgtgtgtatgttctgcggtagaggcaacaatgaggataaactgctgctctgtgatggatgcgatgattcataccacaccttctgtctcatacccccactgccagacgtacccaagggggactggagatgtccaaaatgtgttgcagaggaatgttctaaaccaagagaagcgttcgggttcgagcaggccgttagagaatacacgctgcagtcctttggggagatggcagacaacttcaagagcgattacttcaatatgccagtgcatatggtgcccacagaactggtggagaaggagttttggagacttgtcagtagtatcgaggaggacgttattgtcgaatacggggccgatatctcgtctaaggatttcggttccggctttcccgtgaaagacggccgacgtaagatccttccagaagaggaggagtacgcactctctggctggaacctcaataacatgcctgtcctagagcagtcagtcctcgcccatatcaatgtcgatattagtggcatgaaggtcccctggctatatgtgggaatgtgctttagctcattttgttggcatatcgaagaccattggtcctacagcataaactatctacactggggagagcctaaaacatggtacggtgtccctagtcatgccgccgaacagctggaagaagtgatgagagagctggcccccgagctattcgagagccagccagatttacttcatcagctggttaccattatgaatcccaatgtgctcatggagcacggagtgccagtgtacaggaccaatcagtgcgcaggcgagtttgtggtcaccttcccccgtgcataccacagcggttttaaccagggttataatttcgccgaagctgtaaacttctgcaccgccgattggctgcccattggtcgccagtgcgttaatcactatagacgactgcgacgtcattgtgtgttctcacacgaggaactgatatttaaaatggcagctgatccagaatgtctggacgtgggcctggcagccatggtgtgtaaggagctgaccctgatgacagaggaggagacacgcctccgcgaaagcgtcgtgcaaatgggggttctgatgagcgaggaagaggtgttcgagctggtgccagacgacgaacgacaatgttctgcatgtcgaaccacttgttttctgagtgccttaacttgcagctgcaatcctgagcggctagtctgtctgtaccatcccacagacctctgtccatgcccaatgcagaagaagtgcttacgatacaggtaccctctcgaggatttacccagcctgttgtacggggtgaaggtgcgcgctcagtcatacgatacatgggttagtagagtgactgaagcactgagcgctaatttcaatcacaagaaagatctcatagaactgcgggttatgctggaggacgccgaggatagaaagtacccggaaaacgacctctttagaaagctcagagacgcggtcaaagaagctgagacttgcgcgagcgttgctcaactactcttaagcaaaaagcagaagcataggcagtcaccggatagtggtagaaccagaaccaaactcactgtcgaagagcttaaagcctttgtgcaacagcttttcagtctgccctgtgttatttctcaagccagacaggtgaaaaaccttctcgatgatgtggaggaattccacgagagggcccaagaggcaatgatggacgagaccccggatagtagtaaattgcagatgctcatagacatgggctcatctctgtacgttgagttaccggaactcccaagactgaaacaggagctccagcaggctcggtggctggacgaagtgaggcttacccttagcgacccacaacaggtcacgctggacgtgatgaaaaaactcattgactccggagtgggtctggctccacatcatgcagtggaaaaagccatggctgagttgcaggagctgctcacagtcagcgagagatgggaggagaaggcaaaggtgtgcctgcaggcaagaccaagacactctgttgccagcctggaatctattgttaacgaagctaaaaacatccccgcatttttacctaatgtgctgtcgctaaaggaggcccttcagaaggcgagagaatggaccgccaaggtggaagccatacaatccgggagcaattatgcttacctggaacagctggagagcctgagcgcgaagggcagaccaatacccgttagactcgaggctctaccccaagtcgagagccaggtggctgccgccagggcgtggcgcgagaggacagggcggacttttctgaaaaaaaacagctcacacaccctccttcaagtgctgagccctaggaccgatattggcgtatatggatctgggaagaatagaaggaaaaaggtgaaggaattaatcgaaaaagagaaagagaaagacttggacctcgagcccctgagcgatcttgaagaggggctcgaggaaactagggacaccgccatggtcgtggccgtctttaaggagagggagcagaaagagatcgaggcgatgcattcgctgagggccgccaacttggccaagatgactatggtcgatagaattgaggaagtgaagttttgtatttgcagaaaaacagcctcaggttttatgctccagtgcgagctctgtaaagactggttccataattcctgcgtgccactgccgaagtcctccagccagaaaaagggctcttcttggcaggcaaaggaggtgaagttcctctgcccgctctgtatgcgctcaagacgcccaaggttggagacaattttgtccttactggtgagcttgcaaaagctgccagttaggcttccagaaggcgaggcactgcaatgcttaaccgagagggccatgtcctggcaggaccgggcccgccaggctttggccacagatgaactcagctcagctcttgccaagttgtccgtgctgtcccagcgaatggtcgaacaagccgcacgcgagaagactgaaaaaatcattagcgctgaactgcaaaaggccgccgcaaaccctgacctgcaaggccacctgccatcattccagcagagcgcatttaacagggtcgtgtcatccgtatccagcagcccgagacagacaatggattacgatgacgaggaaaccgacagcgacgaagatatcagagagacatacggctatgacatgaaagacactgcctcagttaaaagcagttccagtctggaacctaacctgttctgcgacgaagagatccccattaagtcagaagaagttgtgacacacatgtggactgccccttcgttctgtgccgaacatgcatatagttccgcctctaagtcctgcagccaaggaagtagtacaccccggaaacaacctaggaaaagccccttggtgccccgttctctagagcctccagtgttggaattgtctccaggcgcgaaggcccagcttgaagagttaatgatggtcggcgacctgttggaagtctcgctggatgaaacgcaacacatttggagaatccttcaggctacccatcctccttccgaggacaggttccttcacatcatggaggatgactccatggaagagaaaccactgaaagtgaaaggaaaggattcttccgaaaagaagcggaaaagaaaattggagaaagtcgagcaattatttggggaaggcaagcaaaaatctaaggaactgaagaaaatggataagccgaggaagaagaagttaaagctgggcgcggataagtcaaaagaactcaataagctggccaagaagcttgcaaaagaagaagagaggaagaaaaaaaaagaaaaggccgccgcagcgaaagttgagcttgtgaaggagtctacggaaaaaaagagagaaaaaaaagttcttgacatcccttctaagtatgactggtccggtgcagaggaaagcgatgatgaaaatgcagtgtgcgcggcacagaattgccagcgcccttgtaaggataaagtggactgggtacagtgcgacggcggatgtgacgaatggttccatcaggtgtgcgtgggagtgtctcctgaaatggccgaaaatgaggactacatatgtattaactgtgcgaagaaacaaggcccagtgagcccaggaccagccccaccccccagctttatcatgagttacaaattgccgatggaagatctcaaggaaactagctag

SEQ ID NO: 122885 - DNA, 3828 bp, Artificial Sequence
  Description of Artificial Sequence: Synthetic coding sequence
atggggtttgctcctggcaaggctgtagggagccacatcaggggccattatgaaaggatactgaatccatacaatcttttcctcagcggggatagcctcagatgtttacaaaaacctaacctcacaaccgataccaaggataaggagtataagccccatgatatcccacagcggcagagcgtccagccgtccgagacctgcccccctgcacgacgtgccaaaaggatgcgtgccgaggccatgaatatcaaaatagaaccagaagagaccacggaagccaggacccacaaccttcgaaggaggatgggctgtccaactcctaagtgcgaaaacgaaaaggagatgaaatcctctatcaagcaagagcccattgagaggaaggactatatcgttgaaaacgagaaagagaaaccaaagtcccgctcgaaaaaagctactaatgctgtggatctatacgtgtgcctgctgtgtggtagcggcaatgacgaagatcggctgctactttgtgacggctgcgacgacagctaccacacgttttgcttgattcctccactccatgacgtgcctaagggggattggcgatgccccaaatgcttggctcaagagtgcagcaagcctcaagaggccttcggctttgagcaggctgctagagactataccctcaggacattcggcgaaatggcggatgcattcaagagcgattactttaatatgccagtgcatatggtcccaacagagctcgtagagaaagagttttggcgtctcgtctctactattgaggaagatgtcaccgttgagtacggagcagatattgcctccaaagagtttggctctggatttcctgtaagggacggtaaaatcaagctatcaccagaagaagaagagtatttggactcagggtggaacctgaataacatgcctgttatggaacaatcggttctggcccacattactgccgatatctgcggaatgaagctgccttggctgtatgtgggaatgtgtttcagttccttctgctggcacatcgaggatcattggtcgtactccattaattatttacactggggggagcctaagacctggtatggggttccagggtatgcagctgaacaattggaaaatgttatgaagaagctggctcccgagctgttcgttagccagccagatctactgcaccaattggtgaccataatgaaccccaacacacttatgacacacgaggtgcctgtatatagaactaatcagtgtgccggggaatttgttatcacctttcctcgcgcctaccattcaggctttaatcagggcttcaatttcgccgaggccgtgaacttctgtacggtcgattggctgcctctgggcagacagtgcgtggaacactacagattgctgcatcgctattgcgtttttagccacgatgagatgatatgcaaaatggcctccaaagcagacgtcctcgatgtggttgtcgcttctaccgtgcagaaggacatggctattatgatcgaggatgagaaggctctaagagaaacggtgcgaaagttaggagtcatcgatagcgaaagaatggatttcgagctcctccctgacgacgagaggcagtgtgttaagtgcaagacaacctgtttcatgtcagctataagctgttcatgtaagccaggcctgctggtgtgcttacatcacgtgaaggagttgtgttcatgtccaccatacaagtacaagttgcgctatcgctataccctggatgacttataccccatgatgaatgcattgaagctcagggcggaatcctataacgaatgggccctcaacgtcaacgaagctctggaggccaaaatcaacaaaaagaagagcctggtgtcctttaaggccctcatagaggagtccgagatgaaaaagttccctgataacgacttgctcaggcatctgcgactcgtgacccaagacgctgaaaagtgcgcaagcgtggctcaacagctgcttaatggcaagagacagacaaggtaccgaagtggcgggggcaaatcccagaaccaactcactgtgaatgagctgaggcagtttgttactcagctgtacgccctcccttgtgtgctctcgcagacacctttgcttaaagacctgctcaatagggtagaggactttcagcaacacagccagaaactgctgagcgaggagaccccctccgcagcagaattgcaagatcttttagacgtgtcgttcgaatttgatgtcgaactgccccagttagccgagatgagaattcgtttggagcaggctcgttggcttgaagaagtacagcaagcgtgtttagacccatcaagtttgaccctggacgacatgcgcagactgattgacctcggcgtgggtctcgcaccttactccgcagtagaaaaagccatggcccgcttacaggaactattgaccgtatcggagcactgggatgacaaggccaaatcacttctgaaggctagaccccgacattccctgaatagcctcgccaccgcagtgaaagagatcgaggagattccagcctacctcccaaatggagctgcactcaaggacagcgtgcaaagagcaagggactggctgcaggacgtggagggtctgcaggccggaggacgagtgccggtacttgatacgctaattgagttagttacccggggccgttctatcccagttcatctgaactccctgcctaggttggagaccctagtggcagaggtgcaagcatggaaggagtgtgcagttaacacatttctgaccgaaaactccccatacagcctcctggaagtgctgtgtccacgctgcgatattgggctgctgggcctgaagaggaagcaacggaagctcaaggaaccgctgccaaacggcaaaaaaaagtctaccaagctcgaatctctgtctgatcttgagagggcactcaccgagagcaaggagaccgcttcagctatggccaccctgggagaggccagactccgcgagatggaggcgctgcagtcactgaggctcgctaacgagggtaagctgctttcgccgctccaggacgtggacataaagatctgcctgtgccaaaaggccccggctgccccaatgatccagtgtgagctctgcagggacgcattccacaccagctgtgtggccgtaccctcaatttcgcaaggattgagaatatggctgtgcccccactgcaggcgatctgaaaagccccctctggagaaaattttaccattactcgccagcttacaaaggatcagggtgagacttcctgaaggagacgcactgagatacatgatcgagcggacagttaactggcagcaccgcgcacagcagcttctgtccagtgggaacttgaagttcgtgcaggatagagtggggtcaggactcctgtactcaaggtggcaagcaagtgccggccaagtaagcgatactaacaaagtttcacagccacccggtacaacttcattctccctgccagacgattgggataaccggactagctacctgcacagcccattttcaaccggccgatcctgtatcccgttgcacggagtttctcctgaggtgaatgaactgctaatggaggcgcagctgctccaggtttccctccccgaaatccaggagctatatcaaactttactcgccaagccttcaccagcgcagcagaccgacaggagcagccctgttcgaccctcttctgaaaaaaacgattgttgtcggggaaaaagggatggaatcaactccctggaacgcaagttgaagaggcgcctagaacgtgagggcctgagcagcgaaagatgggagcgcgtcaaaaagatgcggactccctag

SEQ ID NO: 122886 - DNA, 4743 bp, Artificial Sequence
  Description of Artificial Sequence: Synthetic coding sequence
atggaagcagccaccactctacaccctgggcccaggcccgccctgcccctaggaggaccggggcccttgggggaatttctgccacccccagaatgtcccgtcttcgaaccatcgtgggaagagttcgcagatccttttgcatttatccataaaattcgccccatcgccgagcagacaggcatttgcaaggtgagacctcccccagattggcaaccacccttcgcgtgcgatgtcgataaactccactttaccccacgaattcagcgcctcaacgaactggaagcccagacaagggtaaagctgaattttctggatcagatagctaagtattgggaacttcagggcagtaccctgaaaatcccccacgtggagaggaaaattctggatctgttccagctcaacaaactcgtcgccgaagaaggcggctttgcagtcgtgtgtaaagacaggaaatggactaaaattgctactaaaatgggctttgcgcccggtaaagcggtggggtctcacattcgggggcactacgaacgaatcttgaacccgtataatctttttctgagtggtgattcactaagatgcctccagaaacccaacctcactacggacactaaagacaaagagtataagccacacgacatcccacagaggcagtctgtgcagccgtcagaaacgtgtcctcctgccaggagggcaaaacgtatgcgcgccgagcggcagagtctcgctgttttgcctcggcttgaatgctcaggggccattctggcccactgtaacctacggctactggactctagcaactcctcagcctctgccagccaagccatgaatatcaaaattgagccggaagaaacaaccgaggctagaacacacaacttacgccgtagaatggggtgtcccacacccaagtgcgaaaacgaaaaggaaatgaaatcaagcatcaaacaagaaccaatcgaaagaaaggattacatagtggagaacgagaaggaaaagccgaaaagccgcagtaagaaagccaccaatgcggttgacctctatgtgtgccttctgtgtggtagtgggaacgatgaagatcgcctcttattatgtgatggatgtgatgatagctaccacaccttctgtctgattcccccgctccacgatgtgcccaaaggtgattggagatgtccaaagtgtctggctcaggaatgttcaaagccacaggaggccttcgggtttgaacaggctgccagagactataccctgagaacttttggggagatggcagatgcctttaaaagtgattattttaacatgccagtgcacatggtccctaccgagctggtcgagaaggagttttggcggttagttagtaccattgaggaggatgtgaccgtagaatatggcgcggatatagcctcaaaggaatttgggtcagggttcccagtgcgagatggtaagatcaagctcagccctgaggaggaggagtacctggacagcggctggaaccttaacaacatgccggtgatggaacagagcgttctcgcgcacataactgcagacatttgcgggatgaagttaccctggctttacgtaggcatgtgtttcagctctttttgttggcatatagaagaccactggtcttattccattaattaccttcactggggtgaacccaagacttggtacggggttccaggatacgctgcagaacaactggagaacgtgatgaagaagctggcaccagagctgttcgtctcacagcccgatctgctgcatcaactggtcactatcatgaaccctaacaccctcatgacccatgaggtacccgtgtaccgaactaaccagtgcgccggggagttcgtgatcacatttcccagggcctaccatagcggcttcaaccaaggttttaatttcgctgaggccgtaaacttttgtaccgtggattggcttcctcttggacgccagtgcgtcgaacactataggctgttacaccgctactgcgtcttttctcatgacgagatgatttgcaaaatggcgtctaaagctgacgtgctcgatgtcgtggttgcctcaacagtacagaaggatatggctatcatgatcgaggacgagaaagccttgcgtgagacagtacgaaaactgggcgtgatcgactccgagcgaatggatttcgagctgctgcctgatgacgaaagacagtgtgtgaagtgtaaaacgacctgcttcatgtccgccatttcctgttcatgcaaacccggactgctagtttgcctccaccatgtgaaggagctttgttcatgtcctccctacaagtataagttgcggtataggtataccttggatgatctataccctatgatgaacgctttgaagctgcgtgcggagtcctataacgaatgggctctgaatgtgaatgaagccttggaagcaaaaattaataaaaagaagtccctggtgtcgtttaaagcattgatcgaagagtcagagatgaagaagttccccgataacgatctactcaggcatctcaggcttgtgacccaagacgcagagaagtgtgcttccgtggctcagcagcttctgaatggcaagcgacagactcgatatcggtctggcggcgggaaaagtcagaaccagcttacagtcaatgagctccgtcagtttgtaacgcagctttatgcactgccttgtgtcttgtcacagacaccattattgaaggatctgctgaatcgcgtggaagactttcagcaacatagccagaaactcctttcggaagaaaccccttctgcggcggagctgcaggatttgcttgatgtgagcttcgagttcgacgtagagcttcctcaattagctgagatgagaatacgcctggaacaggccagatggctggaagaggtccaacaagcatgccttgatccttcgtcccttacccttgatgacatgcggcgcttgattgaccttggggtgggcctcgctccatactccgctgtcgaaaaagccatggcacgactgcaagagttgctcacagtcagtgagcattgggatgacaaagccaagtcactactgaaagctcgcccaagacacagtctcaacagcctggctactgccgtgaaagagatagaggaaatacccgcctatctgccaaatggggcggcattgaaggactccgtgcaaagagccagggattggcttcaggacgtggaaggccttcaggctggtgggagagtccctgtgctggacacgctgattgaattggttacccgtgggcggtccatacctgtgcatctcaattcattaccacggctcgagaccctcgtggcagaggtccaagcctggaaagaatgtgccgtcaatactttcttaaccgagaatagcccatatagcctcttagaggtgctctgcccccgctgcgatatcggcctgctgggtctcaaacgcaaacagcggaagttgaaggagcctctgcccaacggcaagaagaagagtacaaaactggagagtcttagtgacctagagcgggctttaacagagtccaaagagaccgctagcgctatggcaacactgggcgaggctcgcctgcgtgagatggaagccctacagtcactgcgtctggcgaacgaaggtaaactcctaagtcccctccaagatgttgacatcaagatttgtctttgccaaaaggcccctgccgccccaatgattcagtgcgagctgtgcagagatgcattccatacctcatgcgtggccgtgccatccatttcacagggcctgcggatctggttgtgtccacactgtcggcgctcggagaagcctccactggagaagatcttaccattgctagccagccttcaacgcatccgggtccgcctccccgaaggggacgccttaagatacatgatcgaaaggacagttaactggcaacatagagcccaacagctgctctcatcgggaaacctgaagtttgttcaggacagagtgggaagtgggctgctatactccagatggcaggcaagcgccggtcaggtttcagatacgaacaaggtatcgcagcctcctggcaccacctcatttagcttgcccgatgattgggacaaccgcacttcctacctgcactcccctttttcgacgggtcggagctgtatccccctgcacggagtgtctcctgaggtcaacgagctgcttatggaggcccaactgctgcaggtgtccctcccagagatccaggagctatatcagactctgctggcaaagccatcccccgcccaacagaccgaccgttcgagtccagtccgccctagcagtgagaagaacgactgttgcaggggaaaaagggacgggatcaattccctggaacgcaagcttaagcgtcgcctggagcgagaaggacttagcagtgaacgctgggagagggtgaagaaaatgcggacgcctaaaaaaaaaaagattaaactgagtcaccccaaagatatgaacaacttcaagctggaacgagaacgcagttacgaactggtacggtcagcagagactcacagtttgccctccgatacctcctactcagagcaggaagactcagaagatgaggatgcaatctgtcccgctgtgtcctgtctgcaacccgagggcgacgaggtggattgggtgcagtgtgatggtagctgtaaccagtggtttcaccaggtctgtgtcggcgtctcacctgagatggccgaaaaagaggattacatatgcgtgcggtgcacagtgaaggacgctccatctcggaaatag

SEQ ID NO: 122887 - DNA, 4635 bp, Artificial Sequence
  Description of Artificial Sequence: Synthetic coding sequence
atggaggctgctaccaccctgcaccctggccctagacccgccctccccctggggggaccggggccccttggagagtttctgcctccacccgagtgcccggttttcgaaccttcatgggaagagtttgccgatccattcgctttcattcacaagattaggccaatcgccgagcagacaggcatctgtaaagtgcgcccgcctcccgattggcagccgccttttgcctgtgatgtcgataaacttcactttactcccaggatccagcggctgaatgaactcgaagctcaaacccgagtgaagctcaactttcttgaccaaatcgctaagtactgggagcttcagggtagcaccctaaagataccccacgtcgagaggaaaattctcgacctgttccaactgaataaactggtggcagaagaggggggtttcgcagtggtgtgtaaggatcgtaagtggactaaaatagcaaccaagatggggttcgcacctggcaaggcagtgggttcccacatccgtggtcactatgagagaattttgaatccatataacctgtttctcagtggtgactctcttcgctgtctgcagaagccgaacttgacaaccgatacaaaggacaaagaatacaagcctcacgatatcccacagcgccagagcgtccaaccatctgagacttgcccacctgcccgacgggctaagcggatgagagctgaggcgatgaacatcaagattgaacctgaggaaaccaccgaagccagaactcacaatcttagacgccgaatgggatgccctaccccgaaatgcgaaaatgaaaaggagatgaagagcagcataaaacaagaaccaatcgagaggaaagattatattgtggaaaatgaaaaggaaaaaccgaagagccggtccaaaaaggcaacaaacgccgtagatctttacgtatgcctactctgcgggtctgggaatgacgaagataggctgttgttgtgcgatggatgtgacgactcgtatcacacattttgcctgattccaccgcttcacgatgtgcccaaaggtgactggcggtgtcctaaatgcctcgcccaagaatgtagtaagccacaggaggcatttgggttcgaacaggccgccagggattacacccttcggactttcggggagatggctgacgcgttcaagtctgattatttcaacatgccagtacatatggtgcctacagaacttgtggagaaggaattctggcgtctggtaagtaccatagaagaggatgtgaccgtggagtacggtgccgatatcgcaagtaaagagttcgggtccggctttcctgttagagacgggaaaatcaagctgagcccagaagaagaagaatatttggactcgggttggaatttgaataacatgccagtgatggagcagtccgtattggctcacatcactgctgatatctgcgggatgaagctgccttggctctatgtgggcatgtgcttcagctccttctgctggcacatagaggaccactggtcttattctattaattaccttcactggggggagcctaagacctggtacggcgtgcctggatatgccgctgagcagctagaaaacgttatgaagaagcttgcccctgagctgtttgtttcccagcctgatctgctccaccaactcgttacgattatgaatcccaatacactcatgactcacgaggtgcctgtctacaggaccaatcagtgtgctggggaattcgtcatcacattcccacgagcctaccacagtgggtttaaccagggattcaatttcgctgaggcagtgaacttttgcactgtggattggctgcctctgggtaggcagtgcgttgagcactaccgactgctgcacaggtattgcgtgttctctcatgatgagatgatttgtaaaatggcgtcaaaagctgatgtgctggatgtggtggtggcatcaaccgtgcagaaggatatggctattatgattgaggatgaaaaggccctgagagaaacagtccgtaaactcggcgtgatcgactcggaaaggatggactttgagctacttccggatgacgaaagacagtgtgtcaaatgtaaaacaacatgtttcatgagcgctatatcctgctcctgtaagcctggactgctggtctgtttacaccatgttaaggagctgtgctcttgccctccttacaagtacaaacttcgatatagatataccctggacgacttatatccaatgatgaatgcattaaaactgagggccgaaagttacaatgagtgggccctaaacgtgaatgaggctctggaggccaagatcaacaagaaaaagagcttagtgagctttaaagctcttatagaggagtcggagatgaagaagttcccagataatgatctgctccgccatctccggttggtgactcaagatgcggagaagtgtgcatctgtggcacagcaactgctaaacggaaaaagacagacccgctaccgttccggcggggggaaatcccagaatcagctgaccgtcaacgaactgagacagttcgtcactcagctgtatgcgctgccctgtgtgcttagtcagacccccttactcaaagacctgctgaatcgcgtggaagacttccagcagcactctcagaaactgttatctgaggaaaccccaagcgccgccgagctccaagacctcctagatgtgtcttttgaatttgacgtggaactgccccagctggccgaaatgaggatccgcctcgagcaagctagatggctggaagaggttcagcaggcttgcctggatcctagcagtctgaccctggatgatatgagacgattaatcgacctcggcgttggtctggcgccttactcagctgtggaaaaagctatggcccgtctccaggaattactaactgtcagcgagcactgggacgacaaggcaaagagtttgctcaaagcccggccaaggcacagccttaattccctggcaactgccgtgaaggaaatcgaggagatcccagcctatctccccaatggcgcagctcttaaagattcggtgcagcgtgcaagggactggctccaggacgtcgaggggctccaggcaggaggcagagtgccagtcctagacactctcattgagcttgttactaggggacgcagcatccccgtccatttaaactcgctgcctcggcttgaaacactagttgctgaggtgcaggcctggaaagaatgcgctgttaacactttcctgacagaaaacagcccatatagtctgctggaagtcctttgtccacgctgcgacattgggctgttgggcctcaaacgcaagcagagaaaactgaaggagcctctgcctaatggtaaaaaaaaatccacaaaactggaatctctaagcgatctggaaagagccctcacggagtcaaaagagactgcctccgctatggcaactctgggcgaggcccggctacgagagatggaagccctgcagagtctaaggctcgctaacgagggcaagctgctctccccactccaggacgtggatatcaagatttgtctatgtcaaaaggccccagcagctccaatgatccagtgcgaactgtgtcgagatgccttccacaccagctgtgttgccgtgcctagtatatcccagggcctacgcatctggctctgccctcactgcagaagaagcgaaaaacctcccctggagaagattctgccactactcgcaagcctgcagagaattagagtgcgattgcctgaaggtgacgctctgagatatatgattgagcggactgtcaactggcagcaccgcgcacagcaattgctgtcatccggcaacctgaagttcgtccaggatagagttggtagcggcctcctctattctcggtggcaagccagcgcaggccaggtatcagatactaacaaagtttctcagcccccaggtaccacaagtttctcccttcctgatgactgggacaacagaaccagctacctccattccccattcagcaccggccggtcctgtattcccctgcatggcgtgtcgcccgaagtgaatgagctgctgatggaagcccagctgcttcaggtgagtttgccggaaattcaggagttgtaccagacactgctggccaaacctagccccgcgcaacagactgaccggagttcccctgtgaggccatctagtgagaagaacgattgctgccggggaaagcgcgatggaattaactctctggagcgcaaactgaaaaggcggctcgagcgagaagggcttagctcagaaagatgggaaagggtgaaaaaaatgaggacccctaaaaagaaaaaaatcaagctatcccaccccaaggatatgaacaactttaaactggaacgcgagaggtcatatgagttggtgcgaagtgcagaaacacactctcttccaagtgatacatcctattccgagcaggaggatagtgaagatgaagatgccatttgcccagccgtctcctgcttgcagcctgaaggcgacgaggtagactgggttcaatgcgatggtagctgtaaccaatggtttcaccaggtctgcgtcggtgtttctcctgaaatggcagaaaaggaggactacatttgcgtacgatgtacagttaaagacgccccatcacgcaagtag

SEQ ID NO: 122888 - DNA, 4161 bp, Artificial Sequence
  Description of Artificial Sequence: Synthetic coding sequence
atggggttcgccccaggcaaagccgtgggctcacatattcgcggccactacgaacggatccttaatccctacaacctgttcttgagcggggattcccttaggtgcctccagaaaccgaacctgacaacagacacaaaagacaaggagtataagcctcacgatatcccacagcggcagagcgttcagccaagtgagacttgtccccctgcgcggagagccaagagaatgcgtgcagaagcgatgaatataaaaattgagcccgaggagacaaccgaagcaaggacacacaacttgagacgcagaatgggctgtcctacaccaaaatgtgagaacgaaaaagaaatgaaaagcagcatcaagcaagagccaatcgaacgcaaagactatatcgtagagaacgaaaaggaaaaaccgaaaagcaggtccaagaaggccactaacgccgtggatttgtacgtgtgcctgctctgcggctccggtaacgacgaagatcgcctgttactgtgtgacgggtgcgatgatagctaccacaccttctgtttgatcccccctctgcatgatgtgccgaagggagattggaggtgtccaaagtgcttagctcaggaatgctcgaagccacaggaagcattcggctttgaacaggctgcccgggattacaccctaaggacctttggagaaatggccgacgccttcaagtctgactacttcaatatgcctgtccatatggtacctacagaattggtggagaaggagttttggagacttgtgtcgaccatagaggaagacgtgaccgttgaatatggcgcagatattgccagcaaagagtttgggagtggctttcccgtgcgggatggaaaaatcaagctttctccagaagaggaggagtatctggatagcgggtggaaccttaacaacatgcctgtgatggagcagagcgtgctcgctcacatcacagctgatatatgtgggatgaagctaccatggctttatgtgggcatgtgcttctcatccttttgttggcatattgaggatcattggtcatattctattaactacctgcattggggtgagccaaaaacctggtacggtgttcccggatacgcagcagagcaactagagaacgtcatgaaaaagctggctcccgagcttttcgtctcccagcctgacctcttacaccagcttgttactattatgaacccgaacaccctgatgacccacgaagtgccagtttacagaacaaaccaatgcgccggggaattcgttataactttccctcgtgcataccactcggggttcaatcagggtttcaacttcgcggaggccgtgaacttttgcactgttgactggctgcctctaggccgccagtgtgtggagcactatagattgctgcaccgctactgcgtttttagtcacgatgagatgatatgcaaaatggcaagtaaggccgacgtgcttgacgttgtcgtggcatccaccgtacagaaagatatggcaattatgatagaggacgaaaaggctctgcgggaaacagtgagaaagttgggcgtgattgactctgagcgcatggacttcgagttgcttcccgatgacgagcgccagtgtgtcaaatgtaaaacaacatgttttatgtctgctatctcctgctcctgtaaacctggtctgcttgtttgcctacaccatgtgaaagaactgtgctcctgccccccatacaaatacaagcttagatatcggtataccctggacgatttgtaccccatgatgaatgcgctgaagttgcgtgccgaaagctataacgagtgggccctcaacgtcaacgaggcccttgaggctaaaatcaacaaaaagaaaagcctggtaagttttaaggctctgatagaagagagcgagatgaagaagtttccagacaatgaccttcttaggcacctgaggctggtgacccaggatgctgaaaagtgcgcatctgtcgctcagcagctgttgaatgggaagcggcagaccaggtaccgctctggaggaggcaagtctcaaaaccagctcaccgtgaatgagctgcggcagtttgtcactcaattgtatgctcttccgtgcgtgctgtcgcagacacccttattgaaagacctgctcaatcgtgtcgaggactttcagcagcacagccaaaaactgctgtcagaagagaccccgtccgcggccgagcttcaggatcttttggacgtgagctttgaattcgacgttgagttgcctcagctggctgaaatgcgcatacgtctcgagcaggctcgctggctggaagaggtgcagcaagcttgcctagacccatcctcccttacattggatgacatgaggagactcatcgatcttggagttggcctggcaccatacagtgcagtggagaaggccatggcccgcctccaagaattgctcacagtgtccgaacactgggatgacaaagctaagtcattgctgaaagcgcgcccgcgccactcattgaattccctggcaacagctgtcaaggagattgaagagatccccgcatacttgccaaacggggcagcgctgaaggattcagttcagcgcgcgcgcgactggcttcaagatgtggagggacttcaagcgggagggcgcgtacctgtgctggatactttgatagagttggttacacgcggcagaagcataccggtgcatttaaatagcctcccccgcctggagactctcgttgccgaggtgcaggcctggaaggaatgcgcagtgaacacatttttaaccgagaactccccttatagcttgcttgaagtgctgtgtccacggtgtgatattgggctgttgggtctgaagcgcaaacagcgcaagctgaaggagccgctgccgaacggaaagaagaagtccactaagctcgagagcctgtctgatttggagcgggcactaacagaatccaaggagacagcatccgccatggctactctcggcgaggcccgcctgagggagatggaagcacttcagtcacttcgcctggctaacgagggaaaactcctgagcccgctgcaggatgtcgatatcaagatctgtctatgccaaaaagccccagccgcccctatgatccagtgtgaattatgccgggatgcatttcatacaagttgcgtggcagtgccctccatttcacagggactgcgcatctggctctgtccacactgtcgccgaagcgagaaaccaccgctggaaaaaatactgccgctcctagcttcgctgcagagaatccgggtgcggctgcctgagggcgatgctttaagatacatgattgagaggacagtgaactggcagcatagagcccaacagctactgtcctccgggaatctgaaatttgtgcaggatcgcgtcggatctgggcttctgtatagccgatggcaagctagcgccggtcaggttagcgatactaataaagtgtcccaacccccgggcaccacgtcctttagcctgcccgatgactgggacaacaggacttcctacttgcacagccctttctccacaggcaggtcttgtatcccactgcacggggtgtctccggaagtgaatgagcttctaatggaggctcaactcttacaggtgtcgttgcctgagatccaagagttgtaccagaccctgttggccaaaccatcccccgctcagcagactgatagaagttcacctgtacgcccaagctcagagaaaaatgattgttgtcgaggcaaacgagacggtatcaacagccttgaaagaaaactgaagcggaggctggagcgagagggcctgtcttctgaaagatgggagagggtgaaaaaaatgcgaacccctaagaaaaaaaaaattaagctgtctcatcccaaggatatgaacaatttcaagctggaacgcgaacgaagttatgagctggtccgttctgcagagactcacagtctgccctctgatacatcctattctgaacaggaggacagtgaggacgaagatgcaatttgccccgccgttagctgcctacagcctgagggggacgaagtcgattgggttcaatgtgatggaagctgtaatcagtggtttcatcaggtgtgtgtcggggtgagccccgaaatggccgagaaagaagactatatatgtgtccggtgcacagtgaaggacgcaccctcccgaaagtag

SEQ ID NO: 122889 - DNA, 933 bp, Artificial Sequence
  Description of Artificial Sequence: Synthetic coding sequence
atgatctgcaagatggcctctaaggctgacgtcctggatgttgtagtcgcctccaccgtacagaaagacatggcaatcatgatcgaagacgaaaaggccctaagagaaacggttaggaagctcggtgttatcgacagtgaacggatggactttgaactcctgcccgacgatgagagacagtgtgtcaaatgtaagacgacttgtttcatgagcgccattagttgcagttgtaaacctggcctcttggtgtgcctgcaccacgtgaaagagctctgctcctgcccgccctataaatacaagttgagatatcgctacacactcgatgacctctacccaatgatgaatgctctaaaactgcgcgctgagtcctacaatgagtgggcgcttaatgtcaacgaagctctggaggccaagattaataaaaaaaagtcccttgttagttttaaagccctgattgaggaaagcgagatgaagaagtttccagacaacgaccttctgcgacacctgcggctggtcacgcaggacgccgaaaagtgcgccagcgtcgcacagcagcttctgaacggtaagcggcagacacgatatcgatctggcggcgggaagagtcagaatcagctcaccgtgaacgagctgcgacaattcgtcacacagctgtatgccctaccctgcgtccttagccagaccccattattaaaagaccttctaaaccgcgtggaagacttccagcagcactctcagaagcttctgtctgaggagaccccttcagctgccgaactgcaggacttgctcgatgtttcttttgaattcgacgtggagctcccccagctggcagagatgcgtatccgtctggaacaggcgagatggctggaagaggtgcaacaggcatgcctcgatccctcatcattgaccctggacgatatgcgggtcagctag

SEQ ID NO: 122890 - DNA, 4674 bp, Artificial Sequence
  Description of Artificial Sequence: Synthetic coding sequence
atggagcccggttcagatgactttctgcccccacccgagtgtcccgtatttgagccatcatgggcagagtttcgggaccccttgggctatatcgctaagattcggcctatcgccgaaaaaagtgggatttgcaagatcaggccaccagctgactggcagccaccgttcgccgtggaggtggataatttccgctttactccgagaattcagagattgaatgagcttgaagctcaaactagggtgaagctcaactacctagaccagatcgccaagttttgggagatacagggctcaagcctcaagatccccaatgtggagcgcaggattctggacctgtattccctgagtaagatagttgttgaagagggcggctacgaggcaatctgtaaggaccgaagatgggctcgggtggcacaacgcttaaattaccccccagggaaaaatattggatccttgttgcggagccactacgaacgcatagtctacccatatgaaatgtatcagagcggagcaaatctagtgcagtgtaatacgaggccattcgacaacgaggaaaaagacaaagagtataaaccgcactccattccgcttcgacaaagcgtccaaccgtctaagttcaactcctacgggcggagagccaagcgcctccagcccgatccggaacctacagaggaagatatcgagaagaaccccgaacttaagaagctccagatctatggcgcaggcccgaaaatgatggggctggggctgatggcaaaggataagacactccggaagaaggacaaggaagggcccgagtgtcctccaacagtagtggttaaggaggagctcggcggggacgtgaaagtcgagtctacctcacccaagacctttctggaatctaaagaggagttgtcccatagtccagaaccatgtactaagatgaccatgcggctacgtcgcaaccacagcaatgcacaatttatcgagtcctacgtgtgcaggatgtgctctagaggcgacgaggatgataagctgcttttatgcgacggttgcgacgataactatcatatcttctgcttattgcctcctcttccagagatccccaaaggcgtatggcgctgtccaaaatgcgtgatggcagagtgcaagaggcctcccgaggccttcgggtttgagcaggctactagggagtacaccctgcagagctttggggagatggccgactcttttaaagccgactattttaacatgcctgtccatatggttcctactgaacttgtcgagaaggaattttggaggctagtcaattcaatcgaagaagatgtgactgtggagtacggcgccgacatccactcaaaagagttcggctccggcttccctgtatccgacagcaagcgacatcttaccccggaggaagaagaatatgcgacctcaggttggaacctgaatgtcatgcccgtgctcgaacagtccgttctctgccatattaatgcagacatctcaggaatgaaggtgccttggctgtatgtggggatggtgtttagcgccttttgttggcatatcgaggaccattggtcttactctattaactatcttcattggggcgagcctaaaacctggtacggtgtccctagtctggctgcagaacacttggaggaggttatgaaaaagcttaccccagagttatttgacagtcaacctgacctcctgcatcaactggtgaccctgatgaacccaaatacactgatgagccatggagtcccagttgttagaaccaatcaatgtgccggtgagttcgtgattacgtttccccgtgcttatcacagtggctttaaccagggttacaatttcgcggaggcagttaacttctgtaccgcggactggctcccagccggtaggcagtgcatagaacactatagacggctaagacgatactgcgtcttcagccacgaagaattaatctgcaaaatggctgcctgccctgagaaacttgaccttaatttggccgctgcggtgcataaggagatgttcataatggtacaggaagaacggagactcaggaaggctcttctggaaaagggaatcactgaggcagagagagaagcttttgagctcttacctgatgatgaaaggcagtgtatcaagtgtaaaaccacatgttttctctccgcacttgcctgctacgactgtcccgatggcctggtgtgcctgtcgcacatcaatgatctctgtaagtgttctagctcgagacagtacttgaggtacaggtacacccttgatgaactgcctgccatgctgcacaaactcaaagtcagggccgagagctttgacacctgggcaaataaagtgcgcgtggcgcttgaagtcgaggacggacgaaagcggagcctcgaagagctgcgagcccttgagtcggaggcccgtgaaaggagattccctaacagtgagctgttacagcagctaaagaattgtttatctgaagccgaggcttgcgtctctcgggccttgggcctggtgtcaggtcaggaggcaggcccacacagggtcgctggactgcaaatgaccctaacggagctcagggcattcctggatcaaatgaataatctcccatgcgccatgcaccaaatcggagatgttaagggcgtgctcgagcaggtggaggcgtaccaggcagaagcccgagaagccctcgcatcactgcccagtagtcccgggctccttcagtctctgttggaacggggacgacagctaggcgttgaagtgcccgaggcccagcagttgcagcgtcaggtggaacaggctaggtggcttgatgaagttaaaagaaccctagctccttccgcgaggcgcggcactcttgctgtaatgcggggactgctggtcgctggcgcttctgtagcaccatccccggctgtcgacaaggctcaggcagagctccaagagctgctgactattgccgaaagatgggaagagaaggcgcacctgtgtcttgaggccagacagaagcatcctccggctacactggaagcgatcattcgcgaagcagaaaacatccccgtgcatttgccaaatatacaggccttaaaagaagcactggccaaggcccgggcctggattgccgacgttgacgagattcagaatggcgatcattacccgtgcttagatgatcttgaggggctggtcgccgtgggccgtgacctgcctgtgggcctggaagagctgcgacaactcgaactccaggttctgacggcccatagctggcgggagaaggccagtaagacatttttaaagaagaattcatgttatacgctgctggaggtgttatgtccatgcgcagatgcaggttccgactccactaagaggagcagatggatggaaaaagagctggggctgtacaagagtgatacagagctactgggactgagcgcccaggacctaagagatccggggagcgttatcgtcgctttcaaagaaggtgaacaaaaggaaaaggagggaatcctgcagttgagaaggacaaattctgccaaaccttcccctctggcatcgtcctcaaccgcttcgagcacgacatctatttgtgtctgtggccaggtcctcgctggggcaggcgcactgcagtgcgacttatgccaggattggttccatggacgatgcgttagcgtaccacgattgctttcttccccacgcccaaaccccacgagctctcccctgctggcgtggtgggagtgggataccaaatttttgtgtccgctttgcatgagatcacggcggccccgcctcgagactatccttgcccttctggtggccctgcagcgcctccctgtgcgcctgcccgaaggtgaggccctgcagtgtctcaccgaaagagcaatcagctggcaggggcgagcaaggcaggcattagcctccgaggacgtgacggcgctgttgggcaggctggccgaacttcgacagaggttacaggccgaacctaggcccgaagagcccccgaattaccccgctgccccggcgagcgatcctctgagggagggctccggaaaggatatgccgaaagttcaaggactgctcgagaatggggatagcgtcaccagccccgaaaaggtggcacctgaggaaggctccgaccttgagttattgagttccttactgccccagctaactggaccagtgttagaactgcctgaggctaccagagctccactcgaagagctcatgatggaaggcgatctgctggaggtgactttagacgaaaatcactctatctggcagctgttacaggccggtcaaccgcccgatctcgaacgcattagaaccttgctggaactcgagaaagccgaaagacatggatctcgggcccgggggagagcccttgaaaggcgtcggcgacgcaaggtggataggggtggcgaaggtgacgaccccgcccgcgaagagctggagcctaaacgagtgcggtcaagtggtccagaggccgaagaggtgcaagaagaggaagaactagaggaggagacgggcggtgagggaccacctgcacctattccaacaaccggctctccaagcacgcaggagaatcagaacggactagagccagccgaaggtacgacctcgggcccaagcgctccttttagcaccctgactcctcgactacacctgccctgtcctcaacagccacctcagcagcagctgtag

SEQ ID NO: 122891 - DNA, 4551 bp, Artificial Sequence
  Description of Artificial Sequence: Synthetic coding sequence
atggagcctgggtctgatgattttctgcccccaccagaatgcccagtcttcgaaccaagctgggccgaatttcgagatcccctaggatatatcgcaaaaatcagacctattgctgagaagtcaggcatctgtaagatacgccctccagccgactggcagccccctttcgccgtggaagtagacaatttccggttcacccctcggatccaacggttaaacgagttagaaattgtagtggaagagggcggatatgaggccatttgcaaagatagacggtgggctcgcgtggctcagcggctgaactacccaccaggcaagaacatcgggagcctgctccgctctcactatgagcggatcgtgtatccatatgagatgtatcagagcggtgccaaccttgtacagtgtaacacaagaccgttcgacaacgaagaaaaagacaaagagtataaaccccacagtatccccctgaggcagtctgtgcagcccagcaagttcaacagttatgggcggcgcgccaagcggctgcaacctgatcctgagcccacagaagaagacattgagaagaatccggagctcaaaaaactgcaaatctatggggccggacctaagatgatgggactggggctcatggccaaagacaagacactccgaaaaaaagacaaggaaggtcccgagtgtccccctacagtcgtcgtcaaagaggagctggggggggacgtcaaagtcgagtccacgagcccaaaaacctttctcgagtcaaaggaggagctgtcccacagtcctgagccttgtacgaagatgacgatgaggctcaggagaaaccacagcaacgctcagttcattgagagctatgtatgccgaatgtgttctcgcggcgacgaggacgataagctgctcctgtgcgacggatgtgatgacaattaccacatcttttgcttactgccccctcttccagagattcccaagggcgtttggagatgtccaaaatgcgtgatggccgagtgcaaacgtcccccggaagcattcgggttcgagcaggccacaagagagtacacgttgcaaagctttggggaaatggcagactctttcaaggctgactacttcaatatgccagtccatatggtgcccaccgaattagttgaaaaagaattctggcgactagtcaacagtatcgaagaggatgtgaccgtggaatatggcgcagacatacatagcaaagaattcggctcaggctttcctgtctctgatagcaagcggcacctcacacctgaggaggaagagtatgcaacaagcgggtggaacctaaacgtgatgcccgtccttgagcagtcagtgctgtgccacataaatgccgacatctcaggtatgaaggtgccgtggttatacgtggggatggtcttttctgccttttgttggcacattgaagaccattggagctattctattaactacctccactggggcgagcctaagacctggtacggcgtccctagtctggccgcggagcacctggaggaggtgatgaagaaattaacacccgagctcttcgattcccagcccgacctcttgcatcagctcgtgactttaatgaaccctaacacattgatgtcccacggcgttcccgttgtgcgaacaaatcagtgcgccggagagttcgtcataacatttccacgcgcttatcacagcgggtttaaccaaggttataacttcgcagaggcagtaaatttttgtacagccgattggctgccagccgggagacagtgtatcgagcattaccggcgattgaggaggtactgtgtcttctcccacgaagagctgatctgtaagatggcggcctgcccagagaagctagacctcaacctggcagccgctgtgcacaaggagatgtttattatggttcaggaagagcggaggcttagaaaggctctgctggagaagggcatcacagaagcagagagggaagccttcgagctcttgcccgacgacgaacgtcaatgcatcaagtgtaagacaacttgctttctgagcgcactcgcctgctacgactgtcccgatggactggtgtgcttgtcccatatcaatgatctgtgcaagtgttcctcatctcggcaatacctgcgttaccgctacactttggatgagttacctgcaatgctgcataagctgaaagtgagggctgagtccttcgacacatgggcaaataaggtcagagtagcactggaggttgaagatgggcgcaaaaggtccctggaagagctgagagctctcgaaagcgaggccagagagcggcgattccctaattctgagcttctccaacaactgaagaattgcctgtctgaagctgaggcatgtgtgtcccgcgctctgggacttgtgtccgggcaggaagcagggcctcacagagttgccggactacagatgacgttaacagaattgcgcgcctttctggaccagatgaataatcttccatgtgcaatgcaccagatcggagacgtgaagggagtgttggaacaagtggaggcctaccaagccgaagctcgagaagccctggccagtctcccatccagtccgggattgctccagtcactgcttgagagaggcagacagctgggggtagaggtgccagaggcccaacagcttcagcgacaagtagaacaggctcgctggttggatgaggttaagcgtacccttgcaccaagtgcaaggcgcgggactttggcagtgatgcgcggattattggtggccggcgccagtgttgccccgagcccagccgtggacaaagctcaggccgaactccaagaacttcttacaatcgctgagaggtgggaggaaaaggctcacctgtgcctggaagccaggcagaaacacccccctgcgactctggaggctatcatccgcgaagccgagaatatacctgttcacctaccgaacatccaggccctcaaggaagctttagctaaggcccgggcctggatcgccgatgtagatgaaatccaaaatggcgaccattacccttgcttggacgacctggagggcctcgtcgctgtgggccgtgatttgcctgttggactcgaagagctgaggcagctggagttgcaggtcctaaccgctcacagttggcgggagaaagcatctaaaacgtttcttaaaaaaaatagttgctatacgcttctggaagtgttgtgcccatgcgctgatgcaggctcagactccaccaagcggtcacgctggatggagaaagaactgggactgtacaaaagcgacaccgagttattgggacttagcgcacaggatctgagggatcccggtagtgtgatcgtggccttcaaggaaggggagcagaaggagaaagagggaattctgcagttaaggcgcacaaatagtgccaaaccgagtcctctggcctctagctctacagcatcctccacgacatctatctgcgtttgcggccaggttctggcaggagcaggagccctccaatgcgatctttgccaggactggttccatggcaggtgtgtctcagtgcctcggctactgtcaagcccaaggcctaaccccacctctagtcctttactggcctggtgggaatgggatacaaagtttttgtgcccattgtgtatgcgatccaggaggccccggctggaaactatactcgcactgttggttgctctgcagcgtctgcctgtgcggcttccagaaggggaggctctacagtgtctgaccgaaagggctatcagctggcaggggcgggcccgacaggccctggcttctgaggacgtgaccgctctcctcggacggcttgctgagttgcgtcagcggttgcaagcggaacctcggccggaagaaccccctaactatcccgccgcaccggcttcagacccgcttcgggaggggtcagggaaagatatgcccaaagttcagggtctgcttgagaacggtgatagcgtcaccagccccgagaaggtcgccccagaggagggttctgatttagagctcctgagcagcctgctacctcagctaacagggcccgtgctcgagctgccagaggccacgagagctcctttggaggagctcatgatggagggtgatctgttagaggtgacactcgacgagaatcacagcatttggcaacttctgcaagcaggccagcctccagaccttgaaagaatcagaaccctcctggaactggaaaaggctgaaagacatggttcccgggcccggggcagggcattagagagaagacgcagaaggaaagtggatcgggggggagaaggcgacgatcccgcccgagaggaactcgagcctaaaagggtgcggagctcaggcccagaggctgaggaggtacaagaagaagaggagttggaagaagaaaccggcggtgagggtcccccagcccccattccaacaactggctcgccaagtacacaggaaaaccagaatggactggagcccgcagaaggcaccacctcaggcccttctgccccattttccaccctgacgcctcggttgcacctgccatgtccacagcagcccccacaacaacagctctag

SEQ ID NO: 122892 - DNA, 4683 bp, Artificial Sequence
  Description of Artificial Sequence: Synthetic coding sequence
atggaacccggatccgatgactttctccctcctccagagtgtccagtgtttgaaccgagctgggcggagttcagagatccactgggttatatcgccaaaattagaccaattgcagaaaaatccgggatctgtaaaatacggcctcctgctgactggcagcccccatttgctgtggaggtcgataattttcgatttaccccaaggattcagcggttgaacgagttagaggctcagacgagagttaagctgaattacctggatcaaatcgcaaagttctgggagatccagggaagttctcttaagatccccaatgttgagcgcagaatcctcgacttatattccctcagcaagatagtggtggaggagggaggctatgaggccatttgcaaggatcggcggtgggctcgagtggcccagcgcctcaattatcctcccgggaagaacattgggagtttacttaggtcccactatgaaaggatcgtgtacccttacgagatgtaccagagtggtgcgaatctggtgcaatgtaacactagacctttcgacaacgaggaaaaggacaaagaatacaagccacactcaatcccgctgcggcagagtgtccagccttctaagttcaattcgtacgggcgaagagcaaaacggctgcaaccagatcctgaacctacagaagaagatatcgagaaaaatccagagcttaagaagcttcagatatatggcgccggccccaagatgatgggtctgggactcatggccaaggataaaaccctgagaaaaaaggacaaagagggacctgagtgtccccctacagtggttgtcaaggaggagctcgggggagacgttaaagtcgaatctacctccccaaaaacattcctggagtccaaagaggagctgagccatagcccggagccttgcactaagatgaccatgcgcttgcgtaggaaccacagtaacgcgcagttcatcgagtcttacgtctgccggatgtgctctagaggcgatgaggacgacaaactgcttttgtgtgatgggtgcgatgacaattaccacatcttctgcctccttcctccactacctgagatccccaaaggtgtgtggcgctgccctaagtgtgtgatggctgagtgcaaacgaccacctgaagcgtttggtttcgaacaggctacgcgagaatatacactccagagcttcggagagatggccgactcgttcaaggcggattactttaatatgccggtccacatggtccctaccgagctcgtagaaaaggagttttggagactggtcaattctattgaggaagatgtgaccgttgagtacggggcagatatccactcaaaagagttcgggtctggattccccgtatccgattcaaagcgacaccttactccagaggaagaagaatatgccacatcaggatggaacctgaacgtgatgcctgtgctggaacaatcagtgctctgtcacataaatgctgatatttcaggcatgaaggtgccctggctctacgtgggcatggtgttctctgctttttgttggcacatcgaggaccactggagctattccatcaattatttgcattggggagaacctaaaacatggtacggtgtgccttctctggccgctgaacacctcgaggaggtgatgaagaaacttaccccggagttattcgatagtcagccagacctcctgcatcagctcgtgacattaatgaatccgaatactttgatgagccatggggtccccgtagtgaggactaaccagtgtgccggtgaatttgtaattacctttcccagggcatatcacagcggatttaatcagggctataactttgcggaagctgtcaatttttgcaccgccgactggcttccggccggtcgtcagtgcatcgagcactatagacggttgagacgctactgcgtgttcagtcacgaagagttgatttgtaaaatggctgcttgtcccgagaaactggatctgaatctggccgccgccgtccacaaggagatgtttataatggttcaagaggaaagaagactaagaaaagcgctcctggagaagggcattacagaggctgagcgggaagcctttgaattgctccctgacgacgagagacagtgtattaagtgcaaaaccacatgctttctatccgcactggcctgttatgactgcccagatgggttggtttgtctgtctcatatcaatgatctgtgcaaatgcagttcctcaagacaatacctgcgctaccgctacaccctagatgaactgccagcaatgcttcacaagttgaaggtgagggctgagagtttcgatacctgggcaaacaaagtgcgcgtggccctcgaggtggaagacgggcgaaagcgctcacttgaagagctccgggctttggagtcagaggccagggaacggcgctttcccaactccgagctactccagcagttgaaaaactgcttatctgaggctgaggcctgtgtatcccgggcactgggtctcgtgtccgggcaggaggccggacctcatcgagttgccggtttacaaatgacactgacggagcttcgtgcgttccttgaccaaatgaacaatctcccttgcgctatgcatcaaatcggcgatgtgaagggggtactggagcaggtggaagcctatcaggcagaagcccgggaggccctggcctctctgccttctagcccgggccttctgcagagcttactggagaggggccgacaattaggtgtggaagtgcccgaggcacagcagctgcagagacaagtggagcaggcgcgatggctcgatgaggtgaaaaggacactggcgccctctgctagacgaggcacgcttgctgtgatgcgcggactgctggttgccggggcctctgtggcgccgtcgcctgccgttgacaaagcccaggcggaactacaagagttattaacaattgcagaacgctgggaggagaaggcacatctttgcctggaggctaggcagaagcaccctccggccaccctcgaagcaattatcagagaagcagagaatatccctgtacacctacccaacattcaggccttgaaggaggctctcgcaaaggctagagcgtggattgccgatgtggacgaaatacagaacggcgatcactatccatgcctggacgacctggagggcctggtggctgtcggtcgcgatctgccagtggggctggaggagcttaggcagttggagttgcaggtcctcaccgcccatagctggcgggagaaggcatccaagaccttcctgaagaagaactcgtgttacaccttactcgaggtactgtgcccttgtgcagatgcgggttctgacagtaccaaacggtcaaggtggatggagaaggagttggggctgtataagagcgacacagaacttctgggcttgtcagctcaggacctccgggacccaggtagcgtcattgttgcatttaaggagggggaacagaaggagaaggagggtatcctgcagctgcgcagaacgaattcggcgaagccaagcccactggcctctagtagcactgcgtccagcacaacttcaatttgcgtatgcggccaagtcttggcgggggctggtgctctccagtgtgacttgtgtcaggattggtttcatggccggtgcgtgtctgttcctaggcttcttagttctccacgtcccaatccaaccagtagcccactcttagcttggtgggagtgggacactaaatttctgtgccctctttgcatgagatctagaagaccccggttggagacaatcctggccctcttggtagccctgcagcgccttcctgtgaggttgcccgagggagaggccctgcagtgcttaactgagcgcgcaataagctggcagggacgagcccgacaggccttggcgtcggaggacgtcacagccctcttaggccgcctggccgagttgcgccaaagactgcaggcggagccaagacctgaagaacctcccaattacccggctgcgcctgctagtgatccactcagagagggaagtggaaaagatatgccaaaagtacagggcctgctggagaatggggacagcgtcactagcccagaaaaggtggctcccgaggaaggctcaggcaagcgagatctggagctcctctcttccctgctgcctcagctgaccggtcccgtcctagaactgcccgaggctactagagcacctcttgaagaattgatgatggaaggtgacctgctcgaggtgaccctcgacgagaatcattcaatttggcaactcctccaagccggccaaccccccgacttagaacggataagaaccctgttggaactggagaaagcagaacgtcatggatccagagctagaggaagagcattggaacgccgacggcgacggaaagtggatagaggaggagagggtgacgatccggcaagagaagagctggagccaaagcgggtgcgatcttcaggccccgaggctgaggaagtacaggaggaggaagagcttgaggaggagacgggcggggagggacctccagctccaatccccacaacaggttctcctagtactcaggagaaccagaacgggttagaaccagctgaggggacaacctcaggacccagcgcccctttttctaccctgacgccccgcttgcacttgccttgtccgcagcagccgccacagcagcagctgtag

SEQ ID NO: 122893 - DNA, 4680 bp, Artificial Sequence
  Description of Artificial Sequence: Synthetic coding sequence
atggagcctgggtctgatgattttctcccccccccagaatgtcctgtgttcgaaccttcgtgggccgagttcagggatcctttgggatacatcgcgaaaatacggccaattgcggagaaaagcgggatctgtaagattagacccccagctgattggcaacctccatttgctgtcgaggtagacaactttagatttactccccgaatccagcgactgaacgagctggaagcccagacccgagtcaaattaaactacttggatcaaatcgccaagttttgggaaattcaaggctcttctctcaagatccctaatgtcgaacgcagaatactggacttgtacagcctcagtaagattgtggtcgaggaaggggggtacgaggccatttgcaaggatcgccgatgggccagagtggctcaacgcctgaactacccgccgggaaaaaacatcggctccctcctgcgctcccattacgagcggatagtgtacccatacgagatgtatcaaagcggggccaacctggtgtgcaacaccaggccatttgacaacgaagaaaaggataaggagtataaaccacatagcattcccctccgccagtctgtccagccttcgaaatttaactcctacggtcgtcgcgccaagagattgcagcccgacccggagccaacagaagaagatattgagaagaacccggaattaaagaaactgcagatctacggggccggaccaaagatgatgggcctgggcctaatggctaaggataaaaccctgcgtaagaaggataaggaaggacccgaatgcccacccaccgtggtggtgaaggaggaattgggtggtgatgtgaaagttgagagtaccagtcctaagaccttcctagagtccaaggaagagctgagtcattcacctgaaccatgtaccaaaatgactatgaggctgcggcgcaatcactctaatgcacagtttatagagagctatgtctgtagaatgtgcagcaggggagatgaagatgacaagctcctcttgtgtgacggttgtgatgacaattaccatatcttttgtctactgcccccgctgcccgagattcccaagggcgtgtggaggtgcccgaagtgcgtgatggctgagtgcaaaagaccaccagaggccttcgggtttgaacaggccacaagagaatatacgctacaatccttcggtgagatggccgacagcttcaaggccgactacttcaacatgcccgttcatatggtgcccaccgaattagttgagaaggaattttggagactggtgaactccattgaggaagacgtcactgtcgagtatggcgctgatattcacagcaaagagtttggcagcggatttccggtttccgacagcaagcgtcatctcacgcctgaggaggaggagtacgctacatccgggtggaacttaaacgtcatgccagttctggagcagtcagtcctctgtcatataaacgccgatattagcgggatgaaggtgccttggctgtatgtcggaatggttttctcggcattctgttggcacatcgaagatcactggtcttatagcatcaattatctgcactggggtgagccaaagacctggtatggagtcccaagtcttgctgctgaacacctggaggaagtcatgaagaaattaacacccgaattattcgactctcagcctgacctgctccaccaactcgtcacacttatgaatcctaataccctgatgtcgcacggagtgccagtagttcgtaccaatcaatgtgccggtgaatttgtgatcactttccccagggcctaccactcaggattcaatcaggggtataatttcgcagaggccgtgaacttttgcaccgccgattggctgccagccgggcgacagtgcatcgaacactacagacgcctgcggaggtactgcgtgttttcccacgaggaactcatctgcaagatggccgcgtgtccagaaaagctggatttaaatctggcagccgccgtacacaaagaaatgttcatcatggtccaggaagaacgcagacttaggaaagccctgttagagaaagggataaccgaggccgaacgggaagcgttcgaactactgcctgatgatgaacgccagtgtatcaagtgcaagactacatgtttcctaagcgctctggcttgttatgactgcccagatggcctggtgtgccttagccatattaatgacctatgtaaatgcagtagctccaggcagtatttgcgataccgatataccttagatgagctgccggccatgctgcacaagttaaaggtcagagctgagtcttttgacacttgggccaataaagtgagggttgccttggaggtggaagatggaagaaagagaagtcttgaagagttgcgagcgttggagagtgaggctcgggaaagaaggtttcccaacagtgaactgctgcagcagctcaaaaattgtctgagcgaggctgaggcatgcgtttcgcgggctttgggactcgtgtccggtcaggaggctgggccacacagggtggccggactgcagatgaccctgactgagctgagagcatttctggatcagatgaacaacttgccctgcgcaatgcaccagatcggcgatgtgaagggggtcttggagcaggtggaggcataccaggcggaagcacgagaagccctggcctccctgccttcatcccctggacttcttcagagcctgttggaaagagggcggcagctgggtgttgaagtgccggaagcccaacagctgcagcgccaggttgagcaggcacggtggcttgatgaagtcaagcgtactctcgctcccagcgccaggcggggaactttagcagtcatgagaggattgttggtagccggtgccagcgtggctcctagccccgccgtagacaaggcgcaggccgaactccaggaactcttgaccatcgccgagcgctgggaggagaaagcccatctgtgccttgaggcccggcaaaagcacccaccggccaccctggaagcaattatcagggaggcggagaacatccccgtacacctacctaacatacaggctctgaaagaggctctggcaaaggcccgggcgtggattgcagatgtggacgagatacaaaatggcgaccactacccgtgtttggacgatctagaggggctcgtagctgtgggccgcgacttgccggtgggtctggaggagctgcggcagcttgagttacaggtgctaaccgctcacagctggcgggagaaagctagtaagacctttctgaaaaaaaactcttgctacaccctgctggaagtcctctgtccgtgtgccgacgcgggatccgactccacaaaacgctcgcgctggatggagaaggagctcgggctttataagagcgataccgaactcctaggtttaagtgcccaggatttgcgcgaccctgggagtgtgattgtagccttcaaggagggcgagcagaaggagaaggaaggcattttacagctccggcgaacaaatagtgctaaaccatccccactggcttcgagttccactgcctccagcaccacttccatctgcgtgtgcggacaagtactagctggggccggcgcccttcagtgtgatctgtgccaagattggtttcacggccggtgtgtaagcgttccccgcttactgagtagcccgcgaccaaatcccacgtcatctccactgctggcttggtgggagtgggatacgaagttcctttgcccgctgtgcatgcggtccagacggcctaggttagagacgatactcgcactcctcgtagctctccagcgtcttcccgttagactcccagagggtgaagcattacagtgtctgacagagagagcgatcagttggcagggacgcgccaggcaggcacttgcatccgaggacgtgacagctctcctgggcagacttgccgagttacgacagcggctgcaggcagagcccaggcccgaggagccccccaattacccggccgccccagcaagcgacccactgagggagggatctggaaaagacatgccgaaagtgcaggggctgttagagaatggtgattccgtcaccagtcccgaaaaggtggctccggaggaggggtctggtaagagggacctcgagctgctgagtagtctcctgccccaactcaccggacctgtcctggaactaccggaggctactagagcccccctcgaagagctgatgatggaaggagatttgcttgaggtgaccctggacgaaaatcactccatttggcagttactgcaggccgggcagccacccgacctggaaaggatcagaaccttactggaactcgaaaaggccgaaaggcacggaagccgcgctcgaggcagggcactggagagaagacggaggcgaaaagttgaccgaggaggagaaggggacgatcctgctcgggaagaactggagcctaagcgtgtgcgttctagcgggcctgaagctgaagaagtgcaggaagaagaagaactagaggaagagactggcggggagggtccaccagcacccatccccaccacaggatcccctagcacccaagaaaaccagaacggactggaacccgcagagggtacgaccagtggaccatctgcccccttcagcacgctaactccccggctgcacctgccgtgtccacagcagcccccacagcagcagttatag

SEQ ID NO: 122894 - DNA, 4140 bp, Artificial Sequence
  Description of Artificial Sequence: Synthetic coding sequence
atggaaccagggtccgatgactttctgcctccccctgagtgcccagtgttcgaacctagttgggcagaatttcgtgatcctctgggctatatcgctaaaatccgtcctatcgccgagaagagtggcatatgtaaaattcgcccccccgctatagttgtggaagagggtggctatgaggctatttgtaaagatcggagatgggcacgggtcgctcagcgtctgaattatcctcccggaaagaatatcgggtcactcttacgaagtcactacgaaaggatcgtctacccgtatgaaatgtaccaatcaggggccaacttggtccagtgtaacactcgcccctttgataacgaggaaaaagataaagagtataagccccacagcattccgttgcgccagtccgtgcagccgtctaaattcaactcatacggaaggagggctaagaggctccagccagaccctgaacctacggaggaggacattgagaagaaccccgaactgaaaaagctgcagatatacggtgctggccccaagatgatgggcttgggactgatggcaaaggataagaccctcaggaagaaggataaagaaggacctgaatgccctcctacagtcgttgtaaaggaagagctgggcggagatgtaaaggtggaaagtacgagtcccaagacatttctggaatccaaggaagagctctctcattccccagagccatgcaccaagatgacgatgcgtttaaggaggaaccactcaaacgctcagttcatagagagttatgtttgccgtatgtgctcccgaggcgatgaagacgacaaactgctgctgtgtgacggttgtgacgataactatcatattttttgtttattgcctccactgcccgagatccccaaaggagtatggagatgtcccaaatgcgtcatggccgagtgcaaacgtcccccggaggcctttggtttcgagcaggccacaagagaatataccctccagagcttcggtgaaatggctgacagtttcaaggcagactacttcaacatgcctgtgcacatggtgccaaccgagttagttgagaaggaattctggagactggtcaatagcattgaagaagacgtgacagtagagtatggagcggatattcacagcaaggagttcggaagcgggtttcccgtaagcgatagtaagcgtcacttaactcccgaggaggaagaatatgccacctccggatggaacttgaacgtgatgcctgtgctggagcagagtgtactgtgccatattaacgcggatatttccgggatgaaggtgccatggctttacgtgggcatggtgttctcagccttttgttggcatattgaggaccactggagctactccattaactatctgcactggggcgagccaaagacctggtacggggtaccttccctcgccgccgagcaccttgaagaagtgatgaagaagcttacccctgaactttttgacagtcagccggacctgctgcaccagctggttaccctcatgaatcctaacacactgatgagccacggcgtgcccgtcgtcaggactaatcagtgcgcaggcgaatttgtcatcacgtttcctagagcctatcattccggcttcaatcagggttataatttcgctgaggccgtgaatttttgtacagccgactggcttccagcgggaaggcagtgcattgagcattataggcgccttcgacggtactgcgtcttcagtcatgaggaactgatttgtaaaatggcggcctgcccggagaagctcgatctgaacctagcagctgcagtacacaaggagatgttcatcatggtgcaagaggagcgacggctgcgaaaggccctgttggaaaaaggtatcactgaggcagaaagggaagcctttgaactgctgccggatgacgagcgacagtgcattaagtgtaagacaacatgctttctctcagcactcgcatgctacgattgtccggatgggctcgtttgtctctcccatatcaatgacctgtgtaagtgcagcagcagcagacagtacctacgctatagatataccttagacgagctcccggcgatgctccataagctgaaagttcgggccgagtcatttgatacttgggcgaacaaggtgcgggtggcgctggaagtggaggacggaagaaagcgtagcctcgaggaactccgggccctagagtccgaggcaagagagcggcggttcccaaatagtgaacttctgcagcagttgaagaactgtttgtccgaagccgaagcttgcgtcagccgcgctttgggcttggtgtccgggcaggaggccggccctcatcgggtggcaggactgcagatgactctgactgagctaagagccttcttggatcagatgaataatctgccatgcgcaatgcatcagataggcgatgttaagggagttctcgagcaggttgaggcatatcaggccgaggcccgtgaggctctcgcctctctcccatcatccccgggcctgctccagagcctgctagagaggggtcgacagctcggcgtagaggtgcccgaagcacagcagctgcagcgccaggtggaacaagcccgctggctcgatgaagtaaagcgcacactggccccaagcgctcgtcgggggacactggctgtcatgaggggactgctggtggcaggagctagcgtcgctcccagtccggccgtggataaagctcaggcagagttgcaagagttacttaccatagccgaaagatgggaagagaaggcccatctttgcctggaggctcggcagaaacacccccccgccacgctggaggctattatccgggaagccgagaatatccccgtccatctgccaaacatccaggccctgaaagaggccctcgcaaaggcccgtgcttggatcgccgatgttgacgagatccagaatggagatcattatccttgtctcgacgaccttgaaggccttgtggccgtaggtcgtgatctgccggttggactggaagagctgcggcagctggagctgcaagtgcttactgctcacagctggcgcgagaaggcaagcaagacctttctgaaaaaaaactcatgctacacactccttgaagtgctgtgtccttgcgcggacgcggggtctgacagcacaaagcgatctagatggatggaaaaggagctcgggctgtacaagtccgacaccgaactgctaggactgtccgctcaggatctccgggaccctgggagcgtgatcgtggcctttaaagaaggcgaacagaaggagaaagaaggcatactccagttgcggaggactaattccgccaagccatctccgttagccagctcaagtaccgcctccagcacgacatcaatttgcgtgtgcgggcaggtcttggctggagctggggctctgcagtgcgatctgtgccaggattggttccacggacggtgcgtgagcgtgccacgtctacttagctcccctaggccgaatccaacttccagtccactactggcctggtgggagtgggacacgaagttcctgtgccccctgtgcatgagatctagaagacctaggttggagactatcctagcactcctggtggcactacagcgcctgccagtccgtctcccagaaggcgaggccttgcagtgcttgaccgagcgtgccatctcttggcaggggcgagcccgtcaggctctagccagtgaagacgtcacagcactcttagggcggcttgccgagcttagacagcgattgcaggcagagccacggccagaggaaccgcctaactacccagcagcacccgcaagtgacccgctgagggaaggctcaggcaaagatatgccaaaagtccagggtctgttggagaacggtgactcagtgaccagtcctgaaaaggtcgcccctgaggaaggctcagacctggaactcctctcatccttgttgcctcagctgacgggcccagtgctagagctccccgaagccactagagcccccttggaggagcttatgatggaaggtgacctgttagaagttacccttgatgagaaccactctatccctgaatctttggatttttgtattcttaccccgcgttactgctctgatctcagctcctgggggcccgctccaggagtcttccctccttggtag

SEQ ID NO: 122895 - DNA, 4620 bp, Artificial Sequence
  Description of Artificial Sequence: Synthetic coding sequence
atggaacctggctgtgacgagttccttcctccccctgagtgcccggtctttgaaccctcctgggccgaattccaagacccactgggttatattgccaaaatacgccccatcgccgagaaatccggtatatgtaagattagaccccccgccgattggcagcctccctttgccgtcgaagtcgataactttcggtttaccccacgcgttcagaggctcaacgagttagaggctcaaactcgcgtgaagctgaattacctggatcagattgcgaaattctgggagatccagggatcttcactgaaaatccctaatgtggagcggaaaatacttgatttgtattcgctgtctaagatcgtgattgaggagggaggctatgaggcaatatgtaaagaccgccggtgggcgagagttgctcaacgtctccattacccccccggcaagaacatcgggtctctactgagatcccactacgaacggatcatatacccctatgagatgtttcagagcggcgcgaaccacgttcagtgtaatactcatccattcgataacgaggtgaaggataaggagtataagcctcattccattcccctgaggcaaagcgtacaaccttccaaattcagttcctatagtagacgggccaaaagattgcagccagaccctgaacctaccgaggaagacatagagaaacaccccgagctgaagaaactccagatttacggtcccggtccaaagatgatgggactggggctgatggccaaagataaggataagacagttcacaaaaaagttacctgtccaccaacagtgactgtcaaggacgagcagagcggcggaggtaacgtttcttccaccctgctgaaacaacaccttagcctagagccgtgcactaaaaccactatgcagctgagaaagaatcattccagcgcacagtttatcgacagctacatctgccaagtttgctcgagaggcgatgaagacgataaactgttgttttgtgacggctgtgacgataattaccatatcttctgcctgctcccccccctgcccgagattcctagggggatttggcgctgtccaaaatgtattctggccgagtgtaaacaaccacctgaagcatttggattcgaacaggccacacaggagtattccctgcaatcgtttggagaaatggctgactctttcaaatctgactacttcaatatgcccgtccacatggtacctacggaactggtggaaaaagaattctggaggcttgtctccagtatcgaggaggacgtgaccgtcgaatatggagccgatatccactctaaagagttcggcagcggatttcccgtgagcaatagtaagcagaacctgagccctgaggagaaggagtacgcaacatcgggatggaatctgaatgtcatgcctgtgctggaccagtcagtgctgtgccatatcaacgctgacatcagtggaatgaaggtcccctggctgtacgtaggcatggtgttttcagccttttgttggcatatcgaggatcactggtcttacagcatcaattatcttcattggggcgagcctaaaacttggtatggagtgccgtctctcgccgcagagcatttggaagaggttatgaagatgctgaccccggagctgtttgattcacagcccgacctcctgcatcaactcgtgaccctgatgaatcccaacactctcatgtcccatggagttccagtcgtgcgaactaaccaatgcgccggcgagttcgtgattactttccctcgggcataccatagcggtttcaaccagggttacaatttcgcagaagccgtaaacttttgtacagccgactggctgccagctggacggcagtgcattgaacattacagacgcttgagacgctactgtgtcttcagccacgaggagttgatctgtaaaatggcagcttttccggaaaccctggacctgaacctggccgttgccgtgcacaaggagatgttcataatggtgcaggaggaaaggaggctccgaaaagccctgcttgagaagggggtaaccgaggccgagcgtgaggcgttcgagctgctgcccgacgatgaaaggcaatgcatcaaatgcaagactacttgttttctcagcgctctggcctgctatgattgccccgacgggctggtttgcctctcccatatcaacgatctttgcaaatgttccagcagtaggcagtatttgcgctaccggtacaccctcgatgaacttccgaccatgctccataagctaaaaattcgggccgagagttttgatacatgggccaacaaagtccgcgtcgcattggaagtcgaagatggtcgaaagaggagttttgaagaactccgggcactggaaagcgaagcccgggaacgccgatttccaaatagcgagctgctgcagcggctgaaaaattgcttgtctgaggtagaggcttgtattgcccaggtgcttggcttggtttctgggcaggttgcgcgcatggacacccctcaattgaccctgaccgagctcagggtgctgcttgaacaaatgggatccctcccctgcgccatgcaccagattggcgatgtcaaggacgtgctcgagcaggtcgaggcctaccaggctgaagcccgggaggcgctggccacactcccctcatcccctggactgcttcgctctcttctggagcggggacaacagctcggagtggaggttcctgaagctcatcagttgcagcagcaagtcgaacaggcacaatggttggacgaggtgaaacaggcacttgccccaagtgcccacagaggctccctcgtgatcatgcagggcctgctcgttatgggagctaagatcgcctcttcaccctctgtagataaagctcgagccgaactacaagaattgttaacgatcgcagaaaggtgggaggaaaaagctcacttttgcctggaggcacggcagaagcatccccccgcgacacttgaggccattataagagagaccgaaaatatacccgtacacctcccaaatattcaagcactcaaggaggcactgacaaaagctcaggcctggattgctgatgtcgatgaaatccagaacggggatcactacccatgccttgatgatctggaagggctagtcgccgtcgggcgcgacctgcctgtggggcttgaagaactgagacagctggagctgcaggttcttacggcacatagttggagggaaaaggcttccaaaacgttcctgaagaagaatagttgttatactctgctggaggtgctatgtccctgtgccgatgcgggatcagacagcaccaagaggtcgagatggatggagaaggctctcggcctgtatcagtgtgataccgaactgctgggcctgagcgcacaagatctccgtgacccagggtcagtgatcgtagcgttcaaggagggtgaacagaaagaaaaggaggggatcctacaactgagacgtaccaatagcgccaagcctagtccactggctccctccctgatggcctcttctccaacctcaatctgtgtgtgtggacaggtgccagccggcgttggagtcctgcagtgcgacctgtgccaggactggtttcacggacaatgcgtaagtgtgcctcacctgcttactagtccaaagccaagtctcacctccagtcctctgttagcctggtgggagtgggacacgaagttcctgtgtcccctgtgtatgagatctagaaggccacggttggaaactatccttgccctgttggtcgcattacagcggctgccagtgcgcctccctgaaggggaagccttacagtgcctgaccgagcgggctataggttggcaagatagggcccgcaaagccttggcgagcgaggatgtgactgctttactgagacagctggcagagctacggcagcagctgcaggctaagccacgacctgaggaggcatctgtctatacttctgcaactgcatgtgatcccattcgggaaggctctggtaacaatatctcaaaggtacaaggattgctggaaaatggagacagcgtgacatccccggagaatatggcccctggcaaaggcagcgacctggaactgctgagtagcctgctccctcagttgactggaccggtgctcgaacttccggaggctattcgcgcacccttggaggagctaatgatggaaggagacttgcttgaggttacgttagacgaaaatcattctatctggcaactgcttcaggctgggcagccaccagacctcgaccggattcgtactctgctggagctcgaaaaattcgagcatcagggcagtagaaccaggagcagagctttggaaagacggagaaggcgccagaaggtggatcaggggagaaacgtggaaaacctggtccaacaggagttgcaatcaaagcgggcaagaagctctgggattatgtcccaggtggggcgcgaagaagagcattaccaggagaaggccgacagagaaaatatgttcctgaccccctctactgatcacagccctttcctgaagggcaaccagaactcactccaacacaaagattccggatcaagtgcggcatgtccctccttgatgccactgctgcagctgtcctattcggatgagcaacaactttag

SEQ ID NO: 122896 - DNA, 4449 bp, Artificial Sequence
  Description of Artificial Sequence: Synthetic coding sequence
atggaacccggatgtgacgaattcctgcccccccctgagtgccctgtgttcgagccaagctgggcagagtttcaagacccgctgggttacatcgccaagatccgtcccatagcagaaaagtccgggatctgcaaaattagacctcccgctgattggcagccacccttcgcagtggaagtcgataattttagattcacgccccgtgttcagcgacttaatgagttagaggcacagacaagagttaaactcaattatctagaccagatcgccaaattctgggagatacagggctcaagcctcaagatccccaacgtggagaggaaaatcctagatttatactcactgagcaagcaatgtaatacgcacccatttgataacgaagtaaaagacaaggagtacaaaccgcatagcattcccctgcgccagtcggtgcagcccagcaagttcagtagctactctcgtcgggctaagcggttgcagcctgaccccgagcctacagaggaggacatagagaagcatccagaactaaaaaaactccagatttacggcccaggccccaaaatgatgggtctggggttgatggcaaaggacaaggacaaaactgtccacaagaaagtaacttgccctcccaccgtgacagtcaaggacgagcagtccggaggcggaaacgtgtcatccacccttctcaagcagcacctttccttggaaccttgtactaaaaccaccatgcagcttcgaaaaaaccactcctcagcacaatttatagattcatacatctgccaggtgtgctcgcgcggggatgaggacgataagctgcttttctgcgacggatgcgatgacaattaccatatcttttgcctgcttcccccattacccgaaatcccacgcggaatttggcgttgcccaaagtgtatcctcgccgagtgcaaacagccccctgaagccttcggttttgaacaggccacccaggagtattcattgcagtcttttggagaaatggctgacagttttaaaagtgattacttcaacatgccggtccatatggtgccaacagagttggtcgaaaaagagttttggaggctcgtgtcatctattgaggaagatgttacagtcgaatacggcgcagacatccatagcaaggaattcgggtccgggtttccggtgtcgaatagtaaacagaacctgagtcctgaggagaaagagtatgctaccagtggatggaacttgaatgtgatgcccgtgttagatcagagtgttctgtgtcatattaacgctgacatcagcgggatgaaggtgccctggctgtatgtcggaatggtcttctctgcattctgctggcacatcgaggatcattggagctactccatcaactacctacattggggggaacccaaaacctggtacggcgtgcctagcctcgccgcagaacacctcgaagaggttatgaagatgttaacccccgagctgtttgactcccagcccgatctactgcaccaactggtcacactcatgaatccaaacacacttatgtcgcacggtgtgcccgttgtgcgtacaaatcagtgtgctggggaattcgtgatcacattcccaagggcctaccacagcggttttaatcaggggtataatttcgctgaagctgtgaatttctgtaccgcagattggctgccagcaggcagacagtgcatcgaacactaccgtaggctgcgcaggtactgtgtgtttagccatgaggaacttatctgtaagatggctgcattccctgagaccctggatctgaacctggcagtcgctgtgcacaaggagatgtttattatggtacaggaagaacgtcggctgaggaaagccttactcgaaaagggcgtcaccgaggctgagcgagaagccttcgagctcttgcccgacgatgagcgccaatgtattaagtgtaaaacaacatgctttcttagcgctctcgcttgctatgattgcccagacgggctggtttgcttgtctcacatcaacgatctgtgcaagtgtagctcttcccggcagtaccttaggtatcgctataccctcgacgagctgcctactatgctgcacaagcttaaaatcagggcagagtccttcgatacgtgggcaaataaggtgagggtggcactcgaagttgaggatggcagaaaaagatcctttgaagaactacgggccctggagagcgaagccagagaaagacgctttcctaatagcgagctactccagcggctcaagaattgtctgagtgaagtggaagcatgcatcgcccaggtcctcgggctcgtgagcggtcaagtggcaagaatggacactcctcagctgactctgaccgagcttcgcgtcttactggagcagatgggaagcctgccttgtgccatgcatcagatcggagatgtaaaagatgtcctggaacaggtggaggcatatcaggctgaggcgcgcgaggcactcgccactcttccgagcagtccaggcctgttgcggtctctcctggagagagggcagcaactgggcgtcgaggtgccggaggctcatcagctgcaacagcaggtggagcaagcccagtggctggatgaggtaaagcaggcgctcgcgccttccgcacacaggggaagtttggtgataatgcaaggcttactagtcatgggggcaaagatcgcaagttctccctctgtagataaagcccgggccgaactgcaggagctgctgactatagctgaacgctgggaggaaaaggctcatttttgcttggaagcacgacagaagcatcctcctgcaaccctggaggccataatacgtgagactgaaaacatacccgttcacctgcctaatatacaggccctcaaggaggccctaacgaaggcgcaagcgtggatcgctgatgtggacgagatccagaatggagaccattatccatgcttggacgatctcgaaggcttggtagccgtggggagagaccttcctgtgggtctggaggagctccgccagctggagcttcaagtgctgactgcccactcatggcgcgagaaagcaagcaagacctttttgaaaaaaaattcctgctacaccctgctggaggtgctctgtccttgtgcagatgccgggagcgacagtaccaagcgtagtcgctggatggagaaagcactaggattatatcagtgtgacactgagctgctgggcttaagcgctcaggatctccgggatcctgggagcgttatcgtagccttcaaggagggtgaacaaaaagaaaaagagggaatcctacagctgcgccggactaactccgctaaaccatctccacttgcaccatctttgatggctagctccccgacttcaatatgtgtgtgcggccaggttccggctggggttggggtgctccagtgtgacctgtgccaggattggttccacggccagtgcgtgagcgtgcctcacttactgaccagccctaagccttccctcacgagttctcccctgctggcttggtgggagtgggacacaaagttcctgtgccctctgtgcatgcggagcaggcgacctagactggagacaatccttgccttgctcgttgctctgcagagacttcccgtccgtctccctgaaggagaagcactccagtgcctcacagaaagagcaatcggctggcaagatagagcacgcaaagcccttgccagcgaggacgtgactgccctactgcgccaactggccgaactgaggcagcagctgcaggcaaagccacgccccgaagaggctagcgtctacacgtcagccacagcttgtgacccgataagagaaggcagtgggaataatattagtaaggtgcaggggctcctcgagaatggagatagcgtaactagccccgagaacatggcaccaggcaagggtagcgatcttgaactgctgagcagcctcctgccccagctcaccggtcccgtgctggagctgcccgaggctatacgggccccactggaagagctgatgatggaaggtgaccttctggaagtgactctcgatgagaatcattcaatatggcaactactgcaggccggccagccccccgatctcgataggattcgcacactgctggaattggaaaagtttgagcatcagggctcgagaacaagatcccgggccctcgaacgcaggcgcaggcgacagaaggttgatcagggcaggaatgtggagaatctggtgcagcaggaacttcagagtaaaagggcgagaagcagtggcattatgtctcaggttggacgcgaggaagagcattatcaagaaaaggctgatagggaaaacatgttcctgacgccaagtaccgatcattctccatttttgaaaggaaatcagaactccttgcagcacaaagactctggttcttccgccgcatgccccagtctgatgcctttgctgcagctttcgtatagtgatgaacaacagctgtag

SEQ ID NO: 122897 - DNA, 882 bp, Artificial Sequence
  Description of Artificial Sequence: Synthetic coding sequence
ctacccaacattcaggcattgaaggaagccctgactaaagcccaggcctggatcgccgacgtggacgaaatacagaacggcgaccactatccttgtcttgacgacctggagggactggtggcagtgggcagagatcttcccgttggcctggaggaattaagacagctcgagttgcaagtcctatgcccctgcgcagacgccggaagcgactctacaaaacgcagccggtggatggagaaagccctgggactttaccagtgcgatacagagctgctgggtttatctgcacaagacctcagagaccctggctctgtgatcgtagccttcaaggaaggcgagcaaaaggagaaggaaggaattcttcaactcaggcgcaccaatagcgccaagccttcaccgctcgcccctagcctcatggcttccagtccaacttctatctgtgtttgcggccaggttcctgccggcgtgggggttctacagtgtgacttatgtcaagactggttccatggccagtgtgtgagcgtgcctcatctacttacttccccgaaaccaagcctgacaagctcacccctgctggcctggtgggagtgggataccaagtttctgtgcccgctgtgtatgagatctcgcaggccccgcctggaaaccatcctggccctcctcgtggctctgcaacggctgccagtgcgcttgcccgaaggtgaggccttacagtgcctcaccgaacgcgcaattggctggcaagatcgcgctcgcaaggcactagcatcggaggacgtcaccgccctgctgaggcaactggccgagctgaggcagcagctgcaggccaaacctaggcccgaggaggccagcgtatacacgtccgcaacggcgtgtgattag

SEQ ID NO: 122898 - DNA, 4431 bp, Artificial Sequence
  Description of Artificial Sequence: Synthetic coding sequence
atggaacccggttgcgacgaatttctccctcctcctgagtgccctgtgttcgagccatcttgggccgaattccaagatcccctcggctacatcgcgaagattcgccccatcgccgagaagagtgggatctgtaagatcaggccaccagcagattggcagccccccttcgccgttgaagtggacaattttagatttacccccagggtgcagcgattaaatgagctcgaaatcgtcattgaagagggggggtacgaggcaatctgtaaggaccgcaggtgggccagggtagcacaacggttgcattatcccccaggcaagaacataggctctctgcttcgctcgcattacgagcggatcatctatccatacgaaatgtttcagagcggagcaaaccatgtacaatgtaacacccacccattcgacaatgaggtcaaggacaaggagtacaaaccccactccataccgctccgccaatctgtacaacccagcaaattctcgagttactctcggagagcaaagagactgcagcctgatccggaaccaactgaggaggacattgaaaaacatcccgagctaaagaaactgcaaatttatggccccgggcccaaaatgatgggactcggactgatggcaaaggataaggacaaaactgtgcataagaaggtgacttgccctcccacagttacagttaaggacgagcagtctggtggcggaaatgtgtctagtactctcctgaagcagcacctgagcctcgaaccatgcaccaaaacaaccatgcagttgagaaaaaatcacagctcagcccaatttatcgactcttacatttgccaggtttgttctagaggtgatgaggatgataaattgctgttctgcgacggatgcgatgacaactaccacatattttgtctcctcccacctctccccgagattcctcggggaatctggagatgccctaagtgtattctggccgagtgcaaacagcctcccgaggccttcgggtttgagcaggccactcaggagtactccttgcagtctttcggggagatggccgactcctttaaatccgactattttaacatgcccgtgcatatggtgccaactgagctggtagagaaggagttttggaggcttgtgtcaagcatcgaagaagacgtaacagtggaatacggagccgacatccactccaaggaattcggctcaggctttccagtgagtaactctaaacagaacctctccccagaggaaaaagagtacgccacatcaggttggaatctgaacgtcatgcctgttctcgatcagtcagttttatgtcacattaacgccgacatttctggcatgaaggtcccttggctgtacgtgggcatggtgttcagcgcattttgctggcatattgaggatcattggtcatacagcataaattacctgcactggggagaacctaagacatggtatggagtgccaagtcttgccgcagaacacctggaggaggtcatgaagatgctaacccctgagctcttcgattcacaacccgaccttcttcatcagctggttaccctcatgaatccaaatactctgatgtcccacggcgtgcctgttgtgagaacaaatcagtgcgctggagaattcgttattacgtttcctagagcatatcactcgggcttcaaccagggttataactttgccgaagctgtgaatttttgcacagctgactggctccctgccggtcgacagtgcatcgaacactatcgcagactccggagatattgtgtattttctcatgaagaattaatctgcaaaatggcagcatttcctgagacgctcgatctgaacctggcggtcgcagtgcataaggaaatgttcatcatggtgcaggaagaaagacggttacgcaaagcacttctggagaaaggcgtgacagaagctgagcgcgaggcattcgaactgctccccgacgacgagcggcagtgcatcaagtgcaagactacttgcttcctttctgcacttgcatgctacgattgtccggacgggctcgtctgcctctctcacattaacgatttgtgtaagtgttcctcatccagacaatacctgcgttatagatatactctcgatgaactgccaactatgcttcacaaattgaagattcgcgccgaaagtttcgacacctgggccaacaaggtgcgtgtggccctggaggtcgaggatggccggaagcgctcattcgaagagctgcgagcgctggagagtgaggcacgcgagcggagattccctaatagcgaactcctccagcgcctgaagaattgcctttccgaagtggaagcttgtattgcccaggttcttgggctcgtgagtggccaggtggcgcgcatggacaccccccagttgactctcacagaactgcgggtactgcttgagcagatgggttccttaccttgcgccatgcatcagatcggtgacgtgaaagatgtattggagcaagttgaagcgtaccaggctgaggcgcgggaagctctcgcaacattaccaagctcacctgggttacttagatcactgcttgagcgcgggcagcagctgggcgttgaagtcccagaggcacaccaactgcagcagcaggtggagcaagcacagtggctcgatgaggttaagcaggccctagcaccatctgctcaccgaggttctctggtgataatgcaagggcttctcgtcatgggagccaagattgccagctccccaagcgttgataaggctagggcggagctacaggaactgcttactatagccgagcggtgggaggaaaaagcgcatttttgcttggaggcccgacagaagcatccgcctgcaactctggaggccataatccgagaaaccgaaaatattcccgttcaccttcccaatatccaggctctaaaggaagccctcaccaaggcacaggcctggatagccgatgtcgacgagatccagaatggagaccattatccttgtttagacgacttggagggcctggttgcggtcggcagagatttgccagtcggcctagaagagctcaggcagttagagctccaagtgcttaccgcacactcctggcgcgaaaaggcttctaagactttcctcaaaaagaactcatgttatacactattagaggtcctctgcccgtgtgccgacgccggctccgattccacaaagcgcagcaggtggatggaaaaagctctcgggctgtaccagtgtgacactgagctgctgggtctgagcgcccaggacttgagagatcccggctctgtgatcgtggccttcaaagagggagaacaaaaagagaaagaaggaatcctccaactgcgtcgcacaaacagtgcaaagccaagccctctggccccctcactgatggcttcatcccctacgagcatctgcgtgtgcggccaggtgcccgccggtgtaggagtgctgcagtgtgatctgtgtcaggactggttccatgggcagtgcgttagcgtccctcacctcttaaccagcccaaagccatcactgacctcttcgccactgcttgcatggtgggaatgggacactaaattcctgtgccctctgtgtatgcgctcacgacggccccgactggagaccatcctggctttgcttgtggccctccagcgcctgcctgtgagactgccagagggggaagctctgcagtgcctcacagagcgggccatcgggtggcaggatagagcacggaaggctcttgcttcagaagatgtgactgcactattacggcagttagcggagttgagacagcagctccaggctaaaccaaggcctgaagaggcgagcgtttacacgtcagccaccgcgtgtgacccgattcgggaaggctcaggtaataatatctctaaggtccaaggattattggaaaatggggactcggtaacatcacctgagaacatggcccccgggaaaggttccgacctggagctgttgtcctcgctactgccccagctgactggcccagtgctcgaactgccagaggcgatcagggcacccttagaggaactcatgatggagggcgaccttctggaagttacgctcgacgagaaccattccatatggcagctgctgcaggccggacagcctcccgacctggacagaatcaggaccctgctggaattggaaaaatttgagcaccagggcagccgcacccggtccagagccttagagagaagacgccggcgccaaaaggtcgatcagggtagaaatgtcgagaacctggtgcagcaagaactgcagtcgaagagagctaggtcgtctgggattatgtcacaggtgggacgagaagaggagcactaccaggaaaaagcagatcgcgagaacatgttcctgacgccttccaccgaccatagtccatttctaaagggtaatcagaatagccttcaacataaggactctggatag

SEQ ID NO: 122899 - DNA, 1278 bp, Artificial Sequence
  Description of Artificial Sequence: Synthetic coding sequence
atggaacctggctgcgatgagttcctcccacctcctgagtgtccagtatttgagccgtcctgggcggagtttcaggaccccctcgggtacatagcaaagattaggccaatcgccgagaaaagcgggatttgcaagataagaccaccggccgactggcagccaccttttgcagtggaagttgacaacttccgcttcaccccccgggtacagcgtctgaacgagctagaggcccagacccgggtgaaactaaactacctggaccagatcgccaaattctgggagattcagggaagcagcttgaagattccgaatgtggagaggaagatactcgatctttacagtctgtccaaaatcgtgatagaggaaggtgggtatgaagccatctgcaaggatcgtagatgggcacgtgtcgcgcaacgtctccactatccaccgggaaaaaatattggctcgctactgcgctcccattatgaacgcatcatctatccgtacgaaatgttccagtctggagctaaccatgtgcctgaaccaaccgaggaggacatagagaaacaccccgagctgaagaagctgcaaatttacggaccaggcccaaagatgatgggactgggactgatggctaaagacaaggataaaaccgtgcataagaaggtaacctgtccacctactgtgactgtgaaagacgaacaatcgggtggggggaatgtgagctctactctgctaaaacaacacctttcgctagagccttgtactaaaacgaccatgcagctcaggaagaaccattcaagcgcccagtttattgattcatacatttgtcaggtgtgctcccgtggggacgaagatgataagctccttttctgcgatgggtgtgatgacaattaccacatcttctgcttgctacctcctctacccgagatccctcgcggcatctggcggtgccctaagtgtattctggctgaatgtaaacagccacccgaggccttcggctttgagcaggccacccaggaatattccttgcagtcctttggggaaatggctgacagcttcaagtcggactatttcaacatgcccgttcacatggtaccaacggaactggtcgagaaggagttctggcgacttgtaagttccattgaagaggatgtgaccgtagagtacggagctgatatccactccaaggaattcggcagtggcttcccagtaagcaactcaaagcagaatctgagtccagaggagaaagagtacgccacttcaggatggaacctgaacgtcatgccctag

SEQ ID NO: 122900 - DNA, 2667 bp, Artificial Sequence
  Description of Artificial Sequence: Synthetic coding sequence
atggagcctggatgcgatgagtttctgcctcccccagagtgccccgtgttcgaacctagctgggcagagttccaagatcccctgggctacatcgccaaaatccgccccattgcagagaagtcaggcatctgtaaaatcagaccacctgccgactggcagccaccgtttgcggtcgaagtggataactttaggtttacccccagggtgcaacgactcaacgagctggaagcccaaacccgcgtgaagctaaactacctggatcagatagctaagttctgggagattcagggaagcagtcttaagatccccaatgttgagcggaagattctggatttgtacagcctgtctaagatcgtgattgaggagggaggttacgaggcaatctgcaaagatcggaggtgggcacgagtcgcccaacgcctccactatccccctgggaaaaacatagggtcactgttgcggtcacattatgagagaattatttatccctacgagatgttccagagcggagctaatcatgttcaatgcaacacccaccccttcgataacgaggtgaaagacaaggagtacaagccccatagcataccgttacggcaaagtgtgcagcccagcaagttttctagctactccaggcgagccaaacgcctgcagccagaccccgagcctactgaggaggacattgagaagcacccagagctgaagaagctgcaaatttacgggcccggccccaaaatgatgggtctgggtttaatggctaaagacaaggataagaccgtgcacaagaaggtgacctgcccccccaccgttacagtgaaagacgagcagagtggtggggggaatgtttcatccaccctgctgaagcagcacctctctctggagccttgtactaaaacgaccatgcagttaagaaagaaccactctagcgcacaatttatcgactcatatatttgtcaggtgtgctcgcgcggtgacgaggacgacaagcttttgttttgcgacggctgtgatgataattaccacattttttgcttgttaccccctctcccagagattccacggggcatctggcgctgtcctaagtgcatcctggcagaatgcaaacagccgccggaggcattcggattcgagcaagcaacccaagagtacagcttgcaatcgtttggcgagatggcggactcgtttaagagcgactacttcaacatgcccgtgcacatggtgcccaccgagctggtggagaaagaattttggcgcctcgtctcttccatcgaggaggacgtcaccgtcgagtatggcgcagatatccactctaaggaatttggatcaggatttcccgtgtccaatagcaaacaaaatctgagccccgaagagaaagagtatgctacttctggctggaatttgaatgtaatgcctgtgctggaccagagcgtgctatgtcacatcaacgccgacatctccggtatgaaagttccatggctgtatgtcggtatggttttctctgccttctgttggcatatcgaggatcactggtcctacagtataaactaccttcactggggggagcccaaaacctggtatggcgtgccaagcctggccgcggagcatttagaggaggtgatgaagatgctgaccccagaactgtttgactcccagcccgatctcctgcatcaattggtcaccctgatgaaccctaacacactcatgtcccatggcgtgccggttgttagaaccaaccagtgtgccggcgagttcgtgattacctttccacgagcctatcatagtggatttaatcagggatacaattttgccgaggccgtcaatttttgcacggctgattggctgcctgctgggagacagtgcattgagcattatagacgccttcgccggtattgcgtgttttcccatgaagagttgatttgtaagatggccgccttccccgagactctcgatttaaacctggcagtggctgttcacaaggaaatgttcatcatggtgcaggaggagcgcagactgcgtaaggctctgctggagaagggcgtgacagaagcagaacgagaggcctttgagctcctgccagatgatgagcggcaatgcatcaagtgcaaaaccacttgctttctatcagccttagcctgttacgattgcccagacgggctggtttgtctctcccacatcaacgacctttgcaaatgttcttcttccagacagtatctgagataccggtacacgctcgatgagctgccaacgatgctgcacaagctcaagattagggccgagtcttttgacacctgggctaacaaggtcagagtggcgttggaggttgaggatggacgaaagagaagcttcgaggaattgcgggctctggaaagcgaagccagagagaggaggtttccaaactcagagcttctacaacgattaaagaattgtctcagtgaggtggaagcatgtatcgcacaggttttaggtttggtgagcggccaggttgcccgcatggatacacctcagctgacgctaacggagctgagggtccttctcgaacagatgggatccctgccatgcgcaatgcaccagatcggcgacgtaaaggtgttaagctggaagtggaggaggtatgttttcccataccatttatgcgtgtatagcatgcaggggaacatcctacccgactag

SEQ ID NO: 122901 - DNA, 4713 bp, Artificial Sequence
  Description of Artificial Sequence: Synthetic coding sequence
atggaacccggttgcgacgagttccttccccctcctgaatgcccagtttttgagcccagctgggctgagtttcaggatcctctgggctacattgccaagattagaccaattgctgagaaaagcggaatctgcaagatccggccccctgcagattggcagcctcccttcgcagtggaggtcgacaacttcagatttacccctagagttcagcgtcttaatgaattagaagcacagacacgcgtgaagttgaactatctggaccaaattgccaagttctgggagatccagggatccagtctcaagattccaaacgtcgaaagaaaaatcttagacctgtacagcctgtctaagattgtaattgaggaaggcggatacgaggccatctgcaaggatagaagatgggccagagttgcccaacgactgcactaccccccggggaaaaatataggatctctcctcaggagccattatgaacgcattatctatccatacgagatgttccaaagcggggctaatcatgtacagtgcaacactcatcccttcgacaacgaggttaaagacaaggagtataagccccactcaattcccttgaggcaaagtgtgcagcccagcaagtttagttcctactcaaggcgggctaagcggctccagccagaccctgaacccacagaggaggacatcgaaaagcatccagagctgaaaaagctacaaatctacggccctgggccgaaaatgatgggactcggactcatggccaaggataaagacaagacggttcacaaaaaggtgacctgcccccctaccgtgaccgtgaaagatgaacagagtggcggggggaacgtcagctccacgctgctgaagcagcacctcagcctggagccctgcacaaagaccacaatgcagctgaggaagaatcattccagcgcacagttcatcgatagctatatctgccaggtgtgttccaggggggatgaggacgacaagttgctgttctgcgatggctgcgacgataactatcacatcttctgcctgctgcctccactcccggagatccctagaggcatctggcgctgtccaaaatgcattctcgcggaatgtaaacaacccccagaggccttcggctttgagcaggctactcaggaatactcattgcagagctttggtgagatggccgattcatttaaatccgattacttcaacatgccagttcacatggttccaacagaactggtagaaaaggaattctggaggctggtctcgtctattgaggaagatgtgacggtggagtacggcgcagatatccatagcaaggagtttggaagcgggttcccagtgtcaaattctaaacagaacttgtctcccgaagaaaagagacagtcactcacagtcctgaccaggctgataagctcgttttgggcacaggctgtcctgccaccatggcccccgaaagtactggggctccaggagtacgcaacctcgggctggaatcttaacgtgatgccggtccttgaccagtctgtgttatgccatatcaatgctgatatttctggcatgaaggttccatggctgtatgtcggcatggtgttcagcgcattttgctggcatattgaagaccattggtcttacagcatcaactacctgcattggggagaacctaaaacctggtatggcgtgccctcgctggctgcagagcacctagaggaagtgatgaaaatgctcactcctgagctgttcgactcccaacccgacctactccaccagctggtcaccctgatgaatcccaacaccctcatgtctcatggcgtccctgtcgtccgaactaatcagtgcgcaggagagtttgtgataacattcccaagagcttatcactcagggttcaaccagggttacaactttgcagaggccgttaacttctgtacggccgattggctgccagcgggtcggcagtgcatagaacattacaggcggctgcggcgatattgcgtgttcagtcatgaagaactgatctgcaagatggccgctttccctgaaacgctagacctaaaccttgctgtggcggtgcataaagagatgttcattatggttcaggaagaacgccgcctccgcaaagcactgctggaaaagggggtcaccgaggctgagagggaagcctttgagctcttgcccgacgatgagcgccagtgcattaaatgtaagacaacttgttttctgtcggccttggcatgctacgactgtccggatgggctggtatgcctgtcacatatcaatgatttatgcaagtgtagcagctctagacagtacctcagatatagatatactctggacgaacttcccacaatgttacacaaactgaaaatccgcgcagaaagctttgacacgtgggctaacaaggtcagggtcgccctggaagtggaagatggacgcaagaggagcttcgaggagctgcgggccctggaatcagaggcgcgtgagcggcgcttcccaaactctgagctcctacaaagactgaagaactgtttgagcgaggtggaggcctgtattgcccaagtcctggggctggtgtcaggacaggtcgcaaggatggataccccccagctgacactgaccgagctccgcgtgctcctcgagcagatgggatctttaccctgcgcaatgcatcagatcggtgatgtgaaagacgtgcttgaacaagtagaggcctaccaggctgaggccagggaagctctagccactctgcccagcagtccgggacttctccgttcattgctcgaacgggggcagcagttgggggtggaggttcctgaggcgcatcagttgcagcaacaggtggagcaagcccaatggttagatgaggtaaaacaggctctagcccccagcgcacaccgaggatccctagtgataatgcagggactcctggtcatgggcgcaaaaattgctagctctccatccgtagacaaggccagagcggagctgcaggagctcctcactatagcagagaggtgggaagaaaaggctcatttctgtctggaggcccgtcagaagcacccaccagcaacccttgaggcaatcatccgcgagacagaaaatattccagtacatctgccaaacattcaagcactgaaagaggccctcaccaaggctcaggcatggatagctgacgtagatgagatccaaaacggggatcattatccctgcttggacgatctggagggactggtggctgtggggagagatctcccagtgggccttgaggagctgcgccaactggaactgcaggtgttaacagcccattcatggagagagaaggcatcaaaaacctttcttaaaaagaattcttgttacacgctccttgaggtgctctgcccttgtgcagatgctggaagcgacagcaccaagcgcagcagatggatggaaaaggctttagggctgtaccaatgcgacacagagctcctgggactctccgcccaggatcttcgcgatccagggagcgtcattgtggccttcaaagagggagagcagaaagagaaagaagggatcctgcagctgcgtaggacgaatagcgccaagccctccccccttgctcctagcctcatggcttcatcgccaacgtctatctgtgtgtgtgggcaagttcccgctggggtcggcgtcttacagtgtgatttgtgccaggactggttccatggccagtgtgtgagtgtcccgcaccttctcacatcaccaaagccaagtctgacgtctagccccctcctagcatggtgggagtgggacacaaagttcctgtgtcctttgtgcatgaggtcaaggagacctagacttgaaacgatccttgccttactggtcgccttacagagacttcccgtgcgactgccagagggagaggcattacagtgccttactgagcgcgcaattggctggcaggacagagcaagaaaagccctcgcttcggaggacgtgacagctcttctcaggcagctcgccgagctcagacaacagctgcaggctaagccaaggcccgaggaagcaagtgtgtacacttccgccaccgcctgtgatccaattcgcgaggggtcaggtaataacatatccaaggtccaggggctgctcgagaacggggactctgttacgtctcctgagaacatggcccctggtaagggctctgatctcgagctgctttcctcactcttgccccagctgactggtcctgtacttgaactccccgaggcaatcagggcccctctggaggagctgatgatggaaggggatctcctggaagtcacacttgacgagaatcactccatctggcagctgctgcaggccggacaacctcccgacctggatcgtataaggacactgctggagctggagaagttcgaacaccagggaagccgcacgcgtagtagagcgctcgagcggcgccgcaggcggcagaaggtagatcaggggcggaacgttgaaaatctggtgcagcaggaactccagagtaagcgagcccgcagtagcggtatcatgtcacaagtgggtagagaagaggagcattaccaagagaaagccgacagggagaacatgtttttaacaccttcaacagaccattcaccattcctcaagggcaatcagaattcccttcagcacaaagatagtgggtcttctgctgcctgtccctccttgatgccacttcttcagctgtcatactccgatgaacagcaactgtag

SEQ ID NO: 122902 - DNA, 3297 bp, Artificial Sequence
  Description of Artificial Sequence: Synthetic coding sequence
atggatctgggcaccctttacgagtcttgtaaccaaccacaggacgcaatcaagtgctatctcaatgctactcgaagtaaatcatgttcaaatacgtcagcgctggccgcgaggataaagtacctccaggcacagttatgcaacctaccccagggttcactgcagaataagaccaaacttttgccctcaatagaagaagcttggtctttacccatccctgccgagttgacttctaggcagggcgctatgaacacagcgcaacaggcttgcaaaccacatcatccaaacacagaacccgtcctcggactgtctcagacccctatttcccaacaaagcctgccattgcacatgattcccagctcccaggtcgacgacttgtctagccccgccaaaagaaagagaacgtcaagtccaacgaaaaatacaagtgataattggtccggaggccacgccgtaagccatccccccgtgcagcagcaggcccattcgtggtgcctgacacctcagaaactgcagcacctggaacagctccgcgcaaacagaaataacctcaaccccgcacagaagcttatgctggaacaattggaatcccagtttgtgctcatgcagcagcatcagatgaggcctaccggggtggctcaggttagatctacaggaatacccaatggccccaccgcagatagtagtctcccaactaatagtgtgtcaggccaacagccacaactggcgctgacaagggttccaagtgtttcacagcccggtgttcgcccagcctgccctggtcagcccctcgccaacggccccttttccgctggccacgtaccatgcagcacaagcaggacattaggaagtaccgacactatcttgatcggaaacaaccacatcactgggtccggctcaaatggcaacgtcccgtacctgcagcgtaatgccctcaccttgccacacaaccgtaccaacttgacatcctctgccgaggaaccctggaagaaccagctatctaactccactcagggcctacataagggacaatcctcccactctgccggacccaacggtgagaggccactgagttcaactggcccttcgcaacatctgcaggcagccggctctggaattcaaaatcagaacggacatcccactctgccatcgaactccgtgacccagggagccgctcttaatcatctctcctcccatacagctaccagtggaggtcaacagggcatcacactgaccaaagaatctaagccttcaggcaacatcctgactgttcccgagacttcgcgacatacgggcgagacacccaactccactgcctctgtcgaggggttgcctaaccacgtccaccaaatgacagctgatgccgtctgctctccatcccacggcgactctaagagtccaggattactgagttctgacaacccccagttatcggccctgttgatgggcaaggctaataacaatgtggggactggcacatgcgacaaagtaaataacatccacccggctgtgcatactaagacggataattccgtcgcttcctcgccctcttcagctatttccacggccactccctcccccaagtccaccgagcaaacgactactaacagtgtcacttctctgaactccccccacagcggactgcatactataaacggtgagggcatggaggagagccagagtcccatgaagacagatcttcttctcgtgaatcacaagccctcccctcagatcatcccgtctatgagcgtaagcatctaccccagttcagctgaagtattaaaggcctgtcgcaatctgggcaaaaatggcctttctaactcaagcatactgctggataagtgtcctcctcctcggcccccatcatcgccttatccacccctcccaaaagataaactgaacccaccaacgccatccatatatctggagaataagcgggacgcgttctttcctcccctgcatcagttctgtaccaatccaaataaccccgtcactgtgattcggggcttggccggggcgctcaagctcgacttgggactgttctctaccaaaaccctggtggaagcaaataatgagcatatggtggaggtccggacccagctcctccagcccgctgacgaaaactgggaccccacagggacaaagaagatatggcattgcgaaagcaaccgcagtcatactacaattgccaaatatgcgcagtaccaggcttcttccttccaggaaagtctgagggaggagaatgaaaagcgatcccatcacaaagatcacagcgactcagagtcaacctctagcgataattctgggagaaggcgcaaaggtccatttaaaaccatcaagttcggaaccaacatagatctcagtgatgataagaaatggaagctgcagctgcacgagctcactaagctgcccgcctttgttcgggtggtgtccgctggcaatctgctgagccacgtgggacacaccatcctcggtatgaacacggtgcagttgtacatgaaggtacctgggtctcgcactccaggtcatcaagagaataacaatttttgctccgtgaatatcaacatcggccccggcgattgcgaatggttcgtcgttcctgaaggctattggggggtcctgaatgacttttgtgagaagaacaacttgaatttcttgatgggaagttggtggccaaacctggaggatctttacgaggcaaacgtaccggtatatcggtttatccagagacctggcgatctagtgtggattaacgctgggacggttcactgggttcaggctataggctggtgcaacaatattgcgtggaatgtcggccctctaactgcttgccagtataagctcgccgtagagcggtatgagtggaataagttgcaatctgtcaagtcgattgtgcctatggtccatctttcttggaacatggcccgaaatattaaagtgtcggaccccaagttgttcgaaatgattaaatattgtctccttcgtacactaaaacagtgccagacactgcgcgaggctctcattgcagcagggaaagagatcatatggcacggcagaaccaaggaagagcctgcccactattgttcgatatgcgaagtggaggtttttgacctcctcttcgttaccaacgagtccaactcccgcaaaacctatatagtacattgtcaggattgtgctcggaaaacctccgggaacctggagaattttgtggtcctggagcaatacaagatggaagaccttatgcaggtgtacgatcaattcaccttggcaccgccactcccttcagctagtagctag

SEQ ID NO: 122903 - DNA, 4206 bp, Artificial Sequence
  Description of Artificial Sequence: Synthetic coding sequence
atgaaatcctgcggtgtgtccctggcaaccgccgcggcagctgcagctgcctttggggatgaggagaaaaagatggccgcagggaaggcttcaggtgagagcgaagaggcttcaccatcactgaccgcagaagagcgagaggcccttggaggcctggacagcagactgttcgggttcgtccggttccatgaggacggcgcccgcactaaagcgctgctgggaaaagcggtgcggtgttacgaaagccttatcctcaaagccgagggtaaggtcgagagtgactttttttgccagttagggcattttaaccttttgctggaagattatccaaaagctctgtccgcataccagcgttattattctctgcaatctgattactggaagaatgctgcgtttctgtatggtctaggactcgtctatttccactataatgccttccaatgggctattaaggcctttcaagaagtgctgtatgtggatccaagtttctgccgggccaaagagatccacctccgcctcggtctgatgtttaaggtaaataccgattacgaatctagcttgaaacacttccagctggccctggtcgattgcaatccttgcactctttccaacgccgagatccagtttcacatagctcacctctacgaaacacagcggaagtatcatagcgcgaaggaggcgtacgaacagcttctccagaccgagaatctgtccgcgcaggtcaaagccaccgttctgcaacagttggggtggatgcatcacaccgttgatctactcggcgataaagcaactaaggaaagttatgccatccaatatttacagaagtcattagaggcagacccgaactccggccagtcatggtactttctaggccgctgttattcatctattggaaaggtccaagacgcttttatctcctacaggcagtccattgacaaatcagaggcaagcgcggacacctggtgctcaatcggcgttctttaccagcagcagaatcagcctatggatgcactccaggcttacatttgcgccgtgcaactggatcatggacacgccgccgcatggatggatttgggcactctctatgagagttgcaatcagccgcaggacgccattaagtgttacttaaatgccactcggtccaaatcgtgctccaacacatccgcacttgcggcaagaattaaatacctccaggcccagctttgcaatctaccccagggtagcttgcagaacaaaaccaaacttctgccaagtatcgaagaagcatggtccttgcctattcctgccgaactgacttcccggcaaggtgcgatgaacacggcccagcagaacacaagcgacaattggtctggaggacacgccgtctcacaccctcctgtgcagcagcaagcccactcatggtgtctaacaccacagaagttgcaacacctcgaacagctgcgggcaaacaggaataatttgaatccggctcagaagctgatgttagaacagttggagtcacagtttgtgctcatgcagcagcaccagatgcggccaacaggcgttgcgcaggtaaggtcaactggaattccaaacgggcctacagctgattccagtttgccaacaaactccgtgagtggacagcagccccagctggcgctgacccgagtgccttctgtgtctcagccgggtgtccgtcccgcctgtcccgggcagccattggcgaatggtcccttttcagccggccatgtgccgtgcagtacatcgcgcacgttaggaagcaccgacaccattttaataggcaacaatcatatcaccgggtcagggtccaatggaaacgtcccatacctacagcgaaatgccttaactctccctcacaaccgtactaatctgacaagctctgctgaagagccttggaaaaatcagctgtctaattctacacaaggcctgcataaaggtcaaagctctcactcggctggtcctaacggggaaaggcctctcagttctaccggtccatcccaacacctgcaggcagccgggagcgggattcagaatcagaatggacaccctactctcccttccaactccgttactcaaggtgccgccctcaaccacctgagcagccatacagcgacgtccgggggacagcaagggatcactctcaccaaagagagtaagccttccggcaacattcttacagttcccgaaacatccaggcacacgggtgagactcctaacagtacagcaagcgtcgaggggctgccaaatcacgtccaccagatgaccgccgatgccgtctgctcacccagccacggggattccaaatctccggggttactaagctctgataacccgcaactcagtgcactcctaatgggcaaagccaataataacgtagggaccgggacttgcgacaaggttaacaatatccacccggctgtgcacaccaaaacagataactcggtagcttccagccccagctccgctatcagcacggcgactccctccccaaagtctaccgagcagactaccactaactcagtcaccagtttaaacagcccccattcaggtctgcataccatcaacggtgagggcatggaggaatctcagtcccctatgaagacagacctcctgctggttaatcacaaacctagcccacagattatcccgtccatgagtgtgtccatttacccctctagcgcagaggttcttaaagcatgcaggaatctgggtaagaacggtctttcaaatagctccattcttttggataagtgtcccccacctaggcccccaagtagtccctaccctccgttgcccaaggacaagctcaaccctccaactccatccatctacttggaaaacaaacgcgacgcattttttccacctctacatcagttttgcactaatccaaacaacccagtgacagtgattagaggtctggctggagcacttaaacttgatctcgggcttttttctactaaaaccctcgtagaggccaataatgagcacatggtggaggtgcgcacacaactgcttcaaccagctgacgagaactgggaccctaccgggaccaagaaaatttggcattgcgaaagcaacagaagccatacaactattgccaaatacgctcaataccaagcgagttccttccaggaatcactgagagaagagaatgagaaacggtcccaccacaaagatcacagcgacagcgagagtacctcctccgacaacagcggacgcagacgaaagggcccctttaaaactatcaagtttggcacaaatattgacttatctgacgacaagaagtggaagctccaattgcatgagcttacaaaactgcctgcctttgtgcgggtagtgtccgctggaaatcttctgtcacacgtggggcacactattcttggcatgaatacagtgcagttgtacatgaaagtgcctggaagccgcacacctggtcatcaggaaaataacaacttctgttcagttaatattaacattggccccggcgactgcgagtggtttgtagtccctgagggatattggggcgtcctgaacgacttttgtgagaaaaataacctcaatttcctgatggggtcttggtggcccaatctcgaggatctctacgaagcaaacgtgcccgtgtatcgttttattcagaggccaggcgacttagtttggatcaacgctggaaccgtccattgggtccaggctatcggttggtgcaacaatatagcgtggaacgtgggacccctcactgcctgtcaatacaaactagcagtcgaacgctacgaatggaataagctgcagtcagtaaagtctatcgttccaatggtccacctgagttggaatatggcgcggaacatcaaggtctctgatcccaagctattcgagatgatcaaatattgtttgctgcgcaccctgaagcagtgccaaacactgcgcgaggcccttatcgctgctggaaaagaaatcatttggcacgggagaactaaggaagagccggcccattattgtagtatctgcgaagttgaggtcttcgatctgctgtttgtgacaaacgagagtaacagtagaaaaacctacatcgttcactgccaggattgcgcccggaagacatctgggaatctggaaaactttgtggtcttggagcaatacaagatggaagacttaatgcaagtatatgaccaattcactctggcacctccactgccctcagcgtcctcttag

SEQ ID NO: 122904 - DNA, 4227 bp, Artificial Sequence
  Description of Artificial Sequence: Synthetic coding sequence
atgaagtcttgtggagtctcactagctaccgccgctgctgcagctgccgcttttggcgacgaagaaaagaagatggcagcaggtaaggctagcggagagtcagaggaagcatcgcccagcctgaccgccgaggagcgcgaggccttaggcggcttagacagccggctctttgggttcgtcaggtttcacgaggacggggctagaactaaagctctgttaggcaaagcggtcagatgctatgagtcgctgattctgaaagctgagggcaaggttgaatcagacttcttctgccaattgggccattttaacctgctattggaagattatcccaaggccctgtctgcctatcagcgctactactccctccaaagtgactactggaaaaacgcagcctttttgtatggcctgggattagtgtattttcactacaacgcctttcaatgggccatcaaggcatttcaagaggtgttgtacgtcgatcccagcttctgtcgagcgaaagaaattcatcttagactcgggctgatgttcaaggtgaacacagactacgaaagcagcctgaaacactttcagctggcactggtcgattgcaatccttgtacactgagcaacgcggagatccagtttcacatcgcacacttgtatgagacacagagaaaatatcactcagctaaggaggcttatgaacagctcctccagacggagaacctcagcgcacaagtgaaggccacagtactgcagcagttagggtggatgcaccacaccgtcgatctactcggtgataaagccacaaaagaaagctacgccatccagtatttacagaaaagtcttgaggctgaccctaattctgggcaaagttggtactttctgggcaggtgttacagttctattggcaaggtgcaagacgcatttatctcgtaccgacagagtattgacaaaagcgaggccagcgctgacacgtggtgcagcatcggagtgctgtatcagcagcagaaccagccgatggatgcgcttcaggcctacatttgtgcagttcagcttgatcatggtcatgccgccgcctggatggacctcgggaccttgtatgagtcctgcaaccagccccaggacgcaatcaagtgctacctaaatgctacaaggtccaagtcttgtagtaatacaagcgcattagctgcgcgcatcaaatacttacaggcgtgcaagcctcatcacccaaacactgaaccagtgcttggcctcagccaaacccctatcagtcagcaatctcttcccctccacatgattcctagcagtcaggtcgacgatctttctagtcctgcaaagcggaagcggacatcgagccctacaaaaaatacctcggataattggtctggaggtcacgctgtgagccacccacctgtccagcagcaggcgcatagctggtgcctgacaccacagaaactccagcatctggagcaactgcgggcgaatcgtaacaatctgaaccctgcccaaaaactgatgctagagcagttggaatcgcaattcgtgctgatgcagcagcaccaaatgcgacctacaggtgtcgcccaggtgaggtcgaccggcatccctaatggaccaacggcagattcctccctgccgacaaactcggtgtcaggccagcagccccagctcgcgctaactagagtaccttccgtgtctcagcccggtgtgcgcccagcatgtccggggcagcccttagccaatggaccgttctccgctggacacgtaccgtgctcgacttcgagaactctgggttcgaccgataccatcttaataggtaataaccatatcacagggtcaggatccaacggcaacgtgccctatctccaaagaaacgccctcactctgccccacaatcggacaaacctgacgagctccgctgaagagccctggaaaaaccagctgagcaacagtacccagggcctgcataaagggcagtccagccatagcgcaggccccaacggggagcgtcccctttcctctacaggacccagccagcaccttcaggcggccgggagcggtatccagaaccagaatggtcaccctactctccctagcaatagcgtgacacaaggggcagctctgaaccatctgtcctctcatacagccacctccggaggccagcaggggatcacactgactaaagagagcaagccatctggtaatatcctgactgtccccgagacatcccggcacaccggggaaacgcctaattcaactgcgtccgtcgagggcttgcctaaccacgtgcaccagatgactgcagacgccgtttgcagtccctcacacggcgattctaagtcaccaggcctgttgtcctcagataacccacagctgtctgccctccttatgggcaaggcaaataacaatgtgggaaccggaacttgcgacaaagttaacaacatccaccctgcggtccacaccaagactgataactctgtggcctcctcgccaagttccgccatttctacggctacgcctagccctaagtccactgagcaaaccaccactaattccgtgacaagtctcaattctccccactcgggtctgcataccatcaacggagagggaatggaagagagtcagtcaccaatgaagacggatttgctgctcgttaaccacaagccctccccacagattataccatctatgagcgtgagtatctatccgagttccgccgaggttttgaaagcttgcaggaatctgggcaagaatggcttaagcaactcatctatcctcctcgacaagtgccctccccctagacctccaagcagcccatatcctccgctgcctaaagacaaactgaatcctccgaccccctcaatttatttggaaaacaagcgtgacgctttctttccgcctctccaccagttttgtaccaatcccaacaatcccgtaaccgtgatacgaggcctggccggcgcccttaagctggatctcgggctcttcagcacaaaaacactcgtcgaagccaataacgagcacatggtagaggtgcgcacccagctgctgcagcctgccgatgaaaactgggatccaactggcactaaaaaaatctggcattgcgaaagcaatcggtcccacacaactatcgcaaagtacgcacaataccaggccagctcctttcaagagagtctccgcgaggagaatgagaagcggagccaccataaagatcattccgactccgaatctacgtcttctgataatagcggcagaagacgtaaagggcctttcaagacaattaaattcggcacgaacatcgacttatctgatgacaagaagtggaaactgcagctccacgagctgactaaactacccgccttcgtgagagtggtgtcagcaggaaatttgctgtctcacgttggacacacaattctcggcatgaacacagtgcagctgtatatgaaggtgcctggatccaggactccaggacaccaagaaaataataacttctgcagcgtgaacattaatatcggacccggcgactgcgagtggtttgtggtgccagaggggtattggggcgtgctgaatgacttttgcgaaaaaaacaacctgaacttcctgatgggttcttggtggcccaatctggaggatctgtatgaggccaatgtcccagtttacagatttattcagcggccgggcgatttggtctggatcaatgcgggcactgtgcactgggtccaagccattggctggtgcaataatattgcgtggaatgtggggccgctcacagcctgtcaatacaagctggccgttgaacgatatgaatggaacaagctccagtcagtaaaaagcatagtcccaatggttcatttaagctggaacatggcccgtaacatcaaagtatctgacccaaagttattcgaaatgatcaaatattgcctactcagaacattgaagcaatgccagactctccgggaagccctgatcgcagcaggcaaggagatcatatggcacggccgaactaaggaagagcctgcccattattgttccatatgtgaagttgaggtgttcgacctgctgttcgtgaccaatgagtcgaatagtcgtaagacttacatagtacactgtcaggactgcgcacggaagacaagtggtaacctggagaactttgtggtgctggagcagtacaagatggaggacctgatgcaggtttatgaccagttcacactggctcctcccctcccttccgcctccagttag

SEQ ID NO: 122905 - DNA, 3000 bp, Artificial Sequence
  Description of Artificial Sequence: Synthetic coding sequence
tgaggcaccctctatgagagttgtaaccagcctcaagacgccattaagtgctacctgaatgcaactagatctaagtcttgtagcaacacgagcgcactggctgctaggataaagtatctgcagaatacaagtgacaattggtcaggaggacatgcagtgagccacccacctgtccagcagcaagcccactcttggtgcctgactcctcaaaaacttcagcatcttgagcaattgcgggcaaaccgaaataacttgaacccagcccagaagctcatgcttgaacagctggagtctcagtttgtcctgatgcagcagcatcagatgcggccgacaggggtggcccaggtccgctcaaccggcattcctaacggcccgactgcagattcctcccttcctaccaacagcgtctcgggccaacagccccaactggcactcacacgtgtcccaagcgtctcacaacccggggtgcggcccgcctgcccggggcaacccctcgccaatggacctttttcagcaggtcatgttccatgttccacctccaggactctaggcagcactgacacaattctaatcgggaacaaccatatcaccggaagtgggtccaacggcaacgtcccttatctgcaacggaacgcactgactctgccccacaatcggaccaacctcacgagctcagcggaggagccatggaaaaatcagttaagtaactcaactcagggcctgcacaagggccagtcttcccattctgcaggcccaaatggcgagcgaccattgtcatcaacaggtccctcgcaacatcttcaggcagcaggaagcggcatccagaaccagaatgggcaccccaccttaccttccaatagtgtgacacaaggggccgcactgaaccacctgtcgtctcataccgctaccagcggcggtcaacagggaatcacactgacaaaagaaagcaagcctagtggaaatattctgaccgtgcccgaaacttcaagacataccggcgaaacccccaactctacagcctctgtggaaggactcccaaatcacgtgcatcaaatgactgcggatgccgtgtgctctccttcacacggtgacagcaagagccctgggctgctgtccagcgacaacccacagctttcggctctactgatggggaaagctaataacaatgtgggaacgggcacctgtgacaaggtgaacaatatccatccagctgtccacactaagacggacaattccgtcgctagctcgccttccagcgccatatcgacggctacaccctcgcctaaaagcacagagcagacaacgaccaattccgtcacctcactaaactccccccactctggactacatacgattaacggggaaggaatggaagaatcccaatcccccatgaagacagacctccttctggtcaaccataagccaagtccacagatcattccatctatgtctgtcagtatctatccctcctcagctgaggtgctcaaagcctgccgcaatctgggtaagaatggcttgagcaattcttctattctgttggataagtgcccacctccccgccctccttcaagcccctatccaccattgccaaaggataaacttaaccctcctaccccctctatttacctcgaaaacaaaagagacgccttttttcctccactgcatcagttctgcaccaatccaaataatccagtgaccgttatcaggggtctggcaggggctctgaagctcgacctgggcctgttctctaccaagacccttgtggaagcgaacaatgaacacatggtggaggtccggacccaactattgcagcctgccgacgaaaactgggatcctacagggaccaaaaagatatggcattgtgaaagcaatcgctcacacactaccatcgccaaatatgcccaataccaagcatccagcttccaggagtccctgcgtgaagagaacgagaagcgatcgcaccataaggaccactccgacagtgaatcaacctccagtgacaatagtgggcgccgcagaaagggaccattcaagaccatcaaatttggtaccaacatcgatctaagtgatgataagaaatggaaactacagctgcatgagctgaccaagctcccagcctttgtgagggtcgtttctgcaggcaatttgcttagccatgttgggcacacaattttggggatgaacactgtccaactgtatatgaaggtgccaggttcacgcactcctggtcatcaggaaaacaataatttctgctcagtcaatattaacatcggacctggggattgcgagtggtttgtcgtgcctgagggttactggggcgtactcaacgatttctgtgaaaagaataatctaaatttcctcatgggctcctggtggcccaacctggaagacctttacgaagcaaatgttcccgtttaccggtttattcagcgccctggagatctggtgtggattaacgctgggacggttcattgggttcaagccatcgggtggtgcaataatatcgcctggaatgtggggccattgactgcttgtcagtataaactggcagttgagcggtatgagtggaacaaactgcagtctgtgaagagtatcgttccgatggtacacctgagttggaatatggcccgtaatattaaagtgagtgatcctaagctgttcgagatgattaagtactgtctcctccgcacgttgaagcagtgtcaaaccctcagggaggcgctgattgcagctggaaaagagataatatggcatggtaggaccaaggaagagccagcccactactgttcaatctgtgaggtggaggttttcgacctgctcttcgtgacaaatgagagtaatagtaggaaaacttacatcgtgcactgccaggattgcgccaggaagacctccggaaaccttgagaactttgtggtgctggaacaatataaaatggaggatctgatgcaggtgtatgaccagttcacactggccccaccattgccctcagcctccagttag

SEQ ID NO: 122906 - DNA, 486 bp, Artificial Sequence
  Description of Artificial Sequence: Synthetic coding sequence
taggcgaggaatatcaaggtgagtgatcccaaactgtttgagatgattaagatcttttcgctgtcccccaactttcgagccgagaagtgcctgagagatcatctggtgcagcctctcagaagcaatggggagcctgagcccctgagatttacgggcgaatactgccttctgagaacactgaagcagtgccagaccctgcgagaagcgctgattgcagccggaaaggaaattatttggcacggcagaactaaagaggagccggcccactattgctcaatctgcgaggtggaggtgtttgacctgttgttcgtgaccaacgaatccaactcccggaaaacatatattgtccattgtcaagattgcgcacgcaagacttctggaaaccttgaaaactttgtggtgttggagcagtacaagatggaggacctgatgcaggtctacgaccagttcacactggccccacccttaccttcggcctcgagttag

SEQ ID NO: 122907 - DNA, 3135 bp, Artificial Sequence
  Description of Artificial Sequence: Synthetic coding sequence
tagaacaaaactaagcttctcccctcgatcgaagaggcttggagcctgcctatacctgccgagttgacctcgaggcaaggagccatgaatacggcacagcaggcctgcaagccgcatcacccgaacactgaaccggtgctgggactctctcaaacgccgatctcacagcaaagcttgcccttgcacatgatcccctcaagccaggtggacgaccttagttctccggcgaagcgcaaaagaactagcagtccaacgaaaaatacgagcgataattggtcgggtggacacgccgtcagtcatcccccagttcagcagcaagctcactcgtggtgtctgacccctcagaagttgcagcatctcgagcagttgagagcaaaccggaataatctcaatccagcacagaaactgatgctggagcaactggaatcacagttcgtccttatgcagcaacatcagatgcgcccaactggggtcgctcaggttaggagtaccggcatccctaacggccccactgccgatagtagcctccctacgaattcagtgagcggccaacagcctcaattagctctgacccgggtgccaagtgtcagtcagcctggcgttcggccagcctgtccaggacagcccctcgcaaatggaccgttttccgcaggccatgtcccatgctcaacctcccggacactgggatccactgacacaattctcataggtaataatcacatcaccggttctgggagcaatggaaatgtcccatacctgcaacgcaatgccctgactctgccccacaacaggaccaacttgacatcaagcgccgaggaaccttggaaaaatcagcttagtaacagcactcagggtttgcacaaaggacaatcgtcccattcagccggtcccaacggtgaacgccccttatcatctaccggtccatcacagcaccttcaagctgctggcagcggcatacagaaccaaaacggacaccctacattaccaagcaactccgttactcaaggggccgctctgaatcacctttcaagtcatacagccaccagtggtggacagcaagggatcacgctgacaaaggagagcaaaccgtccggcaacattctcactgtaccagagaccagcaggcacacaggagagacaccgaatagtactgctagtgtggagggcttaccaaatcacgtccaccaaatgacagcggatgctgtctgcagcccctctcatggcgattctaaatctccaggtctgctctcatctgacaaccctcagttgtctgctctgcttatggggaaagctaataacaatgtaggcactggcacttgcgacaaggtgaataacatacatcccgccgtccacacaaagaccgataactctgtggcaagctccccgtcatcggccatttccaccgccacaccctctccaaagagcacagagcaaacgaccactaattccgtaacctccctcaacagcccccatagtgggctgcatacaataaacggcgagggcatggaggagagtcagtccccgatgaaaaccgatcttctgctggtgaaccacaagcctagtccccagatcatcccctcaatgagcgtctccatatatccatccagcgcagaggtgcttaaggcatgtaggaacctcggtaaaaacggtctgagtaattcatccatactcttagataagtgcccacccccacgccccccttcaagtccttatccccccctgccaaaggataagctgaatcccccaacgcccagcatctacctcgaaaataagcgggacgcctttttcccacccctgcaccaattttgcactaatccgaataaccccgtaacagtcatacgaggcctggccggagcccttaagctggacctgggtttgttttcaaccaagactctggtggaggcaaacaatgagcatatggtggaggtgcgaacccagctcctccagcccgccgacgagaattgggaccccacaggcactaagaagatctggcattgcgaaagtaatcggtctcacaccaccatcgccaagtacgctcagtatcaagccagctcattccaggagtccctgagagaggaaaatgaaaaacgctcccaccataaagaccactccgactcagaaagcacaagctccgacaattccggccgcaggcgtaaggggccctttaagacaatcaaatttgggacgaacattgacctttctgacgacaaaaaatggaagctgcagctgcatgagctcactaagttaccagcattcgtgagagtggtgagtgccggcaatctattgtcccatgtgggccatacgatcctggggatgaacaccgtccagttgtacatgaaagtgccagggtctcgtacccccggacatcaggaaaacaacaacttctgtagcgttaacattaatatagggccaggagactgcgaatggttcgtagtccctgagggttactggggggtgctaaacgacttctgtgaaaagaacaacttgaacttcctcatgggatcatggtggcccaacttggaggacctgtatgaggctaatgtgccggtgtatagattcattcaacgccccggcgacctggtctggattaacgctggaacagttcactgggtgcaggcaatcggctggtgtaacaacatcgcttggaatgtgggtcctttaactgcctgccagtataaattggccgtggaaaggtacgaatggaacaagttacagtcagtgaagtcaattgtgcccatggtccatctctcatggaatatggcacgcaacattaaggtatccgacccaaaactgtttgagatgatcaagtactgccttttacgcacacttaagcaatgtcagacattgagagaggccctgatcgcagccggaaaggaaatcatctggcatggccgcaccaaagaggaaccagcccattattgctcaatctgcgaggtggaggtcttcgatcttcttttcgttactaacgagagcaacagccgtaagacctacatcgttcattgtcaggattgcgctcgcaagacctccggaaacctggaaaacttcgttgtgctggagcaatataagatggaggacctcatgcaggtgtatgatcagtttacactggcacctccactgccatccgcctcttcctag

SEQ ID NO: 122908 - DNA, 675 bp, Artificial Sequence
  Description of Artificial Sequence: Synthetic coding sequence
taacttcaggcgtacatttgtgccgtgcaattagaccacggccatgccgccgcttggatggacttagggacactttatgaatcttgcaatcagcctcaggacgccattaaatgctaccttaacgccacaaggtccaagagttgcagtaatacctccgccctcgccgcaaggatcaaatacctacaggcccagctgtgtaatttgccccagggctcattgcagaataagaccaagctgctgccgtctattgaggaagcctggagcttgcccattcctgcagaacttaccagcaggcagggcgcaatgaatacagctcagcaaaacactagcgataactggtctgggggacatgctgtgagccatccacccgtacaacaacaagcccacagctggtgcctgacccctcagaagttacagatgcgccctactggagtggcgcaggttcggtcaactgggatccccaacgggccaactgccgattcttccctccctaccaacagcgtatctgggcagcagccccaattagccctgactcgggtcccgagcgttagtcagcctggagtgcgccccgcttgtcccggccagccgttggccaacggaccgttttccgcagggcatgtgccctgcagcactagtcggactttgggctcaaccgacaccattctgattggctag

SEQ ID NO: 122909 - DNA, 516 bp, Artificial Sequence
  Description of Artificial Sequence: Synthetic coding sequence
tcgctccagaataagacaaagttgcttccttctattgaggaggcttggtctctccccattcccgccgaactgacttctcggcagggggctatgaacactgctcagcaaaatacttccgataattggtcaggcggccacgccgtaagtcatcctccggtgcagcagcaggcccattcttggtgtctgacgccgcagaaactgcagcacctggagcagctgagagccaatcgaaacaatcttaatcctgcccagaagcttatgttagagcagctcgagtctcagttcgtgctgatgcaacaacaccagatgcgtcccaccggcgtggcacaggtgagatccacagggatccccaatggccccacagccgactcaagcttaccaacgaattccgtgagtggccaacagccacaactggccttgacgcgggtgccgagcgtgagccagcccggggtccgcccagcttgccctggacagcccctggccaacggacccttctgccgaccatgctccctctag

SEQ ID NO: 122910 - DNA, 4071 bp, Artificial Sequence
  Description of Artificial Sequence: Synthetic coding sequence
atgaagtcctgcggggtcagcctggccacagcagcagccgccgccgccgcgttcggcgatgaggagaaaaagatggcagcgggaaaggcttccggtgaatctgaagaggcctctccttcgttaacagcggaagagcgtgaagcgctgggaggactggactccagactgtttggcttcgttaggtttcacgaggacggggcgagaacaaaagcgctgctaggaaaagctgtgcggtgctacgagagcctgatccttaaagcagagggcaaagtagaatctgatttcttctgccagttgggacacttcaacctgctcctggaggactatccaaaggccctgtcagcctaccagcgttactattctctgcagagcgactactggaaaaatgctgcttttctgtacggcctgggactggtatacttccattataatgctttccagtgggcgattaaagcgttccaggaagtcctgtacgtggacccgtctttctgtcgtgcaaaagagatccatctccgtttaggactcatgtttaaggttaacacggattacgagagcagccttaaacacttccaactggctttagttgattgtaatccttgtaccttgtctaacgccgagatccagtttcatatcgcccacctgtatgagacacaacgaaaatatcactctgccaaggaagcatacgaacagctgctccagacggagaatctgagcgcacaagttaaggccacagtgcttcagcagcttggctggatgcaccacacagtagatctccttggggacaaggccactaaagagtcctacgcaatccagtatctccagaaatctctggaggctgaccccaactcaggccagagttggtatttcctcgggcgctgctattcttcaatcgggaaagtgcaggatgcgttcatatcttatcggcagtccatcgacaaaagcgaggcctccgccgatacatggtgctcaatcggggtgctttaccagcaacagaaccagcctatggatgccctacaagcctacatatgtgccgtgcagttagaccatggacacgcggcggcctggatggatctgggcactctgtatgagagttgcaaccagcctcaagacgctataaagtgctatctgaacgctacacgctcaaaatcctgctccaataccagtgccctagctgctcggattaaatacctgcaaaacacctccgacaattggagcggtggccacgccgtctctcatccacccgtacaacaacaagcacattcatggtgtctgacgccccagaagttacaacatctagaacagctacgcgccaataggaacaacctgaatcccgctcagaagctgatgctggagcagctggagtctcagttcgtcctgatgcaacagcatcaaatgagacccacgggcgttgctcaggtccggtcaaccgggattcctaatggtccaactgctgattcttctctgcccacaaatagcgtgtccggccagcagccacagctcgcactgacaagggtgccctcagtgtcgcagcccggggtacggccggcatgccccggacagcctctggctaacgggccattctccgccgggcacgttccctgtagtactagcagaactctagggagtaccgacacaatactgataggtaataatcatattaccggtagcgggtcgaatggaaatgttccgtacctccagcgcaacgcgctcaccctcccacacaacagaaccaacctgacctcctccgcggaggaaccatggaaaaaccagttgagcaattctacccagggtctgcacaaggggcagagctcgcatagcgccggccctaacggggaaagacccttgtctagcactggcccctctcagcatctgcaggcagccggtagcggaatccagaatcagaatgggcatcccacgctgcccagcaactctgttacacagggtgcagctctgaaccacctatccagccataccgctacctctggagggcagcaggggattacgctgaccaaagagtccaaaccttccggcaatatattgacagttccggagacgagtcgacacaccggagaaacaccaaattccaccgcatcagtggaggggctgcccaaccacgtgcatcagatgacagcggacgcggtctgctcaccctcacatggcgatagcaagtcacctggtctgctgagctccgacaaccctcagctgagcgcattactaatgggtaaggccaacaataacgtgggtaccgggacctgcgacaaggtaaacaacatccaccccgcagtgcataccaagaccgataactctgtcgctagctccccatcttctgccatttctactgccaccccttcccctaagtccacggagcagacgaccactaattccgttacatccctaaacagccctcactctggactgcacacaattaatggagagggcatggaggaatctcagtcaccgatgaaaacagacctcctccttgtgaatcataaaccctcgcctcagattatcccctccatgtcggtatctatttacccgtcctcagccgaggtactgaaggcatgcaggaatcttggtaaaaacggcttgtccaattcctctatactgctggataagtgcccacctccaagacctccaagctccccataccctccattgccaaaggataaactgaatccccctaccccgtctatctatctggagaacaaacgggacgccttttttcctcctctccatcagttctgtacaaaccctaataaccccgtgactgtgatacgtggactggcaggcgcgctcaagttagatctcggtctcttctccacaaagacgttggtcgaggcaaataatgagcacatggtggaggtacggactcagctgctgcagccagcggacgagaactgggaccccaccggtactaagaaaatctggcactgcgaaagcaacagaagccatactaccatcgctaagtatgctcagtaccaagccagcagcttccaggaaagcctgcgcgaggaaaatgaaaaacggagtcatcacaaagatcactcagattcagaatccacgtcctccgataattctggaaggcggagaaaggggccatttaaaactattaagtttggaactaacattgatttgtctgatgacaagaagtggaaattacagttgcacgaactcacgaaactgcctgctttcgtccgggtggtgtctgctggcaacctcctaagtcatgtgggccacacaatcttgggtatgaacacagttcagctttatatgaaagtgccaggttcccggacgccaggtcatcaggagaacaataatttttgctctgtgaatatcaacatcggcccaggcgactgtgagtggtttgtggttccagaaggatactggggcgtcctcaacgacttctgtgagaagaataatctaaacttcctgatgggttcctggtggccaaacctggaggatctttatgaagctaatgtgccggtgtaccggtttatccaaaggcctggcgatttggtctggatcaacgcaggaaccgtgcactgggttcaggctatcgggtggtgtaataatatcgcatggaatgtcggacctctcacggcctgtcaatataagctggcagtggagagatatgaatggaataagctccagtctgtaaagtccattgttccaatggtgcacctgagttggaatatggcccggaatattaaggtgtctgatccaaagctcttcgaaatgattaagtactgtctgctgaggaccctgaagcagtgccagacccttagggaggcgctcatcgcagctggaaaggagatcatttggcacggcaggaccaaggaagaaccagcccattactgctcaatttgcgaggttgaggtttttgaccttctgtttgtgacaaatgaaagcaattcccggaagacgtacatagtgcactgtcaggactgcgcgcgtaaaaccagcggtaaccttgagaattttgtagtgttggaacagtacaagatggaggacctgatgcaggtgtacgaccagtttactctggctcctcctctcccctccgcctccagctag

SEQ ID NO: 122911 - DNA, 675 bp, Artificial Sequence
  Description of Artificial Sequence: Synthetic coding sequence
atgaagagttgtggggtgtcactcgcgaccgctgccgctgcagcagccgccttcggcgatgaagagaaaaagatggctgcggggaaggcttctggtgaaagtgaggaagcgtcccctagtctgaccgccgaagaacgtgaagccctgggaggtctggatagccgcttatttggtttcgtccgatttcacgaggatggagccagaacaaaggccctactggggaaggcggtgaggtgctatgagtctttgattctgaaggcagagggaaaggtggagtccgacttcttctgccaactggggcacttcaatctcttgctcgaagactatcctaaagccctcagcgcatatcagaggtattactccctgcagagtgactactggaagaatgcagcctttctgtacgggttaggcctggtttattttcactacaatgcctttcaatgggcaattaaggcgtttcaggaggtattgtatgttgacccaagtttctgccgtgcgaaggaaatccacttacgccttgggctgatgtttaaagtcaacaccgattatgaaagttccctgaaacacttccagctggcgctggtagattgcaatccatgcactttgtccaatgctgaaatccaattccacattgcgcacctgtacgagactcaggtgggctgtattaccctctag

SEQ ID NO: 122912 - DNA, 3969 bp, Artificial Sequence
  Description of Artificial Sequence: Synthetic coding sequence
atgaagagctgcggagtttccctggcgaccgccgctgccgccgccgccgccttcggtgatgaagaaaaaaaaatggcagctggaaaagcctcaggagagtccgaggaagcatctcccagcctaaccgctgaagagagggaggcattgggtggactggattctagactatttggatttgtccggtttcacgaggacggggcccgcactaaggccttactgggtaaagctgtgcgatgctatgagagcctgatcctcaaggcagagggaaaggtggagtccgatttcttctgccagctcggtcatttcaacctacttctggaggattatccaaaagccctcagcgcataccagcgctactatagtcttcagtcggattattggaagaatgctgcgttcctgtatggcctgggtctggtctacttccattataatgccttccaatgggccattaaagcctttcaggaggtactctacgtcgatccatctttttgccgcgccaaggagatacacctacgactcgggctcatgtttaaggttaatacggattatgaaagctcgctgaagcactttcagctggcactggtagactgcaacccctgcaccttatctaatgccgaaatacagtttcatatcgcccacttgtacgagactcagcgtaagtatcattccgccaaggaagcctacgaacagttgttgcagactgaaaacttaagtgcccaggtgaaggctacagtcctacagcagctcgggtggatgcatcacactgttgatttgcttggcgacaaggctactaaagaatcctatgctattcagtatttgcagaagagcctcgaagcagatccgaactctggacagagctggtatttcctggggcgatgttattcctccattgggaaagtgcaggatgcctttatatcctataggcagtctattgacaagtctgaggccagtgccgacacatggtgtagtatcggtgtgctgtaccaacagcagaatcaacctatggacgcgctgcaggcttacatctgtgcagtccaactagatcatgggcatgctgctgcttggatggatctgggaaccctctatgagtcatgcaatcagccacaggacgccatcaagtgctacctgaacgctactcgtagcaagtcttgttccaatacctctgcactcgccgcccgcattaaatacctccaaaacacgtccgataattggagtggtggacacgccgtatcacatcctcccgtgcagcagcaagcgcactcttggtgcctcacgccccagaaacttcagatgcgcccaaccggcgtggcccaagtacggagcacaggtatcccgaatggacccaccgccgacagcagtctgcctactaacagcgtcagcggacagcaacctcagctggctttaacccgcgtacccagcgtgagccagcctggggtgcgtcctgcatgccctggacagcctctagcaaatggaccattttccgctggccatgtgccatgctcaacctcacggacactggggagcactgatacaattctgatagggaacaatcacattacgggtagcggctcgaacgggaacgtcccttaccttcaacggaatgccctcacactgcctcacaatcggacgaacctgacgtcctccgctgaggagccatggaagaaccaactatcgaatagcacccagggactccacaagggacagtctagccacagtgctggtcctaacggcgaacgacccctctcatcgacaggtccgtcccagcatttacaggcagcaggttcaggtattcagaaccagaatggtcatcccactctgccatcaaattctgtcactcagggcgccgcacttaaccacttgtcaagccacacagccacttccggcggccagcaaggcatcaccctcactaaagagtccaaaccttccggcaatatactcaccgtccctgagacttccagacacacaggcgaaacacctaacagcaccgcctctgtggagggccttcccaaccatgttcaccagatgaccgccgacgcggtgtgctcgccctcccacggagactctaagtcacccgggctcctcagctcagataacccccagctgtccgccctcctcatgggcaaagccaacaataatgtgggcacaggtacatgcgataaggtcaataatatccaccctgccgtccacaccaaaaccgataatagcgtggcctcatctccatcctccgcaatcagcacagccacaccatccccgaagagcaccgagcagacaaccactaatagcgtcacaagtttgaattctccccactccggtctgcatactatcaacggcgagggaatggaagaaagccagagccccatgaagaccgatctcctcctagtgaatcacaaaccgagccctcagattatcccatccatgagcgtcagcatctaccccagttccgccgaggtcttgaaagcatgtagaaatctgggcaaaaacggtctgagcaactctagtattctactcgacaaatgtcccccacccaggcctccctcttcaccttatccccctctgccaaaggataaactgaatcccccaaccccgagtatatatctggaaaataagagagacgcatttttccctccactgcaccagttttgcaccaatcccaataatcccgtgaccgtcattagaggtctcgccggagccttgaagctagatttgggactgttcagcactaagaccctagtggaagcgaataacgaacacatggtggaagtgcgcacacagttgctgcaacctgccgatgagaattgggaccccactggaacaaagaaaatctggcactgtgaatctaacaggagtcatactactatagctaaatacgcacagtatcaggcgtcttcctttcaagagtccttgcgggaggagaatgagaagaggtctcaccataaggaccatagcgactccgagtctacgagctctgacaacagcgggcgacgccgcaaaggacccttcaagaccattaaattcgggaccaacattgacctttcagatgacaaaaagtggaagctacaattacacgagctgacaaaacttccagccttcgtccgcgtcgtgtccgccgggaatcttctaagccacgtggggcacacgatcctaggtatgaacaccgtgcagctgtacatgaaagtcccaggtagtagaacacccgggcaccaggaaaataataatttctgcagcgtgaatatcaacattggcccaggggattgcgagtggttcgttgtgcccgagggttattggggtgtgctgaatgacttttgtgaaaagaataatctgaactttttgatgggttcgtggtggcctaacctggaggatctgtatgaagccaatgtccccgtctacagatttatacagcgaccaggtgacttggtatggattaatgccggcacagtgcactgggtccaagcaattgggtggtgtaataatatcgcctggaatgtgggccctctcacagcctgtcagtacaaactggccgttgagagatatgagtggaacaagctgcaaagcgtcaagtctattgtccccatggtgcacctttcctggaatatggccagaaatataaaagtcagcgatccaaaacttttcgaaatgatcaaatactgcctgctgcgaactctgaaacagtgccagaccctccgggaggctctgatagctgccggtaaagaaattatatggcatggacgcaccaaggaagagcctgctcactactgtagcatctgtgaggtagaggtgtttgacctcctgtttgtgacaaatgagagcaacagtaggaagacctatatcgtgcattgtcaggattgtgctcgaaagacttccggcaacctggagaattttgtcgtgttggaacagtataagatggaagacttaatgcaggtgtacgaccagttcactttggcacctccgctcccatcggcatcatcctag

SEQ ID NO: 122913 - DNA, 5049 bp, Artificial Sequence
  Description of Artificial Sequence: Synthetic coding sequence
atgcatcgggccgtggatcctcctggagcgagggcggctagggaggccttcgcattaggcggactgtcttgtgcaggggcttggagtagttgcccgcctcaccctccgcctaggtcagcttggctgccaggtggaaggtgttccgcttcaattggccagcccccactccctgcccccctgcccccttcccatggctccagcagcggccatcccagcaagccttactacgcccccggggcacctacccccaggcccctgcatgggaaactggagtctttacatggatgtgttcaagctctcctccgcgagccggcccagcctgggttatgggagcagcttgggcaattatacgagagcgagcacgattcggaggaggctactagatgttaccactctgccctgaggtacggaggcagcttcgcagagttaggtcctagaattggccgccttcagcaggctcagctgtggaacttccataccggatcctgccagcaccgtgctaaagtgcttccaccattagagcaagtctggaacctcttgcatctggagcacaagcgtaactacggggctaaaagaggaggccctccagtgaagcgtgctgccgagccccccgtcgtacagcccgtgccgccagccgctcttagcggaccgtccggggaggaaggattgtcccctggaggcaaacgcaggaggggttgtaattctgaacagacaggcctgcccccggggctacctttgccgccccctccactccccccaccgcctccccctccccctcctcctcccccgcctctacccggactggcaacaagccctccgttccagctgaccaaacccggtctatggagcactctgcatggtgacgcttggggcccagaacggaagggatctgccccaccagagcgccaggagcagcgccactcactgccccacccctatccttaccccgctccagcatacacggcacaccctccaggccatcgtctggtccctgcagctccccccggacctggtccccgccctcccggggccgaatcccatgggtgtctgcctgcaactagaccccccgggtccgatctgagagaatcacgcgttcaacggtctagaatggattcctctgtttctcctgcggcaaccaccgcttgtgtaccctacgcaccgtctagacctcccggactgcccgggaccaccaccagttcatcatctagttcttcctcgaatacgggactgcggggggttgagcccaacccaggaatacccggtgccgatcactatcagacacctgcactggaagtgagtcaccatgggcgactggggccatcagcccacagttcacggaagcccttcttgggcgcccccgcggcaaccccccacctgtccctcccacccgggccaagttcacccccccctcccccctgtcctcggcttttgaggccgcctccccctccagcctggctcaaaggaccggcgtgcagggccgctcgcgaagatggtgaaattttagaggaactcttttttggcaccgagggcccaccccgacctgctcccccccccctgcctcacagggaggggtttctcggacctcctgcttcacgcttcagcgttgggacacaggattctcacaccccccctaccccgccaacacccacaacctcttcttctaattccaattcaggcagccattcttcatctcctgccggacccgtaagtttcccccctcccccctacctcgcacgctccattgaccccctaccccgccccccttcgccagcacagaaccctcaggaccctcctcttgtacctctcacactcgctttacctccagccccccctagctcctgccaccagaacacatccgggtccttccgtcggcctgagtccccacgacccagggtgtcattcccaaaaacccctgaagtggggccaggccctcctcctggccctctgagtaaagcccctcagcctgtaccccccggagtgggagaactcccagcccgggggccccgcctgttcgatttcccaccaactccactcgaagatcagttcgaagagccagccgagtttaaaatcctgcccgacgggttggccaatattatgaaaatgctcgacgaatccatccggaaagaggaggagcagcaacagcacgaagctggagtggcacctcagccaccccttaaagaacccttcgcgtctctccagagcccttttcctaccgatacagcacccacaacaaccgcaccagctgtggcggtgacgaccacgactacaactacaactacgactacagcgactcaggaagaggagaaaaagccccctcctgccctgccacctcctcctcctttagccaaattcccacctccatcccagccccaacctcccccacctcctccgcctagcccagcctcccttctgaaaagcctagcaagcgtcttggaaggtcagaagtactgttaccgcggcaccggcgctgctgtgtctactcgtcctggcccactgccaactacacagtatagccctggcccaccctctggcgcgaccgccttacctcctacttccgccgctccatccgcccagggctcaccacaaccaagcgctagttcctcaagccagttctcaacatctggtggcccatgggctagagagcggcgtgccggtgaggaacccgtacctgggcccatgaccccgacgcaaccgcccccgccacttagcctgcccccagctcggtctgaatcagaggtgctagaagagatctctagagcatgtgagactctggtggagagagtgggacgctctgccaccgatcctgccgatccggtcgatactgccgagccagccgattctgggaccgaaaggcttctccctccagcccaggcgaaagaagaggctggaggagtagcagccgtgtcgggcagctgcaagcggcgtcagaaggagcaccagaaggagcaccgccgacataggcgagcctgcaaggactctgtggggcgaagacctcgggaaggtcgtgctaaggcaaaagccaaggtgcccaaagaaaagagcagacgcgtattgggcaatctcgacctgcaatcagaggagattcagggacgggaaaaaagccgccccgaccttggtggagcgtcaaaagcaaagcctccaaccgcccctgcaccccccagcgccccggcgccttccgctcagcccacacctccttcagcttctgtgccggggaaaaaggctagggaagaggctcccggtccaccaggagtgtcccgggctgatatgcttaagctgcgaagtttgtctgaaggtccacctaaagaactgaaaattcgcctaataaaggtggagtcgggagacaaagagactttcatcgcttctgaagttgaggaacgacgcctgagaatggcagaccttacgatcagccattgcgccgccgacgtggtgagagcctccaggaatgctaaggtgaagggaaagttccgagaatcgtatctctcacctgctcagtctgtaaagcctaaaatcaacacggaggagaagctgccaagagagaaactgaaccccccaaccccgagtatctatctcgaatcgaagcgcgatgctttttcccctgtgttactgcagttctgtactgacccccgtaacccgataaccgttattcgcggtctagcaggcagtctgcggctcaacctaggactgttttctactaagacattggtggaagctagtggcgaacacaccgtagaggtcaggacccaggtccaacagccctctgatgaaaattgggacctgacgggaacacgccagatctggccttgtgagagcagtcgcagccacacgaccatcgcgaaatacgctcagtatcaggcttcaagtttccaggagagcttgcaggaagaaaaagagagcgaggacgaggagtcagaggagccagactcaacaactgggacacctccttcctcagcacccgacccaaaaaaccatcatattataaaatttgggaccaatatcgatttatcagacgcaaagagatggaagccccagctgcaagagctcctaaaattgcccgcattcatgcgggttaccagcaccgggaacatgctgtcgcatgtgggtcatactatactcggaatgaacacagtccagctttacatgaaagtccccggtagcagaacccctggtcatcaggaaaacaacaatttctgcagtgtaaacatcaatatcggccccggcgattgcgagtggttcgcggtccacgagcactattgggagaccataagcgctttttgcgatagacacggggttgattatcttactgggtcgtggtggcctatcttagatgacctgtacgcctcaaatattcccgtgtatcgattcgtacagagacccggagacctggtgtggatcaacgccggcactgtccattgggtgcaggccaccgggtggtgcaacaacatcgcttggaatgtcgggccgttaaccgcctaccaataccagctggctttagagcgctatgagtggaacgaggtgaagaatgtgaagagcatcgtgccaatgattcatgtctcttggaatgtggccaggaccgtcaaaattagcgacccggatctcttcaagatgattaaattttgtttgcttcagagtatgaagcactgtcaggtgcagcgggaatctctggtgcgggcaggaaagaaaattgcctaccaaggtcgagtcaaggacgagcctgcatactactgtaatgagtgtgacgtcgaagtgttcaatattttgtttgtcacctctgagaacggtagccgaaacacttatcttgtacactgtgaaggctgcgcacgacgacgatcagccggcctgcaaggggtggtggtcctcgagcaatacaggaccgaagaactggcgcaggcctacgatgcttttacactcgttcgcgctcgtagggctagaggtcagagaaggcgggccttagggcaagccgccggaacaggttttggttctcctgctgccccgttccctgagccaccgcccgcattctctccacaagccccggcaagcacctcaaggtag

SEQ ID NO: 122914 - DNA, 4932 bp, Artificial Sequence
  Description of Artificial Sequence: Synthetic coding sequence
atgcacagggctgtggatccacccggggcccgagccgccagagaggcctttgcactcgggggtctctcatgcgcgggggcgtggtccagctgtccaccccaccctccgcctcgctccgcttggctgccgggcggcagatgctccgcttccatcgggcagcccccgcttccagccccacttcccccctcccatgggagctcatcaggacacccaagtaaaccctattatgcacccggagcacccaccccccgccctctgcacggaaagctggaatctttacacggttgcgttcaggccctgctgagggaacctgcacagccaggcctctgggagcagttgggacagctgtatgagtctgagcacgatagcgaggaagccacacgatgctaccacagtgcgctgcggtatggggggtcattcgccgaactggggcccagaattggacggctgcagcaagcccaactgtggaacttccacactggatcctgtcagcatcgcgctaaggtcctgcctcctttggaacaggtgtggaacctcttgcatttagaacacaaaagaaactatggcgcaaagaggggaggcccacccgtcaagcgcgctgctgaacctccagtggtacagccagtcccccccgcagcactcagtggaccctcgggcgaagagggcttgtcccctgggggcaagagaagacgcggatgcaactctgagcagaccggtctgccacccggtctacccctgccaccaccaccactgcctcccccgcctccgccaccacctccgcctcccccgcctctgcctggattagcaaccagtcctccctttcagttgacgaagcctgggctgtggtcaaccttgcacggcgacgcctggggacctgagcgaaagggaagtgctccgccggaaagacaggaacagaggcatagcctcccgcacccctatccatacccagccccggcttacacagcccacccgccaggtcatcgcctagtccccgccgcaccgcctggcccgggcccccgtcctcccggtgccgaatcccatgggtgcctgcctgccacgcgaccaccaggcagcgacctgcgagaatctagagtgcagcggagcagaatggattcaagtgtaagccctgccgctacaactgcctgcgtgccatacgccccatctcgtccaccaggcctgcccggaacgacaacgagcagttcttctagcagctccagcaacacaggcttgcggggcgttgagccaaaccctggtatacctggcgccgaccactaccaaacccctgcattggaggtctctcaccatgggagactgggtccgtccgctcattcttcccggaagcctttcttaggagcccccgctgcgaccccccacctctcccttccacctggcccctcttcccctccaccaccaccttgtccccggctgttacgccctcctccaccaccagcatggttaaagggtcccgcttgccgcgcagcccgagaggacggcgagattctagaggagctgtttttcggtacggaaggcccaccacggccagcccctcctcctctgcctcatagagaaggattcctgggtccccccgccagtcgattcagcgtaggaacacaggacagtcacaccccgccaaccccacctactcccaccacctcctcaagcaattctaattccggctcccattcctcttcacctgctgggcctgttagcttcccgccccccccatacctggcccgcagcatcgaccccctgcctcggcccccctctccggctcagaacccccaggacccccctctggtacctttgaccctggcgttgccgcctgctccaccatcgtcttgtcatcaaaatacatccggatctttccggcgccccgaatcccctcggcccagagtgtcgttccccaagacaccagaggtcggccccggccctccaccaggacctttgtccaaggcgccacagcccgtcccccctggagtcggcgagttgccagctaggggcccccgcctctttgactttcccccaaccccgctggaagatcagttcgaggagcctgctgagtttaagatcttgccggatggacttgcaaacattatgaaaatgctggacgagtccattcggaaagaggaggagcagcaacaacatgaggctggagtagcaccccaacccccgctgaaggaaccttttgcttcactccagtctcccttccccacagacacagctcccactaccactgcacccgccgtggccgttacaaccactactacaaccactactaccacaacagcgacccaggaggaggagaaaaaaccccctcccgctctgcccccacctccgcctctggctaagttccctccaccatcccagccgcagccgccccctccccccccaccttcccctgcttccttgctgaagtcactcgcatccgtgcttgaggggcagaaatattgttacaggggtacaggggcagccgtgagtactcgccctgggccattgcccaccacacagtatagccctggtcctcctagcggagctactgccctgccaccaactagcgccgccccttcagctcaagggtcgccgcagcccagtgctagtagcagttcccaatttagtacctcagggggtccgtgggcgcgagagaggcgcgcaggcgaggagcccgtgccagggcctatgacccctacccagcctccgccaccgctgtcgctgccaccagctaggtcagaaagcgaggtattagaggaaattagtcgagcttgtgagaccttggtagagcgcgtgggcagaagcgcaacagaccccgctgatcctgtcgatacagccgagcccgccgactccgggaccgaaaggcttctcccgcccgctcaagcgaaagaggaggctggcggggtggcagcggtaagcggctcctgtaaacgtagacaaaaggaacatcagaaggaacatcgcagacacagaagggcttgcaaagattcagtgggcaggagacctcgggaggggcgcgcgaaggcaaaggccaaagtccccaaggagaagtcacgcagggtgctagggaatctggatttacaaagcgaggagatccagggtcgcgaaaaatcccgcccagacttaggaggtgcttccaaggcgaaaccacctactgcccccgctccaccatccgctcctgccccaagtgcacaacccacccctcctagcgccagcgttcctggcaagaaggctcgagaagaggcgccagggccccccggcgtgtcccgggctgatatgctgaaactgcgatccctcagcgagggaccccctaaggagctcaaaattagattgatcaaagtggagagcggggataaagaaacctttatcgcctcagaagtcgaagagcggaggcttcgaatggccgatctcaccataagtcactgtgccgcagacgtggttagggcttcccgcaatgcaaaggtgaaggggaagtttcgcgaatcttacctatcgcccgcccagagcgttaagcctaagattaacacagaggaaaagcttcctcgtgagaagctcaatccccctacaccgagtatttatctggagtctaagcgcgatgcttttagtccggtgttactccaattctgcaccgacccgcgaaatcccataacagtgattcggggccttgctggcagtctgcgcctaaatctgggactcttcagcactaaaacactggtagaagcgtctggtgaacacacggtcgaggtaaggacccaggtgcaacagccttccgacgaaaattgggacttaacaggcaccagacagatttggccctgtgagtcttccaggtcccacaccaccattgcgaagtatgcacagtaccaggccagttcattccaggagtctttgcaggaagaaaaagaatctgaggatgaggagtctgaagaacctgattctacaacaggtacacctccctcctccgctccagaccccaagaaccatcacattattaaattcgggactaatattgacctgtccgatgccaaaaggtggaagccccagctacaggaactgctcaaactcccggcttttatgagggtgacctcaactggtaatatgctaagccacgttggccatactatactgggaatgaatacggtccagttgtatatgaaggttcccggttccagaactccgggtcaccaggagaacaataatttttgtagtgtgaacattaatatagggccaggggactgcgagtggtttgctgtccacgagcactattgggagactatttctgctttttgtgaccgccacggagtggactatctcactgggagctggtggcccattctcgatgacctgtacgcaagcaacatccctgtctaccggtttgtacagcggccaggagatttggtatggatcaacgcaggtaccgtgcactgggtccaggctactggttggtgcaataatatcgcctggaacgtgggcccacttacagcttaccagtaccagctggcgctggagaggtatgagtggaatgaggtgaagaacgtgaagagcatcgtacctatgatccacgtgtcgtggaatgtggccaggactgtgaagatctccgacccggacttattcaaaatgattaaattttgtctgttacagagcatgaagcactgccaggtccaacgcgaaagcctggtcagagccgggaagaaaattgcttaccagggccgggtgaaggacgaacccgcctactattgtaacgagtgtgacgtagaagtttttaatattctcttcgttactagtgagaacggctcccgtaacacttatctggtacactgcgaagggtgtgcccgccgccgatctgctggtctacagggtgtggtggtgttggaacagtatcgcaccgaggagctggcccaggcatatgatgctttcactctggctcctgcaagcacttccagatag

SEQ ID NO: 122915 - DNA, 1245 bp, Artificial Sequence
  Description of Artificial Sequence: Synthetic coding sequence
atgcatagtagaggacgggaaatcgtggtgcttctgaacccttggtctattaatgaggcagtcagctcatattgcacatattttattaaacaggacagtaaatccttcggtatcatggtgtcttggaaaggaatttatttcattttgactctgttttgggggagcttttttggctctatctttatgctgtcgcctttcctccccctcatgtttgtaaatccttcctggtatcgttggattaacaacaggctggtcgccacctggctgaccttacccgtggcccttctggagacaatgttcggcgtcaaagtcatcattactggagacgcctttgtgcccggggaacgctccgtcattattatgaatcaccgaaccagaatggattggatgttcctgtggaactgtctgatgaggtacagttacttacgcctggagaagatctgcctgaaggcctctctgaaaggcgtgccaggtttcgggtgggcaatgcaggctgctgcctacatcttcattcacagaaagtggaaagacgataaatcccactttgaggatatgattgactatttttgtgatattcatgagccgctccagctactaatcttccctgaaggaactgacttgaccgagaattcgaaatcgaggtctaacgcttttgccgagaagaatgggctccaaaagtatgagtacgtgcttcaccccaggaccacaggcttcacctttgtcgttgataggctgcgggaaggaaaaaacttggacgctgtgcatgacattaccgtggcctacccacacaatattccgcagagcgagaaacatctgctgcaaggagacttcccgagggagattcatttccacgtacatcgatatcctattgatactctcccaacaagcaaagaggatttgcagctgtggtgtcacaagcggtgggaggaaaaggaggaacgcctgcggtccttttaccagggagagaagaacttttacttcactggtcaaagcgttattccaccgtgcaagtccgaactacgtgtgttggtggtaaaactgctgtctattctgtactggacacttttttctcctgccatgtgtctgctgatctacttatacagcctggtgaagtggtactttatcatcacaatagtgatattcgtgcttcaggagcgcatatttggtggcctagagatcatcgaactggcctgctaccggctgctgcacaagcaaccacatcttaattcgaagaagaatgaatag

SEQ ID NO: 122916 - DNA, 927 bp, Artificial Sequence
  Description of Artificial Sequence: Synthetic coding sequence
atgcactcccggggcagagaaatcgtggtcctgctgaatccgtggtcgatcaatgaagcagtctcctcttactgcacctacttcatcaagcaggactccaagtcattcggaatcatggtttcatggaagggcatatattttattctgaccctcttctgggggtccttttttggcagtatctttatgctgtccccctttcttccactcatgtttgtgaatccctcctggtatcgttggatcaacaataggcttgtcgccacctggcttaccctgccagttgctttattagagacaatgttcggcgtgaaagtcattataaccggtgacgctttcgtacccggcgaaaggtccgtcatcatcatgaaccaccgcacccgtatggactggatgtttctctggaactgcttgatgaggtattcatacctgagactcgagaagatctgcttgaaggcgtccttgaagggggtaccgggtttcggatgggccatgcaggctgcagcgtatatcttcatccatcgcaagtggaaagacgataagagccactttgaggacatgatagactacttctgcgacatccatgaacccctacaactcctaatcttccccgaggggactgatttgacagagaactcaaagagccggagtaatgcttttgccgagaagaatggtctccagaagtatgagtatgtcctccaccctcggaccactggtttcacctttgttgtggataggctcagagaggggcggcgtcagtcagaaggatctaaaggaccgctccagggagagctgcagatcactgcccagggaaaccaacgcggtcacaaacagatggagaaacattcaatgctgatggactggaagaaccagtaccgagagatcggccatacagcccaatccaacttgcagattcagtgttactcacattag

SEQ ID NO: 122917 - DNA, 927 bp, Artificial Sequence
  Description of Artificial Sequence: Synthetic coding sequence
atgcattcccgcggtcgggaaatcgtggttctcctcaacccttggagcatcaacgaggcagtttcctcatactgcacatactttattaaacaggattccaaatcatttggcatcatggtgtcctggaagggaatttatttcatcttgactcttttttgggggagctttttcgggtccattttcatgctgtcccccttccttccccttatgtttgtgaacccatcctggtatcggtggatcaataaccggctagtggccacctggctgaccctgcctgtggcattgcttgagactatgtttggcgttaaagtgatcatcacaggggacgcatttgtgccaggcgagcggtctgtaatcattatgaatcacagaactagaatggactggatgttcctctggaactgtctaatgaggtactcctatctgagacttgaaaagatctgtcttaaggcatctctcaagggggtgcctggatttgggtgggccatgcaggcagccgcctacatctttatccaccggaagtggaaggacgataagtcacacttcgaggatatgattgactacttctgtgacattcatgagcctttgcagttgttgattttccctgagggcaccgatctcaccgaaaactctaagagtcgaagtaacgcctttgcagaaaaaaacggactgcaaaagtacgaatatgtcctccaccctcgcacgactggattcacctttgtggtggaccgcctccgggagggccgacggcagtctgaaggcagtaaggggcctctccagggagagctacagatcaccgcacaggggaaccagcgggggcataagcaaatggaaaaacactcaatgcttatggactggaagaatcagtaccgcgagatcggccacacggcccaatcaaatctgcagattcaatgctatagccactag

SEQ ID NO: 122918 - DNA, 1131 bp, Artificial Sequence
  Description of Artificial Sequence: Synthetic coding sequence
atggtatcttggaaaggcatttacttcatcttaacattattttgggggagtttcttcggaagcatattcatgttatcacccttcctgccactgatgttcgtcaacccctcttggtatcgatggattaataatcgtctggtggccacatggttgacactccctgtcgctctcctcgagacaatgtttggcgttaaggtgatcataactggcgacgcgtttgttcccggggaaagatcggtcatcatcatgaaccaccgtaccagaatggattggatgttcctctggaactgtttgatgcgctactcctatctgaggctggagaagatttgcctcaaggctagcctcaagggagttcctggattcggctgggccatgcaggctgccgcctacatttttatacatcgaaagtggaaggacgataaatcccacttcgaagacatgatcgattacttctgtgatattcacgaacccttacagctgctcatcttccctgaaggcaccgacctgactgagaactcaaaatctagatccaatgccttcgctgagaagaacggactgcaaaaatatgagtacgtcctgcacccgcggaccacagggtttacattcgtagtggaccggttacgggaaggcaaaaacttggatgccgtacatgacataacggtcgcatacccccataacattcctcaatcagagaaacatctgctgcagggcgacttcccccgagagatccactttcatgttcaccgctatccaattgacactctccccacgagcaaggaggacttgcaactgtggtgtcacaagagatgggaggaaaaggaggaacgactgaggtctttctatcagggggaaaagaatttttacttcactgggcagtccgtgatccccccatgcaagtcagagctgcgggttttggtggtgaagcttctgtctatcctctactggaccctcttcagccctgcaatgtgcctgctcatatacctctattccctcgtgaaatggtactttataataaccattgtaatatttgtgctgcaggaaagaatcttcggtggtcttgaaattatagagttagcctgttacagacttcttcataaacagccgcaccttaatagtaaaaaaaacgagtag

SEQ ID NO: 122919 - DNA, 993 bp, Artificial Sequence
  Description of Artificial Sequence: Synthetic coding sequence
atggtctcctggaagggcatttactttatcctcaccctcttttggggtagctttttcggtagtatttttatgttaagcccattcttgccactgatgttcgttaacccatcctggtacaggtggatcaacaacagactcgttgcgacatggctgactttgccggtagctctcctcgaaacaatgttcggagtcaaagtgatcattacaggggacgcttttgttcctggagagcgctccgtgattattatgaaccatcggacccgaatggattggatgtttttgtggaattgtcttatgagatatagttacctccgccttgaaaagatttgtctgaaggcatctctcaaaggtgtgccaggatttggttgggctatgcaagctgcggcgtatatctttattcatcggaagtggaaggacgataagagccatttcgaggacatgattgactatttctgtgacatacatgagccactccaactgctcatttttccagaggggacggatctaaccgaaaacagcaagagccgcagcaacgcatttgccgagaaaaatggactccagaagtacgaatacgtactgcacccccgaactaccggatttacttttgtggtggaccgccttcgcgaggggaaaaacctggatgctgttcacgatattacagtggcatacccccataacattccccagagtgaaaagcatctgttgcagggcgacttccctcgggagattcacttccacgtacaccggtaccccatcgacacacttcctacgtctaaggaagatttgcagctctggtgtcataaaagatgggaagagaaggaggaaagactcagaagtttctatcagggagagaaaaatttctacttcacaggtcagtcggtgatacctccctgcaaatccgagctgcgggtcctcgtggttaaactgtatactgtcttggaccctgtacagccatgcaacgtgccaacacacatcttcgtgcagtcctgctag

SEQ ID NO: 122920 - DNA, 462 bp, Artificial Sequence
  Description of Artificial Sequence: Synthetic coding sequence
atgcattccagagggagggaaatcgttgtccttctgaatccctggagtattaatgaggccgtgagtagttactgcacgtactttatcaaacaggattccaagtctttcggaatcatggtctcttggaaaggaatttacttcatattgacactgttttggggctctttttttgggagcatatttatgctttctccattcttgcccctgatgtttgtaaatccatcttggtacaggtggatcaataatcggctggtagctacctggttgacgctacccgtagcgctactggagaccatgtttggagtgaaggtgataattacaggagatgctttcgtgcccggagagagaagcgtcattattatgaaccatcgaacaaggatggattggatgttcctgtggaattgcctgatgcggtacagctacctccggctggagaaaatttgtctgaaggcaagcctttag

SEQ ID NO: 122921 - DNA, 1131 bp, Artificial Sequence
  Description of Artificial Sequence: Synthetic coding sequence
atggtgtcctggaaaggaatttactttatccttaccttgttttgggggtccttcttcggctccatcttcatgctctctccttttctcccgctaatgttcgtgaatccctcctggtataggtggattaacaaccgcttagtggcgacatggctgactctgcctgtggcgctgctagaaactatgttcggtgtgaaagtcataattactggagacgcattcgttcctggagaacgttctgtcattattatgaaccaccggactaggatggactggatgttcctctggaactgcctgatgaggtattcctacctgaggctggagaagatttgcttgaaagcctctcttaagggcgttcctgggttcggctgggccatgcaggcagctgcctacatattcatccaccgcaagtggaaggacgacaagagccacttcgaggatatgatcgactacttttgcgatattcatgaacccttgcagctactgatttttccggaaggcactgatctgaccgagaattcaaagtcaaggtctaacgcctttgccgagaagaacggcctacagaaatatgaatacgtactccatccccggaccaccggctttacttttgtggtggataggcttcgggagggcaaaaatctggacgccgtccacgacatcaccgtggcgtatccacataatattcctcaaagtgaaaagcaccttctccagggggatttcccccgggaaattcatttccatgtgcacaggtaccctatcgatacgctacccacttccaaagaggatctccagctctggtgccataaacgctgggaggagaaagaagagcgacttagaagtttctatcaaggtgagaaaaatttctactttaccgggcagtcagtgatccctccctgcaaaagcgaactgcgagtgctcgtggtgaaactgctttccattctctactggaccctcttttctcccgctatgtgtctcctgatttacctgtacagcctggtaaagtggtacttcatcattactattgtaatttttgtgttgcaagaacggatctttggtggactggaaatcattgagcttgcttgttacaggctattgcataaacagccgcacctgaatagtaagaagaacgagtag

SEQ ID NO: 122922 - DNA, 1095 bp, Artificial Sequence
  Description of Artificial Sequence: Synthetic coding sequence
atggccgctatatcgacatcaatccccgtgatatctcagcctcagttcaccgctatgaatgaaccccaatgtttctacaatgagagtattgcctttttctataatcgcagcggaaaacatctggctacagaatggaacactgtgagcaagctggtcatggggctcgggatcacagtttgcatcttcattatgttggccaatttacttgtgatggtcgccatctatgtcaatcgacggtttcacttccccatttactatctgatggctaatcttgcggccgctgacttttttgcgggccttgcctatttctacctgatgtttaatactgggcctaatacccggcgtctcaccgtgagtacctggctcctgcgtcaaggactgattgatacatcactgactgcttccgtagccaatctgctggcaatcgcaatcgagagacacataactgtctttagaatgcagttgcacacccgaatgagcaatcgcagggttgtggtcgtcattgtggttatctggactatggccattgtgatgggtgcaatcccatcagtcggctggaactgtatctgcgacatcgaaaactgcagtaatatggctccactgtactccgacagttatctcgtgttctgggcgatcttcaatctggtgaccttcgttgtgatggtggtgctgtacgcccatatcttcggctatgttaggcagagaaccatgagaatgagcagacactcttcgggccccaggaggaaccgcgacaccatgatgagccttctcaagactgtggttatcgtcctgggagcttttattatttgttggacacctgggctcgtactgttgcttctcgacgtgtgctgcccacaatgcgatgtcctggcttacgagaaattttttctgttactggcggaattcaacagcgccatgaatcctatcatctattcctacagagacaaagaaatgtcggccactttccggcagatactttgctgtcagagatcagaaaatcctaccgggcctacagaaggttcggataggagcgcatcatcactaaatcacacaatcttagccggcgtgcatagtaatgatcattctgttgtctag

SEQ ID NO: 122923 - DNA, 1095 bp, Artificial Sequence
  Description of Artificial Sequence: Synthetic coding sequence
atggccgctatctcgaccagcatcccagtgatcagccagccacaattcaccgcaatgaatgagccgcaatgtttctacaacgagagcatcgcgtttttctacaatagaagtggcaagcaccttgccacagagtggaataccgtttccaagcttgtgatggggctgggaattactgtgtgcatctttatcatgctggccaatctgctggtgatggttgccatctatgtgaacagaaggttccatttccccatttactatctgatggctaatctcgccgccgccgatttcttcgcaggcctggcctatttctatctaatgttcaacaccgggccgaatacacgtcggctcacagtgagcacctggctcttgcggcagggactgatcgatacatccctgaccgcttccgtcgccaatctgctggccatcgcgattgaacgacacatcacagttttcaggatgcagctgcacactaggatgagtaaccgtcgggtggtggtggtgatcgtggtgatctggactatggccatcgtgatgggggccatcccatcggtgggttggaattgcatatgcgacattgagaactgctccaacatggccccactatatagcgactcctacctagtcttctgggcgatttttaacctcgtcacatttgtagtcatggtcgtactgtacgcccacatattcgggtacgtgcggcaacggacgatgagaatgagccgacacagttccggccctcggcgtaatcgggacacaatgatgtcgctgctgaagaccgtcgtcattgtccttggcgcatttatcatctgctggactccaggccttgtgctgttgctgctcgatgtctgttgcccgcagtgcgacgtattggcatatgaaaaatttttcctactgctcgctgagtttaattctgctatgaatcccattatatacagttatcgagataaggagatgagtgcaacgtttcgccaaattctttgttgtcagagatccgaaaatccaactgggcctacagagggatcagataggtctgccagcagccttaaccacaccatactcgcgggggtgcactcgaacgatcatagcgtagtatag

SEQ ID NO: 122924 - DNA, 1095 bp, Artificial Sequence
  Description of Artificial Sequence: Synthetic coding sequence
atggccgccatctccacaagcattccagtcataagccaacctcaattcaccgcgatgaacgagccacagtgtttctataatgagtccattgcattcttttataacagaagcggaaaacatctggcaacggaatggaacaccgtgagcaagctggtgatgggcctggggatcacggtatgtattttcattatgctggccaacctcttggttatggttgctatctatgtgaatcgccgtttccactttccaatttactatcttatggccaatcttgcagccgctgacttctttgctggcttagcttatttttacctgatgtttaatacaggaccaaatactcggcgactgacagtaagtacctggttacttcgtcaggggcttatcgacacatccttgacagccagcgtggctaacctgttggcgattgcgattgagaggcatattactgtgtttaggatgcagctacatacaagaatgtctaatcgcagagtagtggtcgtaattgtggttatctggaccatggcaatcgttatgggagccatcccatccgttgggtggaattgcatctgcgacattgaaaattgttcaaacatggctccactatactcagactcgtacttggtgttttgggccatctttaatctcgtgacatttgtcgtgatggtggtgctctacgcccacattttcggctatgtccgccagcgtaccatgagaatgagccgccattccagcggacctcgcaggaatagggacaccatgatgagcttgcttaaaaccgttgtcatcgtcctcggagccttcataatctgttggacaccagggctcgtcctgctgctcctggacgtgtgctgtccacagtgcgacgttctagcctacgagaaatttttcctgcttctcgcggaattcaattcagcaatgaacccaattatatactcttaccgtgataaggaaatgtctgcaacttttagacagatcctgtgctgccagcggtccgagaacccaactgggccaacagagggtagcgaccgcagcgcatctagcctgaaccataccatcttggccggggtgcactctaacgaccattccgtggtatag

SEQ ID NO: 122925 - DNA, 549 bp, Artificial Sequence
  Description of Artificial Sequence: Synthetic coding sequence
atggcagctataagtacaagcattcctgtgatctcacagccgcaatttacagccatgaacgagccacaatgcttttataacgagagtatcgcatttttttacaatagaagcgggaaacacctggccactgagtggaacaccgtgtcaaagcttgtgatgggactaggcataacagtgtgcatcttcattatgctggccaaccttctggtcatggttgcaatatacgtaaaccgtcgcttccatttccccatttattacctcatggctaatctagccgcagccgacttttttgccggtctggcatacttttacttgatgtttaataccgggcccaacacacgccgcctcaccgtgagtacctggctccttagacaaggtctcattgacactagtctgaccgctagtgtggcaaatctcctagcaattgccatcgagagacacatcactgtgttccggatgcagctacacactcgcatgtccaaccggcgcgtcgttgtcgtgatagtggtgatctggactatggcaatcgtcatgggcgctattccctag

SEQ ID NO: 122926 - DNA, 1041 bp, Artificial Sequence
  Description of Artificial Sequence: Synthetic coding sequence
atgaatgagcctcagtgcttttacaacgaaagtatcgcattcttttacaatcggtcagggaagcatttggcgaccgaatggaataccgtctccaagttggtgatgggcctagggattaccgtgtgcatctttattatgctggccaacctgttagtgatggtggctatctacgtaaatcgtcgttttcactttccaatttactatttaatggccaatttggcggcagccgacttcttcgccggactggcctacttttacttaatgtttaacaccggtccaaacacccgcagactcaccgttagcacctggcttctgaggcagggcctgatagacacaagcctgaccgcctccgtagctaacctgctggcgattgccatcgaaagacacattaccgttttcagaatgcaactacatacaaggatgtccaatcgacgggttgtggtggttatcgtggttatatggacaatggcaatcgtaatgggcgcaataccatctgtgggatggaattgtatctgcgatatcgaaaattgtagcaatatggcacccttgtacagcgatagttacctcgttttttgggctatattcaacctcgtcaccttcgttgttatggtggtcctctacgcccacatctttggttatgttcggcagagaactatgagaatgagcaggcacagttcaggccctcgacggaacagggacactatgatgagcctgttgaaaaccgtggtcatcgtgctcggggctttcatcatttgttggacaccaggcctcgtcctgttactgctggacgtctgttgccctcagtgtgatgtgctagcctacgagaaattcttcctcctgcttgccgagtttaatagtgcaatgaaccctatcatttatagctaccgtgacaaggagatgtcagccacattcaggcagattttgtgctgccaacgaagtgagaatcccactggaccaactgaaggctctgatagatctgcttccagtctgaatcacactatcctggcaggggtgcacagcaatgaccatagcgtggtctag

SEQ ID NO: 122927 - DNA, 1098 bp, Artificial Sequence
  Description of Artificial Sequence: Synthetic coding sequence
atggaggagggcgcccagcgctctggagccctgggcgctccacatcaatttaccgccatgaacgagccacagtgcttttataacgaaagcatcgcttttttctacaacaggtcaggaaaacacctggcaactgagtggaatacagtgtctaagctcgtgatgggactgggaatcactgtatgcatcttcattatgctcgccaacctcctggttatggtggccatctacgtgaacaggcgcttccacttcccaatttactatctgatggctaaccttgctgctgcagacttctttgccggattggcatacttctacctgatgttcaacaccggaccgaacacacggaggcttacggtctcaacgtggctgctgcggcaaggtctgattgatacaagtttgacagccagcgtggccaacctgctggccattgcaatcgagaggcacatcacggtgtttaggatgcaactccatacacggatgtccaacaggcgggtggttgtagtcattgtagtaatttggacgatggcaatagttatgggtgcaataccttctgtcggttggaattgcatctgtgacatcgagaactgctctaacatggcaccgttatactctgattcctatttagtattctgggcaatttttaaccttgtcactttcgtggtcatggtggttctgtacgcccacatcttcggctatgtacgccagagaacaatgcgaatgtctcgccactcctcaggacccaggaggaatagagatactatgatgtcactgttgaagaccgtggttatcgtgctcggggcgttcattatatgttggacgcccggactcgtgctgctgttgcttgacgtttgctgcccacaatgtgatgtgctcgcctacgaaaaattctttctgttgctggccgaattcaacagtgctatgaaccctatcatctattcttatagggataaagaaatgtcggccacgttccgccaaattctgtgttgccagaggtctgagaatccaacaggacccacagaggggagcgacaggtccgcttcttcactcaatcataccatcctggccggagtgcatagtaacgaccattcggtggtttag

SEQ ID NO: 122928 - DNA, 1098 bp, Artificial Sequence
  Description of Artificial Sequence: Synthetic coding sequence
atgctgctcctgctgatccctgcacacagtagcgtgttagaaaatgagttcactgccatgaacgaaccccagtgtttctacaacgagagtatcgcctttttttataaccgttctggcaaacacctggcgaccgaatggaatactgtgtctaagttggtcatgggactgggtatcactgtgtgcattttcataatgctcgcaaacctgctggtcatggtggctatctacgttaataggcgatttcattttccaatttattatctcatggccaacctcgccgctgccgatttctttgccggcctggcttatttttatctgatgtttaacactggtcctaatacacgcagactcacagtttcgacgtggctcctccgccaaggactaatagacaccagcttaacagccagtgtggccaatctgctggccatcgcaatcgaacgccacatcacggtgtttcgaatgcaattgcacacccgaatgagtaatcggcgcgtcgtcgtggtgatcgtcgtgatctggaccatggccattgtgatgggggcaataccttctgtaggctggaactgcatatgcgacatcgagaattgcagcaacatggcccctttgtatagcgacagttacctagttttctgggccattttcaatctggtcaccttcgtggttatggtggtgctgtacgcccatatcttcggctacgtgcgccagaggacaatgcgaatgagtcggcactcctctggacctcggaggaatagagatacgatgatgagtctcctcaaaacggttgtcatcgtgctcggggcgtttataatatgttggactccggggctagtacttcttctactggatgtgtgttgccctcaatgcgacgtgcttgcttacgaaaagtttttcctgctactcgcagaattcaactcagctatgaatccgattatctactcctatagggataaggaaatgtccgccacctttcgtcagatcttgtgttgtcagagatcggaaaacccaacagggcctaccgaagggagtgaccggtccgctagctccctcaatcatacaattttggccggagttcatagcaatgatcacagtgttgtgtag

SEQ ID NO: 122929 - DNA, 1056 bp, Artificial Sequence
  Description of Artificial Sequence: Synthetic coding sequence
atggttattatgggccaatgctactacaacgagacgattggcttcttctacaataattccggcaaggaactctcaagtcactggcggcctaaagatgtggtcgttgtcgcgctaggattgaccgtgtccgtgttagtgctcctgaccaatctgcttgttatcgccgcgattgcctccaacaggagattccaccagccgatctactacctactagggaatctggccgctgccgacctgttcgccggggttgcttacctctttctgatgtttcacactgggccccggaccgctcggttaagcctcgagggttggttcctgaggcaaggactacttgacacctcgttaaccgccagtgtcgccaccctgctggcgattgctgtcgaacgtcataggagcgtgatggcagtgcagctgcactcgcggctgccaaggggtagagtcgtgatgctaattgtcggtgtgtgggtcgccgcactgggactcggattactacccgctcacagttggcactgtctttgcgctctggatcgatgtagcagaatggctcccctcttatcccgctcgtacctggctgtgtgggcactgtcgagcctgctggtgttcttactaatggtcgcggtgtacacccgaatcttcttctacgtgagacggagagtgcaaagaatggccgagcacgtgtcttgccacccccgttacagggaaacaaccctgagcctggtgaaaacagtggtcataattctcggagcattcgtagtctgttggacacctggacaggtcgtgctgctgctggatggtttgggctgcgagtcatgcaatgtgctagcagtagagaagtactttctgctgctggcggaggcgaacagcctcgtgaacgccgccgtgtactcctgcagagacgccgagatgcgccgcactttccgacgcctcttgtgttgcgcatgtctgagacaatcaacacgtgagagtgtgcactacacatcctcggcccagggcggtgccagcactcgaattatgctccctgagaacgggcatccactgatggactctaccctgtag

SEQ ID NO: 122930 - DNA, 1056 bp, Artificial Sequence
  Description of Artificial Sequence: Synthetic coding sequence
atggtgattatgggccagtgctactacaatgaaacaatagggtttttttacaacaatagcggaaaggagctgtcttcccattggcgccccaaagacgtcgttgttgtggcgctgggcttgacagtgtccgttctggtgctgctcacaaatcttctcgtcattgccgctattgcctcgaataggaggttccatcagcctatttactacctgctgggtaatctggcagctgccgacctgttcgccggggtcgcctacttatttctcatgtttcacactggccctaggacggcaaggctgtcattggagggatggttcctaaggcagggcttgctcgatacctctttgacggccagcgtggcaacactgctcgctattgccgtcgagagacatagatcagtcatggcggtgcagctgcattccagactgcctcggggccgtgtagtaatgctgatcgttggtgtctgggtagccgccctgggactgggactgctgcctgcccactcatggcattgcctgtgtgccttggatcggtgtagccggatggctcccctgctatcgagatcttaccttgccgtgtgggcactctcctcactcctggtgttcctgctcatggtggccgtttatactaggatattcttttatgtccgtcggagggtgcaacgcatggccgagcacgtgtcatgtcaccctcggtatagagagactaccttatccctggtcaagaccgtcgtcattatcctcggggcgttcgtggtatgttggacccccggacaggttgtcctcctacttgatggactgggttgtgaaagctgtaacgttctcgccgttgagaagtacttcttgctgctcgccgaagcgaattctctcgtcaatgcagctgtctattcatgcagggatgctgaaatgcggcgcacatttcgcagattgctttgctgtgcctgcctgcgccagagtactcgtgagagcgtccactatactagttcggcgcagggcggagccagcacccgtatcatgctccctgaaaatggccaccctctgatggatagcaccttgtag

SEQ ID NO: 122931 - DNA, 1062 bp, Artificial Sequence
  Description of Artificial Sequence: Synthetic coding sequence
atgaacgagtgccattatgataaacacatggatttcttttataacaggagtaacacagatactgtggatgattggactggcaccaaacttgtgatagtgctgtgcgttggcacattcttttgcctgtttatcttcttcagcaactccctggtgattgcggcggtgataaaaaatcgcaaattccatttccccttttactacctcttggccaacctggccgccgcagatttcttcgcaggtatcgcctatgtgtttctgatgttcaatacaggacccgtttccaaaaccctgacagttaacaggtggtttctgaggcagggccttttggacagctctctgactgctagcctcacaaatctattggtgatcgccgtcgaaaggcatatgtctattatgagaatgagggtgcactctaacctgactaagaagagagtcacgctgctgattcttttggtatgggccatagcaatttttatgggagcagttcctaccctgggttggaactgtttatgcaacattagtgcatgcagtagtctggcccccatttactcgagatcttaccttgtgttctggaccgtgtcaaacctgatggcattccttattatggtagtagtttatctgcgtatctacgtctacgtgaagagaaagacgaacgttctgagtccccacaccagtgggtctatctccaggcgacggacgcccatgaaactcatgaaaactgtgatgactgtcctgggggcattcgtggtctgctggacccctggcctggtcgttttactgctggacgggctgaactgcagacagtgcggagtgcagcatgtcaagcggtggtttctcctgcttgccttattaaatagcgtggttaatcctatcatatatagctacaaggacgaggacatgtatgggacaatgaagaagatgatttgctgtttctctcaagagaatcctgaacggaggcctagccgcataccatctaccgtgctgtctcggagcgacactggcagtcaatatatcgaagatagcatttctcagggcgcagtatgcaataaaagcacaagctag

SEQ ID NO: 122932 - DNA, 1062 bp, Artificial Sequence
  Description of Artificial Sequence: Synthetic coding sequence
atgaacgagtgccactatgacaagcatatggacttcttttataatcgcagcaacaccgatacagtggacgactggactggcaccaaacttgtgattgtgctctgtgtggggacatttttttgtttatttattttcttcagcaattcgcttgttattgccgctgtgattaaaaaccgcaaattccatttccccttttactacctcttggcaaatctggccgcagcggatttctttgccgggatagcctacgttttcctgatgtttaataccgggccagtgagtaagacgcttactgtaaacaggtggttccttcggcagggtctgctggatagcagtttaacagcttccctcaccaacctgcttgtaatcgcagtggaaagacacatgagtatcatgcgcatgcgtgtgcacagcaacctaacaaaaaagagagtcacactcctcattctcctggtgtgggccattgctatatttatgggcgccgtgcctaccctgggttggaactgtttgtgcaacatatccgcctgttcaagcctcgcacctatctactccaggtcatatctggtgttttggaccgtttctaacttgatggccttcctgattatggtcgtcgtctaccttagaatctacgtctatgtgaagaggaagaccaatgttttgagtccacatacgagcgggtccatttctaggaggcgcacccccatgaagcttatgaagacagtgatgacggtcctgggggccttcgtggtctgttggactcctggactcgtcgttctcctcctggacggactgaactgtagacagtgcggagtgcagcatgtgaagcggtggttcttattactcgccctccttaatagcgtggttaatcctatcatttacagctacaaggacgaggacatgtacgggaccatgaaaaaaatgatctgctgttttagccaggaaaaccctgagcggcgcccttcaagaataccttccaccgtactctcccgttctgacaccggttcacagtacatcgaagacagcatcagccagggggccgtgtgcaacaagtcaactagttag

SEQ ID NO: 122933 - DNA, 1113 bp, Artificial Sequence
  Description of Artificial Sequence: Synthetic coding sequence
atgggagacagacggttcatagacttccagtttcaggacagtaatagttcccttaggccccgtctcggaaatgcgaccgccaacaatacatgtatagtggatgattccttcaagtataaccttaatggagctgtatactccgtcgttttcatcctaggactcataaccaactctgtgtccctgttcgtgttttgttttagaatgaagatgaggagcgaaaccgctatcttcattactaatctggcggttagcgacctgctgtttgtctgcactctccccttcaagattttttacaattttaatagacattggccttttggcgacaccctgtgcaagataagcggaactgcgttcctaactaatatctatgggtccatgctcttcttgacttgcatctcagtcgatcggttcctggcaatcgtataccccttcaggtcccgaaccatacgcacgaggcgaaatagtgccatagtgtgcgccggagtgtggatccttgtcctttcaggcggaattagtgcctccctgttctccacaaccaatgtaaacaatgccactactacatgtttcgagggcttcagcaagcgggtctggaagacttatctgagcaagattacgatcttcattgaggtggtgggctttatcattccgcttattctgaatgtgagctgctcttccgttgtgctgcgaaccctgcggaaacccgccaccttatcccagatcgggacaaacaaaaaaaaggtgctgaaaatgataactgtacatatggccgtgttcgttgtctgttttgttccgtacaatagcgtcctgttcctctatgctctggtgcgtagccaggccatcactaactgctttctcgaacggtttgcaaagattatgtaccctattaccctgtgcctggctactttgaactgttgcttcgatcccttcatttattatttcactctggaatctttccagaagagcttctatatcaatgcccacatacgaatggagtctctgtttaaaaccgagacaccgctgacgacaaagccatccctacccgcgatccaggaagaagtctcagaccagaccacaaacaacggaggagagctcatgctggagagcaccttttag

SEQ ID NO: 122934 - DNA, 1113 bp, Artificial Sequence
  Description of Artificial Sequence: Synthetic coding sequence
atgggagaccgcaggttcatcgattttcaattccaggatagcaattcatcactgcggccccgactgggtaatgccacagccaataacacctgcatcgtcgatgacagcttcaagtacaacttgaacggggccgtctacagtgtggtgttcatcctgggattgatcaccaactccgtttccctattcgttttctgcttcaggatgaaaatgaggtctgagacagccatatttatcacaaacctggctgtgagcgacttactttttgtctgtactctgccatttaagattttctacaacttcaatcgacattggccttttggcgacactctgtgcaaaatttctggcacagcattccttacaaatatttacgggagcatgttattcttgacttgtataagtgtggaccgctttctggccattgtctatcccttccgcagccggacaattaggacgcggaggaatagtgccattgtatgcgcgggtgtgtggattctggtgctgagcggaggaattagcgcctcactcttctcaaccacgaatgtaaacaatgcaacgaccacttgtttcgaggggtttagcaagcgggtgtggaaaacatatctcagtaagatcacaatttttatcgaggtggtgggttttatcatccccttaatcttaaatgtctcctgctcatccgtcgtgttgcgtacccttagaaaacctgcaaccttgtcccagatcggtactaataagaaaaaggtgttaaaaatgatcacagtccacatggcagttttcgtggtctgcttcgttccctacaactcggttctgtttctctatgcactggtgcggagccaagccatcactaattgctttctcgagaggtttgccaagataatgtacccaattacgctttgcctggctacactgaattgttgctttgacccatttatctattactttactctcgaatcttttcagaaatccttctacataaatgcacatatccgtatggagtctcttttcaagaccgaaaccccgctcacgacgaagcctagtttaccggcaatacaagaggaggtttcagaccagacaacgaacaacggtggcgaactgatgctagagtccacattttag

SEQ ID NO: 122935 - DNA, 1119 bp, Artificial Sequence
  Description of Artificial Sequence: Synthetic coding sequence
atgctcgccaactcttcctccactaattcttccgtcctaccttgtccggattaccgccctacacaccggctccatctggtcgtctatagtctggttctggcagcaggtctgcctttaaacgcgttggcgctgtgggtatttctgcgggcgcttagggtccatagtgtggtctctgtgtacatgtgtaatctcgcggcctccgacttactctttaccttgtcacttcccgtgaggttaagctactatgctctccatcactggccgttccctgacttactgtgtcagactacaggggcaattttccagatgaatatgtacggttcctgtatatttcttatgctcatcaacgtggaccggtatgctgctatagtgcatccgctaaggctccggcacctgcgacgtcctagagtggctcgtttgttgtgtcttggggtgtgggcacttattttagtgtttgcagttccggctgcacgcgtccaccggccctcgcgatgtaggtaccgcgatctggaggtgcggttgtgctttgagtcattctctgatgagctgtggaaaggccgcctgctgcctcttgttctgctagcagaagccctcggatttttgctgcctctggctgccgtagtgtatagttccggccgagtgttctggacccttgctaggcccgatgcaacacagtcacagcgtaggaggaagaccgtcaggctgctgctggccaatcttgtgatcttccttctctgctttgtgccttacaatagcactctggcggtgtatgggctgttgaggtctaaactggtggcagccagcgtgcccgcaagagatagagtccgcggagtgttaatggtgatggtgctgctggcaggtgcaaactgcgtcctcgatcccctggtctattactttagcgcggagggcttccgcaatacccttcggggccttggaactccccaccgggcgcggacttccgctaccaatggaacacgcgctgcacttgcccaatcagagcgcagcgccgttaccacggacgctacaagacccgatgccgcatcccagggactactccgaccatccgattcacacagcctgagctccttcacccaatgtccacaagatagcgcgctgtag

SEQ ID NO: 122936 - DNA, 1119 bp, Artificial Sequence
  Description of Artificial Sequence: Synthetic coding sequence
atgctggccaactctagttctaccaactcttccgtgctcccatgtcccgactacaggccgactcacagactgcatctcgtggtttactcactggtactggctgctggtctgcctctgaacgccctggccttatgggtgttcttgcgcgcactgcgtgtgcactcagtggtgagcgtgtatatgtgcaatctggctgcttccgatctcctcttcacactctccttgcctgtgcgtttgtcatactatgcactccaccattggccgttccccgatctgctttgtcagaccacaggggcaatctttcagatgaatatgtacggcagctgtatctttctaatgctgatcaatgtcgaccgatatgctgctattgtccatcccctacggctcagacacctgcgacggccccgagtggcaaggctgttgtgtcttggagtgtgggctctgatcctggtgttcgccgtccccgctgccagagtacaccgaccaagcagatgtcgttaccgcgatttggaagtcaggttgtgtttcgagtcctttagcgatgagttgtggaagggacgcctgctccctcttgtgctcctggcggaggcattaggatttttactccctctggctgctgtggtgtattctagcgggagggtcttttggacccttgcacgccccgacgccacacagtcacagaggagacggaagacggtgcgcctgctcctggctaaccttgtgatctttctactgtgctttgtcccctacaactccacattagctgtctatggcttgctgcgctctaaacttgtggcagccagtgttcccgcacgggacagggtgcgtggtgtactgatggtgatggtgttactggccggcgcaaattgtgtgcttgatccgctggtctactacttctccgccgaggggtttaggaacacgctgagaggtttaggcactccacatagagcaagaacctccgctacaaatggcacacgcgcagcacttgcccagtctgagagatctgcagtcacaacagacgctactaggcccgacgctgcctcacaggggttgctgcgaccctccgatagccactctctgtccagcttcacccagtgtcctcaagacagcgcactttag

SEQ ID NO: 122937 - DNA, 1290 bp, Artificial Sequence
  Description of Artificial Sequence: Synthetic coding sequence
atgctggctaactcatcctccacaaactcctccgtgctgccttgtcccgactacagacccacacacagactccatttagttgtatacagcttggtgctcgcagctggactgcccctgaatgctctagctctgtgggtctttctcagggcgttgagggtgcacagcgtggttagtgtgtacatgtgcaatctggcggctagtgatctgctgtttaccctctcactcccggtgagacttagttactacgcactgcatcattggccattccctgacctgctctgccagacaaccggcgccattttccagatgaacatgtatgggagttgcatcttcctaatgctgattaacgtagacaggtacgctgcaatcgtgcatccactcagacttaggcatcttcggagacccagggttgccaggcttctgtgcctgggtgtatgggccctaatcctggtatttgccgtgccggcagcgagggtgcaccgcccctcccggtgccgctaccgtgacctcgaagtaagactatgtttcgagtccttctcagacgagctttggaaaggtcgtctactgcccctggtgttgttggccgaagctctcgggtttctgcttcctctggctgctgttgtgtactcctccggtagggttttttggacccttgcaaggcccgacgcaacacagtcccagcgtcgccgtaagactgtgcgcctcttgctcgccaacctcgtgatcttcctgctgtgtttcgtgccctacaactccactttggccgtctatggcctcctgcggagcaagctagtggctgcctcagtcccggcacgtgaccgggtgcggggggtcctaatggtaatggtgctgctagcaggcgccaactgtgttttggaccctctcgtttattacttttctgcagaaggtttccgaaataccctgcggggtctggggacaccgcacagggccaggacgtctgcaactaacggtacgcgggcagccctcgcccagtcagaaaggtctgcggtcactacagatgcgactaggcccgacgcagcttcacagggcctgctgcgcccttcagacagccacagcttgagctccttcacccacgccatagcgctctcggttccggattcccagcgcctctctttttgggaggcctatcgggtttacacgcaggagggaggtttgggaacgtggactttcgggtggcagttccaactgtccaatgcggaggagtacaaagtctggaaaccaggtcccagggaaggatctgctgccggcaacgggttctttaaactgtag

SEQ ID NO: 122938 - DNA, 1605 bp, Artificial Sequence
  Description of Artificial Sequence: Synthetic coding sequence
atgcggctgcgtggctgtgggccccgggcagccccagcgagcagtgctggagccagcgacgctagactgttggctcccccgggtagaaatccattcgtgcatgaactgcggctgagcgcactgcagaaagctcaggtcgccctgatgactctcaccctatttcccgtgcggctcctcgtcgccgcggccatgatgctccttgcttggccgctcgccttagttgctagtctgggctctgcagagaaggaacccgagcagcctcccgcactctggaggaaggttgtggacttcttactgaaagcaattatgagaacaatgtggtttgcaggtgggtttcaccgggttgccgttaaggggaggcaggcacttccaaccgaggcagccatactaactctggcacctcacagttcctacttcgatgccattccagtgacaatgacaatgtctagtatagtcatgaaagcagagtctcgcgatatccctatttggggaaccctgatacaatatattcggcccgtgttcgtgtccaggagcgaccaggactcgaggcgcaaaacagtcgaagagatcaagcgcagagcgcagtcaaacggcaaatggccgcagattatgatcttccccgagggcacatgtacaaaccgcacctgtctgatcacctttaagcccggtgcgttcatcccgggcgctcccgttcagcccgtggtactgagatatccaaacaaactggatactatcacctggacgtggcagggacctggcgccctggagatcttgtggctgacactgtgccaatttcacaaccaggtcgagatcgagttcctgccagtgtactcaccatcagaggaggaaaaaagaaatcccgctttgtacgcatcaaatgtgcgtcgggtaatggctgaggctctgggcgtctctgtcacagattacacattcgaagactgccagctggccttagccgaggggcaactgaggctaccagccgacacttgtctcttggagtttgctcggcttgtccgtggactaggcctcaagccggaaaagctggagaaggaccttgacagatacagcgaacgagccagaatgaagggcggagagaagatcgggatcgcagagtttgctgcctcactagaagtccccgtgtccgatcttttggaagacatgttttctctttttgatgagagtggctctggcgaggttgaccttcgggagtgcgtggtcgcactgtcggtcgtctgccgccctgcccggaccttggatactatccagctcgctttcaagatgtatggagcacaggaagacggaagtgtcggagagggcgacctttcttgcatcctgaagactgctctgggagtcgccgagctcacagtgactgacctgtttcgggccatcgaccaggaagagaagggtaaaattacctttgctgacttccaccgcttcgccgaaatgtacccagccttcgccgaagagtatctttaccccgatcagactcactttgagtcatgcgccgaaacgtctccagcacctatcccaaatgggttttgcgcagatttttccccagagaactcagacgccgggagaaagccagttagaaagaaacttgactag

SEQ ID NO: 122939 - DNA, 1605 bp, Artificial Sequence
  Description of Artificial Sequence: Synthetic coding sequence
atgcgcttgcgggggtgcggcccgcgcgctgcccctgccagcagcgccggcgctagtgatgccagacttctggctcctcctggaaggaatcccttcgtgcatgaacttaggctgtcagctctgcaaaaagcacaggttgcgctaatgactctgaccctgttcccagtcaggctcctggttgcagcagccatgatgctgctggcttggcctctcgctttggtggcctctctggggtctgccgagaaagagcccgagcagccacccgcactgtggcgcaaagtggtcgactttctgctgaaggcaatcatgagaactatgtggttcgcgggcggctttcatcgtgtggctgtaaagggtcgccaggctctgccaacggaggccgccatccttaccttggcaccccattcttcctacttcgatgctatccccgttaccatgacaatgtcctccatcgtgatgaaagccgagtctagggatataccaatctggggaacgctgattcagtacatccgccctgtgtttgtaagtcgctcggatcaggattcaaggaggaagacagtggaagagataaaaagacgagcccaatcaaatgggaaatggccacagatcatgatctttccggaggggacttgtaccaatagaacttgcctgatcacattcaaacctggagcctttattcctggggcaccggtccagcccgttgttcttaggtatcccaataagctcgataccataacatggacatggcagggcccgggcgccttggaaatcttgtggctcaccctctgtcagtttcataatcaggttgaaattgagtttctcccggtgtacagcccgtccgaggaggaaaaacggaatcctgcactttacgccagtaatgttcgaagagtgatggctgaggccttgggagtgagcgtaactgactatacgttcgaggactgtcagctggctctcgcggagggacagctcagactgcccgcggatacttgcttgctcgaattcgcgcggctagtgagagggctgggactaaaacctgagaagctggaaaaggacttggatcggtacagtgaacgcgcgaggatgaagggaggagagaagatcggaatcgccgagtttgctgctagcctggaggtgcctgttagcgatctgctggaagatatgttctctctgttcgacgaatctggatctggcgaggtggacctcagagaatgcgtggtagcactgtcggtggtttgtcgcccggccaggacactggacacgattcagctggcctttaagatgtatggggcccaagaggacggtagtgtcggagagggcgacctcagttgcattttaaagaccgctctcggtgtggctgaacttactgtaactgacctctttagggccattgaccaggaagagaagggaaaaataacttttgcagattttcaccggtttgcagagatgtacccggccttcgcggaggagtacctctatccagatcagacacactttgagtcttgtgctgaaacaagtccagccccgatacccaatggcttttgcgccgacttttctccggaaaattctgacgcagggcgcaagccagttcgaaagaaattggactag

SEQ ID NO: 122940 - DNA, 1464 bp, Artificial Sequence
  Description of Artificial Sequence: Synthetic coding sequence
atggcctctagtgccgagggtgatgaaggcactgtggtggctctggcaggagtgctgcagagtgggtttcaggagctatccctgaacaaactggcaacttccctgggggcgagtgaacaagccttgagacttataatttccatctttctgggataccccttcgcactcttctaccgccattatctattctacaaagagacgtacctgatccacctgttccacacattcaccggcctcagcatagcctacttcaacttcggcaatcaactttatcatagtctgttgtgcatcgtgctgcagttccttatcttacgcttgatgggacgcaccattaccgcagtgttgaccactttctgctttcagatggcttatttactcgccggttactattataccgctaccggtaattacgatattaaatggaccatgcctcactgtgtactaaccctaaagctcatcggcctggctgtggactatttcgacggaggaaaagatcaaaatagtctgagtagcgagcagcaaaagtatgccatcagaggggtccctagcctgctcgaggttgccgggttttcctacttctatggcgcctttctggtgggcccacagttctctatgaatcattatatgaagttagtgcaaggcgaactgatcgatattcctggcaagattcccaattcaataattccagccctgaaaaggctctcactcgggttattctatctggtggggtatacactgctgagtccccacataactgaggactacctgcttacagaggactacgacaaccaccccttctggtttcgctgcatgtatatgctgatttggggcaaattcgttctgtataaatatgttacctgctggctggtcaccgaaggcgtgtgtatactcacaggattaggatttaacggatttgaagagaaaggcaaggccaagtgggacgcctgcgccaatatgaaagtgtggctattcgaaaccaatcccagattcaccggaacaatcgcatcattcaatattaatacaaatgcttgggtcgcgaggtacatctttaagcggctcaaatttctggggaataaagagctgtctcagggtctctccttgctcttcttagccctttggcatggcttacactccggttacctggtgtgtttccaaatggagtttctgattgtgattgtcgaaaggcaagccgcccgtctgattcaagagagccccacactgtcgaagcttgccgccataactgtcctgcagcccttttactacctcgtgcagcagactattcattggctgttcatggggtattcgatgactgccttctgcttgttcacatgggataagtggctgaaggtgtacaagtccatttacttcctgggccacatcttctttttgtccctacttttcattcttccgtatatacacaaggcaatggttccaaggaaagagaagctgaagaagatggagtag

SEQ ID NO: 122941 - DNA, 1575 bp, Artificial Sequence
  Description of Artificial Sequence: Synthetic coding sequence
atgtcccagggcagtccaggtgattgggccccactggacccgacacccggaccacctgcatctcccaatccttttgttcacgagctccatctttccagactgcagagggtgaaattttgcctccttggcgcactccttgccccaatccgggtgcttctagcgttcatcgtcctctttctgctgtggccttttgcctggttgcaagtggccggcctctcagaggagcaactgcaggagcccatcactggatggagaaaaacagtgtgtcacaacggcgtgctggggctatctaggctgctgttctttttgttaggcttcctcagaattagggtaagaggacaacgggcttcccggcttcaggcccctgtactggtcgccgcaccccactccacattcttcgatccaattgtcctgctcccctgtgatctccccaaagtggtcagcagagccgagaacctttcggtcccagtgatcggggcattgctgaggtttaatcaggcaattctggtgagccggcacgaccctgcgtcgcggcggcgcgtggtggaggaggtccgtcggagggctacctcaggcggcaaatggcctcaggttctcttctttcccgagggaacatgctctaataaaaaggctcttctgaaatttaagcccggagcctttattgcaggagtgccagtgcaaccagttcttattcggtatcccaattccctcgacaccacatcctgggcttggaggggccccggagtgctcaaggtcctttggcttacagctagtcaaccatgttcaatagtggatgtggagtttctcccagtttatcacccaagccccgaggaatcacgggatccgaccttgtatgccaataacgtgcagagggtcatggctcaggccttgggcataccggcgacagaatgcgagttcgtcggtagcctgcctgtgatcgtggtggggagactcaaagttgctctggaacctcagttatgggagctgggcaaggttcttcgcaaggccggactctctgctggctacgtggatgccggggcggaaccaggcagatcacggatgatttcgcaagaggagttcgcacggcaactgcaactgagcgatccccagacagtagccggggccttcgggtactttcagcaggacaccaaggggctcgtggactttcgagatgtagctcttgcactcgccgctctagatggggggcgctcactcgaggagctgacacgcctcgccttcgaactatttgcagaggaacaggcagaagggccaaaccggctcctctacaaagacggtttttccactatcctccacctcctattaggatcacctcacccagcagccactgccctacatgccgaactgtgccaggccggaagcagccagggcctctcactttgtcagtttcagaattttagcctgcacgatcctctttacggcaaactttttagtacatatttgaggccccctcacacctctagggggacaagtcagacacctaatgccagcagcccaggaaatccaactgccctggcgaacggtaccgttcaggctcccaaacagaaaggcgactag

SEQ ID NO: 122942 - DNA, 693 bp, Artificial Sequence
  Description of Artificial Sequence: Synthetic coding sequence
atgtgcggcaataatatgtcaacgcccctccccgccattgtgccagccgcaagaaaggctactgccgctgttattttcttgcatggtctgggggatacaggccacggatgggccgaagctttcgccggcatacggtcctcacatattaaatatatctgcccccatgccccagtgcgccctgtaacactgaacatgaacgtggctatgccgagttggttcgacattattgggttatctccagatagccaggaggacgaatctggtatcaaacaggctgctgaaaatatcaaagccctgatcgatcaggaagtgaagaacggaatcccttctaaccggattattttggggggcttttcccaggggggcgcgctgagtctgtataccgcactgaccacccaacaaaagctggctggcgtgaccgctctatcttgctggctgccactccgggccagtttcccccaaggcccgattggcggtgctaatagagacatcagcattctccagtgccacggcgactgcgaccctttagttccgctgatgtttggtagtctgaccgtcgagaaactgaagacactcgtgaatcccgcgaatgtaacttttaaaacttacgaaggtatgatgcactcttcttgtcagcaggagatgatggatgttaagcagttcatagataaactgttgcctccaattgactag

SEQ ID NO: 122943 - DNA, 645 bp, Artificial Sequence
  Description of Artificial Sequence: Synthetic coding sequence
atgtgtggaaacaacatgtccactccacttccagcaattgtacctgcggctcggaaagccactgccgccgtcatctttttgcatggactaggggacacaggccatggatgggccgaggcattcgccggaattagatcatctcacattaagtacatctgtcctcacgcctttgatataatcgggctctctcctgattctcaggaagacgagagcggcattaagcaggctgcggagaatattaaagctttgattgatcaagaggtgaaaaacggcatcccttctaaccggatcatcttgggcggattctctcaagggggtgccctgagcctgtacaccgcactgacaacacagcaaaaactcgcgggcgtcaccgcactgagctgctggctgccactccgggcgtcctttccacagggaccaattggcggggccaatagggacatctcaatcttgcagtgccacggcgactgcgacccactggttccactcatgttcggatctctcactgtggagaaattaaagactttggtcaatcctgcaaatgtgaccttcaagacctacgagggcatgatgcatagcagctgtcaacaggaaatgatggatgtgaagcagtttattgacaagcttctgccgcccatagactag

SEQ ID NO: 122944 - DNA, 1092 bp, Artificial Sequence
  Description of Artificial Sequence: Synthetic coding sequence
atggaattacatgagcggcctgatgaacggcggaaagctcggacaagcactcaggggcggcttggagattggaggcgcgtgcacgctgatgggttcactcatagggtgtggtcatcatcgtcctggctggagcctgcaatgacctcccggactagagtgacctggcctagtccgcccagacctctacccgtccccgctgccgcggccgtcgcgtttggggccaagggcacagaccccgccgaagcccgcagcagccgtggaatcgaagaggccggcccgagagcccatgggagagccggtcgggaaccagaaagacgccgttcgagacaacagagaaggggaggtctgcaagctaggaggagcactcttctcaagacttgcgcgcgtgctagagccaccgctcctggcgccatgaaaatggtagctccttggacccgtttttacagcaacagctgctgcctatgctgtcatgtgagaactggaacaattctcctgggcgtctggtacctaatcataaatgctgtggtcttattaatcctgctgtcagccttggctgatcctgatcaatataatttcagctccagtgagctgggaggcgactttgaattcatggatgacgcaaatatgtgcatcgcgatcgcaatcagtctgttgatgatcctgatctgtgctatggccacttacggcgcctacaagcagagagccgcttggatcattcctttcttctgttaccagatattcgattttgcccttaacatgctggtcgcgataaccgtgttaatatacccaaactcaattcaggagtatattagacaactgccccccaacttcccctaccgagatgacgtgatgtcagtgaatccgacttgcctggtgcttatcatccttttatttatcagtataattctgacctttaaagggtaccttatatcctgcgtttggaattgctaccgttatatcaacggtcgcaactccagcgatgtgctggtctatgttacctccaatgacaccaccgtgctgcttcccccttatgacgacgcgaccgtaaatggagcggcaaaggaaccccctcccccatacgtgtcggcttag

SEQ ID NO: 122945 - DNA, 954 bp, Artificial Sequence
  Description of Artificial Sequence: Synthetic coding sequence
atgactagcagaactcgcgtgacctggcctagtcccccgcggcctttacccgtccccgctgcggccgctgttgccttcggcgcgaagggcacagatcccgctgaggcaaggtcctcacgtggcattgaggaggccggacctcgggcccacggccgggccggccgtgagcccgagcggaggagaagtaggcagcaacggcggggtggattacaggctaggcgctctaccctgttgaagacgtgcgcacgagctcgcgccacggccccaggtgctatgaaaatggtcgcaccatggacacgcttctatagcaactcctgttgtctgtgctgtcacgtgcggactggcacaattcttctgggcgtgtggtatctgataatcaacgccgtagtcctgttgatactcctctcagccctcgctgacccggaccaatataactttagctcctcggagttgggaggcgattttgagttcatggacgatgccaacatgtgcattgctattgccatctctctccttatgatcctgatttgcgccatggccacttacggcgcatacaagcaacgtgccgcctggattatccctttcttctgttatcagattttcgattttgctctgaacatgctcgtggccatcaccgtcctgatttatcctaattccattcaggagtacatccggcagttacctccaaatttcccttatcgggatgatgtcatgagcgtgaatcccacatgcctggtgctgatcatcctcctctttattagcatcatcttaacctttaagggctatcttatctcctgtgtatggaactgttatagatatatcaacgggcgaaactctagtgacgtcctggtatacgtcacctcaaacgacaccacagtgttgctgcctccttacgacgatgctacagtcaatggagccgccaaggagcccccgcctccatacgtaagtgcttag

SEQ ID NO: 122946 - DNA, 681 bp, Artificial Sequence
  Description of Artificial Sequence: Synthetic coding sequence
atgaaaatggtggctccttggactagattttattcaaattcatgttgcttgtgttgccacgtgcgtaccggcactatactgctgggagtgtggtacctgattatcaacgcggtggttctgctgatcctgctgagcgccttggctgatccggatcagtataactttagttcaagtgaactgggaggagatttcgagttcatggacgacgcaaacatgtgcatcgctatagccatttccttgctaatgatcctgatctgcgccatggcgacttatggtgcatacaaacagagagccgcatggataatcccatttttctgttatcaaatatttgatttcgcgctgaacatgctagttgccattacagtgttgatctaccccaattcaatccaagagtacattagacagctgccacccaatttcccataccgcgatgatgttatgtcagtgaaccccacctgtctggtacttatcattctgctcttcatctcaatcattctgacatttaagggctacttgatctcctgcgtttggaactgctaccgttacatcaacggtcgaaatagctccgacgtcctggtgtacgtcactagcaacgacaccaccgttctgcttccaccttatgacgatgctacggtgaatggagcagccaaggagcctccaccaccctacgtaagcgcctag

SEQ ID NO: 122947 - DNA, 789 bp, Artificial Sequence
  Description of Artificial Sequence: Synthetic coding sequence
atggacccccggcttagcactgtgaggcagacatgctgttgctttaatgtgagaatcgccaccactgctctcgccatataccatgtcataatgtctgtgctattatttatcgagcatagcgtggaggtggcgcacgggaaggcatcttgcaaactctcacagatgggctatctgcgtattgccgacttgatctcctcatttctcctcattacaatgcttttcatcattagcctgagccttttgatcggggttgtgaaaaaccgcgaaaagtacctgttaccttttctgtcactgcaaattatggactaccttttgtgcttacttactctgctggggagttatatcgagctgcccgcctacctgaaactggcaagtcgtagccgggcctctagctccaagtttccactgatgacccttcagcttcttgatttttgcctgagcatcctgacactgtgtagcagctacatggaggttcctacctacttgaatttcaaaagtatgaaccatatgaattacttgccatcccaggaggatatgccgcataatcagttcattaaaatgatgattattttcagcattgccttcatcacagtcttgatttttaaggtttacatgtttaagtgtgtgtggcggtgttatagactgattaaatgcatgaattcagtcgaggaaaagaggaattccaagatgctccagaaggtcgtcctgccttcatacgaagaggccttaagccttccatccaagactcccgagggtggcccagcgccgcccccttacagcgaagtctag

SEQ ID NO: 122948 - DNA, 873 bp, Artificial Sequence
  Description of Artificial Sequence: Synthetic coding sequence
atggacccccgcctgtccactgtcagacagacatgttgttgctttaacgtgcgcattgccacaacagccctcgcaatttaccacgtgatcatgtccgtgttgctgtttatcgagcatagcgtggaggtagcccacggtaaggcttcttgcaaactgtcacagatggggtaccttcgcatcgcggatctgataagcagtttcctccttatcacgatgctttttatcatctctctgtctctcctgattggggttgtcaaaaatcgagaaaagtacctgttgccctttttgtcactccagattatggactatctgctgtgtctcttgacgttgctgggctcctatatcgagctgccagcttatctcaaactggcttctcggtctagggcatcttctagtaaattcccgctcatgaccttacagcttctcgacttttgtctgagcatcctgactctttgttcatcttatatggaggtgccaacatatttgaacttcaagagcatgaatcatatgaattatcttccatctcaggaggacatgccgcataaccagtttatcaaaatgatgatcattttctccatagccttcatcaccgtgctgatcttcaaggtgtacatgttcaagtgcgtgtggcgatgttaccgtctcatcaagtgcatgaattcagttgaggagaaacggaattctaagatgctgcagaaagtcgtactgcctagctacgaggaagctttatctccggcgggacccgtttcctgtagccagctcgggcaaaggttccgtttatcccactccagcggactttcaatcatccagcccaacaacgcatggtttattagtatctcaagtgatacttgcctcgacgattggcctttctag

SEQ ID NO: 122949 - DNA, 11406 bp, Artificial Sequence
  Description of Artificial Sequence: Synthetic coding sequence
atgtcaactgacagcaactcactagctagggagtttctcaccgatgtgaaccggctttgcaatgccgtggtgcagagggttgaggcccgagaggaggaggaggaagaaacccatatggccacccttggccaatacctagttcacgggcggggttttttgcttttgaccaagttaaactccattattgatcaggcacttacgtgtagagaggagttacttaccctgctgctgtccctcttgccactggtttggaaaatccccgttcaggaagagaaagctaccgactttaacctccctctctcagccgacataattttgacaaaagagaagaattcaagtagtcagagatcaacacaggagaaactccaccttgagggctccgctctgtcaagtcaggtttcagccaaggtgaatgtgtttcggaagtccagaaggcagcggaaaataacacatcgctactcagttcgagacgcccggaagactcagctgtccacttcagatagtgaggccaactcagacgaaaagggtatagctatgaataaacatagacgacctcacctactccaccattttttgacctcctttcccaagcaggaccaccccaaggccaagctcgatcggcttgctacgaaggaacagacacctcctgacgccatggccctggaaaattcgcgcgagattatcccccgccagggcagcaatactgatattctctccgaacccgcagccctgagcgtgatcagtaacatgaacaactcccccttcgacctgtgccacgtgctgttatccctgctggaaaaagtttgtaagtttgatgtgacattgaatcacaacagcccactggcggctagtgtggtccctacgctgacagaatttttggcaggattcggggactgttgttccctgtccgataacctcgaaagtcgtgtcgtgagtgccggctggactgaagaaccagtcgcactgattcagagaatgctctttcgcaccgtgcttcacctgctgtcagtcgacgtatcaaccgccgaaatgatgcccgagaacctgcgaaaaaatctgactgaactcctccgagctgccctgaaaattagaatctgcctagaaaaacaaccggacccctttgctccacgtcagaagaaaactctacaagaagtccaggaggactttgtcttttctaagtataggcaccgtgccctcctgttacccgagctgttggaaggagtgctgcagatcttaatttgttgcttgcagagcgccgcgagcaaccccttctacttctcccaggcgatggacttggtgcaagaattcattcagcaccacggctttaatctgtttgagaccgctgttctccagatggagtggctggttctgcgggatggagtgcccccagaagcttccgaacacctcaaggctctgatcaattcggtcatgaaaatcatgtctacagtaaaaaaggttaaaagcgaacagctgcatcatagcatgtgcaccaggaaaagacaccgaaggtgtgagtattcccactttatgcatcaccaccgagatctctccggactgttggtctctgccttcaaaaatcaggtgagtaaaaatccatttgaggaaacagccgacggagatgtatactaccccgagcgatgctgctgcattgccgtctgtgcccatcaatgtctgaggctactgcagcaggcaagcctatcttcaacctgcgtgcagattctctctggtgtgcataatataggtatctgttgctgtatggaccccaagtccgtaatcataccccttctacacgcttttaaactccccgccctgaagaacttccagcagcatatactgaatatcctgaataaactgattctggaccagctgggaggtgcagagataagcccaaaaatcaagaaggcggcgtgcaacatttgtaccgtggacagcgatcagcttgcacagctcgaggagactctgcagggcaacctatgcgacgccgaactcagtagttctctctcctctcctagttacaggtttcagggtattttgcctagttccgggtcagaagatctgctgtggaaatgggatgcactcaaagcttaccagaacttcgtcttcgaggaggatcgcctgcattcaattcagatagcaaaccatatctgtaatttaatccagaagggcaatatcgttgttcagtggaagctgtataactatatattcaacccggtgctccagaggggcgtggaattagcacaccactgtcaacacctctccgtgacctccgcccagtcacatgtgtgcagtcatcacaaccagtgtctgccacaggatgtgctgcaaatttacgtgaagaccctccccatacttctcaagagtagggtcattcgagacctcttcttaagttgtaatggcgtaagtcagatcattgaactgaactgccttaatggcattcgcagtcattccctgaaggcatttgagactctcattataagcttaggggaacagcagaaggatgcctcagtgcccgacatagatggcatcgacatcgaacaaaaagagttgtcaagcgtgcacgtcgggacaagcttccaccaccagcaagcctacagcgactctccacagagcctttctaagttttacgccggtttgaaagaagcctacccgaaaaggcgtaaaaccgttaatcaggacgtgcacatcaacaccattaacttattcctgtgcgtggcctttctgtgtgtcagtaaggaggccgaatcagaccgagagagcgccaatgactccgaagataccagcggatacgattctactgccagtgagcccctctctcatatgttgccatgcatttctttagaatcactggtcctgcctagcccagagcacatgcaccaggccgccgacatttggtccatgtgccgctggatttacatgttgtcttcagtctttcagaagcaattttaccgcctgggcgggttcagggtgtgccacaaattgattttcatgatcatccagaaactcttcaggagccacaaagaggagcagggaaagaaggagggtgacacctcagtgaacgagaatcaggacctgaatagaatctcccagccaaagaggacaatgaaagaggatctgctcagcctggcaatcaaatctgacccgatcccttcagaactcggatccttaaaaaagtcagcagattcactggggaagctggaactgcagcacatttcctccatcaatgttgaggaggtgagtgccactgaagcagcccctgaggaggctaaactcttcacgtctcaggaatcagagacctcactgcagtccatccgattgctcgaggccttgttagcaatctgtctgcacggcgcgcgtacgagtcaacagaagatggaacttgagctgcccaaccagaatctcagtgtagagtcgatactctttgaaatgagggaccacctgtcccaatctaaggttatcgaaacacagctagcgaagcccctgttcgatgccctgctccgcgtcgccctaggcaattacagcgctgactttgagcacaacgatgcgatgactgagaaatcccaccagtccgcagaggagctgagcagccaacccggcgatttcagcgaggaggctgaggattcccagtgttgttcttttaaattgttagtggaggaagaaggatatgaagcagattccgaaagtaatcctgaggacggggagacccaggacgacggcgtggacctcaaaagcgaaactgaaggattctctgctagctcctctcctaatgacctgctagagaatctcacccagggagaaatcatataccccgagatctgtatgcttgagcttaacctgctgagcgcgagtaaagcaaagcttgacgtgcttgctcatgtatttgaatcatttctcaaaataatcagacagaaagaaaagaacgtgtttttgcttatgcaacagggaaccgtaaaaaatcttcttggtggatttctgagcatcctcacgcaggatgattccgacttccaagcttgtcagagggttctcgtggaccttctcgtgtctttgatgtccagtagaacatgtagcgaagaactgactctacttctgcgcatctttctagagaaatccccctgcaccaagatactgctgctgggcattctgaagatcatcgaatctgacacaactatgtcccccagccagtacctgaccttcccactgctgcatgcgccaaacctgagtaatggcgtttccagccagaaatatcctggcattctgaactccaaagccatgggcctgctacggcgggctagggtgtctaggtctaaaaaggaggcagacagagagtccttccctcatcggctgttatcctcatggcacattgcccctgtgcaccttccacttcttggacagaattgctggcctcacctgtcagaagggtttagcgtgtctctgtggtttaatgtcgaatgcatccacgaagccgaaagtactacagaaaaagggaagaagataaaaaagcgcaataaaagcctgattctccccgattcatcgtttgacggtacggaatccgacaggcctgaaggagccgagtacataaaccccggagaaagattaatagaagaaggctgcatacacatcatctccctgggcagcaaggcactgatgattcaggtgtgggccgacccccataacgccactctcatattccgagtctgcatggactctaacgacgatatgaaagcagtgcttctggctcaggtggagtcacaggaaaatatatttctgccttcaaagtggcagcatttagtgctcacttacttacaacagcctcagggaaaaagacggattcacggtaagatttccatctgggtctcgggccagaggaagcctgatgtgactttggacttcatgctgcccagaaaaacgtcattgtctagcgatagcaataaaacgttttgtatgatcgggcattgcctcagttcgcaggaggagtttttacagctcgcaggcaaatgggacttgggaaacctgctcctgtttaacggagcgaaggtgggcagccaagaggccttctacctgtacgcctgtggtccaaaccacactagtgtgatgccctgtaagtatgggaagcccgtcaacgattacagtaagtacatcaacaaagaaatactccgctgtgaacagatcagggagctctttatgacaaaaaaggatgtcgacattggtcttctgattgagtccctttcggttgtctacaccacctactgtcccgctcaatataccatctacgaaccagttattcgattaaagggccagatgaaaacacaacttagccagcgtcccttctcttcgaaggaggtgcagtctatcctgcttgaacctcatcacctgaaaaaccttcagccaaccgaatacaaaacaatccagggaatcttacacgagattggcggaaccggcatcttcgttttcctcttcgctcgagtcgtggagctgagctcatgtgaagaaacccaggcgctggctctcagagtgatcctgtctttaattaagtacaaccagcaaagggtacacgaactagagaactgcaatggactatcgatgattcatcaagtgctcataaagcagaagtgcatcgtagggttctacatattaaaaacgctcctcgaaggctgctgcggcgaagatatcatttacatgaatgagaacggagaatttaagctggacgtagacagtaacgccatcatccaggatgtcaaactgctggaggagctgcttctcgactggaagatatggtctaaagctgagcagggtgtgtgggaaactctccttgcggctctggaagtgttgatccgggccgaccaccaccaacaaatgtttaatatcaagcagttgctgaaggctcaagtggtgcatcactttctgctcacctgccaagtgttgcaggagtacaaggaaggtcagcttacgcctatgcctagggaggtgtgccgctcctttgtcaaaatcattgcggaagtccttggatctccgccagatctggaattgctgacgataatcttcaactttctgctggctgtgcaccctcctacaaatacctatgtttgccacaacccaacgaacttctatttttccttgcatatagatggaaaaatatttcaggaaaaggtgcgtagtatcatgtatttgcgacattcaagttcgggcgggaggtcactcatgagtcccggtttcatggtgataagcccctctggcttcacagcctcgccttatgaaggcgagaacagctccaatattattccccagcagatggctgcccatatgttacgcagcaggtccctccccgcctttccgactagcagcctgttgacccagtcccagaaattgacgggatccttgggctgcagcatcgaccgactgcaaaacattgctgatacctacgtggcgacccagagtaagaaacagaacagtctcggcagcagtgataccttaaaaaaaggaaaggaagacgctttcattagttcttgcgagagcgccaagacggtttgcgaaatggaggctgtcctatcagcacaggtgagcgtcagtgatgtgccgaaaggcgtgctaggcttcccagttgtgaaagccgaccacaagcaacttggagctgaaccacgctccgaggacgactcccccggcgatgagtcctgtcctcgaaggcccgactacctgaaaggactcgcgtcctttcagaggagccactccaccatagctagtctgggcctcgccttcccctctcagaacggaagcgccgcggtgggtaggtggccgtcgctagtggaccgcaacaccgatgattgggaaaacttcgcatactccctgggatatgaacccaattacaaccgcaccgcttcagcacacagtgtcactgaggactgcctcgtcccaatctgctgtggactttacgagctgctatcaggggtgttactaatcctccccgatgttctgttggaggacgtcatggacaaactgatccaggcagataccttactggtcctcgtaaaccacccctcacccgcgatccagcagggtgtcattaagctgctggacgcctactttgctagggcttcaaaggagcagaaagacaagttcttgaaaaatagagggttttctctgctggccaaccaactttatctccatcggggcactcaggaattattggagtgcttcatcgaaatgttttttgggcgacatataggcctcgacgaagaattcgacctcgaggacgtcaggaatatgggactcttccagaagtggagcgtcattccaattttgggcttgatagaaaccagcttatatgataacattctgttacacaatgcacttctgctgctgctgcagatactgaacagctgcagtaaggtggctgatatgttgttagacaatgggctcctctatgtcctgtgcaacacagtggcagcattaaacggcctggaaaagaacatccccatgagtgagtataagctactggcttgcgacatccagcagctttttattgctgtgacgattcatgcatgctcatccagcggcagccaatacttccgcgttatcgaagatctaatcgtgatgctgggttacctgcagaattctaagaacaagaggacacagaacatggctgtggcgcttcaactgagagttctacaagctgcaatggagttcatacgcacaactgccaatcacgattcggagaacttaacagatagtttgcagagtccatcggctccgcatcatgccgttgtgcaaaagcggaaatccattgcgggcccccgcaaatttcctctcgcacagactgagtccctcctcatgaaaatgcgctctgttgccaatgacgaactgcatgtaatgatgcagaggcgcatgtcccaggagaatccctctcaggccacagagactgagctcgcccagcgtctgcagaggttgacagtgctcgccgtgaaccgtatcatttaccaagaattcaactcggacatcattgatatactgcggactccagagaatgtaacccaaagtaaaacatctgtgttccaaacagaaatctccgaggagaatattcaccacgaacaaagctctgtatttaacccctttcagaaagagatcttcacttacctcgtggagggatttaaggtgtctattggctcctcaaaggctagcggaagcaagcagcaatggaccaagattctctggtcatgtaaagaaacattccgcatgcaactgggaagactcctagttcacattctgtcgcctgcccatgcggcacaggagaggaaacagatcttcgagatcgttcatgaaccaaatcaccaggagatactaagggactgtctgagtcccagcctgcagcatggggccaagctggtgctgtacttatccgagcttatccacaatcaccagggtgagctgaccgaggaggagcttggcaccgcggaactccttatgaacgctctgaaactgtgcgggcacaagtgtatcccaccatctgcatcgacaaaggcggacctgattaagatgattaaggaagagcagaaaaagtacgaaactgaagaaggtgtaaataaggcggcgtggcaaaaaaccgttaataacaaccagcagagtctttttcaaaggttagatagtaaatctaaggacatttccaagatcgcagccgatattacccaggccgtttcactcagccaaggcaacgagcgtaagaaagtgatccagcatatacggggtatgtacaaagtggatctcagcgcctcgcggcactggcaggaactcatccaacagctgactcacgacagggcagtttggtacgatcccatatattatcccacctcctggcaactggatccgaccgaaggcccgaatagagagcgccggaggctacagcggtgctacctgaccatccccaacaaatacctgctcagggacagacagaaatctgaagatgtggtaaagccacctctgtcttatctgtttgaggacaagacgcactcaagcttctcatccaccgtcaaagataaggccgcttctgaatcaatcagggttaacagaaggtgtatcagtgtggcaccatcaagggagacagccggggaacttctacttgggaaatgcgggatgtacttcgttgaggacaatgcttctgacactgttgaatcctccagcctgcagggtgagttggaacctgcttctttcagctggacttacgaggagatcaaggaggtgcataaacggtggtggcagctgagagacaacgcagttgagatttttttgactaacgggcgcaccctgttgcttgcttttgacaatacaaaggtacgggacgatgtgtatcacaatatcctgacaaataacctgccaaatttgctcgagtatgggaacattaccgcactgacgaacctgtggtatacaggacagatcactaacttcgaatatcttacgcaccttaacaagcacgctgggagaagctttaacgatctcatgcagtacccagtctttcccttcatactggctgactacgtctcagagacgctggatctgaacgatctgttaatttataggaatctcagtaagcctattgccgtccagtacaaggagaaagaagatcggtacgtcgacacatataagtatctggaggaagagtaccggaaaggggcacgcgaggacgaccctatgccaccggtgcaaccctaccactacggaagccattactcaaatagcgggactgtgcttcactttctggtccggatgccacctttcactaaaatgttcttggcataccaggatcagtctttcgacattcccgaccgcacatttcacagcacgaatacgacatggagactgagctctttcgaaagcatgacagacgtaaaggagctcataccagagtttttctacctgcctgagtttctcgtgaatcgggaaggattcgactttggtgtgagacagaatggggaacgcgtgaatcatgtaaacctccccccatgggcaagaaacgaccctagactcttcatattgatacaccgacaggccctggagtccgactacgtgtctcaaaatatctgtcagtggattgatttagtcttcggctataagcagaaaggaaaagcctccgtgcaggctatcaacgtattccacccagccacatacttcgggatggatgtgagtgcagttgaggacccagtccaacgccgcgcgcttgaaaccatgatcaagacttatggacagaccccccggcaattgttccatatggctcacgtaagcaggcccggcgcaaagctcaatattgagggggagcttcctgccgctgtaggcctcttggttcagttcgcctttcgggagacaagagaacaagtcaaggaaatcacgtatccgtcgccacttagctggatcaagggccttaagtggggagaatacgtggggagtccatcggccccggtcccggttgtttgctttagccagccacatggagaacgcttcgggagcctccaggctctgccgacacgagctatctgcggtctgtcccgtaacttttgtctgctcatgacttattctaaggaacaaggcgtgcgcagcatgaatagtaccgatatacaatggagtgcaattctgtcttggggctatgcggataatatcttacgattgaaaagcaaacagtccgagcctcctgtgaacttcatccagtcttctcaacagtaccaagtgacttcctgcgcatgggtgcccgactcctgccaattgttcactgggtctaagtgcggagtgattacggcttatacgaacaggttcaccagtagtaccccctcggaaattgaaatggagactcagatccacctgtatggtcacacagaggagatcacttcgctattcgtgtgcaagccatattctattctgatctccgtctcgcgagacgggacttgtattatttgggatttaaaccgcctgtgctatgttcaatccctcgctggccacaagtctccagtcacggctgttagcgccagcgagacttccggagatattgcgaccgtctgcgactctgcgggtggaggatctgacctacgcttgtggactgtgaacggggacttggtaggtcacgtgcattgccgcgagatcatttgtagcgtggccttttctaatcaacccgaaggcgtgtccattaatgtgatcgcaggcgggctagagaatggtatagtcaggctgtggtctacgtgggaccttaaacctgtgcgggaaataaccttcccaaaatctaacaagccaatcatctccctgaccttcagctgcgatgggcaccatctgtatacagctaacagtgacggaaccgtgattgcctggtgtcgaaaggaccagcagagactgaaacaacctatgttctacagcttccttagctcatacgccgccggatag

SEQ ID NO: 122950 - DNA, 11406 bp, Artificial Sequence
  Description of Artificial Sequence: Synthetic coding sequence
atgagtactgactctaattctctggcccgtgaatttttaacagatgtaaatagactctgtaacgcagtggtccagcgagtggaggctagagaggaagaggaggaggagacacacatggctaccctaggtcagtacctcgttcacgggcgcggctttctgctgctgactaagctcaatagtattatcgaccaggctttgacatgtcgggaggagttgctgacccttctgctgtcactgctgccgctcgtgtggaaaatcccagtccaggaagagaaggccaccgactttaatcttcccctgagcgccgacattatcttgactaaagagaaaaatagtagttcacagagatccacgcaagagaagctgcatttagaagggtccgcactgagctctcaagtatctgccaaagtgaacgtgttcaggaagtccaggaggcagcggaagattacacataggtattctgtccgcgatgctcggaaaacacaactctccacaagcgactccgaggcaaactccgacgagaaggggatcgccatgaacaagcacaggagaccgcacctcttacaccactttcttacttcgtttccaaagcaggatcaccctaaggccaaattggacagactcgccacaaaagaacaaaccccacccgacgctatggccctagagaatagtagagagattatccccagacagggctctaataccgacattcttagtgagccagcagcactttccgtcatctcaaatatgaacaattctccattcgatctttgccacgtgcttttgtccttactcgagaaggtgtgtaagttcgacgtgactctgaatcataacagccccctcgctgcttcagtggtgcctaccctaaccgagtttctcgctggttttggtgactgttgttccctgagcgataacctggagtctagggtggtttccgcaggctggactgaggaacccgttgctcttatccagcgtatgcttttcaggacagtgctccacttgctgtctgtagatgtgtcaacggccgaaatgatgccagagaatctgcgtaaaaatttaaccgaactactccgcgctgctttgaaaatccgcatttgcttggagaagcaacctgatccctttgctcccaggcaaaagaaaactcttcaggaagtccaggaagacttcgtattctccaagtaccgccatagggcattgctgctcccagagctcctggagggtgtgctccaaatactgatctgttgtctgcagtctgccgcttccaaccccttctatttctctcaggctatggatttggtacaggaattcatacagcaccatggattcaacctgttcgaaaccgctgtcctgcaaatggagtggctcgtgcttcgcgacggtgtgccccctgaggcatccgagcatctgaaagccctgattaacagcgtcatgaagatcatgtccactgtgaagaaagtcaaatctgaacagcttcatcacagtatgtgcacgcgcaagcggcatcgtagatgtgagtacagccattttatgcatcaccatcgggacctctctggcttactggtgtccgcatttaaaaatcaggtctctaaaaacccctttgaggagactgcggatggagacgtctactatcccgagcgctgttgctgtatagctgtttgtgctcaccagtgcctgaggctgctccagcaagcgagcctgagctcaacatgtgtgcaaatcctgagcggggtgcataatatcggcatatgctgctgcatggatcctaagtctgtgatcatacccctgctccacgctttcaaacttcccgccctgaagaattttcaacagcatattctgaatatactgaacaagcttatcctagatcagttgggaggagcagaaatctccccaaagataaagaaggctgcctgtaacatatgtacagtggattcagaccagttggcccagcttgaggagacactccaggggaacctttgcgacgctgaactgagctcttctctgtcttccccatcttatagatttcagggtatcctcccgtctagcggcagcgaggatttgttgtggaaatgggacgccctgaaagcctatcaaaatttcgtgtttgaagaggaccggcttcacagcattcagatcgcgaaccatatctgtaacctcattcaaaaaggaaacatcgtggtgcaatggaagctctacaattatatttttaatcctgttctgcagcggggcgtggagctggctcaccactgccaacatctgagcgtaacgtccgcccagagtcacgtgtgctcccaccataaccagtgtctaccacaggacgttcttcaaatctatgttaaaacattgcccatcttactgaaatcacgcgtgattagggacctgttcctatcatgcaatggtgtgtctcagatcatcgagctcaattgcttgaacggcatcagatcacattctctgaaggcgtttgagaccctcatcattagcttaggcgaacagcagaaggacgccagtgtcccagacatcgatggcatcgacattgaacagaaagaactgtcttctgtgcacgtcgggacttcgtttcaccatcaacaggcttactccgattcccctcagagccttagcaaattctacgcagggttaaaagaggcttatcctaagaggagaaagaccgtgaaccaggacgttcatatcaacaccattaacctgtttctttgcgtggcatttctgtgcgtcagtaaggaggccgaaagtgaccgtgaaagcgctaatgatagtgaggatacctccgggtacgattctacagcatccgagcccctcagccacatgctgccatgcattagcctagagtcactagtccttccttctccagaacatatgcaccaggcagccgatatttggtcgatgtgtcggtggatttatatgctgtccagcgtgttccaaaagcaattttaccggctgggaggctttcgggtttgccacaaactcatattcatgattatccaaaaattgttcagatcccacaaggaagaacagggcaaaaaggaaggagacacttctgtgaacgagaaccaggacctgaatagaatctcgcagcccaaacggacaatgaaggaggacttactgtctctcgctatcaagtcagaccctatcccctccgagttgggatcattgaagaagagtgcagacagccttggcaaactggagctccagcatatctcgtccattaatgtggaagaagtcagcgcgaccgaagctgcccctgaagaagccaaactgttcacaagccaggagagtgaaacctccctccagagcattcgcttgcttgaagcgctgctggccatttgccttcacggcgctaggacgtctcagcagaaaatggaattggagctgcccaatcagaacctgagcgtggagagtatcctttttgagatgagagaccacttatcacagagcaaggtgatcgaaactcagctggctaaacccctattcgacgcccttctacgagtcgccttggggaactattccgctgattttgaacacaacgatgccatgaccgaaaagtcccaccagagtgctgaggagctcagttcacagccaggtgacttctccgaggaggctgaggatagccaatgttgctcctttaaattgctcgtcgaagaggagggctatgaggccgattctgaaagcaatccagaggacggtgagacccaagacgacggggtggatctgaagtcagaaaccgagggctttagcgcttctagcagtcccaacgacctgctggaaaatctgacccagggcgaaataatttaccctgagatttgtatgctggaactgaatctgttgagcgccagcaaggccaagttggatgtgctggctcacgtcttcgaaagctttttgaaaataataagacagaaagagaaaaacgtcttcctgctcatgcagcagggcactgttaagaatctgttaggagggttcctgagcatcttgacacaagacgatagtgattttcaagcttgtcagcgggtgctggtagacctgcttgtgtcattgatgagttcccgaacctgcagcgaggagttgaccttactgttgcgaatcttcttagaaaagagcccgtgtacaaaaatcctgttattaggcatactgaagattatagagagcgataccacgatgtccccaagtcaatacctgacttttcccctcctgcatgccccaaacctgtctaacggcgtgtcctctcaaaagtatcccggaattttaaattctaaggccatggggctgctacgcagggccagggtgtcacgttctaaaaaagaagcggatagagagtccttccctcaccgcctacttagcagctggcacatcgcacctgtacatttaccactgctgggccagaattgttggccccatctttccgaggggttttccgtctccctttggtttaacgttgagtgcatacacgaggctgaaagcaccacagagaaagggaagaaaatcaagaaacgtaataagtccctgatactgcctgatagctcatttgatgggacggaatctgatcgcccggagggggccgaatatatcaatcccggagagcgtttgatcgaggagggatgcatccacattatctccctcggatctaaagccctcatgatccaggtgtgggcggatccccacaacgctactctgattttccgtgtgtgcatggattcaaatgatgatatgaaggctgtgctactggcccaggttgaaagtcaggagaacatcttcttaccgtccaaatggcagcatctggtgctcacctatctccagcagccccagggaaagcggcgaattcacggcaaaattagcatctgggtttcgggtcagcgaaagcctgatgtgaccctggatttcatgctgcccagaaagactagcctgtcctctgacagcaataaaaccttctgcatgattggccactgcctgtcgtctcaggaggaatttctgcagctggcgggcaagtgggacctcggaaacctgcttctctttaatggagctaaggttggcagccaggaagccttttatctttatgcctgcggcccgaatcatacttcagtgatgccgtgcaagtatgggaaacctgtcaacgattactctaagtatataaacaaagaaattctcaggtgcgagcagatcagggagttattcatgactaagaaagacgtcgatatcggactgctgattgagtccctttccgtcgtatatactacatattgtcctgctcagtatacaatttacgaacccgtgatccggctaaagggacagatgaagacccagctcagtcaacgtcccttttcctctaaagaggtccaaagcatcctgcttgaaccacaccatctgaagaatttgcagcctacagagtataaaactatccagggcattttgcatgaaattggcgggacaggcatcttcgtcttcctctttgcacgggtagtggagctgagttcctgtgaggagacccaggcccttgctctccgtgtgattttatctctgattaagtacaaccagcagcgcgttcacgaacttgaaaactgcaatggcctatctatgattcaccaagttctgataaaacagaaatgcattgttgggttttacattctgaaaaccttgctggagggatgctgtggagaggatatcatttatatgaatgaaaatggggagttcaagctggatgtggacagcaacgcaataatacaggatgtgaaattgctggaggaactgctgttggactggaaaatctggtcaaaagcagaacaaggggtctgggaaacactcctggcagccttggaagtcctcattcgtgctgaccaccaccagcagatgttcaacataaagcagctgttaaaggcccaggtggtgcatcacttcctgctaacctgccaagtactgcaggagtacaaagagggccagttgacgcccatgcccagggaggtgtgtaggtccttcgtaaaaattatcgctgaggttctgggtagcccacctgatctggagctgctgacaatcatctttaactttcttcttgccgtgcaccctcctaccaatacatatgtgtgccacaatcccacgaacttctatttttcactgcatattgacggcaaaatcttccaggaaaaggtcaggtccatcatgtaccttaggcactcttcttcaggtggtagatcactgatgagcccgggatttatggtaatcagtccctctgggtttaccgcgagtccctacgaaggcgagaacagcagtaatatcattccccagcagatggccgcgcatatgctgcgctccaggagtttgccagcattccccacttcatccctgctcacccagagccaaaaactgactgggtctctcggctgctcaattgaccggctccagaacatcgcagacacgtacgtcgcgacccagagcaagaaacagaactcgctcgggtcatccgataccctgaaaaagggaaaggaagacgcttttatctcctcatgtgaaagtgccaagacagtctgtgagatggaggcggtgctctcagctcaagtttccgtgtcagatgtcccgaaaggggtgctcggcttccctgtggtgaaggccgaccataaacagctgggcgccgagccaaggtcagaagacgatagccctggggacgaatcctgcccccgcaggccagactacctgaagggtcttgcctcctttcaacgttcccattcaaccatcgcctctttgggcctggcattccctagtcagaatgggtcggccgctgtgggaaggtggccatccctggttgatcgcaacaccgacgactgggagaatttcgcttattctctgggctacgaaccgaactataatcggacagcttctgcacatagcgtgaccgaagattgtctcgttcccatttgttgcggtttgtacgagctgctatccggggtgctcctcatcctgccggacgtattacttgaggacgttatggataagttaatccaggccgatacccttttggtcctcgtgaatcacccaagcccagcgatccagcaaggcgtcataaagttgctggacgcctacttcgccagagccagcaaagaacaaaaagacaaattcctgaagaatcgtggctttagtttgctggcaaatcagttatacctccatcgcggcacccaagagctgcttgagtgcttcattgagatgttttttggccggcacattggcctagatgaggagttcgacctggaagatgtgcgcaatatgggacttttccagaaatggagcgttatccctatcctgggactgattgaaacttccctgtatgacaatatcctgttgcataatgcactcctcctgctcctgcaaatactgaattcttgttcaaaggtcgccgacatgttgttggacaatgggctgctctatgtcctgtgtaatactgtagccgccctaaacgggctggaaaaaaacattcccatgtcagagtataaactgctggcttgcgacattcagcaactgtttatcgctgtcacaatccacgcatgcagcagttctggttctcaatactttagggtgatagaagacctcatcgttatgcttggctatctgcagaattccaagaataagcggacccagaacatggcggtggcgctgcagctaagggtcttgcaagccgcgatggaattcatccgaaccacagccaatcacgactccgagaaccttacagactctctacagtccccttccgccccgcaccatgcagtggtccagaaacgcaagtccattgccggtccccggaagtttcctctagcccaaaccgagtccctgttgatgaaaatgcgtagcgtggcaaatgacgagctgcacgtcatgatgcagcgccgaatgagccaggaaaacccttcccaagccaccgaaacagagctcgcacaaaggctacagagattgactgtgctggctgtgaacaggatcatttatcaggagtttaacagcgacatcatcgatatcctgcgcactcctgaaaacgtgacacagagtaagacatccgtctttcagacggagatatcagaggaaaatatccaccacgagcagtcctctgtcttcaatccttttcaaaaagagatttttacctacttggtagagggcttcaaagtcagcattggtagcagcaaagcctccggctctaagcagcaatggacgaagatcctgtggtcctgtaaagagacattccgaatgcagttgggcaggctgctggttcacattctgtcgccggcccacgccgcgcaggagcggaagcagattttcgagattgtccatgaacctaatcaccaggagattctccgagactgtctatctccgtcccttcaacatggtgccaagctggtgctgtatctcagtgaactgattcataaccaccagggcgaactcaccgaggaggagttgggaacagctgaactgctgatgaatgcactgaaactctgtggacacaagtgcattcctcctagcgcttctacgaaagccgatctgattaagatgatcaaggaggagcaaaagaaatatgagactgaggagggtgtcaataaggctgcctggcagaaaaccgtgaacaacaatcaacagagtctctttcagcggttagattcaaagtctaaagatatcagcaaaatcgcggccgatattacccaggccgtaagcttaagccaggggaatgagcgcaaaaaggttatccagcacattcgcggaatgtataaggttgatctctctgctagtcgacactggcaagaactgattcagcagctcacccatgatagagccgtttggtacgatcctatctactatccgactagttggcagttagaccccaccgaaggacccaacagggagagaaggagactgcagcgctgctacctcactatcccaaataagtaccttttgagagatcgccagaaaagcgaggacgtcgtcaaacctcccctgagctaccttttcgaggataagacacattccagcttttctagcaccgtgaaggataaagcggcctccgagtcgattcgggtgaaccggcggtgtatctccgtggcaccctccagagagaccgctggcgagttacttctgggtaagtgtggtatgtacttcgtagaagacaacgcatcagatacagtggagtcatcctcactacagggagaactcgagccagcttcattttcatggacctacgaagaaatcaaggaagttcataagagatggtggcagttaagagacaacgccgttgaaattttccttactaatgggaggactctgctcctggcctttgacaacactaaagtacgggatgatgtgtaccacaacatcctgactaacaatctgcctaacctgctcgaatacggaaatataactgccctcaccaacctgtggtatactggtcagatcactaattttgagtacctgacccaccttaacaaacatgctgggagaagcttcaacgacctgatgcagtatccagtttttccattcatcctggctgactacgtgagcgagacgctggatctgaatgatctgctcatatataggaacctgagcaagccgattgctgttcagtacaaagaaaaagaggacaggtacgtggacacctataagtatctggaggaggaatataggaagggagcgcgggaagatgatcctatgccccctgttcagccttatcactacgggagccattacagcaacagcggcactgtgctccactttctggtgagaatgccgcccttcaccaaaatgtttttggcctaccaagaccagtcattcgacatacccgatcggactttccactcgaccaatacaacttggcggctgagtagcttcgaaagcatgaccgacgtcaaggagcttattccagagttcttttatcttcctgagtttctggtgaatcgagaaggcttcgactttggcgtccgacagaatggggagagggtcaatcatgtgaatttaccaccttgggctagaaacgatcccagactcttcatactcatccaccggcaggccctcgagagcgactacgtgagccagaacatctgccagtggattgatttggtctttggatacaaacagaaaggaaaggcatccgtgcaggccatcaacgtgttccacccggctacttactttgggatggatgtgtctgctgtggaggatccggtccaaagaagggcattagaaactatgattaaaacctacgggcaaaccccacggcaactcttccacatggcacatgttagccgacccggggcaaaactgaatatcgagggggaactacccgccgccgtgggcttactcgtgcagttcgcctttcgggagacccgagagcaggtgaaggagattacttacccatcccctttgtcttggatcaagggactcaagtggggggaatacgtggggtcgcccagcgcgcccgtgccagtcgtgtgtttttcacaaccacatggggagagatttggatcactgcaggcattgccaaccagggcaatatgtggacttagcaggaatttttgtctcctgatgacttattcaaaggaacagggtgttcggtccatgaattccaccgatatccaatggtcagccatcctctcgtggggatatgcagacaacatcctccggctaaagtcgaagcagtcagaacccccggtgaatttcatacaatcgtcccagcagtatcaagtcacttcctgtgcctgggtgcccgactcgtgccagcttttcaccggcagcaagtgcggggtcatcaccgcatatactaacaggttcacgtcttctaccccgtctgagattgaaatggagacacagatccatctatacgggcatactgaagagatcacatctctcttcgtgtgtaaaccttacagcattctaatcagcgtgtcaagagatggcacctgtattatctgggatctgaatagactctgttatgtgcaatcccttgctgggcacaagagtcccgttactgctgttagcgccagcgaaacctccggagacattgccaccgtgtgcgatagcgcaggaggaggcagcgacctccggttgtggacagttaacggggacctggtcggtcacgtccactgtcgggaaattatatgtagcgtggcttttagcaaccagccagaaggtgtcagcatcaacgtcatcgccggaggcctggagaacggtatagtacggctgtggtcaacgtgggacttaaaaccggtgagggaaatcactttccccaagagtaataagccgatcatttctcttacattctcatgcgatggccatcacctttatacagcaaatagtgacggcacagtgattgcctggtgcaggaaagaccagcagcgcctcaagcagcctatgttctattccttcctgtctagctatgccgcaggatag

SEQ ID NO: 122951 - DNA, 4149 bp, Artificial Sequence
  Description of Artificial Sequence: Synthetic coding sequence
atgagtacagactccaactccttagctagggagttcctgaccgatgtaaaccggctctgtaacgctgtagtccaaagggtggaggccagggaggaagaggaggaagagacacacatggccacattggggcagtatctggtgcacgggcgtggctttctgcttctcaccaaactaaatagtatcattgaccaggcactcacttgccgagaagaactcctcaccctcctgttatccctgctgccgttagtgtggaaaatcccggtgcaggaggagaaggcaactgattttaacctgccactgtccgcagatatcatcctcactaaagaaaaaaactcctcttcccagcgctctacccaggaaaagctgcaccttgagggatcagccctgtctagccaggtgagcgccaaagttaacgtcttccggaaatcaaggagacagaggaaaatcacccatagatacagcgtcagagacgcccgtaagacacagctgtcgacttccgattcagaagccaatagcgacgagaagggcattgccatgaataaacaccggcgccctcaccttctccatcatttcttgacctccttccccaagcaggatcatccaaaggccaagctcgaccggttggctactaaagagcagaccccgccagatgcaatggcccttgaaaattcacgagagatcattccgcggcaaggctctaacaccgacatactctctgaacctgctgctctgtcagtcatctctaacatgaataactccccgtttgacctgtgccatgtgctcctaagcttactcgaaaaagtgtgcaaattcgatgtgacgttgaatcacaactcaccattggcagcctctgtggtgcctacgctgaccgaatttctggccggttttggagattgctgcagtttatctgacaatcttgagagccgcgtggtgtctgccggatggaccgaggaacccgtagctctgatccaacgcatgttgttcagaacagtattgcacctcctgtccgtcgatgtcagcacggcggaaatgatgcccgagaacttgagaaaaaatctcacagagctcttgagggccgctctgaaaataagaatttgtttggagaagcagcctgacccgtttgcgcccaggcagaaaaaaactttgcaggaggtccaggaggatttcgttttctccaagtaccgtcatcgcgcgcttctgttgccagagctgctagagggggttttacagatcctgatctgctgcctacagtccgcagcctccaatccattctacttctctcaggcaatggaccttgttcaggaatttatccagcaccacggttttaacctcttcgagaccgctgtcctgcagatggagtggcttgtgctgcgggacggagtgcctcctgaagcctccgagcatctgaaggctttgatcaacagtgttatgaagatcatgtcgacagttaagaaggttaagtctgaacagctgcaccatagcatgtgcactcggaaaaggcaccgcaggtgcgagtactcccacttcatgcaccatcaccgcgatctgtccgggttattagtgagcgcattcaagaatcaggtgagcaaaaatcccttcgaagagacagcggacggcgatgtctactatcctgagagatgctgttgcatagccgtctgcgcccaccagtgcctcagactcctccagcaagcttctctctcctcgacgtgtgtgcagatcctctcaggcgtgcacaatatcggcatatgttgctgcatggatcccaagtcagttatcatcccccttctgcacgccttcaagctgcctgctcttaagaactttcagcagcacatcctcaatattctcaacaaactgatcttggatcagttgggaggtgccgagatcagtccaaagatcaaaaaagcagcctgtaatatctgcaccgttgattccgaccagctggcccagttggaagaaactctacagggcaacctctgcgacgctgagctgtcttcaagcctgtcaagccctagttatagattccaggggatcctgcccagctccggaagcgaggatctgctctggaagtgggatgcacttaaggcttaccagaatttcgtcttcgaagaggacaggctgcacagtatacagattgccaatcacatctgcaatcttatccagaaggggaacatcgttgttcagtggaaactgtataactatatctttaacccagtgctgcagcgcggcgtggaactggctcaccattgtcagcacctgagtgtaacctcggcgcagtcgcatgtgtgcagccaccacaaccagtgtctcccgcaggatgtgcttcaaatttatgtgaaaacactccccatcctccttaaatcacgtgtcatccgtgatctcttcctttcatgtaatggagtgagtcagatcattgaattaaactgcctgaatggcattagatcccacagtctcaaggcatttgaaactctgatcatatctctgggtgagcagcagaaggacgcctctgtgccagacatcgacgggattgacattgagcagaaggaactctccagcgtacatgtgggcacatcatttcaccatcaacaggcgtacagcgactcccctcaaagcctctcaaaattctacgctgggctcaaggaggcctatccaaagcggagaaaaacagtaaatcaggacgtgcatatcaacaccattaatctgtttctgtgcgtcgcatttttatgtgtctctaaagaggcggaatctgatcgagaaagcgctaatgactccgaggatacatccggctatgattccacagccagcgagccactgagccatatgctaccatgcatctccctggaaagcttggttctcccatcgcccgaacacatgcaccaggctgccgatatctggagcatgtgcagatggatttatatgctatcctccgtattccagaaacagttctatcgattgggtggctttagggtctgtcataaactgatattcatgatcattcagaagctgtttagatcacataaggaggagcagggtaaaaaagagggtgacacctccgtgaacgaaaaccaggacctgaataggatttcacaacccaagaggactatgaaagaggacttgttgtccctggccattaaaagcgatcctattccatccgagctgggctccctgaaaaaatccgcggattcactcggaaagctggagctgcagcatattagctccatcaatgtagaggaggtctccgcaacagaagcagcacctgaggaggcgaagctgtttactagtcaggaaagtgagactagcttacagtcaattagactgttagaggcactgttagctatttgtttgcacggagccaggacctctcagcagaaaatggagttggaactacctaaccagaacttgtcggtcgagagcatcctgtttgagatgcgggatcacctgtcccagtccaaggtcatagaaactcagctggccaagccactgttcgacgccctgctgagggtcgcgcttggcaactattcggcggatttcgagcacaacgatgctatgacagaaaaatctcaccagtcagccgaggaactcagcagccagcccggcgactttagcgaggaggcagaggactctcagtgttgttcatttaagctgctggtggaagaagaagggtacgaagcagatagcgagtcgaaccccgaggacggcgagacacaggatgatggagtggacctcaagagtgaaaccgaaggattttctgccagctcatcccctaacgatctgcttgagaatctaacacagggggaaattatctatcccgaaatttgcatgctggagctgaacctgttaagtgcaagtaaggccaagttagacgtcctggcacatgtgttcgaatcattccttaaaataatcaggcagaaagagaaaaatgtattcctgttaatgcaacaagggacagttaaaaatctgctcggagggttcctctccatcctgacccaggatgatagtgatttccaagcttgtcaaagagtgctggtggacctgctggtgagcttaatgtcgagcaggacgtgctccgaagaactgactcttctgctgcggatatttttggagaagagcccttgtacaagagccactgaccagaaggttcagtcgacttag

SEQ ID NO: 122952 - DNA, 1254 bp, Artificial Sequence
  Description of Artificial Sequence: Synthetic coding sequence
atggccgcacctggaagcgcccgtagacccctcttactcctgctgttgctcctcttgctcgggctgatgcactgtgcctctgccgctatgtttatggtcaagaatggcaacggcaccgcgtgcataatggccaacttctcggccgcgtttagtgtcaattacgatactaaatccgggccgaagaatatgacattcgacctgccttccgacgccaccgtcgtgctcaacagatccagctgcggaaaggagaatacttccgatccaagcctagtcatcgcttttgggcgcggtcatactctcacacttaatttcactaggaacgccactcgatactctgtgcagcttatgtccttcgtttacaacctctccgatacccacctgtttccaaatgcaagtagcaaggagataaagaccgtcgaatcgataacggatattagggccgatattgataaaaagtacaggtgtgttagcggcacccaagtgcacatgaataacgtgaccgtgacactgcacgacgccacaattcaggcatatctgtctaattcaagtttcagccgcggagaaacccgttgcgaacaggatcgaccaagcccaaccactgcccctcccgcacccccatcaccttcaccgtcccccgtgcccaaaagtccgagtgttgacaaatacaacgtcagcggcacaaatggaacatgtctattggccagtatgggactccagctgaatctgacctatgagcggaaagacaataccacagtaacacggcttttgaacatcaatccgaataagacttcagcctcagggtcttgcggcgcgcatctggtgacactggagctgcactccgaggggacaactgttctgctctttcagtttggcatgaacgcatcatcctcacgtttttttcttcagggcatccaactgaacaccatcctacctgacgcgagggatcctgcattcaaggcagcgaacgggtccctgagggccctgcaggccacagtaggtaattcatataaatgcaacgcggaggaacatgtgcgcgttacaaaagcgttcagcgtgaatatattcaaagtctgggtccaggcttttaaggtggaggggggacagttcggaagcgttgaagagtgcctgctcgatgagaacagcatgcttattccgatagctgtgggtggagcactggctggcttagtgctgattgttctgatcgcttacctggtcgggcggaagaggtctcacgcggggtatcagacgatctag

SEQ ID NO: 122953 - DNA, 1095 bp, Artificial Sequence
  Description of Artificial Sequence: Synthetic coding sequence
atggcagcccctggtagcgcccgcaggcccttgcttctccttctccttttgttattgctgggcctgatgcactgtgcaagcgccgccatgtttatggtcaaaaacggaaatggaaccgcttgcatcatggctaatttctctgctgccttctctgtgaattatgatacgaagtccggcccgaagaacatgacattcgatctccccagtgacgccactgtggtgttaaaccgaagttcatgtggaaaagagaatacgtcagatccctctctggtgatcgctttcggtcgtggccacactcttacccttaacttcacaaggaacgcgacacgctattcggtgcagttaatgtcatttgtatacaacctgtcggatacccatttgttccctaatgcaagtagtaaggaaactcgctgcgagcaggatcgacctagcccaacaaccgcccctccggccccaccatcaccctcacctagcccagtcccaaaaagcccttcagtggacaaatacaacgtttcaggaacaaatggtacgtgcctccttgccagtatgggtctccagctgaaccttacatacgaaaggaaggataacactactgtcacccggctgcttaatataaaccctaataagacaagtgcatctggcagctgcggggcccatctggtaacgcttgagctacactccgagggcaccactgttttgctcttccagttcggcatgaacgcgtcctcttcgcggttttttttgcagggaattcagttaaacactatcctgcccgacgcccgcgacccggccttcaaagccgccaatggatctttgcgagccctccaagccactgtgggtaacagttacaagtgtaatgccgaagagcacgtccgggtgacaaaagcattcagcgttaatatcttcaaggtttgggtacaggcatttaaggtagagggaggccagttcgggtctgttgaagaatgtctcctcgacgagaacagtatgcttataccaatcgctgtgggtggtgcactggccggcctggtactgatcgttctcatcgcctacttggtgggacgcaagaggagtcatgccggatatcagacaatctag

SEQ ID NO: 122954 - DNA, 1233 bp, Artificial Sequence
  Description of Artificial Sequence: Synthetic coding sequence
atggtctgttttaggttgttcccagtgcccgggagtggtctggttttagtctgtctcgtcttgggggctgtgaggtcatacgccttagagctcaatcttacagactccgagaacgcaacctgtctctacgcaaagtggcagatgaactttactgtccgctacgaaacaaccaataaaacttataaaactgttactatcagtgaccacggaacagtgacgtacaacggctcaatctgtggcgatgaccaaaacggtcctaagatcgccgtgcagttcggccccggcttcagctggatagccaattttactaaggccgcctcaacatactccattgacagcgtgtcattttcctacaataccggcgacaacacaacctttcccgatgcggaggataaaggtattttgaccgtcgatgagttgttggccattagaatccctttgaatgatctgttcagatgcaatagcctctcaactctggaaaagaatgacgtcgtgcaacactactgggatgtgttggtgcaggctttcgtgcagaacggtacagtttctacaaatgagttcctttgtgataaagataagacaagtaccgttgcacctaccatccataccactgtgccctcccctaccacaactcccacaccaaaagagaagcctgaggctggcacttattctgtgaataacgggaacgatacctgcttgctcgccacgatgggactccaactgaacataacccaggacaaagtagcctccgtaattaatataaaccccaacactacacactctacaggcagctgtcgctcccatacggccctgttgcgcttgaattccagcaccataaagtatttggactttgtgtttgccgtaaaaaatgaaaaccgattctatctcaaagaagttaatatttctatgtatctggtaaacggtagtgtgttttctatcgccaataataatctatcctactgggacgcaccactggggtcctcgtacatgtgtaataaggagcagaccgtgtccgtgtctggggcctttcagataaacaccttcgacctgagggttcagccgtttaacgtcacccagggcaaatactcgactgctcaagactgcagcgctgacgacgataatttcctggtgccgatcgctgtcggcgccgccctggctggcgttctaattctggttctgcttgcttactttattgggttgaagcatcaccacgcaggctatgagcaattctag

SEQ ID NO: 122955 - DNA, 1233 bp, Artificial Sequence
  Description of Artificial Sequence: Synthetic coding sequence
atggtatgttttcgtctgtttccagtgcctgggtctggacttgtgttggtgtgtctggttctcggggccgtgcggagctacgccctggaacttaatctgaccgactctgagaacgccacttgcctatatgcaaaatggcagatgaactttactgtgcgttatgagaccacgaataaaacttacaaaacagtgaccatcagcgaccacggcactgtgacctacaatgggagcatctgcggagacgaccagaacgggccgaagatcgccgttcaattcggacccggatttagctggatcgccaattttactaaagccgcttcaacctactctattgacagtgtgtctttttcttacaatacgggcgacaatacgactttccccgacgctgaagataagggaattctgactgtcgacgaactgcttgctattcggatacctttaaatgacctttttagatgtaactcactgagtactttagaaaagaatgatgtggtgcagcattattgggatgtccttgtgcaggcatttgttcagaatggcaccgtaagtacaaacgagtttttatgtgataaagacaagacctctacagttgctcccaccatccacacaaccgtcccaagccccaccaccacaccaacccccaaagaaaagccagaagccggcacatactccgtcaacaatgggaacgacacctgccttctggccacaatgggtctccagctcaatatcactcaggacaaagtcgcttccgttataaatattaatcctaacaccacccattctactggcagctgtcgtagccatacggccttgcttcgactcaactcctcaacaatcaagtacctcgatttcgtgttcgcggtgaagaacgagaaccgcttctatctcaaagaagtgaacatctcaatgtacctggtgaacgggagcgtgttctccatcgccaataataatctttcctactgggatgctcctctcggaagttcctacatgtgcaacaaggagcaaacagtttccgtctctggagccttccaaattaacacttttgatttgagggtgcaaccattcaacgtgacccagggaaagtatagtaccgctcaggaatgtagcctcgacgacgacactatcctcatacccatcatcgtgggagccgggctgagcggtcttatcatcgttatcgtaatagcatacgtgattgggcgccggaagtcctatgctggataccagacattatag

SEQ ID NO: 122956 - DNA, 1236 bp, Artificial Sequence
  Description of Artificial Sequence: Synthetic coding sequence
atggtgtgttttagattgttcccagttcccggtagcggcctagttctggtttgtcttgtgctgggagcagtgcgtagctatgcgctggagctgaaccttaccgactcagagaacgccacttgtttatacgccaagtggcagatgaactttacggtgcgctatgaaactaccaacaaaacctacaaaacggtgaccatctctgatcacggcaccgtgacatacaatggtagcatctgtggagacgatcagaacggtccgaagattgctgtgcaatttggacccggcttctcatggatcgcaaattttaccaaagccgcctctacttattccatagatagcgtgagcttcagctacaatactggcgataatactacattcccagatgccgaggataagggtatcctgaccgtcgacgagctgcttgccatcaggattcctctcaacgacctgtttcggtgtaatagcttgagcacactggaaaagaatgatgttgtccagcactactgggatgtgctcgtgcaggcgttcgttcagaacggcaccgtatcaacaaatgagtttctgtgcgacaaggacaagaccagcactgtcgccccaacaatccacacgaccgttccctctcccactaccacacctaccccgaaagaaaagcctgaggccggtacctattcggtcaataatggaaacgacacatgtctgttggcaacgatgggacttcagctgaacattacccaggataaggtggcaagcgtgatcaatatcaaccccaacacaacccacagtaccgggtcctgtcgcagccacacagctctgctacgcctgaattcttccacaattaagtatctcgattttgtgtttgcagtgaaaaacgaaaataggttttacctgaaagaggtgaacatctctatgtatctggtgaacggctcagtcttttctatagcgaacaacaacttaagctattgggatgctccactggggtccagttatatgtgcaataaagagcagacagttagcgtaagcggggcctttcagattaacacgttcgacctcagagtgcagccgttcaacgttacccagggaaaatatagtacagctgaggaatgctcagcagactcagacctcaatttccttatacccgtggccgtaggggtggccctgggcttcttgatcattgtcgtgtttataagctacatgattgggcgccgaaaaagtcgcaccggttatcagagtgtctag

SEQ ID NO: 122957 - DNA, 903 bp, Artificial Sequence
  Description of Artificial Sequence: Synthetic coding sequence
atggtgtgcttccgcctgtttccagtccccggcagcggactcgtccttgtctgtcttgtcttgggcatcttgacagtggacgaacttttggccataagaatccctttgaacgatctgtttcgctgtaactcgctgagcaccttagagaaaaatgacgtggttcagcactattgggacgtgttggtgcaggctttcgtgcagaatggtactgtctctacgaatgaatttctgtgtgataaggacaagaccagtactgtggcacccacaatccacactactgtgcctagccccacaactaccccgacgcctaaggagaaacctgaggccggtacctatagtgtgaataacgggaatgatacctgtctcctggctactatggggctccagctgaatattactcaggacaaagtggcttccgtcattaacatcaacccgaacacaacacactccacagggagctgtaggtcacacacggccctgttgaggttaaactcctccaccattaaatacctagattttgtattcgcagtcaagaacgaaaaccggttctatcttaaagaagttaacatttccatgtatctagtgaacggatctgtcttttccatagcaaataataacttgtcctattgggacgctcccctggggagctcgtacatgtgcaacaaagagcagacagtctcagtgtctggcgcttttcagatcaataccttcgacttgcgggtgcagccctttaatgtgacccaaggaaagtactcaaccgctgaggagtgttccgcagatagcgacctcaactttctgatccccgtagccgtgggcgtggctctgggttttctcattatagtggttttcatctcctacatgatcggccgccgaaaatcgaggactggctaccagagcgtctag

SEQ ID NO: 122958 - DNA, 1092 bp, Artificial Sequence
  Description of Artificial Sequence: Synthetic coding sequence
atgaactttaccgttaggtatgaaaccactaataaaacgtacaaaaccgtaactatttccgatcacggaaccgtgacctacaacggttctatttgtggggacgaccagaacggccccaagatcgccgtacagttcggccccggcttttcgtggatcgccaacttcaccaaggcagccagcacgtacagtatagattcagttagtttctcgtacaataccggcgataacacaacctttccagatgctgaggataagggaattctaactgtggatgagttgctggcaattagaattcccctgaatgaccttttccgttgcaattctctgagtaccctggaaaagaacgatgttgtgcagcattactgggatgtgctagtccaggctttcgttcagaatggcaccgtgagtacaaacgaatttctttgcgacaaggacaagacctccacagtggcaccaactattcacacaacagtgccaagcccgacaaccacacccacaccaaaagagaaacccgaagccggcacttacagtgtcaacaacgggaacgacacctgtctactagcaactatgggcctgcagctgaacatcacacaagataaggttgcaagcgtgataaatattaatcccaatacaactcacagcaccggctcttgccggtctcacacagctctgctaaggctgaactccagtacaattaagtatctggacttcgtgttcgccgttaaaaatgaaaaccggttttacctcaaagaagtgaatataagtatgtatttggtgaacggatcagtgttcagtatagcgaataacaatctctcctactgggatgcaccgcttgggtcgagttatatgtgcaataaagagcagacggtgagtgtgtccggtgcttttcagatcaataccttcgatctgagagtgcagcctttcaatgtcacccagggtaaatatagcactgcccaagaatgcagcctggatgacgacactatactgattcctattatcgtaggagcaggattgagcggtctcatcattgtcatcgttattgcctacgtgatagggcggaggaagagttatgctggctaccagactctctag

SEQ ID NO: 122959 - DNA, 447 bp, Artificial Sequence
  Description of Artificial Sequence: Synthetic coding sequence
atgaaggctcttatcgtgcttgggctcgtgctcctcagtgtgacagtgcaaggaaaggtgtttgagcgatgtgagctggctcggaccctgaagagactgggcatggacggttacagggggatctccctagccaactggatgtgtctggctaagtgggagtcaggctacaacacacgtgcgacaaactataacgccggcgaccgatccacagactatgggatattccaaataaattcccgatattggtgcaatgacggaaaaacccccggcgctgtcaatgcctgtcatctgagctgtagcgcgctgcttcaagacaacattgccgatgccgtggcgtgtgcaaaacgcgtggtacgcgatccccaaggcatacgggcctgggtggcctggcgtaaccgttgccagaatagagatgtgaggcagtacgtccaggggtgtggagtgtag

SEQ ID NO: 122960 - DNA, 585 bp, Artificial Sequence
  Description of Artificial Sequence: Synthetic coding sequence
atgcaggatgctcccctctcatgcttgagccccacaaagtggagcagcgttagctcagcggattccaccgaaaaatcagcaagtgcagcaggcactcgcaacctcccatttcaattctgcttacggcaggccttgaggatgaaagcggctggaatccttaccctgataggttgtctggttaccggggcagagtctaagatctacacacgctgcaaactggccaaaattttttcgcgcgccgggctggataactactggggtttctctttagggaactggatctgtatggcctactacgaaagcggctataacaccacagcccaaaccgtgctggatgacggctcaattgattatggcatctttcagatcaattcttttgcctggtgtcgacgaggtaaactgaaagagaataatcactgtcatgttgcatgttctgccttggtgacagacgatctgaccgatgcaattatttgcgcaaaaaagatagtgaaagaaactcaaggaatgaactattggcaaggctggaaaaaacactgcgagggacgggacctgagcgactggaagaaggattgcgaagtaagttag

SEQ ID NO: 122961 - DNA, 441 bp, Artificial Sequence
  Description of Artificial Sequence: Synthetic coding sequence
atgaaagccagcgtagtgctcagcttgctgggctacttggtggtccctagcggtgcctatatccttggccgttgcacggttgcaaagaagctccacgatggtggtctagattattttgaaggatactccctggaaaattgggtctgcctggcatattttgaatccaagttcaacccgatggccatttatgagaacacccgcgaaggctacaccggtttcggtctctttcagatgcggggcagtgactggtgcggggatcatggcagaaaccgttgtcacatgagctgctctgcactactgaacccaaacctggaaaagacaattaagtgcgcgaaaactattgtaaaaggcaaagaggggatgggagcgtggccaacctggagcagatactgtcagtatagcgatacccttgcgaggtggctggacggctgcaaactgtag

SEQ ID NO: 122962 - DNA, 441 bp, Artificial Sequence
  Description of Artificial Sequence: Synthetic coding sequence
atgaaagcatcagtggttctgagcctgctcgggtacctggttgtgccctctggtgcgtacatcttgggacggtgcactgtggccaagaaattacatgatggaggccttgactacttcgagggctacagcctagagaattgggtgtgtctagcctacttcgagtcaaaattcaacccgatggcgatctacgagaacactcgcgagggctacaccgggttcggcctgttccagatgagaggctcagactggtgcggcgatcatgggagaaatcgttgccatatgagttgctccgccttactgaatccgaacttggaaaaaacaattaagtgtgctaagaccatcgtcaaaggcaaggagggcatgggagcctggccaacctggtcaaggtactgccagtatagcgacactctggctagatggttggacggatgcaagctgtag

SEQ ID NO: 122963 - DNA, 447 bp, Artificial Sequence
  Description of Artificial Sequence: Synthetic coding sequence
atgaccaaagctttactgatatatttagtatcatctttcctcgctctcaatcaagccagtttaatctctcgctgcgatttagcccaagtattgcaactggaggatctggacggattcgagggatatagcctgtcagattggttatgtctcgccttcgtggagagcaagttcaacattagcaagatcaatgagaacgccgatggttctttcgactatggcctgtttcaaattaattcacattactggtgcaacgactataaatcatactctgagaatctgtgccacgtggactgtcaggaccttctgaaccccaatttattggcaggtatacactgtgcaaaacgaattgtaagcggtgcccgggggatgaataattgggtggaatggaggcttcactgctcaggccgacctctgttttattggctgacgggatgccggttgagatag

SEQ ID NO: 122964 - DNA, 447 bp, Artificial Sequence
  Description of Artificial Sequence: Synthetic coding sequence
atgactaaagccctacttatctacctggtttcgtcttttctggctctcaatcaggcatctttaattagtcgatgcgacctggcccaggtgctccagctcgaggatcttgacggattcgagggctattccctatctgactggctgtgcctagcctttgtggaatccaaattcaatattagcaagatcaatgagaacgctgatgggtcctttgactatgggctgttccagatcaactcacattattggtgtaatgactataaatcctactctgaaaatttatgccacgtcgactgccaagacctcctcaatccaaatctgctggccgggattcattgtgctaagaggattgttagtggggccagaggtatgaacaactgggtagaatggcgcctgcattgttctggacggccgcttttttactggctcaccggatgcagattgcggtag

SEQ ID NO: 122965 - DNA, 447 bp, Artificial Sequence
  Description of Artificial Sequence: Synthetic coding sequence
atgacaaaggctcttctcatatacttggtcagctctttccttgcactgaatcaggcgtctctgatctcccgctgcgacctcgcccaggtacttcagctcgaggacctcgacggatttgaagggtactctctctctgactggttgtgtctggccttcgtggaatccaagtttaatatttctaaaattaatgaaaacgccgatggatcgttcgactacgggttgtttcaaatcaattcacattattggtgtaatgattacaagtcttactcagagaacttatgtcacgtcgactgccaggatctgttaaatcctaatttgcttgccggaattcattgtgccaaacggatcgttagcggcgcaagaggaatgaacaattgggtcgaatggagacttcactgtagtggccgacccttgttctactggttgaccggctgcagattacggtag

SEQ ID NO: 122966 - DNA, 2952 bp, Artificial Sequence
  Description of Artificial Sequence: Synthetic coding sequence
atggaaatgaagctgcctggccaagagggctttgaggcatcttcagctcctcggaatatcccgtcaggagaactcgattccaaccccgacccaggtacaggcccgtccccagacggtccctcagacactgaaagtaaagagctgggcgttccgaaggatcccctcctgttcattcaactgaatgaattgctgggatggcctcaggccctagagtggcgagagacaggatcctcctcggcatcattactcctggatatgggagagatgccgtcgatcacattgtcaactcatttacaccacaggtgggtgttattcgaggaaaaactagaagtagcagcaggccgctggtctgccccccacgtccccactctcgcacttccaagcttacagaaactacgcagcctactggcggagggtctcgtgttgttagactgtccagctcagtctctgctggaattagtggagcaggtaacgcgggtggagtctctttcaccggaactgaggggtcaactgcaggcactgcttctgcaacggccacagcattataaccagaccaccggaactagaccctgctggggttcaacacatcctaggaaagcatccgataatgaggaggcccccttaagagaacagtgtcaaaatcccctccggcagaagctgcccccgggcgctgaggcagggaccgtgctggctggggaactggggtttctggcgcagcctttgggcgcatttgttcgcctcagaaacccagtggtgctggggtctttgaccgaagtgtccctgcctagccgatttttctgcctcttgctgggaccttgtatgctcggcaaggggtaccatgagatgggtagagctgccgcagttctgctctccgatccgcagttccaatggtccgtgagacgtgcatccaatttacacgacttgttagctgccctcgatgcgttcttagaagaagtgacagtgctgccccctgggagatgggaccctaccgctcggattcccccgccaaagtgccttccttctcagcacaaaagactgccgagtcagcagcgcgaaatacgcggaccagctgtaccccgcctaactagtgccgaggacaggcatagacacggccctcacgctcactcgcctgaactccaaagaaccgggagactgtttggaggtctgattcaggacgttagaaggaaggtgccctggtaccccagtgatttcctggacgcgctgcatttgcaatgtttcagcgctgttctctatatctatctggccactgtcacaaacgctattactttcgggggactcctgggagatgccaccgatggcgctcagggagtgctggagtcctttctcggtaccgctgtcgccggtgccgctttctgcctcatggcaggccagccactcaccatcctctcgtcaacaggccccgtcctggtgttcgagagactcctgttttccttttctcgggactatagccttgactatctgccatttcgattgtgggtgggcatttgggttgccaccttctgccttgtgctcgttgctacagaagcatcagttttggtgcgatatttcaccagatttacagaggaaggcttctgtgccctgattagcctcatcttcatttatgacgccgtggggaaaatgctgaacctaacccatacctatccaattcaaaagcccgggtcatctgcttatggttgtctgtgtcagtatcctgggccgggggggaatgaatcccagtggatccggactcgacccaaagaccgcgacgacattgtatctatggatctcggcttaattaatgccagcctcctacccccccctgagtgcacacgccagggggggcacccgcggggccctggctgtcacactgtgcccgatatagctttcttttccctgctgctgtttctcactagtttcttcttcgcaatggccctgaagtgcgtgaagaccagtcgcttctttccatcagtggtacgaaagggcctgagcgacttctcatcagtgttggctatcctgctcgggtgcggcttggacgccttcctcggcctggccacccctaagctcatggtcccccgcgagttcaaacctacactccctggcagaggctggctcgtcagcccattcggcgccaacccatggtggtggagcgttgctgctgccttacctgccctccttctatccatccttatatttatggatcagcagatcaccgcagtgatcctgaaccggatggaatacaggctgcaaaaaggggcgggcttccacctagacctgttctgcgtagctgtgctcatgctgctgacctcggcattgggcctgccgtggtatgtctcggcaaccgttattagtttggcacatatggacagccttagacgtgaatcaagagcatgcgcccctggagaaagaccaaactttctgggaattcgagaacagagactcacagggctcgtggttttcattctcacgggcgcctcaattttcctggcacccgttttgaaatttattccaatgcctgtgctgtatggcatcttcctgtacatgggcgtagcggccctctcctccatacagtttactaatagagtcaagctgctcctgatgccagcaaagcaccagcccgacctgcttttgctaaggcacgtgcctttgactagggtccacctgtttactgccatccagctcgcctgtctcgggctcctgtggatcattaagtcaaccccggctgctataatatttccactgatgctgttaggcctggtcggggtccgaaaggcgttagagagagtgttctcaccacaggaattgctgtggctcgatgagctcatgccagaggaggaaagaagcatcccagaaaaggggctggaaccggaacactccttttcaggatcagactcagaggattcggaacttatgtatcagcctaaggcacctgagatcaatatctccgttaattag

SEQ ID NO: 122967 - DNA, 123 bp, Artificial Sequence
  Description of Artificial Sequence: Synthetic coding sequence
atgcggtttgcatggacagttcttttactgggtccgctccaattgtgcgcactggtacattgtgcgcctcccgccgctggccaacaacagccccctcgggagccacctgcggctcctggatag

SEQ ID NO: 122968 - DNA, 1134 bp, Artificial Sequence
  Description of Artificial Sequence: Synthetic coding sequence
atgcgcttcgcttggactgtcctgctgctgggaccactccagctgtgcgctctagtgcattgtgcacctcctgcagccggacagcagcaaccacctcgggagcctccggcagcccctggtgcagctagcgctcagcagccgcggacgcctatccttttgatccgcgataaccgcaccgccgctgctcgcacacgaaccgccgggtcctccggagtgacggctggccgccctcgcccaacagcgaggcattggttccaggccgggtacagtacgagtagggcccgagaagccggtgcatctcgcgctgagaatcagaccgccccaggggaggtgcccgcgctgagcaatctcagaccaccatcccgcgtcgatggcatggttggagacgatccttacaatccatacaagtattccgatgataacccatactacaactactacgacacatatgaaagaccacgaccaggggggcgatatcgcccaggctatggaaccggctatttccagtatggcttgcctgacctggtcgctgacccttattatatccaggctagcacttatgtgcaaaagatgtccatgtataatctccggtgtgcagccgaagagaactgcttggccagcactgcatacagagctgatgtgcgtgattacgatcacagagtcctcctccggtttccacaaagggttaaaaaccagggaacatctgacttcctgcctagcagacccagatatagctgggagtggcacagctgtcatcagcactatcatagcatggacgagttttcccattacgacttactggacgctaacacacagcggcgggtcgcagagggacacaaggccagtttctgcttagaagatacttcctgtgactacgggtaccatcgccgattcgcttgcaccgctcatacgcagggcctcagcccaggctgttatgacacatatggcgccgatatagactgtcagtggatcgatattacagatgttaaacctggaaattacattctgaaggtctccgtgaatccctcttacctggtgccggagtctgactacaccaataatgtagttcgatgcgacatcagatacaccggtcaccatgcttacgcatcgggttgcacaatctctccttactag

SEQ ID NO: 122969 - DNA, 2325 bp, Artificial Sequence
  Description of Artificial Sequence: Synthetic coding sequence
atggaacggccactctgttcacacctttgctcatgccttgcaatgctggctcttctttcgcctctctctctggcccagtatgattcttggccacattatcccgaatactttcagcagcccgcaccagagtatcaccagccacaagcgcccgccaatgtagcaaagatccagcttcgcctggctggccagaagcgaaagcatagtgagggacgtgtggaggtttattatgacggccagtggggaaccgtttgtgatgacgatttctctatccacgccgcccatgtcgtgtgcagagaactaggttatgttgaggccaaatcttggaccgcaagttcctcctatgggaaaggcgaaggcccaatctggctggataatttacattgcaccgggaacgaagcgacacttgccgcctgcacttccaacggctggggcgtgacggactgcaagcatactgaagatgttggagtagtttgcagcgacaagaggatcccaggcttcaagtttgataactctctgatcaaccagatagagaacttgaacatccaggtggaagatatccgaatccgcgcaatcctgtctacctatcgcaagaggacccctgttatggagggatacgtcgaggtaaaggagggaaagacatggaagcaaatttgtgataaacattggactgccaaaaattcccgagtggtgtgtgggatgttcggctttccaggcgaaaggacatacaatactaaggtctataagatgtttgcctccagacgtaagcagaggtactggcctttctctatggactgcacaggcacggaagcacatattagcagttgtaagctcggcccacaggtcagtcttgacccgatgaaaaatgtcacatgcgagaatggcctccctgccgtggtctcctgcgttcctggacaggtcttttctcccgatggacccagcagattcagaaaggcttacaagcccgaacagcctctcgtgcgtcttcgcgggggagcttatattggcgaaggaagagtggaagtgctgaagaacggggagtgggggacggtgtgcgacgataagtgggatctggtgtcagcctctgtggtttgtagggagctgggatttggtagcgccaaggaagccgttaccggtagccgcctgggccagggcatagggcctatccacctgaacgagatccagtgtaccgggaacgagaagtccattattgattgtaagtttaatgctgaaagccaaggatgcaatcacgaagaagacgctggagtgcgctgcaacacccccgcgatgggattgcagaagaagcttagactgaatggaggacggaacccatacgagggcagagtggaggtgctggtcgaacgcaacggatctctcgtttggggaatggtgtgtggtcagaattggggcatcgtggaggcaatggtggtgtgccggcaactgggattgggtttcgcatccaacgcctttcaggagacttggtattggcatggcgacgtgaactctaataaggtggtgatgtctggagtgaaatgttccggtactgaattatctcttgcccattgccgacacgatggtgaggacgttgcgtgtccccaaggcggggtgcagtacggcgcgggagtagcatgttcggaaacggcccctgatctggtcttgaatgcagagatggtgcaacagactacttacctcgaggatcggccaatgtttatgctccagtgcgctatggaagagaattgtctcagtgcatctgccgcgcagactgacccaactacagggtacaggaggctcctgagattctccagccagattcataacaatgggcagtctgatttccgaccaaagaatgggcggcatgcatggatctggcatgactgtcaccggcactatcacagcatggaggtgtttacgcactatgacctgctgaaccttaacgggactaaggttgctgaagggcataaagcatctttttgtctggaagacacagagtgcgaaggcgatatccagaaaaactacgagtgcgcaaattttggcgaccagggcatcactatgggatgttgggatatgtatagacacgatatcgactgccagtgggtggatattacggacgttcccccgggagactacctgttccaggtggtgatcaaccccaattttgaagtcgctgagtccgactattcaaataacataatgaagtgccgaagcagatatgatggccataggatctggatgtataattgccatatcggaggcagcttctcagaagagactgaaaaaaagttcgagcacttttctggcctccttaacaaccagctgtcaccccagtag

SEQ ID NO: 122970 - DNA, 456 bp, Artificial Sequence
  Description of Artificial Sequence: Synthetic coding sequence
atggagcgaccactctgctcccatctatgttcatgtctcgctatgttggccctgctgagcccgctcagtctagctcagtatgacagctggccacactatcctgagtacttccaacagcctgcccccgaatatcatcaaccccaggctcccgccaatgttgctaagattcagctcaggcttgcgggccagaagaggaagcactccgaagggagagtggaagtgtactacgacggccagtgggggaccgtttgtgatgacgatttttcaatccatgcagcacacgtggtctgccgcgagctcggttacgtggaggctaagagctggaccgcaagctcatcctacggtaagggggaggggcctatttggctggataatctgcactgtaccggaaatgaggcaactctagcagcttgtactagcaatggatggggagtgactgactgtaaacacacctag

SEQ ID NO: 122971 - DNA, 291 bp, Artificial Sequence
  Description of Artificial Sequence: Synthetic coding sequence
atggaaagacctctgtgcagtcatctgtgcagctgtctggcaatgctggcactgctctcacccctctcactggcccagtacgactcatggcctcactaccccgagtacttccagcagcctgcgccggaatatcatcaaccgcaggcgccggccaatgttgccaagatccagcttcggcttgcgggccagaagcgtaagcacagcgaaggaagggttgaggtttactatgatggccagtgggggaccgtgtgcgacgacgatttctccatccacgctgctcatgtggtgtag

SEQ ID NO: 122972 - DNA, 420 bp, Artificial Sequence
  Description of Artificial Sequence: Synthetic coding sequence
atggaacggcctctgtgtagccacttgtgcagctgtctcgccatgctcgcgttgcttagcccactgtcgctagcccaatatgactcatggccccattatcccgagtatttccagcagcccgcaccggaataccaccagccccaggcaccagcgaacgtcgctaaaatccagctgagactggctggccagaaaaggaagcatagtgaaggtagggttgaggtttactacgatggtcagtgggggacagtatgcgacgatgacttttccatacacgccgcgcatgtggtgtgtagagagctgggttacgtggaggcaaagagttggactgcatcttcatcttatggaaaaggagagggtcccatctggttagataacctccactgtaccgggaacgaagccacactggcagcttgcacatag

SEQ ID NO: 122973 - DNA, 2262 bp, Artificial Sequence
  Description of Artificial Sequence: Synthetic coding sequence
atgaggccagtgtcagtgtggcaatggagcccctggggcctgctgttatgcctgttgtgttcctcgtgcctgggctctccaagcccaagcaccgggccagaaaagaaagcgggctcccaagggctgcgcttcaggctggcgggctttccaagaaagccttacgagggaagggtggaaatccagcgggcaggggaatggggcacaatctgcgacgatgactttaccctgcaggcagctcatatcctttgcagggagctcggcttcaccgaggccacagggtggactcacagcgcgaagtacggccccgggaccggaagaatctggttggataatctctcttgctcgggcaccgagcagtcagtgacagagtgcgccagtagagggtggggcaattccgattgtacacacgacgaagacgctggggtaatctgcaaggaccaacgactccctggattcagcgatagcaacgtgatcgaggtggagcatcaccttcaggtggaggaagtgcgcatccgtccagccgtgggctggggaagacgcccattgcccgtcacagaagggttagtagaagtgaggttacctgacggatggtctcaggtgtgcgacaaagggtggtccgcacataactcccacgtagtatgtggcatgctcggctttcctagcgagaagagagtaaatgctgcattttatcgcctgctggcccagcgccaacagcactccttcgggctgcatggagttgcatgcgtgggtactgaggcccatctctccctgtgctccctggaattttacagggccaacgataccgcaagatgcccgggcggggggcctgccgttgtcagctgtgttccgggccctgtgtacgccgcctctagtgggcagaaaaaacaacaacagagcaaaccgcaaggggaggctcgagtgcggctgaaagggggtgcccatcctggggaggggcgagtggaggtgctgaaggccagtacctgggggacagtgtgcgacaggaagtgggatttgcatgccgcctccgtcgtttgtcgagaactgggctttggatcagctcgggaggccctgagcggcgcacgcatgggacaaggtatgggggccatccacttaagtgaagtgcgctgttccgggcaggaactgtccctgtggaagtgccctcataaaaatattaccgctgaagattgttcacacagccaggacgcaggggtgcgctgtaatctaccttacacaggcgcagaaaccagaattaggctcagcgggggacgcagtcagcacgagggaagagttgaggtccagataggaggacctggtcctctgcgctggggattaatttgcggtgacgactggggcactctggaggccatggtcgcttgccgtcagctgggtttggggtatgccaaccacgggctgcaggaaacgtggtactgggattctggcaacatcaccgaggtggtgatgagtggggtcagatgtactggaacagagctgtcactggaccagtgtgctcaccacgggacacatataacttgcaagagaacaggaacacgcttcaccgctggagtcatttgttccgaaacagcatctgacctgctgctccacagcgcacttgtacaggaaactgcctacattgaagataggccactgcatatgttgtactgcgccgctgaagagaactgcctcgcttccagcgccagaagcgcaaattggccctacgggcaccggcgacttctcagattctcctctcagatccataacctcgggcgtgctgatttcagacctaaagccggccgccacagttgggtgtggcacgagtgccatggacactatcactctatggatatcttcacccactacgatatcttaacgcctaatgggactaaggtggcagaaggacataaagctagcttttgcctcgaagatactgaatgccaggaagatgtgtccaagcgttacgagtgcgctaattttggtgaacaagggatcacagtagggtgctgggatctgtatcgccacgacattgactgtcagtggattgatattacagatgtaaagcccggtaactacatactccaggtcgtgataaatcccaacttcgaggtggccgagagcgactttactaacaacgcgatgaagtgtaactgtaaatacgatggtcatcgcatttgggtccacaactgccatattggcgatgctttttcagaagaggccaatcgccgattcgagaggtacccaggtcagacttcaaatcagatcatttag

SEQ ID NO: 122974 - DNA, 1827 bp, Artificial Sequence
  Description of Artificial Sequence: Synthetic coding sequence
atgaggcccgtgtccgtctggcagtggagtccctgggggctgttactatgtctactttgcagttcctgtctgggatcccccagcccaagtacaggaccggagaaaaaggccggcagtcagggactgaggtttaggttggccggctttccacgaaaaccctacgagggtcgggttgaaatccagagagcgggcgaatggggtaccatctgcgatgatgatttcacactgcaggcggcacatatcctgtgtagagaactagggttcacagaagccacagggtggactcattctgctaagtatggacctggaaccggtcgcatatggttggacaacctgtcatgttctggcacagaacagtctgtgacagaatgtgcatcacgaggctggggaaattccgattgcacccacgacgaagacgccggcgtaatttgtaaggatcagagactcccaggtttttccgactctaacgtgattgaagctcgcgtcaggctgaagggaggggcgcacccaggggagggaagagtagaagttcttaaagcgagcacatggggcactgtatgcgaccggaaatgggacctccacgccgcctctgtcgtgtgccgcgagctgggctttggctcagcacgcgaggctctctcaggggcaaggatgggccagggaatgggtgccattcacctaagcgaggtgaggtgttctggccaggaactgtcactgtggaagtgtcctcacaagaacattaccgctgaggattgtagccactcgcaggatgccggagtgcggtgtaatttaccatataccggagccgaaactcgaatacgcttaagtggcggacgctcccagcacgaaggccgtgtggaggtccagatcggggggccggggcctttgcgatggggccttatatgtggggatgattggggaacattagaggcaatggtggcgtgccgccagctgggcctcggatatgctaatcacggcctacaggaaacgtggtattgggactctggcaacattacagaagtggttatgtctggcgtcagatgcaccgggaccgaactcagcctggaccaatgtgctcaccacggtacccatataacctgtaagagaaccggtaccaggtttaccgcaggcgttatttgctcggaaactgcctccgatctgcttcttcactctgcactggtccaggagacagcctatatcgaagacaggcccctgcacatgctctactgcgcggctgaagagaattgcctggctagcagcgccaggtccgccaattggccctacggccatagacgtctcttgagattttcaagtcagattcataacctggggagagctgattttcgcccaaaggcgggaagacactcctgggtttggcatgagtgccacggccattaccacagcatggatattttcactcactatgatatcctgacccctaacggcaccaaggtggctgagggccataaagcctccttctgcctggaagatacagagtgccaggaggacgtgagtaaacgctacgagtgcgcgaatttcggggagcagggaatcactgtggggtgttgggatctgtacagacacgatattgattgtcagtggatagatattaccgatgtgaaaccgggcaactacatcctgcaggtggtgattaaccctaactttgaagtggctgaaagcgattttacaaataatgcgatgaagtgtaattgtaagtatgatgggcaccgcatatgggttcataactgccatataggagacgcattttccgaagaagcaaacaggcgatttgagagatacccgggccagactagtaatcaaatcatctag

SEQ ID NO: 122975 - DNA, 2094 bp, Artificial Sequence
  Description of Artificial Sequence: Synthetic coding sequence
atgcgcccggtgagcgtatggcaatggtccccgtgggggttactcctttgtttgctgtgttccagttgtttaggatcccctagccctagcactggccccgagaaaaaggccgggtctcagggtcttagatttagactggccggtttcccccgtaaaccatacgaaggccgtgtggagattcagagagcaggtgaatggggaactatttgtgacgacgactttacattacaggcagcacatattctatgcagagaacttggattcacagaagctacgggctggacacactctgcaaaatatggtcccggcacaggaagaatttggcttgacaatctgtcctgtagtgggaccgaacagtccgtcaccgaatgtgcatcaagaggatggggaaactctgactgtactcatgatgaggatgctggggtaatctgtaaagaccagagactgccgggctttagcgattctaacgtcatcgaagttgaacatcacctgcaggttgaagaagtcagaatccgccccgccgttggctggggccgccgaccattaccagtcactgagggtctggtggaagttcggctccccgacggttggtctcaggtgtgtgacaagggatggtctgctcacaattcccacgtggtttgtggtatgctcggctttcctagcgaaaagagggttaacgccgcattctatcgtctgctagcccagaggcagcaacactcctttggattgcacggagtggcgtgcgttgggacagaagcccacttaagcctctgctctcttgagttctacagagctaatgataccgctaggtgtcccgggggcgggccagccgtcgtatcttgtgtgcctggacccgtttatgcggccagctctggccagaaaaagcaacaacaaagcaagccccaaggcgaggcgcgagtccggcttaagggaggcgcccaccccggcgagggacgggttgaagtgctaaaggcatctacttggggaaccgtctgtgacaggaaatgggatcttcacgcagctagcgttgtttgccgggagctcgggtttgggtcagcccgagaggcactctcgggggctaggatggggcagggtatgggggcaatccacttaagtgaggtgcgctgtagcgggcaggagctttccttgtggaagtgcccccataagaacattaccgcggaagactgttcccattctcaggacgcaggcgtccggtgcaatctgccctataccggcgctgaaactcgtgaaacttggtactgggactccggaaacatcacagaggtggtgatgagcggtgtgcggtgtactgggactgaactgtctttagatcaatgtgctcaccacggaacgcacatcacgtgcaagcgcaccggaaccagattcaccgccggagttatttgttccgaaaccgcatccgacttactgctgcacagtgctctagtccaggagaccgcgtatattgaagacaggcctcttcatatgctgtactgcgctgctgaagaaaactgcctggcaagctctgcgcgctctgccaactggccatacggtcacagaaggctcctgaggtttagttcacagatccacaatctcggccgggccgatttcaggccaaaggccggacggcacagctgggtttggcatgagtgccatggacactatcattctatggacatttttacccattacgacatcctgacacctaatggcaccaaagtcgcggagggacacaaggcatcattctgcctcgaggatacggaatgccaagaagacgtgtctaagagatatgagtgtgcaaatttcggggagcagggcattacagtgggttgctgggacctgtatcgccacgacattgattgtcaatggatcgacatcaccgatgtgaagccgggaaactatatcttgcaggttgtgatcaaccctaatttcgaggtagcggagagtgatttcacgaacaatgccatgaagtgcaactgtaagtatgacgggcaccggatatgggtacacaattgtcatatcggcgatgcatttagcgaggaagccaaccgtcggttcgaaaggtatccagggcagacctcaaaccagattatttag

SEQ ID NO: 122976 - DNA, 912 bp, Artificial Sequence
  Description of Artificial Sequence: Synthetic coding sequence
atgcgacccgtctctgtgtggcagtggagtccatggggcctcctcttatgtctactgtgctcgtcgtgcctcggatcccctagcccctctaccggacctgaaaaaaaagctggaagccaggggctgcggtttaggctcgcagggtttccgcgcaaaccctacgaggggagagttgagattcagcgggctggcgaatggggcaccatttgtgacgatgactttaccctgcaggctgcccatatactgtgtcgggagttaggatttactgaggctacgggatggacccattctgcaaaatacgggcccggcaccggccgaatctggctggataatctgtcctgtagcggaacagagcagtcagtgaccgaatgtgccagccgcggctggggaaattccgactgtactcatgatgaagacgctggtgtgatctgtaaagatcagcgcctgcccggcttttctgattccaatgttattgaggtggagcaccatctgcaggtggaagaggtgaggatcagacctgccgtaggctgggggagaaggcccctgccggttactgaggggctcgtcgaagtgcggctgcccgatggttggtcccaggtgtgtgataaggggtggagtgcccataactctcatgtcgtgtgcggcatgctaggctttccaagcgagaaaagagtcaacgccgctttttatcggctgctcgctcagcggcagcagcattcttttgggctgcatggagttgcttgtgtgggaacagaagcccatcttagcctgtgcagtctggagttttaccgggccaatgacacagcccgctgtccagggggaggcccagctgtggtctcctgcgtgcctggccctgtctacgctgctagctcaggacagaaaaagcagcagcagtcaaaaccccagggctag

SEQ ID NO: 122977 - DNA, 2271 bp, Artificial Sequence
  Description of Artificial Sequence: Synthetic coding sequence
atggcctggagtcccccagccaccctgttcctgttcttactgttgttgggacagccaccaccctccagacctcaaagtctcgggaccacgaaactgcgcctagtgggtccagagtcaaagcctgaagaaggacgcctcgaggtgctgcaccagggtcagtgggggacggtgtgcgatgacaactttgcaatacaggaagccacggttgcctgtcggcagctgggctttgaggccgcactgacttgggcccatagcgctaaatatggccagggggaaggacccatatggttagataacgttcggtgtgtggggaccgaatcctcactggaccagtgcgggagcaatggttggggagtctcagactgctcccatagtgaggacgtaggggttatttgccaccctcgccgacaccgcgggtacctttccgaaacagtgagtaatgcattaggaccccagggacgcagactggaggaggtccggttgaaaccaattctggcttcagcgaaacagcactcaccggtgaccgagggagctgttgaagtcaagtatgagggccactggagacaggtttgcgaccagggatggaccatgaacaactcccgggtcgtttgcggaatgctgggctttccaagtgaagtccccgtggacagtcactattacaggaaagtgtgggacttaaaaatgcgggatcctaaatcacgcctcaaatcactcacaaacaagaatagcttttggatccaccaagtaacgtgtttgggaacagagccccatatggccaactgtcaggttcaggtggctcccgcccgtggcaagctacgtcccgcttgtccaggcggcatgcatgcagtggtctcctgtgtagcgggaccccactttaggcctcctaagacaaaacctcagcgtaagggaagctgggccgaagagcccagggtccgcctgcggtctggagctcaagtgggcgagggtcgggtcgaagttctgatgaacagacagtgggggacggtgtgcgatcacagatggaacctgatctccgcttccgtggtctgccgccagctgggctttggtagtgccagggaagctctcttcggcgcaagactggggcaggggctggggccaatccatttgtccgaggttcggtgtcgcggatacgaacggacactgtccgactgccctgcccttgagggatctcagaatggatgtcagcacgagaacgacgccgccgtacgctgtaatgtgccaaacatgggattccagaatcaggtcagacttgcgggcgggagaatacccgaagaaggcctgctcgaagttcaagtcgaggttaatggtgtgccacggtggggatctgtgtgttcagaaaactggggcctcacagaagccatggtcgcatgtcgacagttgggactgggcttcgccatccatgcatacaaagagacatggttttggtcgggcactccgagggctcaagaagtggtgatgtctggggtacgttgttccgggacagagctggcattgcagcagtgtcagcggcacgggccagttcattgcagtcacggaggtggaagattcctggccggggttagctgcatggatagtgccccagatctggtaatgaatgcccagctagtgcaggagaccgcctacttggaggacagaccactgtctcagctctactgcgcccacgaagaaaactgcctcagtaagtctgccgaccacatggactggccgtacggctatagaaggctattgagatttagtacccaaatatacaacctgggcagaacagacttccgcccaaagacggggagggatagctgggtatggcaccagtgccacagacactatcattcaatagaggtgtttacccattatgatttgctcacactaaacggctctaaggtggccgaaggacataaggcaagtttctgcttagaggacaccaactgcccaaccggtctccagaggagatatgcctgcgccaacttcggcgagcagggcgtgaccgtgggttgctgggatacatacaggcacgacatcgattgccaatgggtcgacataaccgatgtgggacccggcaactacatatttcaggtgattgttaatccgcattatgaggtggcagaatctgacttttccaataatatgcttcagtgccggtgtaagtatgatggacacagagtgtggcttcataattgccacactggcaatagctaccccgccaatgccgagttgtccctggaacaagaacaaaggcttcgaaacaatctgatctag

SEQ ID NO: 122978 - DNA, 1794 bp, Artificial Sequence
  Description of Artificial Sequence: Synthetic coding sequence
atggctgccgttcaggctgccgaggtcaaggtggacggctctgagcccaaattgagcaaaaacgagctgaagcgccgcctcaaggccgaaaagaaggtagctgagaaggaggccaaacagaaagagctatctgagaagcagctttcccaagcaacggcggcggccaccaaccatactacggataatggagttggcccggaggaagagtccgtcgatcccaatcaatactacaagattaggtcccaggcaatccatcagttgaaagtgaatggagaggatccgtatcctcacaaatttcatgtggacatctcactgactgactttatccagaagtattcacacctgcagcctggcgaccatctgaccgatataacgttgaaggtggccggacgtatccacgccaagcgggcctctggcggcaagctgattttctacgacttacggggggaaggtgtgaaactgcaggtgatggccaattcacgcaattacaagtctgaagaagagtttattcacattaacaataagctgcgcaggggcgacatcatcggagtacagggtaaccctggcaaaaccaagaaaggagaacttagcatcatcccatatgagatcactttgctgagtccatgccttcacatgctcccgcatttgcactttggacttaaagacaaggagaccaggtaccgacaacgctacctcgacctgatcctgaatgactttgtgcgtcaaaaatttatcatcaggtctaaaatcatcacttatatacgcagtttcttggatgagctgggttttctggaaatcgaaacaccgatgatgaatataattcctggcggtgctgtcgcaaagccttttatcacataccacaatgagctagatatgaatttgtatatgagaatcgcgcctgaactgtaccacaaaatgctggtggttggcggcatagacagggtgtatgagattggacgccagttcagaaacgagggaatcgatcttacccacaatcctgagttcactacatgcgaattttacatggcctacgctgattatcacgatctcatggagataaccgagaagatggtgagcggcatggtgaagcacattacgggaagttacaaggttacatatcatcccgacggtccagaaggacaggcctacgatgtggacttcacacctccattcagaagaattaatatggtcgaggagcttgagaaggccctgggaatgaagctacctgaaactaacctgtttgagacagaagagacgaggaaaatactcgatgacatctgcgtggccaaggccgtggaatgcccccccccccggacaacagccaggctgttagacaaactggtcggtgagttcctggaagtcacttgtattaacccgacatttatctgtgaccacccccagataatgagtccgctcgctaagtggcaccgcagtaaagaggggctcacggaacgcttcgaactgtttgtcatgaaaaaggagatctgtaacgcttatactgagctgaacgacccaatgagacaacgacagctgttcgaggaacaggcaaaagccaaggctgcgggggacgatgaggccatgttcatcgacgaaaacttctgcacagcccttgagtacggcttgccccctactgcagggtggggcatgggaatcgatagagtggctatgttcttaactgactccaataacattaaagaggtcctactgttccctgcaatgaagcctgaggacaaaaaggaaaacgtcgcaactactgataccctggaatctacaactgtggggacaagcgtatag

SEQ ID NO: 122979 - DNA, 1878 bp, Artificial Sequence
  Description of Artificial Sequence: Synthetic coding sequence
atgttaacccaggcagcagtgcgccttgtccgggggtccctcagaaagacatcttgggctgagtgggggcacagggaactgagactgggccagctggccccctttactgctcctcacaaggacaaaagctttagcgaccagcgctcagaactgaaaaggcggcttaaggcggagaagaaggtggctgagaaggaggcgaaacagaaggaactgtctgagaaacagctgagccaggctactgcagctgccacgaatcatacaactgacaacggcgtcggtccagaggaggagagtgtagatcccaaccagtattacaaaatccgcagtcaggccatacaccaattgaaggtgaatggagaggacccctacccccataagttccatgtggacatctcgctgacagatttcatccaaaagtactcccatttacaaccaggcgaccatctcactgacatcaccctgaaggtggcagggcgtatacatgcaaaacgagcatccggcggtaagctgattttttatgatctgcgaggagaaggtgttaagttgcaagtgatggccaactctcgcaactataagtcagaggaagagtttattcacataaacaataagctccgccgaggcgacataattggtgtccaggggaaccccggaaaaactaagaagggtgaactgtccataatcccgtacgaaattactctgctgtccccctgtctccatatgttaccacatttgcatttcggactcaaagataaagagacccgttatcggcaacgctaccttgacctgatcttaaacgattttgtgcgacagaagtttatcatacgttccaaaatcatcacttacatccggagtttcctagacgaactgggctttcttgaaatcgagacccccatgatgaacatcatccccggaggtgcagtggccaaacctttcatcacttaccataatgaactggacatgaacctgtatatgcgcattgcccctgagctgtaccacaaaatgctggtcgtgggaggcatcgatcgggtctacgaaatcggccgtcagttcagaaacgaaggcatcgacctgactcataaccctgagtttaccacctgcgagttttacatggcctatgctgattatcatgaccttatggagatcactgaaaagatggtaagtggcatggtgaagcacatcacagggtcctacaaggtaacctaccaccccgacgggcccgagggccaggcttacgatgtggacttcaccccacctttcaggcggatcaacatggtggaggaactggagaaggctcttgggatgaaactgcccgagacgaatctttttgaaacggaggaaacgaggaaaatcttagatgacatatgcgtggccaaggccgtggagtgtcccccgccacgcactacagccaggctcttagacaagctagtcggggagttcctggaggtcacctgtatcaatcccaccttcatttgcgaccacccccagattatgtccccacttgctaagtggcataggtcgaaagagggtctgactgagcgcttcgagttgtttgttatgaagaaagaaatatgcaacgcatatacagaacttaatgaccccatgaggcagcgtcagctcttcgaagagcaggctaaggcgaaggccgctggcgatgacgaagccatgtttatagacgagaacttttgcaccgccctggagtacggtcttccaccaacggctgggtggggcatgggaatcgatcgcgtcgctatgttcctgaccgactccaacaacataaaagaagtcctcctgtttcctgctatgaagcccgaagacaaaaaagaaaacgtcgcgaccactgatacactggagagtaccaccgtaggcacttcagtctag

SEQ ID NO: 122980 - DNA, 1569 bp, Artificial Sequence
  Description of Artificial Sequence: Synthetic coding sequence
atgcagccgtggcacggcaaagccatgcagcgcgcttccgaggcgggtgctaccgcacccaaagcttcagcacggaacgcccgaggggctcctatggacccgaccgagagtcccgccgccccggaggcggctctccccaaagcaggcaagttcgggccggcccgcaagtcaggctcccgccagaaaaagagcgccccagacacacaggagcgccctccagtgagggcgacaggggctcgggcgaaaaaggccccccaacgcgctcaagatacacaaccatcggacgctacttccgcgcccggtgccgaaggcttagaaccaccagccgctcgggagcccgcattaagtcgagcgggctcatgccggcagcgcggggcccgatgcagtacaaagcctagaccccctccagggccctgggacgtaccatcacctggcctcccagtgtcagcaccgatactcgttcggagagacgctgctccaggcgccagcaaactgcgagctgtgttggaaaagctgaagctgagcagggatgacataagcaccgccgccggcatggtaaagggagtggtcgaccacctgcttctgcggctgaagtgcgactccgcatttcgcggggtggggcttcttaacaccggaagttattacgagcatgtcaaaatttctgcaccgaacgaatttgatgtaatgttcaagttggaagttccacgcattcagctagaggagtattcgaatacccgggcgtattattttgtgaaattcaagcggaaccctaaggagaaccccctgagccagttcttggaaggagagattctgagtgccagcaagatgctttctaagttccggaaaatcattaaggaggagatcaacgacattaaagacacagacgttattatgaaacggaaaagaggagggtctccagccgtgactctccttatttcggagaagattagcgttgatatcacactcgctttagagagtaaatccagttggcctgcatcgactcaggagggcttgcgaatccagaactggttgtccgcaaaggtgcgtaagcagctccggcttaaacctttctacctggttcctaagcatgccaaagaggggaatggattccaggaagaaacatggcgcttaagcttcagtcacatagaaaaggaaatccttaataatcacggaaaatccaagacctgttgtgaaaataaggaggagaaatgctgtcgtaaggattgcctcaagctgatgaagtacctgttagaacaattaaaagagagatttaaagataaaaaacatctcgataagttttctagctaccatgtgaaaaccgcattttttcatgtttgcactcaaaatccgcaagactctcagtgggatcggaaagatttaggtctctgcttcgacaattgcgtgacttacttcctacagtgcctacgcacggagaaactcgagaactattttatccctgaatttaatctgttcagcagtaacctgatcgacaaacggagcaaggaattcctgacaaaacagatcgagtacgagcgcaacaacgaatttccagtgtttgacgaattctag

SEQ ID NO: 122981 - DNA, 1344 bp, Artificial Sequence
  Description of Artificial Sequence: Synthetic coding sequence
atgcagccctggcatggtaaggctatgcagagagcctccgaagccggcgccaccgcaccaaaagcctctgcccgcaatgccagaggagctccaatggatcctaccgagtccccagcagcgccagaggccgcgctgccaaaggccggcaaattcgggcctgcgagaaaaagcggttctcgccaaaagaagagcgcacccgacacacaagagagaccacctgttcgggctacgggagcccgggccaaaaaggccccccaacgtgctcaggacacacagccatcggatgccacttcagccccgggggcagagggattggagcccccagcagctcgagagcccgctcttagtcgcgccggatcctgccgccagagaggtgcccgctgctcaacaaagccccggccaccacctggcccttgggatgtcccttctccagggttaccagtgagtgcaccgatcctggttcgcagagatgctgcaccaggcgctagtaaactccgggcagttttggagaagctcaaactgtctagagatgatatttcaacagctgccggcatggtgaagggagtggtggaccacctgctccttcggttgaaatgtgatagcgccttcaggggtgtgggtctgctcaatacgggtagctattatgagcatgtgaagattagcgcaccaaatgaattcgatgtgatgtttaagctggaggtaccccgtatacagctggaagaatacagcaacacgagggcctattattttgtgaaatttaagaggaaccctaaggagaatccactttctcagtttctggaaggagaaatcctgagtgcgagcaagatgctgagcaaattcagaaaaatcataaaggaagaaataaacgacatcaaggacacagacgtgatcatgaagcgtaagagaggaggatccccagcagtgacgctgctgatttctgagaaaatctccgtcgatatcaccttagcccttgagtcaaagtcttcttggccagcgagtacacaggaaggcttgaggattcagaattggttatctgcaaaggtccgaaagcaacttaggctgaaacctttctatctggtgcccaagcacgcgaaagaggggaacggcttccaggaagagacgtggcggctttctttttctcacattgaaaaggaaattctgaataatcatggtaagtccaagacgtgctgtgagaacaaggaagagaaatgttgccgaaaggactgccttaagcttatgaagtacctcctcgagcagctaaaagagagattcaaggataaaaaacatctagacaaattctcatcttatcacgtgaagacggcattttttcatcggctgtactag

SEQ ID NO: 122982 - DNA, 1080 bp, Artificial Sequence
  Description of Artificial Sequence: Synthetic coding sequence
atgatagcagcacaagcaaagttagtatatcacctgaacaagtattataatgaaaagtgccaggccagaaaagccgcaattgctaaaacaatccgagaggtctgtaaggtggtcagcgatgtcctcaaggaggtggaggtgcaggagcccagattcatttcatccttaaacgaaatggataataggtatgaagggttagaggtgatctcccccaccgaattcgaagtggtcctctatctgaatcagatgggcgtgttcaatttcgttgatgacgggtcgttgcctgggtgcgctgtgttgaaactgtctgacgggagaaagcggagtatgagcctgtgggttgaattcattaccgcttcaggttacctatctgcccgtaagatccgcagcagattccagacactggttgcccaggccgtggataagtgttcttatagagatgtagttaaaatggttgctgacacttctgaggtgaaattgcgtatccgggatcggtacgtggtgcaaattactccagctttcaaatgtaccggtatttggccacgcagtgcggctcattggcccctgcctcatattccatggcctggccccaacagagtggctgaagtaaaggcggagggatttaatctgctgtcaaaagaatgccattcgttggccggaaaacagtcctcagccgagtcggatgcctgggtgctccagttcgccgaggccgaaaaccgcctgcagatgggcggatgtcggaaaaagtgtctctccatcctgaaaactctaagggacagacacctagagctgccagggcagcccctgaacaattatcacatgaaaactctcgtgtcttacgagtgcgaaaagcatccgcgcgagagcgattgggacgagagctgcctgggcgaccggttgaatgggatcttactgcaacttattagctgcctccagtgcaggagatgcccacactatttcttgccaaacttagatctgtttcaggggaagcctcattcggctctcgaaaacgccgccaagcagacctggcggttggccagggagatactcacaaatcccaagagccttgagaagttatag

SEQ ID NO: 122983 - DNA, 1176 bp, Artificial Sequence
  Description of Artificial Sequence: Synthetic coding sequence
atgtcaggtcctgtccccagccgagcgagggtttatacggatgtcaacacccatcgccctcgtgaatactgggattatgagtcccatgtggttgagtggggcaaccaggacgattatcagctggtccggaaactgggcaggggaaaatactctgaagtattcgaagctatcaacatcacgaacaacgagaaggtggtggtcaagatactcaagcccgtgaagaaaaagaaaatcaaacgtgagatcaagatactcgaaaatcttcgggggggacccaacatcatcaccctcgctgacatcgtgaaagaccctgtttcccgcaccccagccctggtgtttgagcatgtcaataataccgattttaaacaactgtaccaaactctcaccgactatgacatccggttctacatgtatgaaattctgaaggcactggattattgccacagcatgggaatcatgcatagagacgtcaagccgcacaatgtaatgatcgatcatgagcacagaaagttaaggttgatcgattggggtttagccgagttttaccaccccggtcaggagtacaacgtgagggtggctagccggtacttcaaaggaccagagctcctggtggactaccagatgtatgactatagcctggatatgtggtcactcggctgcatgttagcctctatgatctttagaaaagagccctttttccacgggcatgataattatgatcagctggtgcgaattgctaaagtgctgggaactgaagatctatatgattatatcgacaagtacaatattgagctggaccctaggtttaatgacattctgggaaggcactcgaggaagaggtgggaacgctttgtccacagtgagaaccagcatctggtttctccggaggcactagattttctcgacaaacttttacggtacgatcatcagtctcggctaacagccagagaggctatggagcacccctacttttataccgtcgtgaaagatcaggctagaatggggtcttcaagcatgcctggaggctctactcccgtgagcagcgccaatatgatgagtggaatcagctccgtgcctacccctagtccattgggcccactggccggatccccagtgatcgccgcagcgaatccactggggatgccagtacccgccgcagcaggcgctcaacagtag

SEQ ID NO: 122984 - DNA, 1347 bp, Artificial Sequence
  Description of Artificial Sequence: Synthetic coding sequence
atgtatccctccaacaaaaaaaaaaaggtctggagggaggagaaagagcgactgctcaagatgaccctggaagagcggagaaaggagtacctacgcgattacattcctctaaattcaatactcagttggaaggaggaaatgaagggaaagggccaaaatgatgaggagaacacccaagagaccagtcaggtcaagaagagtctcactgaaaaagtgtccctgtatcgaggagatataacattattggaggttgatgcgatcgtgaatgcggccaatgcatcactgctaggagggggcggcgtggacggttgtattcacagggccgcgggcccctgtctcctggccgagtgccggaatctcaatggatgtgatactggccacgccaagattacgtgtggctatgatctgccagcgaagtatgtaatccacacagttggcccaatcgcccgcggccacataaatggcagtcataaggaggatctggctaactgctataagagcagtctcaagctggtaaaagaaaataacatccgtagcgtggctttcccatgtatctctacaggtatctatggctttccaaacgagcccgcggcggtcatcgctcttaatactatcaaggaatggctggccaaaaatcatcacgaagtcgatcggatcattttttgtgtgttccttgaagttgacttcaaaatctacaagaagaaaatgaatgagttcttctctgtcgacgacaacaatgaggaagaagaggacgtggaaatgaaggaggatagtgatgaaaacggcccagaggaaaagcagtctgtcgaagagatggaggagcagagccaggatgcggatggcgtgaatacggtgacagtcccgggacccgcctctgaggaagccgttgaggattgcaaagacgaagactttgccaaggacgaaaatataacgaaagggggcgaggtgaccgaccactccgttagagaccaggaccaccctgacgggcaggaaaatgactcgacaaaaaacgagatcaagatcgagaccgaatcacagtcatcttatatggaaacagaggagctttcatctaatcaggaggacgcggttattgtcgaacaacccgaggtgattcctctcaccgaggaccaggaggagaaggagggagagaaagcgcctggagaagacacaccacgcatgcccggcaagagcgagggaagcagcgatctggaaaatactccaggacccgatgttgaaatgaacagccaggttgataaagtaaatgaccctacggagtctcagcaggaagaccaactcattgctggggcacaggacgaggccaaggaacagaggaacggtactaaatag

SEQ ID NO: 122985 - DNA, 642 bp, Artificial Sequence
  Description of Artificial Sequence: Synthetic coding sequence
atgaacgagttcttctctgtcgatgacaacaacgaggaggaggaagacgtggaaatgaaggaagacagtgacgaaaacggacctgaggagaagcagagcgtggaagaaatggaagaacagagccaggacgccgacggggtcaacacagtgactgtccctgggccagcttctgaggaggccgtggaggactgtaaagatgaagacttcgctaaagatgagaacatcaccaagggcggggaggttacagaccactcggtccgagaccaggatcatccagatgggcaggaaaatgactcaactaagaacgagattaaaatcgagaccgagagccagtctagttacatggaaaccgaagaattgagcagtaaccaggaggacgccgtgatcgtggaacagcctgaagtaattcctttgaccgaggaccaggaggaaaaggagggagaaaaggcccccggggaggatacgccacgtatgcctggcaagtccgaaggcagttcagatcttgagaacacacccggtccggacgtagagatgaatagccaggtggacaaggtgaatgatccaactgagtcccaacaagaggaccagctgattgctggcgctcaagatgaggcgaaggagcagcgtaacggaaccaaatag

SEQ ID NO: 122986 - DNA, 642 bp, Artificial Sequence
  Description of Artificial Sequence: Synthetic coding sequence
atgaacgaatttttcagtgtggatgataataatgaggaagaagaggacgtggagatgaaagaagacagtgacgaaaacggcccagaggaaaagcagagtgttgaggaaatggaggagcagagtcaggacgccgacggggttaatacagttactgttcccgggcctgcaagcgaagaggcagtggaagactgcaaggacgaggatttcgccaaagacgagaacatcacaaaaggcggagaagtcactgatcactcggtcagagatcaggaccatccagatgggcaggaaaacgactctacgaaaaatgaaataaagattgagactgagtcccagagctcttacatggagacggaagaactctctagtaaccaggaagatgctgtcattgtagaacaaccggaggtgattccacttacagaagaccaggaggaaaaggagggggaaaaagctcctggcgaagacaccccaagaatgccaggcaagtccgaggggtcttccgacctggaaaatactcctgggccagatgtagagatgaattcacaggtggataaggtgaatgatcctactgagtcccagcaggaagatcagctgatagctggggcccaggacgaggcaaaggaacagcggaatgggacgaagtag

SEQ ID NO: 122987 - DNA, 1068 bp, Artificial Sequence
  Description of Artificial Sequence: Synthetic coding sequence
atggcagtgcaggaatctgccgcacaactctcaatgacactgaaagtccaggagtaccctacgttaaaggtaccctacgaaactctcaacaagcgctttagggcagcccagaagaacatagaccgtgagacctcgcacgtgacaatggtagtggccgaactcgagaagacgttgagcgggtgcccagcagtcgactcagtcgtctctctccttgacggcgtggtggaaaagctgtcagtactgaagcgtaaggccgttgagtccatccaagcagaagacgagagcgcgaagttgtgtaagcgccggatcgaacatttgaaagagcactcttccgaccagccagccgcggcatctgtttggaaacggaagagaatggacagaatgatggtggagcacttgttacgatgtggatactataacaccgccgtgaaactcgctcgtcagtcaggcatcgagagttgcctggagtttagcctgcgcatccaggagttcatcgaactcatacgccagaacaaacggttggacgcagttagacatgctaggaagcatttttcccaggcagaaggaagccagctggacgaagttcgccaggcaatgggcatgctagcttttcctcctgatacccacatctctccttataaagaccttttggacccagctaggtggcgtatgctgatccaacagtttagatatgacaattaccgcctccaccagctaggcaataattctgtgtttaccctcactctgcaggccggtctttctgcgatcaagacaccccaatgctacaaggaggacggatcttctaaatcacccgattgccctgtctgctcccggtccctgaacaaattagcgcagcctttgccaatggctcactgtgccaattcacgccttgtctgcaagatctcgggcgatgttatgaacgaaaataacccaccaatgatgctccctaacggatacgtgtatggttacaactcactgttgtctatcaggcaggatgacaaggtcgtgtgcccaagaacaaaggaggtgtttcacttcagtcaggcggagaaggtgtatattatgtag

SEQ ID NO: 122988 - DNA, 1191 bp, Artificial Sequence
  Description of Artificial Sequence: Synthetic coding sequence
atggctgtacaggagtctgccgcccagttatctatgaccttgaaagtgcaggagtatccaaccctgaaagtcccctacgaaactctcaataaacggtttcgcgccgcacagaaaaatatcgatagagaaacttcccacgtgacaatggtggtggccgagctcgagaagaccctgtccggttgtcccgcagtggactccgtcgtgtcattgctcgacggcgtggtagagaaactgtctgtcctcaagagaaaagccgtggagtcgattcaggcagaagacgagagcgccaaactatgtaaaagaaggattgagcacctgaaggagcacagctcggatcagccagcagctgcaagtgtgtggaagaggaaacgtatggatagaatgatggtggagcacttgttacggtgtggctattacaatacagccgtgaaacttgccaggcagtccggtattgaggacttggtgaatattgaaatgtttctgacagcaaaagaagtggaagagagcttggagcggcgggagacagccacctgtctagcgtggtgtcacgacaacaaaagcaggctgcggaagatgaaaagctgcttggaatttagcctgaggatccaagaatttattgagctgatccgccaaaacaaaagactggatgcagtcagacatgcccgcaaacatttctcccaggcagaggggtcacagctggatgaggtgcggcaagcaatgggtatgctggcctttccccccgatacacatatttccccttacaaggacttattggatcccgcaaggtggcggatgttaatccagcaatttagatatgacaactacaggctccatcagctgggcaacaactctgtttttaccctgacccttcaggccggcctgtcagccattaagaccccacagtgctacaaggaagatggatcaagtaaatccccggactgcccggtttgttctagatctctgaacaaactggctcaaccccttccaatggctcattgcgccaactcacgcctggtatgcaaaatatcgggcgacgtgatgaatgagaataacccacccatgatgttgcccaacgggtacgtgtacggttataactcacttctatctatccgtcaggatgataaggtagtgtgtcctcggacgaaggaggtgttccatttttcacaagccgagaaagtttacattatgtag

SEQ ID NO: 122989 - DNA, 987 bp, Artificial Sequence
  Description of Artificial Sequence: Synthetic coding sequence
atggccgtacaggagtcagccgctcagctgagcatgaccttgaaggtgcaagaatatcctacgctcaaagttccatacgaaaccctcaacaagaggttccgtgccgcccagaagaatattgaccgcgagacgtcccacgtgacaatggtcgtagctgaactagagaaaacactcagcggctgtccggcagttgactcagtagtgagcctgctagacggtgtggtggagaagctctccgtgctgaagcgtaaagccgtagaatctattcaggccgaggatgagtctgctaagctatgcaaaaggcgaatcgaacacctgaaagagcatagctccgaccagcccgctgccgcttctgtctggaaacgtaagagaatggatcgaatgatggttgaacatctcctcagatgtgggtactataacaccgcggtaaagttagccaggcagagcggaattgagacctgtaagaaggctcttcagccatcccgtcgcgagccagcaggccgaggcgctccaggtcatggccacgcggggctccccgctcggcacgctcacctacccgtacagggtcccagcgggccttgcacggtggccgatgctgatcctgccgtgcctgttcggcagctgccgactacacctgctggcaaacaattttgcgtccacccacaccccgccggatggcccctctctcatcaggaacagtgttataaagaggacggttcttccaaatcccctgattgtcctgtttgctctagatctctcaataaattagctcagcctttgcccatggcacattgcgccaacagccgactcgtgtgtaagatttccggagacgtcatgaatgaaaacaaccctcctatgatgctacctaacggctacgtctatggttataacagtttactctccatcagacaagacgacaaagttgtatgtccacgtaccaaagaggtatttcactttagccaagcagaaaaagtatatattatgtag

SEQ ID NO: 122990 - DNA, 954 bp, Artificial Sequence
  Description of Artificial Sequence: Synthetic coding sequence
atgaccctgaaagtgcaggagtaccctactctgaaggtgccttatgaaaccctgaacaagcggtttcgcgccgcccaaaagaatattgatcgagagacgtcccatgtcaccatggttgtcgccgaacttgagaaaactctgtctgggtgtcccgccgtggactccgtggtgagtttgttagatggcgtggtggagaagttgtcggtattgaagcgcaaggaccttgtgaacatcgaaatgtttctgaccgctaaggaggtcgaagaatccctggagcggcgcgaaactgccacctgtctggcctggtgccacgacaacaagtcccgcctacgcaaaatgaagtcttgtctggagtttagcctaaggatccaggagttcatcgaactgatccgtcagaataagcggctggatgcggtgcggcatgccaggaagcattttagtcaagccgagggaagccagttagatgaagtacgtcaggccatgggtatgttggcatttcctcctgacacccatatctcaccatacaaggacctgctagaccccgcccgttggaggatgctaatccagcaatttagatatgacaactataggctgcaccagctgggaaataacagtgtgttcactctcacattacaggccggattgtcagccatcaagacaccacagtgttacaaggaggatggctcgagcaagagtcctgattgtccagtttgcagccggagcttgaataagctggcgcagccccttccgatggcccactgtgccaattcccggcttgtttgcaagatttcgggcgacgtgatgaacgaaaacaatccgcccatgatgcttccaaacgggtacgtatacggatataatagtctcctgtcaattaggcaggacgataaagtcgtgtgccctaggaccaaagaggtcttccatttttctcaagctgagaaagtctacatcatgtag

SEQ ID NO: 122991 - DNA, 1305 bp, Artificial Sequence
  Description of Artificial Sequence: Synthetic coding sequence
atggcagtccaggaatccgccgcacaactgtccatgacacttaaagtgcaggaatacccaaccctcaaagtgccttacgagacccttaataagcgattccgggcagctcaaaagaatatcgatagggaaacttcccacgtgacaatggtggtagccgaacttgagaaaacactgtccgggtgtcccgctgttgacagcgttgtgtccctcctagacggggttgtagagaagctttctgtactgaagaggaaggcggtagagagtattcaggctgaggacgagagtgccaagttgtgtaagcggcggatagaacacttgaaggaacattcctcagaccaaccggcggcagcaagtgtctggaaacgaaagagaatggatcgtatgatggtggaacatctcctcagatgtggctattacaacacggccgtcaaactggctcgacagtcaggtattgaagatttggtcaacatagaaatgtttctgaccgccaaggaggtggaggagtccctagagcgaagagaaacagcaacctgtctggcgtggtgtcacgataacaaatcaagattgagaaaaatgaagggtcgccaaaataaacatgaggcgaagacaggacgaaaaagtcgggccgcctcatcttcacccaaagaatcgctggatcttggcatggagacactcaagggaaagcccgagctctcctgcctggaattttccctgcgaattcaagagtttatcgaactgattcgccagaacaaacggctggacgctgtgcggcatgcaagaaaacatttttcacaggcggagggcagccagctggacgaagtgcggcaggccatgggtatgctggcattccctcccgacacacatataagtccttacaaagatctgttggaccctgctagatggcggatgctgattcagcaatttcggtacgataactaccggctgcaccagctgggaaacaattccgtcttcacgttgacgctgcaggccggattatccgccattaagactccacagtgttataaagaagacgggagctcaaaatctccagattgtccggtttgcagcaggtcactgaataagctggctcagccactgccaatggcgcattgtgcgaactcacgactggtgtgtaaaattagtggggacgtcatgaacgaaaacaacccgccaatgatgctgcctaatggatacgtttacggctataatagcctgctgagcattcggcaagatgataaagttgtgtgtcctcggaccaaggaggtgttccatttcagccaggccgagaaagtgtatattatgtag

SEQ ID NO: 122992 - DNA, 1047 bp, Artificial Sequence
  Description of Artificial Sequence: Synthetic coding sequence
atggttgtggccgaacttgaaaagaccctgagcgggtgtccagccgtcgactccgtggtgagtctcctagacggagtggtggagaagctgtccgtgctaaagcgcaaagctgtcgaaagtatccaggccgaggatgaatccgctaaactgtgcaagagacgcatagaacatctgaaggagcatagctccgatcaaccggctgccgcttccgtttggaagcggaagagaatggaccggatgatggtagagcatttgctgagatgcggatactataacactgcagtgaaactggcgcgccagagcggtatcgaagacctggttaatatcgaaatgttcctgacggccaaagaagtggaggaatctcttgagcgacgcgagactgccacatgcctggcttggtgccatgacaataagtcacgcctgcgtaaaatgaagagctgcctggaattcagccttaggatccaggaattcatcgagttgatccgtcaaaacaaacggttggatgccgtgagacatgcaagaaaacacttctcacaggccgagggctctcagctggacgaggtgaggcaggctatgggtatgttggcctttcctcctgacacccacatcagtccatataaggacctacttgatcctgcccgatggcgaatgctgatccaacagtttcgttacgacaactaccggcttcatcagctgggaaacaattccgtattcacactgaccttgcaggcggggcttagcgcaattaagacgccacagtgctataaggaggacggtagtagtaaaagccccgattgccccgtgtgctctagatccctgaataagctggctcagcctctgccaatggcccactgcgccaatagtagactggtgtgcaaaatcagcggggatgtgatgaacgaaaacaatccaccaatgatgctccccaacggctacgtttatggttacaactctctgctgagcatccgtcaggatgacaaagtcgtttgtcctaggaccaaagaagttttccattttagccaagccgagaaggtgtacatcatgtag

SEQ ID NO: 122993 - DNA, 1188 bp, Artificial Sequence
  Description of Artificial Sequence: Synthetic coding sequence
atgtggacactgcgcgccacaggtcgcgaggtgggctcatcctcttgcgaggacacagtcgctcccgtaccctatgaaacactcaataaacgctttagagccgcacagaagaacatcgaccgggaaacaagtcacgtcacaatggtggtggctgaactggagaagacactgtccgggtgccccgccgtagactctgtggtttcactgctagacggagtggtcgagaaactgtctgtgctcaagcggaaggctgtggagtctattcaggctgaagacgagtcagcgaagttatgcaagaggaggattgagcatttgaaagagcatagttcagaccagcctgctgccgcttctgtctggaagcggaaaaggatggaccggatgatggtagagcacctgctgagatgtgggtactacaataccgcggttaaacttgccagacagagcggtattgaagacctggttaatatcgaaatgtttctgaccgccaaagaagtcgaagagtctcttgaacggagagagactgccacttgtctcgcttggtgccatgacaacaagtcaagattgcggaagatgaagtcttgtctggaattcagtctgcgaatccaggaatttatcgagctgataagacaaaacaagcggttggatgctgtgaggcacgctcgcaaacactttagccaggcagagggctcccagctcgacgaagtgaggcaggccatggggatgctggcctttcccccagatacacatatcagcccctataaagatctgttggatcccgcccggtggagaatgctcattcagcagtttcgctatgacaattaccgcctgcaccagctcggaaacaactcagtatttaccctaaccctccaggcggggctatcagccattaaaactccgcaatgctataaagaagatggtagttcgaagagcccagattgtcccgtgtgctcaaggtccctcaacaaactggctcaaccgttgcctatggcccactgcgcgaactcaagacttgtctgcaagatctcaggcgatgtcatgaatgaaaataacccccctatgatgcttcccaatggttatgtctatgggtataattcactgctgtcgatcaggcaggatgacaaggtcgtatgtccaaggaccaaagaggtgttccatttcagtcaggctgagaaagtttacattatgtag

SEQ ID NO: 122994 - DNA, 987 bp, Artificial Sequence
  Description of Artificial Sequence: Synthetic coding sequence
atggctgtgcaagagtcagccgctcagctgtctatgaccctgaaggtacaagaatacccaactctgaaggtgccttatgaaaccctgaacaaacgctttcgtgcagcacagaaaaatattgaccgggaaacttcacacgtgacaatggttgtggccgagctggagaagactctttccggttgccccgccgtggactctgtcgtcagtctcttggacggagtggttgagaagctttcagtgctgaagcgcaaagcagtagaatccattcaggcggaagatgagagcgccaagctctgtaagcggcgcatagagcatcttaaagaacactcttcggatcagcccgccgctgcttctgtttggaaacgaaaacggatggaccggatgatggtcgaacacctactgaggtgcgggtactataataccgcggtgaagctggctcgtcagagcggcatcgagacctgtaagaaggccctgcagccaagtcgccgcgaaccagccggcagaggcgcaccggggcacgggcacgcaggcctaccagcccgccatgcccacctgcccgttcaggggccttccggaccgtgtacagtggcggatgctgaccctgccgtcccggtcaggcaactcccaaccactccggctgggaaacagttctgcgtgcatccacaccccgcggggtggcctcttagtcaccaagatacctgctacaaagaagacgggtccagtaagagccctgactgtcctgtttgctcaaggagtctgaacaaacttgctcagcctctcccaatggctcattgcgcaaattcccggctagtgtgcaagatctctggcgatgtgatgaacgaaaataacccccccatgatgttacctaacggctacgtgtacgggtacaattccctgctgagcatccgacaggacgacaaagtggtgtgtccgagaactaaggaagtgttccacttctcccaggctgagaaggtctacataatgtag

SEQ ID NO: 122995 - DNA, 1128 bp, Artificial Sequence
  Description of Artificial Sequence: Synthetic coding sequence
atggccgtacaggagagcgctgcccagctttccatgacactgaaagtgcaagaataccccactctgaaagtgccgtacgagacactgaataagagattcagggccgcccaaaagaatattgacagggaaaccagccatgtcacaatggtcgtcgcagaactggaaaaactttccgttttaaaacgtaaagccgtggaatcgatccaggctgaggatgaatccgctaagctttgtaagaggcgtatcgaacatctgaaggaacattcatcggaccagcctgctgcggcctctgtatggaaaaggaagaggatggaccgcatgatggtcgagcatttgctgcgttgcggatactataacacagcagttaagctcgcccggcaatcgggcattgaggatctagtgaacatcgagatgtttcttactgcaaaggaggtcgaagaatccctcgaaaggcgtgagaccgccacatgcctggcatggtgccatgataacaaatctaggctcaggaagatgaaaagttgtttggagttttcactccgaatacaggagttcatcgagcttattaggcagaataaacgtctggacgccgtgagacacgctaggaaacatttttcccaggcggaagggtcccagttagacgaggtccgacaggccatgggtatgctggccttcccacctgatacacatatctctccttataaggatcttctggaccccgcacggtggaggatgctcatccaacaatttcgttacgacaattacagactgcaccagcttgggaacaattctgtgttcactctgacattgcaggcaggcctctcggcaatcaagacgccgcaatgctacaaagaggacgggtcaagcaaatcgcccgactgtcccgtgtgtagccggtctctcaacaaattagcacagccactgcctatggcacattgcgcgaacagcagattggtgtgcaagatcagtggagacgtcatgaatgaaaataatcccccaatgatgctgccaaacggctatgtgtacgggtataattcactgctctcaataagacaggacgacaaggtcgtgtgtcctcgtaccaaggaggtcttccactttagtcaggctgaaaaagtctacattatgtag

SEQ ID NO: 122996 - DNA, 1467 bp, Artificial Sequence
  Description of Artificial Sequence: Synthetic coding sequence
atggctcctgcggcatggctgaggtcagcggccgcacgagctctcctgcctccaatgctgttgctgctcctccagccccctcctctcctggctcgcgcactccctcctgacgcccaccacctccacgcagagcgaagagggcctcaaccgtggcatgctgctctgccgtcatccccagctcctgcgccagcaacacaggaagcaccccggccagccagttcactccgcccgcccagatgtggcgtgccagatcctagcgacgggctcagcgctcggaacaggcagaaacgattcgttctaagcggggggaggtgggagaagacggatttgacttatagaatactgcgatttccttggcagttggtgcaggagcaagtgagacaaacaatggccgaggcccttaaggtgtggtctgatgtgacccccctgacgtttaccgaagttcacgaaggccgggccgatattatgatcgacttcgccaggtattggcatggagatgatctaccctttgatggaccaggtggcatcctcgctcacgccttttttcctaaaacacacagagagggagacgtccactttgactatgatgagacctggaccataggggacgaccagggaacggacttgttgcaggttgccgcccacgagtttggacacgtcctgggactccagcacaccacagccgctaaggcccttatgagcgccttctatacctttcggtatccactctccctgagcccagacgactgtcgaggtgtgcagcatctgtacggccagccatggccaacggtcacaagtaggacgccagcactcggcccacaggctgggattgataccaacgaaatcgcccctctagaacccgacgccccgccggatgcttgcgaagcctcctttgatgctgtctccacaattaggggagagttgttcttctttaaagccggattcgtgtggcgattaagggggggtcagttacagccagggtatccggctctggcatcccggcattggcaaggactaccctctcctgtggatgcagccttcgaggacgcacaaggccatatttggtttttccagggagctcagtattgggtgtatgatggagagaagccagttctcggccccgcaccactcaccgagcttgggctggtcaggtttccagtgcacgccgctttagtctggggtcctgaaaaaaataaaatttatttttttcggggcagagattactggcgcttccaccccagcaccaggagagtagacagtccggtcccgaggcgcgcaaccgactggcgcggtgtgccatctgaaatcgacgcagcattccaagatgcagacggatatgcctacttcctgagaggaagactgtactggaaatttgatcctgttaaagttaaggcgttggaaggctttccccgcttagtggggcccgattttttcggttgcgcggagccagccaatacctttctttag

SEQ ID NO: 122997 - DNA, 1563 bp, Artificial Sequence
  Description of Artificial Sequence: Synthetic coding sequence
atgagaaacaaaaagatcctgaaagaggatgagctgttgagcgagactcaacaagctgctttccatcaaatcgccatggaaccctttgaaatcaatgtccctaagcctaagcggcgcaatggtgtgaacttttccctggctgtggtagtcatttacctcatacttttgaccgcaggggccggcctgctcgtggtgcaggtgttgaacttgcaggctcggctaagagtgttggagatgtacttcttaaacgacacactggcagcagaggatagccctagttttagtcttctacagtcggcgcacccaggagagcacctggcacagggggcttcacggcttcaggtccttcaagcacagctgacctgggtgcgagtgagccatgagcacctgctgcagcgggtggataacttcactcagaaccccggaatgttccggataaagggcgagcagggcgccccaggattgcaggggcataagggcgccatgggtatgcccggtgctccaggaccgccaggccctcccgcagagaaaggcgcaaagggtgctatgggccgcgacggcgcaacaggaccaagcggcccacaaggtcctccgggcgtcaagggagaggccggactgcagggccctcagggcgctcctggaaagcagggcgctacaggaacccccggaccccagggagagaagggttctaaaggggacggaggccttattggcccgaaaggagaaacaggcactaaaggcgaaaagggtgatctgggcttacccggaagcaagggagatcgcggcatgaaaggggatgcaggagttatgggcccaccaggggcgcagggaagcaaaggggatttcgggagaccgggaccacctgggctggccggattccccggagctaagggtgaccaaggccagcctggactgcagggggtccctggacccccaggcgcagtgggccacccaggggcaaagggggagcccggcagcgccggcagtcccgggcgggccggtttgcccggaagtccggggtctccaggagcgaccggactaaagggatcgaagggggatactgggctgcagggccagcagggcagaaaaggtgagtctggggtgcccgggcccgcgggtgttaagggcgaacaagggtccccgggcctcgccggtcctaaaggggctcctggacaagctggccaaaaaggtgaccagggagtgaaaggctcttctggggaacagggcgtgaagggggagaaaggggaaaggggcgagaatagcgtgtccgtacggatcgttgggagtagcaacagagggcgggccgaggtttattacagcggcacatggggcaccatatgcgatgatgagtggcagaactctgacgcaattgtgttctgcaggatgttggggtactccaaaggccgggctctgtacaaggtcggcgcgggcacaggccagatttggctggacaatgtgcaatgcaggggcacggaatctacgctgtggtcttgcaccaaaaacagctggggccatcatgattgttcgcacgaggaggacgccggggtcgaatgctctgtgtag

SEQ ID NO: 122998 - DNA, 1329 bp, Artificial Sequence
  Description of Artificial Sequence: Synthetic coding sequence
atgtacttcctgaatgatactctggccgcggaagactctccttctttctccctcctgcagtctgcccatccgggtgagcatcttgcacagggcgcgagccgcttgcaagtgctgcaggcacagttgacctgggtaagggtgagtcatgagcacctgttacaaagagtagacaattttacacagaaccctggaatgtttaggataaagggggaacagggggctccagggctccaggggcacaaaggtgctatggggatgcccggagctcccggcccaccagggccccctgccgaaaagggggccaagggcgccatggggcgtgatggcgctacgggcccaagcgggccacagggaccacccggagtcaaaggggaggcagggctccaaggaccgcagggagctccaggtaagcagggcgccaccggtactccagggcctcaaggggaaaaaggttccaagggtgatggcggactgattggtccaaaaggggagaccgggacaaagggggaaaaaggcgatctgggactgcctggatcgaaaggcgaccgtgggatgaagggtgacgctggggtgatggggcctccgggcgcccaaggaagcaagggagatttcggtaggcccggcccaccgggcctggcgggatttcccggcgcgaaaggagaccaggggcagcccgggctgcagggagtgcctgggcctccaggagccgtcggacacccgggagccaagggggaacctgggtctgccggaagcccaggcagagccggtctacctgggagccccggctctccaggcgccactggacttaaaggttccaagggagatactggcttgcaaggccagcaggggaggaaaggtgagagtggcgtgccaggacccgcaggagtaaagggtgagcaggggtctcccggcctggccggtcctaaaggggcccccggacaggccgggcagaaaggagatcagggggtgaaggggtcctccggtgagcagggggttaaaggagagaagggcgagcgaggggaaaactctgtaagtgtcaggatcgtgggatcctcaaataggggaagggccgaggtctactactctgggacttggggtaccatttgcgacgatgaatggcagaactctgatgccatcgttttctgccgcatgcttggctactcaaagggacgtgcactgtataaggttggagctggaaccggccaaatttggctcgacaatgtgcagtgcaggggtacggagtctactctatggtcctgtacaaaaaactcttggggacatcatgactgcagccacgaggaagacgcgggcgtagagtgttcagtttag

SEQ ID NO: 122999 - DNA, 1356 bp, Artificial Sequence
  Description of Artificial Sequence: Synthetic coding sequence
atggagcagtgggaccacttccacaatcagcaggaggacaccgacagctgcagcgagagtgtgaagtttgacgcgagatccatgaccgccctgcttccccccaaccccaagaattcaccatcattgcaggaaaagctcaaaagtttcaaggcagctctgatcgccctctacttgcttgttttcgccgtgctaatccccttgattggaattgttgctgcacaattgctgaagtgggagaccaaaaactgttcagtttccagcacaaatgccaatgacatcacacagtccctgaccggcaaaggcaacgacagtgaggaagaaatgagattccaggaagtgtttatggaacacatgtcaaacatggagaaacgcattcagcacatccttgatatggaggctaacctcatggacacagagcattttcaaaacttcagcatgaccacagaccagcgattcaatgacattctactacaactgtccactctgttttcttccgtgcaggggcatggcaatgcaattgatgagatatctaagtccctgatcagtctgaatacgacccttctggatttgcagctcaatatcgaaaatctgaacggaaaaatccaggaaaacacgttcaagcagcaggaggaaatctccaaactagaagaacgggtatataacgtgtcagctgagatcatggccatgaaagaggaacaggtgcatctcgagcaagaaattaaaggggaagttaaggtccttaataacataactaacgatctgcggctgaaagactgggaacacagccagacgttacgcaatatcactcttatccaaggcccccccggaccacctggtgaaaaaggggaccgcgggcccaccggagaatccggaccgaggggatttccaggccccattgggcccccagggctgaaaggggatcgcggggctattggattccctggctccaggggcctgccgggttacgcgggtaggccgggtaactccggaccgaagggtcagaagggggaaaagggaagcggtaatactctcacccctttcaccaaagtccgacttgtaggcggcagcggaccgcacgaagggcgagtcgagatattacattctggccaatggggcactatttgtgacgaccggtgggaggtccgcgtgggccaagttgtttgcaggtccttaggttacccgggtgtacaggccgtgcacaaagctgcccactttggtcaagggactggcccgatctggctgaacgaggttttttgttttggcagggaatcttcaattgaggaatgtaaaatcaggcagtggggaacgcgcgcgtgctcacattccgaggatgcaggagtaacctgcacactatag

SEQ ID NO: 123000 - DNA, 1167 bp, Artificial Sequence
  Description of Artificial Sequence: Synthetic coding sequence
atggaacagtgggaccacttccacaatcagcaggaagacaccgacagttgctcagaaagtgttaagttcgacgcccgctccatgaccgccctgttgcctcctaaccctaaaaatagcccgagcttacaagagaagctgaaatcttttaaagcagctctgattgcgttatatctgctcgtgttcgcagtgctcattcccctgattggcatcgtcgctgcacagttgttgaagtgggagacaaaaaattgttctgtctcctcgactaacgcgaatgatatcacccagtcacttacagggaagggtaatgactcggaggaggagatgagattccaagaggtgttcatggagcatatgtccaacatggagaaacggatccagcatatcctggatatggaagctaatctcatggacaccgaacactttcagaatttcagtatgactactgatcagcgttttaatgacattctgctgcaactcagcaccctctttagcagtgtgcagggccacggaaacgccattgacgagatctctaaatctttgatctcacttaataccacgcttctggatctgcagttgaacatcgaaaatctgaacggcaagatccaggagaacacatttaagcaacaggaggagatcagtaagctcgaggagcgcgtctacaatgtgtccgccgaaatcatggccatgaaagaggagcaggtgcatctggaacaagaaatcaagggggaggtgaaagttctgaataatatcaccaacgacctgcgtcttaaggactgggagcactcacagaccctcaggaacatcactcttatccaggggcctcccggaccccccggggagaaaggcgatcgtggccctacaggggagagcggtccacggggatttccagggcccattggcccgcctggcttgaaaggcgaccgtggcgccattgggttccctggctccagagggctgcctggatacgctggacgtcctggcaattctggaccaaaggggcagaaaggtgaaaaaggtagcggcaatactttatctaccggaccaatctggttgaacgaggttttctgctttggccgggagtcttcaatagaggagtgcaaaatccgccagtggggcacaagggcttgctctcactctgaagatgccggcgtgacgtgcacactctag

SEQ ID NO: 123001 - DNA, 1167 bp, Artificial Sequence
  Description of Artificial Sequence: Synthetic coding sequence
atggaacagtgggaccactttcacaatcaacaggaagacacagattcctgctctgagagcgtaaagtttgacgcacggtcaatgaccgccctgctgccgcccaatccaaagaacagtccctctctccaggaaaagctgaaaagttttaaggccgctctcatcgccttgtatctcttagtgttcgccgttctaattcctctgattggaattgttgccgcacaattgctgaaatgggaaaccaagaattgcagcgttagctctaccaacgcaaatgatatcacccaatccttaactggaaaaggcaacgactccgaggaggagatgcgatttcaggaagtgtttatggaacatatgagcaatatggaaaaacggattcagcacattctggatatggaggctaacctgatggacactgaacattttcagaacttcagtatgactaccgaccagcgatttaacgatatattgctccagctctccaccctgttctctagtgtgcagggccatggtaacgccatcgacgagatcagcaaaagtctgatatcgctgaacaccactctcttggacttgcaattgaatatcgagaatctgaacggaaagatccaggagaatacttttaagcagcaggaggagatctcaaagttagaagagagggtgtacaatgtgagcgccgaaattatggctatgaaagaggagcaggtgcacctagagcaggagataaagggtgaggtcaaggtcttaaacaatattaccaacgacttgcgtctgaaggactgggaacattctcagacgctgagaaatatcacgctaattcaggggcctccgggaccgccaggggagaaaggtgaccgcgggccgacaggcgagtcgggcccacggggattccctggccccattggccccccaggcctgaaaggggacaggggcgccattggctttcctggcagcaggggcctgcctggatatgccggtcgtccaggcaactctggaccgaaaggccaaaagggagaaaagggatctgggaacactctctctactggaccaatatggctgaacgaggtattctgtttcgggcgggaaagctctatagaggagtgtaagatccgccagtggggaacccgcgcatgctcccattctgaggacgccggggtgacctgcactctgtag

SEQ ID NO: 123002 - DNA, 1077 bp, Artificial Sequence
  Description of Artificial Sequence: Synthetic coding sequence
atggagcaatgggaccactttcacaaccaacaggaggatacggatagttgtagtgagtcggtgaaatttgacgcacggagtatgacggctcttctgcctcccaatcctaagaactcccctagtctccaggagaagctgaaaagcttcaaagccgctcttatcgccctttaccttctcgtttttgccgtccttatcccccttattgggattgtagccgctcagctcctgaaatgggaaacaaagaactgcagcgtgtccagcaccaatgcaaacgatatcacgcagagcctcaccggcaagggcaatgactccgaggaagaaatgcgtttccaggaggtctttatggagcacatgagtaacatggaaaaaaggatccagcacatccttgatatggaggcgaacttaatggacactgagcatttccagaatttttctatgactacagatcaacgatttaacgacattctgctgcagctgagcacacttttctcatccgtgcaggggcacggcaatgccatagatgagatctccaagtctctgatctccctcaacacgacactgctggacctgcagttgaatatagaaaacctgaatggcaagatccaggagaatacctttaaacagcaggaggaaatttccaagcttgaagagcgggtctataacgtgagcgccgagattatggcaatgaaagaggaacaggtgcacctcgaacaggaaatcaagggggaggtgaaagtgttgaataatattacaaatgacctcaggttgaaggactgggagcacagccagaccttgaggaacatcactctcattcagggccctcctggacctccgggagaaaaaggggaccggggacctacaggggagtccggtcctcgcggattcccagggccgataggccctccggggctgaagggagaccgcggggctattggttttccaggatctcgcgggttgccaggctacgcggggcgccccggcaactccggtcccaaaggccagaagggcgagaagggttcaggcaacaccttacgtcctgtccagctgacagaccacatccgcgcgggccccagttag

SEQ ID NO: 123003 - DNA, 1410 bp, Artificial Sequence
  Description of Artificial Sequence: Synthetic coding sequence
atgtgttacctctccgctatcatctccatcagcctcctcaataaaaagcccagtatggagcaatgggaccattttcacaatcagcaggaagacacagactcatgcagtgaatccgtaaaattcgatgcaagatccatgacggccttgcttcctccgaaccctaagaactcgccttccttgcaggagaagctgaaaagtttcaaggccgcattgattgctttgtacctgctggtctttgcagtgttgatcccactaatcggaattgtggccgcccagctgttaaagtgggaaacaaaaaactgctctgtgagcagcactaatgctaacgacatcacacagtctctgacgggtaagggaaacgactccgaggaagagatgagattccaggaggtcttcatggagcatatgtcaaatatggaaaaacggattcagcacatcctagatatggaagctaatttgatggacactgaacattttcagaacttttccatgacaacagatcagaggtttaacgacattttgttgcagttatctactttgttcagctctgttcagggacacgggaatgcaatcgacgaaatttccaaatcattaatcagccttaacactactttgctagacttacagctgaatattgagaacctgaacggaaagattcaggaaaatactttcaaacagcaggaggagatctccaaacttgaggaaagggtgtacaacgtcagcgccgagatcatggccatgaaggaggaacaggtgcatctagaacaggaaataaagggcgaagtcaaggtcctgaacaacatcaccaatgacctgcggctcaaagattgggagcactcccagacgctgagaaacataaccttgattcagggaccacccgggccgccaggagagaagggagaccgcgggcctaccggagaatccgggcctagggggtttcccggacccatcgggcctcctggccttaagggcgaccggggagctattggctttcctggcagccgcggactgcccggctatgccgggcgtccgggtaactcgggcccaaaaggccagaaaggagagaaaggttccggaaacaccctaacaccattcactaaggtgaggctggtgggaggctctggtccacacgagggccgcgtcgaaattctgcactccggccaatgggggaccatctgcgatgaccgctgggaggtacgggtaggccaggtggtgtgcaggagcctggggtacccaggtgtacaggcagtgcacaaggccgctcacttcggtcagggaacggggcccatttggctgaacgaggtgttttgcttcggccgcgagagtagcatcgaggagtgcaagatccgtcaatggggcacccgggcttgtagccactccgaggacgccggggtgacctgcacactctag

SEQ ID NO: 123004 - DNA, 195 bp, Artificial Sequence
  Description of Artificial Sequence: Synthetic coding sequence
atggagcaatgggatcacttccataaccaacaggaggacaccgattcttgctccgagagcgttaaattcgatgcccgctcaatgacggccctactgccgccaaatccaaaaaatagccctagcttacaggaaaaactcaaatcatttaaagccgcgttgattgctctttatctgctcgtgttcgcagtcttgtag

SEQ ID NO: 123005 - DNA, 399 bp, Artificial Sequence
  Description of Artificial Sequence: Synthetic coding sequence
atggcaatgaaagaagagcaggtgcatctcgaacaggaaattaaaggcgaagtcaaggttctgaacaatataacaaatgacctgcggctcaaggactgggagcattctcaaacgctgcgaaacattactctgatccagggccccccaggcccccccggggaaaagggagataggggtcctaccggtgagtcaggacctagaggtttccctggtcccataggaccaccaggattgaaaggggataggggggccattggatttcccggctccagagggctgcctggatacgctggaaggcctggaaacagcggcccgaaagggcagaagggtgaaaaagggagcggcaataccctgcggcccgtgcagctgacagatcacattcgtgccggcccaagttag

SEQ ID NO: 123006 - DNA, 4203 bp, Artificial Sequence
  Description of Artificial Sequence: Synthetic coding sequence
atggaactgctcccgccactgcctcagagttttttgctcctactgctgctaccggcgaaacccgctgccggagaggactggcaatgcccaaggacgccatacgctgcgagccgggacttcgatgtgaagtacgtagtgcctagttttagtgctggcggcctcgtccaggcaatggttacctacgagggggacaggaatgaaagcgctgttttcgtggccatcaggaatagacttcatgtgctcggccctgacctgaaaagtgtacaatccctggccactggccccgccggcgatcctgggtgtcagacgtgtgccgcctgtgggcctgggccccatggccctccaggcgacacagatactaaggtacttgttttagaccccgccctgcctgcattagtctcctgcggttcttccctgcaggggagatgcttcctgcacgatttggagccacagggaaccgcagttcatctggcagctcccgcctgcctgttttctgcccaccacaataggcccgacgactgtccagactgtgtcgcctcccccctcgggacccgtgtgaccgtggtggagcaggggcaagcttcttacttctatgtcgcttcctccctcgatgccgccgtggcagcaagcttctcaccgcgcagcgttagcatccggagattgaaggccgacgcatccggattcgctcccgggtttgttgccctctctgtgctgcccaagcacttagtctcctactctatcgaatacgtgcactccttccataccggtgctttcgtgtatttcctgacggtccagcctgcgtctgtaacagatgacccgtctgcccttcatacacgactcgcaaggttatcagccacagagcccgagcttggcgattatcgagagttggtgctagattgcagattcgcacctaaaaggcgcagacggggcgcgcccgaagggggtcagccataccccgtcttgcgtgtggctcacagcgctccggttggcgcgcagttggctactgagctttctatcgccgaggggcaagaagtcctcttcggagtcttcgttactggaaaagacggtggaccaggggtcggcccaaattccgtggtgtgcgcattcccaatagaccttttggacacattgatagacgagggggttgagaggtgctgcgagtcacccgttcacccaggtcttcggcgaggactggatttttttcagtcccctagcttttgcccaaaccccccaggactggaggcgctctcccccaatacctcctgtcgacacttccccttgctggtaagttcatcttttagtcgtgtggacctcttcaacggacttctgggcccagttcaggtgacagctctatacgtaacgcggttggacaacgtaacagttgcccacatgggcacgatggacggtcggattctgcaggtcgaactcgtgcggtccctgaactacctgttgtatgtgagcaacttttccctgggcgatagtggtcagcctgtccagagggatgtttctcggctcggggaccacttgctgttcgcttcaggtgatcaggtctttcaggtgccgatccaggggccagggtgccggcactttctgacctgtggtaggtgtctccgggcctggcactttatgggctgcggatggtgcggcaatatgtgcggacagcagaaagagtgcccaggcagctggcagcaggatcactgccctcctaaattaacagagttccaccctcatagcgggcctctgagaggttctacaaggctgactttgtgcggttctaacttctacctgcacccttctggactggtgcccgaaggaactcatcaggtgacagtcgggcagagcccgtgcagacccttaccaaaggatagctccaaattgcgaccagtgccgaggaaggattttgtggaagaattcgagtgcgagcttgagccgctgggcactcaagccgtgggcccaacaaatgtttctctcaccgttaccaatatgccacccgggaagcacttccgcgtcgatgggaccagtgtgctgagagggttctctttcatggaacctgtattaatcgcagtgcaacccctgttcggtccgagggctggagggacatgtctgacactggaggggcagtccctgagcgtggggacaagtagagctgtgctagtcaacggcacagaatgcctgctcgcgcgggtgagcgaaggccagcttttgtgcgctactccccctggcgcgaccgtcgcaagtgtgcccctttctctccaggttggtggcgctcaggtgcctgggagctggacgtttcagtaccgcgaggaccctgtggtgctgagtatctctcccaactgcggatatataaactctcatatcacgatttgcggacagcacctgacttcggcgtggcacctagttctgtctttccatgacgggctgagggccgttgaaagcagatgtgagaggcagctgccagagcagcagctgtgtagattaccggagtacgtggtccgggatcctcagggctgggtggcgggcaatcttagcgctcgcggggatggcgcggcaggctttaccctgcctggattccgttttctccctcctccacaccctccctctgcaaacctcgtgcctctgaaacccgaggagcatgctataaaattcgagtacataggtctgggagccgtcgcagattgcgtgggtattaacgtcaccgttggtggtgagagttgccagcatgaatttcgcggcgatatggtggtctgccccttgccgcccagtctccagcttggccaggatggcgcgccactgcaagtgtgtgtggatggagaatgccatatactcggacgagtagtccgcccgggacccgatggagttccgcagagcacactgttgggtattctgctgcccctgctcttgctggtcgccgcactggccacagctctggttttctcatattggtggaggaggaagcagttggttctcccacccaacctgaatgatctggcctctctggatcagactgctggcgctactccattgccgattctttacagcggctcagactatcgatctggcctggctttgcctgccatagacggtttggatagcacaacgtgcgtccacggtgcctcattttcagactcggaagatgagagctgtgtcccattgttacggaaagagtctatccaactgcgcgaccttgacagcgcgctcctggctgaggtcaaggacgtcctaatccctcacgaacgcgtggtcacccactcagatagggtcattggcaaagggcattttggcgtcgtctatcatggagagtatatcgatcaggcccagaatcgaatccaatgtgcaattaagagtttgtcaagaatcactgagatgcagcaagtggaagcatttctaagggaggggctcctcatgcggggcctgaatcacccaaatgtgttagctctgatcgggattatgcttcccccggaggggctgccacatgtcttgctgccatacatgtgtcatggcgacctcctgcagttcatccgttcccctcagcggaatcccacagtcaaggatctaatcagttttggactacaggtagcaaggagcatggagtatctggctgagcagaaatttgtgcaccgggatcttgcagctcggaattgtatgctcgacgagtcttttaccgtgaaagtagctgacttcgggctggctcgagacatcctggatcgcgaatactattcagtgcagcagcacaggcatgcacgtttgcctgtgaaatggatggcccttgagtccctccagacctatcggtttacaacaaagagcgacgtgtggtccttcggcgttctgttgtgggagctcctcacaaggggcgctccaccttacaggcacatcgatcccttcgatctgacccattttctggcacagggacggcgtctcccccagccggagtactgtccagactccctctatcaggtgatgcaacagtgctgggaggcagacccagctgttaggcccactttccgggtcctcgtgggggaggtcgaacaaatagtgagcgcgctgctgggagaccactacgtgcaattgcctgcaacatatatgaatctcgggccctcgacctcccatgaaatgaatgtacggcccgagcagccccaattttctccaatgcccggtaacgtgcggaggcccagacccctctccgaaccaccccgacctacttag

SEQ ID NO: 123007 - DNA, 4056 bp, Artificial Sequence
  Description of Artificial Sequence: Synthetic coding sequence
atggaactgttgccgcctctgccacagtcttttctcctcctgttgctattacctgctaagcctgctgccggggaggactggcaatgcccccgcactccctatgcagcatcacgtgactttgacgtcaagtacgtggtgccatccttcagcgctggcgggctcgtgcaagcgatggtgacatacgagggcgacaggaatgagtccgcagttttcgttgctattagaaataggctgcatgttctcggccccgatctcaagagtgtccagtcgctcgctaccgggcccgccggcgacccaggttgccagacatgcgcagcctgcggaccggggccccatggccctcctggcgatactgacaccaaggtcctggtactggaccctgcgttgcccgcactggtgtcttgcggtagtagtctgcagggccgttgctttttgcacgatctcgaaccacaagggacagctgtgcatttagccgcacctgcctgtctgttttcagcacatcataaccggcccgacgattgcccagactgtgtggcctcacctctgggcacgcgtgtcaccgtggtcgagcagggccaggctagctacttctacgtggcctcatctctggacgccgccgtggccgctagcttttcgcctcggagcgtgtccatcaggcggctgaaggccgatgcgagcggatttgccccaggctttgtggccttgtcagtgctgccaaaacacctggtttcctactctatcgagtacgtgcactctttccacacaggggctttcgtctactttcttaccgtccaacccgcgagtgtgaccgatgacccttccgccctgcacacaaggcttgcaagactgagcgctacggagccggaacttggcgactaccgcgaactagtgctagactgtcggtttgctcctaaaaggaggcgccgcggtgcaccggaaggaggacagccatacccggtgctgcgggtggcccacagcgctcccgttggtgcccagctggccacggaactgagcatcgccgaaggacaggaagttctgttcggagtgttcgtgactgggaaggacgggggacctggagtgggacccaattccgtggtgtgtgccttccccatcgatctcctggacaccctgattgacgagggcgtagagcggtgctgtgagtctcctgtgcatcctggcttgagacgagggcttgacttcttccaatcaccatctttctgtccaaatccaccagggctcgaggcgctatcccccaacacgtcttgtcgacacttccctctcctcgtgtcatcgagttttagccgcgttgacttatttaacggactcctgggcccggtccaggtcaccgcactctatgttacaaggctagataacgtcaccgtcgcccatatgggaaccatggatggacgtatcctgcaagtggagctggtgcgatcactcaactacttactttatgtgtcaaatttcagcctcggcgactccggccagcctgtccagagggatgtgtccaggctcggtgatcacttgctgtttgcatccggggaccaggttttccaggtgccaattcagggacctggttgtcgtcactttctaacgtgcggaagatgtctcagagcctggcactttatgggatgtggctggtgcggtaacatgtgcggacaacaaaaggagtgccccggcagttggcaacaggatcattgccctccgaagctgaccgaattccacccccacagtgggcccctccgcggtagcaccagacttacgctctgtgggagtaatttttatctccacccgagtggacttgtccctgaaggaacacaccaggtgaccgtgggtcaatctccatgccgccccttgcccaaggactcctccaaactccgtcccgtaccacgcaaagacttcgtcgaagaatttgagtgtgagctagaacccctcggcacacaggccgtgggccccacaaacgtttcactgacagtcacgaacatgcccccagggaaacattttcgtgttgacggtacttccgttttgcgcgggtttagctttatggagccagttctgattgcagtgcagcccctattcggcccccgggccggcggaacctgcttgacactcgaagggcagtctcttagcgtgggtacctctagagccgttttagtgaatggaacagagtgtctactggcgagggtgtcagaaggccagctgctttgtgccaccccgccaggcgccaccgtggcgtctgtccccttgtccctgcaggtgggcggagcccaggtgcccggatcttggacattccaataccgggaagatccagtggtgctctctatcagccccaattgcgggtacattaactcccacatcacaatctgcggccaacacctaaccagtgcctggcacctcgtcctgtcctttcatgacggactgagagcagtggagtctaggtgtgaacggcagctcccagagcagcagctttgtcgtctgccagaatacgtcgtgcgggatccccagggctgggttgctggtaatctgagcgctcgcggcgatggagccgccgggttcactttaccggggtttcggttcctcccccctcctcacccacccagcgctaacttggtgcctctcaaacccgaggagcacgctatcaagtttgaagtctgtgtggatggggagtgtcatatcctaggcagagtggttagacctggtcccgatggtgtgccccaatccactctactgggcatcctgctgccgctgctcctcttggtcgctgcacttgccaccgctctggtgttcagttactggtggcgaagaaagcagctggtgttgcctccaaatttaaatgacctcgcctcactggaccagaccgccggtgccaccccgctgccgatcctctactctggctccgattatcgctccggtcttgccctccctgccatagatggactggactcgacaacatgcgtccacggggctagctttagtgacagtgaggacgaaagctgtgtccctctgctgcggaaggagtctattcaactgcgcgacctggactccgctctcttggccgaagtgaaagatgtgctgatccctcacgagagggtcgttactcattcggatcgtgtaataggcaagggccactttggcgtcgtgtaccacggtgagtatatcgatcaggctcagaatagaatccaatgtgccatcaagagcttatcacgtatcacggaaatgcaacaggtggaggcctttctgcgggaaggcctgctcatgaggggactgaaccacccaaatgttcttgcgctgatcgggattatgctccctccagaaggactcccgcatgttttgttgccttacatgtgccacggagatcttctgcaatttatccgttcaccccagcgcaatcctaccgtgaaagatctgatctcatttggtttacaagtggcccgctcaatggaataccttgcggagcaaaaatttgtgcaccgcgatttggccgctagaaattgtatgctggacgagagcttcaccgtaaaggttgcggattttggtttggcccgtgacatccttgacagagagtactactcagttcagcagcaccgccacgctcgccttcccgtaaaatggatggccttggagtctctgcagacctataggttcaccacaaagagcgatgtctggtctttcggggtgctgctgtgggaacttctgactcgcggcgcccccccatacaggcacattgaccccttcgatctgacccacttcctagcacagggtcgtaggctgcctcagccggaatattgtcccgattccctgtaccaggtgatgcagcagtgttgggaggctgacccagcggttaggcccacattccgcgtcttggtgggcgaagttgagcagatagtatcggcattactgggcgatcattatgtccaactgccagcaacgtatatgaacctcgggccttctacgtcacacgagatgaacgtgcgcccagagcagcctcagttttctccaatgcccggcaacgtaagacgccccaggcctttgtccgagcctccgagacccacttag

SEQ ID NO: 123008 - DNA, 2157 bp, Artificial Sequence
  Description of Artificial Sequence: Synthetic coding sequence
atggaggacctgggcgagaatacaatggtactcagcacactgagatcactcaataacttcatctcccagagggtcgaagggggaagcggccttgatatttcaacgtccgcccccggaagccttcaaatgcagtatcaacagtccatgcagctggaggaacgcgccgaacagatcaggagcaagtctcacctaatacaggtcgagcgggaaaagatgcagatggagctgagccacaaacgggcacgtgtggaactggaaagagcggctagtacttcagctagaaattacgaaagggaggtggataggaaccaggaacttctgacgcgcatcaggcagttgcaggagcgtgaggctggagctgaagagaaaatgcaggagcagctggaaaggaataggcaatgtcagcagaatttggatgccgctagcaagcgattgagagagaaagaggactccctggcccaggccggcgaaacaattaacgcgctgaagggaaggattagcgaactgcagtggtctgtcatggatcaggagatgagagtgaagagactggagtctgaaaaacaagaactccaggagcagttggacctccagcacaagaaatgtcaggaggctaaccagaagatacaggaactccaggcttctcaggaggcacgggccgatcacgagcaacagatcaaggacttagagcagaagctgtcactgcaagaacaggacgccgcaatagtaaagaatatgaaatctgaactggtgcgcttgccccggttggaaagagagctcaaacagctgagagaggagtcagcccacctgcgggaaatgcgggaaactaacggtctgctccaggaggaactggagggactgcaacgtaagttaggaagacaagagaaaatgcaggaaacgctcgtcggattggaacttgagaacgagaggctcctggctaagctgcagtcttgggaaagacttgatcagactatggggctgtctatccgcacgccagaggatctgtcccggtttgtcgttgaattacagcagagggagctggcactcaaagacaaaaactctgcggtgacatccagtgcccgcggactcgagaaggctaggcagcagctgcaggaggagctccgccaggtctccgggcagctgctggaggaacgcaagaagagggagactcacgaggccctcgcaagacgtttacagaaaagagttctgctgctcacaaaagagcgtgacggaatgcgggccattctgggaagctatgacagcgagctcacaccagcggagtattctccacagttgactagaagaatgagagaagctgaagacatggtgcagaaggtgcattcccattccgctgagatggaggctcagctaagccaggctttggaggaactgggcggccagaaacagcgggcagatatgttggagatggagctcaaaatgcttaaaagccaatccagctcagctgagcagagctttctgttctctcgcgaagaagcagataccctgcgattaaaggtggaagagctggagggcgaaaggtcgcgattggaggaagagaagagaatgttagaggcccaactggaaagacgcgctctacagggagactatgatcagagccgaactaaagtacttcacatgtcactgaaccccacctccgtcgctaggcagcgtctccgggaagaccattctcagctgcaggccgaatgcgagagactgcgcgggctcctgagggctatggagaggggaggcaccgtgcccgccgacctcgaagctgcagctgcgagtcttccttcatccaaggaggtcgccgagttgaaaaagcaggttgaatcagcagaattgaagaatcagcggctcaaagaggtatttcagaccaagatccaagaattcagaaaggcgtgctatacactgacgggctatcagattgatatcactacagaaaaccagtaccggctgactagcctgtacgccgagcaccctggggactgtctgatcttcaaggcgacatctccctctggaagcaagatgcagctgctggagaccgaatttagccacacagtcggcgaacttatcgaggtgcatctgcggcgtcaggactctatccctgcttttcttagcagcctgactctggagcttttcagccggcagaccgtcgcatag

SEQ ID NO: 123009 - DNA, 2157 bp, Artificial Sequence
  Description of Artificial Sequence: Synthetic coding sequence
atggaggatttgggagaaaatactatggttctctccacactgaggtccctgaacaacttcatatcacagcgggttgagggtggaagcggccttgacatctccactagcgctcccggctctctccagatgcaatatcagcagtcaatgcagctggaggaacgcgctgagcagataagatcaaagtcccacctcatccaagtggagagagagaaaatgcagatggaactgagccacaaacgggcaagagtcgagttggagagagcagctagcacctcggcacgaaactacgaacgcgaggtagacaggaaccaggagttacttacacggatcagacagctgcaggaaagagaggccggtgcagaagaaaaaatgcaggagcagctggagagaaacagacagtgtcagcagaacctagatgccgcgtccaagcggctcagggaaaaggaggattctcttgctcaagctggggagaccattaacgcgctcaagggccgcattagtgagctccagtggagtgttatggaccaggaaatgagagttaagcgattggagagcgagaagcaggaattgcaggaacaattggatcttcagcataaaaagtgtcaggaagcgaaccagaagatccaggaactgcaggcaagccaggaggcacgcgcagaccacgagcagcagattaaagacctggagcagaaattaagtctccaggagcaagatgcagccatcgtgaaaaacatgaaaagtgagctggttcgactgccccgccttgagcgcgaactgaaacagcttcgtgaagagtctgctcatctgcgcgaaatgcgtgagacgaatggtttactgcaggaggaacttgaaggactgcagcgaaagctcgggaggcaggagaagatgcaagagacattggttggactggaacttgagaacgaacggcttctggctaagttgcagtcttgggaacggcttgatcagacaatggggctaagcatacggacccctgaagacttaagccgctttgttgtcgagctgcagcagagagaactggccctaaaggataaaaactccgccgtaacctcatcagctaggggtctggagaaggcccggcagcagttgcaggaggaactacgccaagtcagcggacaactgctcgaagaaagaaaaaagcgggaaacccacgaggcactcgcacggcggctgcagaagcgggtcttactcctgaccaaggagcgggacggcatgagggccatactgggttcttacgattcggagctgacacccgcagaatatagtccacagctgacccgccgcatgcgggaggcagaagatatggtgcagaaggtgcacagccacagcgctgagatggaggctcaactttcccaagccttagaagagctgggcgggcagaagcagcgggctgatatgctggaaatggaacttaagatgctcaaatcccaatctagctcagcagaacagagcttcctattcagtagggaagaggcagatacattgaggttgaaagtggaggagctggaaggggagcgatcacgactggaggaagaaaaacgtatgctcgaggcccaattggagcgacgtgccttgcaaggcgactatgatcagtccaggacaaaggtgcttcacatgtcactgaacccaaccagcgtggctaggcagcgcctccgcgaggaccattctcagttgcaagcagagtgtgagcgcttgagggggttacttcgagccatggagcggggtggcaccgtgcctgctgatttggaggcggcggccgccagcctcccctcgtccaaagaggttgctgaactcaagaagcaggtcgagtctgcagagctaaaaaatcagaggctgaaggaggtcttccagacaaagattcaggagtttcggaaagcatgctacaccctcactggataccagatcgacattaccactgagaatcagtacaggttgacctccctgtatgctgagcatcccggcgattgcctgattttcaaggccactagtccatcaggctctaagatgcaacttctggagaccgaatttagccacacagtgggcgaactgattgaggtccacttgcggcgccaggatagtatcccagcctttctgagttctctcactctcgaactcttcagcagacagacagtggcctag

SEQ ID NO: 123010 - DNA, 1881 bp, Artificial Sequence
  Description of Artificial Sequence: Synthetic coding sequence
atgctgccggcgaggggctgcgtaagaaagcggacggtgtggcctcgcctggcccgcgtactcatcgttaccctgctgacccttgagttgagctacgctccgttaccgtgtcagttatctggcgttccatacaacaccggagatcctgtagggcggtgggcccgcccatgtatttggccttgtccctggcacactacaatcaacgctctcaagggccggatttctgaactccaatggtctgtaatggaccaggagatgagagtgaagcgtctcgaatccgagaaacaggaacttcaggagcagctggacttgcaacacaagaagtgccaagaagccaatcagaagatacaggaactccaagcaagccaagaggcgagagccgaccacgagcagcaaatcaaggacctcgagcagaagctgtctctgcaagaacaagacgcagccattgtgaagaatatgaaatctgagctggtccgcctcccccgcctggagcgggagctgaagcagctcagagaggagtctgctcacctgcgtgagatgagagagacaaatggtctgctccaggaggagctggaaggtcttcagcgaaagctgggccgacaagagaagatgcaggagacgctcgtgggcctggaactggagaatgagcgactcttggcaaagctgcaatcatgggagagattagatcagacaatggggctgtccatccgcactcccgaggatctatcacgcttcgtggtcgagctgcaacagcgggaacttgcattaaaggataaaaatagcgccgtcacctcctcagcacggggtttggagaaggcccgacagcaactgcaggaggagttgagacaagtgtccggacagttgctagaggagcgcaaaaaacgagaaacacatgaggccctcgctcgaagactgcaaaagagagtgctcttgctgacaaaggaacgtgacggaatgcgggccattttgggctcttatgactcagagcttactcctgccgaatattctcctcaactcactaggcgcatgcgcgaagccgaggatatggtacagaaagtgcatagccatagcgccgaaatggaggcacagctgagccaggcactggaagagctgggcggccaaaagcagcgagctgatatgctggagatggagctgaagatgttgaaaagtcagtcctcttcagctgagcaatcattcctgttctcccgagaagaagcagacacactgagactcaaagttgaggagcttgaaggcgagcgatcccgactggaagaggaaaaaaggatgttggaagcccagctcgagcggcgcgccctacaaggggattacgaccaatcacggactaaggtgcttcacatgtcactgaacccaactagtgttgcccgacagagattgagggaggaccatagccagcttcaggccgaatgcgagcggctgagaggcctgcttcgggctatggagcgaggagggacggtgccagccgacctggaagctgccgctgctagtcttccatctagtaaagaagttgctgaactgaagaagcaggttgaatccgccgagctaaagaatcagaggctgaaagaggtcttccaaacgaagatacaggaattccgcaaggcctgttacaccctcaccggttatcagatcgatatcaccaccgagaatcagtataggctgacaagtctatatgcggaacatcctggtgattgcctgatattcaaggctacaagtccctccggttcaaagatgcagctgctcgagaccgagttcagccatactgtgggcgagttgatagaagtccaccttaggcggcaggacagtattccagcatttctgtcaagcctgacacttgaactattcagcagacagaccgttgcctag

SEQ ID NO: 123011 - DNA, 2157 bp, Artificial Sequence
  Description of Artificial Sequence: Synthetic coding sequence
atggaggacctcggcgagaatactatggttctttcgaccctcagatctctgaataattttatcagtcagcgggtggaaggtggtagtggccttgacatcagtacctcggcccccggatccctgcagatgcaatatcagcaatccatgcagctggaggaacgtgccgagcaaattagatccaagtctcacctcatccaggtcgaaagggagaagatgcagatggaactttctcacaaaagagccagggtggaactagagcgtgccgcctccacctccgctaggaactacgaacgagaagtggaccgaaatcaggaactgctcacacggattcgccagcttcaggaacgggaggcaggtgctgaggaaaaaatgcaagaacaactggaaaggaatagacagtgtcagcagaatctagatgccgcctctaaacggctgcgggagaaagaggattccctcgctcaggccggtgaaacaatcaatgctctcaagggccgaatcagtgagttacagtggtcagtgatggatcaggagatgagagtgaagcgtctggaatctgagaagcaggaactgcaggagcagctggacctgcaacacaaaaagtgccaagaggctaatcagaaaatccaggagctacaggccagtcaagaagcccgggccgatcacgaacagcagatcaaagacttggagcagaagctgagccttcaggagcaggacgccgccatcgtaaaaaacatgaaatctgagctcgttcgactgccgcgactagaacgtgagttgaaacagcttcgggaggagtcagcccatctcagagaaatgcgggaaactaacggtctgcttcaggaagaactcgagggcctacagcgtaagttggggagacaggaaaaaatgcaggagacactggtgggcctggaactggagaacgaaagacttctggctaaattacagagctgggaacgactggatcaaacaatgggcctcagcatccggaccccagaggacctatcccgttttgtggtggagctgcagcagcgggagctggccctgaaagataaaaattctgccgtgacatcgtcagcacgtggcctggagaaggcccggcagcagctgcaggaggaactgaggcaggtcagcggtcagctgctagaggagcgaaaaaaacgcgagacccacgaggcgctggcgcgcaggctccagaagcgtgtgctattgctcacaaaagagagggacggaatgagagccattctgggcagctatgatagcgagctgacacccgccgaatacagtcctcaattgactcgccgaatgcgagaggctgaggatatggtccaaaaggtccattctcactctgcagagatggaagctcagctgtcacaggccctggaggagttgggaggacaaaaacagcgggctgatatgctggagatggagctgaagatgctaaagtcccagtcttctagtgccgagcagagttttctcttctcccgggaggaagcggacacattacgactcaaggtggaggaactggaaggcgaaaggtcaaggttggaagaggagaagaggatgctggaggctcaactcgagcggagagcactccagggggattacgaccaatccaggactaaggtattgcatatgtctctgaacccaacctccgtcgctcggcagcgactgagagaagatcattcacagcttcaggctgaatgcgagcgtctccgcggcctgcttagagctatggagcgaggtggcaccgtgcccgcagatctggaagccgcggctgcttccctgccatcctcaaaggaggtggccgagctcaagaaacaagtggaatcagccgagctgaaaaaccagaggctaaaagaagtctttcaaaccaagatccaggagtttcgcaaggcttgctacacactcacaggctatcagatagatataacgacggagaatcagtaccgactgaccagcctgtatgcagaacatcccggtgattgtctcatcttcaaggccacctctccatccgggagcaagatgcagctcctcgagacagagttcagtcatacagtaggggaactgattgaggttcacctgcggagacaggatagtattcccgccttcctctctagcctgactttagagctgttctcccgacaaacagtcgcctag

SEQ ID NO: 123012 - DNA, 474 bp, Artificial Sequence
  Description of Artificial Sequence: Synthetic coding sequence
atggaagacctaggggaaaacaccatggtgcttagtaccctcagaagcctgaacaatttcatcagccagagggtggaagggggttcaggactggatatttctacgtcggcgcctggatccctgcagatgcagtaccagcagagtatgcagctggaagaacgggcggagcaaatccgtagtaagtctcatcttattcaggtggaacgagagaaaatgcagatggagttgagccacaaaagggcccgcgtcgagctcgaaagagcagcatccaccagcgcacggaattatgaacgcgaggtcgaccggaaccaagagctgctgacccgaataagacagctccaggagcgcgaagcgggagctgaggagaagatgcaggagcagttagaacgaaacagacagtgccagcagaatttggacgctgcttcaaagcgcctgcgtgaaaaggaggactctctagcccaggcaggcgaatag

SEQ ID NO: 123013 - DNA, 810 bp, Artificial Sequence
  Description of Artificial Sequence: Synthetic coding sequence
atgcgggaactggagttcgcaaagctcgaatgctgtctcgcttggcagctccaggcatcacggagagaactggagatggaattaaaaatgttgaagagccagagcagctcagcagagcagtcttttctgttctcccgggaggaagctgataccttacgcctgaaagtcgaagaacttgaaggagagagatcacggttggaggaagagaagaggatgctcgaggcacagttagagcgacgggctctccagggagattatgatcagtcccgcacaaaagtgcttcatatgtccctgaaccccacatcagtggcccgccaaaggctgagggaggaccacagtcaactccaggcagagtgtgagcgcttgagaggactgcttcgagccatggagcggggcggcacggtacccgctgacttggaggctgccgccgccagcctgccttcttcaaaggaggtcgccgaacttaagaagcaggttgaaagcgctgaactaaagaatcagcgcctgaaggaagtattccagacaaagatacaggaattccgcaaagcctgctacaccctaaccgggtaccagatcgacatcaccacggaaaaccagtataggctgacttctttgtatgcggagcaccccggcgactgtttgatcttcaaggctactagtcctagcgggagcaagatgcaattgcttgaaacagaattcagtcacaccgtcggggaacttattgaagtccacctccggcggcaagacagtatcccagcattccttagcagcctgaccctggaacttttcagcagacaaacagtagcctag

SEQ ID NO: 123014 - DNA, 618 bp, Artificial Sequence
  Description of Artificial Sequence: Synthetic coding sequence
atggctctccagttgtcacgggagcagggcatcaccttgagggggtccgccgagatagtggccgagttttttagtttcggtatcaatagcattctgtaccaaagggggatctacccatccgagacatttaccagggttcagaaatacggcctgacattacttgtcacaaccgacttggaactgataaagtatcttaacaacgtggtcgagcaacttaaggattggctgtacaaatgcagcgtccagaagctggtggtggttataagcaacatcgagtccggcgaggttctggaaaggtggcagttcgacatcgagtgcgacaaaacagctaaagacgattccgctccacgggagaagtctcagaaagccattcaggacgaaatccgaagcgttattcgtcagataactgctactgtcacctttctgccattgctggaggtgtcatgtagcttcgatctattgatatacacggataaggatctcgtcgtgcccgaaaagtgggaggagtccggcccgcagtttataacaaactctgaagaagtgagattgaggtcttttactaccacaatccataaagttaactcaatggtggcttacaagatcccggtgaatgactag

SEQ ID NO: 123015 - DNA, 1212 bp, Artificial Sequence
  Description of Artificial Sequence: Synthetic coding sequence
atgccaaaccgcaaggcctccaggaacgcatattactttttcgtgcaagagaaaatcccagaattacgtagacgaggcttgcccgtggcgagagttgctgatgcaatcccctattgtagtagcgactgggccaagcctgtgtttactcctcttcgaaggcctggcatgctggttcctaaacaaaacgtgtcgccacccgatatgtccgctctctcacttaaaggtgatcaggctctgctcggaggcatcttctattttctgaacatcttctcccacggcgagctgccccctcattgtgaacagagatttctcccctgtgaaattgggtgcgtgaaatacagcctgcaggaaggcatcatggctgactttcatagctttattaacccaggcgagatccctcgtggtttcagattccactgtcaagcagccagcgattcctcccacaagattcccattagcaactttgagcgcggtcacaaccaggccactgtactgcagaacctgtaccgcttcatccatcccaatccaggaaactggccacctatttattgtaaatccgatgatcggacccgggtgaactggtgtctgaaacatatggccaaggccagcgagatacggcaagacctgcaactgctgacagtcgaagatcttgtggtgggcatctaccagcaaaagtttctgaaggagcctagcaaaacttggattcggagcctcctggatgtggccatgtgggattatagctcaaatacgagatgcaagtggcatgaggagaacgacatccttttttgtgccctcgctgtttgcaaaaaaattgcctactgtatctctaacagcctcgctacgctgttcggaattcagctaactgaagctcatgttccactgcaagactacgaggcaagtaacagtgtcacacccaaaatggtcgtacttgacgcgggtcggtaccaaaagttgcgtgtaggatcctccggattctcccactttaatagcagcaatgaagagcagcgttctaacaccccgattggagattatccatctcgcgccaaaatcagtggtcaaaactcttccgtacgaggccgcgggatcactagattgcttgaatcaatctccaactcttctagtaatatccataagttcagcaattgcgacactagtctatctccctacatgagccaaaaagatggttacaagtccttctccagcctctcttag

SEQ ID NO: 123016 - DNA, 1305 bp, Artificial Sequence
  Description of Artificial Sequence: Synthetic coding sequence
atgcctaataggaaagccagcagaaacgcttactatttttttgtgcaggaaaaaattcccgaactaaggcgcaggggcttgccggtcgcaagagtcgctgatgccatcccttactgttccagcgactgggccctgctgcgggaggaggaaaaagagaaatacgccgagatggcacgggaatggagggcggcccaggggaaggatcccggtccttctgagaagcagaaaccagtgttcaccccgctccgccgaccaggaatgctagtgcctaagcaaaacgtttcccccccggacatgagtgctctgtctcttaagggagaccaggcactgcttggaggaatattctatttcctgaacatctttagccatggagagctgccaccacattgtgagcagcgcttccttccatgcgagatcggatgtgtaaagtattctctgcaagaagggataatggcagacttccatagctttattaatcccggagaaattccgcgcggttttaggttccattgccaggctgcttctgacagcagccataaaatacctatttcaaattttgagagggggcataaccaagccaccgtgctgcagaacctctatcggttcattcatccaaatcccggaaattggcctcccatttattgtaagagcgatgacaggacacgcgtgaactggtgcctcaaacatatggcaaaagcctccgagatcaggcaggacctgcagttattgactgtggaggatctggtcgtgggcatctatcaacagaagttcttgaaggaacctagtaagacttggatacggtccctgctcgacgttgccatgtgggattatagcagtaatacacggtgtaagtggcacgaggagaacgatatactcttctgcgccctggccgtgtgtaagaagattgcttattgcatcagtaattccctagcaaccctgttcggaatccagctgacagaggcacatgtacccctgcaagactatgaggctagcaactcagtgactccaaagatggtagtcctggatgctgggcgataccagaagctaagagtcggatccagcggatttagtcatttcaattctagtaatgaggaacaacggagcaatacccccataggcgactatccttcccgcgcgaagatttcaggccagaattcctctgttaggggtcgaggtataactagactgttagagtctatcagtaactcttcttctaacatacacaaattctcaaattgtgataccagcctaagcccctatatgtctcagaaagatggctacaagagcttttctagcttaagctag

SEQ ID NO: 123017 - DNA, 951 bp, Artificial Sequence
  Description of Artificial Sequence: Synthetic coding sequence
atgccgaaccggaaagcaagtagaaacgcctactacttttttgtgcaggaaaaaatcccggagttgaggcggcggggtctgcccgtggcacgcgtggctgatgcaattccttattgctctagcgattgggcaaagccagtgttcacgcctctgaggagacctggcatgctggttcctaagcaaaacgttagtccgcctgatatgagtgccctctcactgaaaggagatcaggcactgctggggggcatcttttactttctcaacattttttcccatggggaattgccaccccactgcgagcagcgattccttccctgtgaaatagggtgtgttaaatatagtctgcaggaaggaataatggcagatttccactcgttcatcaaccccggggaaataccaagaggcttcaggttccactgtcaggctgcaagcgacagctcccataagatccctatctcgaactttgagcggggccacaaccaggctaccgttctgcagaacctgtatcgattcattcacccaaatccaggcaactggccaccaatctactgcaaaagtgacgaccggactcgggtcaattggtgcctgaagcatatggctaaggccagcgagatccggcaagatctccagctactaactgtggaggatctggtggtgggcatctaccagcaaaagtttctgaaggagcccagcaagacctggattcggtctcttcttgacgtggccatgtgggattactcaagtaacacgagatgtaagtggcacgaggaaaatgacatactattttgtgctctcgctgtgtgcaagaaaattgcttattgtattagtaattctctggctactctgttcggcatccaactgactgaagcccacgtgcctttacaggactatgaggctagcaacagcgtgactcccaaaatggtagtgcttgatgccggaagatatcaatag

SEQ ID NO: 123018 - DNA, 471 bp, Artificial Sequence
  Description of Artificial Sequence: Synthetic coding sequence
ctgctccagcgatgcaagtggcatgaggagaacgatatactcttctgcgcactcgccgtttgtaagaaaatcgcctactgcattagtaacagtcttgctacacttttcgggatacagctgaccgaggcccacgtgccacttcaggactacgaggcgagcaattctgtgacacccaaaatggttgttctggatgccggacgatatcaaaaattacgcgtgggatctagtggcttctcacactttaatagctcgaatgaggagcaaagaagtaacacaccaattggtgactacccgtcccgggccaagatctccggtcagaatagctccgtgagagggaggggcatcactcggctcttggagtccatcagtaactcatcctcaaatatacacaagttttccaactgcgatacatctctcagtccgtatatgtctcaaaaagacggttataagtccttcagttctctgtcatag

SEQ ID NO: 123019 - DNA, 747 bp, Artificial Sequence
  Description of Artificial Sequence: Synthetic coding sequence
atggaccaaagacagagaaggattcttgggcaaccactgagcatccccacatcccaaccaaagcagaagcgcacttctatgatttcattcttctccaaggtatcatggaaattacgatttcaaaaacgcgaacccctcaagaacgtatttttcatactcgccgagcgcgcccgcgacccatcagccaagaagcgtcacatggcaatgagaaacctcggcactatggcgtacgaagcaccagacaaagtgcgcaagtataagaaaatcgtgctcgatctgttagtatacggactgtacgatcctgtcaacctggaggtgatccatgaatctatgaaaaccttgacggtggtccttggcaagattcagggaaaggggctggggagcttctttatcgatattaccctgcagaccaggactctgctagatgatgagaacgacagcctcagatacagcgccttcgtgcttttcgggcagctcgctgccttcgccggccgcaaatggaaaaaattctttacttcgcaggtgaagcagactagggatagtttgctgatccacttacaagatcgaaatccccaggtggctaaagcgtgtaaaaccacgttccaagcctgcagcccgtatttgaaactgaaagaggagtacagctttcagtcggaggaagatcagagaaataccaagctttatcagcagctcagccattatcatcccgaaatcctccagttcttttacgccaacaaaatactttag

SEQ ID NO: 123020 - DNA, 747 bp, Artificial Sequence
  Description of Artificial Sequence: Synthetic coding sequence
atggaccagcgccaaaggcgcatactggggcaacccctaagcatccctactagccaaccaaagcagaagaggacctctatgatttcttttttttcaaaagtaagctggaaactcagattccaaaaacgcgaacccctgaagaacgtcttctttatcctcgctgagagggccagggatcctagcgcaaaaaaaagacacatggccatgcgaaatctgggaactatggcctatgaagctcccgacaaggtgaggaaatacaagaagatcgttctggatctgctggtatatgggctctacgatccagtaaacctggaagtgattcatgaaagtatgaagacacttactgtggtgctgggaaaaattcagggcaaaggtctgggatccttctttatagacatcacactacagactagaacacttctggacgacgagaacgattccctgcgctactcggccttcgtactgttcggacagctcgcagcatttgcgggtagaaagtggaagaaattcttcacgagtcaggtgaagcagactcgggacagcctacttatccatctccaggaccggaatcctcaagtggccaaagcctgcaaaacaacctttcaggcctgtagcccctacctgaaactgaaagaggagtacagttttcaatctgaggaggatcagagaaatactaagctctatcagcagcttagccattaccacccggagatattgcagtttttctatgcaaacaaaattctttag

SEQ ID NO: 123021 - DNA, 591 bp, Artificial Sequence
  Description of Artificial Sequence: Synthetic coding sequence
atggaccaacgccaaaggaggattcttggccagcctctgagtattcccacatcccaacccaaacagaaacgcacctccatgatttctttcttcagcaaagtctcgtggaagttacggttccagaagcgtgagccattaaagaatgtgttctttattctagcagagagagcgcgggatccatccgcgaagaagaggcacatggcaatgaggaacctgggcaccatggcttacgaggcaccggacaaagtgaggaagtataagaagattgtgctcgatctgctggtgtacggcctttatgaccctgtcaatctggaggttatccatgagagcatgaagacactcacggtggtccttggaaaaatacagggaaaaggtctgggtagctttttcattgacataactctgcagaccaggaccctgctggatgatgcatgtaaaaccacatttcaggcctgctctccctatttaaagctcaaggaggagtacagcttccagagtgaagaagatcagcgcaacacgaagctatatcagcagctgagtcattaccaccctgagattttacagtttttctacgcgaacaagattctctag

SEQ ID NO: 123022 - DNA, 633 bp, Artificial Sequence
  Description of Artificial Sequence: Synthetic coding sequence
atggcctgggggtcgaagggcatccaaggatgggaaaatctggccgagagcagccatttggccactactcgcgagtcgtctcctccagagtcaggcacaggtagcggctcttcccgagggtcacggctccaagagccccaggtaagttggaaattaagattccagaagcgcgaaccattgaaaaatgtatttttcatacttgctgaaagggcaagggacccatctgccaagaagaggcacatggccatgcggaatctgggcacaatggcttatgaggcgcccgacaaggtccgtaagtacaagaaaatagttctggatctgctcgtgtatggtctttatgatccggttaacctcgaggtgatccatgagtctatgaaaacccttaccgtggtcctggggaagattcagggcaagggcctgggttccttcttcattgatataactttgcaaacgcgaacactactggatgatgcctgtaagaccactttccaggcttgtagcccttatctcaagctcaaagaggaatactcttttcaaagcgaggaagatcagcgcaacacaaaactgtatcagcaactgtctcactaccacccggagatcctgcagttcttttacgcaaacaagatactgtag

SEQ ID NO: 123023 - DNA, 789 bp, Artificial Sequence
  Description of Artificial Sequence: Synthetic coding sequence
atggcatggggcagcaagggaatccagggatgggagaacctggccgagtcctctcacctggccaccacgcgggaatcctcacctccagagtcgggcactggctccggttcctcacgcggatcgaggctgcaggaaccacaggtctcatggaagctgcgctttcagaaacgggaaccgctcaaaaacgtgttttttattctcgcagaacgagcaagagacccatctgccaaaaaacgacacatggctatgcgcaaccttggtactatggcatacgaggcccccgacaaagtgaggaaatataaaaagatcgtgcttgacctgctggtgtatggcctgtatgacccagttaacctggaagtgattcatgagagtatgaaaacactgacggtggtcctgggaaaaatccagggcaagggattgggctccttcttcattgatatcacacttcaaaccagaaccctgctggacgacgagaacgactcccttcgatacagcgctttcgtcttgttcggacagctagccgcatttgccggcagaaagtggaagaaattctttacatctcaggtgaaacaaacccgtgacagtctactcatccacctccaggaccgcaacccgcaggtggctaaggcttgtaagaccactttccaggcatgtagcccatacttgaaactcaaggaggaatactcctttcagtcagaggaggatcagaggaatactaaactatatcagcagctaagccactaccaccctgagattttgcagtttttttacgctaataagatcctgtag

SEQ ID NO: 123024 - DNA, 591 bp, Artificial Sequence
  Description of Artificial Sequence: Synthetic coding sequence
atggaccagagacagaggcgaattttgggtcaacccctcagtatcccgacatcccagccaaaacaaaagagaacttcaatgatctcattctttagcaaagtgagctggaaactacggtttcagaaacgagagcctttgaaaaatgttttctttatcttggctgaaagagccagagaccccagcgcaaaaaagcgacacatggctatgcgaaacttgggaacaatggcttacgaggcccctgacaaggtaagaaaatataagaaaatcgtgcttgacctcctcgtatatgggctctatgatccagtaaatttagaagtgattcatgagagcatgaagacacttaccgtggttttgggaaaaattcagggcaagggcctgggatctttttttatcgatatcacactccagacgcggaccctcctggacgatgcttgtaagacaaccttccaggcctgcagtccctatctgaagctgaaggaggagtatagtttccagtccgaggaagatcaaagaaatactaagctttatcagcagctgtctcactatcatcccgagattctgcaattcttttacgcaaacaagatattatag

SEQ ID NO: 123025 - DNA, 771 bp, Artificial Sequence
  Description of Artificial Sequence: Synthetic coding sequence
atgaagttgctggaaaacagtagtttcgaagcgattaattctcagctaaccgttgaaactggcgacgcccatattatagggagaattgaatcatactcctgcaagatggccggcgacgataaacacatgtttaagcagttttgccaagaaggtcaaccccatgtcctagaggccctgtcccccccgcagacatctgggctgtctccatctcgtttgtctaagtcccagggcggagaagaagagggacctttgagcgataagtgcagccgcaagacccttttttatcttatcgcaaccctgaacgaaagctttaggcctgattatgacttctcaacagcccgaagtcacgagttctctcgtgagcctagtctgtcttgggtggtcaatgccgtcaactgcagcctattctctgcggtgcgtgaggattttaaagatttaaagcctcagctgtggaatgccgtggatgaggaaatatgcttagccgagtgtgatatctattcttacaaccctgaccttgacagcgatccttttggcgaggacggatccctgtggtctttcaattactttttctacaataagcggctgaaaagaatagtatttttctcctgcagaagcatttctggatccacatacacacctagcgaggccggcaatgagttggacatggaactgggtgaggaggaggtcgaggaagagtcccggagtggaggatccggagccgaagagaccagcacaatggaagaagatagggttccggttatctgcatctag

SEQ ID NO: 123026 - DNA, 213 bp, Artificial Sequence
  Description of Artificial Sequence: Synthetic coding sequence
atgaagctgttggaaaatagttcgtttgaagccatcaactcccagctgacagtggagactggggacgcacatatcatcggcagaatcgaatcctatagttgcaagatggcaggagatgacaagcacatgtttaaacagttttgccaggagggtcagccacacgtattagaagcactctcccctccgcagacgtctggtctctcaccaagttag

SEQ ID NO: 123027 - DNA, 771 bp, Artificial Sequence
  Description of Artificial Sequence: Synthetic coding sequence
atgaaacttctcgagaacagttcattcgaagccattaacagccagctcacagtggaaaccggggacgcccacataataggcaggattgaaagttattcatgcaaaatggcgggagacgacaagcatatgtttaagcagttttgtcaggaagggcagccacacgttctggaggcactctcacccccccagacatccgggctctcaccttcccggctgagcaagagtcagggtggggaagaagagggtcctttgtccgataagtgctcacgaaagacactgttttacctgattgcgacactaaacgaaagcttccggcctgattacgactttagcacagcccgatcccatgagttttcgcgcgagccctcattgagttgggtcgttaacgcagtgaattgttccctgtttagcgcagtacgagaagacttcaaggatttgaaacctcagctctggaacgccgtagacgaagagatctgcttggccgagtgtgacatttattcttataatccagatctggacagtgatccgtttggtgaagatgggtccctctggtcttttaactacttcttctataacaagaggctgaagagaatcgtcttcttttcttgcaggtccatatcaggatcaacatacacaccttctgaggccggaaatgaactggacatggaacttggcgaagaagaggttgaagaggagtctcgatctggcgggagtggagcagaagaaactagcaccatggaagaggatagagtcccggtcatttgtatatag

SEQ ID NO: 123028 - DNA, 1104 bp, Artificial Sequence
  Description of Artificial Sequence: Synthetic coding sequence
atgcgtaaagggaaaggccctatctgtctcttcagcaggcctacgcttaggccaagccgctctaaagtgtccctgattgagggccggggagccaacatggctgcccgttggcggttctggtgcgtgtccgtgacaatggtggtggctcttctcattgtctgtgatgttccgtccgcttcagcccagagaaaaaaagagatggtcctgtctgagaaggtctcccaactcatggaatggacaaataagaggccggttatacggatgaatggtgacaaatttcggagattggtgaaagcaccgccgcgtaattatagcgttattgtgatgttcaccgcactacagttacacagacagtgcgtggtgtgcaaacaagccgatgaggaatttcagattttagcaaactcttggcgatactcctctgcatttacaaacaggatatttttcgcaatggtggattttgatgaaggaagcgacgtttttcagatgcttaatatgaattcagcccctacattcatcaactttccggcaaaggggaagccaaaacgtggagacacttatgagctgcaggtgagaggcttctccgccgaacaaattgcgcggtggattgccgacagaaccgacgttaacatccgggtcatcaggccaccaaactatgctggccccctgatgctaggactcctgctcgccgtgattggaggcctcgtgtacctcagacggtctaacatggagttcctcttcaataaaaccgggtgggccttcgccgctttgtgcttcgtccttgcgatgacgtccggccagatgtggaaccatattaggggaccaccttacgcccacaagaatccccacacaggacacgttaattacattcacgggagctctcaagcccagttcgtggctgagacccatatagtgctactgttcaatggtggcgttactctgggcatggtgttattgtgcgaagccgcaacctctgatatggacatcggtaaacgcaagattatgtgcgtggccggcatcgggctagtggtgctgtttttttcctggatgctgtcaatatttagatcaaagtaccacgggtacccatattcttttctgatgagttag

SEQ ID NO: 123029 - DNA, 657 bp, Artificial Sequence
  Description of Artificial Sequence: Synthetic coding sequence
atggtggactttgatgaggggtcagacgtgtttcaaatgctgaatatgaacagcgccccgacattcataaattttccagccaagggaaagcccaaacgtggggacacctacgagcttcaggtccggggatttagcgctgaacagatcgcccgctggattgccgaccgcacagatgtgaatatcagggttattagacctcccaactatgcgggtcctctcatgttgggcctgctgctggcggtgattgggggccttgtgtacctgcgtagaagcaacatggaattcctgttcaataagacagggtgggccttcgctgccctgtgctttgtgctggccatgacatcaggacagatgtggaaccacattcgaggtcccccgtatgcgcataaaaacccccacacaggacatgtgaattacattcatggcagcagccaggcccagttcgttgctgagacccacatcgtcttattgttcaatgggggggtaacccttggaatggttctgctttgcgaagccgccaccagtgacatggacatcggtaaacgcaagattatgtgtgtcgcgggaatcggcctcgtggtgcttttctttagctggatgcttagcatctttcgtagtaagtatcacggctacccctactcattcctcatgtcctag

SEQ ID NO: 123030 - DNA, 330 bp, Artificial Sequence
  Description of Artificial Sequence: Synthetic coding sequence
atggaaagtgacttttatcttcgatactatgtgggacacaaaggcaagtttggtcatgagttcctggaattcgagttcagacctgatggcaagctgcgatacgccaataatagtaactacaaaaacgacgtaatgatccgtaaagaggaactggagattgtgatcggggacgagcatatcagctttactacgagtaagatagggtcactgatagacgtcaaccaaagcaaagatccagaaggattaagagtgttttactatcttgtacaagatctaaagtgtttagtgttcagtctcatcggcctgcactttaagatcaagccaatctag

SEQ ID NO: 123031 - DNA, 441 bp, Artificial Sequence
  Description of Artificial Sequence: Synthetic coding sequence
atggagtccgatttttacctgcggtactacgtgggccacaaggggaaatttggccatgagtttctggaattcgaatttcgccctgatgggaagttgagatatgcaaacaattccaattacaaaaacgacgttatgattaggaaggaggcatatgtccacaagtctgttatggaggagctgaaacgcattatagatgatagtgagatcacgaaggaggacgatgcactgtggccaccccccgatagggttggacggcaggagctcgagatcgttataggcgatgaacacatttcatttaccacctctaagatcggctcactgatcgatgtcaaccagagcaaggacccagagggacttagagtattctattacctggtacaggatttaaagtgcctagttttttccttaatcggtctgcactttaagataaaacccatttag

SEQ ID NO: 123032 - DNA, 1731 bp, Artificial Sequence
  Description of Artificial Sequence: Synthetic coding sequence
atgggctccatcctgtccagacggatcgctggcgtggaagacatcgatatccaggccaattccgcataccgctatcccccaaaatctggaaactatttcgcctctcatttcttcatgggaggcgagaaatttgacactccccaccccgagggttatctgttcggggaaaatatggatttgaactttctagggtcgagaccagtccaatttccctacgtcacaccagcccctcacgaacctgtaaagactttaaggagcttggtgaacattcgcaaggactccttacggctcgttcgttacaaggacgacgcagattcgcctactgaagatggggataaaccgcgagtactgtatagcctggaattcacttttgatgcagatgcaagagtggccattaccatctactgtcaggcttccgaggagttcctaaacggtagagctgtctatagccctaaatccccgtccctccaatctgagacagtccattacaagcgcggagttagccagcagttttcccttccatcttttaaaatcgatttctccgagtggaaggatgacgagctgaacttcgatctcgacagaggcgtatttcccgtggtgattcaagctgtggtagatgaaggcgatgtggtcgaggtgactggtcacgcacatgttctgttagccgcattcgagaaacatatggacggttccttctccgtgaagccgctgaaacaaaaacagatagtggatcgagtgagctacctgctccaggagatctacggcatcgaaaataaaaataatcaggaaactaaaccaagcgatgatgaaaactcagataactctaatgagtgcgtggtctgcctgtccgacttgagagataccctgatcctgccgtgtcgacacctgtgtctctgcactagctgtgcggatacccttcgctatcaagcaaataattgtccaatatgcagacttcccttcagggcgctattacagattcgggctgtgcggaagaagccaggtgcactttcacctgtgagctttagtcccgtgcttgcccagtctctggaacacgatgaacacagctgcccatttaaaaagagcaaaccccaccccgcttcacttgcctccaagaagcccaaacgcgaaacgaactccgactcggtgccacctggctatgaaccaatctcgctgcttgaggcactgaacggattaagagcagtgtcccctgcgattcctagcgcccccctgtacgaggaaattacctattccggaatctcagacggtttgagccaagcaagctgcccactggcagctatcgaccatattctggactcgtcacgccagaaaggacgaccccagtctaaggcccctgattcaaccttgaggagtccttcctcaccgatccacgaagaggatgaggagaaactgagtgaggacgtggacgccccgcctccattaggaggagctgagctagccttgcgggagagcagctcgcccgaaagttttatcacggaagaggtggatgagagctcatcacctcagcaaggtacccgagcagcttcaattgaaaacgtgctgcaagatagcagtcctgaacattgtggtagaggaccacccgctgacatataccttcccggccgccctacatccatggaaacagcacatggtctcgccactacttctcccacatggccgcccctgggtggtccctcccctgatccctccgccgccgaactgacacctttatag

SEQ ID NO: 123033 - DNA, 1659 bp, Artificial Sequence
  Description of Artificial Sequence: Synthetic coding sequence
atgggctcaatcctttcaaggcgaatcgctggtgtagaggacatcgatatccaggctaatagtgcctaccgctaccctcccaagtccggaaactatttcgcatcgcacttctttatgggaggagagaaatttgatacccctcaccctgaagggtatttgttcggagagaatatggacttgaacttccttggttccaggcctgtgcaatttccatatgtgacccccgctcctcacgaaccagtgaagactctgaggtccctggtgaacattcgcaaggactccctgaggttggtcaggtacaaggacgatgctgactctcccacggaagacggtgacaaaccaagagttctttattccctagaatttactttcgacgcagacgccagagtggccatcacgatttattgccaggctagcgaggaattcctcaacggccgcgctgtctactctcccaaaagcccctccctgcagtccgagaccgtgcactacaaacggggggtctcccagcagttcagtttgccctcattcaaaatcgacttttctgaatggaaggacgatgaattaaacttcgacctggacagaggagtatttcccgtcgtcattcaggccgtcgtcgacgagggggacgttgtcgaagtgacaggccacgcccacgttctgctggccgccttcgagaagcatatggatggctctttttcagttaaacctctcaaacagaaacaaattgtcgatagagtgtcatacctcctgcaggagatttatggtattgagaataaaaacaaccaggagaccaaaccgagtgacgatgagaactctgataactccaatgaatgtgtggtgtgtctctcagacttacgtgacacgctgattctcccctgccgccatctgtgtttgtgtacgtcctgcgcggacactctgcgttatcaagcgaataattgtccaatatgcaggttaccatttcgcgcactgctccaaatcagggccgtgcggaaaaagcctggagcactctctccagtttcttttagccccgtgttggcccaatcactggagcacgatgagcacagttgtccgtttaaaaagagtaagccacacccagctagcctggcttcaaaaaagcccaaaagagagacaaactcagattcggttcctccagggtatgagcccatctccttgctggaggcactgaatggcctgagggctgtctcaccggccatcccttctgcaccattgtatgaggagatcacctattccgggatcagcgatgggctctcccaggccagctgtccacttgcagctattgaccatatccttgactcttctaggcagaaggggagaccccagagcaaggcgcccgattcgactctgcgctcaccctcttctccaatacacgaggaggacgaagaaaagttgagtgaggacgtggacgctcctcctccattggggggagccgagctggctctaagagagtccagctcgcctgagtccttcattaccgaagaagtagatgaatcttcttcaccccaacagggtacacgagctgcaagcattgagaatgtgctgcaggattctagtccagagcactgtggcaggggaccaccggccgatatttaccttccagccctgggacctgacagttgcagcgtcggcattgacgaatag

SEQ ID NO: 123034 - DNA, 1596 bp, Artificial Sequence
  Description of Artificial Sequence: Synthetic coding sequence
atgggttcgattctgtccaggcgcatcgcgggagttgaggatatcgatattcaggccaactcggcctaccgctatcctcccaagtccggaaactatttcgcttcacacttctttatgggcggtgagaagtttgatacaccgcaccctgaggggtatctgttcggggaaaacatggacctgaacttcctgggctcccgcccagttcaattcccctacgtcacccccgccccacatgaacccgttaaaacccttagatccctggtcaacattagaaaggactcactgaggctagtgcgctacaaagatgatgcagacagccctaccgaggacggagacaagcctcgggtgctgtattcattagagttcaccttcgatgctgacgctcgggttgcaatcacaatctattgtcaagcctcagaggaatttctaaacggcagggccgtttacagccccaagtcgccctcactccaaagtgagactgtgcattacaagcgtggcgtgtcacagcagttcagcctacccagtttcaaaattgacttcagtgagtggaaggatgatgagcttaattttgacctggaccggggagtcttccctgtcgtcatccaggctgtggtcgacgaaggagacgctgtggtagaagtgaccgggcatgcacacgtgcttcttgcagcttttgagaagcacatggacggctccttcagtgtcaagcctcttaagcagaaacagatcgtggatagggtgtcgtatttactgcaggaaatctacggcatcgaaaacaaaaacaaccaggaaaccaagccgagcgacgacgaaaattctgataattcaaacgagtgtgtggtgtgcctatctgacctgcgggacaccctcatcctgccttgccgccacctatgcctttgtacatcctgcgctgacaccttgagatatcaagccaacaactgtcctatttgtcgactgccgttcagggccctccttcagatccgagccgtgcggaagaaacctggtgcactgtcacctgtgtcatttagcccagtgctggcacaaagcctggagcatgacgaacacagtaattccgactccgtgcccccaggctacgagcccatctctttgctggaggctctgaacggcctccgggcagtctcacctgccatcccttctgcgccgttgtacgaggaaatcacttacagcggcatttcagatgggctcagccaagcatcttgtcccctggctgcaattgaccatattctggacagttcccgacaaaagggaaggccccagagtaaggcccccgattcaacgctccggtccccaagtagtcccatacatgaggaggacgaagagaagctttcagaagatgttgacgcaccccctcctctggggggcgccgaactcgccctcagagaaagtagttctcccgagagcttcattaccgaggaagtggatgagtcttcctcccctcaacaggggacccgggccgcatcaatagagaacgtcttacaggatagctctcccgagcattgtggtcgggggccccctgcggacatctacctgcctgccctaggccctgattcctgcagtgtagggattgatgagtag

SEQ ID NO: 123035 - DNA, 963 bp, Artificial Sequence
  Description of Artificial Sequence: Synthetic coding sequence
atgggaagcatcctctcccgccgcatcgctggagtcgaggacattgacattcaagctaactcagcttacaggtaccctcctaagtccggcaattatttcgccagccatttttttatgggaggcgagaaattcgatacaccacatcctgagggatatctgttcggtgagaatatggacttaaacttccttggttcccggcccgtgcagttcccctatgtgacacctgctccacacgaacctgtcaagactctcagaagtcttgtgaacatcagaaaagatagcctaagactggtgaggtataaggatgatgccgacagcccgaccgaagacggggataaaccaagggtgctctattcgctcgagtttaccttcgacgccgatgcaagggtagccattaccatttattgccaggcttccgaagagttcttaaacgggagggcagtctatagtcctaaatcaccctctctgcaatctgaaacagttcattacaagcgaggcgtgagccaacaattctctcttcctagttttaagatcgacttctccgaatggaaggacgacgaactgaatttcgatctggatagaggcgtttttccggttgtcatccaggctgtagtcgacgaaggcgacgtagtggaagtgacaggccacgcccacgtgctattggcggcatttgaaaagcatatggatggtagcttcagcgtgaagccactaaaacagaagcagatcgtcgacagggtgtcatatcttttacaggaaatctacggaatcgagaacaaaaataaccaggagaccaagccgtcagacgacgagaacagtgataacagtaacgaatgtgtcgtgtgtttgagtgatctccgcgacaccctgattctcccctgccgacatctttgtctctgtacaagttgtgcggacacactgcgatatcaagccaacaactgtccaatttgtaggttgcagctgtag

SEQ ID NO: 123036 - DNA, 1632 bp, Artificial Sequence
  Description of Artificial Sequence: Synthetic coding sequence
atggctaagggtgagggggcagaatctggctctgctgcaggcctattgcccacttccatccttcagagcaccgagagaccggctcaagtgaaaaaagaaccgaaaaaaaaaaagcagcaactgtcggtgtgcaacaagttatgctacgcgttaggaggcgcgccctatcaggtcactggttgtgctctgggctttttcttgcagatatacctacttgatgtcgcacagaaggacgaagaagtggttttttgcttttcttcttttcaggtcggccctttttccgccagcatcattctgttcgtgggaagagcctgggatgcaataaccgacccactcgtcggcctgtgtatcagcaagtccccgtggacatgtctgggtagactgatgccttggatcatcttctctaccccactggccgtgatcgcatacttcctcatctggttcgttcctgactttccccatggtcagacctattggtatctgcttttttactgtctcttcgaaacgatggtgacctgttttcacgtgccttatagcgcattgaccatgtttatttctaccgagcagacagagagggattccgccactgcctaccgtatgaccgtcgaggtcctcggaacagtgctggggaccgcaattcagggtcagatcgtaggtcaagcagataccccctgctttcaagacctcaacagcagcacagttgcctctcaatccgcaaaccacacccacggcaccaccagccacagagagacacaaaaggcgtacctcctggcagcaggcgtgatcgtgtgtatatacataatctgtgctgtgatcctgatcctgggcgtccgcgagcagcgtgaaccatatgaggcacagcagagcgagcccattgcctatttcaggggtctgcgcctggtgatgagtcatggaccttatatcaaactgattaccggtttcctctttaccagtctggcctttatgctggtggaggggaacttcgtgcttttctgcacctatactctcggatttaggaatgagtttcagaacctgctgctggcaatcatgctctccgctacacttaccatcccgatttggcagtggtttctgacacgcttcggcaagaagactgcagtatatgtaggaatcagctctgccgtgcctttcctgatcctggtggcactcatggaaagcaaccttatcatcacatatgcagtcgctgtagctgccggtattagcgtggctgcagcctttttgttgccatggtctatgctccctgatgttatagacgacttccacctgaagcagcctcattttcatggtaccgaacccatcttcttcagcttctacgtgttttttaccaaatttgcctcaggtgtttctctcggcattagcactctgtcccttgattttgccggctatcaaacccggggatgtagtcagcccgagagagtgaagttcaccctcaatatgctcgtgacaatggccccaatcgttctgatcctactgggtttgttgcttttcaaaatgtaccccattgacgaggaaaggaggcgacagaacaagaaagctctgcaggcattgcgggatgaagcgagctcttcaggttgctccgagactgattctacggaactcgcatcaattctctag

SEQ ID NO: 123037 - DNA, 1593 bp, Artificial Sequence
  Description of Artificial Sequence: Synthetic coding sequence
atggccaagggagaaggagctgagtcaggaagcgcagctgggctgctcccaaccagcatcctgcagtccacagaacgtcctgctcaggtcaagaaagaaccaaaaaaaaaaaaacaacagctgtcggtgtgcaataaactgtgttacgcactggggggcgcaccctatcaagtcactggatgtgccctcgggttcttcttgcagatctatttgctggacgtggcacaagttggcccattttctgcctctatcatcctgttcgtcggaagagcctgggacgccataacagacccacttgtcgggctctgcatctcaaaaagcccttggacgtgcctggggaggctgatgccctggatcatttttagtacccctctggccgtcattgcatatttcctgatctggttcgtgccagatttcccacacggccagacgtattggtaccttttgttctattgccttttcgagaccatggtgacttgctttcacgtgccttatagcgccctgaccatgttcatttcgaccgagcagacagaacgcgatagtgccacagcctatcggatgacggtagaagtgctgggaacagtactcggaactgcaattcaaggccagattgtcggacaggccgatactccttgctttcaggaccttaactcatctacggtggcgtcccaatcagcaaatcacacccatgggaccactagccaccgagaaacccagaaagcatatctgttggccgcgggcgtgatcgtgtgcatctacatcatttgtgcagttatcttgatcctcggcgttagagagcagagagaaccatatgaggcccagcagtcagagccgattgcctattttagggggttgcgtctcgtcatgtctcatggtccttacattaagttgattactggcttcttgtttaccagcctcgctttcatgctcgtggagggcaactttgttctgttttgcacgtacacccttggatttcgaaacgagttccaaaatctgctgctggctatcatgcttagcgccaccctgacaataccgatctggcagtggttcttgacaaggttcggtaagaagactgccgtgtacgtaggcatctccagcgctgtcccttttctcatcctagtggcacttatggagtctaacctcattattacctacgccgtggccgtagccgcaggcattagtgtggctgctgccttcctcctgccctggtcaatgctgccggatgtcatcgatgacttccaccttaagcagccccatttccatggcacagagcccattttctttagtttctacgtattcttcaccaagttcgcctcaggtgtctcactggggattagtacattgtctctcgactttgcagggtaccagacacgcgggtgctcccaaccggaacgcgttaaatttaccctcaatatgctggtcacaatggccccgatcgtgctgattttgctcggcctattacttttcaaaatgtacccgatcgacgaggagcgacgaagacagaacaaaaaggcactgcaagccttgcgtgacgaggccagcagctccggctgctccgagaccgattccacagaactagcctccatcctctag

SEQ ID NO: 123038 - DNA, 1125 bp, Artificial Sequence
  Description of Artificial Sequence: Synthetic coding sequence
atggtgacttgtttccacgtcccttactctgctctgaccatgtttatttcaaccgagcagacggagcgagacagcgcaaccgcctacagaatgacagtggaggtcctgggtactgtgttaggtaccgctatccaggggcagatagtgggccaggcagatacaccctgctttcaggacctaaattcttccacagtggcatcacagtctgctaatcacacccatggtaccacttctcatagagagacccagaaagcctacctgctcgctgcgggcgtcatcgtatgcatctacataatatgcgcagttattcttattctgggggtccgcgaacagcgggaaccctacgaagcgcagcaaagcgagcctattgcctacttcaggggacttcgcctggtgatgtcccatggtccctacatcaaactcatcacaggctttttatttacatctctggctttcatgcttgtggagggcaacttcgttttgttctgcacgtacaccttaggttttcgaaacgagttccagaacctgctgctagcaattatgctgtcggccacactgaccattccaatctggcaatggttccttacacggtttgggaagaaaactgccgtgtatgtgggaatcagctccgccgtgccttttctaatcctggtggcgctgatggagagcaatctaatcatcacatacgctgtggctgttgcggccgggatcagtgtcgctgcagccttccttcttccttggtccatgctgcctgacgtcattgacgactttcatctgaaacagccgcatttccacggaacagagccaatttttttttccttttacgttttcttcacgaaatttgcaagcggggtctctttaggaatttcaaccctgagccttgacttcgctggctaccagacgcgcggctgctctcagcctgaacgcgtcaagttcacattgaacatgctggtgaccatggcccccattgtcctgattctgctgggcctgcttttattcaaaatgtatccgatcgatgaggagcggaggcgacagaataagaaagcgctgcaggctctccgcgatgaggccagcagctcggggtgttctgaaaccgatagtactgaactggcaagtattttgtag

SEQ ID NO: 123039 - DNA, 801 bp, Artificial Sequence
  Description of Artificial Sequence: Synthetic coding sequence
atggccaagggggaaggggcggagtctggctccgccgctggcctcctgccgacatccatcctccagtctacagaacgccccgcccagaaggagcccaaaaagaaaaaacagcaactgtccgtctgcaataaactttgctatgccttgggcggtgcgccataccaggtaaccggttgcgcgctaggctttttcttgcagatctatctcctcgacgtggctcaggtgggaccattcagcgccagcataatacttttcgtggggcgcgcatgggacgcaatcactgaccccctcgtgggactgtgtatttcaaagtctccatggacttgcctgggacggctcatgccgtggattatcttttcaactcctctggccgtcattgcctatttcctcatctggtttgtcccagacttcccacacgggcaaacctattggtatttacttttttattgccttttcgaaacaatggtaacatgcttccacgtaccctactccgcgttgacaatgttcatcagcactgagcagaccgagagggatagcgccactgcataccgcatgaccgtggaagtgcttggcactgtgctgggaaccgctatccagggacagatcgtcggccaggctgataccccttgtttccaggaccttaattcctctacagttgcctcacaatctgcaaaccatacccacggaacaacttcacaccgcgagacccaaaaagcgtacctgcttgccgctggcgtcattgtgtgtatctatatcatctgtgccgtgatcctgatcctcggcgtcagagagcagcgctag

SEQ ID NO: 123040 - DNA, 2376 bp, Artificial Sequence
  Description of Artificial Sequence: Synthetic coding sequence
atggctgatgataaagtggctatcctgaccgacgatgaggaggagcaaaaacgaaagtacgtcctggccgatccattcaatggaatctcgagagagccggagccacctagtaatgaaacccccagctccacggagacttcagcaatcccagaggaagaaattgattggatagagaagcattgcgtgaagataaataacgaccttctcatcagcaaggttttctacttcttcttctactccgcatacggatcactgtacccattgctacctgtttactacaagcagttgggaatgtcaccgtctcagtcaggtctgctcgtaggaattcggtacttcattgaattctgcagtgcccctttctggggagtcgtggctgatcggttcaagaaagggaagatagtcttgctgttctccttgctctgctgggtactgtttaacctgggtatcggctttgtgaaaccagccactctccggtgcgtcccaaaaattaggcctactacgcaccctacgaatgcatcccatcagctgaccatccttcccaccaatagcagctttacgtcttttctgactatttctccaaagatgcgtgaaaagaggaacctcttggaaacccgccttaatgtttccgatactgtaacactgcctaccgccccgaatatgaacagtgagccaacgttgcagccccaaacgggcgagatcacaaaccgtatgatggacttgaccctgaactcttcgaccgccactccagtttcgcctggatccgtcacaaaggaaactaccacagtaattgtcactactactaagagtttaccttctgatcaggttatgctcgtgtacgaccaacaggaggtagaagctatctttcttgtgatcctcgttgtagttataattggcgagttcttctccgcaagctccgtgaccatcgtggacactgtgacgctccagtatctgggtaaacatcgtgacagatatgggctccagcgcatgtgggggtccctaggatggggcctggctatgctgagcgtggggattgggatcgattacactcatatcgaagtactaatcgatgggaagggctgtaagcctcctgaataccgaaattatcagatcgtgtttatcgtctttggggtgctgatgaccatggccctgatcgtggctacacagttccggttcagatataaccatttcaaaaatgacgactctaagggaaaggaagtggaaatcccccaggttgagcggaacaactcaacagagagctcagaagaaaccccgaccactacctctcatagtcaggcttttaatttctgggaccttataaagttactgtgtagcgtgcagtatggatcagttctgttcgttgcctggtttatgggctttggttacggcttcgtgtttacatttctgtactggcaccttgaggacttgaacggtacaaccacacttttcggagtatgctctgtgctgagtcacgtaagcgaactgacggcctatttttttagtcacaagcttatcgaactgattggccacattcgggtcctttacatcggacttgcctgcaatactgcacgctacatatacattagttacctcgagaatgcctggactgtattgcccatggaagtcctccaaggtgtgacacacgccgccatatgggcggcctgtatttcatatttaagcgctgctgttcctcccgagctcaggacatccgcgcagggcatactgcaggggcttcacctgggcctcggccgaggctgcggtgccatgatcggcggagtcttggtgaactactttggcgcggcagccaccttccgaggcattggcatggcctgtctggttattctcctcctattcgcccttattcagtggctggccgtgccggacgaggaggaggataaaaccatgctggccgaacgcattcctgtgccgtctagcccagtccccatcgccacgattgacctcgtgcagcagcagacggaagacgttatgccgagaatcgagcctcgcctgccacccaaaaaaacaaagcaccaggaggagcaggaggacgtgaacaagccagcctggggggtgtcatcgagtccctgggtgacattcgtgtatgctctctatcagattaaagaaatgatgcagcttaccagggacaatcgcgcttcagagatacaacctctgcaggggaccaatgaaaatcgggagaatagccctgccgggcgcgcccagccagtgccatgtgagacacattccgatcccagtaggaaccagccctctccagatgccgccgcctcacagacacagacaagccccgcccatccttccgtggacccttgcacggaggagagcgaggagcagcaggctcagctggcggccgggggtcattag

SEQ ID NO: 123041 - DNA, 2376 bp, Artificial Sequence
  Description of Artificial Sequence: Synthetic coding sequence
atggccgacgacaaagtggcaatactaaccgatgacgaggaggagcagaaacggaagtacgtgctggcagacccatttaatgggatttctagggaaccggagcccccttccaacgagacacccagcagcacggaaacgtccgccataccggaggaggagatcgattggatcgagaagcattgcgtcaaaatcaacaacgacctgctcatctcaaaggttttttacttttttttctactccgcctacggcagcctgtatcctttgctgcctgtgtactacaagcagctcgggatgtctcccagtcagagcggcctattggtcggaatccgctactttatcgaattctgttctgctcctttttggggcgtcgtggccgatcggttcaagaaggggaagatcgtgctgctcttctcgcttttgtgttgggttctctttaaccttggcatcggctttgtgaagcctgctacactgcgttgtgtccctaagatacgccccacgacacacccaactaacgccagtcaccaacttacaatcctacccactaatagttcttttacctccttcttgaccatttcccctaaaatgcgggagaagcggaacctcctcgaaacaagactcaatgtgagtgacaccgtcaccctgcctaccgcgcccaatatgaactccgaaccaacccttcagccacagaccggcgaaatcaccaataggatgatggacctgactctaaatagttcaactgccactcccgttagtcctggttccgtcaccaaggagactaccaccgtcattgtgaccaccactaaatccctcccatccgatcaagtgatgctagtttatgatcagcaagaggtagaagccattttcctggtgattttggtggttgtcatcatcggtgagtttttctctgcttcttccgtgactatcgttgatacggtcacactgcagtacctgggcaaacacagagatcgctacgggctgcagcggatgtggggttccctaggctggggcctggccatgttatcagttggcattggaattgactatacacacattgaggtgttgatcgatggaaaaggctgcaagcccccagaatatagaaattaccagattgtgttcattgtgtttggggttctcatgactatggccttgatcgtggccacacagttcaggtttaggtataaccattttaaaaacgacgacagcaaaggtaaagaagtggagattccgcaggttgagaggaacaattcaacagagagttcagaggagaccccaacaacaacttcgcattcacaggcatttaatttttgggatttaataaagctactttgcagcgttcagtacggaagcgtcttgttcgttgcatggttcatgggtttcggatacggattcgtgtttacctttctgtattggcacctggaggacctgaacgggacaaccactctgttcggagtgtgctcagtgctttcccacgtgagtgagctcacggcctactttttctcccacaaacttattgaactcatcggccatataagggtgctttacattggactcgcatgtaatacagctaggtacatctatatctcttatttagagaatgcgtggaccgtgttgccaatggaggtcttgcagggagtgacgcatgcggccatatgggccgcctgcatctcttacttgagcgctgctgtgccgcccgaactgcgcacgtctgcccagggcatcctccagggattgcatctcggacttggccggggctgcggtgccatgataggtggggtgttagtcaattattttggagctgcagccactttcagggggataggtatggcctgcttggtaatcctgttactatttgccttaatccagtggctggcggtcccagacgaagaagaggataaaactatgctcgcagaacgaatccctgtgccatcatcacctgtgccaatcgcaaccatagatctggtacagcaacagaccgaggacgttatgccaaggatcgaacctcgtctcccccctaagaaaactaaacaccaggaggagcaggaagacgtgaataaaccagcctggggcgtcagcagctcaccctgggtaacatttgtgtacgccctttatcagattaaggagatgatgcagctaacacgcgataatcgtgcctcagagatccagcccctgcagggtacaaatgagaatagagaaaattctccagcggggcgagcccagcccgtaccatgtgaaacccactctgatccctccaggaaccagccttctccagacgcggcagcctcacagacccagacttcccctgcccacccgtcagtggacccctgcacagaagagagtgaagagcagcaggcgcagctcgccgcgggcggacactag

SEQ ID NO: 123042 - DNA, 129 bp, Artificial Sequence
  Description of Artificial Sequence: Synthetic coding sequence
atggccgacgacaaagtggctatcctcactgacgacgaggaagaacagaagcggaaatatgtactggccgatccttttaacggaatcagccgcgagcctgaaccccctagcaacgaaaccccgtcttag

SEQ ID NO: 123043 - DNA, 345 bp, Artificial Sequence
  Description of Artificial Sequence: Synthetic coding sequence
atggcagacgacaaagttgcaattctaactgacgatgaggaggagcagaagcgcaagtatgtgttggccgaccccttcaatgggatttccagagaacccgagccaccctctaacgagacaccatcaagcactgagacctctgctattcccgaggaagaaatagactggatagagaagcactgcgttaaaatcaataacgacttactgatttccaaggttttttatttctttttctactcagcatatgggagtctttaccctctactgccggtgtattacaaacagctcggcatgtccccctcacagagtggactgctagtcgggataagatatttcattgagtag

SEQ ID NO: 123044 - DNA, 471 bp, Artificial Sequence
  Description of Artificial Sequence: Synthetic coding sequence
atggctgacgataaggtagctatcttaacggatgacgaggaggagcagaaacgtaagtatgtcctcgctgatccttttaatggtatatcacgggaacccgaacctcctagcaatgaaactccaagctccacagagaccagtgctattcctgaagaagaaatcgattggatagaaaaacattgcgtgaagattaacaacgaccttttaatctcgaaggtgttttattttttcttctatagcgcgtacggctccctgtatcccttattacccgtgtattacaagcagctcggaatgagcccttcgcagagtggattacttgtcggcattaggtactttatcgaattctgttctgcaccattctggggcgtggtcgctgataggtttaaaaaaggaaaaattgtcctgttgtttagcctgttgtgctgggtgctgttcaatctgggaatcggtttcgtgaagcctgcaacttag

SEQ ID NO: 123045 - DNA, 762 bp, Artificial Sequence
  Description of Artificial Sequence: Synthetic coding sequence
atggaagttttacagggtgtgacacacgcagccatctgggctgcttgcatatcctatctatccgccgctgttccacccgaactgaggactagcgcccagggtattctccaaggcctccaccttgggctggggcgcggatgcggcgccatgattggtggagtactggtgaattatttcggcgccgccgctacattccggggaatcggcatggcctgcctggtgatactgctgctgtttgccttgatccaatggctcgcggtacctgacgaagaagaggacaaaaccatgctggctgagcggatcccagtgcctagtagccccgtacctatcgcgactatagatctggtccagcagcagaccgaagacgtcatgccccgaatcgagcctaggctgcctccaaaaaaaaccaaacaccaagaagagcaagaggacgtgaacaaacctgcttggggtgtgtccagctccccatgggtcactttcgtgtatgccctctatcaaatcaaggaaatgatgcagctgacaagggacaaccgcgcatcagaaatacagccactccaggggactaacgaaaatcgggagaactcgcccgccggaagagctcaacccgtaccctgcgaaacacactccgatccaagcagaaatcagccgtccccagatgccgcggcctcccagacacagactagccccgcgcacccatcagtcgacccttgtactgaagagagcgaggaacagcaagcacaactggcagctggtggacattag

SEQ ID NO: 123046 - DNA, 696 bp, Artificial Sequence
  Description of Artificial Sequence: Synthetic coding sequence
atggaagtcttacaaggggttactcatgcagcgatctgggcggcttgcataagctacctctctgctgccgttccccccgagcttcggaccagcgcccaaggcatcctccagggcctgcaccttgggctgggacgcggatgtggcgctatgatagggggggtattggttaactacttcggcgctgcggctactttccggggtatcgggatggcttgcctggtcatcctgctcctgtttgcactgattcagtggttggctgtgcccgatgaagaggaggataagactatgttggccgaacggatccctgtgccaagctctcctgtgccaatcgcaacaatcgatctggtgcagcagcagacggaagacgtcaataagcccgcctggggcgtgagcagctccccatgggttacttttgtgtacgccttgtatcagattaaagagatgatgcagctgacccgtgataatagagcctcggagatacagcccctgcagggaacaaatgaaaatagagagaattcacccgccggcagggcccagccagtcccatgcgagacacattccgatccctctagaaatcagccctcaccagatgccgcagcctcgcagactcaaacctcacccgcccacccatccgtcgacccctgcacggaggaatcggaagagcagcaagcgcagctcgctgccggaggccactag

SEQ ID NO: 123047 - DNA, 1557 bp, Artificial Sequence
  Description of Artificial Sequence: Synthetic coding sequence
atggctggtcttaggaatgagagcgagcaagaaccactgttgggggacactcctgggtcccgggaatgggacatcctcgagactgaggaacattacaaatccaggtggcgaagtattcggattctttacctgacaatgttcctctcatcagtggggtttagtgtggtgatgatgtcaatctggccatatttacaaaaaatcgatcccaccgctgacacctctttcctggggtgggtcattgcatcctattctctgggccagatggtggcgagcccaatattcggactatggtcgaactacagaccccgaaaagaaccactgatagtgtccattttgattagcgtggcggcgaattgtctgtacgcatatttgcatatccctgcgtctcataacaagtactatatgctcgtcgctcgtgggctcctgggaatcggtgccggaaacgtggcagtcgtgcgcagttacaccgctggtgcaacaagtctccaggaacgaacttcctctatggccaatatcagtatgtgtcaggctcttggatttatactcggcccggtcttccagacctgttttaccttcttgggagagaagggcgtgacgtgggatgtgatcaagctacagattaatatgtatactactccagtgttactgtcagcgtttctaggcattctcaacataatcctgattttagctatcctccgggaacacagagtggacgactcaggaaggcagtgcaaatcaattaacttcgaggaagcctcaacagatgaagcacaggtccctcaaggaaacatagatcaagttgccgtggttgcgataaatgtcctgtttttcgttacattgttcattttcgccctttttgaaactattatcacccctttaacaatggatatgtacgcctggactcaggagcaggccgtgttatataatggaatcatcttggctgcgctgggcgtggaagcagtcgtgatcttcctcggcgtcaagttgttatcaaagaaaattggagaaagggctattctgttaggcggtctgattgtagtttgggtgggtttctttattttactcccctgggggaaccaattccctaaaatccagtgggaggatttgcacaataacagcatcccgaacacgacttttggcgaaataattattggcttatggaaatcgcccatggaagatgacaacgaacgcccaaccgggtgttcaatcgagcaggcctggtgcctctacacacctgtcattcatctggcccagtttctaacatccgcggtcctcatcggcctcggctatcccgtgtgcaatttgatgtcatacacactctactccaagatactgggtcccaagccacagggcgtctacatgggctggctgacagcaagcggctcaggagcccgaattctcggccctatgtttatctctcaggtctacgctcattggggacctcggtgggctttctctctggtgtgcggtataatcgtcctgactatcactctcctaggtgtcgtttacaaacgcctgatagcactcagtgtacgatatgggcgcattcaggaatag

SEQ ID NO: 123048 - DNA, 462 bp, Artificial Sequence
  Description of Artificial Sequence: Synthetic coding sequence
atgttcctgtcatcagtcggcttcagtgtcgtaatgatgagtatttggccatacctacagaaaatagatcccacagccgacactagtttcttaggatgggtgatagcctcttactccctgggacagatggtggcatcgccgatatttgggctgtggtctaactaccggcctaggaaggaacctttgatcgtttcaatcctcatcagtgtcgccgccaactgcctctacgcttatcttcatattccagcctctcacaacaaatactacatgctcgtggctagaggccttctaggcattggagcagtattccagacatgttttaccttcctgggagaaaaaggcgtgacttgggacgttatcaagctgcagatcaacatgtatacaaccccggttcttctcagcgcttttctgggcatactgaatattatacttatcttagctattctaagcaaatatcgctag

SEQ ID NO: 123049 - DNA, 555 bp, Artificial Sequence
  Description of Artificial Sequence: Synthetic coding sequence
atgtttctgagttctgtgggattcagcgtggtaatgatgtctatatggccctacctgcagaaaatcgatccaactgccgacacaagttttctaggatgggtcatcgcaagctactcacttgggcagatggttgcctcccccatctttggcctttggtcaaactatcggccacgcaaggaaccactcattgtatcgatactaatctctgtggctgcgaattgtctgtacgcgtaccttcacatcccagcgtcacataataagtactatatgcttgtcgcacgcggacttttaggcattggggccggaaacgtcgccgtggtccggtcctacaccgcaggtgcaacgtctttgcaggaacgcactagttccatggccaatatcagtatgtgccaagccttgggtttcatccttggtccagaaaatatcgtatggatgactcaggaggatagcgtcaaagtgctgatattgaaaaagcaggtgcagatgaagctcagatttcctaaggaaatcttgacacgactcctcctgtggccgtctatgttctgcttcctttag

SEQ ID NO: 123050 - DNA, 750 bp, Artificial Sequence
  Description of Artificial Sequence: Synthetic coding sequence
atgggggagctgatggcattcctgttgcctcttattatagttttaatggttaaacatagtgattcaagaacgcacagcctcagatattttagactgggggtctctgacccaatccacggagtgcccgagttcataagcgtgggttacgtcgacagccatccaattaccacgtatgactctgtcacacggcagaaagagccccgcgcgccgtggatggcagagaatctcgccccagatcactgggagcgatacacacagttgctcagaggttggcagcagatgttcaaggtcgagttgaaacgcctccagcgtcattacaaccatagcgggtcccacacctaccaacggatgatcggctgcgagctcctcgaggacgggagcactactggttttctgcaatacgcctatgacgggcaggatttcctaattttcaacaaagatacactcagctggctagccgtcgacaacgtggctcacaccataaaacaagcctgggaggcgaaccagcacgagctattgtatcagaaaaattggctcgaagaagaatgcatcgcgtggttgaaaaggttccttgaatacggcaaagatacactccagagaacagagagtgagacgatccctcttgtgatgaaagcagtaagcggatctatcgtgttggtgatcgtgctagcaggggtcggagtgctcgtgtggcgacggcggcctagagagcagaacggcgcaatatacctcccaacccctgaccggtag

SEQ ID NO: 123051 - DNA, 783 bp, Artificial Sequence
  Description of Artificial Sequence: Synthetic coding sequence
atgcgacccgaagaccgtatgttccacattcgggccgtgattctccgtgccctctcactcgcttttctcctcagcctcaggggcgccggtgccatcaaagccgaccatgtttcaacctacgccgcgttcgtccagacccatagaccaacaggcgagtttatgttcgaatttgatgaggatgagatgttttacgtagacctcgataagaaagagaccgtgtggcacctggaagagtttggccaggccttctccttcgaggcccaaggtggcctggcaaatattgctattctgaataacaatctaaacacccttatccagagaagcaaccacacccaagctacaaatgatccacctgaggttacagtgttccctaaggaacccgttgaactgggacagcctaacaccctaatatgccatatcgataaattttttccgcctgtgctcaacgtgacttggctctgcaacggagagttggtgacagaaggcgtggccgagtctcttttcctacccagaacagactactcctttcataagtttcattacctcacttttgtcccttccgcggaggatttctacgactgcagagtagaacactgggggttggatcaaccattgctgaagcattgggaagcacaggagccaattcaaatgcccgaaacgaccgaaacagtcctgtgtgcactgggactggtgctgggcctcgtgggcattattgtggggaccgttctgatcattaaatctctgagatcagggcacgaccccagagctcagggcaccctgtag

SEQ ID NO: 123052 - DNA, 783 bp, Artificial Sequence
  Description of Artificial Sequence: Synthetic coding sequence
atgagaccagaggatagaatgtttcatatccgcgcagtgattctgagagccctttcgcttgcttttctactctccctacggggagcgggcgcgatcaaagctgaccacgtgagcacatacgccgccttcgttcagacgcacagacccactggcgaattcatgttcgaattcgacgaggatgagatgttttacgtggacctcgacaaaaaggagacggtttggcatctggaggagtttgggcaggccttctcgttcgaggctcaaggcggcctggcaaacattgctatcctgaacaacaatctcaataccctgatccagagatctaatcatactcaggcaaccaacgacccccccgaagtgaccgtcttcccgaaagagccggtcgaactggggcagcctaacaccttgatctgccatatagataaattcttcccaccagtgctcaacgtgacatggctttgtaatggtgaattagtgacagagggcgtcgccgagagcctgtttctgccaaggacggactactcattccataagttccactatctgacttttgtacccagcgccgaggatttttatgactgcagggtcgaacattggggactggatcagccactcttgaaacactgggaagcacaggagcccattcagatgccggagaccaccgaaactgtgttgtgcgcattgggcctcgtcctgggcctggttggaatcattgtggggacagtgctgataatcaagagcctccggtccggccacgacccccgcgcccagggaactctgtag

SEQ ID NO: 123053 - DNA, 72 bp, Artificial Sequence
  Description of Artificial Sequence: Synthetic coding sequence
atgcggcccgaagatcgcatgtttcacatccgagcggtcatactcagggccctgtctctcgcatttctgtag

SEQ ID NO: 123054 - DNA, 387 bp, Artificial Sequence
  Description of Artificial Sequence: Synthetic coding sequence
tagaacaccttgatctgtcatattgacaagttctttcctccagtacttaatgtgacttggctctgcaacggcgaactagtgaccgaaggggtggccgagtctctgttcctacctaggaccgactatagttttcataagttccattatctgaccttcgtaccttccgccgaagacttttatgattgtagagtggaacactggggtctggatcagcccttgctcaagcactgggaggcccaggagccaatacagatgccggagacaactgagactgtcctttgtgcgttgggcctggtgctaggtctggtgggcatcattgtgggaactgttcttataataaaatccctgaggtcgggacacgaccccagggctcaagggacactttag

SEQ ID NO: 123055 - DNA, 630 bp, Artificial Sequence
  Description of Artificial Sequence: Synthetic coding sequence
atgagacctgaggatcgtatgttccacatcagagccgtcatccttcgggctctcagcctggcgtttcttctgagccttcgcggcgccggcgcaatcaaagcggatcatgtgtctacttatgcggcttttgtgcagacacaccgcccgacaggagaatttatgttcgagtttgatgaagacgagatgttctatgtggacctggacaaaaaggagacagtgtggcaccttgaggaatttggacaggcgttctcatttgaggctcaaggggggctcgccaacatcgccattcttaataacaatctaaacacgctgattcagcgttctaatcatacccaggctacaaatgatccccccgaagttaccgtgttccctaaagagcccgttgagttggggcagccgaatactctaatttgccatatcgacaaatttttcccacccgtgctcaatgtgacatggctgtgcaatggcgaactggtgactgagggagtggctgaatcactattcctgccccggacggattattccttccataaatttcactatttgacctttgtgccatctgctgaagatttttacgattgtcgcgtagagcactggggcctcgaccagcctctcctaaaacactggtag

SEQ ID NO: 123056 - DNA, 783 bp, Artificial Sequence
  Description of Artificial Sequence: Synthetic coding sequence
atgagaccggaggatagaatgttccatataagggcagtaattctgcgtgctctgtccctggcatttttactttccctgaggggcgctggcgccatcaaggccgatcatgtaagtacatatgccgccttcgtacagacgcatcggcccactggcgaattcatgtttgaatttgatgaggatgagatgttttacgtggacctggacaagaaggaaaccgtctggcatcttgaagagtttggccaggccttttctttcgaagcccaggggggcctggctaatattgccattctgaacaataatctgaatactttaatccaacggtcgaaccacacccaggcgacaaacgacccaccggaggtcactgtctttcctaaggagccagtggaactcggacagccgaataccttgatctgccacatcgataaatttttcccaccggttctgaatgtcacttggctatgcaatggagaattggtgacagagggggtggcagaatccctattcttgccccgtactgattattcgtttcacaaattccactatcttacgttcgtgccatctgcggaggatttttacgattgcagagtagaacactggggcctggatcagcccctgctgaaacattgggaggcacaggagcccatacagatgccggagacaactgagaccgtgttgtgtgcccttggtctagtcttgggtctggtggggattatcgttgggaccgtcttgatcataaagagtttacgcagcgggcacgaccctcgggcacaggggactctgtag

SEQ ID NO: 123057 - DNA, 72 bp, Artificial Sequence
  Description of Artificial Sequence: Synthetic coding sequence
atgcggcccgaggacagaatgttccacatccgggctgtcattctgagggccctatccttagcctttctgtag

SEQ ID NO: 123058 - DNA, 783 bp, Artificial Sequence
  Description of Artificial Sequence: Synthetic coding sequence
atgcggcctgaggacaggatgtttcatattagagccgtaatccttcgggctcttagtcttgccttcctgctgagtctcagaggggccggagcaattaaagctgaccatgtgagtacatacgccgcctttgtacagactcataggccgaccggcgaatttatgttcgagtttgacgaggacgagatgttttatgtggacttggacaaaaaagaaacagtttggcatttagaggagttcggccaggccttcagctttgaagcacaaggcggcctagcaaacatagccatcctgaacaacaatctgaacaccctaatacagcgcagcaaccatacccaggcgacaaatgacccgcccgaagtcacggtgttccccaaagaaccagtcgagttgggccaacctaatacgctcatatgtcatatagacaaattcttccctcccgttctcaacgttacatggctttgtaacggtgaactcgtaactgagggcgtggcagaatctttgttcttgcctaggaccgattactcattccataaatttcattatttaacattcgtaccttctgcagaagatttctatgactgtcgtgtggaacactggggcttagatcagcccctcctcaaacattgggaggcccaggaaccaattcagatgccagagacgaccgaaacagttttgtgtgccctgggtctcgtcctgggtctggtggggataatcgtaggaacagtgctgattattaagtctctgagatctggacacgaccccagagctcaggggaccctgtag

SEQ ID NO: 123059 - DNA, 387 bp, Artificial Sequence
  Description of Artificial Sequence: Synthetic coding sequence
tgaaataccctaatctgccatatcgacaaattcttccctcctgtcctcaatgtcacatggctctgcaatggggagctggtgaccgagggagttgctgaaagcctgtttttgccaagaacagactacagcttccacaaattccattacctcacgtttgtgccatctgctgaagacttctatgactgtagagtggagcattgggggctagaccagcccttgctgaagcactgggaggcccaggagcctatccagatgccagagacgaccgaaacagtgctgtgtgccctgggactcgttttgggtctggttggtatcatcgtgggcacagtcctgatcattaaaagcctcaggtccggccacgaccctcgcgcgcagggcacattgtag

SEQ ID NO: 123060 - DNA, 783 bp, Artificial Sequence
  Description of Artificial Sequence: Synthetic coding sequence
atgagaccagaggaccgaatgtttcacatccgcgccgtgattctccgcgctctgtctctagcctttctgctcagcctccgcggcgctggggcaattaaagcagatcacgtctcaacctacgcagcatttgtacagacccatcgacctaccggcgagtttatgttcgaattcgacgaagacgagatgttttacgtggatcttgacaagaaagaaactgtctggcacctcgaagagttcgggcaagcattttcatttgaggcacagggtggattggcaaatatcgccatcctgaacaacaatctcaacactctgatccagagatccaaccatacccaagcaaccaacgatcctccagaggttacggtgttccctaaggaacccgttgagctgggtcagcctaacacacttatttgccatatcgacaaattctttcctcccgtcctcaatgtcacgtggctctgtaatggtgaactcgtgaccgagggcgtggcagagagcctcttcctaccccggaccgactatagtttccacaaattccactatctgacgttcgtcccatccgcggaggacttctacgactgcagagtggaacactggggcctggatcaaccattacttaaacactgggaggcccaggagccgatccaaatgccggagacaacagagactgtcctgtgtgccctaggacttgtgctcggactagttggtataattgtggggaccgtcctgatcatcaaatccctgcgcagcggccacgacccacgcgcccagggcaccttgtag

SEQ ID NO: 123061 - DNA, 72 bp, Artificial Sequence
  Description of Artificial Sequence: Synthetic coding sequence
atgagacccgaagaccgcatgttccatatccgagcagtgattctccgcgccttgtccctggcgtttttgtag

SEQ ID NO: 123062 - DNA, 630 bp, Artificial Sequence
  Description of Artificial Sequence: Synthetic coding sequence
atgcggccagaagacaggatgtttcacataagggctgttatccttcgcgccctttcattagcattcctgctgagtctccgcggtgccggtgcaattaaagctgaccacgtgtctacgtatgctgcttttgtccagacacataggcctactggtgagttcatgttcgagttcgatgaggatgaaatgttctacgtggatctcgataaaaaagagactgtgtggcacctggaggagtttggacaggccttttcctttgaagcacaaggcgggttggcaaacatcgctatacttaataacaatctgaatacgcttattcaacgcagcaaccacacccaggcaaccaacgatccacccgaagttactgtctttcccaaggagccggtggagctgggacagcctaacacgctcatatgccatattgacaagttcttccccccagttctcaatgtcacatggctgtgcaatggagagctcgttaccgagggggttgctgaatcactgtttctgccaagaactgattactcttttcacaaattccattacctcacgttcgtgccctctgccgaggacttttacgattgcagagtggaacactgggggcttgaccagccacttctgaaacattggtag

SEQ ID NO: 123063 - DNA, 72 bp, Artificial Sequence
  Description of Artificial Sequence: Synthetic coding sequence
atgagaccagaagacagaatgtttcatatccgcgcagtcatcttgcgggcgcttagtctggcatttctgtag

SEQ ID NO: 123064 - DNA, 387 bp, Artificial Sequence
  Description of Artificial Sequence: Synthetic coding sequence
tagaatacattgatttgtcacatagacaagttcttcccgcccgtcttgaatgttacctggctgtgtaacggggagctcgtgactgagggagtggcagaatcattgtttctacctcgtactgattactcattccacaaattccactacctgacatttgtgccctcagcagaggatttttatgattgcagagtggagcactggggcctggatcagcccctgctgaagcactgggaggcccaagaacctatccagatgccagagactacagaaacagtcctgtgcgcacttggtctggtgttaggcctcgtaggaatcatcgtaggcacagtgttgattattaagtcactcaggtccggccacgatccccgggcgcaaggaacattgtag

SEQ ID NO: 123065 - DNA, 783 bp, Artificial Sequence
  Description of Artificial Sequence: Synthetic coding sequence
atgagacccgaagatcgcatgttccacatcagggcagtgatcttgagggcactgagcctagctttcctgctgagcctccggggtgctggcgcaatcaaagctgaccacgtgagcacctacgccgcgttcgtgcagacacatagacctaccggcgagtttatgttcgagttcgacgaggacgaaatgttttatgtcgatttggataagaaagagacggtgtggcatttggaagagtttggccaagccttttcgttcgaggcacagggaggtttagcaaacattgctatcctcaacaacaacctcaataccctcatccaacgcagcaatcatacccaagcaaccaatgatccgccagaagtgaccgtgttcccaaaagaaccagtggagctggggcagccaaacacgctcatctgccacattgacaagttcttccctcctgtccttaacgtgacatggctctgtaacggggagctcgtgacagaaggggtggcagagtccctgttcctgccgcggacagactatagcttccacaagttccactacctgacattcgtcccctcagccgaagacttttatgactgtagggtggagcactggggcctggatcaacccctgttgaaacattgggaagcacaggagcccattcagatgccagaaacaactgaaacagtcctctgcgctcttgggctggtgcttggtctcgtcggaatcatcgtggggacagtgctgatcatcaaaagcttacgctccggacatgacccccgcgctcagggtactctttag

SEQ ID NO: 123066 - DNA, 387 bp, Artificial Sequence
  Description of Artificial Sequence: Synthetic coding sequence
taaaacactctcatctgccacatcgacaagtttttcccacctgttttaaatgtgacttggctgtgcaatggcgagttggtgactgagggcgttgccgagagcctattccttccgagaaccgactactcctttcataagtttcactatctcacattcgtccccagtgccgaggacttttacgactgtcgagtcgagcactggggccttgatcaacctttacttaaacactgggaggctcaggagcctatacagatgcctgagaccacagagacagtcttgtgtgccctaggcctggtcctcggacttgtcgggattatagtggggacagtgctgattatcaaaagccttcgttccggccacgaccctagggcacagggaactctgtag

SEQ ID NO: 123067 - DNA, 72 bp, Artificial Sequence
  Description of Artificial Sequence: Synthetic coding sequence
atgcgtcccgaagaccgtatgttccacattcgggcagtcatcttgcgggccctgtctttggctttcctctag

SEQ ID NO: 123068 - DNA, 630 bp, Artificial Sequence
  Description of Artificial Sequence: Synthetic coding sequence
atgcgtcctgaagaccggatgttccatatcagggcagtaatccttcgggctcttagtctagcctttttactgtcattgaggggagcaggggccatcaaagccgaccatgtgagtacctatgcggcctttgtacagactcaccgccccactggagagttcatgttcgagtttgatgaggacgagatgttctacgtggatctggacaaaaaggagacagtctggcatctcgaagagtttggacaggcatttagcttcgaagcccagggggggttggcaaatattgctattctgaataacaatctgaacaccctcattcagcggtccaaccacactcaagccacgaacgaccctcctgaggttacggtgttcccaaaggagccagtcgaacttgggcagccgaatactctgatctgccatattgataagtttttccccccagttttgaatgtcacatggttatgtaatggcgaactagtgacggaaggggttgccgagtcgctgttcttacccaggacggattacagcttccataaattccattacctcacattcgtgcccagcgctgaggatttttacgattgccgtgtcgagcattggggccttgaccaaccactcttaaagcattggtag

SEQ ID NO: 123069 - DNA, 639 bp, Artificial Sequence
  Description of Artificial Sequence: Synthetic coding sequence
atgcggccggaagatcgtatgtttcacatcagagccgttatattgcgcgcgctgtcgctcgcgttcctgctcagccttcgcggcgccggggccataaaggctgaccacgtgtcaacatatgctgcttttgtgcaaacccaccgaccaacgggcgagttcatgttcgaatttgacgaagacgagatgttttacgttgaccttgacaagaaggagacggtctggcacctggaggagtttgggcaggctttttccttcgaagtgaccgtgtttcctaaggagcctgtggagttaggacagcccaacacgctgatttgtcacattgacaaatttttcccccccgtcctgaatgtgacttggctgtgcaatggagaactcgtcactgaaggtgtagcagagagcctgttcctccctaggacagattatagcttccacaagttccactacctgacattcgtcccctccgcagaggacttttatgactgccgcgtggaacactgggggttggaccagccactactcaagcactgggaagcccaggagcccatccagatgcccgaaaccactgagactgtactctgcgctttaggcctggtgctggggctggtgggcatcattgtcggaactgtcctcatcatctag

SEQ ID NO: 123070 - DNA, 639 bp, Artificial Sequence
  Description of Artificial Sequence: Synthetic coding sequence
atgcgacccgaggatagaatgttccatattcgggccgtgatcctacgagccctgtccctggcttttctgctgtccctgcgtggcgctggagccataaaagctgaccatgtaagcacatatgccgcctttgtgcagacccacaggcccacaggtgagttcatgttcgagttcgacgaggatgaaatgttctatgtcgacctggacaaaaaggagaccgtatggcacctggaggagttcggccaagcgttcagctttgaggttacagtcttccccaaagaacctgtcgaactgggtcagcccaacaccctcatttgccatatcgataagttctttcctccggtgctgaacgtgacatggctctgtaatggcgagctcgtcacagagggcgtcgccgaatccctttttctaccccggaccgactacagttttcataaatttcattatctgacctttgtgccgtccgccgaagacttctatgactgtagagtggaacactggggcctggaccaacctctgctgaaacattgggaagctcaggagcccattcagatgccagagactacagaaaccgtgctttgtgctctcggcctggttctgggccttgtggggatcatcgtgggcactgtgttgatcatctag

SEQ ID NO: 123071 - DNA, 387 bp, Artificial Sequence
  Description of Artificial Sequence: Synthetic coding sequence
taaaatacactcatttgccacatagacaaattttttcctcctgtgttaaatgtcacatggttatgcaacggggagctggtaacagaaggtgtagctgagagcctattccttccccggaccgactactctttccacaaatttcactatctcaccttcgtacccagtgccgaggatttctatgactgccgggtcgaacattggggtttggaccagcctcttctcaagcactgggaagcccaggagccaatccagatgccagaaacaacagaaacggtgctgtgcgccctgggactcgtgctcggccttgtgggcataatcgtgggcacagtgcttatcattaaaagcctgagatccgggcacgaccctcgcgcccaggggacattgtag

SEQ ID NO: 123072 - DNA, 639 bp, Artificial Sequence
  Description of Artificial Sequence: Synthetic coding sequence
atgcggcccgaagaccggatgtttcatattcgcgcagtgattctccgcgcactaagtctcgccttcctcctgtccttaaggggagcgggcgctatcaaagccgaccacgtatctacatatgctgccttcgtgcagacccatcgacctaccggcgaatttatgttcgagtttgacgaggatgagatgttctacgtcgatctggataagaaggaaacggtctggcaccttgaagaattcggccaagcatttagttttgaggtgaccgttttcccaaaagagcctgtggaacttgggcagcctaataccctgatatgtcatatcgacaagttcttcccgcccgtgctcaatgtgacttggctttgcaacggcgagctggtaacggaaggagtggctgaatcactgtttctcccgagaaccgactatagctttcacaagtttcactacctgacatttgttccaagcgctgaagatttctacgattgtcgcgtcgagcattggggcctggatcagcctcttttgaaacattgggaggcccaggagccaatccaaatgccagagaccactgagaccgtgctgtgcgccttgggcctggtgttggggttggtggggatcatagtggggacagtgctcataatctag

SEQ ID NO: 123073 - DNA, 630 bp, Artificial Sequence
  Description of Artificial Sequence: Synthetic coding sequence
atgcggccagaagatcgaatgtttcacattcgggccgtgattctgagagccctatctctcgccttccttttaagtttgcgcggcgccggcgctataaaggcagatcacgtatcgacctatgccgcatttgtccagacacataggccaactggtgaattcatgttcgagttcgatgaagacgagatgttttatgtggatctggataagaaggaaacagtgtggcatctcgaggaatttggccaggccttctccttcgaagcccagggcggattggctaacattgcgattctgaataataacctgaacacgctcatccaaagaagtaaccatacacaggccacgaatgatcccccagaggtaaccgtatttcccaaggagcctgttgagctgggccaaccaaatactctaatatgccacatcgacaagttttttcctcccgtccttaacgtcacatggttgtgcaatggggagttggtgaccgagggtgtcgctgaatccttgtttctgccgagaaccgattactcgtttcacaaatttcactatctgactttcgtcccctcagccgaggacttctacgactgtcgagtggaacactggggactggatcagcctctgctgaagcattggtag

SEQ ID NO: 123074 - DNA, 72 bp, Artificial Sequence
  Description of Artificial Sequence: Synthetic coding sequence
atgagacccgaagacagaatgtttcacattcgtgcagttattcttagagccctaagccttgcttttttgtag

SEQ ID NO: 123075 - DNA, 639 bp, Artificial Sequence
  Description of Artificial Sequence: Synthetic coding sequence
atgaggccagaagacaggatgttccatatccgggccgtgattctgcgagccctgagcttggcgttcctcctaagtctgcggggcgctggtgccattaaggccgatcacgtgtctacctacgccgcatttgtgcaaacacatcggccaactggcgagttcatgtttgagtttgatgaggacgaaatgttttacgtcgatctagacaagaaagaaaccgtctggcatctcgaagagttcggacaggctttttcctttgaagtcaccgtcttccccaaagagcctgtcgagctcggccagcctaacacactgatatgtcacatcgacaaattcttcccacccgtactgaacgtgacctggctgtgtaacggggagctggtaaccgaaggcgtggccgagagcctattcctgccccgcactgattattcattccacaagtttcactacttaactttcgtgccaagcgctgaggacttttacgattgccgcgtcgagcactggggcctggaccagcctctgctgaagcattgggaagctcaagaacccattcaaatgccggaaaccactgagacggtattgtgtgcccttggcctggtgcttgggctggtagggatcattgtggggacagtcctaataatctag

SEQ ID NO: 123076 - DNA, 630 bp, Artificial Sequence
  Description of Artificial Sequence: Synthetic coding sequence
atgcgaccagaagaccgtatgtttcacatcagggccgtaatattaagagcccttagtctcgccttcctgctctccctgagaggagccggggcaatcaaggcagaccacgtctccacttacgccgcctttgtccagacacaccgaccaactggcgagtttatgtttgagttcgatgaggatgagatgttctacgtggatctcgataagaaggagacggtgtggcacctggaggaatttggacaagcctttagtttcgaagctcaggggggactcgcaaacattgcaatccttaacaataacctcaatacattaatccagcgaagtaatcatacacaggctacgaacgaccctcccgaggtgaccgtcttcccaaaggagcccgtagagctaggacagcccaacacacttatttgccacatagataagttcttcccccccgtgctcaacgtcacctggttgtgtaatggagaactcgttaccgagggcgtcgccgagagcctgttcctgccccgtacagattactcgtttcacaaatttcactatctgactttcgttccaagtgctgaagacttctatgattgtcgggtggaacactggggccttgatcagcctctgctcaagcattggtag

SEQ ID NO: 123077 - DNA, 387 bp, Artificial Sequence
  Description of Artificial Sequence: Synthetic coding sequence
tgaaacactctgatctgtcacattgataaattctttccccccgtgctcaacgtgacctggttatgtaatggcgagctagtcactgaaggcgtggctgagtctctctttctccctcgcacagactactcctttcataaatttcattaccttacatttgtgccgtccgccgaggacttctatgattgccgggttgaacactggggtcttgaccagcctttactgaagcattgggaagctcaggaacctattcagatgccggagaccaccgagactgtgctgtgcgcacttggtctggtacttggactggttggcatcatcgtgggaactgtgttgatcataaagtctctgcgatcaggccacgatccccgggctcaggggacactgtag

SEQ ID NO: 123078 - DNA, 783 bp, Artificial Sequence
  Description of Artificial Sequence: Synthetic coding sequence
atgcggcccgaggacaggatgttccacataagggccgttattctgcgggcactcagcctcgccttcttactgtctctgcgcggcgctggagctatcaaggctgaccatgtctcaacatacgccgctttcgtccaaactcacagacctacaggagagttcatgtttgaattcgacgaagacgaaatgttttacgtggatttggataaaaaggagacagtgtggcacctggaagagtttggacaggcttttagcttcgaggctcagggcggtctcgcaaacatcgcgattttgaacaataaccttaatacattgatacagaggagtaaccacactcaagccactaacgatcctccagaagtcacagtattcccaaaagagccggtggagctggggcagcctaatactctgatctgccacattgataaattctttcctcctgtcctgaacgtgacttggctctgcaacggcgaactggtgactgaaggggtcgccgagtcactgtttttgccccgcaccgattattcatttcacaaattccactatctgacattcgtcccctcagctgaagatttctacgactgcagggtcgagcattgggggctggaccaacctctgctcaaacattgggaagcccaggaacctattcaaatgcccgaaacgacggaaactgtcctctgcgccctgggactcgttctgggtctagtgggcatcatagtgggcactgtgttgattattaagagccttaggagcggacacgatccacgtgctcagggcacactgtag

SEQ ID NO: 123079 - DNA, 639 bp, Artificial Sequence
  Description of Artificial Sequence: Synthetic coding sequence
atgcggcctgaagacaggatgttccacatccgggcagtaattctgcgggctttgagcttagcctttttactgagtctgaggggggccggggcgatcaaggccgaccacgtgtctacctacgcggcttttgttcagactcaccgccctacaggggaatttatgtttgagtttgatgaagacgaaatgttttatgtggacctggacaagaaagaaaccgtttggcatctcgaagagttcgggcaagctttttcgttcgaggttacagtttttcccaaagaacctgtggagctgggtcagcccaacaccctcatttgtcatatagacaaattttttccacctgtgcttaacgtgacttggctgtgtaacggagaactcgtaaccgagggcgtggccgaatctttatttctcccccgaaccgattacagcttccacaagttccactacctaacattcgttccaagtgcggaggacttttatgactgtagggtggaacattggggccttgaccaaccacttctgaagcattgggaggcccaggagcccatccaaatgccagagacaaccgaaaccgtgttgtgcgctcttggactggtgttgggactggttgggattattgtgggaactgtcctgattatttag

SEQ ID NO: 123080 - DNA, 72 bp, Artificial Sequence
  Description of Artificial Sequence: Synthetic coding sequence
atgaggcccgaggataggatgtttcacatccgcgccgtgattctgcgcgctctatcccttgccttcctgtag

SEQ ID NO: 123081 - DNA, 639 bp, Artificial Sequence
  Description of Artificial Sequence: Synthetic coding sequence
atgagacccgaggacagaatgttccacattcgagcggtaattctgcgggctctgtccctggctttcctgctcagtctaaggggcgccggtgcaatcaaggcagaccacgtatcaacctacgctgccttcgtgcagacccatcgacctaccggggaatttatgtttgaatttgacgaggatgagatgttttatgtcgacttagacaagaaggaaaccgtctggcacctcgaggagtttggacaggctttcagctttgaagtgacagtttttcccaaagaacccgtggagctggggcagccaaatacccttatttgtcacattgacaagtttttcccccctgtcttgaacgtgacttggttatgcaatggagaactggtcactgaaggagtcgctgaatctctgttcctgccacggaccgactattcatttcacaagtttcactatctgacctttgttccttctgcggaagacttttatgactgccgcgtggagcactggggcctcgaccagccgttgctgaagcactgggaagcacaggagcctattcaaatgccggaaaccactgaaacagttctgtgcgctttgggtctggttctcggtttggtgggaatcattgtgggtacagttctgattatttag

SEQ ID NO: 123082 - DNA, 72 bp, Artificial Sequence
  Description of Artificial Sequence: Synthetic coding sequence
atgcgaccagaggaccgtatgttccacatccgggccgtgatactaagggctctctccttggcattcctgtag

SEQ ID NO: 123083 - DNA, 639 bp, Artificial Sequence
  Description of Artificial Sequence: Synthetic coding sequence
atgagacccgaagaccgcatgttccatattcgtgctgtaatccttcgggccctgtctctggcatttttattgtctcttagaggggccggagcaataaaggccgatcatgtgagtacctacgcagccttcgtccaaacacacaggcccaccggtgaattcatgtttgaattcgacgaagatgagatgttttacgtagatctcgataaaaaagaaacagtttggcatctcgaagagtttggacaggcgttttctttcgaggtgactgtttttccaaaggaaccagtggaacttgggcagcctaatacactcatctgccacattgataaattcttcccaccggttctgaatgttacatggctatgcaacggtgagctcgtgaccgagggggtcgctgagtctctctttcttccgaggaccgattacagctttcataagtttcactacttgaccttcgtgccctccgcagaggacttctatgactgcagagttgaacattggggcctagaccagcccctgctgaagcactgggaggcacaggagcctattcaaatgccagaaacaaccgaaaccgttctttgcgcactcggattggttctgggcctggtggggatcatagttggtactgtgctgatcatttag

SEQ ID NO: 123084 - DNA, 387 bp, Artificial Sequence
  Description of Artificial Sequence: Synthetic coding sequence
tgaaatacccttatttgccatattgacaaattctttccacccgtccttaacgtcacatggctgtgtaatggagaacttgtaacagagggcgtcgcagaaagtctcttcttgcctcgcacggactacagttttcataagttccattatctgacatttgtcccctccgcggaggacttttacgattgtcgggttgagcactgggggttggatcagcctctcctaaagcattgggaggcccaagaacctatccagatgcccgagaccacggagactgtgctgtgcgcattgggcctggtgctgggattagtgggcattatcgtcggtaccgttcttatcattaagtcactgcgcagtggccatgacccccgtgcccaaggcactctttag

SEQ ID NO: 123085 - DNA, 630 bp, Artificial Sequence
  Description of Artificial Sequence: Synthetic coding sequence
atgcggcccgaggaccgaatgttccacatacgggccgtcatcctccgggccctctcattggcctttttgctcagtctccgcggcgcaggggccattaaggctgaccacgtatccacgtacgccgcgtttgtacagacccaccgacctaccggcgagttcatgtttgaattcgatgaggatgaaatgttctatgttgatctggataagaaggaaaccgtttggcatttggaggagtttggccaggctttttcttttgaagcacagggtggcctggccaacattgccattctgaacaacaatcttaacactcttatccagcgctcgaaccacacacaagcgaccaacgatcctcccgaagttaccgtttttccaaaggagccagtggagctgggccagcctaacactcttatatgtcatatcgataaattcttcccgcctgtgctgaacgttacctggctgtgtaatggcgagctcgtcacagagggagtggccgaaagcctgtttctgccccgcaccgactactccttccataaattccattacctcaccttcgtaccctcagcggaggacttttatgactgtcgagtagagcactggggactggaccagccacttcttaaacactggtag

SEQ ID NO: 123086 - DNA, 783 bp, Artificial Sequence
  Description of Artificial Sequence: Synthetic coding sequence
atgaggccagaggatcgaatgttccatattcgggccgtgattttgcgcgcactgagtcttgcattcctgctgtctctacggggtgccggtgccataaaggctgatcatgtgtcgacttacgccgcctttgtgcaaacgcatagacccaccggcgagttcatgtttgagttcgatgaggacgagatgttctacgttgatctggataagaaagagaccgtctggcacttagaggagtttggacaggcttttagcttcgaggcccagggaggtctcgctaatatcgccatcctgaataacaatctcaacactcttattcagagaagtaatcatacccaggccaccaatgacccaccagaggtcaccgtgttcccaaaggaacccgtagagcttgggcagccaaacaccctgatctgtcacattgataaattcttcccccccgtccttaacgtgacgtggctctgcaatggtgagctggtgacagagggcgtggcagagagcttgtttcttcctaggaccgattattccttccacaagttccactatctgacatttgtcccgtccgccgaggatttctatgactgtcgggtcgaacactgggggttggaccagccactcttaaaacactgggaggctcaggaacctatacagatgcctgagaccactgagacagttctgtgtgccctgggcctcgtgctgggcttggtgggtatcattgtggggacagtgctcattataaagagcctcagatcaggacacgacccccgggcccagggcacgctctag

SEQ ID NO: 123087 - DNA, 387 bp, Artificial Sequence
  Description of Artificial Sequence: Synthetic coding sequence
tgaaacaccttgatatgtcacatcgacaagttctttcccccagtgttaaatgtcacctggttatgtaacggcgaacttgtgactgaaggcgtggcagagagtctgtttctgccccgcaccgattattcatttcataaattccattatctgactttcgtgcctagcgccgaagatttctatgactgcagggtggagcactgggggttagaccagccactccttaagcactgggaagcccaggagccaattcagatgcctgaaaccaccgaaactgtcttgtgcgcccttggcctcgtgctgggtttggtcggtattatcgtgggcacagtgctgattattaagtctctgcgttccgggcatgaccccagagcccagggaaccctttag

SEQ ID NO: 123088 - DNA, 630 bp, Artificial Sequence
  Description of Artificial Sequence: Synthetic coding sequence
atgcggccagaagacagaatgttccatatccgcgctgtcatactgcgtgccttgtctctcgctttcttgcttagtttgcgcggtgccggcgcaattaaagcagaccatgtgagtacctatgccgctttcgtgcagactcaccggccaactggggagttcatgtttgagtttgatgaggatgagatgttctatgtcgacctcgataaaaaggaaaccgtctggcatttggaagaattcggacaagccttctcattcgaagctcagggtggtttggctaacattgccattttaaataacaacctcaacaccctcatccaaagaagtaaccacacccaggccactaatgatcctcctgaggtaaccgtgtttcctaaggagccagtggagctcggccagcctaatactttaatctgccatatagacaagttctttccgccggtcctgaatgtgacctggctctgcaatggcgagctcgtgaccgagggagtggccgagtccctgttcctacctaggaccgactatagctttcacaagtttcattacctcactttcgtgccatctgccgaagacttttacgactgccgagtggaacactgggggctcgaccaacctctgctcaagcactggtag

SEQ ID NO: 123089 - DNA, 630 bp, Artificial Sequence
  Description of Artificial Sequence: Synthetic coding sequence
atgcggccggaggatcggatgtttcacattagggccgtcatcttacgagcgctgtccctggcatttcttcttagtctcagaggtgccggagccatcaaggcggatcatgtttccacttacgctgcatttgtccagacacataggcctactggagagttcatgtttgaatttgatgaggatgagatgttctacgtcgatctggacaagaaggagacagtatggcacttggaagagtttggacaggccttctccttcgaagctcaggggggtctcgcaaatatcgcaatcttgaacaacaacctcaatacattgatccagagatctaaccatactcaggcaaccaacgacccccctgaggtgacagtctttcctaaagagcccgtggaacttggtcagcccaatactctaatatgtcacatcgataaatttttcccccccgtgttgaatgttacttggctctgcaatggggagctcgtgaccgagggcgttgccgagtcattattcttacctaggacagattattctttccacaaattccactacctaacctttgtgccctcggccgaagacttttatgattgccgtgtcgaacactggggcctggaccaaccgctgctcaagcactggtag

SEQ ID NO: 123090 - DNA, 783 bp, Artificial Sequence
  Description of Artificial Sequence: Synthetic coding sequence
atgcgccctgaagatcggatgttccatattagggctgtgattctccgggccttaagcttagccttcttgctgtccctccgcggcgccggcgccataaaagcagaccacgtcagcacctatgcagcctttgtgcagacgcatcgccctacaggggagttcatgttcgaattcgacgaggatgaaatgttttacgtggatttggacaaaaaggagacggtctggcatctggaggagtttgggcaagcctttagctttgaggctcagggcggcctggccaacatcgccatcctgaataataacttaaacaccctgatccaacgaagcaatcacacccaggcgactaatgacccccccgaggtcacagtgttcccgaaggagcccgtggaacttggacagcctaatacgttgatttgtcacatcgataaattttttcccccagtgctgaatgtgacatggctgtgcaatggggagttagttacagagggtgtggctgaatctctgtttctgccccgcactgattacagcttccataagtttcactacctcacatttgtcccttcagccgaggacttttatgattgcagagtggaacactggggcctggatcagcctctcctgaagcattgggaggcccaggaacctatccagatgccagagactacggaaactgtcctttgtgctctgggtctcgtacttggccttgtgggtattattgtcggaaccgttcttattatcaagtcactgcgctcagggcacgatccgcgtgcccagggcactctatag

SEQ ID NO: 123091 - DNA, 639 bp, Artificial Sequence
  Description of Artificial Sequence: Synthetic coding sequence
atgagacccgaagaccggatgttccacatacgtgcggtaatcctgagagctctgagtctggcctttctgttgtccctgcgcggcgccggtgctatcaaggccgatcacgtgtctacttacgcagcgtttgtacagactcaccgacccactggagagttcatgtttgagttcgacgaagacgaaatgttctatgtggaccttgataaaaaggagactgtgtggcacctggaagaatttggccaggccttctctttcgaggtgaccgtattccctaaggagcctgtggaactggggcaaccaaataccctgatatgtcacatcgataagtttttcccacccgtcctgaatgtgacctggctttgtaatggtgagctggtgaccgagggcgtggcagagagtctgttccttcctcgcactgattacagctttcacaaatttcactatttaacctttgtgccctccgcggaagatttttatgattgccgagtggaacattggggactggatcaacctctgcttaaacattgggaagcccaagaacccatacagatgcctgagacaactgagactgttctttgcgccctgggcctggtgctcggccttgtcggcattatcgtaggcaccgtgctgattatctag

SEQ ID NO: 123092 - DNA, 783 bp, Artificial Sequence
  Description of Artificial Sequence: Synthetic coding sequence
atgcgcccagaagatcggatgttccatatccgcgcggtgatcctaagagcactgtcactagcattcctcctgagcctgaggggcgccggggcgattaaagcagaccacgttagtacctacgcggccttcgtccaaactcatagacccactggagagttcatgtttgaattcgatgaagacgaaatgttctacgtggacctggacaaaaaagaaaccgtttggcaccttgaagaattcggacaggccttttcctttgaggctcagggtggtctggccaatatagctatcctgaataacaatctgaacacgctcatacagaggagcaaccacacgcaggctaccaatgaccctccagaggtcaccgtgttccccaaggagcccgtggaactcgggcagccaaataccctcatttgccatatagataaattctttcctccagtgctgaacgtgacctggctctgcaacggcgagctggttacagagggagtggccgagtcgctctttctccctaggactgactacagcttccataagttccattacctgacattcgtacctagcgccgaggacttttacgattgccgtgttgaacattggggcctggatcagcccctgcttaagcactgggaggcacaggagcccatacagatgcctgagacaacagaaacagttctctgtgctctgggacttgtcttgggcttagtgggcattatcgttggcacagtgctgatcatcaaatcgcttcgttccggccacgatcctcgggcccaggggaccttatag

SEQ ID NO: 123093 - DNA, 783 bp, Artificial Sequence
  Description of Artificial Sequence: Synthetic coding sequence
atgcgacctgaggatagaatgttccatatacgcgccgtgattctgagggctctttccctcgccttcctgctgtccctacgtggtgccggagccattaaagccgatcatgtgagtacgtacgcggcatttgtgcagacacatcggcctacgggtgagttcatgttcgaattcgacgaagacgagatgttctacgtggatctcgacaaaaaagagaccgtgtggcatctggaagagttcggccaagctttttcttttgaagcccagggtgggcttgctaatatagcaatactgaacaacaaccttaatacactgatccagcggagtaaccacactcaggcgacgaacgatcctcccgaggtcactgtgtttccgaaagagcctgtggagttaggtcagcccaacacccttatttgtcacattgacaagttctttcctcccgtcctgaacgtgacatggctgtgcaatggcgaattggttaccgaaggagtggctgagagtttatttcttccgaggactgattatagcttccacaaatttcactacctaaccttcgtgccctcagcagaagatttctatgattgccgcgtcgagcattggggtctggaccagccccttctaaagcattgggaggcccaggaaccaatccaaatgccagaaactactgaaaccgtgttgtgtgctctggggttagtgttgggcttagtgggaatcatagtggggactgtcttgatcataaagtccctcaggtcaggacatgatccgcgcgcccagggtaccttgtag

SEQ ID NO: 123094 - DNA, 783 bp, Artificial Sequence
  Description of Artificial Sequence: Synthetic coding sequence
atgaggcccgaagatagaatgtttcacatcagggccgttatcctgcgagccttgagcctggcattcctgctgagcctcagaggagccggtgctattaaagcagaccacgtgagcacctatgccgccttcgtccagacccaccgtcccacaggcgagttcatgtttgagttcgatgaggatgagatgttttatgtggacttggacaaaaaggaaactgtctggcatcttgaagagtttggccaggctttttccttcgaggcccaaggaggattggcgaacatagctatcctcaataacaatctgaatacactgatacaaagatccaaccatactcaggcaacaaatgaccctcccgaggtgaccgttttccccaaagagccggtcgaacttggtcaaccaaacactctcatttgccatatcgacaagtttttcccccccgtgctgaatgtaacatggctgtgcaatggcgagctggtcaccgagggagtcgccgagagtctcttcctgccccgcactgattactcatttcataaatttcactatctcacgttcgtgccttccgccgaggacttttacgattgcagagtggaacactgggggctcgaccagccactgctcaagcattgggaggcgcaggagccaatccagatgcctgaaacgaccgagacagttctgtgcgcgctcgggttggtgctcgggttggttggaattatagtggggaccgtactgataataaagtcgctgcgctccggccatgatcctcgcgctcaagggacactgtag

SEQ ID NO: 123095 - DNA, 783 bp, Artificial Sequence
  Description of Artificial Sequence: Synthetic coding sequence
atgagaccggaggatagaatgtttcacataagggccgtgatcctgagggccctgtccctggcctttttgctgtccttaagaggtgctggcgcgatcaaagcggaccacgtgagcacctatgctgcattcgttcaaactcaccggccgacaggcgaatttatgtttgaatttgatgaagatgaaatgttttatgttgatctggacaagaaagagaccgtgtggcaccttgaagagtttgggcaagcatttagcttcgaggcccagggaggcctggccaacatagctatcctcaataacaatttgaacaccctgatccaacgctcgaaccatactcaggccacaaatgatccccccgaggtcacggtttttccaaaggaacccgtggaactgggacagcccaacaccctgatttgccatatcgacaagttttttccaccggtccttaacgttacttggttgtgtaacggggagctggtcacagagggagttgcagagagcctgttcctcccaagaaccgactatagttttcacaaattccattacctgacatttgtcccctccgctgaagatttctatgactgccgggtggaacattgggggctggaccaacctctgttaaagcactgggaggcccaggagcctatccagatgccagaaactacagaaacagttttgtgcgccctggggctggtgcttggactggtgggcattatcgtcggcacagtgttaattatcaagtctctgcgctccggccacgaccccagagcacagggaaccctctag

SEQ ID NO: 123096 - DNA, 783 bp, Artificial Sequence
  Description of Artificial Sequence: Synthetic coding sequence
atgcggcctgaagacaggatgtttcacatcagagccgtgattctgagggcactctcactcgcttttctcctttccctgcgcggagcgggggccattaaggctgaccacgtgtctacttatgcagcattcgtccagacccaccgtcccacgggtgaatttatgttcgaattcgatgaggatgagatgttctacgtggatctcgacaaaaaagagacggtttggcatctcgaggagtttggacaggctttctctttcgaggcccagggagggctcgctaatatcgctatcctcaacaataacctgaacacactaatccagcggtcaaaccatacccaggcaaccaacgatccacccgaggtcaccgtgttccctaaggagccggtggaactaggccagcctaatactttgatctgccacatcgacaagttcttccctcctgtactgaatgtaacgtggctgtgcaatggcgaattagtgactgaaggtgtggcagaatccctgttcctcccacggacagactactcttttcacaaattccactacttaaccttcgtgcctagtgcagaagacttttatgattgtagggtggagcattggggactcgatcaacctctcttaaagcactgggaagctcaagaacccatacagatgcccgagaccaccgagaccgttctgtgtgctctgggtttggttctggggctggtggggattatcgttgggaccgtcttaataattaaatcgttacggtccggacatgatccccgggctcaggggaccctgtag

SEQ ID NO: 123097 - DNA, 783 bp, Artificial Sequence
  Description of Artificial Sequence: Synthetic coding sequence
atgcgcccggaggacagaatgttccatataagggccgtgatcctgcgcgcattgtcgcttgcctttctgctgagcctgcggggcgctggcgccattaaggccgaccatgtgtccacctatgccgctttcgttcagacccaccggccgactggggagttcatgtttgaatttgacgaggacgaaatgttttacgtggatctggacaagaaagagaccgtatggcacctggaagagttcggacaggccttttcgttcgaggcccagggtggactggccaacatagccatacttaataacaatctgaataccctcatccagcggtcaaatcacacgcaggcaactaacgacccccccgaggtgacagtttttcctaaagagccagtggagctcggacagcccaataccctgatctgtcacattgacaagtttttcccacctgtgctgaatgtaacatggctttgtaacggagagcttgttacggaaggagtggcagagtcattgttcttgccacgcacagactacagttttcataagtttcactacttaactttcgtgccctctgccgaggacttctacgactgccgtgtagagcattggggactggaccagccactcctcaagcactgggaagcacaggaacctattcaaatgcccgaaactactgaaacagtgctctgcgcccttggactagtgcttgggctcgttggcatcatcgtagggacggtgctgattattaagagtctgagatctggccacgacccgagggcacaggggacactatag

SEQ ID NO: 123098 - DNA, 777 bp, Artificial Sequence
  Description of Artificial Sequence: Synthetic coding sequence
atgatggtgctgcaagtctctgcagctccacgcacagtcgccctcaccgctctgctcatggtactgttgactagcgttgtgcagggtcgcgctaccccagaaaactatgtctaccagttgcgccaggagtgctatgcatttaatggaacacagcgcttcttggaacgttatatctacaaccgtgaggaattcgtgagatttgatagcgatgtgggtgagttcagggccgtgacagaactcggtcggcctgacgaggactactggaacagccagaaggacttgctcgaagagaagcgagccgtacccgacagggtgtgccgtcataactatgagctagacgaggccgtgacgctccaaagacgggtgcagcccaaggtcaacgtctcacctagcaagaagggtcctctgcagcaccataacctcttagtatgccacgtcacagatttttacccaggatccatacaggtacgatggtttctgaacgggcaggaggaaacggcaggtgtcgtctcaacaaatttgatcagaaacggggattggaccttccagatactcgtgatgctcgaaatgacaccacagcagggtgatgtgtatatttgtcaggtcgagcacacatccctggacagccctgtgacggttgagtggaaggctcaatctgattcagccaggtccaaaacccttactggtgcgggggggttcgtgttggggctgataatatgtggcgtgggaatcttcatgcatcgtcggtccaaaaaggtacaacgcgggtccgcttag

SEQ ID NO: 123099 - DNA, 687 bp, Artificial Sequence
  Description of Artificial Sequence: Synthetic coding sequence
atgatggtgctccaggtgagcgccgcccctcgaaccgtggctctcaccgctttactgatggtcttactgactagtgtggtacaggggagagctacccctgagaactacctttttcagggcaggcaagaatgctacgcctttaacggcactcagaggttcctcgaacggtatatctacaacagggaagagctggtgaggttcgatagcgatgtcggggaatttcgtgctgtcaccgagttagggcgcccagaagcagagtattggaactcacagaaggacatacttgaggaagagagagcagttcccgataggatgtgccgccacaactatgaacttggcggtcccatgactttgcaacgacgcggaagcatacaggtcagatggttcctgaacggacaggaagaaaccgcaggcgtggtgtccaccaatttgattcggaacggcgattggacttttcaaattctagtgatgcttgaaatgacgccccagcagggagacgtgtatacttgtcaagttgaacacacctctcttgactctccagtgacagttgaatggaaggcccaatctgattccgcgagatccaaaacccttaccggcgctgggggattcgtgctaggactgatcatctgtggcgtgggtatttttatgcatagaaggtccaaaaaagtgcagagagggtccgcatag

SEQ ID NO: 123100 - DNA, 777 bp, Artificial Sequence
  Description of Artificial Sequence: Synthetic coding sequence
atgatggttctacaagtaagcgccgcaccccgaacagtcgccctcacggcactgctaatggtgctcctaacctccgtcgtgcaggggcgcgctacaccagaaaattaccttttccaagggcgccaagagtgctacgcctttaacggaacccaacggttcctggagcgttacatttataatagagaagagctggtgaggttcgatagtgatgttggggagttccgggctgtgacagagttgggtaggcctgaagctgaatactggaattcacagaaggatatattggaggaagaaagggcagtccctgaccgcatgtgcaggcataattatgagcttggcgggcctatgactctgcagcgtcgggtacagcctagggtgaatgtatccccgtccaaaaaaggccctctccagcaccataaccttctggtttgtcatgtgacagacttttatccggggtcaatccaagtgagatggttcctaaatgggcaggaagagacggccggggtggtctctacgaacctaataaggaatggggattggaccttccaaatcctcgtgatgctggagatgactcctcagcagggcgatgtttatacatgtcaagtggagcacacctcacttgactctcccgtgactgtggagtggaaagctcagtcggactccgctagatcaaagacccttactggagcgggcgggttcgtcctgggcctgattatttgtggagtaggaattttcatgcaccgtcgctccaaaaaggtgcaaaggggctccgcttag

SEQ ID NO: 123101 - DNA, 690 bp, Artificial Sequence
  Description of Artificial Sequence: Synthetic coding sequence
aaacaagcttggagaggaagtgccacgcgcctcgggccacagaattcaggcagacaggagtgctatgcgttcaacggcacccaaagatttttggagagatatatatacaatagggaagagcttgtgcggtttgactccgacgtaggtgaatttagagccgttaccgaactcgggcgtccagaagcagaatactggaattctcagaaagatatcctggaggaagaacgcgccgtgcccgaccggatgtgcaggcataactacgagctggggggacccatgactcttcagcgaagagtccaaccacgcgttaatgttagccctagtaagaagggaccactgcagcaccataaccttcttgtttgtcacgttacagacttctaccccggctctattcaagtacgatggtttctgaacggccaggaagagaccgccggtgttgttagtacaaatctaatccgaaacggagactggacgtttcagatcctcgtgatgctggagatgactccccaacagggcgacgtatacacctgccaagttgagcacacaagccttgatagccccgtgaccgtagagtggaaagcacagagcgactcagcgcgctccaagaccctaacaggagctggcggattcgtgcttggactaattatctgtggggtgggaatttttatgcacagacggtcaaaaaagtag

SEQ ID NO: 123102 - DNA, 687 bp, Artificial Sequence
  Description of Artificial Sequence: Synthetic coding sequence
atgatggttctgcaagtgagcgcggcacccagaactgtcgctctgacggcccttctgatggtgctgctcacttcggtagtgcagggccgtgccactccggagaattatctctttcagggtcgccaggaatgctatgcttttaacggcacccagcggttccttgaacggtatatctacaatcgggaagaattcgctagatttgactccgacgtcggggagttccgggctgtgacggaacttggccggccagctgctgagtactggaactcccagaaggacattctggaggaaaagcgggccgtccctgatcgaatgtgcagacataactacgagctcggcggccctatgactcttcaaagacgcggctcaattcaagtgcgctggttcctaaatggtcaggaggagacagctggggtcgtcagcacaaacctgatccgcaacggggattggacgttccagatcctggtaatgctggagatgacccctcagcaaggggacgtgtatacgtgtcaggtggaacatacaagtctcgatagtccagtgaccgttgagtggaaagcccagtccgactcagctaggtctaaaaccttaacaggagccgggggatttgtgctggggctcataatctgcggtgttgggatatttatgcatcgcaggtccaagaaagtgcagaggggcagtgcttag

SEQ ID NO: 123103 - DNA, 687 bp, Artificial Sequence
  Description of Artificial Sequence: Synthetic coding sequence
atgatggtgctgcaggtgtcagccgctcctcggactgtggctctaaccgctctattgatggtcttgcttacttctgtggttcaggggcgggccactcccgaaaattatctctttcagggtaggcaagaatgctacgcgtttaatggtacacagaggtttctggagagatacatttataacagagaagagttcgtgaggttcgattccgatgtgggtgagtttagagccgtcacagagctgggaagacctgatgaggaatattggaattcacagaaagatatcctagaggagaagcgcgccgttccagacaggatgtgccgtcacaattatgaactgggaggacccatgacattgcagaggcgcgggagcatccaggtgcgctggttcctgaacggccaggaagagacagctggcgtcgtgagcaccaacctgattagaaatggcgactggacatttcagattttagtgatgctggagatgacacctcagcagggtgacgtctacacgtgccaggttgaacatacgagcatggatagcccagtgacggtagagtggaaggcccagtccgacagtgctagatcaaagacactgactggggccggcggattcgtgcttggactcattatttgcggcgtgggtatctttatgcatcgacggtctaaaaaggtgcagagagggagcgcatag

SEQ ID NO: 123104 - DNA, 708 bp, Artificial Sequence
  Description of Artificial Sequence: Synthetic coding sequence
tagaactatcttttccaaggtaggcaggagtgctacgcattcaacggaactcagcggtttcttgagcgctacatctacaaccgagaggaattcgtaaggttcgacagcgatgtgggagaatttcgtgctgtcacagagctgggacgccctgacgaagaatattggaattcccagaaggatatcctcgaggagaagagggcggtccctgatcgcatgtgcagacacaactatgaactgggcggcccaatgactcttcagcggagagttcagccccgagtaaacgtctcgccatcaaagaaaggaccactccagcatcataacctgttagtgtgccacgtgactgacttttacccaggtagtattcaagtgagatggtttctcaacggacaggaagaaaccgccggcgttgtctctaccaacttaataagaaatggagactggaccttccagatcctggtgatgctggagatgactccccaacaaggcgacgtatacacatgccaggtagagcacactagtatggactctcccgtcaccgtagagtggaaggcgcagtccgattccgctaggtccaaaaccctcaccggagccggaggcttcgtactcgggctgataatatgcggtgttggtatctttatgcaccgtcggagtaaaaaaggcgagaaagcatgcagattcaatgaagaccttcataagcagggctcttag

SEQ ID NO: 123105 - DNA, 777 bp, Artificial Sequence
  Description of Artificial Sequence: Synthetic coding sequence
atgatggtgctgcaggtttcagcagcccctcgaactgttgctctgacagcccttctcatggtactgctgacatccgtcgtgcaaggccgcgccactccggaaaactacctgttccagggtcgacaggaatgctacgcgttcaacggcacgcaacgcttcctggagcgctacatttataaccgggaggagtttgtacgcttcgactctgacgtgggggagtttcgcgccgtgaccgagctcggtcgtcctgacgaggaatattggaattcgcagaaggacatccttgaggagaagcgtgcggtgccggaccgcatgtgccgtcacaactacgaacttgggggacctatgacactgcagcggagagttcagccccgcgttaacgtttcaccttccaaaaagggccctctgcagcaccataatctgttggtgtgtcacgtgactgacttttacccaggcagtatccaggttcggtggttcctcaacggacaggaggagactgctggagttgtcagcactaacctcattcgtaatggagattggaccttccagatccttgtaatgctggagatgacgccacagcagggagacgtgtacacctgtcaagtggagcataccagtatggattcgcctgtgacagtggaatggaaagcgcaatcagattccgcacgctcaaaaaccctcaccggcgccgggggtttcgtgctgggactcatcatctgcggggtaggtatttttatgcatagacggtccaaaaaagtgcagaggggatctgcatag

SEQ ID NO: 123106 - DNA, 687 bp, Artificial Sequence
  Description of Artificial Sequence: Synthetic coding sequence
atgatggttttgcaagtgagtgctgcccctaggaccgtggctctcacagcactcctcatggtgctcttgacctcagttgtacagggccgagccacccctgaaaactatttgttccagggtcgtcaggaatgctatgcgtttaacggaacccagcgattcctggagcgttacatttacaatagagaggaattcgccaggttcgattcagacgtcggggagtttcgagcagtgactgaactcggacgccctgcagctgagtactggaacagccagaaagacatcttagaagaaaagcgtgctgtccccgaccggatgtgtaggcataactatgaacttggcgggcccatgacactccagcgtagggggagcattcaagtcagatggttccttaatggacaggaagagacagcaggggtagtgagcacgaatctgattaggaacggtgattggacattccagattttagttatgctagagatgactcctcaacagggagatgtctatacttgtcaggttgagcacacatcacttgattctcctgtgaccgtggagtggaaagcccagtcagattccgctagatcaaagacccttacaggcgccggcggattcgtgctgggtctgatcatatgcggagtcggcattttcatgcacaggcgatctaaaaaggttcagcgcggctctgcctag

SEQ ID NO: 123107 - DNA, 690 bp, Artificial Sequence
  Description of Artificial Sequence: Synthetic coding sequence
aagcaggcctggagaggtagtgccactcggctcggcccccagaatagcgggagacaggagtgttacgccttcaatggaacccaacgctttctggaacgatatatttataatcgggaagagtttgtgcggttcgactccgacgtgggggagtttcgcgccgtgacagaacttggaaggccagacgaggagtattggaactctcagaaagatattcttgaagaggagcgcgccgtccctgataggatgtgccggcacaactacgagcttggggggcccatgacactacagaggagggttcagccacgcgtcaacgtctccccctcgaagaaaggccctctccagcaccataacctgctagtgtgccatgtgactgacttctacccaggaagcatccaggttcgctggttcctaaacgggcaggaggagacagctggagtggtctcaaccaatttaatccgcaatggcgactggacattccagatattggttatgctcgagatgacaccccaacaaggagatgtgtacacctgccaagtcgaacatacatcgctcgactcacctgttaccgtggaatggaaggcccaatcggacagcgcgcgctcaaagaccctcactggagctgggggctttgtccttgggctaataatctgcggagtcgggatcttcatgcatagaagaagcaaaaagtag

SEQ ID NO: 123108 - DNA, 777 bp, Artificial Sequence
  Description of Artificial Sequence: Synthetic coding sequence
atgatggtcctgcaggtgtccgccgcaccccggaccgtggcactgactgctcttctgatggtccttctaacatccgtggtacagggacgcgcaacgcctgaaaactatctgtttcaaggaagacaggaatgttatgcctttaacgggacacagcggttccttgaacggtacatctacaatagagaagagtttgtgagattcgattctgacgtaggggaatttagggcggtgaccgagctcggccggcctgatgaagagtactggaattctcaaaaagacatattggaagaggagagagccgtacccgaccgcatgtgcaggcacaattatgaacttggcggacccatgacactccagcggcgcgtgcagccacgcgttaatgtgagcccatctaagaaagggccgttgcagcaccacaatctgctggtatgccacgtgactgatttttatcctgggtctatccaggtgcgttggtttttaaacggccaggaggagaccgccggcgtagtgtccactaatctcatccgtaatggcgactggactttccagatcctagttatgctggaaatgacaccacagcaaggggatgtttacacatgtcaagtggagcataccagcctcgattctcctgtgacggtagagtggaaagcccagtccgacagtgcccggagtaagacactgacaggagctggtggatttgttctgggattaatcatttgcggcgtgggaattttcatgcatagacgctctaaaaaggtgcagcgcggctcagcgtag

SEQ ID NO: 123109 - DNA, 708 bp, Artificial Sequence
  Description of Artificial Sequence: Synthetic coding sequence
taaaactacctatttcaagggagacaggagtgttacgcctttaatggcacacagcgctttttggagcgttatatctataaccgagaagaattcgctagatttgattcagatgtgggagaatttcgcgctgtaacggagctggggcgcccggctgccgagtactggaatagccagaaggatatcctcgaagaaaaacgggcagttcccgatcgcatgtgccgtcacaactacgagctgggggggcccatgacattacagagacgtgtgcagccacgtgtgaatgtcagcccttctaagaaaggcccactgcaacaccataatcttctagtttgccatgttaccgatttctatcccggatccatccaagtgcgatggttcctaaacggacaggaagaaacagctggcgtggttagcaccaacctcattaggaatggcgattggacatttcagattctcgtcatgctggagatgaccccccagcagggggatgtgtacacatgtcaggtggagcatacatcactggattcccccgtgactgtcgaatggaaggcccagtcagactcagccagatcgaaaacactgaccggagcaggaggtttcgtgctcggcctgatcatctgtggagtcggcatattcatgcatcgccgctcaaaaaaaggtgaaaaagcatgccggtttaacgaagacttacacaagcaaggtagctag

SEQ ID NO: 123110 - DNA, 690 bp, Artificial Sequence
  Description of Artificial Sequence: Synthetic coding sequence
aagcaggcctggcgggggtccgcgacaagactcggccctcagaattcaggccggcaggagtgctatgcattcaatggcacccagaggtttctggaacgttacatttacaatagagaagaattcgctaggtttgacagcgacgtcggcgaatttagggctgtgactgagctggggcgacctgcagccgagtactggaactcacaaaaagacattctggaagagaagcgtgcggttcctgatcgtatgtgcaggcacaattatgaacttgggggcccaatgactttgcagaggcgcgtacagcccagagtgaatgttagtccttctaaaaaagggccgctccaacatcataatctgctggtgtgtcacgtgaccgacttctaccctggaagtattcaggtccgatggttcctgaacgggcaggaggaaacggcaggcgtggtgtccacaaacttgattcggaacggcgattggaccttccaaatcctggtaatgctcgaaatgacgccacagcagggcgacgtttatacctgccaggtcgaacataccagcctcgacagtccagtgactgtggagtggaaagcacagtcagactccgcacgcagcaagacactgactggggccgggggatttgtcctcgggctgataatatgcggagtgggaatcttcatgcaccgaagatctaagaagtag

SEQ ID NO: 123111 - DNA, 777 bp, Artificial Sequence
  Description of Artificial Sequence: Synthetic coding sequence
atgatggtcttacaggtctccgctgcgccacggacagtggcgcttaccgccctactgatggtgctactcacctccgtggtgcaaggtagggccacacctgagaactacttgtttcagggcagacaggagtgttatgctttcaatggcacccagcgttttctggaacgttacatctacaaccgtgaagagttcgccaggtttgacagcgatgtaggcgagtttcgggcagtgaccgagctaggaaggccagccgccgaatactggaacagtcagaaggacattcttgaggagaagagggctgtgccggatagaatgtgtcgccataattatgagctggggggacccatgactctgcagaggagggttcagcctagagtgaatgtctctccctctaagaaggggccccttcaacaccacaaccttcttgtttgccacgtgaccgacttttaccctggttctattcaagtgcgttggtttctgaacggtcaagaggagaccgctggagttgtgagtacaaatctcatcaggaacggtgactggacttttcagatcctggtgatgcttgaaatgactccacagcaaggtgatgtttatacgtgtcaggtggaacatacaagcttggactctccggtcacagtggagtggaaggctcagtcagattctgctaggagcaaaactctcacgggagcgggaggattcgttttgggactgattatctgcggcgtcggaatcttcatgcatagaaggtcaaagaaagttcagcggggtagcgcctag

SEQ ID NO: 123112 - DNA, 249 bp, Artificial Sequence
  Description of Artificial Sequence: Synthetic coding sequence
atgaccccccaacagggggatgtctacacatgccaggtggaacacacctcgctagattctcctgtgaccgtggaatggaaggcccaatccgatagcgcaaggtcaaaaacactgacgggcgctggaggccgggcaggagcgcaccatctgtggtcaggccacctgcatgcccaggaggaacaggaaagcagtacccggatctgtattaatcgggtgccagaattgacggaaaagaccatcgtgccttag

SEQ ID NO: 123113 - DNA, 777 bp, Artificial Sequence
  Description of Artificial Sequence: Synthetic coding sequence
atgatggtcctgcaggtgtctgccgccccccgaacggtcgcactcactgccctccttatggtgctcctcacctctgtcgtgcagggacgcgccactcccgagaattatctgttccagggcagacaggaatgttacgctttcaatggaacccagcggtttctggagcgttacatttataatcgcgaggagttcgtcaggtttgatagtgacgtaggggagtttagggctgtgaccgagctgggtagaccggatgaagagtactggaacagtcagaaggacattctggaagaaaaacgggccgtgcctgatcggatgtgcagacacaactatgagttgggtggtccgatgactctgcagaggcgggttcaaccacgcgtgaacgtgtctccatctaagaagggcccactgcaacatcataatctcctggtctgtcacgttactgatttctatcccggctctatacaggtgagatggtttcttaacggccaagaggaaaccgccggtgtggtcagcactaacctgattcggaacggagattggaccttccagattctcgtgatgttagagatgaccccacagcagggggatgtgtacacttgtcaggtggagcatacttcaatggactcacccgtgactgtagagtggaaggcgcaaagcgattcagccagatcgaaaactctgactggggcgggaggttttgttttgggtttaatcatctgtggggtcgggattttcatgcacaggcggtccaaaaaggttcagagagggtccgcctag

SEQ ID NO: 123114 - DNA, 690 bp, Artificial Sequence
  Description of Artificial Sequence: Synthetic coding sequence
aagcaagcatggcggggatcggccaccaggttaggcccacagaattcaggccgccaggagtgctacgccttcaatgggacccagcgcttcctagagcgctacatatacaaccgcgaagagtttgctcggttcgacagtgacgtgggcgaattcagagcagtgactgagctgggcagaccagcagcggaatattggaattcacagaaggatatcctggaggagaagagagcggtaccagatcggatgtgtcggcacaactatgaattaggcggtcctatgaccctacagcgtcgtgttcagcccagggtgaatgtgagtcccagcaaaaaaggacctctacagcatcataatcttctcgtgtgccatgtgactgacttttatccaggctccatccaggtccggtggttcctgaatgggcaagaagagacagccggggtggtttcaactaatctgatacggaatggggactggactttccagatcctggtcatgctagaaatgacacctcagcaaggcgatgtttatacctgccaagttgagcacacttccctcgatagtcccgtgaccgtcgaatggaaagcacagtccgacagcgcacgctccaaaacactgaccggcgccgggggatttgtgctgggcctgatcatatgtggggtcggcatcttcatgcatcgtcggtctaaaaagtag

SEQ ID NO: 123115 - DNA, 708 bp, Artificial Sequence
  Description of Artificial Sequence: Synthetic coding sequence
taaaattatcttttccaaggccggcaggagtgctatgcttttaacgggactcagcggttcctggagcggtacatctataaccgggaagagctggtgagatttgactctgacgtgggcgagtttagagccgtcacagagctgggacgccccgaagctgaatactggaatagccagaaagatatccttgaggaggaacgcgccgtgcccgacagaatgtgccgtcataattacgagctcggcgggcctatgactctgcagaggcgagtgcagccccgagtaaatgtctcgccttctaaaaagggaccactgcagcaccataatctactcgtctgtcacgtgactgatttttatcctggttctatccaggttagatggtttcttaatggacaggaggagacagctggcgtggtttccacaaacctgattcggaatggagattggacgtttcagatcttggtcatgttggagatgaccccccaacaaggtgatgtctatacctgccaagtcgagcacaccagtctggacagccccgtaaccgtcgagtggaaggcgcagagcgacagcgcacgatctaaaactttaacaggcgccggaggtttcgtgttgggactcatcatctgcggtgttgggatattcatgcaccggaggtcaaaaaaaggagagaaggcgtgtcgctttaacgaggatttacacaaacaaggttcctag

SEQ ID NO: 123116 - DNA, 777 bp, Artificial Sequence
  Description of Artificial Sequence: Synthetic coding sequence
atgatggtgttacaggtgtccgctgccccacgcaccgtggcattaacagcgctgttaatggtgctgctgacctccgtggtgcagggccgcgccacccctgagaattatcttttccaaggcagacaagagtgctacgcattcaacgggactcagaggtttctggagaggtatatatataacagagaagagtttgcaaggttcgactcggatgtgggagagtttcgggctgtaaccgaactcgggcgcccggccgccgaatattggaattcccagaaggacattctcgaggagaaacgcgcagtgcccgaccggatgtgtcgtcataactatgaactcggtggacctatgaccctgcagagacgggtgcagcctcgggttaacgtatcccccagtaaaaaaggccccctgcagcatcacaacctgctggtttgtcatgtcaccgacttctaccccggatcaatacaagtccggtggttcctgaatggacaggaggagaccgcaggcgttgtttcaaccaacctcattcggaacggcgactggacatttcagatcttagtgatgctggagatgaccccacaacaaggagatgtgtacacctgccaggtggaacacacatccctggacagccctgtgaccgtggaatggaaagctcagtccgactctgcgcggtctaagactttaacaggcgccgggggcttcgtccttgggctgatcatttgtggtgtaggcatatttatgcaccgaagatccaagaaagttcaaaggggctctgcttag

SEQ ID NO: 123117 - DNA, 708 bp, Artificial Sequence
  Description of Artificial Sequence: Synthetic coding sequence
tgaaactatgtgtaccagttgcgccaggaatgttacgcgtttaatgggactcagagattcctggaaaggtatatttataaccgcgaggagttcgttcgcttcgacagtgatgtcggggaatttagggccgtcacagaactgggacgaccagacgaagactattggaattctcaaaaggatctgttggaggagaaaagagccgtgcccgatagagtttgtcgacataactacgaactggacgaagccgtgacgttacaacgtagagtgcagccaaaagtcaacgtctcaccaagcaaaaaaggtccactccaacaccataacctgctggtgtgccacgtgaccgacttttatccaggatcaattcaagtgcgctggttcctcaatggacaggaagaaacggctggtgtcgtgtccactaacctgataaggaatggagactggacttttcaaatcctcgtcatgttggagatgactccgcagcaaggtgacgtgtacatctgtcaggtggagcacacatccctcgattctccagtgaccgtggaatggaaggctcagtccgactcagcacgatctaaaactctgaccggggctggaggtttcgtgttgggtctgattatatgcggggtgggcatctttatgcaccggcgaagcaaaaaaggtgaaaaggcctgcaaattcaatgaagatttacacaagcaaggctcttag

SEQ ID NO: 123118 - DNA, 690 bp, Artificial Sequence
  Description of Artificial Sequence: Synthetic coding sequence
aaacaggcttggcgtggatccgccacccggctgggcccacagaactctggtcgccaggagtgttatgcatttaacggaacacagcggttcttagagaggtacatatacaatagggaagagtttgttcgctttgatagtgatgtcggggaattcagggctgtcacggaactgggtaggccggatgaagagtactggaattcccagaaggacatcttggaggaaaaacgggccgtgcctgaccggatgtgtcgtcataactacgagctaggtggacccatgaccctgcaacgccgagtccagcccagagtgaacgtgtccccctctaaaaaggggcccctgcaacaccacaatctgttagtgtgtcatgtgactgacttctatcccggctcgatccaggttaggtggttcttaaacggacaggaagagaccgcaggcgtggtgtctaccaacctgattagaaacggcgattggactttccagatcctagtaatgcttgagatgacaccccagcagggagacgtctatacatgccaggtggaacatacgtcaatggatagccctgtgactgtagaatggaaggcgcaatccgactccgcacgttctaaaacgttaaccggtgcaggcggtttcgtcctggggcttatcatctgtggcgtgggtatattcatgcatcgccgtagcaagaaatag

SEQ ID NO: 123119 - DNA, 687 bp, Artificial Sequence
  Description of Artificial Sequence: Synthetic coding sequence
atgatggttcttcaagtctctgcggcccccaggactgtggcactcactgccctgctgatggtgctgctgacgagcgtggttcaggggcgcgccacacccgagaactacgtgtaccaactgcgccaagaatgctatgcgttcaatggaacacagcgtttcctagaacgttacatatacaacagggaagaattcgtcaggtttgattccgatgtgggtgagttcagggccgtcaccgagctgggacgacctgatgaggactactggaattctcaaaaggaccttctggaagagaaacgggcggtacctgacagggtgtgccgccacaattatgagctggacgaggcagtgactttacaacgtagaggaagcatacaagtacggtggtttcttaatgggcaggaggagactgctggagtggtaagtactaacttaattcgcaatggcgattggaccttccaaattctcgtgatgctagagatgacaccccaacagggcgacgtctacatctgtcaggtggaacatacctcacttgatagtcccgtcaccgtggagtggaaggctcaaagcgacagtgcacgaagtaaaaccttaacaggagcaggggggttcgtcttggggctgatcatatgcggggtcggtatatttatgcatcgccgcagcaagaaggtacagaggggcagtgcatag

SEQ ID NO: 123120 - DNA, 687 bp, Artificial Sequence
  Description of Artificial Sequence: Synthetic coding sequence
atgatggttttacaagtttctgccgccccaagaaccgttgccctcacagctctgttgatggttctcctcacaagtgtggtgcaaggtcgagccacacctgagaactacctgttccagggccggcaggaatgttatgcattcaacgggacccagagattcctagaacggtatatttacaatagagaggagttcgtgcggttcgacagcgacgtgggggagttccgagcggtcaccgaactgggacgccccgacgaagaatactggaattcgcaaaaggatatcctcgaggagaagcgggcggtccccgaccggatgtgtcgacacaactacgaactcggaggccctatgactttgcagcgaagggggtccattcaggtgaggtggttcctgaacggccaggaggaaacggccggagtggtctccacaaaccttatccggaacggagattggacgtttcagatattagtaatgctggagatgaccccacagcaaggcgatgtgtacacctgtcaggtggagcatacgtcgatggattccccagtgacagtggagtggaaagcacagtccgactcggcccgctctaagactttgaccggggccggaggatttgtcctcggcctgattatttgcggggtgggcatatttatgcaccggcggtccaaaaaagttcagcgcggttccgcttag

SEQ ID NO: 123121 - DNA, 687 bp, Artificial Sequence
  Description of Artificial Sequence: Synthetic coding sequence
atgatggtgctgcaggtgagcgctgcaccacggactgtagccctcaccgctctcctaatggttttgttaacctccgtggttcaaggcagagctacacctgagaactatctgttccaagggcgccaggagtgttatgccttcaatgggacacagagattcctcgagcggtatatttataaccgagaagaatttgctcgtttcgattccgatgtaggcgagttccgcgccgtgaccgaattaggccggccggcggccgaatattggaactctcaaaaggatattctcgaggaaaagcgagctgtgccagatcggatgtgtagacataactacgaattaggcggccccatgacactgcaacgcaggggaagtattcaagtccgttggttcctaaacggccaggaggaaacagcaggagtcgtgtccaccaacttaatcagaaacggcgactggaccttccagatactggttatgctggagatgactccacagcagggcgacgtatacacatgtcaggtggaacacacatcattggactcaccagtgactgtggagtggaaggcccagtctgatagcgctcgatcgaagactctcacaggcgccggaggttttgtgctgggcctaatcatctgtggggttggtatttttatgcacagaaggagcaagaaagtgcagcggggtagtgcgtag

SEQ ID NO: 123122 - DNA, 690 bp, Artificial Sequence
  Description of Artificial Sequence: Synthetic coding sequence
aagcaggcgtggcgaggcagcgctacaagactgggacctcagaattcaggacggcaggaatgctacgcctttaatggcactcagcgcttcctcgagagatacatctacaacagggaagaatttgtccggttcgacagcgacgtcggggagttccgggcagtcacagagttaggaaggcccgacgaagaatattggaactctcagaaggatatccttgaagaaaaacgcgccgttcccgatagaatgtgtcggcataactacgagctaggcggaccgatgacacttcagagaagggttcagccccgggtgaatgtatctccaagtaagaaaggccctctccagcaccacaacctcctggtctgtcatgtgactgacttttaccccggcagcattcaggttcggtggttccttaacggccaagaggagactgccggagtagtgtcaactaacctgatccgcaatggggactggacatttcagatactggtcatgttagagatgacaccgcagcagggtgatgtctacacctgccaagtggaacacacatcaatggatagtccagttaccgtggagtggaaggctcaaagcgattctgcgagatctaagacgttaactggagctggcgggtttgttttggggctgatcatttgcggggtgggcatctttatgcataggagatcaaaaaagtag

SEQ ID NO: 123123 - DNA, 708 bp, Artificial Sequence
  Description of Artificial Sequence: Synthetic coding sequence
tagaactatctgttccaagggagacaagagtgttacgccttcaacggcacgcagcgcttcttggagaggtacatatataacagagaggagttcgtacggtttgattctgacgtgggcgagttcagggccgttactgaacttggccgacctgacgaagagtattggaattctcagaaggatatacttgaagaggagcgcgccgtgccagatcgaatgtgccggcacaactatgaacttggaggccctatgactcttcagcgcagagttcaaccccgagtcaacgtgtccccttctaaaaaaggacctctgcaacaccacaaccttttggtgtgtcatgtcacagacttctatccgggttccatccaggttaggtggtttcttaatggacaagaagagaccgccggggttgtgagcaccaatttgattaggaatggcgactggacattccagattctggtcatgttggaaatgaccccccaacagggtgatgtctatacctgccaggtggagcacacctctctggattcaccagtgacagtcgagtggaaggcacagtctgacagcgctaggtctaaaacactcacaggcgcaggtggattcgtgttgggtctcatcatttgcggggtgggcatatttatgcaccggcggtccaaaaaaggcgaaaaagcatgtcgctttaacgaagaccttcacaaacaggggtcttag

SEQ ID NO: 123124 - DNA, 708 bp, Artificial Sequence
  Description of Artificial Sequence: Synthetic coding sequence
taaaattatctgttccaaggcagacaggaatgctacgctttcaacggcactcagcgtttcctcgaaaggtacatttacaatcgagaggagtttgctagatttgacagcgacgttggtgaattcagggctgtgactgagctgggcagacctgcagctgagtattggaacagccagaaagacatccttgaggaaaaaagagccgtgcctgatcgcatgtgtaggcataactacgagctgggagggccaatgacgctacagaggagagtccaacccagggtaaacgtgagtccgtccaagaaaggcccgctacagcaccataacctgctggtctgtcatgtcactgatttttatcctggctccattcaagtgagatggttcctcaacggacaagaggagaccgccggagttgtatctacgaatctgatccgcaacggtgactggacgttccaaatcctggtcatgctcgaaatgacacctcagcaaggtgacgtctacacctgccaggtcgagcacacgtcccttgattcccccgtgactgtggaatggaaggctcagtccgactcggctagatccaaaactttgacaggcgcaggagggttcgtcctagggctgattatctgcggggtgggcatattcatgcatcggagatcgaaaaagggcgagaaggcttgtcgcttcaatgaggatcttcataaacagggaagttag

SEQ ID NO: 123125 - DNA, 687 bp, Artificial Sequence
  Description of Artificial Sequence: Synthetic coding sequence
atgatggtcttacaagtcagcgccgccccaagaactgtggcactcactgccctgctcatggtgctgcttactagcgtggtgcagggacgcgctacacctgagaattatctgtttcagggccgccaggaatgctacgcgtttaatgggacacagcggtttctagagagatatatctataaccgtgaagagttcgtcagatttgattcagatgtgggcgaatttcgggcagtgactgaactgggccggcccgatgaagagtattggaacagtcagaaagacattcttgaagaggagagggccgtacccgacagaatgtgtcgccacaattacgagctcggggggcccatgacactccaacggcggggatcaattcaggtccggtggttcctgaacggtcaggaggaaaccgctggtgtggtaagcaccaatctaatacggaatggagattggactttccagattctggtaatgttggaaatgacaccacaacagggggacgtttatacctgccaagtcgaacacaccagtctggactcacccgtaacggtagagtggaaagctcaaagcgatagcgctaggagcaagactctgaccggggcagggggatttgtgttaggactaataatctgcggggttggcatttttatgcacaggaggtccaaaaaggtccagcggggaagtgcctag

SEQ ID NO: 123126 - DNA, 690 bp, Artificial Sequence
  Description of Artificial Sequence: Synthetic coding sequence
aagcaggcatggaggggcagcgctactagactcggtccacagaactctttacgccaggagtgctacgccttcaatggaacccagagatttctggagcgctacatctataatagagaggaattcgtccgctttgattcggacgtcggagaattcagagcagttaccgagctcggacgacccgatgaagattattggaatagtcagaaagacctgcttgaagagaagagagcagtcccagatagagtttgcagacacaattacgagctggacgaggccgttaccctgcagcgtcgtgtccagcccaaagttaacgtgagcccaagcaaaaaaggacccctgcagcatcataacctgctggtgtgtcacgtgaccgacttttaccccggctccatccaggtgcgctggtttttgaacgggcaggaagaaactgccggcgtcgtgagtactaatctgatccgcaacggagattggactttccagattctcgttatgttagagatgacaccacaacagggggacgtttatatctgccaggtcgagcatacctcactcgacagcccagttactgtcgaatggaaggcccagtcagacagcgccagatctaaaaccttgaccggggccggtggcttcgtgctaggactgattatttgcggggtggggatttttatgcacaggaggagcaagaaatag

SEQ ID NO: 123127 - DNA, 777 bp, Artificial Sequence
  Description of Artificial Sequence: Synthetic coding sequence
atgatggtgctgcaggtgagcgccgctcctagaaccgtggcactaactgcactgctgatggtcctgctcacctctgtggtgcagggcagggccacacctgagaattacctcttccaaggtcgccaggagtgttatgcatttaatgggacacagaggtttctggagcgttatatatataatcgcgaggagttcgcgcggtttgacagcgatgtcggtgagttccgtgcagtaacggagctggggagacctgcagctgaatattggaattctcagaaagacatcctggaggaaaagcgggcagttcccgatcggatgtgcagacataactacgaactgggggggccgatgactttgcagcgccgagtgcagcccagggtgaacgttagtccttccaaaaagggccccctgcagcatcataacctgctggtgtgccatgtgaccgacttctacccaggctcaatacaagtcaggtggttcttgaatggacaggaggagactgccggcgtggtatccaccaatctcataaggaacggtgattggacgttccagatccttgtgatgttggagatgactccccagcagggtgatgtttatacttgccaagttgagcacacaagcttggactcaccagttacagtcgagtggaaggcccagtcagattcagctcggtctaagaccctgactggggcgggcggattcgttctgggcctaatcatatgcggggtgggcatatttatgcacaggagaagcaaaaaggtgcagcggggcagcgcctag

SEQ ID NO: 123128 - DNA, 708 bp, Artificial Sequence
  Description of Artificial Sequence: Synthetic coding sequence
taaaattacctgttccagggccgccaggaatgctatgcctttaatggaacacaaaggtttcttgagaggtacatctacaaccgtgaggagtttgtaagattcgacagtgacgtcggcgaattcagagccgttactgagctcggccgcccagacgaagagtattggaatagccagaaggatatcctcgaggagaagagagcagtgcctgaccgcatgtgccggcataactatgaactaggcggacctatgactcttcagaggagggtgcaaccgcgagtcaatgtctcaccctctaagaagggacctctacagcaccataatctgttggtttgccacgttaccgacttctacccaggctccattcaggtgagatggttccttaatggccaggaagagaccgcgggtgtcgtgtcgactaacttaatcaggaatggcgactggacttttcagatcctggtcatgctggaaatgactccacagcagggcgacgtctacacatgccaggtcgagcacacatcaatggatagccccgtgacagttgagtggaaggcccaatccgattcagccaggagcaagacattgacgggagctggtggattcgtgctgggcctgatcatttgtggcgtgggaatttttatgcatcgtaggtcaaagaagggtgagaaagcttgtaggttcaacgaggatctgcataagcagggttcttag

SEQ ID NO: 123129 - DNA, 690 bp, Artificial Sequence
  Description of Artificial Sequence: Synthetic coding sequence
aaacaagcctggaggggcagtgccacgaggctgggaccccagaacagcggacgccaggagtgctacgccttcaacgggacccagaggtttttagaacggtatatctacaaccgcgaggagttcgccaggttcgactccgatgtgggggagttccgagccgtaacagagctcgggaggccggccgcagagtactggaactcccagaaggacatccttgaagaaaaacgcgcagtcccagaccgtatgtgtcgccataattacgaactcggcggccccatgacccttcagcgacgcgtgcagcctagggttaacgtctcgccatctaaaaaaggtcctctgcaacaccacaatctcctagtctgccacgttaccgacttctaccctggatccatacaggtcaggtggttcctcaacgggcaggaggaaacagcaggtgtagttagtaccaacctcatcaggaacggagattggaccttccagatactcgtgatgctcgagatgaccccgcagcagggtgatgtctatacatgccaggtagagcataccagtctcgactctccagtcactgtcgagtggaaggctcagtccgacagcgcaaggtcaaagacccttaccggtgccggaggcttcgtgttgggattgattatctgtggcgtcggcatctttatgcaccgaagatctaagaagtag

SEQ ID NO: 123130 - DNA, 708 bp, Artificial Sequence
  Description of Artificial Sequence: Synthetic coding sequence
tgaaactacctctttcaaggccggcaggaatgttatgctttcaatggtactcagagatttctggagcgatatatctataaccgtgaggaattcgcccgctttgatagcgacgttggagagttccgcgctgtgactgagttaggcagacccgcagccgaatactggaacagccagaaggacatcctagaagagaaacgagctgtgcctgacaggatgtgcagacacaactacgagctgggtggccctatgacccttcaaagacgcgtgcaaccacgagtgaatgtgagtccgtctaagaagggccccctgcagcaccataatcttctcgtgtgccacgtgactgacttctatcccggctctatacaagttaggtggtttctcaacggtcaggaagaaaccgcaggggtcgtaagtactaacctgatacggaatggtgattggacatttcagatcctggtaatgctggagatgacgccccagcagggagacgtctacacctgccaggtagagcacacctccctggactcccctgtaaccgtggagtggaaggctcagtctgatagcgcacggtcaaagacactcactggcgctggtggattcgtcctcggtctgatcatttgcggcgtcggaattttcatgcatcgaaggtctaagaagggagagaaagcctgtcgtttcaacgaagacctgcataagcagggcagctag

SEQ ID NO: 123131 - DNA, 372 bp, Artificial Sequence
  Description of Artificial Sequence: Synthetic coding sequence
atgatggtcttgcaagtgtctgcagcgcctaggaccgtcgctttaaccgcactactgatggttctgctgactagcgtggtgcagggccgcgccaccccagagaactacctttttcaggggaggcaggagtgttatgcgttcaacggtactcaacggtttttggagagatatatttataatcgggaggaatttgcgcgctttgacagcgatgtgggagagttcagggcagtgactgaactgggaagacctgcggccgagtactggaactcacagaaggatattttggaagaaaaacgcgctgtaccggacagaatgtgccggcacaactatgaactcggaggcccaatgactctgcaacggcgcggggagtag

SEQ ID NO: 123132 - DNA, 249 bp, Artificial Sequence
  Description of Artificial Sequence: Synthetic coding sequence
atgactcctcagcagggggacgtgtatacttgccaggtcgagcacacgtctctggactcccccgtcactgtggaatggaaggcccagtccgattcagctaggtctaagaccttaacgggtgcaggaggccgagctggcgcacaccatttgtggtccgggcatctgcacgcacaggaggagcaagaaagctctaccagaatttgtataaacagagttccggagcttactgaaaagactatcgtgccttag

SEQ ID NO: 123133 - DNA, 249 bp, Artificial Sequence
  Description of Artificial Sequence: Synthetic coding sequence
atgacaccgcagcagggggatgtttatacctgccaggtagagcatacaagcttggattcccctgtgaccgtagagtggaaggcacagtctgacagtgctcgctcgaaaacattgacgggcgctggcggaagggccggagcacaccatttgtggtctgggcacctgcacgcccaagaagaacaggaatcctccaccagaatctgcattaatcgcgtgcctgagctcaccgaaaagactatcgtgccctag

SEQ ID NO: 123134 - DNA, 372 bp, Artificial Sequence
  Description of Artificial Sequence: Synthetic coding sequence
atgatggtactccaagtgtccgccgccccaagaaccgtggctctgactgcccttctgatggtgctgcttacttcagttgtgcaaggacgggcaaccccggaaaactacctattccaaggcaggcaggaatgctacgcctttaatgggacccagcgctttctcgagcggtatatttacaatcgggaagagctggtccggtttgattctgacgtaggggaattccgcgcggtgacagagttaggtcgccctgaagccgagtactggaattcacagaaggacatattggaggaggagcgtgccgtgccagatcgcatgtgtaggcacaattacgaactaggcgggcccatgaccttacagcgtaggggagagtag

SEQ ID NO: 123135 - DNA, 372 bp, Artificial Sequence
  Description of Artificial Sequence: Synthetic coding sequence
atgatggttcttcaagtctccgcagctccacgtaccgtggcactaaccgcactgctgatggttctgctgacttccgtggttcagggcagggcaacccctgagaattacttgtttcaggggaggcaggaatgttacgcttttaacgggacccagcgattcctggaacgatatatttataatcgtgaagagtttgttaggtttgactccgatgtgggggagttccgcgctgtgaccgagctgggcagaccagatgaagagtattggaatagccaaaaagacattctggaagaaaagagagcggtgcctgatcgcatgtgccgtcacaattatgaacttggcgggcccatgacgttgcagcggcggggggaatag

SEQ ID NO: 123136 - DNA, 372 bp, Artificial Sequence
  Description of Artificial Sequence: Synthetic coding sequence
atgatggtgcttcaggtgagcgctgccccgaggaccgtggctcttacggcactgcttatggtgctgctgactagcgtggtgcaaggtagagcaactcctgaaaactacctctttcagggacggcaggagtgttatgcatttaatggaacgcagaggttcctcgaaagatacatatacaatcgggaagagttcgtgcgtttcgacagcgatgttggggaattcagggctgtaacagaactggggcgacccgatgaggagtattggaacagccaaaaggacatcctggaggaagagcgcgcagtgcctgacaggatgtgtcggcacaactacgaactcggtgggcctatgacgctacagcggaggggagaatag

SEQ ID NO: 123137 - DNA, 750 bp, Artificial Sequence
  Description of Artificial Sequence: Synthetic coding sequence
atggtcctgttgacgagcgtagtacagggacgggccacacccgagaattacgtttaccaactccgtcaagagtgttacgcctttaatggaactcagcgcttcttggaacggtacatctacaacagggaggagttcgtgaggtttgactcggatgttggcgaattcagggctgtaactgaattggggagaccagatgaggactattggaactctcagaaagatctgctcgaagagaagagagccgtgccagatcgggtttgtcgccacaattacgaactggacgaggctgtgacactccagcgaagagtccagcccaaggtgaatgtgtcaccaagtaagaaaggacccttgcagcatcacaacctcttggtgtgccacgtaacagatttctatcccggctcgatacaggtgaggtggtttctgaacgggcaggaggagactgccggcgtcgtgagcacaaatctgatccgcaatggcgactggacctttcagatcctggtgatgctggagatgaccccacaacagggcgatgtgtacatctgtcaggtggagcacacaagcctggacagccccgtcactgtcgaatggaaagcccagagtgattcagctcgatccaaaactctgactggagcggggggatttgtgctcggcctcatcatctgtggggtcggtatttttatgcatagacggagtaagaagggagagaaagcgtgcaagtttaatgaggatttgcataagcaaggcagctag

SEQ ID NO: 123138 - DNA, 249 bp, Artificial Sequence
  Description of Artificial Sequence: Synthetic coding sequence
atgactccccaacagggtgacgtttacacctgccaggtagagcacacatcacttgactctcctgtcacagttgaatggaaggctcaatcagacagtgcacgctctaagacactcaccggtgcaggaggcagagctggagcacaccacctgtggagtggacatctgcatgcccaagaagaacaggagagtagcacacggatttgcatcaatagggtccccgagctgactgagaagaccatcgtcccttag

SEQ ID NO: 123139 - DNA, 372 bp, Artificial Sequence
  Description of Artificial Sequence: Synthetic coding sequence
atgatggtgctgcaggtcagcgccgccccgcggactgtggcgctgacagcgcttcttatggtactgctcactagcgtcgttcaggggcgggccacccctgaaaactatctgttccaaggacggcaggagtgttacgctttcaatggcacccaacggttcctagagagatatatctacaatagagaggaatttgctcgcttcgatagcgatgttggggagttcagggccgtcaccgagcttggacggccagcggcggagtattggaattcgcaaaaggatatcctcgaggagaagcgagccgttcccgaccggatgtgtagacataattacgagctgggcggccctatgactttacagcgtcggggggagtag

SEQ ID NO: 123140 - DNA, 372 bp, Artificial Sequence
  Description of Artificial Sequence: Synthetic coding sequence
atgatggtgctgcaggtttccgctgcgccccggaccgttgccctcaccgctctgttaatggtgttgcttacaagcgtggttcagggcagagccactccagagaactatttatttcagggccggcaggaatgttacgccttcaatgggacccagcggtttcttgagcgctacatttacaacagggaggaattcgcccgctttgatagcgatgtgggcgaattccgagcagtcactgaactaggcaggcctgcggccgagtattggaattcgcagaaggacatcctggaggagaaacgggcagtgccagaccgtatgtgtaggcataattatgagctgggaggtcctatgaccctgcagcggcgcggtgaatag

SEQ ID NO: 123141 - DNA, 198 bp, Artificial Sequence
  Description of Artificial Sequence: Synthetic coding sequence
atggatagtcccgtcactgttgaatggaaggcacaatctgatagcgcaaggagcaaaaccctcacaggagcaggcggaagagctggggcccaccacctgtggtccgggcacctgcacgcccaggaggagcaggagtcgtccacccggatttgcattaatcgcgtgccagaacttaccgaaaagacaattgtgccgtag

SEQ ID NO: 123142 - DNA, 381 bp, Artificial Sequence
  Description of Artificial Sequence: Synthetic coding sequence
atgatggtcctccaggtgtccgccgctccgaggaccgtagcacttacagccttgctgatggtccttctgacaagcgttgtccaaggcagggctaccccagagaactacgtctatcagctgcgccaggaatgctatgccttcaacggtacacagaggttcctcgaacgctacatctataatcgcgaagagttcgttagatttgactctgacgtgggcgagtttcgcgctgtgaccgagcttggccgcccagacgaggattactggaattctcaaaaagatctcctcgaggaaaagagagcagttccggatcgagtttgtagacacaactacgaactagacgaggcagtaacgctgcagaggcgggagagagggaaaaaatag

SEQ ID NO: 123143 - DNA, 249 bp, Artificial Sequence
  Description of Artificial Sequence: Synthetic coding sequence
atgactccgcagcagggcgacgtgtacatttgccaggtggagcacacaagtctcgactcccccgtgaccgtggaatggaaggcacaatcagattctgcccgttcgaaaacgctgaccggtgctggaggcagggccggtgcccatcacctttggtccggacatttacacgcccaggaggagcaggagagctcaactcgcatttgcataaacagagttccggacctcacagaaaaaactaatgtcccgtag

SEQ ID NO: 123144 - DNA, 249 bp, Artificial Sequence
  Description of Artificial Sequence: Synthetic coding sequence
atgacaccccagcaaggagacgtttacacctgtcaggtggaacacactagcttggattcccccgtgaccgtggaatggaaggcacagtccgactccgccaggagtaaaactttaactggtgccggtgggagggctggtgcacaccacctgtggagtggacatttgcatgcgcaggaagaacaggaaagctctacaaggatctgcatcaacagagttccagagctgaccgagaagacaattgtgccgtag

SEQ ID NO: 123145 - DNA, 372 bp, Artificial Sequence
  Description of Artificial Sequence: Synthetic coding sequence
atgatggtgttacaggtgagcgccgctccccgcacggtagctctaacagcattattaatggtgctgttgaccagtgtggtccagggtcgagcaacccccgagaattacctgttccagggcagacaggaatgctatgcctttaacgggactcagagattcctggagagatatatatacaatcgggaggagttcgttcgtttcgatagtgatgttggagagtttcgagccgtcaccgaattgggcagacctgacgaggagtattggaacagtcagaaggatattcttgaggaaaagcgagccgttccagatcgcatgtgcagacataactacgagctcggaggtcccatgacacttcagaggcgcggcgaatag

SEQ ID NO: 123146 - DNA, 198 bp, Artificial Sequence
  Description of Artificial Sequence: Synthetic coding sequence
atggactcacccgtcaccgttgaatggaaagctcagagcgattccgccagaagtaaaactctgactggcgcgggagggagggcaggcgcccatcatctatggagcggccatctccatgctcaggaggaacaggagtccagtacgagaatctgtatcaatcgcgtgcccgaactcactgaaaagacaatcgtaccatag

SEQ ID NO: 123147 - DNA, 768 bp, Artificial Sequence
  Description of Artificial Sequence: Synthetic coding sequence
atgatcctgaacaaagcattactgctgggggctctggctttgacgaccgtcatgtccccctgcgggggcgaagacatagtggccgaccatgtagcctcttgtggcgtgaacctgtatcagttttatgggccatctggccagtacactcatgaattcgacggggacgagcagttttatgttgacctcgagcggaaggaaaccgcctggagatggccagaattttccaagtttgggggttttgaccctcagggcgcactgcgcaacatggccgtagccaaacacaatctaaacattatgattaaacgatacaattccaccgctgcgaccaatgaagttcctgaagtgactgtctttagcaaaagtcccgtgaccctgggacagcccaacaccttgatttgtctggttgataatatctttcccccagtggtgaacattacgtggctgtccaacggacagtcggtcacagagggtgtaagtgagaccagttttctgtcgaaatccgatcattcctttttcaaaattagttatctcacctttctgcccagcgcggacgagatttatgactgcaaagtggaacactggggtctggatcagcctttgcttaaacactgggaacctgagatacccgctcccatgtccgagctgacggagaccgtcgtgtgcgcactcgggctgtcggtgggcttgatggggattgtggtggggactgtgttcatcattcaaggactgcggtccgtgggggcaagccgtcaccaaggcccactgtag

SEQ ID NO: 123148 - DNA, 768 bp, Artificial Sequence
  Description of Artificial Sequence: Synthetic coding sequence
atgatcctcaacaaagccttactgctgggtgccttggccctcaccaccgtgatgagcccctgcggcggggaggacatcgtggctgatcacgttgcgagctgtggcgtgaacttataccagttttacggaccatccggccagtatactcatgaatttgacggggacgagcagttctatgttgacttggagaggaaagagactgcatggaggtggccagaattttccaagtttggcggattcgatccacagggggctctgcggaatatggccgtcgcaaagcacaatctcaacatcatgatcaaacggtacaacagtaccgctgcaactaacgaggtgcctgaggtgacggtgtttagcaagagccctgtgaccctgggccaacccaacactctaatttgtcttgtggataatatctttccaccagtggtcaacattacctggttgtccaacgggcagagtgttacagaaggggttagcgagaccagttttttgagcaaatctgaccactccttcttcaaaatcagctaccttacattcctgccctccgccgatgagatctatgattgtaaagttgagcactgggggctggatcaacctctgctgaagcattgggaacctgagatcccagcgcctatgtcagagctgacagaaaccgtcgtgtgtgcccttggattatcagtgggcttgatgggtatcgtcgtgggcaccgtgttcattatccaggggctcaggtcagtgggtgcctccagacatcaggggcctctttag

SEQ ID NO: 123149 - DNA, 765 bp, Artificial Sequence
  Description of Artificial Sequence: Synthetic coding sequence
atgattctgaacaaagcacttatgctgggagctcttgccctaacaaccgtgatgtctccctgtggcggtgaagatatagtggctgaccatgtagcatcgtatggagtcaatctgtatcaatcatacgggccgtccggccaatacacgcatgagtttgatggggacgagcaattctacgtcgatttggggagaaaagaaaccgtgtggtgcctcccagtgctgaggcagtttcgtttcgacccccagttcgcattaacaaacatcgctgtcctgaagcacaacctgaattccttaatcaagagatccaactcgactgccgccactaatgaggtaccagaggtaaccgtattttccaagtcccccgtaacgttggggcagcccaatattttgatatgtctggtcgataatatcttcccccccgtcgtaaacattacttggctcagcaatgggcatagtgttaccgaaggagtcagtgaaacttctttcctttccaaatccgaccacagcttttttaagattagctatttaaccttgctcccatccgcggaggagagttacgactgcaaggttgagcactggggcctggataagcccctgctaaagcattgggaacctgagattccagcgcctatgtcggagctcaccgagacagtcgtttgtgcccttggtctctccgtggggctggtcggaattgttgtcggcactgttttcattatcagaggattgaggtctgtgggagcaagcagacaccaaggtccactgtag

SEQ ID NO: 123150 - DNA, 768 bp, Artificial Sequence
  Description of Artificial Sequence: Synthetic coding sequence
atgatcctgaataaagctctgttgctgggcgccctcgccttaactactgtgatgtctccctgtgggggggaagatattgttgccgatcacgtagctagctgtggggtgaatctgtatcaattctatggaccttctgggcaatatactcacgagttcgatggagatgaacagttctacgtggatctagaacgaaaagagacagcctggaggtggcctgagttcagcaagttcggaggtttcgacccacagggtgctctccgtaacatggcagtagccaagcacaatttgaacatcatgataaaacggtacaattccaccgccgccactaacgaagtgccggaggtcactgttttttccaaatccccagtcactctcggtcaaccaaatactctgatctgtttagtggataacatttttcccccggtggttaatattacatggttgagcaacgggcagtcagtcaccgagggtgtgagcgaaactagtttcctaagcaaatctgaccacagtttcttcaagattagttatttgacttttctgccctccgctgacgagatctatgactgcaaagtggagcattggggactagatcagccactgctgaagcactgggagcctgagatccccgccccgatgagcgagctgactgaaacagtagtatgcgccctcggtctgtctgtgggactcatgggcatagttgtgggaacagtctttataatccagggtctcagatccgtcggagcctcccggcatcaggggccactctag

SEQ ID NO: 123151 - DNA, 768 bp, Artificial Sequence
  Description of Artificial Sequence: Synthetic coding sequence
atgatcctgaataaagcactgctactgggcgctctcgctctgactaccgttatgagtccctgtggaggtgaggatatcgtcgccgaccacgttgcctcctgtggagtaaatttatatcagttctatggaccaagtggccaatacacccacgaattcgatggcgatgaacagttctatgtggatctcgagcgtaaagaaaccgcctggcggtggcctgagttctcaaaattcggcggcttcgaccctcagggtgcccttaggaacatggctgtggccaaacataacctgaacatcatgatcaagaggtacaactcaaccgcagcaacgaacgaagtgccagaagtcactgtgttctctaaaagtccagtgacgctgggtcagccaaacaccttaatctgcctagttgacaacatttttccccccgtggtgaacatcacctggctaagtaatggccagtcagtcacagagggagtatcagagacgtcctttctgagcaagagtgatcatagtttctttaagataagctatctgacatttttacccagtgccgatgaaatttatgactgtaaagtggagcactggggactcgaccaacctttgttaaagcattgggaacccgaaatccctgcacccatgtccgagctaaccgagactgtcgtttgcgctcttgggttatctgtcggcctcatgggaattgttgtagggaccgtctttataatacaggggctgcggtccgtgggcgcatcgagacatcagggcccactgtag

SEQ ID NO: 123152 - DNA, 765 bp, Artificial Sequence
  Description of Artificial Sequence: Synthetic coding sequence
atgattctgaataaagccctgatgctgggcgccctagctttaacgacagtgatgtctccctgtgggggcgaagatatcgtggccgaccacgtcgcctcctatggagtaaacttgtaccagtcctacggaccaagtggacagtatacccatgagtttgacggcgatgagcagttttatgtagacctgggccgcaaagaaacagtctggtgcctacccgtgctccgacagttccgcttcgatcctcaattcgcactgacgaatattgcagtgttaaagcataacctcaacagcctgattaagcgttcaaactcaaccgctgctaccaatgaagttcctgaggtgaccgtcttttctaagagtccagtaacccttggccagcccaatattctcatatgtctcgtggataacatcttcccaccagtggtgaacatcacgtggttgtctaatgggcattcggtgactgagggcgtgtctgagacaagctttctgagtaagtcagaccactcgtttttcaaaatttcctaccttactctgctccctagcgccgaggagtcctatgattgcaaggtagaacactggggcctggataaacccctgttgaaacattgggagcctgagattccagcaccaatgtccgagttgacagaaacagtggtatgcgcactagggctctctgtcggcctcgttggcatcgttgtgggcactgtcttcattataagaggtcttagaagcgttggcgcctcgaggcatcagggccctctttag

SEQ ID NO: 123153 - DNA, 765 bp, Artificial Sequence
  Description of Artificial Sequence: Synthetic coding sequence
atgattctcaacaaagctctgatgttgggggcattggctctcacgacggttatgtccccttgtgggggggaggacatcgtggcggaccacgtggcctcgtatggcgtcaatctgtatcagagttacggcccaagcggtcagtatacacatgagttcgacggcgacgagcagttctatgtggatctgggcagaaaggaaaccgtgtggtgtttgcctgtgctccggcagttccggtttgatccacagttcgctctgacgaacatcgctgtgttgaagcataatctcaactctttgattaagcggtccaattctacagctgctactaatgaggtgcccgaggtgacagtcttctccaaatctcccgtgacactggggcagcctaacattctcatttgtcttgtggacaacatctttccacctgtggtgaatatcacctggttgagcaatgggcacagcgtaactgagggcgtctctgagacatcctttttgtcaaaaagtgaccacagcttcttcaagatttcctatcttacgctgctgccttcagcggaggagagttacgattgtaaggtggagcactgggggctagacaagcctctcctaaaacactgggaaccagaaattccagcgcccatgtctgaactcaccgaaaccgtcgtttgcgctttgggactgtccgtgggcttagtgggtatagtcgtgggaacggtctttattatccgcggtctgcggtccgtgggggccagtaggcaccaagggcctctttag

SEQ ID NO: 123154 - DNA, 75 bp, Artificial Sequence
  Description of Artificial Sequence: Synthetic coding sequence
atgatactcaacaaggcgctcatgctgggtgcactggcacttacaaccgtcatgtccccctgtggcggcgaatag

SEQ ID NO: 123155 - DNA, 765 bp, Artificial Sequence
  Description of Artificial Sequence: Synthetic coding sequence
atgatccttaacaaagcacttatgctcggtgctctcgcattgaccactgtgatgtccccctgtgggggggaagatatcgtggcagaccatgtggcaagctacggagtgaatttataccaatcctacggaccaagcgggcagttcacacacgagtttgacggcgacgaggaattttatgttgatttggagagaaaggagacggtgtggaagcttccactcttccacaggttgcgttttgatcctcagttcgccctaacgaacatcgctgtgttaaagcacaacctgaacatcctgattaaacggtctaattctactgcagccactaacgaggttccagaagttacagtgttctctaagtcacccgtgacccttggtcagcctaacaccctgatttgtctcgtggacaacatttttccccccgtcgtaaacatcacctggctcagcaatggccactctgtaacggagggcgtgagcgagacatcttttctgagtaaatccgaccattcgttcttcaaaatctcttacctgacatttcttccatcggccgacgagatttatgattgtaaagttgagcactgggggcttgacgaacccctgttaaagcattgggaaccagagattccggcacctatgtcggaactcacggaaacagtggtctgcgccctcggtctctctgtaggattggtcggcatcgttgtagggacagtgcttattattcgagggctgagaagcgttggcgctagtcggcaccagggacccctgtag

SEQ ID NO: 123156 - DNA, 768 bp, Artificial Sequence
  Description of Artificial Sequence: Synthetic coding sequence
atgatcctgaacaaagcgctcatgctgggggccttagcgttgacgactgtgatgagcccatgcgggggtgaggacattgtggccgaccacgtagcatcttatggcgtgaatctttatcaatcatatgggcctagcgggcagtacagccacgaatttgatggtgacgaagagttctacgtggacttggagagaaaggagactgtgtggcagctccccctttttcgcagattccgccggtttgatccacagtttgcgcttactaacatcgcggtcctgaaacataaccttaacatcgtcattaagcggagcaactcaactgctgcaactaatgaggtccccgaagtaacagtttttagcaagtcaccagtgactctggggcagccgaacaccttgatctgcctggtcgataatatcttcccacctgtcgtcaatattacatggctgtcgaacgggcactcagtgaccgagggcgttagcgaaacctcttttctgagcaaaagtgatcacagtttctttaaaataagctacctgacatttctcccatctgcggatgaaatctacgattgcaaggtggagcactgggggctagacgaacctttactgaaacattgggagcccgagattcccaccccaatgagcgaacttacagagacagtggtgtgtgctttaggactgagcgtgggtctagtcggcatcgtcgtcgggaccgtactgattatcagaggcttgagatcagtgggcgctagccggcatcagggacctctgtag

SEQ ID NO: 123157 - DNA, 768 bp, Artificial Sequence
  Description of Artificial Sequence: Synthetic coding sequence
atgatattaaacaaggcattgatgcttggggctctggctttaaccaccgtgatgtctccatgtggaggggaagatatagtcgcagaccacgtggcatcatacggagtaaacctttaccagtcttacgggccttcaggccagtactcccatgaattcgatggggacgaggaattttacgtggacttagaacggaaggaaaccgtgtggcagttaccactgttcaggagattccggcgtttcgacccccagttcgccttgactaatatcgctgtcctgaaacataacctgaatatagtaatcaaacgcagcaacagcactgcagcaacaaacgaggtgcccgaagtgaccgttttctccaaatctccagttaccctgggacaacctaacacccttatttgccttgtcgataacatctttccccctgtcgtcaacattacttggctttccaatggacatagtgtgactgaaggcgtgtctgaaacgagctttctttccaagagtgaccactctttttttaagatctcctacctgacttttctaccaagtgatgacgagatttacgattgtaaggttgaacattggggactagacgaaccactgttgaaacactgggagcccgagattccaactcccatgtcagagcttactgagactgtggtgtgtgctctgggcttgtctgtcgggttggtgggcattgtggtgggcacagtgctgatcatccgaggattgcgttctgtgggcgcctcacgccaccaaggacccctctag

SEQ ID NO: 123158 - DNA, 75 bp, Artificial Sequence
  Description of Artificial Sequence: Synthetic coding sequence
atgattctcaacaaggctctgctgttaggagcccttgctctgactacagtgatgtcgccctgcggcggtgaatag

SEQ ID NO: 123159 - DNA, 768 bp, Artificial Sequence
  Description of Artificial Sequence: Synthetic coding sequence
atgattctgaataaggctcttatgctgggagcactggctctgactactgtgatgtctccctgcgggggtgaggacattgtagcagaccatgtagcctcctacggggttaatctttaccagagctatggacctagtggccagtactcacacgaattcgatggagatgaggagttctacgtcgatctcgaacgcaaggagacagtgtggcagcttccgctcttccgcagattccgccgattcgacccccaattcgccctgaccaacatcgcagtgctcaagcataatctcaacatcgtgattaagaggtccaacagcactgctgcgacaaacgaagtgccagaagtgacagttttttctaaaagccctgtaacgttgggacagccaaatacactgatttgccttgtggacaacatattcccccctgttgtcaatatcacctggctcagcaatggccacagcgttactgaaggggtcagtgaaacctcattcctgtcaaagagcgatcactctttctttaaaatctcttacctaacattcttaccaagcgacgatgaaatctatgattgcaaggttgaacactgggggctggatgaaccactgctcaagcattgggaacccgagatccctactcccatgtctgagctaacagagactgtggtgtgcgcactagggctttccgtcggtctggtcgggattgtcgtgggaaccgtcctaataatcagggggctgcggtctgtgggcgcctcccggcaccagggaccactttag

SEQ ID NO: 123160 - DNA, 765 bp, Artificial Sequence
  Description of Artificial Sequence: Synthetic coding sequence
atgattctgaataaagcgttgatgttaggcgccctagcacttaccactgttatgtccccctgcggaggcgaagacatagtcgccgaccatgtcgcatcttacggagtcaacttgtaccagtcctacggcccatccggacagttcacccatgaatttgacggtgatgaggaattctatgtcgacctcgaacggaaagaaacggtttggaagctccccctttttcacaggctccgcttcgaccctcagtttgctcttaccaatattgcagtgctgaaacacaacctgaatatccttatcaagaggtctaattctactgctgcgacaaatgaagttcctgaggtaaccgtttttagcaagagcccagtcaccctgggacagccgaatactcttatctgcctggtagacaatatttttccaccagtggttaatataacatggctgtcaaatggccattcagttactgaaggtgtctctgaaacgtctttcctgtccaagagcgatcactcattctttaagatcagctatttgacctttctgccctccgctgatgaaatttatgattgcaaggtggagcactggggcttggacgagcctttattgaagcactgggagccagaaattccagccccaatgagtgagctgaccgaaacggtcgtatgtgcgctgggactgagcgtgggactggtaggaattgttgtcgggacagtgctgattataagagggctgagatcagtgggtgctagcaggcatcaggggccgctttag

SEQ ID NO: 123161 - DNA, 765 bp, Artificial Sequence
  Description of Artificial Sequence: Synthetic coding sequence
atgatcctcaacaaagcactgatgctcggagccctggcactgacaacagtgatgtcgccctgtgggggcgaggacatcgttgcagatcacgttgccagctatggcgtgaacctgtaccaatcttacggtccttcaggacagttcacccatgagttcgatggtgacgaggagttctatgtagacctggagcgcaaggagaccgtttggaaattaccactctttcaccggctgcgctttgatcctcagttcgcattaacaaacatagctgtgcttaaacacaacttaaacattttgatcaaacgctccaattctacagctgcaactaacgaagttcctgaggtgaccgtgttttcgaagtctcctgtgacactcggacagcctaatactttgatttgtttggtcgataacatttttccgccagtcgtcaacatcacctggttgtcaaatgggcattcagtaactgagggagtgtccgagacttccttcctgtcgaaatctgaccattcattcttcaaaattagctacctgacttttctccctagtgccgatgagatatatgactgtaaagtcgagcactggggtttagacgagcctctccttaaacattgggaacccgagatcccggccccaatgagcgagttaactgaaactgtggtgtgcgcccttggcctgtccgtgggtctggtgggtatagtggtgggcaccgttctaatcatcagaggcctgcgatccgtaggcgcctcccggcaccagggcccactgtag

SEQ ID NO: 123162 - DNA, 765 bp, Artificial Sequence
  Description of Artificial Sequence: Synthetic coding sequence
atgatccttaacaaggctctgatgttgggcgcacttgccctgaccacagttatgtccccttgcggaggggaagacattgtggccgatcacgtggcctcatatggcgtgaacctctaccagtcctacgggcctagcggccagtttacccacgaattcgacggagacgaggaattttatgtggatttggagcggaaggagaccgtttggaaattaccattattccatagacttcgcttcgatccacagtttgcgctgacaaacatcgcggtgctcaaacacaacctcaacattctgattaagcgcagcaatagcacagccgcgacgaacgaggtcccggaagtgaccgtgttcagtaagagtcctgttaccttgggccagccaaacacattaatctgcctggtggacaacatatttcccccagtggtgaacatcacgtggctatctaacggtcacagcgtgacagagggggtgtctgagacttccttccttagtaagtcagatcatagcttctttaaaataagctacctgaccttcctgccatccgctgatgagatttacgactgtaaagttgaacactgggggcttgatgaaccactgttgaaacactgggaacctgagatccctgcaccgatgtctgaactcaccgagacagttgtgtgtgccctgggcctctctgtgggactcgttgggattgtggtgggcacagtcctaataatcagaggactacgcagcgtcggcgcttccaggcaccaaggcccactctag

SEQ ID NO: 123163 - DNA, 768 bp, Artificial Sequence
  Description of Artificial Sequence: Synthetic coding sequence
atgattttgaacaaggctctgatgctgggagctcttgcactgacaacagtgatgtcaccatgtgggggtgaagacattgtggccgaccacgtggcaagctatggtgtgaatctgtaccagtcctatggaccgagtgggcagtatagccacgagtttgatggcgatgaggaattctatgtcgatctagagcgcaaagaaaccgtctggcagttgcctttgttcagaagattccgaaggttcgatcctcagttcgcccttacgaacatcgcggttctaaaacacaacctcaatatcgtgataaaaagatcaaatagtactgcggctaccaacgaggtgccggaggttaccgtgttcagcaagagcccagtgacactggggcagcccaacaccttgatttgcctcgtagataatatctttcccccggtggtaaacatcacgtggcttagtaacggccatagcgtcaccgaaggagtgtcagagacctcatttctgagcaaaagcgaccactcgttttttaagatctcctacctaacattcttgcctagcgctgatgagatttatgactgtaaagtggaacactggggtctggatgaacccctgcttaagcattgggaacccgaaatccccactcccatgtctgagttgaccgagaccgtagtgtgcgccctcggactctcagtcggattggttggaatcgtggtggggaccgtgctcataataagaggcctccggtctgtgggagctagtcgtcaccaggggcccctctag

SEQ ID NO: 123164 - DNA, 75 bp, Artificial Sequence
  Description of Artificial Sequence: Synthetic coding sequence
atgatccttaacaaggcgctgatgcttggcgcactggctcttactaccgtgatgtccccatgtggaggagaatag

SEQ ID NO: 123165 - DNA, 75 bp, Artificial Sequence
  Description of Artificial Sequence: Synthetic coding sequence
atgattcttaacaaggccttgatgctcggagccctcgcactgactaccgttatgtctccctgcggcggtgaatag

SEQ ID NO: 123166 - DNA, 768 bp, Artificial Sequence
  Description of Artificial Sequence: Synthetic coding sequence
atgatactgaacaaggctttgatgttaggggctcttgcgctgaccactgtcatgtccccctgtggcggagaggatatcgtcgcagaccatgtggcaagctacggcgtgaacttgtaccagtcctacggcccatccggacaatattcccatgagtttgacggggacgaggaattttacgtggatctggaaagaaaggagacagtgtggcagctaccgctatttcggagatttcgccggttcgatccccagttcgctctcaccaatattgctgtcctgaaacataacctgaatatcgttatcaaacgctcaaactccaccgcggctactaacgaggtacccgaggtgaccgtgtttagtaagagccccgtgacccttggccagcccaacacactgatctgcctcgttgacaacatcttccccccggtggtgaacattacctggctctccaacggccactctgtgaccgaaggggtctccgaaacatcattcttaagcaagtctgatcactcttttttcaagatcagttacctcacttttcttccgtcggacgatgagatttatgattgtaaagtcgagcactggggtctggatgagcctctgctcaaacactgggagccagagattcccacacccatgtctgaactgaccgagacagtggtctgtgcgctgggtctttcagtgggtctcgttggaatagtagtgggaactgtactgatcataagagggttgcgttcagtgggagcctcacggcaccaggggcccctgtag

SEQ ID NO: 123167 - DNA, 765 bp, Artificial Sequence
  Description of Artificial Sequence: Synthetic coding sequence
atgatactgaataaagcactcatgttaggtgcattggccctgactaccgtgatgtccccttgtggcggcgaggacattgtggccgatcatgtggccagctatggtgttaatctctaccagtcgtacgggcccagcggacaatttacgcacgagtttgacggggatgaagagttttacgtggacctggaacgcaaggaaaccgtctggaaactcccactctttcatcggctgaggtttgatccgcaatttgccctgactaatattgcagtcctgaaacacaacctcaatatcctgatcaagaggtccaactcaacggctgccaccaatgaagtcccagaggtgactgtgttctccaagagccctgtgacacttggccagccaaatacactgatttgtctggtagacaatatctttccgccagttgtaaatatcacctggctcagtaatggacactctgtgacagaaggcgtgtcagagactagtttcttaagcaagtccgatcactcattcttcaagatcagttacctgaccttcctcccttcagcagatgagatctatgattgcaaggtcgagcactgggggttggatgaaccgttgttgaagcactgggagccggagatccctgctcccatgtcagaactaacagaaacagtagtgtgcgcgttgggcctgtctgtggggctggtgggtatcgtggtgggaaccgtcctcataatcaggggtctcagaagcgtcggggcatccagacaccaaggacctctgtag

SEQ ID NO: 123168 - DNA, 765 bp, Artificial Sequence
  Description of Artificial Sequence: Synthetic coding sequence
atgatcctgaataaggctcttatgctgggtgccttagcactgacgactgtcatgagcccttgcggtggcgaagacatcgttgctgaccacgtggctagttacggggtgaatttgtaccagagctacggtccaagcggccagttcactcatgagtttgatggcgatgaggaattttatgttgatttagaacgaaaggaaaccgtatggaagctacctttgttccaccgcctgcgcttcgatccgcagttcgcgctcacaaacatagcagtattaaaacacaatctgaacatcctgatcaagcggtccaactcaacagctgccactaacgaggtgcctgaagtgactgtcttttcaaaatccccagtcaccctgggccagccaaacacattgatttgcttggtggacaatatcttcccacccgtggtcaacatcacgtggcttagtaacggtcatagcgtcaccgagggggtctcggagacaagttttctttcaaagtctgatcacagtttcttcaagataagctatttgacattcctgccctccgccgacgagatctacgactgcaaggtagaacattggggattggacgaacccctcctgaagcattgggaacccgaaatcccagccccaatgtccgaactgactgagacggtagtgtgtgcgctcgggctcagcgtgggactggtgggaatagtcgtgggcaccgtcttgatcataaggggcctgaggtccgtgggtgctagcagacatcaaggacccctgtag

SEQ ID NO: 123169 - DNA, 765 bp, Artificial Sequence
  Description of Artificial Sequence: Synthetic coding sequence
atgatattgaataaggctctcatgctcggagccctcgcactcacaacagtgatgtctccctgtggaggggaggatattgtggcagatcacgtggcttcgtacggagtaaacctgtatcagtcttacgggcccagcgggcagtttacccacgagttcgacggagatgaagaattctatgttgatcttgagaggaaggagacggtgtggaagctgcccctgttccacagattgaggttcgacccacagtttgccctgaccaatatcgccgtcctgaaacataatttgaatattctgattaaacggagcaatagcaccgccgcgactaacgaggtgccagaggtgacggtcttcagtaagtcccccgtcacattgggccagccaaatactctgatttgtctggtcgataatatctttccgcccgtggtgaacatcacctggctgtctaacggtcactccgtgacggagggggtgagtgagacttcattcctgtctaaaagtgatcactccttctttaagatcagttacttgacctttcttccctcagccgacgaaatttatgattgtaaagttgagcattggggactggatgaaccactgcttaagcattgggagcctgaaattcccgcaccaatgtccgaattgacagagacagtcgtgtgcgctctggggctgtccgtcggtctggtgggcatcgttgtggggaccgtgctaattatcagaggcctgaggtccgtaggggcctctagacaccaaggcccactgtag

SEQ ID NO: 123170 - DNA, 768 bp, Artificial Sequence
  Description of Artificial Sequence: Synthetic coding sequence
atgatcctcaacaaagccctaatgctcggtgctctcgcactgacgaccgtcatgagtccctgcggtggcgaggacattgtcgctgatcacgtagcgagctatggagtgaatctataccaatcctatggccccagtggccagtattcgcacgaatttgatggggatgaggagttttatgttgacctggaaaggaaagagaccgtgtggcagctgccacttttccgacgctttaggcgttttgacccacaattcgctctgacaaatattgcagtgctgaaacataatctgaatattgtgataaagcgctctaatagtaccgctgccaccaatgaggtacccgaggttacggtcttctcaaaaagtcccgttacattaggacagcctaatactctaatttgtcttgtggataatatttttccccctgtggtcaatataacatggctgtccaatggtcacagtgtcacagagggggtctcggagacttctttcctgagcaagtctgaccacagcttctttaagatctcctacttaacctttctccctagtgacgatgagatctatgattgtaaggtggaacactgggggctggacgaaccgctcctgaagcactgggaacccgagatccccacccccatgagcgagcttacggaaacagtggtgtgtgctctcggcctgagcgtgggcctggtggggatcgttgtgggcaccgtgctgattatccgcgggctgcgcagtgtgggcgcctcacggcaccaaggtccactctag

SEQ ID NO: 123171 - DNA, 765 bp, Artificial Sequence
  Description of Artificial Sequence: Synthetic coding sequence
atgattctgaacaaggcgttgatgctcggcgcgctggcattaaccacagtcatgtcaccatgcggaggcgaggacatcgtcgccgaccacgtggcatcatacggagtgaatttgtatcagtcttatggcccttctggccagttcactcatgaattcgatggagatgaggagttttatgtggatctcgaaagaaaagagacggtgtggaagctccctctgttccatcggcttcgttttgatcctcaattcgcattaaccaatatcgctgttctaaagcataatctaaatattctgatcaagcggtctaatagcacagcggctacaaatgaggttcctgaggtcacagtgttctcaaaatcccctgttacactgggccaacctaacacactgatatgcctggttgacaacatcttccctccggtggtcaatattacatggctctccaatggacattcggtgacagagggagtttccgaaacatcttttcttagcaaatctgatcactccttttttaagattagctacctgacattcctaccaagtgctgatgagatttacgactgcaaggtggagcactggggactcgatgagcccctgctgaaacattgggagcctgaaatccccgcccctatgtccgagttaaccgaaactgtggtgtgtgctctgggcctctccgtgggcctggtcggcattgtcgtgggcacagtgcttatcattcgagggctgcggagcgttggcgcctctcgccaccaaggcccgctgtag

SEQ ID NO: 123172 - DNA, 645 bp, Artificial Sequence
  Description of Artificial Sequence: Synthetic coding sequence
atgatccttaacaaggcattgctacttggggcgcttgcactcactaccgtaatgtcaccgtgtggcggggaggacatcgtggcagatcatgtggccagctgcggtgtcaatctgtaccagttctacgggccatctgggcaatatacccacgaatttgatggtgatgaacagttctacgttgatctagagcggaaagaaacagcatggagatggcccgaattcagtaaatttgggggatttgacccccagggcgccctgcgcaacatggctgtcgctaagcataatctcaacattatgattaaaaggtacaatagcaccgctgcgaccaatgaggtgcctgaggtaaccgtcttcagcaagagcccggtgacactcggccagcctaacacgctcatctgcctggtcgataacatatttccgccagttgttaatataacttggctttccaacgggcaaagcgtgacagagggggtcagcgaaacctcctttctcagtaagagcgaccactcctttttcaagatctcttacctaacatttctcccaagcgccgatgaaatttatgactgtaaagttgaacactggggattggaccagcctcttctaaagcactggggagcctctcctagcactggggcagaagagtag

SEQ ID NO: 123173 - DNA, 576 bp, Artificial Sequence
  Description of Artificial Sequence: Synthetic coding sequence
atgagcccttgcggaggtgaagatatcgtcgccgaccacgtggcctcatatggagtgaatctctatcagtcatacgggccttccggacagtattctcacgagttcgatggtgatgaagagttttatgtggaccttgaacgcaaagaaactgtgtggcagctccccctgttcaggcgttttagaaggttcgatcctcagtttgcgctcaccaacattgccgtgcttaagcataacctcaacatcgtgattaagagaagtaattctacggctgcgactaacgaagtgcccgaggtaacggttttctctaagtctcctgttacacttggccagcccaacaccctgatctgcctggtcgacaacatttttccccctgtagtgaatattacctggctcagtaacgggcattcggttactgagggagtgtctgagacttccttcttaagcaaaagtgaccacagcttctttaaaatcagctacctcacattcttaccttctgctgacgagatttacgactgcaaggtcgaacattgggggttggatgagccccttctgaaacactggggtctcctgcattag

SEQ ID NO: 123174 - DNA, 441 bp, Artificial Sequence
  Description of Artificial Sequence: Synthetic coding sequence
atgatcctgaacaaggctctgatgcttggcgcattagctctgaccaccgtgatgtccccgtgtgggggggaagacattgttgctgaccacgttgcttcgtatggggtaaatctgtatcagtcatacggtccctcaggacagtacactcacgagttcgatggagacgaacaattctatgtggatctcgggcggaaggaaactgtgtggtgtctgcccgtgctccggcagttccgctttgatccacaattcgctttaactaatatgtgtattgccatttaccggagccggagggtagaccttctgcacgacctggcactcttttccggtccgatctaccacattccgtttcttcttcagatgtttctactgagcccacttctgtgggatctgaattgttatatttgcagtgagcttactaacgctttcgagctattcccatag

SEQ ID NO: 123175 - DNA, 762 bp, Artificial Sequence
  Description of Artificial Sequence: Synthetic coding sequence
gggtgtctggggaaaaggatgatccttaacaaggccctgatgctgggggccctcgcccttacaactgtaatgtcgccctgcggtggagaagacatcgtggctgaccacgtggcatcttacggcgttaacttgtaccagtcttacggccccagcggacagtacacccatgagtttgacggtgatgagcagttctatgtggatctgggacgtaaagagaccgtctggtgtctgcccgtgttgcgccagtttagattcgatccccagttcgccctgacgaatatagcggtactgaaacacaatctgaactccctaatcaaaagatctaacagtactgccgccaccaatgaggttcctgaggttacagtgttcagtaagtcacctgtgacactggggcagccaaacattttgatatgtctggtggataatatcttccctcctgtggtgaacattacgtggttgtctaacggacactcagtcaccgaaggggtatcggaaacatcttttttgtccaagtccgatcatagcttttttaaaataagctatctcactctgctccccagcgcagaagagtcatacgattgtaaagtcgaacattggggtctggacaagcctctgctgaaacactggggaaaggacgagtttcaccacttcctgatgttgtcctgtttgagttcttccgaactccctgccttttatagctacataccgaaactggtgtttcacacgtcctgggtgtcattctttcttatcttctttttctag

SEQ ID NO: 123176 - DNA, 603 bp, Artificial Sequence
  Description of Artificial Sequence: Synthetic coding sequence
atgtcaccttgcggtggagaggatatcgttgctgaccatgtggcctcctacggcgttaatctgtaccagtcttacggaccttccggccagtatagccatgaattcgacggggacgaggagttttacgtagacctagagagaaaagaaacagtgtggcagctccccctattcaggcgttttcggcgatttgatccgcagtttgctctgacaaatattgctgtgttgaagcacaatcttaacattgttataaaaagaagcaacagtaccgccgccaccaacgaggtcccagaagtgacagtgttttctaaatcccctgtcaccttgggccagccaaacacactgatctgcttagtggacaatatctttcccccagtggtgaatatcacatggctctcaaatggccactctgtcacagaaggagtgagtgaaaccagctttcttagcaagtccgatcactctttttttaaaatttcttaccttacctttctgccatcagccgatgaaatttacgattgcaaagttgagcattggggacttgatgagcccttgctcaaacattgggagtctcagtcccgcgagtcagaggaaagtacaaaatcatag

SEQ ID NO: 123177 - DNA, 582 bp, Artificial Sequence
  Description of Artificial Sequence: Synthetic coding sequence
atgagcccgtgtggtggagaagacatcgtcgctgatcatgtggcaagttatggggttaatttgtaccagtcttacggcccttctggacagtatacccacgaattcgacggcgatgagcaattctacgtggatcttgggcggaaagagacagtatggtgcttgccagtgctgcgccagttcagatttgatccacagtttgctcttacgaatatcgctgtgctgaagcataatctgaactcgttgattaagaggagcaacagtacggccgccactaacgaggtcccagaggtaacagtcttcagcaaatcccctgttacactcggtcagcctaatatcctgatatgcttagtggataatatctttcccccagtcgtgaacatcacctggctctctaacggccactcagttacggagggtgtaagcgaaacgagtttcttgtccaaatcagatcacagtttttttaagatttcctatctgactttattaccctccgctgaggagtcctacgactgtaaagtcgagcactggggcttagacaaacccctgttaaagcattgggttcacggatttctcagcttttag

SEQ ID NO: 123178 - DNA, 606 bp, Artificial Sequence
  Description of Artificial Sequence: Synthetic coding sequence
atgtcaccttgcggaggcgaagacatagtcgctgaccacgtggcaagctatggcgtaaatctctatcagagctatggcccctccgggcagtactcccatgaatttgacggagatgaggaattctacgtcgacttggaaagaaaagaaaccgtgtggcaattgccactgtttcgacgtttcaggaggttcgacccccagttcgctcttactaacattgccgtcctgaaacataatctgaatatagtaatcaaacggagtaatagcacagccgccaccaatgaggtccctgaagtgacagtttttagtaaatcacccgttacacttggacagccgaataccttaatctgcctcgtggacaatatttttcctccggttgttaacattacgtggctgtccaacggacacagcgtgacagagggtgtgtcggaaacatcattcctttctaagtcagatcatagcttctttaaaataagttatctcacatttctcccgtctgcagacgaaatctacgactgcaaagttgaacattggggcctggacgagccccttttaaaacactggggcatccaggcagaggaaggacaaagacgcaagaaacttggctag

SEQ ID NO: 123179 - DNA, 258 bp, Artificial Sequence
  Description of Artificial Sequence: Synthetic coding sequence
aataccctgatctgcctggttgacaatatatttccccccgttgtgaatattacctggttatctaacggacactcggtcaccgaaggcgtttcagagacctcattcttgagtaagtccgatcattcctttttcaagatcagctacctcacctttttgccttctgcggatgaaatatatgattgtaaggtcgagcactggggccttgacgaacctctgctaaagcactgggggaaagattttatgtctttcttttattag

SEQ ID NO: 123180 - DNA, 390 bp, Artificial Sequence
  Description of Artificial Sequence: Synthetic coding sequence
ggatgcctgggaaaaaggatgatactgaacaaggctctcatgctgggggctttggccttaacaactgtaatgtccccttgtggtggagaggacattgtcgccgaccatgtcgcatcttatggggttaatctatatcagagctacggcccgtctggacaatatagccatgagttcgatggagacgaggaattttacgtggatctggagcgcaaagaaaccgtctggcagttgcccctcttcagacgctttcgccgcttcgaccctcagtttgcactgacaaacattgccgttctgaagcataatctcaacatagtgattaagagatccaacagcacggctgccaccaatgaagtccccgaggtgacagttttctccaaaagcccagtgtag

SEQ ID NO: 123181 - DNA, 768 bp, Artificial Sequence
  Description of Artificial Sequence: Synthetic coding sequence
atgatcttgaacaaagctctccttctgggtgccctggcattgacagccgtcatgagcccttgtggaggcgaggacatcgttgctgatcatgtggccagttatggggtaaacttttatcagtcacatggtccgagcgggcagtacacccacgaatttgacggggatgaggagttttacgtggatctggagacaaaggaaactgtctggcagctcccaatgttttccaagttcattagcttcgatccccaaagcgctttgaggaacatggccgtcggtaagcacaccctggagttcatgatgcggcaaagtaatagcacggcggcgacaaacgaagttcccgaagtgactgtgttcagtaagttcccagtcactcttgggcagccaaacacgcttatctgcctcgttgacaatatctttcctcctgttgtgaatatcacttggctttctaacggccattctgtgacggaaggtgtatctgagacttccttcttgtctaagtccgaccattctttttttaagatttcttatctgacgtttctcccctcagcagacgagatttatgactgcaaggtcgagcactggggactcgacgaaccactgctcaaacactgggaacctgagattccagcccctatgtccgaactgaccgaaaccttggtctgcgccctagggttgagcgtggggctgatggggattgtggttggcacggttttcattatccaaggattaaggtcagtggatgcgtcgcgccaccagggccttctctag

SEQ ID NO: 123182 - DNA, 768 bp, Artificial Sequence
  Description of Artificial Sequence: Synthetic coding sequence
atgattttaaacaaggctttactgcttggggctctagcacttaccgctgttatgtccccttgcggcggagaggacatcgtggctgaccatgttgcaagttacggcgtgaacttctaccaatcccatggtccgtcagggcagtatacacacgaatttgatggggatgaagaattttacgtcgatctggagacgaaggaaaccgtgtggcagctgcccatgtttagcaagtttatctcctttgatcctcagtctgcactgcgaaacatggctgtggggaagcacaccctggagttcatgatgagacagtcaaattctacagctgccactaatgaagtgccagaggttactgtcttttctaagtttcctgtcactttgggacagccgaatacactgatctgcttggtcgataacatcttcccacccgtcgtcaatattacctggttgtctaatggccattctgtcacagaaggggtgagcgagacctctttcttatctaaaagtgatcactcgttcttcaagatctcctatctgacttttctcccaagtgctgacgaaatctacgactgcaaggtggagcattggggacttgatgaaccactcctgaaacactgggagcccgagatacccgcacctatgagcgagctgaccgaaacactggtgtgtgccctagggctgtccgtgggcctcatgggtatagttgttggtacagtgttcattatacagggtctgagatcggtgggagcatctaggcaccaggggctgctctag

SEQ ID NO: 123183 - DNA, 768 bp, Artificial Sequence
  Description of Artificial Sequence: Synthetic coding sequence
atgatcctgaataaggcactcctgttgggcgccctcgctctgaccgccgtgatgtctccatgcgggggagaagacatcgtagctgatcatgtcgcctcctacggtgtcaacttctatcagagtcacggcccttcagggcaatatacccacgagttcgatggcgacgaggaattctacgttgacctggagacgaaggaaaccgtatggcagcttcctatgttttccaagttcatcagcttcgacccacagagtgctcttagaaatatggcagtcggcaagcataccctggaattcatgatgggccagtctaacagcacagctgctactaatgaagtgcctgaggtcaccgtcttctccaagtttcccgtaaccctgggccagcccaacacacttatttgtttggtggataatatcttcccccctgtggtgaacatcacatggctgagcaatggtcacagcgttacggaaggtgtgtctgagaccagctttctttccaagtctgaccatagtttttttaagattagttacctcacctttctgccctccgcagatgagatctatgactgcaaagtggaacactggggtttggatgaaccgcttctaaaacattgggagcccgaaattcccgctccgatgtcggagttaactgagaccctcgtgtgcgcacttggactcagcgtgggtctgatggggattgtcgtcggcaccgtgtttattattcagggcctcagaagtgtgggagcctcaagacatcaggggctgttgtag

SEQ ID NO: 123184 - DNA, 768 bp, Artificial Sequence
  Description of Artificial Sequence: Synthetic coding sequence
atgatactgaataaggctcttctgctgggcgccctggcacttactgcggtcatgtccccctgtgggggggaggacattgtggctgatcatgtagcctcgtacggggtaaacttttatcaaagccacggcccatccggtcaatatacccatgaatttgatggtgacgaagagttttacgtagacctcgagaccaaagaaactgtctggcagctcccgatgttcagcaagttcatttccttcgatccgcagtcagccctgaggaacatggccgtgggtaaacatacattagagtttatgatgagacagtccaactctacggctgctaccaatgaagtgccagaggtaacagtcttttcaaaatttcccgtcaccctagggcaaccaaatacccttatttgccttgtagacaatatattcccacctgtggtaaacattacatggctgagtaacggacacagtgtcacagagggcgtgtccgaaactagtttcctgtccaagagcgaccactcattctttaaaatatcctacctaacattcctgccaagcgctgacgaaatctacgattgtaaggtggagcactgggggttagacgagccgctgcttaagcattgggagccagaaataccagcccccatgtctgaactgaccgagacattagtctgcgccctcggtttgtctgttggactaatggggatcgtggttgggaccgtattcatcatccagggtcttagaagcgttggagcctcgcggcatcagggtctgctctag

SEQ ID NO: 123185 - DNA, 768 bp, Artificial Sequence
  Description of Artificial Sequence: Synthetic coding sequence
atgatactgaataaagccctgctcctcggagccctagcactgacggcagttatgagtccctgtggaggcgaggacatagtggcagatcacgttgccagctacggggtcaacttctatcagtcccatggcccctccggtcaatatacacatgaattcgacggcgatgaagaattttatgttgatctggagactaaggagacagtgtggcagttgccaatgttttccaaattcatctctttcgatcctcaatcagccttaaggaacatggctgtgggaaagcatacactggagttcatgatgcgccagtcaaatagcactgcagccacaaacgaggtgccagaagtgactgtattttccaaatttccagttacacttgggcagccaaatacactgatctgcttagtggacaacatcttccctcctgtggtgaacatcacatggcttagcaacgggcactctgtcacagaaggtgtctcagaaacgtctttcctaagtaagtccgaccatagcttctttaagatatcttatttaacatttctccctagtgccgatgagatctacgattgtaaggtcgagcattggggcctggatgagccgctgctcaagcattgggagcccgaaattccagccccaatgtctgaacttacagaaacattagtgtgtgctctcggccttagcgccggactcatgggtatagtcgtgggaaccgtttttattattcagggtttacgatccgtgggagcttcccgccaccaagggttgctctag

SEQ ID NO: 123186 - DNA, 768 bp, Artificial Sequence
  Description of Artificial Sequence: Synthetic coding sequence
atgattctgaataaggctcttctcctgggcgcgctggcactgactgcagtgatgtccccctgtgggggggaggacatcgtagctgatcacgtcgcaagctatggagtgaatttttaccagagccacggcccaagcgggcagtatacccacgaattcgatggcgacgaagaattctatgtggacctggaaactaaggagacagtctggcagttgcctatgttcagcaagtttatttcctttgacccccagtcggctctgaggaatatggcggttgggaagcacacgttggagttcatgatgagacaatcaaactctaccgcagcaacgaatgaggtgcccgaggtgactgtctttagtaagttcccagtcacgctcggccagcccaacacccttatctgtctggtggacaacatctttccacctgtggtcaacataacttggttgagtaacgggcacagcgtcaccgaaggagtgagcgagaccagcttcttatctaaaagcgaccactctttctttaagatatcatacttgacttttctaccttcggccgatgagatctacgactgcaaagttgaacactggggacttgacgaaccactgctcaaacactgggagccagaaattccagcccctatgtctgagttgacagaaacactggtgtgtgcattgggactgtccgttggcttaatgggcattgtcgttggaaccgtattcattatacaggggttgagatctgtaggagctagtcgacaccaggggctgctctag

SEQ ID NO: 123187 - DNA, 768 bp, Artificial Sequence
  Description of Artificial Sequence: Synthetic coding sequence
atgatcctgaataaagctctccttcttggggcgcttgcactcacagccgtgatgagcccctgtggcggagaggacattgtcgctgatcatgttgctagctatggcgtcaacttctatcagagtcatggccccagcggccagtatacacacgagtttgatggtgacgaggaattttatgtggatctcgaaacgaaggaaactgtatggcagctcccgatgttttcaaaattcataagcttcgacccacagagcgctcttcgaaacatggccgtcggcaaacacaccttagagttcatgatgcgccaaagcaattccactgcggctaccaatgaagtgccggaggttacagtgttttccaagttcccagtcacccttggacagcctaacacactcatttgtctcgtcgacaatatattcccacctgtcgtgaacattacctggctcagcaatgggcattcagtaacagaaggggttagcgagacctccttcttgtccaagtctgatcacagtttctttaaaatctcctacctcactttcctgccaagtgcagatgagatctacgactgtaaggtggaacattgggggctcgatgagcctctcctcaaacattgggaacccgagattccggcccctatgagcgagctcactgagactcttgtgtgtgcgctggggctgtccgtagggctgatggggattgttgttggcaccgtgttcatcattcaggggttgagatccgtgggagcgtctaggcaccagggactgctgtag

SEQ ID NO: 123188 - DNA, 768 bp, Artificial Sequence
  Description of Artificial Sequence: Synthetic coding sequence
atgattttgaacaaggcccttctgctcggggcattagcgctcactgctgtcatgtccccatgtggaggcgaagatattgttgccgaccacgtagcttcctatggggttaatttttaccaatctcacggtccctcgggccaatatacccatgaattcgatggcgatgaggagttttatgtggacttggagacgaaggaaactgtgtggcagctccctatgttttcaaaatttatctcatttgatccacagtctgcgctgagaaacatggctgtaggtaagcataccctagagtttatgatgaggcagagtaacagcactgccgctaccaacgaagtgccggaggttacagtgttcagtaaatttcctgtaaccttgggccagcccaataccctcatttgtctggtggacaatatcttcccacctgtggtcaatatcacatggctgagtaatgggcactctgttactgagggcgtgagcgagacttcatttctgagcaagagcgaccattctttttttaagatcagctatctgaccttccttccgtctgctgatgaaatctatgactgcaaagtggaacactggggcctggacgaaccccttttgaaacactgggagcccgaaattcccgctcctatgtccgaactgaccgaaaccctggtgtgtgctcttggcctgtctgcaggtctcatgggcattgtggtaggcaccgtgtttataattcaggggctccggagcgttggcgcaagtaggcatcagggactgctctag

SEQ ID NO: 123189 - DNA, 768 bp, Artificial Sequence
  Description of Artificial Sequence: Synthetic coding sequence
atgatccttaacaaagcccttctgctcggggccttggctctcacagccgttatgtctccctgcggaggtgaagatatcgtggctgaccacgtggcgtcctatggggtcaatttttaccagtcccatggaccctctgggcagtatacccacgagttcgatggcgacgaggagttttacgtggaccttgaaaccaaggagactgtctggcaactgcctatgtttagcaaattcatttctttcgacccacagtccgccctccggaacatggccgttggtaaacacacacttgaatttatgatgcggcaatcaaattctacagcagctacaaacgaagttcccgaagtgactgtcttttcaaagtttcctgtgacattaggtcagccgaacacactgatttgtctggtggacaatatctttccacccgtggtaaacataacttggctgagcaacggacactcagtaaccgagggggtgtctgaaacaagttttctttccaaatccgaccacagtttcttcaagatctcctacttgacatttctccccagtgcagatgaaatctacgactgcaaggtggaacattggggccttgacgagcccctcctgaaacactgggagcctgagatcccggctccaatgagtgaattgaccgaaacactggtctgtgcattgggccttagtgtggggctaatgggaatagtagtgggaactgttttcatcattcagggactaaggagtgtgggggccagccggcatcaaggcctactgtag

SEQ ID NO: 123190 - DNA, 249 bp, Artificial Sequence
  Description of Artificial Sequence: Synthetic coding sequence
gaccatgtcgcaagctatggggtaaatttttaccaatcccacggccccagtggacaatacacacacgagtttgatggagatgaagagttctacgtcgacctcgaaaccaaagaaaccgtgtggcaactgcccatgttttcaaagtttatcagctttgatcctcagtcagctcttcggaatatggccgtgggtaagcatactttagaatttatgatgcgacaaagtaattccaccgccgcaaccaactag

SEQ ID NO: 123191 - DNA, 768 bp, Artificial Sequence
  Description of Artificial Sequence: Synthetic coding sequence
atgatcctgaacaaggccctgttgcttggtgcactggccctgacggccgtcatgagtccctgtgggggagaagacatagttgccgatcacgttgcctcctatggagtaaacttttaccaaagccacgggccatccggacagtacacccacgaattcgacggagacgaggagttctacgtggatctggagacaaaggagaccgtgtggcaactacccatgttcagcaagtttatttcattcgacccccagagcgccctacgcaacatggctgtcggaaagcacaccctcgagttcatgatgaggcagagcaactctacagcagctacaaacgaggtaccggaagtgactgtgttctccaaattccccgttaccctggggcagccaaacaccttgatctgccttgtggataacatcttccccccggttgtcaacatcacgtggctttccaacggacactctgtgacggaaggcgtgagcgagactagctttctgtctaaatccgatcacagcttctttaaaatcagctacctgaccttcttacctagtgccgacgaaatatacgattgtaaagttgaacattggggactggacgaaccgctgttgaagcattgggaacccgagattccggctcccatgagcgagctgaccgagacactcgtttgcgcccttggactgtccgtgggactgatggggattgtagtcgggaccgtgttcatcatacagggattgcgcagtgttggcgcctcccgccaccagggactcctctag

SEQ ID NO: 123192 - DNA, 84 bp, Artificial Sequence
  Description of Artificial Sequence: Synthetic coding sequence
atgattctcaataaagctctactgctgggtgctctggctctcacagccgtcatgtcaccttgtggaggcgaggatattgtgtag

SEQ ID NO: 123193 - DNA, 810 bp, Artificial Sequence
  Description of Artificial Sequence: Synthetic coding sequence
atgtcctggaaaaaagctttgcgcatcccgggtgacctcagagtggctacggtaaccctcatgctggctatgttgtcgtctttgctggccgagggacgcgacagccccgaggacttcgtgttccaatttaaaggaatgtgctacttcaccaatggcacagagagggtccgcctggtgaccagatatatctacaacagggaggaatatgcccggtttgactccgacgtgggggtctatcgcgccgtgactccacagggcagacctgacgccgagtattggaactctcagaaggaggtgctcgagggcacccgcgcggaattggatacagtgtgccgccataactatgaggtcgcctttcgcgggatactccaaaggagagtggaacctacggtgacgatttcacccagtagaacagaagccctgaaccaccacaatctcctggtgtgctcagtgacagacttttatcccggtcagataaaagtgcgttggtttcgcaacgaccaggaagagaccgctggggtggtcagcaccccactgatccggaatggtgattggaccttccagatactagtaatgctcgagatgacaccccagcgaggcgatgtgtatacctgccacgtcgaacatcccagcctgcaatcacccatcaccgttgagtggagagctcagtctgaaagtgctcagtccaaaatgctgtctggagtggggggcttcgtactaggactgatctttctggggttggggctcatcatcagacaaagatctcaaaagggtccccaagggcccccacccgctggcctactacattag

SEQ ID NO: 123194 - DNA, 786 bp, Artificial Sequence
  Description of Artificial Sequence: Synthetic coding sequence
atgtcatggaaaaaagctttgcgtattcccggaggtcttagagctgctaccgtaactctcatgctgtcaatgctttcaaccccagtggctgagggtagagactcaccggaggattttgtgtatcaattcaaggggatgtgttattttactaacggcacggagcgggtacgactcgtttctcgctcaatctacaacagggaagagattgtgcggttcgactccgacgtaggcgaattcagggctgtcacactgctcggcttgcctgcggctgagtactggaattcccagaaggacattctcgaacgcaagcgcgcagctgttgaccgcgtctgtcggcacaactaccaactggaactcagaactacacttcagcggagagtggagcccaccgttacaatttcgccctcaagaacggaggcactgaaccatcataacctgttggtgtgctcggtgactgacttctacccagcacaaatcaaggtaaggtggttccgcaatgaccaagaggagacagcgggagtcgtgagcacccctctgattcgcaacggcgactggactttccaaatcctggtgatgttagagatgacccctcaaagaggagatgtctacacttgccacgtagagcacccatcgttacagtctcccatcacagtggagtggagagcccaatctgagagcgcccagtccaagatgctgagcggtattggggggtttgtactggggctgatattccttggcctgggcttgattatacatcaccgttcacagaaaggtcttcttcattag

SEQ ID NO: 123195 - DNA, 786 bp, Artificial Sequence
  Description of Artificial Sequence: Synthetic coding sequence
atgagttggaagaaggcattgaggattcccggcggtttgagagccgcaaccgtcacattgatgctttcaatgctgagcacgcccgtggcggagggcagagactctcctgaggatttcgtctaccagttcaagggcatgtgctatttcacaaatggcactgaacgggtgaggttggtatcccgctccatctataatcgggaggagatcgtgagatttgactccgacgtaggagagtttcgcgccgtgaccctgctggggcttccagctgccgagtactggaacagccaaaaagatattctggagcgaaagcgcgcggccgtggaccgtgtgtgcaggcacaattatcaactcgaactgagaaccacactccagcggcgtgtagagcctaccgtaaccatctctccctcccgcaccgaggctctgaaccaccacaatctcctcgtgtgctccgtaacagacttctacccggcacagattaaggtaagatggttccgaaatgaccaggaggaaacagccggtgttgtgtccaccccactgattaggaatggcgactggacattccaaattctggtgatgctggagatgacccctcagcggggagacgtgtatacatgccacgtggagcacccaagcctgcagtcaccgataacagttgaatggcgagcacagtcggaatctgctcagagtaaaatgctctctggtattggaggcttcgtactgggactgatttttcttggcctcgggttgatcattcaccacagaagtcagaagggcctgctgcactag

SEQ ID NO: 123196 - DNA, 810 bp, Artificial Sequence
  Description of Artificial Sequence: Synthetic coding sequence
atgagttggaagaaggctctcagaatccctggcggtcttcgggcggcaacagtgactttgatgctggcgatgctttccacacccgtcgccgaaggtcgggactcccctgaagatttcgtttatcagtttaaggcaatgtgctattttacgaatgggacagagagagtacgctatgtcacacggtacatttataatcgcgaggagtacgcaaggttcgattctgatgtggaggtctatcgggccgtcacacctttagggcctccagatgccgaatattggaattcacagaaggaagtgctggaacgaacaagagcggagctcgacaccgtctgtcgacacaactaccaacttgaactgcgcacgaccctgcagcggcgcgtggaacctacagtgacaatttcaccctctcgcactgaggcccttaatcatcacaacctcttggtgtgcagcgtgaccgatttttatccggctcagattaaagttaggtggttcagaaatgatcaggaggagactaccggcgtggtttctacccctctgattagaaatggagactggacattccagatcctggtcatgcttgaaatgactcctcagcacggagatgtgtacacctgtcacgtggaacacccctctctccagaaccctatcactgttgagtggagagctcagtcagaaagcgctcaaagcaagatgctcagcggaatcggtgggtttgttctgggcctgatctttttagggctgggcctcatcattcaccaccggtcacagaagggacctcaaggtccccctccggctggactactccattag

SEQ ID NO: 123197 - DNA, 810 bp, Artificial Sequence
  Description of Artificial Sequence: Synthetic coding sequence
atgagttggaagaaggcattacgcatccccggaggtctgcgggtggccactgtcacgctgatgttggccatgctctccacaccagtagcggagggacgagatagccctgaggatttcgtgtaccaattcaagggaatgtgttacttcacgaatggtacagagagagtccggctcgttactcgttacatctacaatcgcgaggagtacgcgcgttttgactcggacgttggggtttacagggccgtcacacccctgggacccccagatgctgaatactggaactcgcagaaggaagttctagagcgtactagagctgaactcgacaccgtctgtaggcacaactaccagctagaactgcgaacaacactgcagcgacgggtggaaccgacagtgaccatctccccgtcacgcaccgaagcactgaatcatcacaacctgctggtctgtagtgttacagacttctatcccgcccaaatcaaagtgagatggtttcggaacgatcaggaggagactacaggtgtcgtaagtacaccactcatcagaaacggtgattggaccttccaaattctggttatgctggagatgactccccagagaggagacgtgtacacttgccacgttgagcacccttcactgcagaatcccatcatagtcgagtggagggctcaatccgaatccgcccagtcaaagatgctatccgggattggcgggtttgtcctgggtctgatttttctgggactggggcttattattcaccatcgaagtcagaaaggaccacaaggacctccccccgcaggactgttgcattag

SEQ ID NO: 123198 - DNA, 675 bp, Artificial Sequence
  Description of Artificial Sequence: Synthetic coding sequence
atgtcttggaagaaagccctgagaatccctggagatctcagggtggctaccgtgacgctcatgttggcaatgctgagttccttgttagccgagggccgggatagccctgaggatttcgtctttcaatttaaaggcatgtgttacttcaccaatggaacagaaagagtgagactagtaacccgctacatttataatcgtgaggaatacgcgagattcgattcagacgtgggcgtgtaccgtgctgtgacgccgcagggaaggccagatgctgaatattggaactcccaaaaggaggttctggagggcacacgggctgagctagacaccgtctgtagacacaactatgaggtggcatttaggggtatactacagcgccgcgtcgaaccaacagtaacaatcagcccatcaagaacagaggctttgaaccaccataatctattggtgtgtagcgtcacagacttttatcccggacagatcaaagtgaggtggttcagaaacgatcaggaagaaacagccggcgtggtatcaacccctttgattagaaatggagattggacttttcagatccttgttatgctggagatgactcctcagagaggcgatgtgtacacatgtcatgttgaacatccttctctgcaaagcccaatcaccgtagagtggaggttactccattag

SEQ ID NO: 123199 - DNA, 786 bp, Artificial Sequence
  Description of Artificial Sequence: Synthetic coding sequence
atgagctggaagaaagccctgcgcatcccaggagatttgagggtggcaacagtgactctgatgctggcaatgctgtcctctctgttagctgaggggcgcgattcccccgaggatttcgtttttcagtttaagggaatgtgttatttcactaacggtacggagcgggtacgcttggtaacccgatacatctacaaccgcgaggaatacgcaaggttcgactccgacgttggggtgtatagagccgttacgcctcagggcagaccagacgccgagtactggaactcccaaaaagaggttctggaaggaactcgcgccgagctggacacggtgtgcagacacaactacgaggttgcctttagaggaattctacaaagaagggtggagccaactgtgaccatctctccctcacgcacagaagcactaaaccatcataacctgctggtgtgtagcgttaccgatttctaccccggacagataaaggttagatggttccggaacgatcaagaagagacagctggggtcgtgtcaaccccattgattaggaacggggactggacatttcaaatcctggttatgctcgaaatgacaccgcagaggggggacgtttatacatgccatgtggaacatccctcattacaatcacccattaccgtggaatggcgggcccagtcagaatccgcgcagagtaagatgctgtccggggtgggaggctttgtccttgggctgatctttctaggtctgggactaatcatacggcaaagatcgcagaaagggttgctgcactag

SEQ ID NO: 123200 - DNA, 786 bp, Artificial Sequence
  Description of Artificial Sequence: Synthetic coding sequence
atgtcatggaaaaaggccttgcggattcctggagggctgagagctgctaccgtgacgctgatgttagctatgttgtctactcccgtagccgaaggcagggactcaccagaggattttgtgtaccagttcaaggcgatgtgctattttacaaacggaactgaacgtgtacggtatgtcacacggtatatctacaaccgcgaggagtacgcacggttcgattcagatgtcgaggtctatcgggccgtgaccccactgggaccacctgacgctgaatactggaactcacaaaaagaagtgttggagagaacaagagccgaactggacacagtctgtcgtcacaattatcagctggagctgagaaccaccctgcaacggcgcgtggaaccgaccgtgaccatatcaccgagcaggacagaggcactgaaccatcacaacctccttgtgtgttcggtgacggacttctacccagctcaaataaaagttcgttggtttcgtaacgatcaggaggagacaacaggcgttgtctctactcccctaattagaaacggggactggacattccagatactcgttatgctcgagatgaccccacagcatggcgacgtgtacacctgtcacgtggaacacccatcattgcagaatccaatcactgtcgagtggcgtgcccagtccgaatccgcccagagcaagatgctttcaggaatcgggggttttgtgttaggactgatatttttaggactgggcttgattatccatcacagatctcagaaggggctgttacactag

SEQ ID NO: 123201 - DNA, 675 bp, Artificial Sequence
  Description of Artificial Sequence: Synthetic coding sequence
atgtcttggaaaaaagccctgaggatccccggaggactgagagcggcaaccgtcactctgatgctaagcatgctgtccactcctgtggccgaaggaagggatagcccagaggattttgtgtaccagttcaaagggatgtgctatttcaccaacggtacagaacgggttagacttgtgagcaggtctatttataaccgggaagagatcgtgaggtttgactccgacgtaggcgagttccgagcggtgacactgctggggcttccggctgcggagtactggaattcccagaaggacattctagaacgaaaacgagctgctgtagaccgtgtgtgtagacacaattaccaactggaactaaggacaacacttcaacgcagagttgagcccaccgttaccattagcccaagccgcaccgaggctctgaatcaccataacctgctcgtgtgctctgtcaccgatttctatcctgcccagattaaggtgcgttggttccgcaatgaccaggaggagactgcaggggtggtgagcacgccactgattcgaaacggggactggacttttcagatactggtgatgctggaaatgactccccagaggggggacgtgtacacctgccacgtggaacacccctcattgcagagcccgattactgtcgagtggagactgcttcattag

SEQ ID NO: 123202 - DNA, 786 bp, Artificial Sequence
  Description of Artificial Sequence: Synthetic coding sequence
atgtcatggaagaaagccctccggataccagggggacttcgtgccgctactgtaaccctgatgctggccatgctgagcacgcctgtggccgaaggccgcgatagccctgaagattttgtatatcagtttaaggctatgtgctatttcacgaacggtacagagcgggtgcgatacgtgacaagatacatctacaatcgggaagaatacgctaggtttgattccgacgttgaagtctacagggccgtcactcctcttggtccacccgatgccgagtattggaattctcaaaaggaggtactggagagaacccgtgcagaactggatactgtatgccgccacaactaccagctggagttgcggacaaccctccagagaagagtggagcccaccgtgaccatctctccctcccgcacggaagcactgaaccatcacaaccttctggtgtgttcggtgacagacttctatccagctcagattaaggtgaggtggttccgtaatgaccaggaggagacaactggagtcgtgagtactcctcttatcagaaatggtgattggactttccagatcttagtgatgttggagatgaccccgcagcatggggatgtctacacctgccatgtagaacatccatctctgcagaatcctatcactgtggaatggagagcccagtctgagtctgcgcagtcaaaaatgctttctggaatcggcggctttgtactgggtctgatctttctcgggctcgggctcattattcatcatcggagccagaaaggtcttttgcactag

SEQ ID NO: 123203 - DNA, 786 bp, Artificial Sequence
  Description of Artificial Sequence: Synthetic coding sequence
atgagctggaaaaaggctttacgcatcccagggggacttagagtggccactgtcactctgatgctagctatgctttctacccctgtagctgaaggaagagactcccctgaggactttgtgtaccaatttaaggggatgtgttattttacaaacggtaccgagagagtaagaggagtgactcggtacatctataatagggaagaatacgcgcgctttgattccgacgtgggggtatatcgggccgtgacacccctggggcccccggctgccgagtattggaatagccagaaggaagtgcttgaaagaaccagggccgagctggacacagtgtgccgacataattatcagctggagctgagaactacactgcagcgtcgagtagaacccactgtgacaatttcaccttcccgtactgaagcacttaatcaccataacctgttggtgtgttccgtcactgacttctatcccgcacaaatcaaagttagatggtttcgcaacgaccaggaggaaacgacgggagtggtgtcaacacctttgatcaggaatggtgactggacattccagatcctagtcatgctcgaaatgacgccccaacggggggatgtgtacacttgtcatgttgagcatcccagtctccaaaaccctatcattgtggaatggagagctcagtctgagagcgcacagagcaagatgctatctgggataggtggcttcgtgctgggtctcatcttcctggggttgggcctgattatccatcatcgcagtcagaaggggttgctccactag

SEQ ID NO: 123204 - DNA, 675 bp, Artificial Sequence
  Description of Artificial Sequence: Synthetic coding sequence
atgtcctggaagaaggcccttagaataccaggcggcttgcgagcggcgaccgtgacgcttatgctgagtatgctgagtactcccgtggccgaggggcgtgattcacctgaagattttgtttaccagtttaaaggaatgtgctacttcactaatgggactgaaagggtccgcctcgtttcaagaagtatttataaccgtgaagaaatcgtgcggttcgattctgacgtgggagagtttagagctgtcaccctcctcggtctgccggcggcagaatactggaacagccagaaggatatccttgaaaggaagagggccgctgtcgatcgtgtttgcagacataactaccagctcgagttgaggacaaccctccaacggcgcgtggaaccgacagtcaccatctccccctcacgcaccgaagccctgaaccatcacaatctcctggtgtgttccgtgacagatttttaccctgcccagattaaggtgcgatggttccgcaatggccaggaggaaaccgcaggggtcgtgtctacgcccctaattcggaacggcgactggaccttccagattttggttatgcttgaaatgacccctcagaggggtgacgtctacacctgccacgtggagcacccatctttgcagtccccaattactgtagaatggaggctccttcattag

SEQ ID NO: 123205 - DNA, 786 bp, Artificial Sequence
  Description of Artificial Sequence: Synthetic coding sequence
atgagttggaaaaaggcgttgaggatccccggtggcttacgcgtcgctacagtcaccttaatgttagcaatgctttctacacccgtcgctgagggtagagactccccagaggacttcgtataccagtttaagggcatgtgctattttaccaacggaacagagcgcgttagactcgtcacaagatacatctataatcgggaggaatatgctcggttcgacagtgatgttggagtttacagagcggtcacaccgttaggtccgcctgatgctgaatactggaactctcagaaggaagtactggagcgtactagggccgaactcgacaccgtgtgcagacataactatcagctggagctgcgcacaacactccagcgacgggtggagcctaccgtgactatttccccctccagaaccgaggccctcaaccatcacaacctgttggtctgtagtgtgacggacttctatccggcccaaatcaaagtgcgatggttcagaaacgaccaagaggaaacgacaggtgtggtgtccacccccctaattcgaaatggcgactggaccttccagatactcgttatgctcgaaatgacgcctcagcggggagacgtctacacctgccacgtggagcatccttctcttcagaacccaataatcgtggagtggagggcccagagcgaatctgcccagagtaagatgctgtccgggatcggaggttttgtcttgggacttatcttcctaggactcggacttattatccatcaccgctcacagaagggactgctgcactag

SEQ ID NO: 123206 - DNA, 786 bp, Artificial Sequence
  Description of Artificial Sequence: Synthetic coding sequence
atgtcctggaagaaggccttgcgtattcctggcggtttgcgagctgctaccgtcaccctgatgctgagtatgctgtccacacctgtggccgagggcagagattccccagaggatttcgtgtaccagtttaaggggatgtgttactttacaaacggcacagaaagagtgcgcctggtgtctcgatccatttataatagggaagaaattgttcgttttgactctgacgtcggggaattcagggcagtgaccctgctgggattgccggcagctgaatattggaactctcagaaagatatcttagagcgaaagcgggccgccgtggaccgggtttgccggcataattatcagctggagctccgtacgactctgcagagaagagtcgagcccacagtcactatctcccccagcagaaccgaggccctgaaccaccacaacctgttggtgtgcagtgtgacagatttttaccctgcccagatcaaggtgaggtggtttagaaatggacaagaggaaactgctggagtcgtgtccacaccgctgatccggaatggtgactggacgttccagatattggttatgctagaaatgaccccccagcgtggagatgtatacacttgtcatgtggagcacccctcactgcaaagccccataaccgtagaatggcgggcacagtccgagagtgcccagagcaaaatgctgagcggcattggggggttcgtcctcggtctgattttcctcgggctggggctcattatccaccatcggtctcaaaagggattgctccattag

SEQ ID NO: 123207 - DNA, 810 bp, Artificial Sequence
  Description of Artificial Sequence: Synthetic coding sequence
atgtcctggaagaaagccctccgcattcccggtggcctgagggctgcgacggtgaccctgatgttatctatgctctctacgcccgtggcagaagggagggactcgcctgaagactttgtttaccaatttaaggggatgtgttactttacaaacggaaccgaaagagtcagactggttagcaggtctatctacaatagagaagagattgtgcgattcgactccgatgtgggtgagttccgggcagtaactctattgggacttcctgcagctgagtactggaattcacagaaggatatcctcgagcgaaagagagcagctgttgatagagtttgtcggcacaactatcagcttgaactgaggaccactctgcagaggagggtggagcccacggtgaccatctcaccatcgcgaacagaagcattgaaccatcataacctccttgtgtgtagcgtgaccgatttctatcctgcacagattaaggtccggtggttccgcaacgggcaggaggaaaccgcaggagtagtttccacacccctcatcagaaatggagattggacattccagattctggtgatgttggagatgaccccacagagaggcgatgtgtatacttgccacgtcgaacatccttcacttcagtccccaattacagtcgagtggcgcgctcagtctgaatcagcccagtccaaaatgctgtctggtatcggggggttcgtgctgggactgatatttctcggtctgggcctcatcattcaccaccgttctcaaaagggaccacagggcccgccccctgctggtctcctccattag

SEQ ID NO: 123208 - DNA, 786 bp, Artificial Sequence
  Description of Artificial Sequence: Synthetic coding sequence
atgagttggaagaaggcccttcggattcctggcgggctaagagtcgccactgtcacgcttatgctggctatgctctctacccccgtggcagaggggcgtgactctcctgaagacttcgtgtatcagtttaagggtatgtgttacttcacgaacggcacggagagagtgaggttggtgacccgttatatttataacagagaagagtacgccagattcgattcagacgtgggagtctacagggccgtaacacctctcggtccaccagatgcagaatactggaactcccaaaaagaggtcctggagaggacccgagccgaactagacactgtctgccggcacaattaccaactcgagctgaggacaacactccagagaagagtggaaccgactgttacaatctcaccctcacgcaccgaggctctgaaccaccacaatctcctggtttgctcggtaactgatttctacccagcacagattaaggtacggtggtttaggaatgaccaggaggagaccaccggtgtggtttcgacacccttaatccggaacggcgactggacatttcagatcttggtcatgctggaaatgacgcctcagcgcggagatgtttacacatgccacgtggagcatccttctctccagaatcctattatcgtggaatggagggcccaatccgaaagtgctcagtccaagatgctgagcggtataggcgggtttgtcctgggcctaatcttcctcggtctgggtcttatcattcaccacaggtcacagaagggcttgttgcattag

SEQ ID NO: 123209 - DNA, 675 bp, Artificial Sequence
  Description of Artificial Sequence: Synthetic coding sequence
atgagctggaaaaaggcacttaggataccaggcggactgcgcgcagccaccgtcacccttatgctagcaatgctcagtacacccgtcgcagagggaagggacagccctgaagattttgtctaccagtttaaggcgatgtgctactttacaaacggaaccgaaagagttaggtacgtgacccgatacatctacaatagagaagagtacgcgagatttgatagcgacgtggaggtatatcgagccgtcacacctttggggccgcctgacgcggagtactggaacagccagaaagaggttctggaaagaacccgcgccgaattggacaccgtttgccggcataactaccaattggagcttaggacaacattacaaaggcgggtcgagcccaccgttaccatctccccctcacgtacagaggccttaaatcaccacaacctccttgtgtgtagtgtaacggatttctatccagctcagataaaagtcaggtggttcaggaatgaccaggaggagaccacaggcgttgtcagcacaccgttgatcagaaatggagactggaccttccagatcctggtgatgctggaaatgactcctcagcatggggacgtgtacacttgccatgtggaacacccttctctccagaaccccatcaccgttgagtggcgattgctgcattag

SEQ ID NO: 123210 - DNA, 786 bp, Artificial Sequence
  Description of Artificial Sequence: Synthetic coding sequence
atgagttggaagaaagcccttcgcattcccggggggctgagagcagcgacagtgacattaatgctgtctatgctgtctactccagtagcggaaggcagagatagtcccgaggattttgtgtatcagtttaagggcatgtgctacttcaccaatgggaccgagagagttagacttgtgagtcgctctatctacaaccgggaggaaatcgttaggtttgacagtgacgtgggagagttcagagccgtgacgctgctgggactaccagccgcagagtattggaatagtcagaaggacatcctggagcgaaagcgcgcagcagtggaccgcgtctgcagacataactaccaacttgaacttaggactaccttgcagaggagggtggaaccaacagtgaccatttcaccgagccgaacagaggccctcaaccaccataatctgctggtgtgcagcgttactgacttctaccccgcacagatcaaggtgcgctggtttcgaaacggacaggaagaaaccgctggagtcgtgagcaccccactcatccgaaatggggattggacctttcaaatccttgtaatgttagagatgacaccccaaaggggggacgtctatacttgtcacgtagaacacccttctcttcaatctcctattacggtagagtggagagctcagtcagagtccgcacagtcaaaaatgcttagtggcatcggtggatttgtgctcggactgatcttcctcggactcggtcttatcatacatcacaggagccagaagggactgctgcattag

SEQ ID NO: 123211 - DNA, 405 bp, Artificial Sequence
  Description of Artificial Sequence: Synthetic coding sequence
atgtcctggaaaaaagccttgaggatccctggggggctgcgagccgctaccgtgacgctaatgctgagtatgctgtccactcccgtcgcagagggcagggactctcctgttgagccaactgtcacaatttctcctagccggaccgaggcccttaatcatcacaatctgctggtgtgcagcgttactgacttctaccccgctcagatcaaagttagatggtttaggaacggtcaagaggaaacagccggtgtcgtaagtactccactcattaggaacggcgactggaccttccagattcttgtgatgttggaaatgacacctcagagaggagacgtgtacacatgtcatgtcgaacaccccagccttcagtctcccattactgtcgagtggcgtttgctgcactag

SEQ ID NO: 123212 - DNA, 405 bp, Artificial Sequence
  Description of Artificial Sequence: Synthetic coding sequence
atgagctggaaaaaagccttgagaattcctggaggcctcagggtcgcgactgtgacccttatgctagccatgttatccacaccagtggctgagggacgcgacagtcccgtcgagcctaccgtgactatttctccttccaggactgaagcacttaatcaccacaacctgctggtgtgttcggttaccgacttctatccagctcagatcaaggttagatggttcaggaacgaccaggaagagactacaggagtggtctccactcccctgatccgaaacggggactggacctttcagatccttgtgatgttagaaatgactccacaacggggcgacgtgtatacgtgccacgtggagcacccttccctgcagaatcctataattgtagaatggcggctgctccactag

SEQ ID NO: 123213 - DNA, 435 bp, Artificial Sequence
  Description of Artificial Sequence: Synthetic coding sequence
atgagctggaagaaggccctcaggatcccagggggcctgagagtggctactgtgacaccattaggcccgcctgacgcagagtattggaactcccaaaaggaggtgctcgaaaggacaagggctgagctggataccgtgtgccggcacaattatcagctggagctccgcacgaccttgcagagacgtgtggagccaaccgtgaccataagcccctcaaggacagaggccctgaaccaccacaacctcttggtatgcagcgtgaccgacttttaccctgcccagatcaaagtcaggtggttcagaaacgatcaggaggaaactacgggggtggtctccactccccttataagaaacggggactggaccttccagatacttgtcatgcttgagatgacacctcagcgaggcgacgtgtacacctgccatgtggaatag

SEQ ID NO: 123214 - DNA, 405 bp, Artificial Sequence
  Description of Artificial Sequence: Synthetic coding sequence
atgtcttggaagaaagctctacgcattcccggaggactcagagctgccacggttacccttatgctcgctatgttgtcaactccggtagcagagggtagggatagccccgtggagcccacagtcactatcagtccctccaggacagaggctctcaatcatcataatcttcttgtgtgctctgtcactgatttttatcctgcccaaatcaaggttagatggttcagaaatgaccaggaggagacaacaggggtcgtgagcacccctctgatcaggaatggcgactggacatttcagattcttgttatgctggaaatgaccccgcagcacggagatgtgtatacttgccacgttgaacacccttcactgcaaaatcctatcactgttgaatggcggctactgcattag

SEQ ID NO: 123215 - DNA, 786 bp, Artificial Sequence
  Description of Artificial Sequence: Synthetic coding sequence
atgtcttggaagaaagccctgcgcataccaggagacctgcgtgtcgccactgttacactgatgctcgcaatgctctcctccctgcttgcagaaggacgggactctccggaagacttcgtgtttcagttcaagggcatgtgctacttcacaaacggcactgaacgggttcggctggtcacaaggtacatctataatcgcgaggagtacgcaagatttgatagtgacgtcggtgtgtatcgggcggttacaccccagggcaggcccgacgccgagtattggaactctcaaaaagaggtactcgagggaaccagggcagagcttgatactgtgtgccgtcacaactacgaagtggcttttcggggcatactgcagcgacgtgtcgaaccgacagtgactatctcaccttcaaggaccgaggcattgaatcaccacaatctcttggtatgttctgttaccgacttttacccaggtcaaatcaaagttaggtggtttaggaacgaccaggaggagacagcaggagtggtctctacaccgctcattagaaacggagattggaccttccagattctggtcatgctagagatgacaccacagagaggagacgtttatacgtgtcacgttgagcatccatctcttcaatcacctatcaccgtggaatggagagcgcaatcagagtctgcccagtccaagatgctgagcggcgttggcggatttgtcctcggcctcattttccttggactcgggctgatcattaggcaaagaagccagaagggactcctccactag

SEQ ID NO: 123216 - DNA, 675 bp, Artificial Sequence
  Description of Artificial Sequence: Synthetic coding sequence
atgagctggaagaaggctcttaggatccctggcggactgagggtcgctaccgtcacgttgatgttagctatgttatccacaccagtggccgaaggacgggacagtccagaggattttgtctaccagtttaagggaatgtgctacttcactaatggcactgagcgtgtgcgtctggtcacacgttatatatataatagagaggaatatgctcgcttcgactcagatgtcggggtgtatcgcgctgtcactccgctgggcccacccgacgctgaatactggaactcacagaaggaggtgctggaacgcactcgtgccgagctggataccgtctgcaggcataattatcagttggaactgagaacaacattgcaacggagagtggaaccgacagttacaatttccccaagccggaccgaggcactgaatcaccataacctcctcgtctgcagcgttactgatttttatccagctcagattaaggtgaggtggtttcgtaatgaccaggaagagactactggcgtggttagcacaccactgattagaaacggggattggacttttcaaatcttagtaatgcttgagatgacgccgcagcgcggggatgtgtacacatgccatgtagagcatccatcacttcagaacccaatcatcgttgagtggcggctgttacactag

SEQ ID NO: 123217 - DNA, 435 bp, Artificial Sequence
  Description of Artificial Sequence: Synthetic coding sequence
atgtcatggaagaaagctctcagaattcccggcgatcttcgggtagctacagtaactccgcagggtcggcctgacgccgaatactggaattctcaaaaggaggtgctcgagggcaccagggccgagctggacacagtgtgcagacacaattacgaggtggccttccgcggcatcctgcagcgaagagtcgagccaacggtgaccatctccccctctcgaacggaggcattaaaccatcataatttgctggtatgttccgtgaccgatttttatccaggtcagatcaaggtgcggtggtttcggaacgaccaggaggagacggctggggttgtaagtacacccttgataaggaacggggattggactttccaaattctggttatgctagaaatgacccctcaaaggggagacgtgtacacttgtcatgtagagtag

SEQ ID NO: 123218 - DNA, 435 bp, Artificial Sequence
  Description of Artificial Sequence: Synthetic coding sequence
atgtcatggaagaaagccctgcggatccccggggggttacgcgccgccaccgtcacattgctgggtctgcctgcggcagaatattggaacagccagaaagatatcctggaacgaaagagggctgccgtcgatagagtgtgcagacataactaccagctggaacttcggaccacgttacaaagacgggtggaacctactgttacaatcagcccttcccgaaccgaagcactgaatcaccataatctgttggtctgcagtgttaccgacttctacccggctcagatcaaggtccgctggtttcgtaacggccaggaagaaacagctggcgtggtctcgacaccactcatccggaatggagactggactttccagatccttgtcatgctggaaatgaccccccagagaggcgacgtgtacacctgccatgttgagtag

SEQ ID NO: 123219 - DNA, 435 bp, Artificial Sequence
  Description of Artificial Sequence: Synthetic coding sequence
atgtcatggaagaaggcattacggattccaggcggccttcgggcagccacagtcactcccctcggccccccggatgccgagtattggaactcccagaaggaggtactggaaagaacaagagctgagctggataccgtttgccgacacaactaccaacttgaactgaggacgactctccagcgtagggtagaaccaactgtcaccatttcacctagcagaaccgaggctttaaaccatcacaaccttctcgtttgctctgtcaccgatttctatccagcccagatcaaggtgcgctggtttcgcaatgatcaggaagaaaccacgggcgtcgtaagcacgccgctcatcaggaatggcgactggacgttccagatactggtgatgctggagatgacacctcagcacggcgatgtgtacacctgccacgtcgagtag

SEQ ID NO: 123220 - DNA, 411 bp, Artificial Sequence
  Description of Artificial Sequence: Synthetic coding sequence
atgagctggaaaaaggcgcttcggataccagggggtctgcgggctgccacggttacactgatgctttccatgctgtccacgcccgtcgccgagggccgcgattccccggaagacttcgtgtaccaatttaagggaatgtgttacttcacaaacggcacagagcgagtgcggttggtgtctagatctatctataatagggaggagatcgtgagatttgactcagatgtaggggaatttcgtgccgtcaccctgctgggtctcccagctgcggagtactggaacagccagaaagacatccttgaacgaaagcgcgccgctgtggaccgcgtctgcaggcacaattaccagctcgagctccgcaccacactgcaacggcggggaatggtgacagggccaagtcggagttggtag

SEQ ID NO: 123221 - DNA, 411 bp, Artificial Sequence
  Description of Artificial Sequence: Synthetic coding sequence
atgtcttggaaaaaggctttgcgcatccctggaggtctcagggccgcaaccgttaccctgatgctggcgatgttaagcactccggtggccgagggaagggatagcccagaggattttgtgtatcagttcaaagctatgtgttatttcacgaatggcactgagcgggtgcggtatgtaactagatatatatataatcgcgaggagtatgcccggtttgatagtgacgtagaggtgtatagggccgtaacccctcttgggccacctgacgcggaatattggaacagccagaaggaggttctggagcgaacacgggctgagctggatacggtttgccgacataactatcagctcgaactgagaacaactctacagcggagaggaaccgtgacgggcccttccaggtcgtggtag

SEQ ID NO: 123222 - DNA, 411 bp, Artificial Sequence
  Description of Artificial Sequence: Synthetic coding sequence
atgagctggaaaaaagcactacggatacccggcgatctaagagtggcaacagtgacactgatgctcgccatgctgtctagtttattagccgagggacgcgattcccctgaggatttcgtgtttcagtttaaaggcatgtgttatttcacaaatggcaccgagcgggtcagattggtcacacgatacatctataaccgtgaggagtatgcccggttcgacagtgatgtgggcgtctatcgcgccgtgacaccccagggacggccagacgcagagtattggaattcccagaaagaagtcctggagggaacgagggccgaactggacaccgtgtgcagacacaactacgaggtcgcttttaggggcattcttcagagaaggggcatggtcaccgggctctccaggagctggtag

SEQ ID NO: 123223 - DNA, 717 bp, Artificial Sequence
  Description of Artificial Sequence: Synthetic coding sequence
atgctgagcaccccagttgcggagggaagggacagccccgaagattttgtataccagtttaagggcatgtgttacttcacaaatggcacagaacgcgtgcggctggtgtctagatccatctacaatagggaagagatagtgaggttcgacagcgacgtgggcgagttccgcgccgtaactctcctggggctgcccgccgccgagtattggaacagtcagaaagatatcctggagaggaagcgcgccgctgtcgatcgggtgtgccgccacaattatcagctcgagctcaggactacattgcagagacgagtggagccaactgttacaatctccccgagcaggacggaagccctgaaccatcacaacttactggtgtgttccgtgacagatttttatcctgcccaaattaaagtgagatggttcaggaatgggcaggaggagaccgccggcgtcgtaagcacaccgctgattagaaacggcgattggacattccagattctggtgatgctggagatgaccccgcagaggggcgatgtgtatacctgtcatgtcgaacacccttccctgcagagcccgatcaccgtggaatggcgggctcagtctgaatccgctcagagtaagatgttgtctggcataggaggcttcgtgctggggctgatcttcctcggcttaggcctgatcattcaccacagaagtcagaaaggattactgcactag

SEQ ID NO: 123224 - DNA, 543 bp, Artificial Sequence
  Description of Artificial Sequence: Synthetic coding sequence
atgtgctatttcactaacggaactgaacgagtcagaggtgtgacccgatatatctataatcgagaggagtatgctagatttgactcagatgtgggcgtgtaccgggctgtgaccccacttggacctcctgccgctgaatactggaatagtcagaaggaggtcctggaacggacacgagctgaactcgacactgtgtgtcgtcacaactaccagctggagctccgaaccacacttcagaggcgggttgagccgacagttacgatttccccctcccggactgaagccctgaaccaccataacctgctggtctgtagcgtgactgacttctatccagcccagattaaagtcaggtggttcagaaacgatcaggaggagacaaccggagtggtctccacaccacttattcgcaatggggactggaccttccagattttagtgatgctggaaatgacacctcagcgcggcgacgtctacacatgccacgtggagcacccatccctgcaaaatcctattatcgtcgagtggagaatggatgaattctag

SEQ ID NO: 123225 - DNA, 717 bp, Artificial Sequence
  Description of Artificial Sequence: Synthetic coding sequence
atgctgagcacccccgtagccgagggtagggactctcccgaagacttcgtgtatcaatttaaaggaatgtgttatttcaccaatggcacagaacgggtccggttagtgagtagatccatctacaaccgagaggagatcgttcgctttgattccgatgtgggcgagttcagggctgtgaccctgttgggcctgccagccgctgaatattggaacagccagaaagacatactggaaagaaaacgggcagctgtggatcgcgtttgtcggcataactaccagcttgaactccggactactctgcagaggcgggttgagcctacagtgacaatctctcctagcaggaccgaggcgctgaaccatcacaatttgctggtatgttcagtgacagacttttaccccgctcagatcaaagttcgttggttcaggaacgaccaagaagaaacagctggcgtggttagtacacctctgatcagaaatggagattggacttttcagattttagtaatgttagaaatgaccccccagcgaggagacgtttacacctgccatgtagaacacccaagcctgcagtctcccatcacagtagagtggagggcacagagcgagtcggctcagagcaaaatgctttcaggtatcggtggcttcgtgctgggattgattttcctgggcttgggcctcatcatccatcataggagtcagaagggcctcctgcactag

SEQ ID NO: 123226 - DNA, 744 bp, Artificial Sequence
  Description of Artificial Sequence: Synthetic coding sequence
atgctatctacccccgtggctgaaggtcgtgatagccctgaagacttcgtctaccagttcaagggcatgtgctactttaccaacggtaccgagagagtaaggggcgtgactcgttatatttataaccgcgaggagtatgcaagatttgactcagatgtgggcgtgtatagggctgtaacccccttaggtcctccagccgccgaatattggaacagtcaaaaggaagttctcgagcgtacccgagctgagctggatacggtttgtcgacataattaccagctggagttacgtaccacgctccagaggagggtggaaccaacagtcaccatttcaccttctaggacagaggccctgaatcaccacaacttactcgtctgtagcgttaccgatttctaccctgctcagatcaaagtgcgttggttccgaaacgaccaggaggagactactggtgtcgtaagtacccccttaatccggaacggggattggacgttccaaattcttgtcatgttggaaatgacaccccagaggggtgatgtttacacgtgtcatgtcgaacatccctcactgcagaaccccattattgtcgagtggagggctcagtctgaatccgcacagtccaagatgctctccggcattgggggattcgtgctgggcctgatcttccttggtctggggctgatcattcatcacagaagtcagaaggccctacctcagggaccaccgccagctggtgacattagctag

SEQ ID NO: 123227 - DNA, 717 bp, Artificial Sequence
  Description of Artificial Sequence: Synthetic coding sequence
atgttgtctactccggtggccgaaggacgcgactcaccggaagatttcgtctaccaattcaaaggaatgtgctactttacaaacggcactgagcgcgtgcgattggtttctagatctatttacaatagagaagaaattgtgcgctttgactccgatgtgggagagtttagagctgtcaccctgctaggtttacctgcagcagaatactggaatagtcagaaggacattttagagcgcaagagggcagccgtggaccgcgtctgccggcacaattaccagttggaactgaggacaactctgcaaagacgagtggaacctaccgtgactatctccccgtcaaggactgaggccctgaaccaccataatctgctagtttgtagcgttaccgacttttatcccgcacagattaaggttcggtggttccgaaacgatcaggaggaaactgccggtgttgtttctacacctctcattagaaatggggactggaccttccagatcctggtcatgctagagatgacccctcaacgaggagacgtgtacacctgccacgtcgagcacccgagcctgcagtcacctattacggttgaatggcgcgcccagtccgagagcgctcagagcaagatgctttccggtatcggcggattcgtacttggcctcatcttcctagggctcggcctcataatccaccaccgaagccagaaagggctgcttcactag

SEQ ID NO: 123228 - DNA, 801 bp, Artificial Sequence
  Description of Artificial Sequence: Synthetic coding sequence
atggtctgcttgcgcctccccggcgggtcctgcatggcagtactgacagtgacacttatggtgctgtcatcccccctagccctggctggggatacccgccctcgatttctagaatactccacatccgaatgccacttctttaacgggacagagagggttagatacctggaccggtatttccacaaccaagaggagaacgtgcggtttgatagtgacgtgggagagtttcgggccgttactgagttgggaagaccagacgctgagtactggaattctcagaaggatctactggaacaaaagagagggagagtggataactattgtagacataactacggagttgttgagtcttttaccgtccagaggcgagtgcaccctaaggtgacagtgtacccaagtaagacacagccactgcaacaccataatcttctagtctgctccgtttcagggttttatcccgggagcatcgaggtgcgatggttcaggaacggccaggaggagaaaactggcgtagtgagtacgggactgatccacaacggggactggaccttccagacgttagttatgctggagacagtgcctagatccggtgaggtttacacctgccaggtcgagcacccttctgtcacctcgcctcttaccgtggaatggagagcacgtagcgaatcagcccagtctaagatgctgtctggcgtggggggcttcgtcctgggactgctattcctcggcgccggtctgtttatatactttcgcaatcagaaagggcacagtggactgcagccccgaggatttcttagctag

SEQ ID NO: 123229 - DNA, 801 bp, Artificial Sequence
  Description of Artificial Sequence: Synthetic coding sequence
atggtgtgtctgaagctcccaggcggcagttgcatgactgccttgacggtcaccttgatggttttaagcagccccctggccctcagtggggacacccgccctagattcctgtggcagcctaaaagagagtgccattttttcaatggcacagagagagtgcggttccttgaccgctacttttataaccaagaagagtcagtgagatttgatagtgacgtgggagagtttagagctgtaacagagctggggcggcctgatgctgagtactggaattcccagaaagacattctggagcaggcccgcgctgccgtagatacctattgccgacacaattacggagtcgtcgagtccttcaccgtgcagagaagggtgcaacccaaggtgacagtgtatcctagtaagacccagccactgcagcatcataatttgctagtctgttcagtttccggtttctaccctggctccatcgaagtgagatggttcctcaatggacaagaagagaaggcaggtatggtgagtactggcctgattcagaatggggattggacttttcagactctggtgatgttagagactgtccccaggtccggggaggtgtacacttgccaggtcgagcacccgtccgtcaccagcccccttaccgtggaatggagagcacggagcgagagcgctcagtcaaagatgttaagcggtgtcggagggttcgtactggggctgctgttccttggggctggtttgttcatatactttcgcaaccaaaagggacattctggattgcagccgactggtttcctgtcttag

SEQ ID NO: 123230 - DNA, 801 bp, Artificial Sequence
  Description of Artificial Sequence: Synthetic coding sequence
atggtgtgcctaaggctccctggggggtcttgcatggccgttcttaccgtgaccctgatggtgctgtcttcccctttggccctagcaggggacactcggcctcggtttcttgaatactccacaagcgagtgccacttcttcaatggtaccgaaagggtgagatacctggacaggtactttcataaccaagaggaaaatgtccgcttcgacagcgatgtgggggaattcagggcagtgacagaactgggcagaccagatgccgagtactggaatagtcagaaggatcttctcgaacagaagcggggtagagtggataactactgtaggcacaattacggagtagtggagtctttcaccgtgcaaagaagggtccaccccaaggtgacggtgtacccaagcaagactcagcccctccagcaccataacctgctggtatgctcggtcagcgggttctatccagggtctattgaggtgcgctggtttaggaatggacaggaggagaaaacaggcgtggtaagtacggggctgatccacaatggggattggacgttccagaccctcgtgatgctcgaaaccgtcccgcgatctggcgaggtgtatacctgccaggtggaacacccatccgtgacttctccgctcactgtggagtggcgcgcccgtagtgagagtgcccagtccaaaatgcttagcggagtgggcggttttgttctagggttattgttcttgggcgctgggctcttcatctacttcagaaaccagaagggacattccggcctgcagccaaggggttttctctcctag

SEQ ID NO: 123231 - DNA, 753 bp, Artificial Sequence
  Description of Artificial Sequence: Synthetic coding sequence
ctgctgaaattgacacgagattttcctcagcgccatgagaagtaccaaagctgggcaggcacctttcacctttgcttaaaaaagaataagtatcccgattctcggagcacattcattaagcatgctggtagctacctgaagagaggggaatttttaagcatacataccgcaatcacttgtttctttctgcagatcagcgcacgttttctggaacaggttaaacacgagtgccattttttcaacgggaccgaaagagtaagatttctagaccgctacttctaccaccaggaggaatatgtccggtttgactccgacgtgggcgagtatcgggctgtgaccgagctcggaaggcccgacgcggaatactggaacagccagaaggatcttctagagcagcgccgcgcggaagtggacacatattgtcggcacaattatggtgtagtcgagtctttcacggtgcagaggagagtgtaccctgaagttactgtctaccccgctaaaacccagcctcttcagcaccacaatttactggtctgcagcgtcaatggcttttacccaggcagtattgaggttagatggttcagaaatggacaagaagaaaaaaccggtgtggtatcaacaggcctaattcaaaacggtgactggacatttcagactctggtgatgctggaaaccgtcccacggtctggtgaggtgtacacctgtcaggtggaacatccatcccttacatcgcctctgaccgtggagtggtag

SEQ ID NO: 123232 - DNA, 756 bp, Artificial Sequence
  Description of Artificial Sequence: Synthetic coding sequence
tagctgctcaaactgacacgggactttccccaacggcatgaaaagtatcagtcctgggccggcacctttcatttatgcctgaagaagaacaaatatcctgattcacggtccacctttataaaacacgctggtagctacctaaagagaggagagtttttggctatccacactgccatcacctgttttttccgccagatatctgctcgcttcctggaatattctacatccgaatgccatttctttaatggaaccgagcgggtaagatacctcgacaggtatttccataatcaagaagagaacgttaggttcgattccgatgtaggagagtttcgggccgtcaccgaattgggcagacctgatgccgaatactggaattcacagaaggacctactggagcagaagcgaggccgggtagacaactactgtcgccacaattacggtgtggttgagagcttcacagttcagcggagagttcaccccaaagttacagtgtatccttctaaaacgcagcccctccagcatcataacctccttgtctgtagcgtgagtggattttacccagggtccatcgaggtaagatggtttcggaatggacaggaagaaaagaccggagtggtttctaccgggctgattcacaatggcgattggacattccagacactggtgatgctggagacggttccaaggtccggcgaagtatacacctgccaagtagaacatcctagcgtgacatctccccttacagtcgaatggtag

SEQ ID NO: 123233 - DNA, 801 bp, Artificial Sequence
  Description of Artificial Sequence: Synthetic coding sequence
atggtttgcctgaagttcccaggcggatcttgcatggccgcgctgacagtaacactgatggtgctctcttcccctctggccctcgctggggatacaagaccaaggttcctggaacaggtgaaacatgaatgtcacttctttaacggcacagaaagagtgcgttttctagaccgctacttctaccaccaggaagagtatgtacgtttcgatagtgatgttggcgaatacagggcagttaccgagctaggtcgcccagatgcggaatactggaactcgcagaaagacctgttggaacagagaagggccgaggtggatacgtattgtaggcacaactacggggtagtggagagctttaccgtccaaaggcgcgtgtaccctgaggtgactgtgtatcccgctaagacccagcctctccaacaccataatcttcttgtgtgctcagtgaatggtttctaccctgggagcattgaagtacgctggttccggaacggccaggaagaaaaaactggagtggtgagcacagggctcatccagaatggcgattggactttccagacccttgtgatgcttgagactgtgccacggtccggggaagtgtatacctgtcaggtagaacacccatcgcttaccagccccctgaccgtcgagtggagggcacggagcgagtcagcgcaaagcaagatgctttcaggagtggggggctttgtgctcgggctgctctttctgggggctggcctgtttatctacttccgaaatcagaagggccactcagggcttcaacctaccggttttttgtcctag

SEQ ID NO: 123234 - DNA, 756 bp, Artificial Sequence
  Description of Artificial Sequence: Synthetic coding sequence
taactgcttaagctgacaagagatttcccccagcggcacgagaaatatcagagttgggctggaacttttcacctttgtctgaaaaagaacaaatatccagatagcagatccacttttattaagcacgcaggctcatacctcaagagaggagaatttctggccatccacacggcaatcacatgtttctttcgacaaatctcagctcgtttcctcgaatacagtacctctgagtgccatttcttcaacggaaccgagcgcgtcagataccttgatcggtatttccacaaccaggaggaaaatgtgcgctttgattccgatgtcggggaatttagagccgtcactgaactcggcagacccgatgccgagtattggaactcccagaaagatttactcgagcagaagcggggcagggttgataactactgtaggcacaactacggggtggtcgaatctttcactgtgcagcgcagggttcatcccaaggttaccgtttaccccagtaagacccagcccttacaacaccacaatctgctagtctgcagcgtttctggcttctaccccggctccattgaggtgcgctggtttaggaacggccaagaagagaagacaggtgttgtgtccaccgggctaattcacaacggtgattggactttccagaccttagtcatgctcgaaacagttcctcggtccggcgaggtctatacttgccaggttgagcatccctctgtcacatcacccttaactgtagagtggtag

SEQ ID NO: 123235 - DNA, 753 bp, Artificial Sequence
  Description of Artificial Sequence: Synthetic coding sequence
tgacttctcaagctcaccagagactttccccaaagacacgaaaagtatcagtcttgggctggtacgttccacctgtgccttaaaaagaataaatacccagattcgcgaagtacgttcatcaaacatgccgggagctacttaaaacgcggcgaattcctatccatccacaccgctatcacgtgcttttttctacagatctcggctcgcttcctgtggcaggggaaatacaaatgccactttttcaatggtaccgaacgggtgcaattcctggagaggctgttttataaccaggaggagttcgtgaggtttgattcagatgtcggcgaataccgggctgtgaccgagctaggccgccctgtggctgaaagctggaatagccagaaggacatcttagaggaccgccggggtcaggtcgacaccgtgtgcaggcacaattacggcgtgggggagtcttttaccgtacaacggagggtgcacccagaagtcacagtgtatcccgcaaaaacccagcccctgcagcatcacaacctgctcgtgtgttcggtgtctggattttaccctggaagtatagaggtgcggtggtttcgaaacgggcaggaggaaaaggcgggtgtagtgagtaccggtttgatccaaaacggggattggacgttccagaccctggtcatgttagaaacggtgccgagaagcggagaagtgtacacatgccaggttgagcacccctcagtcatgagtcccctaaccgtggaatag

SEQ ID NO: 123236 - DNA, 801 bp, Artificial Sequence
  Description of Artificial Sequence: Synthetic coding sequence
atggtctgtttgaagctgcctggaggttcatgtatggctgctctgacagtgaccttaatggtgctgtcgtctcccctggccctggcaggggatacacagccgcgcttcctgtggcagggcaaatacaagtgtcacttcttcaacggcactgaaagggtgcagttcctggagcgcctgttttacaaccaggaggaattcgttcgattcgacagcgatgtgggcgaataccgcgccgtgaccgagttagggcgccctgtcgcggagtcctggaactctcaaaaagacatccttgaggaccgtagggggcaggtggacaccgtctgccgccacaactacggggtgggtgaaagctttactgtccagaggagggtccatccagaggtcactgtgtacccggcaaagacccagcctctacaacatcacaatcttttggtctgctctgtttccggcttctacccaggctcaatcgaggtgcgatggttccggaacggccaggaggagaaggcaggcgtggtaagcaccggactaattcaaaacggcgactggactttccagacactggttatgctagagactgtacctaggagtggcgaagtgtatacgtgtcaggtcgagcacccgagtgtaatgtctcctctgactgtggagtggcgcgcccgctcagagtccgcgcaaagcaaaatgctgtccggcgtgggaggctttgtcctgggcttgttgttcttgggagccggcctctttatatatttcaggaaccagaaaggtcattccggtctgcaacctactggcttcctgtcctag

SEQ ID NO: 123237 - DNA, 801 bp, Artificial Sequence
  Description of Artificial Sequence: Synthetic coding sequence
atggtctgcctgaagctaccaggaggctcttgcatggctgctctcactgttaccctcatggtcttaagctcccctctagctctcgccggcgacacccagccacgcttcctgtggcaaggcaaatacaagtgtcacttttttaacggaacagaaagagttcagttcctggaaagacttttctacaaccaggaggaattcgtgcgttttgattcagacgttggagagtatagagctgtgacagaattagggcgccctgtggcagaatcatggaacagccaaaaggacatcctggaagacaggaggggccaggtagacaccgtatgcaggcacaactatggcgtgggggaaagctttactgtgcaacggagggtgcatcccgaggtgaccgtctaccctgcaaagacccaacccctccaacaccacaacctgttggtgtgttcagtgtccggcttctacccaggctctattgaggtgcggtggtttcgtaacggtcaagaagagaaggccggcgtcgtgagcaccggcctcattcagaacggcgattggacttttcagactctagtaatgttagagaccgtcccacggtctggagaggtctatacgtgtcaggtggagcaccccagcgtcatgtccccacttaccgtggagtggcgtgcccgtagcgagtcagcccagtcgaagatgctgtcgggggtggggggatttgtccttgggctgctatttctgggcgccggcctgttcatttattttagaaatcagaaggggcatagcggcctccagccaactggctttctgtcctag

SEQ ID NO: 123238 - DNA, 810 bp, Artificial Sequence
  Description of Artificial Sequence: Synthetic coding sequence
atgtcttggaaaaaagccctccgcatccccggcggcctgagggttgccaccgtcacattgatgctggctatgctgtccactcccgtggctgaagggagggactctccagaggattttgtataccagttcaagggcatgtgctactttacgaacggaaccgagcgggttaggggcgtgacaaggtatatctacaatagagaggaatacgctagatttgactccgatgtgggtgtgtaccgagcagttactccgctaggccctccggccgccgaatactggaatagccagaaggaagtgttggaacggactcgcgctgagctcgacactgtgtgtaggcataactaccaactggaactaagaactacacttcaaagacgggtctaccccgaagtcaccgtgtacccggctaagacacagccattgcagcaccataatttactcgtctgcagtgttaatggcttttacccaggcagcatcgaagtcaggtggttccgtaatgggcaagaagaaaagaccggcgtagtcagcaccgggcttatccaaaacggagactggactttccagactctggtcatgcttgaaacggtgcctagaagcggggaggtttacacgtgccaagtggagcatccatccctcacttcccccctcactgtggagtggcgagctagaagtgaaagtgctcaatcaaaaatgcttagcggggtcgggggatttgtgctgggcctgctgttcctgggcgctggactgttcatttatttcaggaaccagaagggccattcaggtttgcagcccacaggcttcctgagctag

SEQ ID NO: 123239 - DNA, 792 bp, Artificial Sequence
  Description of Artificial Sequence: Synthetic coding sequence
atggtgtgcctgaaattccccggaggatcttgcatggctgccctgactgtgaccttgatggtgctcagtagcccactggctctagccggtgacaccaggcctagattcctcgagcaggtgaaacacgaatgccactttttcaacggcaccgagagggtgcggttccttgatcgatacttttaccaccaggaagagtacgttagatttgattctgatgtcggagaatatcgggccgttactgagttagggcgaccagacgccgaatactggaatagccaaaaggatctcttggagcagcgacgagcggaagtcgacacgtattgcaggcacaactacggggtggtggagtcttttacggtgcagagaagggtctatccagaagtaacagtgtaccccgcaaaaacacagccgcttcagcaccacaacttgctcgtctgctctgtgaacggattttaccccggctccatagaggtccggtggtttaggaatggtcaggaagaaaaaaccggagtggtctccacgggtctgatccagaacggcgattggaccttccagacccttgtgatgctggaaactgttcccaggagcggcgaagtgtatacatgtcaggttgaacacccgtctctgacctctccgttgacagttgagtggcgcgctagatccgaaagtgcccagtcaaaaatgctcagcggggtgggaggttttgtgctagggctactcttcctaggggcaggcctttttatttatttccgaaaccaaaagggccattctggcctacagcctacggggtag

SEQ ID NO: 123240 - DNA, 141 bp, Artificial Sequence
  Description of Artificial Sequence: Synthetic coding sequence
cactccgggcttcagcctactggcaacacctttagttcaagtttgaggaacaggttcggggggcaggcccagcacgcctgcaatccgtccactctgggagggcgggggggaagaataatgcgaatccctgagctgaagtag

SEQ ID NO: 123241 - DNA, 891 bp, Artificial Sequence
  Description of Artificial Sequence: Synthetic coding sequence
atggtctgtctgaagttcccgggcgggtcctgcatggccgcactgactgtcactctgatggttctgtcaagtcctcttgctttggctggtgacactagaccacggtttctcgaacaggtgaagcatgagtgccacttttttaatggaaccgagcgcgtgagatttttggacagatacttttaccatcaggaggaatacgtcaggttcgacagtgatgtgggagaataccgggctgtgactgaactgggcagacccgacgctgagtattggaatagtcagaaggatctgctggagcagcgtagggccgaggttgatacttattgtagacacaattatggcgtcgtggaatctttcactgtgcaacgccgagtttacccagaagtaaccgtgtaccccgccaaaacacaaccgctgcaacatcacaatttgctggtgtgttcggttaacggtttttacccaggcagcatcgaagtgaggtggttccggaacggccaggaagagaaaacaggcgtcgtctcaactggcctgattcaaaatggtgactggacattccagacactggtgatgcttgaaacggttccaagatccggagaagtttatacgtgccaggttgagcatccctccctgacttctcctctgacggtggaatggcgagcaaggagcgagtctgcacaatctaaaatgctgtctggtgtcggcggatttgtgcttggtttgctgttccttggtgcggggctctttatttacttccggaatcagaagggccactctggtttacaaccgacaggtaatacctttagctcatctcttcggaatcgctttggcggtcaggcacagtggctgactcccgtcatcccagctctttgggaggccgaggctggcgagagttag

SEQ ID NO: 123242 - DNA, 801 bp, Artificial Sequence
  Description of Artificial Sequence: Synthetic coding sequence
atggtctgcctgaagctgcctggggggtcctccctggcggcactgacggtcaccctgatggtgctgagctcacgcctggcttttgcgggcgatacgcggcctcgatttctggaactcctgaagagtgaatgccatttcttcaacggcactgagcgggtgcgctttctcgagcgccactttcacaatcaggaggagtacgcgcggttcgatagtgacgtaggcgagtaccgggcagttcgcgaactcggcagacctgacgccgagtattggaactcccagaaggatctcctcgaacagaaacgcggacaggtggataactattgtcgacataattatggagtgggggagagcttcaccgtgcaaaggagagtgcacccccaagtcactgtttatccagcgaaaacccagccactgcagcaccacaacctcctggtgtgctcagtgtcagggttttatcccggttctatcgaggtgcgctggtttcgaaacggacaggaagagaaggctggcgttgtgagtacagggctgatccaaaatggagactggacttttcagactctcgttatgctcgagaccgtgccccgcagtggcgaggtatacacgtgccaagtggagcatccttctgtaacttcccctcttaccgtggagtggagcgccagatcagagtccgctcagagtaaaatgctgagcggagtaggcggattcgtgctgggacttctcttcctgggagccgggctcttcatctacttccgtaatcaaaaaggccatagcgggttgcagccaacaggcttcctctcatag

SEQ ID NO: 123243 - DNA, 801 bp, Artificial Sequence
  Description of Artificial Sequence: Synthetic coding sequence
atggtttgtctgaaactgcctgggggaagttctctggctgccttaaccgtgaccctgatggtactgtcaagtcgtttagcctttgccggggacacgaggccacgctttctggagctgagaaagagcgaatgccacttttttaatgggacggagagagtgagatatctcgatcgatattttcataatcaggaagagttcctgcgttttgactccgatgtgggtgaataccgcgcggtcactgagctcggcaggccggtggccgagagctggaattcccagaaggacctgttagagcagaagagaggcagggtggacaactattgtcggcacaactacggagtgggtgagtccttcactgtgcagcggcgggtccacccacaggtcaccgtataccccgccaaaacgcaacccctgcagcaccacaacctgcttgtctgttcggtttctggcttctatcctggtagcattgaggtccgatggttcaggaacggccaggaagaaaaagcaggggttgtgtctacaggactgattcagaacggcgattggacctttcagaccctggtgatgctggagacagtccccaggagtggggaggtctatacatgtcaggtagagcatccaagcgtgacttccgcccttacggttgagtggagagccaggtcagaatcagcgcagtcaaaaatgctctccggggtcggcggctttgtgctggggctgctattcttgggagcaggcttgtttatctatttcaggaatcaaaaggggcatagcggacttcagcccaccggcttcctatcatag

SEQ ID NO: 123244 - DNA, 801 bp, Artificial Sequence
  Description of Artificial Sequence: Synthetic coding sequence
atggtttgtttaaagttgcctgggggatcatctctggctgcgctgacagtgaccctgatggtgctgagcagcagactggcctttgccggtgatactcgaccgaggtttctagagctgctcaaatccgagtgtcactttttcaatggcaccgaacgcgtcagattcctggagaggcattttcacaaccaggaagagtatgcaaggttcgactccgacgtgggggagtacagggccgtgcgagaactgggcagaccagatgctgaatattggaatagccagaaagacctcctcgagcaaaagcgagggcaggtagataattactgtcgccacaactacggggtaggagagagttttacggtgcagcggagagtgcacccacaggtgactgtctaccccgcaaaaacacagcctctccaacatcacaatctgctggtctgtagcgtcagcgggttctacccaggaagtatagaagtgaggtggtttcggaatgggcaggaagaaaaagctggcgtggtgagcacgggactaatccagaacggggattggactttccaaacccttgtcatgctagagaccgtgccccgtagcggggaagtgtacacttgtcaggtcgaacatccatccgtgacatcaccacttaccgtggagtggtcagctaggtcggaaagcgcgcagtcaaagatgttgtctggcgtgggggggttcgttctgggcttgctctttctgggggccggccttttcatctactttcggaatcagaagggccactctggtctccagccgacagggtttctctcatag

SEQ ID NO: 123245 - DNA, 801 bp, Artificial Sequence
  Description of Artificial Sequence: Synthetic coding sequence
atggtctgtctcaaactgcccggaggcagctacatggctaagttgacggtgacactgatggtgctgtcctcccccttagccctggccggggatacccgaccgaggttcctgcagcaggataagtacgagtgccactttttcaacggaaccgaaagagttagattcctgcaccgcgatatctataaccaagaggaagatcttcggtttgactctgacgttggggaatacagagctgtaacagaattgggaagacctgacgctgagtattggaactctcagaaagactttctcgaagataggcgcgccgctgtggatacatattgtcgacacaactatggagtgggagagagcttcaccgtacaacggcgcgttgaacctaaagtcaccgtgtacccagcgaggacacagacgttacagcaccataatcttttagtgtgttctgtcaatggattttaccccgggtccatagaagtccggtggtttcggaatagccaagaggaaaaagcaggggtcgtttccaccggcctgatccagaacggcgattggacctttcagacactcgtgatgctggagaccgtcccccggtctggagaagtgtacacctgccaggtcgagcatccctctgtcacgtctccactcactgtggaatggcgtgctcagtcagagtcagcccaatcaaagatgttgtccggggtggggggcttcgtgttgggtctgttatttctgggggccggccttttcatttatttcaagaaccagaaaggacattctggactgcatccaacaggcttagtgtcctag

SEQ ID NO: 123246 - DNA, 891 bp, Artificial Sequence
  Description of Artificial Sequence: Synthetic coding sequence
atgggagagctcatggcatttctgctccccctgattatcgtcttaatggttaagcactctgatagcagaactcactcattaaggtacttcaggttaggggtgagcgacccgattcatggagtcccagagtttattagcgtaggctacgttgacagtcatccgataacgacttatgactccgttactcgacagaaggagcccagagccccctggatggccgagaatctagcccctgaccactgggagcggtatacacaactgctcagaggatggcaacagatgtttaaggtggaactgaaaagactgcagcgccactataatcacagcgacaacgtcgcacatacaattaaacaggcttgggaggccaaccagcacgagctcctataccagaaaaattggcttgaggaagagtgcatagcctggctgaagaggttcctcgagtacggtaaggataccctgcagaggaccgaaccgccattagtgagagtgaataggaaggaaacgttcccgggcgtaaccgcactcttctgcaaggcccacggcttctatcccccagaaatctacatgacctggatgaagaatggcgaggagattgtccaggagatagattacggcgacatcctgccctcgggtgacggcacctatcaggcttgggctagcatagagcttgaccctcaaagtagtaacctttacagctgccatgttgagcactgcggcgttcatatggttctgcaggtaccacaggaaagtgagacaattccattagtcatgaaggccgtgtctgggtccattgtcttggtcatcgtgctggccggcgtcggcgttctggtatggagaaggaggccacgggaacagaatggagctatttacctccccaccccggataggtag

SEQ ID NO: 123247 - DNA, 1026 bp, Artificial Sequence
  Description of Artificial Sequence: Synthetic coding sequence
atgggagaactgatggcttttcttttgccccttattatcgtactgatggtgaaacatagcgattcacggacccacagtctgcggtatttccgcctgggggtgtcagacccaattcacggggtccctgaattcatctctgtgggatatgttgactctcaccccatcaccacatacgatagcgtgacccgccagaaggaaccacgagcaccatggatggcagagaatctggcaccagatcattgggaaaggtacacacagctgctgagagggtggcagcagatgttcaaggtggagttgaagcgcttacaacggcactacaaccacagtggatcccatacataccagcggatgatcggctgtgaactcctggaggacgggtcaaccacaggctttctgcagtacgcctatgacggacaggactttctgatcttcaataaggacacactgagttggctggctgtggataatgtggcccacaccatcaaacaggcgtgggaggccaatcaacatgagcttctctatcagaagaactggctggaggaagagtgtattgcctggctaaaaaggtttctggagtatgggaaggacaccctacaacggacggaaccccccctggtgagggtgaacagaaaagagactttccctggtgtaactgccctgttttgcaaagcccacggattttatccaccggaaatttacatgacatggatgaagaacggcgaagagattgtacaggagattgactatggcgacattctccctagcggagatgggacgtaccaggcttgggctagcatcgaactggaccctcaaagctcaaatctttattcgtgtcatgtagagcattgtggcgtgcacatggtgctacaggtaccccaggaaagtgaaaccatcccattagtcatgaaggccgtgtccggatcaatcgttcttgttatcgtcttggccggtgtgggagtactcgtctggcgacgacgcccaagagagcaaaacggagcaatctacctgcccaccccggaccggtag

SEQ ID NO: 123248 - DNA, 645 bp, Artificial Sequence
  Description of Artificial Sequence: Synthetic coding sequence
atgggggaacttatggcatttctgctccctctgattatagtgctgatggtcaagcattccgattcccgcacccatagcctccgctacttccgcttaggcgtaagcgacccgattcacggagtcccggaattcatttccgtaggttacgtcgatagtcaccccatcacaacgtacgactccgttacaaggcagaaggagcctcgcgccccgtggatggctgagaacctagcaccagaccactgggaacgctacactcagttattacgaggctggcagcagatgttcaaggtcgagttgaaaagattacagcgacattataatcactccggctctcatacctatcagcggatgatcgggtgcgagctcctcgaggatggctcaactaccgggttcctacaatatgcctatgatgggcaagactttctgatttttaataaggacacactctcatggctggcggtggacaacgtggctcataccattaagcaagcctgggaggccaatcaacatgagctcctgtaccagaagaactggctggaggaagagtgtattgcctggttaaaaaggttccttgagtacggcaaagatacactgcagaggactgagcagaatggagcaatctacctcccaaccccggatagatag

SEQ ID NO: 123249 - DNA, 792 bp, Artificial Sequence
  Description of Artificial Sequence: Synthetic coding sequence
atgtgggagcttcgttccgcaagcttttggcgagcgatcttcgctgaattctttgccacactcttttatgtgttctttgggcttggatcttccctcaggtgggcaccgggaccacttcatgtgctgcaggtcgctatggcatttggcctggcactggcaacattggtgcagtctgtaggccacattagcggggcacacgtgaacccggccgtgacattcgccttcttggtcggcagtcagatgagtctgttgcgcgctttctgttatatggcagcccagttgttgggagctgtggctggcgccgctgtgctctatagcgtcactcctccagccgtgagagggaacctggcgctcaacacactgcatcctgccgtcagcgtgggccaagccaccaccgtcgagatatttctgacactgcagtttgtgctgtgtatttttgccacgtatgatgaaagaagaaacgggcagctgggctcggtggccctggctgtagggtttagcttggcgctcggccacctcttcggaatgtactacacaggtgctggcatgaatcctgcccgatcatttgctccggctattctgaccgggaactttactaaccactgggtctattgggtggggccaatcattggtggaggtctgggttcactattatacgactttcttcttttccctcgcctcaaatcaatctctgaacggctgtcagtgttgaaaggagcgaaacccgacgtgtccaatggacaaccagaggttaccggggaacctgtggagctcaacactcaggcactttag

SEQ ID NO: 123250 - DNA, 2682 bp, Artificial Sequence
  Description of Artificial Sequence: Synthetic coding sequence
atggccaccgaagagtttatcattagaattccaccctaccactacattcatgtgctcgatcagaatagcaacgtcagcagggtggaagtgggacccaagacatatatcagacaggacaacgagagagtcctgtttgcaccgatgcgaatggttaccgtccccccacgccactattgcactgtggcgaaccccgtatcaagggatgcccaagggttggtcctctttgatgtcacaggacaggtgcgtctacgtcatgcggacttggaaatacggcttgcccaggatcccttccctctatacccaggggaggtgcttgagaaggatatcacacctcttcaggtcgttctgcctaacacagcgctgcatctgaaggctttactggacttcgaagacaaggacggcgacaaggttgtcgctggggacgagtggcttttcgagggacccggtacatatatcccacgtaaagaagtggaagtcgtggagatcatccaggctacaataattagacagaaccaggctttgagattacgggccaggaaggaatgctgggacagggatggcaaggagcgcgtgactggcgaggaatggttagtgacaacagtgggggcttacctacccgcagtttttgaggaggtgctcgatctggtcgatgccgtgattctcaccgagaaaactgccctgcacctgagggcacgccgcaatttcagggacttcagaggggtgagccggcgaactggcgaagaatggctagtgaccgtccaggatactgaagctcatgtacccgacgtgcacgaggaggtattgggcgtggtgcctattactacactgggaccccacaactactgcgtgatactggatccagtcggaccagacggaaaaaaccagctggggcagaagcgggtggtgaagggtgaaaagagtttttttctgcagccaggggaacagcttgagcagggtatacaggacgtttacgtacttagcgaacaacaagggctcctattgcgggcccttcaaccattggaggagggagaggatgaagaaaaggtgagccaccaggccggagaccactggcttattagaggtcctctagagtacgttccttcagccaaagtcgaagttgtggaagagaggcaagcaattccactggacgaaaatgaaggcatctacgttcaggacgtaaagactggcaaggtgagagctgttatcggcagcacgtatatgcttacccaggatgaggtcctttgggaaaaggagctgccccctggcgtagaagaattgcttaataagggtcaagatcctctggctgatcggggcgagaaagatactgcaaaaagcctgcaaccccttgcccctagaaataaaactcgggtagtttcctatcgggttccacataatgccgccgtgcaggtatatgactacagggaaaaacgagccagagtcgtcttcggaccagagttagtttcgctgggcccggaggagcagttcactgtcctctctttaagtgctgggaggcccaaaagaccacacgcccggagggcattatgccttttactgggcccagacttctttaccgacgtgatcacaatcgagaccgccgatcacgctaggctgcagctccagttggcatataattggcatttcgaggttaacgacagaaaggacccccaggaaacagcgaagttattctccgtgccagacttcgtgggggatgcctgtaaggcaatagccagccgagtaagaggggcagtggcctcagtaacttttgacgatttccacaagaatagtgccaggatcatccggactgctgtgttcgggttcgagactagcgaagctaaaggaccagatgggatggccctgccacggcctcgggatcaggcagtgttcccccagaacggactcgtcgtctcttcagtggatgtgcaatcagtggagcctgtagatcagagaacccgagatgcactccagagaagtgtccagctggctatcgaaattacaaccaattcccaagaggctgccgctaagcacgaggctcagcgactcgagcaagaagcaaggggaaggctcgaacgacaaaaaatactcgatcagagcgaagccgaaaaagcgcggaaagagctgttggagcttgaagccctgtccatggccgtcgagagtaccggaacggccaaggccgaggccgagagcagagccgaggccgctcgaatcgaaggcgaaggatcagttcttcaagccaagttgaaggctcaggccctggctatagaaaccgaagcagagctgcaacgagtccagaaggtgcgtgagcttgaactggtttacgctcgggcccagctagaacttgaagttagcaaggcccagcaactggccgaagtagaagtgaagaagttcaagcagatgacggaagccattggtccctcaacaattcgagacttggccgtggccggaccggaaatgcaggtcaagctgctccagagcttggggttaaagagcaccctcattaccgacggatctacccccattaacctgttcaacacagcctttggacttctgggcatgggaccggaagggcagccgctggggcgacgagttgcgtccggtccaagccccggagagggcatctccccacagagtgcccaagcaccccaggcgcccggggacaatcatgtcgtccccgtcctgcgctag

SEQ ID NO: 123251 - DNA, 2682 bp, Artificial Sequence
  Description of Artificial Sequence: Synthetic coding sequence
atggcaacagaggagtttatcatccgaatccctccctatcactacatacacgtgctggatcagaactctaatgtgagccgggtcgaggtcgggcccaagacatacattaggcaggacaatgagcgggtattgttcgcccctatgcggatggtgactgttcccccccgccactactgcaccgttgctaaccccgtgtcgcgtgacgcacagggcttggtgctcttcgatgtcacgggccaagtccgcttgcgtcatgctgacctggagattagacttgcacaggacccctttccactctatcctggagaggtgctggaaaaggacatcacaccccttcaggtcgtgctacccaacaccgccctccatctcaaggcgctgttagatttcgaggataaagatggcgacaaggttgtcgcaggagatgaatggctatttgagggcccaggaacttatatccctcgcaaagaggtggaggtcgtcgaaattattcaggcaactatcataagacagaatcaagctctccgtctacgagcacgcaaagagtgttgggatcgcgatgggaaggagcgcgtgaccggggaagagtggttggtgacaactgtgggcgcctacctgcccgccgtgtttgaggaagtacttgacctggtggatgctgtgatcctcaccgagaaaacagccctccacctaagggcacggcgcaattttagggatttcagaggcgtgagtcggcgaacaggggaagagtggttagtcacagtgcaggacaccgaggcccacgttccagacgttcatgaagaggtgctgggtgtggtcccgattaccaccttaggtcctcacaactattgtgtgatcctggaccccgtgggcccagacggaaaaaaccagctgggccagaaaagagtcgtgaagggagagaagtctttctttttacagccgggggaacaacttgagcagggtatacaggacgtgtacgtcttatcagagcaacaaggtcttctccttagagcactccagcctctggaagagggagaagacgaggaaaaagtgtctcaccaggccggagaccactggcttatcagagggcctctcgagtacgtcccaagcgccaaggttgaagtcgtggaggagcggcaggccatacctctggatgagaacgaaggcatatacgtgcaagacgttaaaaccggcaaagtgcgggctgtgatcgggagcacctatatgctcactcaggacgaggtcctgtgggaaaaagagttacccccgggagtggaggagctgctgaacaaagggcaggatcccctcgccgaccgcggggaaaaagatacggccaagtcgctacagccattagccccacgcaacaagacacgggtggtcagttaccgggttccacataatgccgcagttcaggtgtatgactatcgggagaaaagagctcgtgttgtgttcggacccgaactggtgtccctcggacctgaggagcagttcactgtactatctctatcagcaggacgacccaagaggccacacgcaagacgtgcactttgcctgctgttgggcccggactttttcaccgatgttataaccattgagactgcagatcacgctagacttcagctccaactggcctacaattggcacttcgaagtgaacgatcggaaggacccccaggagaccgcaaaactgttcagcgtgcccgattttgtaggagatgcatgtaaagctatagcctctcgggtccgaggagctgtagcgtccgtaactttcgacgacttccataaaaattctgcacgaatcattcggacagctgtgtttggcttcgagacatccgaggccaagggccccgacggcatggcactaccaagacctcgagaccaggcagtattccctcagaatggactcgtggtgagcagcgtggacgtgcaaagcgtagaacctgtagaccagcggacaagagatgccctgcaacggagtgtgcagcttgctatcgaaatcacaacaaattcccaggaagccgcagcaaaacacgaggctcaacgactggagcaggaagcacggggccggctcgagcgccagaagatcttagaccagagcgaagccgagaaggctcgcaaggagttgctggagctcgaggccctctctatggccgtagaatcgaccggtaccgcaaaagcggaggctgaatctagagccgaggctgcacgcatagaaggcgaaggctctgtattgcaggctaaactgaaggctcaggctctcgcaatcgagacagaagcagaactccaaagggtgcagaaggtgagagaactggaattggtctatgcccgtgcccagcttgagttagaagtctccaaggcacagcaacttgccgaggttgaagtgaaaaagttcaaacagatgacggaagctatcggtccatctacaatcagggaccttgcagttgccggccccgagatgcaggtaaagctcctgcaatcgctgggcctgaagtctactttgatcaccgacggctctacacctattaatctgttcaacaccgcctttggactgctcggcatggggcccgagggtcagcctctcgggcggagggttgcgtccggcccctctccaggagagggaatatcacctcagtcagcccaagcaccacaggcgcctggtgataaccacgtggtgccggtgttgcggtag

SEQ ID NO: 123252 - DNA, 480 bp, Artificial Sequence
  Description of Artificial Sequence: Synthetic coding sequence
atgtgctggactaggacggccacttgtccagtttggagatcagggcagcgcccgacaagcggccgcacaatgagaggaagcggcttcggaggcaggaggcatccatacggtaaagacagccctgctcctccaggctctgcagagttgcccgggctccagggtagcgtgccccctcactggggtggcgtggccgggaatagtgctgggcaccgtggcccacgtgcccggtgtccacgcggaggggccggaggttgcgctcaccaccacccagggcccccccaattactgagggattctaggccatgtcgaaccggatggcaagagtccgctggcgctgaggccaggggacaggggcgtgaggtctttttccctccggcacgcagagctgcaggcactagacacccaggatgtgtttgtgccgtcggcgctgccggagctgcagccgaaggccccgccgcacctggcggcggaggaggatag

SEQ ID NO: 123253 - DNA, 1251 bp, Artificial Sequence
  Description of Artificial Sequence: Synthetic coding sequence
atgtcaacaaagcagatcacatgcagatatttcatgcacggcgtgtgcagagaaggcagccagtgcctgttctcacatgacttagccaacagcaaaccctccactatatgtaaatattaccaaaaaggttactgcgcatacggaacaagatgtagatacgaccatactcgtccttcagctgcagccggaggagccgttggcaccatggcccactccgtcccgagcccagcattccattccccccacccgccctctgaagtcactgcaagtattgtgaaaactaattcccacgagccagggaaacgggagaaaagaactctcgtgttgcgggataggaacctgtccgggatggctgaaaggaagacccagccttccatggtgagcaatcctggatcatgcagtgacccccaaccctctccagaaatgaagccccatagttatctggacgccatccgatcagggctcgatgatgttgaagccagctctagttacagcaacgagcagcaactgtgcccttatgcagccgcaggcgaatgccgcttcggagatgcgtgtgtttacctccacggcgaagtgtgcgagatctgccgattgcaggtcctgcatcctttcgaccccgaacagcggaaggctcatgaaaagatctgcatgcttaccttcgagcatgagatggaaaaagccttcgcttttcaggcaagccaggataaggtctgttcgatatgcatggaagtgatcctggagaaggcctcagctagtgagcggcgcttcgggatcctgtcgaattgcaaccatacctattgtctgtcctgtatccgacagtggcgctgtgccaaacagttcgagaaccctattattaagagctgccctgagtgccgtgtgatctccgagttcgttattccatctgtgtactgggtggaagaccaaaataagaagaacgagctcatcgaagctttcaaacaggggatggggaaaaaagcctgcaaatactttgagcaaggcaaaggcacctgtcctttcggatccaagtgtttgtatcgtcacgcttaccccgacgggcgcctggctgagccagaaaagccccgcaagcagctgtcctcacaaggtaccgtccgctttttcaattcagtgcgactgtgggacttcatcgagaatagagagtccaggcatgtgcctaataacgaagacgtagacatgaccgaactgggagatctgtttatgcacctatctggagtggaatcatccgagccatag

SEQ ID NO: 123254 - DNA, 1524 bp, Artificial Sequence
  Description of Artificial Sequence: Synthetic coding sequence
atggaggagcccgctgccccctccgaggcacacgaggctgctggagcccaggccggtgctgaagcggccagggaaggtgtgtcaggtcctgatctgcctgtctgtgagcccagcggggagagcgccgctcctgacagtgcactcccacacgctgcaagagggtgggcgcccttccccgtcgcaccagtgcccgcccacttgagacgtgggggcctacgaccagcaccagcaagtggcggcggggcttggccctccccgctgccgtccaggagcagcgggatctggacaaaacagattatctgccggtattatatccatggacagtgcaaggaaggtgaaaactgtagatatagtcacgatttgtccggccgcaagatggccaccgagggtggagtgagcccccctggtgccagtgctggtggaggcccttctaccgccgcccatattgagcccccaactcaggaggtggccgaagctccaccagccgcttccagcctgagtctgccagtgattgggtctgccgctgagcgggggttctttgaggccgaaagggataacgctgatcggggcgccgcagggggggcaggcgttgagtcctgggccgacgctatcgagtttgttcctgggcagccctatagaggtcggtgggtggcctcagccccggaggcaccgctccagtcctctgagaccgagaggaaacaaatggctgtaggtagtggccttaggttctgttactacgcaagtcgcggcgtctgcttcagaggcgagtcgtgtatgtatcttcacggcgatatctgtgatatgtgcggacttcagacactgcaccccatggacgctgctcagcgggaggagcatatgcgtgcttgtatagaggctcacgagaaagatatggagctcagttttgctgtacagcgcgggatggataaagtgtgtggtatttgcatggaagtggtatatgagaaagcaaacccaaatgaccgtagattcggcatcctctcaaattgtaaccattccttctgcatcaggtgcatccgccggtggaggtcagccaggcaatttgagaatcgcattgtaaagagctgtccacagtgccgtgtaacaagtgaactggtcatcccatctgaattttgggtcgaggaagaggaggagaagcaaaagctgattcagcaatataaagaagccatgtcgaacaaggcatgtcgttacttcgccgaaggaagagggaactgcccatttggtgatacatgcttttataaacacgaataccccgaaggctggggagacgagcctccaggccccggtgggggttcattctctgcctactggcaccagcttgtcgaaccagtccggatgggcgagggcaacatgctgtacaaaagtattaagaaagaactggtggtgctgcgcctggcttctcttctgtttaaacggtttctgagcctacgcgatgagcttcccttttctgaggaccagtgggacctgttacactacgaactggaagaatacttcaaccttatcctgtag

SEQ ID NO: 123255 - DNA, 462 bp, Artificial Sequence
  Description of Artificial Sequence: Synthetic coding sequence
atggccccagcggccgccacgggcggatctaccttacctagcggcttctccgtctttaccacgttacccgacctgttatttatcttcgagttcatttttggggggttggtctggatactcgttgcatcctcccttgttccttggcctctggtgcagggttgggtaatgttcgtatccgtgttttgctttgttgctactaccaccctcattattctttatatcatcggagcacatgggggcgagacatcctgggtaactctggacgccgcctatcattgcaccgcagccctcttttatttaagcgccagcgtgcttgaggctcttgccaccatcaccatgcaggatgggtttacgtacaggcactaccacgaaaacattgctgccgtcgtgttctcatacatcgcgaccttactgtatgtagttcacgcggtcttctccctcatcaggtggaagtcatcgtag

SEQ ID NO: 123256 - DNA, 168 bp, Artificial Sequence
  Description of Artificial Sequence: Synthetic coding sequence
atggcaccagccgctgctacgggaggcagcactcttccttccggatttagcgtcttcacaactctccccgatctcctctttatctttgagtttgtgtttagctatattgccacactactgtacgtggtgcacgcggtcttctctctgattaggtggaaaagcagctag

SEQ ID NO: 123257 - DNA, 336 bp, Artificial Sequence
  Description of Artificial Sequence: Synthetic coding sequence
atggcgcccgccgccgcaacgggaggctccacattgccaagcggatttagtgtgttcaccactctccccgacctcctgttcattttcgagtttatattcggcgggttggtgtggattctggtggcctcctctctggtgccatggcctttagtccaaggatgggttatgttcgtgagcgtgttttgctttgtagctacgacaaccttgatcattctgtatatcattggggcacacggtggggaaacatcctgggttaccctcgtgtttagctacattgcaactttgctgtacgtagtccatgccgtattctccctcataaggtggaaatccagttag

SEQ ID NO: 123258 - DNA, 294 bp, Artificial Sequence
  Description of Artificial Sequence: Synthetic coding sequence
atggcaccagccgctgctaccggcggttccacgctaccgtctggtttttcagttttcaccaccctgcccgacctcctattcatatttgagttcgatgcagcctatcactgtaccgccgctctgttctatctgagtgctagcgtgctcgaggctttggcaaccatcacgatgcaagatggcttcacttaccgtcattaccatgaaaacatcgctgccgtcgttttttcctacattgcaacactcctctatgtagtgcacgctgtatttagcttgatccgctggaaatccagttag

SEQ ID NO: 123259 - DNA, 462 bp, Artificial Sequence
  Description of Artificial Sequence: Synthetic coding sequence
atggccagccctgatccaccagcaacctcttacgccccctcggacgtccccagcggcgttgcactgttcttgacaattccatttgccttcttcctgcccgagctcatcttcgggtttctggtttggacaatggtagccgctacacacattgtgtaccctttactgcaggggtgggtaatgtacgtgtcactaacctcgtttcttatcagcctgatgtttctgctcagttacttgttcggtttttacaagaggttcgagtcctggcgggtactggactcgctctaccacggcaccaccgggatcttgtacatgagtgccgctgtcctgcaagtgcacgcgacaatcgttagcgaaaagctgctggatcccagaatttactatataaattccgcagctagtttcttcgcatttatcgctacgcttctgtatatactacatgccttctccatctactatcactag

SEQ ID NO: 123260 - DNA, 6216 bp, Artificial Sequence
  Description of Artificial Sequence: Synthetic coding sequence
atggaactggctcatagtctattactgaacgaagaggccctcgctcaaatcacagaggctaaaagacccgtgttcatatttgagtggctgcggtttttagacaaggtgcttgttgctgccaataagacagacgtcaaagaaaaacagaagaagctggtggagcagttaacagggctgatctccagttcccctgggccccctacgcggaagttgcttgctaaaaatttggccgccctgtatagcataggggatacgtttacagtgttccaaaccctagataaatgcaatgacataatacgcaacaaagacgacaccgcagcttacttgcccacgaagctcgcagctgtggcctgtgtgggtgcattttacgaaaaaatgggaagaatgctgggcagtgccttccctgaaaccgtaaataatctactgaagagcttgaagtctgctgaaagccagggaagatccgagattcttatgtcccttcagaaggtgttatccggacttggcggcgccgcagccagtagccatcgtgacatttacaagaatgctcgctcactgctaacagaccggagcatggctgtgcgatgcgcggtcgccaagtgcctgttagaattgcagaacgaggccgtgttcatgtggacggccgagctggaaaatattgccactctgtgctttaaggctttagaaaactctaactatggcgtgcgcgtggcagtcagcaagctgctggggacggtcatggccacagctcttatgccaaagcaggctaccgtgatgaggcagaatgttaagcgtgcaaccttcgacgaagttctcgaactgatggccaccggatttttacgtggcgggagtggctttctgaagagcggaggtgagatgctgaaagtggggggcagtgttaacagggaggtgcgagtgggggtgacccaagcgtatgtggtgttcgtcacgactctcggcgggcagtggttagagaggagcttcgcaaccttcctatctcacgtgctagacttggtgtcccatccacgggccactcagacacatgtggaggcagtgtacagtaggagatgcgtcagttttattctgcgggcaaccgtcggctccctcctgggggagaaagctcagattgcagccgccaaagagatctgccaagccattggtaaacagatgaaggcagtcgaagctgtagtgaacgacacttcaggagagaataaatctggcgccgcagatattgctgctagccagcacgtcatggtgtgtgcactgcaggaactgggctcactggtccagtccctgaacgctacagcctcaccgctcatccaggaggcaagcatagggctgctggagatcgtcacttctgtgcttcttcaccctagcatggccgcaaggttggccgccgcatggtgtctccggtgtgttgcggtggcactgccctttcaactgaccccctttcttgacaggtgtgctgagaggctgaacaacctgaagacctcccctgaggcggtttctggatattccttcgcgatggccgccctgttgggaggcgtgcaccagtgccccctgggaatacctcacgccaagggtaaaatggtcgtaagcattgcggaagacctgttgaggacagctgcccagaacagtcgcctctccctccagcgaacccaggcaggttggctgctgctcggcgccttaatgacgctggggccaagcgttgtccgataccatctgcctaaaatgctccttctgtggcgtaatgtgtttccccgctcattgaaggagctcgaggccgagaaagcacggggggatagctttacctggcaagtcacactggaggggcgcgcaggagccctttgcgcaatgcgctcgttcgttgctcactgccctgagctgctgaccgaggacgtcattaggaagcttatgactcctatcgaatgcgccatgactatgatgtcacatattccgtcagtaatgaaggcccacggagcacaccttaaggcatctgcagcaatggttcggctgcgactgtatgatatcttggccctgctcccccccaagacctacgaaggttcttttaacgcactgttgcgcgaacttgtggccgagttcacccttacagataacagcgctaacactacgacaagtctgctgcgatctttatgccactacgatgactccgtcctccttgggtcttggcttcaggaaacagaccataagtcgatcgaggatcaactgcagccgaactcggccagcggatccggggcactggaacacgacccatcctccatctaccttcgcatcccagctggtgaggccgtgcctgggcctctccccctgggggtgtcggtgatcgacgcatcggtcgcgctcttcggcgtggtgttccctcacgtatcctataaacatcgactgcagatgttggatcacttcgccgaatgcgtgaagcaggctaagggggtgagacagcaggctgtccagctgaacattttcaccgctgtcttgtccgccttaaagggccttgccgagaataaatcaacactcgggcctgaggaagtgcgaaagtctgctctgacgctcgtgatgggtcccctcgacaaccccaatcctattttacgatgcgctgccggggaggccttgggacggatggcccaagtcgtgggcgaagccacttttatcgcccgaatggcacagtactccttcgacaagctgaagagtgcgagggacgttgtgagcagaaccggtcacagcttggccctgggttgcctccaccgttatgttggtggtatcgggagtggccaacacctcaaaacctccgttagcattctgctggcgctcgcccaggacggaacttctcctgaagtgcaaacttggagcctgcacagcttggcgttgattgtggacagttccggaccaatgtataggggttatgtggagccgaccctcagccttgttctgaccttgttactgaccgttcctccctcacacactgaggtgcatcagtgcctagggcggtgtttgggggcaatcatcactactgttggaccggaactgcaggggaatggagctacaactagcactattcggagcagttgccttgtaggctgcgcgattactcaagatcatagcgacagcttagtgcaggctgctgcaatttcctgtctgcagcagctccacatgttcgcaccccggcatgttaatctgtctagcttggtgccttccctctgcgtgcatctctgttcatcccacctgctgctgaggcgcgccgccgtcgcttgtctgcggcagcttgcccagcgcgaagccgccgaggtgtgcgaatatgcgatgagcttagccaagaataccggcgacaaagaatcatcatccgccaatgtctctccgtttgcgcccggagttagctcgagaaccgatattcactgtcggcaccaaggcgtcaacataactgagaccggtctcgaaggccttctgttcggcatgttagatagggaaacagatcggaagttgtgttccgacatccatgacacgctgggacacatgctgtcctcactcgcagtggaaaagctcagccattggttgatgctgtgtaaggacgtcctggccgcgagctccgatatgagcaccgctacgctgctgtctagtggcaaggatgaagaggcggaaaagaaagacgagatggacgatgacactatgttcactactctgggagaggaagacaaatcaaaaccgttcgtagccccccgatgggccaccagagttttcgctgctgactgcctgtgcaggataatcaacctgtgtgaaaacgccgaccaggcccacttcgaccttgcactggccagatcagccaagctgcggaaccctacgaatgacctcttggtgcttcacctgtcagatctgatcagaatggcctttatggccgcaaccgatcattcaaatcagctgagaatggccggtctgcaagctctcgaggacatcataaagaagttcgcttcagtccccgagccagaatttcctgggcacgtgattttggaacaatatcaggcaaacgtcggtgctgctctacgacccgccttcagtcaggacaccccctcagacattatagcgaaagcatgccaggtttgttctacctggattggaagtggtgtggtgtcagaccttaacgatttgcgtagagtacacaacctactcgtgtcaagcctggacaaggtccaggcgggcaagggcagtagtagccaactgtatagggagtccgctaccaccatggaaaagttagcggtgctgaaggcctgggccgaagtgtatgtggtagctatgaacattaagaaagaggcagagagcaaaccaaaacgcgccattaaaaatacagatgacgacgacgacgattgtggaactatcgatgaactcccgccggacagtttgatcacactcgtgcagcctgagctgcccacactgtctagactttggctcgcagccctgaaagactatgccctccttacgctgccggcggagttcagctcccaactgccccctgacggcggcgcgttttatacgcccgagaccatcgacaccgctcggctgcattaccgtaatagctgggcaccaatcctgcacgctgtggctctctggttgaactcaaccggcttcacgtgcagcgagagcaccgaggcggctgccatatccggactccaaaagcgcagtaccagtgtgaacctcaaccaggcctctggggctgtcggatctgctaaatcactcccggagataaataaggaccgaatgcacctcatcttgggagtaagtattcaatttctgtgtagccctcggcctgaggagccaattgagcacgtaacagcttgtctacaggctctccacaccctcctcgatagcccctatgctcgagtacacatcgctgaggatcagctgatcggcgtggaactactttcagtacttcataggcttcttctgacatggaaccctagctctgtgcagttgttagtgaccggggtagtgcagcagatcgtacgggcggcgcaagattatctacaggagaaacgcaatacactgaacgaggacgatatggaaaaggaggcatgtaccgtgctaggcgagggaggtgacagcggtggcctcattcccggaaagagcctggttttcgcaacaatggaactgttgatgttcatactagtaagacacatgcctcacctttctacaaaagtaagcgattcaccatctcatatcgcgactaagacaaggctgtccgaagaaagcgcaagactcgttgccgccaccgtgaccatcttgagcgacttgccttcactgtgtagtcctgcaggctgtatgacaatacttcctacaattctgtttttgatcgcacgcattttgaaggatacggccatcaaatcagccgacaatcaggtcccaccaccagtgtctgcagccctgcaggggatcaagtccattgttacactcagcatggccaagaccgaagccggagtacagaagcagtggaccgcactaataaggtccacgctggcgtgtatcctcgagtacagtcagcccgaagacagcgtgccgacgccagatgaagtctcaatgcttaccgcaattgctctgtttctgtggtccgccagcaacgagattatcggagtgcagtctcttcagaatggctgtatgaatcgctttaaaaacgcactcaattcttgcgatccttgggtgcaggcgaaatgttaccaacttctgctcagtgtgtttcagcatagtaatcgggcactctcaaccccatatatccacagccttgccccaatcgtggttgagaaattgaaggctgttgagagaaataggcctgcctcaaacatcgagctgctggctgtgcaggagggcattaaagtgctggagactttggtcgccctgggagaggagcagaacagggtccagctcctcgccctgctggtccctaccttaatttcctacctgttggatgaaaactcctttgcgtctgcgtcgagcgcatccaaggatcttcatgaatttgccctgcaaaatctgatgcatatagggcccttgtatcctcacgccttcaagactgtaatgggagccgctcctgagctgaaggtgcgactggagactgcagttcgagcatcacaggccagtaaggctaaggctgctgcacgccaaccggccccggctatacattcggcccctactatcaagctgaaaacgagtttcttttag

SEQ ID NO: 123261 - DNA, 1005 bp, Artificial Sequence
  Description of Artificial Sequence: Synthetic coding sequence
atgtccgaacccataagggtgctcgtgaccggcgctgcgggccaaatagcctactctctactgtactctatcggcaatgggagtgtgtttggaaaggatcagcctatcatactggttttgctggatattactcccatgatgggcgtcttggatggtgtgctgatggaactgcaggattgcgcattgcctttattgaaagacgtgatcgcgaccgacaaggaggatgttgcctttaaggacctggacgtggccattttggtggggagcatgcccaggagggagggaatggagcggaaggatctgctaaaggccaacgtaaagatattcaagtctcagggcgcggctctggataagtacgccaagaagagtgtcaaggtaattgtggttggcaatcccgccaatactaactgtctgaccgcaagcaagtcagcacctagtataccaaaggagaacttcagctgcctgacacgccttgaccataaccgagccaaggcccagattgcccttaaacttggcgttacagccaatgatgttaagaacgtgatcatctgggggaaccactcctcaacccaataccctgacgtaaaccatgcaaaagtcaaactgcagggaaaggaagtgggagtctatgaggccctgaaagacgacagctggttgaaaggcgaattcgtaacgactgtacagcagcgcggagccgcagtcattaaagcccgtaaactgtcatcagctatgagtgccgctaaagccatttgtgaccacgtcagggatatctggttcgggacgccagaaggggagtttgtgagtatgggggtgatctccgatggaaactcatacggcgtgccggatgatctgttgtactcctttccggttgttatcaaaaataaaacctggaaatttgtcgaggggttgcccatcaacgacttttcaagagagaagatggatctgacagccaaagaattgacagaggaaaaggagtctgctttcgaatttttgtcttcagcctag

SEQ ID NO: 123262 - DNA, 1059 bp, Artificial Sequence
  Description of Artificial Sequence: Synthetic coding sequence
atgcgcagatgcagttattttccaaaggatgtgactgtgttcgacaaggacgataaatcagagcctattcgcgtgctcgtcactggcgctgcggggcagattgcctacagcttattgtatagtattgggaatggcagcgtttttggcaaagaccagccaatcatcctcgtcctgttagacataactcctatgatgggggttcttgacggggtgctgatggaactgcaggactgcgcactcccactcttgaaagatgtgattgcaacagataaagaagacgtcgctttcaaagatctcgacgttgccatattggtaggaagtatgccccgacgtgaaggtatggaacggaaggacctgcttaaggctaacgtgaaaatcttcaaaagccaaggagctgccctggataaatacgctaagaaaagtgtaaaggtgatcgtggtcggcaaccccgcaaacacaaactgtcttaccgctagcaaaagcgcaccttccatccctaaggaaaactttagttgcttaacccgcttggatcacaatcgagcaaaggcccagatcgctctgaagttaggagtgactgccaacgacgtcaaaaacgttattatctgggggaatcactcgtccacccaatatccagatgttaaccatgctaaagtgaagctgcagggcaaagaggtgggcgtgtacgaggcactgaaggatgacagctggttaaagggcgaattcgtcacaactgttcagcaaagaggggctgcagtgataaaggcccgcaagttaagcagcgcaatgtcagcggccaaagcgatttgcgatcacgtgcgcgacatttggtttggcactccagaaggggagttcgtgagcatgggtgtcatttcagatggaaacagctacggggtccccgacgacttattgtatagctttcccgtggttatcaaaaataagacctggaaatttgtagaaggcctccctatcaacgacttctctagggagaaaatggaccttacggccaaggaactgacggaagaaaaagaaagcgcttttgagtttttatcgagcgcgtag

SEQ ID NO: 123263 - DNA, 738 bp, Artificial Sequence
  Description of Artificial Sequence: Synthetic coding sequence
atgccgaggagggaggggatggagagaaaggatcttctgaaggctaacgtgaagatcttcaagagccaaggagccgccctggacaaatacgcgaagaagtcagtgaaagtcatcgttgttggcaaccccgcgaatactaactgcctgacagcctcaaaaagtgcaccttcaatacccaaggagaacttctcctgcctaaccagactggatcacaatcgagcaaaagcccagatcgctttgaagcttggagtgaccgccaacgatgtcaaaaatgtgatcatatgggggaatcactcatccacgcaataccctgacgtcaatcatgccaaagtcaaactgcagggtaaggaagtcggcgtgtacgaggccctgaaggacgattcttggttaaaaggagagtttgtgaccactgtgcaacagaggggcgccgcagtgattaaagcacggaaattaagctctgcaatgtccgccgctaaggccatctgcgaccacgttagggacatttggtttggcactccggaaggggagttcgtatccatgggggtcatttctgacggtaacagctatggagtgcccgacgatctactgtactcttttcctgtggtgatcaagaataagacttggaagttcgttgaaggcctccccattaacgatttcagtagggagaagatggacctgaccgctaaagagctcacagaggagaaagagagcgcatttgaatttctgagctcagcctag

SEQ ID NO: 123264 - DNA, 1017 bp, Artificial Sequence
  Description of Artificial Sequence: Synthetic coding sequence
atgctctccgcacttgccagacccgcaagcgcggccctgcgacggtccttcagtacgtcagcccagaacaatgccaaggttgctgttctaggtgcctcaggcggcatcggacagccactatcgctgcttctgaagaacagtccccttgtgagtagactcaccctgtacgacatcgctcacactccaggggtggcggccgacttgtctcacatcgagaccaaagctgctgttaagggctacctcgggccggagcagctccctgattgcctaaaaggttgtgacgttgtagtcatccctgctggtgtacctagaaaaccaggcatgacccgagacgacctctttaacaccaacgccaccatcgtggccacgctgactgctgcttgtgctcaacactgccctgaagctatgatctgcgtgatcgctaatccagtgaacagcactattccaatcacagccgaagtatttaaaaaacacggggtttataatccaaataaaattttcggagtgaccaccctggatatcgtccgggcaaatacatttgttgcggaactgaagggtctggaccctgcaagagtgaatgtgccagtcataggtggacacgctggcaaaaccataattcctctcattagccaatgcacaccaaaagtagatttccctcaggatcagcttacagctttaactggtagaattcaggaagccggaacagaagtggtcaaagcaaaggcaggggcaggaagcgcaactctatccatggcttatgcaggcgcccgattcgtgttcagcttggtagacgccatgaatggaaaggaaggggtggtagagtgttctttcgtgaagtcccaggagacagagtgtacttacttttctaccccacttctgttggggaaaaagggcattgaaaagaatctgggaatcggcaaggttagctcctttgaagaaaaaatgatctctgacgccatccccgaactgaaagccagtatcaagaagggcgaggatttcgttaagactctcaagtag

SEQ ID NO: 123265 - DNA, 1872 bp, Artificial Sequence
  Description of Artificial Sequence: Synthetic coding sequence
atgaacaggtacacgactatgcgtcagctgggagatgggacatatggatctgtcctgatgggaaagtccaacgaatccggggagcttgtagccatcaagcggatgaagcgaaagttctattcttgggacgaatgtatgaacttacgggaggtgaagtccctgaaaaaactgaaccacgcaaatgtgataaaattaaaggaagttatccgcgagaacgatcatctttactttatttttgagtatatgaaagagaatctgtaccaactgatgaaagaccgaaacaaactttttcccgagtccgtaatcaggaatataatgtatcagatactgcaaggcttagccttcatccacaagcatgggttctttcatcgggacatgaagcccgagaacttactgtgcatggggcccgaactcgtcaagatagcagacttcggcttagctcgagaattgcgatcccagcccccatacaccgactacgtgagcacgcgctggtatagagcccctgaagttctgctgaggtcttcagtgtactcatccccaattgatgtctgggccgtggggtccataatggcagagctgtacatgctgcgcccgttatttcccgggacctcagaagtagatgagatcttcaagatatgtcaggtccttggaacaccaaagaagtcagattggcccgaaggctatcagctcgccagtagtatgaacttcaggttcccccaatgtgtgccgatcaacctaaagacactgatacctaatgcaagtaatgaagcaattcaacttatgacggaaatgctgaattgggatcccaagaaaagacctaccgcctctcaggcgcttaagcatccatactttcaggtcggacaggtgctaggcccaagtagcaaccatttagaatctaaacagagcctgaacaaacagctccagcctttggaaagtaagccgagtctggtcgaagtagagcccaagcctctacccgacattattgatcaagtggtggggcagccccagcccaaaacgagtcagcagccactgcagcccattcagcccccccaaaacttatcggtgcaacagccgccaaaacaacagtcccaggaaaagccccctcagaccctcttcccatctatcgtcaagaacatgccaaccaaacccaacggaacgctgagtcacaaaagcggacgccgcagatggggtcagactatattcaaatccggagatagttgggaggaacttgaagactacgactttggggcaagccatagcaagaaaccaagcatgggtgtcttcaaggaaaaacggaagaaagactcgcctttcagactccctgaacctgtcccatctggttcgaaccatagcaccggagaaaacaaaagtcttcctgcggtcaccagcctcaagtctgattccgagctatccactgcccctacgagtaagcagtattatctgaagcaaagtagatacctccccggggttaaccctaagaaagtgagcctcattgctagcggaaaagaaataaacccccatacttggagcaatcagctatttccgaaatctctgggtcccgtgggtgccgagttggcatttaaacgatctaatgctggtaatctggggtcatatgcaacatacaaccagtccggctacatccctagcttcctgaagaaggaggttcagtctgcgggccagaggatccacttagctcccttgaacgcgaccgccagcgaatacacttggaacacgaagacgggccggggacagtttagtggacgtacttacaatccaaccgctaaaaatcttaacatagtgaacagagctcaacctataccatcagtccacggacgaaccgactgggtggctaaatacggaggacatcgatag

SEQ ID NO: 123266 - DNA, 1872 bp, Artificial Sequence
  Description of Artificial Sequence: Synthetic coding sequence
atgaacaggtatacgacaatgaggcagcttggcgacgggacttacggtagtgtgctgatgggtaagagcaatgaaagtggcgagttagttgccataaagcgcatgaaacgaaaattctattcttgggacgaatgtatgaatctcagagaagtgaagtctctgaagaaactgaaccatgccaatgttattaaactgaaagaagttatccgggaaaatgatcatctatacttcatcttcgagtacatgaaagagaacctctaccagctgatgaaggaccgtaataaactgtttcccgagagtgtgatccgtaatatcatgtatcaaattctccagggcctggcctttattcacaagcacgggttcttccatcgcgatatgaaacccgagaatctgctgtgcatggggccagaactggtaaagatcgcagactttgggctggcacgagagttgagatcacaaccaccatacactgactacgtgtcaactaggtggtacagagcacctgaagtactgttgcgatctagcgtctactcctcacccatagatgtgtgggctgttggatccattatggcagagctgtatatgcttaggcccctgttccctggcaccagcgaagttgatgaaattttcaaaatctgtcaggtattggggactccaaagaaatcagactggcctgaaggctaccagctggcatcgtctatgaacttccgtttcccccagtgtgtcccgattaatctcaaaacccttatcccaaacgcttcaaacgaagctattcaactaatgaccgaaatgctgaactgggatcctaagaaacgccccacagcctcccaggccctgaaacacccttacttccaggttggccaggtcctcgggccttcctccaaccacctagagtcaaagcagtccctgaacaaacagctgcagcccctggaatccaagccctccttagtggaggtggaacctaagcctctgcctgacatcatcgaccaggtggtgggacaacctcagcctaagacttcacagcagcctcttcagcccattcagccgccacagaacctctccgtccagcagccccctaagcagcaatctcaggaaaaaccgcctcagaccctcttcccttccatcgtgaaaaatatgcctactaaaccaaacggcaccttgagccacaagtcaggccggaggcgctggggtcagacaattttcaaatctggcgattcctgggaagagctcgaggattacgatttcggcgcctcacatagcaagaagccctctatgggagtatttaaggagaaaagaaagaaagattcacctttccgactgcctgagcctgtgccctccggatcaaatcactcgacaggggaaaacaaatccttgcccgctgtgacctccctcaagtcagatagtgagcttagtaccgctccaacatctaagcagtactatctaaagcagtcccggtacctgcccggcgtaaaccctaagaaggtgagcctcattgcgtccggcaaggaaattaaccctcacacatggagtaatcagctctttcctaaaagtctgggcccagtgggagcagagctggcttttaagcgatcgaatgccggcaatttaggctcctatgcaacttataaccagtctgggtacatcccatccttcctcaagaaagaagtccagtccgccggccagaggatccatctggctcctcttaacgccacagcctctgagtacacctggaacacaaagaccggtcgggggcaatttagcggcagaacttataacccaactgctaagaacttgaatatagtgaatcgggcccaacccataccctccgtccatggccgcaccgactgggtagccaagtacggcggacaccggtag

SEQ ID NO: 123267 - DNA, 867 bp, Artificial Sequence
  Description of Artificial Sequence: Synthetic coding sequence
atgaatcggtacacaaccatgcgacagctgggagatggaacttacggttccgtgctcatgggtaagagcaacgaatcaggagagttagtggctatcaaaaggatgaagcgaaaattttactcgtgggatgaatgtatgaatctgagagaggttaagtctctcaaaaaactcaatcatgctaatgttattaaactgaaggaagtgatccgggaaaacgatcatctgtacttcattttcgagtacatgaaggagaacctctaccagctgatgaaggatagaaataaactgtttccggaatccgtgatccgcaatataatgtatcagatccttcagggattggccttcattcacaagcacggtttttttcatagggatatgaagcccgagaacctattgtgtatgggacccgaactggtgaaaatcgcggattttggcctagctcgggagctgcgcagtcagccgccctatacagattacgtttctaccaggtggtatcgcgcaccagaggtgctacttcggtcctctgtgtattcctcccctattgatgtttgggctgtcggctcaatcatggcagagctgtacatgctgcggcctcttttcccggggacaagtgaggtagatgagatcttcaagatctgccaagtcttaggaacccccaaaaagagcgactggccagaagggtatcagctagccagtagtatgaatttcaggttccctcagtgtgttccgatcaatctcaagacactgattccaaatgcttctaacgaagcaatccagctgatgaccgagatgctgaattgggacccaaaaaaaaggcctacagcatctcagccttgttttctagttgaggttgagcggccgaactag

SEQ ID NO: 123268 - DNA, 1374 bp, Artificial Sequence
  Description of Artificial Sequence: Synthetic coding sequence
atgaacagatacactactatgaggcaattaggagacggcacttacggcagcgtattaatgggtaagagtaacgagtcgggtgaacttgtggctattaagcgaatgaaacggaagttttattcctgggacgaatgcatgaacctgagggaggttaagagcctcaagaaactcaatcacgcaaacgtgatcaagctgaaggaggtgatacgagagaacgatcatctgtattttatctttgaatacatgaaagaaaacctctatcagttaatgaaggacaggaacaagctattccctgaatctgtgatccggaacataatgtatcagattctccagggcctcgcctttatacacaaacatggattcttccatcgagatatgaagcctgaaaacctactttgtatgggaccagaactggtcaaaattgctgactttggcctggcgagagaactgcgttcccagcccccctacaccgattatgtgtctactagatggtatcgcgcccccgaagttctcctacgatctagtgtgtactcctcccctatcgacgtgtgggccgtcggaagtatcatggccgaactgtatatgctgaggcctctcttcccaggcacgtcggaagtggatgagatctttaagatttgtcaggtgttgggcaccccaaaaaaatccgactggccggaagggtatcagctcgcgtcctccatgaattttagattcccccagtgtgttcccataaacttgaaaacgcttataccgaacgcgtctaatgaggccattcaactgatgactgaaatgctgaactgggatccaaagaaacgtcctacagctagccaagcactcaagcatccttactttcaggtgggtcaggtcctgggccccagcagcaatcacctggaatccaaacagtctctgaacaaacagctgcagcctctggaatctaagccatctctggttgaggttgaacccaaacctctacctgacattatcgatcaagtggtaggacaaccgcagcccaaaaccagccagcagcccctacagccgatccagccaccccagaatctgtctgtccagcagccccccaagcagcaatcccaagaaaaacccccacagactctattcccctcaattgtgaaaaatatgccaaccaaacctaacggcactctgtcccacaagtccggacggcggagatgggggcagacaattttcaagtctggagactcttgggaggagctcgaggactacgatttcggggcatcccactcaaagaagccaagtatgggggtcttcaaggagaagagaaagaaggattcaccttttagacagcaggtaaaaatggcagttatttctctgtccgctcatcaattccccactttgtag

SEQ ID NO: 123269 - DNA, 942 bp, Artificial Sequence
  Description of Artificial Sequence: Synthetic coding sequence
atggaggagatgagcggagagtccgtggtgagctctgcagtgccggccgccgcgacacgcacgacatctttcaagggaaccagcccgagttcaaagtacgtcaagttaaacgtgggaggcgccctgtactatacaacaatgcagacgctgaccaagcaagatactatgctgaaggccatgttttccggtaggatggaggtgctgacagactcagagggttggatcctaattgatcgatgcggcaaacactttggcactatacttaattacctgcgcgacggcgcggtgcccttaccagagagccgacgggagatcgaggagttacttgccgaggctaagtattacctagtgcagggattggtggaggaatgtcaggccgctctgcaaaacaaagatacatacgaaccgttctgtaaggtacctgtcataacctcatcaaaggaagaacagaaactgatcgctactagcaataagcctgccgtgaaactcctatacaaccgcagcaataacaaatacagctatacgtccaactccgatgataacatgctgaagaatatcgagctctttgataagctgagcctgcgctttaatgggagggtcctcttcataaaggatgtcatcggagacgagatatgttgctggagcttctatggtcagggcagaaaaatcgccgaggtctgttgcacatcgatcgtctacgccacagagaagaagcagactaaagttgaatttcccgaagcccggatctatgaggagacattaaacatcctgctttatgaggcccaggacggcaggggcccggacaatgcactcctggaggctacaggtggcgcagcaggcaggagtcaccacctggacgaggatgaagaaagagaacgaatcgagagagtgaggaggattcacatcaagcgtcctgatgatagagcgcatctgcaccaatag

SEQ ID NO: 123270 - DNA, 558 bp, Artificial Sequence
  Description of Artificial Sequence: Synthetic coding sequence
atggggcctgagcgacacctcagcggtgcgccagctcgaatggcaaccgtcgtcctcggtggagataccatgggacccgagagaatttttcctaaccagacagaagagctggggcatcaggggcccagtgagggtaccggggattggtcctctgaggaacctgaagaggagcaggaggagaccggttcaggacctgcaggctactcttatcagccactcaatcaagatcctgagcaggaggaggtggagcttgctccagttggagacggagatgtggtggcagacatccaggacagaattcaagccttaggactccatctccccgacccaccactggaatctgaggatgaggacgaggagggtgcaaccgccctcaacaaccacagctcaattccaatggaccctgagcacgtcgagctggtaaaacgcaccatggcaggcgtcagcctgccagcccctggcgtgcctgcgtgggcaagagagatcagtgatgcccagtgggaagacgtggtacagaaagctctgcaggcgcgccaggcttcccccgcatggaagtag

SEQ ID NO: 123271 - DNA, 1719 bp, Artificial Sequence
  Description of Artificial Sequence: Synthetic coding sequence
atggagcctgaggctcctcggcgcagacacacacaccaacgagggtaccttctgacaaggaacccacatctgaacaaagatttggcctttacattagaggagcgacagcagctgaacattcacggtctcttgcctccttctttcaacagtcaggagatccaggtgttgcgcgtcgtgaagaatttcgaacatttgaacagcgattttgatagatacctcctgctgatggacctgcaggaccgcaatgagaaactgttttatagggtcctgacctcagatatagaaaagttcatgcctattgtttacacacccaccgttggcctcgcttgccagcagtattcgttggtgttccgcaagcctaggggactcttcatcacaatacacgatcgcggacatatcgctagtgtactcaacgcatggcccgaggacgtgatcaaagccattgtggtgactgacggggaacgaatcctcggactgggggacctcggttgtaatgggatggggatccccgtgggaaagttagcactatataccgcgtgtggagggatgaatccgcaagaatgtctgcctgttatccttgacgtcggcacagagaatgaggaacttttgaaagaccctctgtacattggcctacgacagcgcagggtgcgtggatccgaatacgacgactttctcgacgaattcatggaggctgtcagcagcaaatatggcatgaattgcttaattcagttcgaagatttcgcgaacgtaaatgcattcaggctgctgaacaagtacaggaaccagtattgtacgtttaatgacgatattcaaggcacggcctctgtcgccgtcgccgggctgctggcagctctgcgcataaccaaaaacaaactcagcgatcagaccattttgtttcagggagcaggggaggcggctctgggcatcgcccacctgattgtgatggcgcttgagaaagaaggtctgcccaaagagaaagccatcaaaaagatctggctcgtcgatagcaagggtctcattgtcaaaggccgggcatcactgactcaggagaaggagaagtttgcccacgaacatgaagaaatgaagaacttggaggccatcgtgcaagaaataaaaccaaccgcactcataggggtggcggccatcgggggagctttcagtgaacagattctcaaggacatggccgcgtttaacgaaagacctattatattcgctctgtccaaccctacttccaaggccgaatgttctgccgagcagtgttataagatcactaagggccgggcaattttcgcatccggatccccttttgaccccgttacactaccaaatggccagactctctaccccggccagggtaataactcctatgtgttccccggggttgccttgggggttgtcgcatgcggcttgcggcagatcacagataatatattcttgactacggccgaagtgatcgctcagcaggtgagcgataaacatttagaggaaggtcgtctctaccccccacttaacaccatccgagatgtgtcgctaaagatcgcagaaaaaatcgtcaaggatgcttaccaagaaaagacagcaacggtctacccagagccacagaataaggaggcatttgtgaggtcccagatgtactctactgactatgatcagatactccccgactgctactcctggccagaggaagtacagaagatccaaaccaaagtcgatcagtag

SEQ ID NO: 123272 - DNA, 699 bp, Artificial Sequence
  Description of Artificial Sequence: Synthetic coding sequence
gtcaaggggagagcgagcctgacacaagaaaaagagaagttcgcccatgagcacgaggagatgaagaacctggaggctattgtccaggagattaagcctaccgcactgattggggtagcagccatcggtggggctttttcagagcaaattctgaaggacatggccgcctttaacgagcgacctatcatttttgctctgtctaatcccactagcaaagctgagtgctccgctgaacagtgttacaaaatcaccaaaggccgcgccatctttgccagcggatctccgtttgatccagtgaccctgcccaatgggcagaccttgtaccccggacaagggaacaactcctacgtgtttccaggggttgcactcggcgtggtggcttgcggccttagacagattaccgacaatatttttctgactactgcggaggtaattgctcagcaggtgagcgataaacacctggaagaaggccgactctaccctcctttgaatacaatccgggatgtgtcactaaagattgccgagaaaattgtcaaggacgcttaccaggagaagacagctaccgtgtaccccgaacctcagaataaagaggccttcgtccgctctcaaatgtatagcaccgattacgatcaaatcctgcccgactgttactcttggcctgaagaggtacagaagatccagaccaaggtggaccagtag

SEQ ID NO: 123273 - DNA, 1221 bp, Artificial Sequence
  Description of Artificial Sequence: Synthetic coding sequence
atgggcataccagtgggtaagttagcactctacacagcatgtggtggaatgaatccacaggagtgcttacccgtcattctggacgtgggaacggagaacgaggagctcctgaaagatcccctgtacataggtctcagacagagacgcgttagaggctctgagtacgacgacttcctggacgagttcatggaggctgtgtcctccaagtacgggatgaactgtctgatacagtttgaggactttgcaaacgtcaatgcattccggctgctgaataagtaccgcaaccagtattgtacattcaacgacgacatacaggggaccgccagtgtcgcagtggctggtcttctggccgccttaaggattactaagaacaaactttctgaccagacgattttatttcagggtgcaggcgaggccgcgctgggcatcgcacacttaatcgtaatggccttagagaaagagggtttaccaaaagaaaaggctatcaaaaaaatctggctggtcgattcaaaaggactgatagtcaaggggcgcgccagcctgacccaggaaaaagagaaattcgctcacgaacacgaggaaatgaaaaatctggaggcaatagtgcaggagataaagcctactgccttaatcggggtcgccgccattggaggcgctttctctgagcagatcctgaaagatatggcggccttcaacgagcggccaatcatcttcgcgctgtccaatcccacttccaaagcagaatgctctgcagagcagtgttacaaaatcactaagggacgggcgatttttgccagcgggagcccctttgatccagtgactcttccaaacggtcaaacgctgtacccaggtcaggggaacaattcatatgtgttcccaggcgtcgctttgggggttgttgcttgcggtcttagacagatcacggataatatcttcctgacgaccgctgaggtcatcgcgcaacaggtgtcagacaaacacctagaggagggccgactgtatcctcccttgaataccatcagggatgtaagcctcaagatcgcggagaaaattgtgaaagatgcctaccaggagaaaacggctacagtataccccgaaccacagaataaggaagcatttgtgcgcagtcagatgtacagcactgactatgaccagattttgcctgattgctacagttggccagaggaagtgcaaaagatccagactaaggtggatcaatag

SEQ ID NO: 123274 - DNA, 1494 bp, Artificial Sequence
  Description of Artificial Sequence: Synthetic coding sequence
atggatctccaggatcggaacgaaaagctgttctaccgagtcttaaccagtgatatcgaaaaatttatgcctatcgtgtatacaccgaccgtgggcctggcatgccaacaatacagtttagtcttcaggaagccgagagggctcttcatcaccatccatgataggggccacatcgcttccgttctgaacgcatggccagaggatgttatcaaggccatcgtggttacagacggtgaaagaatcttggggttaggcgatcttggatgcaatggtatggggatacccgtgggcaaactggcactgtatacagcatgcggtggcatgaaccctcaggagtgcctcccggtgatattagacgttgggactgagaatgaggagctgttaaaggatccgctctacattggcctgcgtcagcgtagggtcagagggtcggagtatgacgacttcctggatgaattcatggaggccgtttccagcaagtacggtatgaattgtttgatccagtttgaagacttcgcaaatgtgaacgctttccgactgcttaataagtatagaaaccagtactgcaccttcaacgatgacatccaaggcactgcctccgtcgcagttgcagggctgcttgccgctctccgcatcaccaaaaataagctgtctgaccagactattttgtttcagggcgcgggggaggcagccttagggatcgcacacttgatcgtgatggctttagaaaaggaaggcttgccgaaggaaaaagccataaaaaagatttggttggtggactctaaggggctgattgtcaaggggagggccagtctcacccaggaaaaggagaagtttgcgcatgagcacgaagagatgaagaacctagaggctatcgttcaggagataaaacccactgcactcatcggtgtggccgccatcggcggagctttttctgaacagatcctgaaggatatggccgcattcaatgagaggcctatcatctttgcactgtccaaccctactagcaaagccgagtgctccgcagagcagtgctacaagattaccaaaggacgggctatcttcgcatctggtagcccatttgaccccgtgactctgcccaatggacaaacactgtacccaggccaagggaacaacagctatgtgtttccaggggttgctctgggtgtagtcgcatgcggcttacgtcaaatcaccgataacatttttctgaccacagcggaggtcatcgctcaacaggtttcagataagcatctagaggagggccgtctgtaccctcccctaaacaccattagagacgtgtccctaaaaattgccgaaaaaatcgtcaaggacgcttaccaggagaaaacagccacagtatacccagaacctcagaacaaagaagccttcgtaaggtcgcagatgtactccactgactacgatcagattctgcccgactgctacagctggcctgaagaagtgcagaagatccagaccaaggttgaccagtag

SEQ ID NO: 123275 - DNA, 1755 bp, Artificial Sequence
  Description of Artificial Sequence: Synthetic coding sequence
atgctaagccgattgcgagtagtgagcacgacctgtaccctggcctgtcgccatctgcacataaaggagaaaggcaaacctttaatgctgaaccccagaacaaataaagggatggcatttacgcttcaagagcgtcagatgctcggacttcagggcctgctgccgccaaagatagagactcaagacatacaagcattaagattccacagaaacctcaagaaaatgacatcacccctggagaaatacatatacatcatggggatccaggagaggaatgaaaagctattctaccgtatcctccaggacgacattgaatctctgatgcccattgtatacactcctaccgtcggcctggcctgttcccagtacggacacatctttcgcaggcccaaaggcctgtttatttctattagcgaccgcggccacgtgcgctcgatcgtggacaattggccagaaaaccatgtgaaagccgtggtcgtcactgatggtgagcggatcttgggacttggtgacctgggtgtgtacggaatgggcatccccgtgggaaagctgtgcctttatacagcgtgcgccggcatccggcctgacaggtgtctgcccgtgtgcatagatgtgggcaccgacaacatcgctcttctgaaagaccctttctacatgggtttgtatcagaaacgcgaccgaacccagcagtacgacgatctaatcgacgagttcatgaaggccataacggacaggtacgggagaaatacattgattcagttcgaggacttcggaaaccataacgcgttcaggttcctccgcaaatacagggagaagtattgtacttttaatgatgacattcaaggaactgctgccgtcgcgttagccggacttctggccgctcagaaagtgatcagcaagccaatcagtgagcacaaaattctgttcttgggcgcaggcgaagcggctcttgggatcgccaacctgattgtgatgagtatggtggagaacggtctgtcggaacaggaagcccagaaaaagatctggatgttcgataagtacggactgctggtcaaaggccggaaagctaaaattgattcatatcaggaaccattcacacactcagcaccagagagtattccggacacctttgaggatgcagtgaacattctgaagcctagcaccatcatcggtgtggccggcgctggaaggttgttcactcctgacgttattcgcgctatggctagcatcaatgaaagacctgttatctttgccctgtctaacccaactgcacaggccgagtgcacagcagaagaagcctacacactgacagaaggcagatgtcttttcgcatctggctcaccttttggccctgtgaagctgaccgatggcagggtattcacccccgggcaaggaaacaatgtctatatcttccctggtgtagccctggcggtaattttatgcaacactcggcacattagcgacagcgtcttcctagaagcagcaaaggctctcacatcccaattgaccgatgaggagcttgctcaaggacgcctgtatccaccactggccaatattcaggaagtctctattaacattgcaattaaggtcaccgagtatctctacgcaaacaaaatggcctttcgataccccgagccagaagacaaggccaaatacgtgaaagagagaacctggcgttctgagtacgattcactccttccagatgtatatgagtggcccgagagcgctagctccccgcctgttatcaccgaatag

SEQ ID NO: 123276 - DNA, 1440 bp, Artificial Sequence
  Description of Artificial Sequence: Synthetic coding sequence
atgctgtctcgactgagggtagtctctacaacatgcaccttggcctgtcggcacctgcatatcaaagaaaaaggaaaacccttaatgctgaacccccggacgaataaaggaatggcatttaccctgcaggagagacagatgcttggcctccaggggctgctgcctccaaaaatcgaaacacaggatattcaagccttgcgctttcatagaaacctgaaaaagatgacgtcacccctcgagaaatacatctatattatggggatccaggagaggaatgaaaagttattctacaggattttgcaggatgacatcgagtccctcatgccaatcgtgtacacacccacagttggactcgcatgctcccagtacggacacattttccggagaccaaaaggtctttttatctcaatctcagatagagggcatgtgcgcagtatcgtggacaactggcctgaaaatcacgtgaaagccgtggttgtgacagacggagagagaatcctgggtctaggtgatctgggcgtgtatgggatggggattccagtggggaagctgtgtctgtacaccgcctgtgccggtataaggccagatcgctgcttaccagtctgcatcgacgtcgggaccgacaacatcgcattgctcaaagatcccttctacatgggcctctatcagaagcgggaccgcacgcagcagtatgatgatctcatcgacgagtttatgaaagccatcacagatcggtacgggcgaaatactctaatccagttcgaagattttgggaatcacaatgccttccggttcctcaggaaataccgagaaaagtactgcacctttaatgatgatatccaggggacggctgcagttgcactggccggcttgctggctgctcaaaaggtcatcagcaaacctatctctgagcataaaattttattcctcggtgccggcgaagctgctttgggcatcgctaatctgatcgttatgagcatggttgagaatggactgtctgaacaggaggcccaaaagaaaatctggatgttcgataagtacggcctgctggttaaaggtagaaaggcgaagatagacagctaccaggagccctttacacactccgctcccgagtctatacccgatactttcgaagacgctgtgaacatattaaagcccagcaccataatcggagtggctggtgccggccggctgttcactcctgacgttatccgggccatggccagcatcaatgaacgccctgttattttcgcactttctaatccgacagcccaggcagagtgcaccgccgaggaggcttacaccttgaccgagggccggtgtttatttgcaagcggtagcccatttggcccagtaaagctgaccgatggccgagtgtttacacctggacaggggaacaacgtttatatctttcccggatatcgcattcctatatgttag

SEQ ID NO: 123277 - DNA, 780 bp, Artificial Sequence
  Description of Artificial Sequence: Synthetic coding sequence
atggcattcacactggaagaaaggctgcagcttggaatccatggactgatcccaccttgctttctgtcccaagatgtgcagctccttcggattatgcgctactacgagaggcaacagtctgatcttgataagtatataattcttatgacactgcaggatagaaatgagaagctgttttacagagtgttaactagtgacgttgaaaaattcatgccaatcgtatataccccaactgttggcctggcctgccagcactacggcttgacttttcgtagaccgagaggcctgtttattacaattcacgacaagggccatcttgcaacaatgttaaatagctggccagaggacaatatcaaggccgtcgtcgtgaccgatggcgaaaggatcctcggcctgggggacctggggtgttacgggatggggattcccgtcggaaaactcgctctgtatacggcctgtgggggtgtgaatccacagcagtgcctacccgtgctcctggacgtggggactaacaatgaagaactcctacgcgatccactgtatatcggcctgaagcaccagagagtgcacggcaaggcctatgacgatctgttagacgaattcatgcaggctgttactgataaattcggcattaactgtcttattcaattcgaggatttcgccaacgccaacgcctttaggctgctgaataaatatcgaaataaatattgtatgttcaacgacgacatccaagatgacttttctaggggcccaaaaagaagccaactgttcttcaagtag

SEQ ID NO: 123278 - DNA, 1815 bp, Artificial Sequence
  Description of Artificial Sequence: Synthetic coding sequence
atgggggcggctcttggaactgggacaaggcttgctccctggcccggacgcgcttgtggggcactgccgcgctggacaccgaccgcgcctgcccagggttgccactccaaaccaggcccagcgagaccagtccccttgaaaaaacgcgggtatgacgtgacgcggaacccccatctgaacaaaggtatggcctttactctggaagaaaggctgcagttaggcattcacgggttgataccaccttgctttttgtctcaggacgtgcagctactgcggataatgcggtattatgaacgccaacaatcagatcttgataagtacatcattctgatgacactgcaggatcgcaatgaaaaactcttttacagggtgcttacctcagatgtagaaaaatttatgccaattgtctatacgccaactgtgggattggcatgccagcattacgggcttaccttccggcgcccgagaggactattcataacaatccatgacaaaggtcacctggcaaccatgcttaatagctggcctgaagataacatcaaggccgtcgtggtcacagacggtgaacggattcttggactaggagatctcgggtgctacggcatggggatacccgtgggaaagctcgccctgtacactgcttgtggaggcgtgaatccccagcagtgcctgccggttctgttagacgtgggaactaataacgaggagctccttcgagatcccttatacattggcctaaagcatcagagagtccacggtaaagcctatgacgacttgctggatgaattcatgcaggccgtcaccgataagtttggaataaactgcttgattcagttcgaagattttgcgaatgcgaacgcctttcgcttattaaataaataccgcaacaaatattgcatgtttaacgatgacatccaaggaactgcgtccgtcgccgttgctggaattctggcggctctcagaattacaaaaaacaagctcagcaaccacgtgttcgtatttcagggggctggcgaggccgctatgggcattgctcatctgctggtgatggccctggagaaggaaggggtccctaaggccgaagcaacccggaagatatggatggtggatagcaagggcttaatagttaagggacggtcacacctcaaccacgaaaaggagatgttcgcgcaggatcacccggaggtcaactcactggaggaagtggtgcgcctggttaagcctactgccatcatcggggtggccgccatcgctggcgcatttaccgaacagatccttagggacatggcctcgttccatgagcggcccataatatttgccctttctaatccaacgtcgaaagcggagtgtacagccgaaaagtgctacagggtgacagaaggccggggtatctttgcttcaggaagcccgtttaagtccgtgacactcgaagatggcaagacattcatccccggccaggggaataacgcatatgtgtttcccggcgtcgccctgggcgtcatcgctggggggatcaggcacatcccagatgaaattttccttctgaccgctgagcagattgctcaggaggtgagcgaacaacatctcagccaggggcggttataccctccactgtctacaattcgcgatgtctccttaaggatcgccatcaaagtgctcgactatgcctataaacacaacttagcctcttattaccctgaacccaaggataaagaggctttcgttaggtccttggtttataccccagactacgacagctttaccttggactcctatacctggccaaaagaggctatgaatgtgcagaccgtgtag

SEQ ID NO: 123279 - DNA, 1815 bp, Artificial Sequence
  Description of Artificial Sequence: Synthetic coding sequence
atgggcgcagccctgggcacaggcacccgcttggcaccttggcctggccgagcctgtggagcactgccccggtggaccccgactgccccagctcaaggatgtcacagtaagcccggacccgccagacctgtgccactcaagaagcgaggatatgatgtcacacggaaccctcaccttaataaagggatggcgtttacacttgaggaaaggctacaactcggtatccacggcctgatcccgccctgcttccttagccaggacgtccagttgctgcggataatgcgatattacgaacgtcagcagtcagacttggataagtatattatactgatgactctgcaggatcggaacgagaagctattttaccgcgtgcttacaagtgatgtggagaagttcatgcctattgtttacactccaacagtgggcctggcctgtcaacattacgggctgacattccgcaggcctcgcgggttgtttattaccattcatgataaagggcatctggcgactatgctgaattcctggcccgaagataacattaaggctgtggttgttacggatggcgagagaatcctaggattgggggacttgggctgctatgggatgggcattcctgtcggcaagctggccctctacaccgcctgcggcggcgttaatccccaacagtgcctgcccgtactgctggatgtcgggacgaacaatgaggaactactccgagatcctctctacatcggcttaaaacaccaacgggtacacggaaaagcctacgatgacttacttgatgaattcatgcaggcggtgaccgataagtttgggattaattgtctgattcagttcgaagactttgccaacgctaatgccttccggttgctgaataagtatcgaaacaagtattgtatgttcaatgacgatattcagggcacagccagcgtggcggttgcgggcattcttgccgccctccggataacgaaaaataaactatccaaccatgttttcgtctttcagggagcgggagaggccgctatgggaatagcccatctgctggtcatggctcttgagaaagagggcgtcccaaaggccgaggccacacggaagatttggatggtggactcaaaggggctcatagtcaaagggcgtagccatctcaatcacgagaaggagatgtttgctcaggaccatcctgaggtaaactccctggaggaagtcgtgaggttggtgaagcccaccgctattattggagtggcagcaattgcaggcgcgttcaccgagcagatcttgagagacatggcatcctttcatgagaggccaatcatcttcgccctgagtaatccaacctctaaggctgagtgtactgccgagaaatgttatcgggtgaccgagggaaggggaatttttgcgtctggcagccctttcaagtctgttacactggaagacggtaaaaccttcattcccgggcaaggaaataatgcctatgttttcccaggcgtagctcttggagtgattgccggaggaataaggcacattccagatgagatttttctgcttactgccgagcagattgcacaagaagtgtccgagcagcacctgtctcaaggtcgactgtaccctcctctgtccaccattcgcgatgtgagtcttaggattgccatcaaagttctcgactacgcctataaacacaaccttgcatcatattacccggagccaaaggacaaagaagcctttgtgcgtagtctcgtctacacccctgactatgactcattcactttagactcctatacttggccaaaagaggctatgaatgtgcagaccgtctag

SEQ ID NO: 123280 - DNA, 1746 bp, Artificial Sequence
  Description of Artificial Sequence: Synthetic coding sequence
atgggtgccgcactcggaacaggcactagactcgctccatggccagggcgcgcatgtggggcactgccccggtggacgccaaccgctcccgcacaggggtgccactccaagccaggacctgccaggccggtaccacttaaaaagaggggctacgacgtgacgaggaaccctcacttaaacaagggaatggcgtttactctagaggagcgactccagctaggtatccatggcctgattccaccatgcttcctcagccaagacgtccagctactccgcattatgcgatattacgaaagacaacagtccgatcttgacaaatacattatccttatgactctccaggataggaacgaaaaactcttttaccgggtgcttacatccgacgtcgaaaagttcatgcctattgtatatacccctaccgtgggactcgcgtgccagcactacggccttacgtttaggcgacccagaggtctgtttattaccatccacgataaagggcacctggccactatgttgaactcctggccagaagataacattaaggctgttgttgtgaccgatggagagaggattctgggactgggcgacctaggttgttatgggatgggaatccccgtggggaaactggctctctacactgcttgtggaggcgtgaatccccagcaatgtctcccggtactcctggatgtcggtactaataacgaggagctcctccgggaccccctgtatataggcttaaagcatcagagagtccacggtaaggcctatgacgacttactggatgagtttatgcaagccgtgactgacaagttcggaataaattgcttaattcaatttgaggatttcgcaaacgccaatgcgtttcgcctccttaataagtaccggaataagtactgtatgttcaatgacgacatccaagggaccgccagcgttgctgttgcgggcatcctggccgcccttcgcattactaagaacaagttatcgaatcacgtatttgtcttccagggagccggggaggccgcaatgggtattgcacatctgctcgtcatggccctcgagaaggaaggcgtccccaaggctgaggccacccggaagatttggatggtggactccaagggacttatcgtaaaggggagaagccatcttaaccacgaaaaggagatgttcgcccaggaccacccagaggtaaatagtttagaggaggtggtgaggctggtgaaaccaaccgcaatcatcggggtagcagctatagccggtgcattcacagaacagattttgcgcgacatggcctcatttcacgaacgtccgatcatctttgccctcagcaacccaacttctaaagctgagtgtactgccgaaaagtgctacagagtcaccgaggggaggggcatatttgccagcggatcacctttcaagagtgtgacgcttgaggacggtaaaacgttcattccaggccagggcaataatgcctatgtctttccaggagtcgctctcggcgttatagcgggtggcatacggcatatccccgacgagatatttctgctgacggctgagcaaatcgcgcaagaagtgtccgaacagcatttgtctcaaggccgcctgtatccaccccttagcacaattagagacgtctcactgcggattgcaattaaggtgctggactacgcctataagcataatctcgcatcctattacccggagcctaaagataaggaagcctttgtccgctccctggtctacacgtag

SEQ ID NO: 123281 - DNA, 1029 bp, Artificial Sequence
  Description of Artificial Sequence: Synthetic coding sequence
atgggggccgcccttgggacaggcactcggcttgctccctggccaggccgggcatgcggagcgttgccgagatggactcctacagcgcctgcccaagggtgtcactccaagcccgggcctgctagaccggtgccactgaaaaaacgcgggtacgatgtaacccggaacccacatctcaataaggggatggcgtttactttagaagagcgtctgcaactcggaatacacggcctcatccccccctgcttcctgtctcaggatgtgcagttgttacgaattatgcgttattacgagcgccagcaaagcgatcttgacaagtacattatcctgatgaccctgcaagatagaaacgaaaaattgttctaccgggtgctgacatccgatgttgagaaatttatgcccatcgtatatacccccacagtaggtcttgcgtgccaacattacggcctgacctttcggaggccacgcggcctttttataactatccacgacaaggggcatctggcgaccatgctgaactcgtggcctgaggacaatataaaggcagtcgtcgtcacagatggagaacgtatcctaggccttggcgatctgggatgctatgggatggggatccccgttggaaaactcgccctgtacactgcttgcggcggggtgaatcctcagcagtgtctccccgtccttctggacgtgggaaccaacaatgaagaattgttaagggaccccctttatattgggctcaagcaccagcgcgtccacgggaaggcctacgacgacttgcttgatgaattcatgcaggctgtgacagataaatttggaattaactgtctgatacagttcgaggactttgccaacgctaatgccttcaggttgctcaataaatacagaaacaaatattgcatgttcaacgatgacattcagggtaccacatgtcacacattcagttgtccctggcatctgtgggcacaggtgatgtttcaacatattcctggacctatgggcttttccgagtggctcccaaggaactcatag

SEQ ID NO: 123282 - DNA, 189 bp, Artificial Sequence
  Description of Artificial Sequence: Synthetic coding sequence
atgggggcggccttgggtaccgggactcgcctagcaccctggccaggacgggcctgcggtgcacttccgcggtggacacccacggcccctgcgcagggttgccatagcaaacccggacccgccagaccagtgcctttaaagaagcgtggttacgatgtcaccagaaacccccatctgaacaaggtctag

SEQ ID NO: 123283 - DNA, 186 bp, Artificial Sequence
  Description of Artificial Sequence: Synthetic coding sequence
atgggagccgcgctggggacaggcacccgattggccccgtggcctggcagggcctgtggcgcacttccacgctggacacccacagcccctgcccagggatgtcactctaagcctggacccgcccgccccgtgccactgaaaaagcgcggatacgatgtgacgcgcaatccacacctgaacaaatag

SEQ ID NO: 123284 - DNA, 456 bp, Artificial Sequence
  Description of Artificial Sequence: Synthetic coding sequence
atgggagcagccctgggcacaggtactcgactggctccgtggcctggacgggcatgtggggccttacctcgctggacccccacggcccccgcacagggctgccactcgaaaccaggacctgcccggcctgtcccactcaagaaaagaggttacgatgtgaccaggaatccacatttgaataaaggtatggcattcacccttgaggaacggttgcaactgggtattcacggattgatccctccctgtttcctctcacaagacgttcagctgctgagaatcatgcgatactatgagagacaacaaagcgatctggataagtacatcatcctcatgacccttcaggaccgaaacgagaagctgttctatagagttctgacctccgacgtcgaaaaattcatgcccatcgtttacacacccacagtggggctggcctgtcagcactatggcctcacatag

SEQ ID NO: 123285 - DNA, 240 bp, Artificial Sequence
  Description of Artificial Sequence: Synthetic coding sequence
atgggcgccgcactcggaaccgggacacggttggctccatggcccggacgggcctgcggcgccttgccccgttggacacctactgctcccgcgcaaggctgtcactctaagcccgggcccgcaaggcccgtacccctgaagaaaagaggttacgatgtcacccggaacccacatctcaacaaggtgatggggcaacgagccggtaggcctgctctgcggagcaggggctgtcgaaaatag

SEQ ID NO: 123286 - DNA, 1815 bp, Artificial Sequence
  Description of Artificial Sequence: Synthetic coding sequence
atgggcgctgcacttggaacaggaacccggctggcgccctggccgggccgtgcttgcggagctctaccccggtggaccccaacagcccctgcccagggctgccacagtaagcccggccccgcacggcccgtccctctgaagaagcgcggctacgatgtgacgaggaatccccatctgaataagggcatggctttcactctggaagaaagactgcagctcggtatccacgggctgatcccgccttgctttctgagccaggacgtgcaactgcttcgcattatgcggtattacgaacggcagcaaagcgatctggacaagtacattatcttaatgactctgcaggatcggaacgaaaaactgttttatcgtgtcctcacttctgatgtggagaaatttatgccaattgtatacacaccgacggtcggattggcgtgtcagcactatggtttgacgtttcgtcgccccaggggactctttatcactatacacgacaagggccatttggcgacaatgttaaatagctggcctgaggataacattaaggccgtcgtggtgactgatggcgagcgcattctaggcctgggcgacctgggttgttacggcatgggaatcccagtgggaaaactcgccttgtacacagcgtgcggaggcgttaatccccaacagtgtctcccggtcctgctagacgtggggaccaacaacgaggagctcctgagggaccctctgtatattggattaaaacaccagagagtccacggaaaagcctacgacgatctgttggacgagtttatgcaagctgttaccgacaagtttggtatcaattgcctcatccagtttgaggacttcgccaatgctaatgcgttccgcttgctgaacaagtacaggaataaatactgcatgttcaacgacgatattcagggaaccgctagcgttgcggtggctggaattttggccgcgctcaggatcactaaaaacaagctgtctaaccacgtgttcgtgtttcagggagcaggcgaggctgccatgggtatcgcgcacttacttgtgatggctctggaaaaggaaggggtcccgaaagccgaagcaactcgcaagatatggatggtggattctaaaggtctgatcgtgaagggcagatctcatctgaaccatgaaaaggagatgttcgcccaggaccaccccgaggtgaatagtctcgaagaggttgtgagattggtcaagcccacagctatcatcggcgtggctgctattgcgggagccttcacagaacagattctgagagatatggctagtttccacgagcgacccattatcttcgccttgtctaaccccacctcaaaagctgaatgtaccgcagagaagtgttatcgagtaaccgagggccgcggcatcttcgcgtccgggagcccgtttaagtcagtaaccttagaagatgggaagacgttcatacctggccagggaaataatgcttatgtgtttcccggcgtcgccctaggtgttatcgccggaggtattcgacacatcccagacgaaatctttctgctcacggctgaacaaatcgcccaggaagtctcagagcagcacctctctcagggcagattgtatcctcctttatcaacaatacgggacgtctccttacgtattgcgattaaagtccttgactatgcctacaagcacaatttagcctcctactacccagagccaaaggacaaagaggctttcgtgcggtccctcgtgtacaccccagactacgatagctttacattggactcttatacgtggccaaaggaggccatgaatgtccagaccgtttag

SEQ ID NO: 123287 - DNA, 759 bp, Artificial Sequence
  Description of Artificial Sequence: Synthetic coding sequence
atggcattcacactggaggagcgtctgcagctgggaatccacggcctaatcccaccgtgttttctgtctcaggacgtgcagctgttacgaattatgcgatactatgagcgtcagcagagcgacctcgacaagtacatcatactgatgacactgcaagataggaatgaaaagttgttctatagagtgttgacatccgatgtagagaaatttatgccaatcgtgtacactcctacggtaggtcttgcctgtcaacattacggccttacttttcggcgtcccaggggacttttcatcacaatacacgacaagggtcacttagccacgatgttaaatagttggcctgaagataatattaaggcagtggtcgtgacagacggcgagcggatcctggggctgggtgatctgggctgctacggtatgggcattcccgtgggcaaactggccctctatacagcctgtggaggcgtgaaccctcagcaatgcttgcctgtcctgttggatgtcgggaccaacaatgaggaactccttagagaccccttgtacatagggctgaaacatcagcgggtccacggaaaggcctatgatgatctcttggacgaatttatgcaggccgttaccgacaaattcggaatcaattgcctgatccagtttgaagacttcgcaaacgctaatgccttccggctcttaaataagtaccgtaacaaatactgcatgttcaacgacgatatccaggcgccctcaaccgctcccgcaacatag

SEQ ID NO: 123288 - DNA, 1482 bp, Artificial Sequence
  Description of Artificial Sequence: Synthetic coding sequence
atgagaggcttcggacctggattgaccgcgaggcgcctgcttcccttacgcctgcctcctcggccaccaggcccaaggctggcatctggccaggctgccggtgccttggagagggctatggatgagctgctgcggagggctgtccccccaacaccggcttatgaactgagggaaaagactcctgcacctgctgaggggcagtgcgccgattttgtatcattttacgggggactcgcagagaccgcacagcgcgcagagctacttggtcgcctggcacgcggctttggcgtggatcacggccaggttgccgagcagtcagcaggagttctgcacctgaggcaacagcaacgagaggcagcggttctgctgcaggcggaggatcggctccgatacgcgctggtccccaggtatcggggactgttccaccacatcagcaaactggatggcggtgttcgatttcttgtacagctgcgcgcagacttgctcgaagcacaggccctgaagcttgtagaaggaccagatgttagagaaatgaatggagttctcaagggaatgctcagtgagtggttcagctctggctttctgaatctggaacgcgtgacatggcacagtccatgtgaggtccttcagaaaatcagcgaagctgaggcagttcatcctgtgaaaaactggatggacatgaagcgccgggtcggtccttatcgaaggtgttactttttcagtcactgtagcacaccaggtgagcccctggtcgtgctgcacgtggctcttaccggcgatatttcaagtaacattcaggctatcgtgaaggagcatcctccttcggagacagaagaaaagaacaagatcactgcagccatcttctactccatctccttgacgcagcaggggctgcagggagtcgagctgggcacctttctgataaaacgcgtagtgaaagagctgcaaagggaattcccccacctgggcgtcttcagctccctttctcctattcccggatttacaaagtggcttctgggcttactaaatagccagactaaggagcatggcaggaacgaactttttacagacagcgagtgtaaagagatatccgagattacagggggtcccattaatgagaccctcaagctccttctttcttcctccgaatgggtccagagtgagaagctcgtacgggccttacagacccctttaatgcggctctgtgcctggtacttatacggcgagaaacacagggggtatgcgctgaaccctgtcgccaattttcatttgcagaatggggccgtcctctggcgcataaactggatggccgacgtgagtctgagaggtatcaccggctcttgtggactgatggcgaactatcgttacttcctcgaggagacgggtccaaattctacatcatacttgggttcaaaaattataaaagcgtcggagcaagtcctgtcactggtggcccaattccagaagaacagcaaactgtag

SEQ ID NO: 123289 - DNA, 558 bp, Artificial Sequence
  Description of Artificial Sequence: Synthetic coding sequence
atggcaagaaagaagctcaagaagtttacaaccttagaaattgtcctatccgtgctgctgctggtgttattcataatttccattgtcctgattgtattattagctaaggaatccctgaaatccaccgccccagaccccgggactaccgggacaccagaccccgggacaacggggacacctgaccccggaaccactggcaccacccatgctcgcaccacaggaccacccgaccctggaactaccggcaccaccccggttagcgcagagtgcccagtggtaaacgaattagagcgaatcaattgcatcccagatcaaccaccaacaaaagctacatgcgatcagcgagggtgctgttggaacccacagggcgccgtctctgtgccctggtgctattattcaaaaaaccactcttatcacgtggagggcaacttagtgaataccaatgctggattcactgcaaggctgaaaaacctaccaagctcaccagtatttggaagcaacgtggataatgttctgctcaccgccgagtaccagacttcaaacaggtttcatttttag

SEQ ID NO: 123290 - DNA, 4989 bp, Artificial Sequence
  Description of Artificial Sequence: Synthetic coding sequence
gctgtctctgtgccctggtgctactactccaaaaatcactcctatcacgtcgagggcaacctggttaataccaatgctggcttcacagctaggttaaaaaatctcccaagctccccggtgtttggatctaatgttgacaacgtgctgctcactgcagaataccaaacatctaaccgcttccacttcaaacttaccgatcaaaccaacaatcggttcgaggttccccacgagcacgtacagtctttctcaggaaatgccgcggcctctttgacctaccaagtcgaaatctctagacagccattcagtatcaaagttaccaggagatccaataaccgggttctgtttgatagctcaataggtcccctactgtttgcagatcagttcctccagctttctacgcgcctgccgtccactaacgtttatggccttggcgagcacgtgcaccagcaatacagacatgatatgaactggaaaacatggcctatctttaatcgggacacaacccccaatggtaacgggaccaatctctacggagctcagaccttcttcctgtgtctggaggatgcctccggactgtcctttggcgtgttcctaatgaattctaacgccatggaggtggtgctgcagccggccccagccatcacctatagaactattggagggattctggacttttacgtttttctcggcaatacccccgagcaggtcgtccaggagtacctcgaactgattggacgcccagctctgccatcttactgggcactcggctttcacttaagcagatatgaatacggaacgttggacaacatgcgggaggttgtggaacgcaaccgcgccgcacagttaccgtacgacgtgcagcacgccgatatcgactacatggatgagcgaagggacttcacttatgacagtgtggattttaaaggctttcctgagtttgtgaatgagttgcacaataacggccagaaactcgtgataatagtggaccctgctatctcaaacaactcaagctcttcaaagccctacgggccgtacgaccgcggctccgatatgaagatatgggtgaatagtagcgatggagttactccactgatcggggaagtgtggcccggtcagaccgtgttccccgactataccaaccccaactgcgctgtctggtggaccaaggagttcgaactgtttcacaatcaagtggagttcgatggcatttggatcgacatgaacgaagtaagtaacttcgtggacggctccgtctccggctgttccactaacaacctcaacaatcctccattcacccctcggatcctcgacggctatctcttctgtaaaaccctttgcatggacgctgtccaacattggggcaagcagtacgatattcataatctgtacggctacagcatggcagtggcaaccgcggaggcagccaagacagtttttccaaacaaacggagtttcattttaacgaggtctaccttcgctggcagcgggaagttcgccgcacactggctaggagataacacagctacctgggatgacctccgatggtctattccaggcgtccttgagtttaacctcttcggcattcctatggtgggaccagatatttgtggcttcgccctagacacacccgaggaattgtgtaggcggtggatgcagctgggagctttttatcccttcagccggaatcataacgggcaaggttacaaagaccaggacccggcctcattcggcgctgattccttattacttaattctagtcgacactacctgaacattagatacaccctgcttccgtacttatacaccctctttttccgagcacactcccgaggggatacagtggcgaggccacttctgcatgaattttacgaagataattccacctgggacgtgcatcagcaattcctgtggggaccagggctgctcatcacccccgtcctagatgagggtgccgagaaagttatggcctacgtccccgacgcagtatggtatgattacgagacaggatcccaggtgagatggcggaagcagaaggttgaaatggagctgccgggagacaagatcggccttcatttgcggggcgggtatattttcccaactcaacagcccaacactaccactctggcatccaggaaaaacccactgggtctaataattgccctggacgagaacaaggaggcgaaaggggaattattctgggataacggggagacgaaggacactgtcgccaataaagtatacttgctttgtgagttctcagttacccagaacagacttgaggtgaacatcagccaatccacgtataaagaccctaataacctggctttcaatgaaatcaagatcttgggtacagaggaaccctccaatgtgactgtgaagcataatggggttccttcacaaacctcacccacagtcacatacgattccaacttaaaagtggctattattaccgacattgacctgcttctaggtgaagcgtacaccgtcgagtggagcattaagataagggatgaagagaagatcgactgctacccagatgagaatggggctagcgctgagaattgtaccgctcggggctgcatctgggaggcaagcaattctagcggggttcccttctgctattttgtcaatgacctatactccgtgagcgacgtgcaatacaattctcatggagcaaccgcggacatctccttgaagtcttccgtttatgcaaacgcattcccttccacacccgtgaatcctctgcgcctcgatgtcacctaccataagaacgagatgttgcagtttaagatttacgatcccaataagaatcgttatgaagtgccggtcccattaaatatcccctctatgcctagtagcactcccgagggccaactctatgacgtgctcatcaagaaaaaccctttcggcatcgaaataagacgtaaatccacagggaccatcatttgggacagtcagctgctgggctttaccttctcagacatgtttatcaggattagcaccaggctgccttcaaaatacctgtacggcttcggcgagactgagcaccggagttacaggcgggatttggagtggcacacttggggtatgttctcccgcgaccagcctcctgggtataagaaaaacagttatggagtccacccttactatatgggactcgaagaagatggttctgcacatggggttcttcttttgaatagcaatgcaatggacgtgacttttcaacccctgcccgctctcacctaccggacaacaggcggtgtcctcgatttttatgtctttttaggcccgactcccgagctggtcacccaacagtacaccgagctgattggtcgtccagtgatggtgccatattggtcactggggtttcaactttgtcgatacggctaccaaaacgattccgagattgcaagtctgtatgatgagatggtggctgctcagattccctatgatgtgcaatattccgatatcgattatatggagcggcagctggattttactctttccccaaagtttgcaggatttcccgcactaatcaacagaatgaaggcagacggcatgagagtgatcctgatcctagatcccgccatctcaggaaacgaaacccagccttaccccgcatttacccggggggtcgaggacgacgttttcatcaagtatccaaatgatggggatattgtttggggcaaggtctggcctgactttcctgatgtggtggtaaacggatcccttgattgggactcgcaggtggagctgtacagggcctacgtggcatttcccgatttttttcggaatagcacggccaagtggtggaaacgggagatcgaggagttgtacaacaaccctcagaaccccgagcggtcccttaagtttgatggcatgtggatagatatgaacgaaccgagctctttcgtaaatggcgcagtctcaccaggttgcagagatgcatctttgaatcatccaccttacatgccccacctggaaagcagagacaggggactctcctccaagacactttgtatggaaagccagcagatcttaccggacggttccttggttcaacactataacgtgcataacctgtacgggtggagtcagactaggcctacctacgaagctgtgcaggaagtgaccggtcagcggggggttgttatcaccaggagtacgtttccctcgtcgggacgctgggccggtcactggcttggggacaataccgcagcctgggatcagctgaagaaatctattataggaatgatggaattctccctcttcggaataagctacactggggccgatatctgtgggttctttcaggatgccgagtacgagatgtgtgttaggtggatgcaactcggagccttttatccattctcaagaaaccacaacactatcgggactcggaggcaggaccctgttagttgggatgctgcttttgtgaacatttcccggaacgttctgcagactcgatataccctgctcccttatctgtacaccctcatgcaaaaggcacataccgaaggtgtcacagtggttcggccccttttgcatgaattcgtttccgatcaggttacctgggatattgattcccagtttttgctgggcccagctttcttggttagtcctgttttggaacgcaatgcacgcaacgtgactgcttatttcccaagagcccggtggtatgactattacacaggggtcgacataaacgccaggggcgagtggaagacactccccgctcctctggaccacattaacctgcatgtgaggggtggatatatacttccttggcaagagccggcgctcaatactcacttgtccagaaagaacccattagggctcataattgctcttgacgaaaacaaagaagcgaagggagaactcttctgggatgatggccagactaaggataccgtggcgaaaaaggtgtaccttctgtgcgaattttccgttactcaacaggtagtgttcctcaatatcgtgttcaactag

SEQ ID NO: 123291 - DNA, 5574 bp, Artificial Sequence
  Description of Artificial Sequence: Synthetic coding sequence
atggcacgtaaaaaactaaagaaatttactaccctggaaatcgtactatccgttctccttttggtcctgtttatcatatctatcgtcctgatcgtgctccttgccaaggagagcctgaaaagtactgctccggatcctgggacaaccggcacgcctgatcctggcaccaccgggacccctgatcccggcaccacaggcacaacccacgctaggactactggcccgccagaccccggaacaacaggcacgacaccggttagcgcagaatgtcccgttgtcaacgagctagagagaatcaattgtatcccagatcaaccccccactaaggccacatgtgatcaacggggatgttgctggaacccccaaggcgcagtctctgtgccatggtgctattactcaaagaatcactcatatcatgtggaagggaacctcgtgaacacaaatgccggcttcaccgcccgcctgaaaaaccttcctagctcccccgtgtttggttctaacgtggataacgtcctgctgacagccgagtatcagacatccaaccggttccattttaagcttacggaccaaaccaacaacagattcgaggtgcctcatgagcacgtgcagagtttttctggtaatgctgcagcttctctcacttaccaggttgagatttcacgacaaccattttccattaaagtaactcggagaagtaataatcgggttctgtttgattcgtccatcgggccacttctgtttgcagatcagttcctgcagcttagcacacggctcccatcaactaacgtgtacggactgggggagcatgtgcaccagcagtacaggcacgatatgaactggaagacgtggcccatttttaacagagacactacccccaacggcaatgggactaacctgtacggagcccaaacattctttctctgtctggaggatgcatccggtctctcatttggtgtgtttctcatgaatagcaatgcaatggaggtggttctccagcctgccccagctatcacttatcggaccattggaggcattctcgacttttacgtgttccttggcaacaccccagagcaggtcgttcaggaatacttggagctaatcgggcggcctgctctgccatcatactgggcactggggtttcatctcagcagatacgagtatgggactctcgataacatgagagaggttgttgaacgcaatagggccgcccaacttccttacgatgtgcagcatgcagatatagattacatggatgaacggcgggacttcacctacgacagtgtggatttcaaaggatttcctgaatttgtgaatgagctccacaataatgggcagaagctggtgattatcgttgaccctgccatttccaacaactcgagctcatccaaaccctacggaccctatgatcggggcagcgatatgaaaatttgggtcaactctagcgatggggttactccactgattggggaggtctggccaggtcagactgtgtttccagattacactaatccaaactgcgctgtctggtggaccaaagagttcgagttgttccacaaccaagtggagttcgatggcatatggatcgatatgaatgaggtgtctaacttcgtagacgggtcagtgtccggctgtagtaccaataatctcaacaaccctcctttcactccaaggatcctagatggatatctgttctgcaagaccctctgcatggatgcagttcagcactggggaaagcagtacgatatccataacctctatggttactccatggctgtggccacagccgaagctgcaaagacggtattccccaataagaggagctttatactgaccagaagtacgttcgcgggatccggcaaattcgccgcacattggctaggggacaacaccgcaacctgggacgacttgcgctggtcaattcccggcgttcttgagttcaacctgttcgggattcctatggtaggcccggacatctgcggatttgccctggatacaccagaggagttgtgccgccggtggatgcagctcggcgccttttaccctttttcccgtaatcacaacgggcaggggtacaaggatcaagacccggcgtctttcggggccgatagccttttgctgaactcaagtagacactatcttaatatccgatacacgcttcttccttatctctataccttgttcttccgggcgcattcgcggggtgacaccgtagctcgtcccctccttcacgaattttacgaggataacagtacctgggatgtacaccagcagtttctgtgggggcccgggctgctaattacgcccgtcctggacgagggagcagagaaagtaatggcctatgtgcccgatgccgtctggtacgattatgagacaggttcccaagtgcgatggcgtaagcaaaaagtggaaatggaactgccaggtgacaaaataggactccatcttcgtggaggatatatatttccgactcaacagccaaacaccacaaccctggcctctcggaaaaatccactcgggctaattattgctctggacgagaataaggaggctaagggagagctgttttgggataacggagagactaaagatactgtcgccaacaaagtgtatctgttatgcgagttcagtgttacacagaatcggctggaagtaaacatctcccaaagtacctataaagaccccaacaatctagcattcaacgaaatcaagattctggggaccgaagagccctccaacgttaccgtgaaacacaacggggttccttctcagacttcaccaaccgtgacctatgactctaacctaaaggtcgcaatcattaccgacatagacctgctgctcggggaagcctacaccgtcgagtggtccattaaaatccgagacgaagagaagattgactgctatcctgatgagaacggagccagcgccgagaattgcactgctcgtggttgcatttgggaagcctccaattctagcggcgtcccgttttgctacttcgtgaatgatctgtacagtgtgtcagacgtacaatacaatagtcacggagctacagctgacatctctttaaaatcatccgtgtacgctaacgcttttccctctacccccgttaatcctttgcgactggacgtgacttaccacaagaatgagatgttgcagttcaagatctatgatcccaacaagaaccggtacgaagtgccggtgcctctcaacataccctccatgccctcttctactccagagggccagctgtatgatgtcttgatcaaaaagaatccttttggcattgagatccggagaaagagcacgggaactattatctgggattcccagctgctgggttttacattttctgatatgttcatccgaatatctacgagactaccatctaaatatttatatgggttcggggagacagaacacagatcatacagacgggatctggagtggcacacgtggggaatgttctcgcgagatcagccaccggggtacaagaagaactcctacggcgtccatccttattatatggggcttgaggaggacggtagcgcgcacggtgtcctgctgctgaactctaatgccatggacgttacttttcagccactgcctgcactcacttatcgcaccaccggtggcgttctggacttttatgtgtttctggggccaacccccgaactggtgacccagcagtacaccgaactaatcggacgtcctgtaatggttccatactggtcgcttggatttcagttgtgtcggtatggctaccagaacgacagtgagatcgcatcactctacgatgagatggtcgccgcccagatcccctacgacgtgcagtactccgatatagactatatggagagacaattggatttcactctgtctcctaaatttgccggatttccagccttgattaatagaatgaaagccgatggaatgcgggtcatcctcattctcgaccccgctatcagcgggaatgaaacccagccctaccccgcttttacccggggtgtggaagacgatgtcttcataaaataccccaacgacggagatatcgtatggggtaaggtttggccagacttcccagatgtcgttgtgaacggaagcctggattgggactcccaagtggagttgtatcgcgcctatgtggccttccctgacttctttaggaattccacagccaaatggtggaaaagagagattgaggagttgtataacaacccccagaacccagagcggtctttaaagtttgacgggatgtggattgacatgaatgagccatccagctttgtgaacggggctgttagtcctggttgcagagatgcatctctcaatcaccccccatacatgccgcacctcgagtcccgagatcgtggcctttcatctaaaactctgtgcatggaaagccagcagatccttcctgacggaagcctggtacagcattataacgttcacaacctctatggctggtcccagacccgccccacttatgaggccgtgcaggaagtgaccggccagcgtggagtggtgataactaggtcaacatttccgagttctggtaggtgggccgggcactggctgggagacaatacagcggcctgggatcaactcaaaaaaagcattattggaatgatggagttttccctatttggaatctcttacaccggggctgatatctgcggattcttccaggacgctgaatatgaaatgtgcgtgaggtggatgcaactcggcgcgttttacccattttctcgcaaccacaacaccatcgggaccaggcggcaggacccggtttcgtgggatgttgcctttgtcaatatatcccgtactgtcctgcagacaagatataccctgctaccctacctgtatacacttatgcataaggcacacacagagggcgttacagtggtgcgcccactcctgcacgagttcgtcagtgaccaggtaacttgggatatcgacagccagttcttgctcggacccgcctttcttgttagccccgtcctggagagaaacgctcgcaacgtaaccgcttacttccccagagcacgctggtacgattactatactggagtggacattaacgctagaggggagtggaaaacactgcccgctccattggaccatatcaatctgcacgtgagaggagggtatatccttccctggcaagagccagctctgaatactcatctttcgcgccagaagttcatgggctttaaaattgcgctcgacgacgaagggactgccggtgggtggttattttgggatgacggccagtcgattgacacttacggaaaggggctgtactatttggcatcatttagtgcctcacagaacaccatgcaaagccatatcattttcaacaattatattaccggtacaaaccctcttaagcttggatacatagagatctggggagtgggatccgtgccggtaacatcagtgtcaatcagcgtgagcggaatggtcattaccccaagttttaacaacgatcctacaacccaggtcctgtccattgacgtgaccgacagaaacatctctctgcacaacttcacatcgctgacgtggatcagtacgttgtag

SEQ ID NO: 123292 - DNA, 2061 bp, Artificial Sequence
  Description of Artificial Sequence: Synthetic coding sequence
atgctactgagaggagtcctgctcgcactgcaggccctccagttggcgggtgcacttgatctgccagccggcagctgcgcttttgaggaaagtacgtgtgggttcgactccgttctggccagtcttccatggatccttaacgaggaggggcactacatctacgtggataccagttttggcaagcagggggagaaagccgtcttactgtccccagatctgcaggctgaagagtggtcttgtctcaggctcgtctaccagatcactacatcttctgaatcgctgtccgatccgtcacagctcaacctgtatatgagattcgaggatgagtccttcgataggctgctctggtccgccaaagagccttccgactcttggctcatcgcgagtttagatttacagaactcaagcaaaaagtttaagatcttaatcgaaggagttctgggccagggaaacaccgcgtcaatcgctctgtttgagattaaaatgaccactggatactgcattgaatgtgattttgaagagaatcacttgtgtggctttgttaaccggtggaaccctaatgtcaattggtttgtggggggcggatctattagaaatgtacacagcatactgccccaggatcacacattcaagtccgagctgggacactatatgtacgtcgattcagtgtacgtcaagcatttccaggaagtggcccaactgatctcgccactaactaccgcacccatggcaggctgcctgtcattttattatcagattcagcaaggaaatgacaatgtcttctcattgtataccagagacgttgccggcttatacgaggagatttggaaggcagaccgccccggcaacgcagcttggaatctggctgaggtggaattcagcgctccttaccccatggaggttattttcgaggttgcattcaatggtccaaaaggagggtacgtggcattagacgatattagctttagcccagttcattgccagaaccagacagagctgctcttctccgccgtagaagccagctgcaactttgagcaggacctgtgtaatttttaccaagacaaagaaggccccggctggacccgcgtcaaggttaaacctaacatgtaccgggccggagatcacactaccggccttggttattaccttctggcaaatacaaaatttacctctcaaccaggttatattggtcgcctgtatgggccaagcctgcccggcaatctccagtactgcttgagattccactacgccatctatggatttctcaaaatgagtgacaccctggcagtctacatcttcgaagaaaaccatgtggtgcaagagaagatctggagcgtgttagagtcgccacgaggggtctggatgcaggccgagatcaccttcaaaaagccgatgccgacgaaggtggtttttatgtctctgtgcaagtcattttgggattgtgggttggtcgccttggacgatatcacaatccagctaggcagctgttcttccagtgaaaaattgccaccaccaccaggtgaatgcacctttgagcaagacgagtgtacctttacacaggagaaacggaaccgttcgagctggcatcgaagaagaggcgaaacaccaacaagttatacagggccgaagggcgaccacacaactggggtcggctactacatgtacattgaggcatcacacatggtttacggtcagaaggctcggctcctttcccgccccctgagaggtgtgtccggaaagcactgtcttacattcttctaccatatgtacggtggaggcaccgggttattgtcagtctacctcaagaaggaagaggatagtgaggagtccctgctgtggaggcgtcgaggagagcaatccatcagctggcttcgggcactgatcgagtatagctgcgaacgccaacatcagatcattttcgaagccatccgaggagtgtctatacgctcagatattgccatcgatgatgtcaaattccaggctgggccgtgtggcgagatggaagacaccacccagcagagctcgggttatagcgaggacctgaacgagatagagtactag

SEQ ID NO: 123293 - DNA, 2880 bp, Artificial Sequence
  Description of Artificial Sequence: Synthetic coding sequence
atggaagtaacttgcttgctgctccttgccctcattccattccattgccgaggccagggggtgtatgctcccgcccaagcgcagatcgtgcacgccggccaggcctgtgtggtcaaggaggacaacatctcagagcgagtgtatacaatcagggagggagatactctgatgcttcaatgtctcgtaactggccatcctaggccccaagttcgttggaccaaaaccgccggctcagctagtgataagtttcaggagacatctgtttttaatgaaaccctccgcattgagaggatcgcccggacacaaggagggcgatactactgcaaggctgaaaatggggtgggggtgccagccattaaatcgattcgcgttgacgtccagtatctcgatgaacccatgctcacagttcaccagacggtcagtgacgtgagggggaatttctaccaggagaaaaccgtcttcctgcgatgcacagtaaactcaaaccccccagccagatttatatggaaacgcggcagcgataccctgagccattctcaggataatggagttgacatctacgagcccttatatactcagggagagaccaaggtgttgaagctgaagaacttgaggccgcaggactacgcatcttatacatgccaggtctctgtgcgaaacgtttgtggaatccccgataaagctattaccttccggctgactaacactacagcaccccccgctctcaagctcagcgtcaatgagacactggtggtgaatccaggcgagaatgtcaccgttcagtgcctgcttacgggcggcgatcccttgccccagctccaatggtctcatgggcccggtcccctccctctgggggctctcgcacagggtggcaccctgtcaatacctagtgtgcaggccagggacagtggatactacaactgtaccgctactaacaacgttgggaaccctgcaaagaaaaccgtcaacttactcgtccggtccatgaaaaacgctacattccagattaccccagacgtcattaaggaatccgagaatatccagttagggcaggacttgaagctttcttgtcacgtggacgctgtaccccaggagaaagtcacataccaatggttcaagaatggaaaacccgccaggatgtctaagcggctgctcgtcacgagaaacgacccggaacttcccgctgttacctcttctcttgagttaattgacctccacttttccgattatggaacttatctttgtatggcatcctttccgggcgctccggtgcccgacctgtcagttgaagtgaatatctcatccgaaaccgtgccacctacaatctccgtacccaagggcagggctgtggtcaccgttcgcgaagggagcccagccgaactgcaatgcgaagttaggggaaagccccggccacctgtgttgtggagccgggtggataaggaagccgccctccttccctctggactgccattggaggagactccggatggtaaactgagactagagcgggtgtctcgtgatatgagcgggacatacagatgccagaccgcccggtataatgggttcaacgtgcgacctagggaggcccaggttcagctgaatgtgcagagcccttgttttccacccgaagtcgaaccttctagtcaggacgtccgccaggctctcggcagacctgtgctgttgagatgtagcctgttacggggctctccccagcgcatagcctcagctgtctggcgttttaaagggcagcttctgcctccccctcccgtggtgcccgctgccgccgaggccccggaccacgcggaattgagattggatgctgtcacacgggattctagcggctcatatgagtgttcggtctctaacgatgtggggagcgccgcctgcctgttccaggtctccgcaaaagcttactcgccggagttctacttcgacacccccaaccccaccaggagtcataaactcagcaagaattactcatacgtactgcagtggactcagcgagaacccgatgccgtggatcctgttttaaactaccgcttgtcgatccgacagctgaatcagcataatgctgtcgtcaaggctatccctgttcggcgagttgagaagggccagcttttggagtacatcttgaccgacttgagggtgccacatagctacgaggtgcgcctcaccccatataccacctttggggccggagacatggccagccgaataattcattataccgagctgcttgccttgcggactctatcttccgacaatacctgtcactttgaggacgaaaagatctgtggctacacgcaggacctgaccgacaattttgactggacgagacagaatgcgttaacgcagaaccccaagcgctcccctaatactgggcctccgaccgatattagcggcactcctgagggatactatatgtttatcgaaactagcaggccccgagagctgggagaccgagcgagattggtctccccgttgtataatgccagcgctaagttctattgcgtctcatttttctatcacatgtatggcaaacatatcggttcgctcaatctcctagtgaggagccgcaataaaggtgcactggatacccatgcttggtcgctttccggcaataagggcaacgtctggcaacaggcacatgtacctattagcccctctggtcccttccagattatttttgaaggcgtgcggggacctggatacttgggggacattgctatcgacgacgtgaccctcaagaagggagagtgcccaaggaagcagactgatcccaataaggtggtggttatgcctggctctggcgctccctgccagtcttctccgcagctgtggggccctatggccatattcctcctcgcgctccaacgatag

SEQ ID NO: 123294 - DNA, 2868 bp, Artificial Sequence
  Description of Artificial Sequence: Synthetic coding sequence
atggaggtcacctgcctcttacttctggccctaattccgttccactgcaggggccaaggtgtgtatgcacctgcacaggcacaaatcgtgcacgccggccaggcctgcgtagtgaaggaggataacattagcgagagagtgtatacaattcgtgaaggtgatactctgatgctgcaatgcttagtgactgggcaccccagacctcaggtgaggtggacaaagactgcaggttccgcttccgataaattccaggaaacatctgtcttcaacgagaccctgcggattgagaggatagccaggactcaaggaggtcgctattattgcaaggcagagaacggagtgggggttcctgccattaagtccatccgggttgatgtgcagtaccttgatgagccaatgctgacagtccatcagaccgtgagcgacgtgcgaggaaatttctaccaggagaagactgtgtttctgagatgtaccgtgaactccaaccctcctgccagatttatttggaagcggggctccgataccctgagccatagtcaggacaacggggttgatatttacgagccactctacacccagggcgaaacaaaagtgctgaagctaaaaaatcttcgccctcaggactacgcatcatacacctgccaagtgagcgttcgcaacgtttgtgggattccagataaagccatcaccttcaggctgacgaacaccaccgccccacccgccttgaagctgagcgtgaatgagaccctggtggtgaatcccggagagaacgtcacggtccaatgtcttttaaccggcggcgacccgctgccccaactccagtggtcccacggacccgggccactgcccctcggcgcactcgcacagggcggcacgctgagtatcccctccgtgcaggccagggactctggatattacaactgtaccgcaactaataatgtcggcaacccagctaagaagactgtgaacctactcgtgcggagcatgaaaaatgccacttttcagataacccctgatgttattaaggaatctgagaatattcagctcggacaggatttgaaactgtcctgtcacgttgacgccgtgccccaggaaaaagtgacatatcaatggtttaagaacggcaaaccagctcgtatgagtaagagactgcttgtgacaagaaatgatcccgagctgcctgccgtcaccagtagtctggaacttatagacttacacttctccgactatgggacatacctttgcatggccagttttccgggggccccagtgccagacctcagcgtcgaggttaacattagttccgaaaccgtcccacccacaatctccgttcccaaaggaagagccgttgtgacagtcagagaggggtccccggctgagctgcaatgcgaagttagagggaagccgaggcctccggtcttgtggagcagagtggacaaagaggcggctctactcccctccggtctcccactagaagaaacccctgatggaaagttgaggctcgagagagtgagccgggacatgagcggtacgtacagatgccaaacagcccgctacaacgggttcaacgtccgtcctcgcgaggcccaggtgcaacttaacgtgcagttcccccccgaagtcgaaccttcatcccaggacgtccgtcaggccctgggccggcccgtccttttacgatgtagtctccttagaggatccccccagcgaatagcctcagcagtgtggcgattcaagggacagctcctgccacctcccccagtcgtgccagccgctgccgaggcacctgatcatgccgaactccgtttggatgcggtcacgagagactcatcagggtcttatgagtgcagtgtcagcaatgacgtgggttcagccgcctgcttgtttcaggtgagtgcaaaagcatacagccccgagttctattttgacacccctaaccccactagatcacacaaactttccaagaattactcctacgtcctgcaatggactcaaagagaacctgacgctgttgacccagtgttaaattaccgcctgagcattcgccagttgaaccagcacaacgccgtggtcaaagccatacccgtgcgccgtgtcgagaaaggacagttgcttgaatacatactgactgatctgagggtaccacatagctacgaggtccgactcaccccttatactactttcggggcgggcgatatggcttctaggattatccactatacggagcccattaactcaccaaacctgagtgataatacatgccactttgaagatgagaaaatttgtggctacacccaggacctcacagataacttcgactggacacgtcagaatgcacttacccagaatcctaaaaggtctcctaacaccggccccccgactgacatcagcggtaccccagaaggctactatatgtttatcgaaacctcccgcccaagggagctcggggatagggctaggctggtaagtccactgtacaatgcctcagccaagttctattgcgtttctttcttttaccacatgtacggtaaacacataggctcactgaatcttcttgttcgtagcagaaacaagggggctttggacacgcacgcctggagcctgtccggaaataagggtaatgtgtggcagcaggcacacgttcctatttctccatccggcccttttcaaatcattttcgaaggcgtcagaggacctggatatctgggcgatatcgcgattgacgacgtcaccctgaagaaaggtgagtgcccccgtaaacagaccgatcctaataaggtggtagtgatgcccggctccggtgccccttgccagtcaagcccacaactctggggccccatggcaatattcctcctggctttgcaacgatag

SEQ ID NO: 123295 - DNA, 2922 bp, Artificial Sequence
  Description of Artificial Sequence: Synthetic coding sequence
atggaggtgacttgtctgctccttctggctcttattccctttcattgcagagggcaaggagtctatgcacctgcccaggcgcagatcgtccatgcaggacaggcctgcgtggtgaaggaggataacatatctgagagagtgtacaccatccgagagggtgatacacttatgctccaatgccttgtgactggccatcctcgaccacaggttaggtggaccaaaaccgctgggtctgctagcgataaattccaggagaccagcgtgtttaatgagacactgaggatcgagcgcatagctcgcacacagggcggtcgctactattgcaaagctgagaacggagtcggtgttcctgccataaagtcgatccgagtcgacgttcaatatttagatgagcctatgttaacggttcaccagaccgtgtccgacgtgagaggaaatttttatcaagagaaaactgtcttcctgcgctgcacagtcaattccaacccccctgctcggttcatttggaaaaggggtagcgacaccttgtctcactcccaggataatggggttgatatctatgagccactctatacccagggtgaaaccaaggtgctcaaacttaagaacctacgcccgcaagattatgcaagttacacgtgccaggtctcagtccgcaatgtgtgtggcattcccgataaagccatcacctttcgcctgaccaacactacagccccgcctgctctgaagttaagcgtaaatgaaacgcttgtggtcaatccgggagagaatgtgacagtgcagtgtctgttgactggcggagacccactgccgcagcttcaatggtcccacggacctgggcccttacctctgggagctttggcccaaggaggtactctcagtatcccctcagttcaggccagggacagtgggtattacaattgcactgccacaaataatgtgggtaatcctgccaaaaaaacagtgaatcttcttgtaaggtcaatgaagaatgcaaccttccagattactcccgatgttatcaaagaatccgagaatattcagctagggcaggatctgaaattgagttgccatgttgatgccgtcccccaggaaaaagtgacttaccagtggtttaagaacgggaaacctgcgcggatgagcaaacggctgctggtgactcgcaacgatccagaactccctgccgtaacctctagcctggaattaatcgatctacacttcagcgattacgggacctacctgtgtatggccagctttcccggcgccccggtccccgacctgtctgtggaggtgaatatctctagcgaaaccgtccccccgaccataagcgtacctaagggcagggccgtagttaccgtgagggagggaagccctgctgagttgcaatgtgaggtgaggggtaaaccaagaccacccgtactttggagtagggtggataaagaggccgcgcttcttccgtctggtctgccactggaggagacacctgacggcaagctgcgtctggagcgagtgtcacgggacatgagtggaacttataggtgccagaccgcgcggtacaatggctttaatgtgcgccctcgggaagcccaagttcaactgaatgttcagttcccgccagaggttgagcctagctcccaggatgttagacaagcattgggcaggccagtgcttctgcgctgttcgctgctgcggggatctccccaaagaattgctagtgccgtgtggaggtttaagggtcaactgctgcctcctccccccgtggtcccagccgccgccgaggccccagatcacgccgaactaaggctggacgcggtgacgcgcgactcatctggatcatacgaatgtagcgtaagtaacgatgtgggaagcgcagcgtgtctgttccaggtgtcagccaaggcttattcaccagagttttattttgatacaccaaatccaacccgttcgcacaagctgagcaaaaattacagctacgttcttcagtggacacagagggagccagacgccgtggatcctgtcctgaactatagactcagcattcggcagctgaatcagcacaacgccgtggtcaaggcgattcccgtgagaagggtcgagaaggggcaactcctcgagtatattttgacggatctgcgcgttccccactcctacgaggtgagactgacaccttacaccactttcggagccggcgatatggccagcaggatcatacactacacggagccaattaacagccctaacttgtcagacaacacgtgccatttcgaggatgagaaaatttgtggctacacacaggatctgaccgataacttcgactggacgcgacagaacgctctgacccagaaccccaagaggtctcctaatacaggcccccccacagacatctccgggacacctgagggatactacatgtttatagagacatctaggccacgggaattgggagaccgcgcacgcctagtgtcccccttgtacaacgcctccgccaagttttattgcgtgagctttttttatcacatgtatggtaagcatataggctctcttaatctcctagtgcgcagccgcaataagggcgcactcgatacccacgcctggagtctctcaggcaacaaggggaacgtgtggcagcaagctcatgtgcccatcagcccgtctggcccttttcaaataatctttgaaggcgtccgagggcccggctatctgggtgacattgctattgacgacgtaacactgaagaaaggggagtgcccccgaaagcagacagaccccaacaagggtgccaggcgggagggggggggaggtgccgaatccggtggctcgtgtgcctggagaggcttcctgtctgtagagggaggctgtctcgggcttaatcgggggtccgagtgcctgtctgatggaaaccacgtcgctttgacagtctag

SEQ ID NO: 123296 - DNA, 2184 bp, Artificial Sequence
  Description of Artificial Sequence: Synthetic coding sequence
atggtttcatttaggctgtcgaacaagacagcttctccctccatcaaactcctggtagacgaccccatcgttgtcaacccaggagaagccatcacactggtctgtgtgacaactggaggggagcctgctccgtcactcacctgggtacggagcttcggcaccctgcctgagaaaactgtcctgaacggcgggactcttacaataccagcaattacatctgatgacgccgggacctactcctgcattgccaacaacaatgttggtaatcctgccaagaaatcgacaaatatcattgtgagagccctgaagaaagggcggttctggataacccccgacccatatcacaaggatgataatatacagattgggagggaagtgaaaataagttgtcaggtggaagcagttcccagtgaggaactcaccttctcttggtttaaaaatggaaggcctttgcgaagtagtgaacgaatggtgattacccaaactgacccggacgtaagccccgggaccacgaatctcgacattatcgacctgaaatttactgacttcggcacctacacgtgcgtagccagtctgaaaggaggagggatctctgacatatccatagacgtgaacatttcaagcagtaccgtgcccccgaatttgactgtgcctcaggaaaagagcccactggtaactcgagagggggacaccatcgagctgcagtgccaggtcactggaaagccaaagcccattatactatggtcccgcgccgataaagaggtggctatgcctgacggatctatgcagatggagtcctatgatgggaccctcagaatcgtcaatgtgtcgcgggaaatgtcaggaatgtatagatgccagacatcccaatataacgggttcaatgtcaagccgcgcgaagctttagtgcagttaatcgtccaatacccacccgccgtggagcctgcctttttggaaatccgccaggggcaagatcggagcgtgactatgtcttgccgtgtgttgcgagcatatcctatccgagtgctgacttatgagtggcggctcgggaacaagctcttacggacaggccagtttgatagtcaggaatacaccgaatacgccgtaaaaagtctgtctaacgaaaactatggggtgtacaactgttcaatcatcaacgaggccggggccggacgttgtagcttcctggtcaccggcaaagcgtatgcgccagagttttactatgatacttataacccagtgtggcagaaccgccatagggtgtacagctacagcctgcagtggacccagatgaatccggatgctgtcgaccgaattgttgcataccgtctggggatccgacaggcaggccagcaaagatggtgggagcaggagataaagataaacgggaacatccagaagggagagcttataacatataacctgactgagttaataaaaccagaagcttatgaagtgcggctgacccctctgaccaagttcggtgaaggcgactccactatccgggtgataaagtattctgccccagtcaatcctcatctgagggagtttcactgtgggttcgaagatggcaatatttgcttattcacccaggatgataccgacaactttgattggacaaagcagtctacagccacaagaaacacgaaatacaccccaaatacaggcccaaatgccgaccgatctggatccaaagagggtttttatatgtacattgaaacatctagacctcgcctagagggagaaaaggcgagactgcttagccccgtgttcagcattgcacctaagaacccgtatggcccaacaaatacagcctactgtttttcctttttctatcatatgtacggacagcacatcggcgtgttgaacgtatatctacgcttaaaagggcaaacaacaatcgagaatcctctgtggtcctcctcggggaataagggacagcgatggaatgaggcacacgtgaatatctacccaatcacaagcttccagttaatatttgaggggatacggggcccagggatcgagggcgacattgctatcgacgacgtgtctatcgctgagggagaatgtgccaaacaggatcttgccaccaaaaattcagtagacggcgcagtgggcatactcgtgcatatttggctgtttccgatcattgtgctgatctctatcctgtcccctcgccgctag

SEQ ID NO: 123297 - DNA, 477 bp, Artificial Sequence
  Description of Artificial Sequence: Synthetic coding sequence
atgtacatcgagactagccgtccaagactggagggagagaaggccaggcttctgagccctgtcttttctatagcgcccaaaaacccttacggccctaccaacaccgcctactgtttcagtttcttttaccacatgtacggccaacacatcggagttctgaacgtatacctgcgactgaaaggacagacgactatcgagaatccgctgtggtcctcctccggcaataagggccaaaggtggaatgaggctcatgttaacatctaccccatcacatcatttcaactgatttttgagggaatccgaggccccgggatcgagggcgacattgcaatcgacgacgtgagcatcgctgaaggcgaatgcgcgaaacaggacctggctaccaaaaattccgtggacggagctgtgggaatcctggtccatatctggctgtttccgattatcgtcctgataagcattctgtcccctcgccgatag

SEQ ID NO: 123298 - DNA, 3078 bp, Artificial Sequence
  Description of Artificial Sequence: Synthetic coding sequence
atgtctgtgtggtcggctggtctgctccggtctgcaaggaggagacggcgaggccggaccgacggaaggagattcctacttaggagggcggtgcctggccacctcggtctggcacgcgccagagttgagagagcatggctggcagcaggactgctcaaggtgccactgaggacaccttgggccgggtatgtacatgtgcacgtcaaaatggacctcttatatggtctggtctggctgctcactgtgctcctggaaggtataagtgggcagggcgtctatgcccctccaacagttaggatcgtgcactccggacttgcctgtaatattgaggaggagaggtatagtgagcgagtttataccatccgggagggtgaaacattggagttaacatgcctggtaaccgggcatccaagaccgcagattcgctggaccaagactgcaggatcagcgtcggataggttccaggactcttcggtattcaacgagactctgaggatcacaaatattcagcggcatcaggggggacgctactattgcaaggcggaaaacggtctcgggtccccagccatcaaatcgatccgagtagatgtgtattacttagatgaccctgtagtcaccgtacaccagtcaattggggaagctaaggagcaattttattacgagcgcaccgtgttcctgcggtgcgtggctaatagcaaccccccggtgcgctatagttggcggaggggccaggaggttttattgcagggctccgacaaaggagtcgaaatctacgaaccgttctttacgcagggcgagactaagattctgaagctgaagaacctgcgcccacaggactatgctaactattcatgcatcgcctccgtgaggaatgtctgcaatatccctgacaaaatggtttcctttaggctgtcaaacaaaacagcctccccttccattaagctgctggtggatgaccctattgttgtgaaccctggggaagcaataactctagtgtgcgtgaccacaggtggagagcctgccccttctcttacctgggtgaggtcgttcggaaccctgcctgaaaaaactgtgcttaacggtggaaccttgacaatccctgccatcacaagtgacgacgctggaacctactcatgtatagcaaacaacaatgtgggaaatccagccaaaaagtccactaacattattgtgagggcactcaaaaaagggaggttctggatcacacctgacccgtatcataaggatgacaatatacagattggtagggaggtgaaaatttcatgccaggtcgaggctgtaccgtccgaggagctcacatttagctggtttaagaatggccgacccctgcgttcctctgagaggatggttatcactcaaacagacccggacgtgagtccaggcaccaccaatttagatatcatagatctgaagttcacagactttgggacttacacttgcgttgcttccctcaaaggaggaggaatctcagatatatctatcgacgtgaatatctctagctccactgtcccacccaatctaacagtgccacaagaaaagtcaccgctcgttactcgcgaaggcgacaccatcgaactgcagtgccaagtcactggcaagcccaagcctatcatactgtggagccgagcggacaaggaggtagctatgcccgatggcagcatgcagatggagtcttatgacgggactttgagaatcgtcaatgttagtagagagatgtctggcatgtatcggtgccagacatcccagtataatggatttaatgtgaagccacgggaggccctcgtccaacttatcgtacagtaccctcccgctgtggagcccgcctttctggagattcggcaagggcaggacagaagcgtcaccatgtcttgtcgcgtgctacgggcataccctattcgtgtcctcacttatgaatggcggttgggcaacaagctgttaagaactggccaattcgacagccaggagtacacagaatacgcagtaaaaagccttagcaacgagaattacggggtgtataattgctccatcattaatgaggccggcgcgggcagatgcagtttcttggttacaggaaaggcctacgcccccgagttctactacgacacctacaaccccgtgtggcagaatcggcaccgggtttattcttatagcctgcagtggacacaaatgaaccccgatgctgtggacaggattgtggcatacagacttggaattcgccaggccggacaacagcgctggtgggagcaggagattaagattaacggcaacattcagaaaggtgagctaataacttacaacctgacggagctgatcaaaccagaagcctatgaggttaggcttacacccttgacaaagttcggtgagggagactcaacaatccgcgtgattaaatatagcgctcccgttaatcctcaccttcgtgagttccattgtggtttcgaagatggaaatatttgcctattcacccaggatgataccgacaattttgactggaccaaacaatcaacggctaccagaaatactaaatacacccccaacacaggcccaaacgccgaccgctcagggagtaaggaaggcttttacatgtatattgagaccagccgaccacgcctggaaggagaaaaggcaaggctcctgtctcccgtgttctctatcgcccctaaaaatccatacggcccaacaaacacggcctactgtttcagtttcttttatcatatgtacggccaacatattggcgtgctgaacgtgtacctgagacttaagggccagaccaccatagagaatccgctgtggtcaagctctgggaacaagggccagcgctggaacgaagctcatgtgaatatctatccgattacctctttccagctgatctttgaaggtatccgtggacctgggattgaaggcgacattgcaattgatgacgttagcatagcagaaggcgagtgcgcaaaacaggatcttgctacaaagaactcagtagacggggctgtgggcatactagtacatatctggctgtttccgatcattgttctaatttcgatcctgagtccgcgccgctag

SEQ ID NO: 123299 - DNA, 2184 bp, Artificial Sequence
  Description of Artificial Sequence: Synthetic coding sequence
atggtctccttccgcctctctaacaagaccgcttcccccagcatcaagcttctcgtggacgaccctattgtcgtcaatcctggcgaggctatcacacttgtgtgtgtgaccaccggaggcgagccagcccctagcttgacctgggtgcgaagcttcggtaccttgccggaaaagacagtcctgaacggaggcactctcaccatcccagcaatcaccagcgacgatgcgggcacctattcttgcattgcaaataacaacgtaggaaacccagctaaaaagagcaccaacattattgtgagggccttaaagaagggcaggttttggattacgcctgatccatatcataaggatgataacattcagatcggtcgggaagtaaaaatcagctgccaagttgaggctgtcccatctgaggaactgaccttttcttggtttaagaacggccgccccctgcgatcctcagagcgtatggttatcactcagacggaccccgatgtcagtccaggcaccacgaacctggatataatcgatctaaaatttacagattttggtacatacacatgtgtggcttcactaaagggtggggggattagtgatatttccatagacgttaacatcagttcttcaacagttccaccgaatctcaccgtgccacaggagaaaagcccgctggtgacacgcgaaggcgataccatagaactccagtgccaggtgacaggcaaacctaagcccatcatcctctggtcccgcgctgataaagaggttgccatgccagacggctcaatgcagatggaatcttatgacggtacccttcgtatcgtcaatgtcagcagggaaatgtcaggcatgtatcggtgccaaacttcacaatataatggcttcaacgtgaaaccccgggaggcattagttcagctgattgtccagtaccctccggctgtcgaaccagcctttcttgagattaggcaggggcaggaccggagcgttacaatgtcctgtagggtgttaagggcatatcccattagggtgctgacatatgaatggcgcctcggaaataagctcctccgcaccggacagttcgactcacaagagtatactgaatacgccgtaaaatccctctccaacgaaaattatggggtgtataactgtagcattatcaatgaggccggtgcagggcgttgtagctttctagtgacaggcaaagcatatgctccggaattctattacgacacgtacaatcctgtctggcaaaataggcatcgtgtgtattcctacagcttacagtggactcagatgaatcccgatgccgtcgataggatcgttgcgtacagactgggtattagacaagctggccagcaaaggtggtgggagcaagagatcaagatcaatggaaatatacaaaagggagagctcattacctataatttgacggagcttataaaaccggaggcctacgaagtgcgactgactcctctgaccaaattcggggagggcgattcgacaatccgagtcatcaagtattctgcccccgtcaatccccatctgagggagttccactgcggattcgaggatggcaatatctgcctgttcacgcaggatgacacagataactttgattggaccaagcagtccacggcaaccaggaatacaaaatatactcctaacacaggaccgaatgctgaccggtctggttctaaagaggggttttatatgtacatcgaaaccagtcgcccacgcctagaaggcgaaaaggcccgcctgctctccccagtcttcagcattgctccaaagaatccctatggcccaacaaatacagcatattgcttctcattcttctaccacatgtacggccaacatatcggagtcctgaacgtctatctgcggctgaagggtcagacgaccattgagaaccctctgtggagttctagtggcaacaaaggacaacgctggaacgaagcccatgtcaatatttaccccattacgagcttccagctgattttcgagggtatccgcggcccgggaattgagggcgacatagcaattgatgacgtcagcatagccgagggagaatgcgcaaagcaggacctggccaccaagaactccgtggacggcgctgtcggcattctggtgcatatatggctgtttcctataattgtgttaatctccattttatctcctcgcagatag

SEQ ID NO: 123300 - DNA, 2871 bp, Artificial Sequence
  Description of Artificial Sequence: Synthetic coding sequence
atggatcttctctatggacttgtctggctactcaccgtgctactggaaggaattagcggacagggtgtgtacgccccgccgaccgtgcgaatcgtccattctggacttgcttgcaatatagaagaagaaagatatagcgaaagagtatacaccattagagagggtgaaactctggagcttacatgcctggtaaccgggcaccccagaccacagatccgctggactaaaaccgctggatcagctagcgatcgcttccaggacagctccgtgtttaatgaaacattgcgcatcacaaatatccagcgccatcaggggggaagatactactgcaaggctgaaaatggtctcgggtctccagctatcaaaagcatacgggttgacgtgtactacctggatgatccagttgtgactgtccaccaaagcatcggtgaagccaaagagcaattctactatgagcggaccgtctttctgcgttgcgtggctaatagcaaccctcctgttcgatactcatggcgccgggggcaagaggttttgttgcagggttcggacaaaggggttgaaatttacgagccatttttcacccagggcgagacaaagatcctgaagctcaagaaccttcggcctcaggactatgcaaactactcttgcatcgccagcgttcggaatgtgtgcaacatcccagataagatggtctcgttcagactttctaataagaccgcttcgccttctatcaaactgttggtcgacgatccaattgttgttaatccaggcgaggctattaccctggtgtgcgtgacaactgggggtgagccggccccatctctaacatgggttcgctcatttgggacccttcctgaaaagacggttctgaacggaggcacgttgaccattccagctattactagcgatgatgccggtacgtatagctgcatcgccaacaacaacgtcggcaatccggccaaaaaaagcaccaacatcatcgttcgcgccttaaagaaagggcgattttggatcaccccggacccatatcataaggatgataatattcagatcggtcgagaggtgaagatatcatgccaggtcgaggcagtgcctagtgaagagctgacattcagttggtttaaaaatggcaggcctttgcgttctagtgagcgcatggttattactcagaccgacccagacgtcagccccggaactacgaacttagatatcatcgatttgaagttcacagattttgggacctatacgtgtgtcgcttccttgaagggcggcggaatatctgatattagcattgacgtgaacatcagttccagcaccgtgccccccaatttgacagttccgcaggagaaaagcccgctcgtcactcgtgaaggagacaccatcgagttacagtgtcaggtgaccgggaaacctaaaccaattattctttggagtagggccgataaggaggtggccatgcctgatggatctatgcaaatggaatcatacgacgggaccctgcgtattgtcaatgtctctagagagatgtctggcatgtatcggtgccagacaagtcagtacaacggttttaatgtgaaacccagagaagcgttggtgcagctcatagtgcagtatcccccagcagttgaacccgccttcctggagattcggcagggccaagatcggagtgtgacaatgtcctgtagggtactacgcgcttatcccatcagagttcttacttatgagtggagactgggaaataaattattgagaaccgggcagtttgactcccaagagtataccgagtacgctgtgaaatcactatccaatgagaactacggggtgtacaattgcagtatcatcaacgaagccggcgccggtcgctgcagcttcctggtgactggcaaggcctatgcaccggagttctactacgacacctacaaccctgtctggcagaatagacacagagtgtacagttactctcttcagtggactcaaatgaaccctgatgcggtggatcggatcgtggcttaccgcctaggaataaggcaggccgggcagcagcgttggtgggaacaagaaataaagattaacggtaatattcagaagggggaactgataacctacaacctgacagaactgattaagcctgaggcctacgaggtgcgccttacccctctcaccaaatttggcgagggtgatagtaccatccgcgtgattaaatactctgcccctgtcaatccccacttaagggagttccactgcgggttcgaagacggaaacatctgtctctttacccaggacgacacagacaattttgattggaccaaacagtccactgctactagaaacacgaagtacacacctaacaccgggcctaatgctgatcgctcgggcagtaaagaaggattctacatgtacatcgagacaagccgccctaggctcgaaggcgagaaggcccggttactgtcccctgtattcagtattgcacccaagaatccctatggccctacaaacaccgcctactgtttttccttcttctaccacatgtatggacagcacattggcgtgttgaacgtttatcttcggctcaagggccagacgaccatcgaaaacccgctgtggtccagttccggaaataaaggtcaaagatggaatgaggcccatgtcaatatttaccctattacctctttccagctgatattcgagggcattagagggcccggaattgagggcgacatcgctatcgatgacgttagcatcgccgagggcgagtgtgcaaaacaggaccttgcaacaaaaaatagtgtcgatggggccgttggtattctcgtacatatctggttgtttcccattatagtgctgatctcaattttgtccccaaggcgctag

SEQ ID NO: 123301 - DNA, 1143 bp, Artificial Sequence
  Description of Artificial Sequence: Synthetic coding sequence
atgagatggctcttactgtactacgccctctgctttagcctgtctaaggcatctgcccacaccgttgaactgaataacatgttcggacagattcagtctcctgggtatcctgactcctacccatccgattcagaggtcacctggaacatcactgtcccagatgggttcagaatcaaactgtactttatgcacttcaacctggaatcttcctatctgtgcgagtacgattatgtaaaggttgagacagaagaccaggtgctggctactttttgtggccgcgaaacaactgatacagaacagacccccggccaggaggtggtcctgagtcctggctcatttatgagtatcactttccggtctgatttctcaaacgaggaacggttcaccggcttcgatgcccattacatggcagtggatgtcgacgagtgcaaggagcgggaggacgaggaactctcttgtgaccattattgtcataattacattgggggctattactgttcttgtaggtttggctatattttacacacagacaatcgcacatgtagggttgaatgctctgataatcttttcacacagcggaccggggtcattacgagccccgattttcccaacccttaccccaaatctagtgaatgtctatataccattgagctggaagaaggttttatggtgaatctgcagtttgaggatatctttgacatcgaagaccaccctgaggtgccttgcccctatgactacattaagattaaagtgggtccaaaagtactgggccctttctgcggcgaaaaggcccctgaacctattagcacgcagtcacattccgtgctcatcctgtttcattctgacaattctggcgaaaatcggggctggagactttcttatagagccgcgggtaacgaatgtccagagcttcagccccctgtacatgggaaaattgaaccatctcaggccaagtatttcttcaaagaccaggtgctcgtgagttgcgacaccggttataaagtactgaaagataacgtggagatggatacctttcagatcgaatgtctgaaggacggcacttggtccaacaagatccctacgtgtaagaagaatgagatagatttagagtcggaattgaagtccgaacaagtgacagagtag

SEQ ID NO: 123302 - DNA, 2187 bp, Artificial Sequence
  Description of Artificial Sequence: Synthetic coding sequence
atgcggtggctcctgctctattacgccttgtgtttttctcttagtaaagcatctgcccatacagtagaattaaacaacatgtttgggcaaattcagtctcccggctatcctgactcttatccatcagactcagaggtgacttggaacatcacagttccagatggctttcgaatcaagttgtatttcatgcattttaacctggagtcgagctacctgtgtgagtatgattacgtcaaggtcgagacggaggatcaggtgctggcgactttctgcggacgggagacgacggacaccgaacaaacacccgggcaggaggtggttctcagccctggcagtttcatgtccataactttcagatccgactttagcaatgaggaaaggtttacagggttcgacgcacattacatggccgtcgacgtggacgaatgcaaggagcgagaggatgaggagcttagctgtgaccattattgccacaattacattgggggatactactgctcatgcagatttggatatatactgcatactgacaatcgcacgtgccgagtggaatgttccgataatctgtttacacaacggaccggtgtcatcacttcccctgatttcccaaacccctacccaaagtcaagcgagtgcttgtacactatagagctggaagaaggatttatggtgaacctgcagttcgaagatattttcgatatcgaagatcatccagaggtgccatgcccttacgactacatcaagattaaagtcggacctaaagtgcttggcccgttttgcggcgaaaaagctccggaacctatttccacgcagtcacattccgttctcatcttatttcattccgacaattccggcgagaacagaggttggcggctcagttacagagccgctggcaatgagtgccctgaactgcagcctcctgttcacgggaaaattgaacctagccaggccaagtacttctttaaagaccaagtcctcgtgtcctgcgacacaggatacaaggtcctgaaggataatgttgaaatggacacgtttcagattgaatgtctgaaggacggcacctggagcaataagattccaacctgtaagattgttgactgtagggctccaggtgaactggagcacggtctcatcaccttctccacccgcaacaatttgaccacatataaaagcgagatcaaatacagttgtcaggagccttattacaaaatgctgaacaataacactggcatttatacatgctcagcacagggggtgtggatgaacaaggttctcggcaggtctctgcccacatgtctgccagagtgtggacagccttcccgatctttgcccagcctcgttaagcgcatcatcgggggacgaaacgcagagcctggcctgttcccctggcaggccctgatcgtcgtcgaggacacatctagagtccccaatgataaatggttcgggagcggcgccctccttagcgcaagctggatcctcacggcggcccatgtgttaagaagccagagaagagatactaccgtgataccagtcagtaaggagcatgttaccgtctacctggggctacacgacgtaagagataagagcggcgctgtgaactcaagtgccgcccgcgttgtgctgcaccccgactttaatatacagaactacaaccatgacatagccttggtgcagctccaagagcccgtccctctgggcccacatgtgatgccagtctgtctacctagactcgagccagagggccccgccccccacatgctgggactggtggccggttgggggatcagcaatcccaacgttacagtcgacgagatcatatctagtggcaccagaacactctctgacgttctgcaatacgttaagttacccgtggtgccccacgcagagtgcaagaccagctacgaaagtagatctgggaattatagcgtaaccgagaacatgttctgcgctggatactatgagggcggcaaagatacatgcctgggcgactctgggggcgccttcgtcatttttgacgatctgtcacaaaggtgggtcgttcaaggattggtgtcgtggggagggcccgaagagtgtggctcgaaacaggtttatggtgtatacaccaaggtgtctaactacgtggattgggtctgggagcagatgggtttaccccagagcgtggtggagccccaggtggagcggtag

SEQ ID NO: 123303 - DNA, 2100 bp, Artificial Sequence
  Description of Artificial Sequence: Synthetic coding sequence
atgaggtggctccttctttactatgccctgtgtttctctctgagtaaagcgagtgcacacacagtagagcttaacaatatgttcggccagatccagagtccgggataccctgatagctacccgtcagactccgaagttacttggaatatcactgtgccagacggcttccgaatcaagctgtatttcatgcacttcaatcttgaatcctcatatctctgtgagtatgactacgttaaggtggaaaccgaagaccaggtcttggccacattctgtggccgcgagacaactgacacggagcaaacccccggccaggaagtggtgctctctcccggtagcttcatgagcataacctttcgaagcgatttcagcaacgaggagcgctttacagggttcgacgcgcattatatggccgtggatgtggacgaatgtaaagaaagagaggatgaagaactgtcatgcgatcattattgtcataattacatcggcggctattactgctcctgccgattcggctatatcctacacacagacaatcggacatgcagagttgaatgcagcgacaacctctttacgcagcgaaccggtgttatcacaagcccggactttcccaacccttatccaaagagctcggaatgtttgtataccatcgaactcgaggagggtttcatggtaaatttgcagttcgaagatatcttcgacattgaggatcaccctgaggtgccttgcccatatgattacattaagataaaagtgggcccaaaagttctcggccctttctgtggagagaaagcacctgagccaataagcacccagagccatagtgtgttgatcctgttccattccgacaattcaggtgagaatcgcgggtggcgtctttcttatcgggcggctggaaacgagtgccccgagctgcagcctcccgtgcacggaaagattgagccctctcaggctaagtactttttcaaggaccaggtcttggtgagctgcgacaccggctataaagtgctgaaagacaacgtggagatggacacgttccagatcgaatgtcttaaggacggaacctggtccaacaagatcccaacttgcaagatcgtcgattgccgcgcgcccggagaattggaacacggcctgattacgtttagcactaggaacaatctgacgacttacaagagcgagattaagtattcgtgtcaggagccttattacaagatgcttaacaacaataccggtatatatacttgttcagcacagggcgtatggatgaataaggtccttggtagatcgctgcccacctgtctgcccgtctgtggtcttcctaagttctcccggaagttgatggcaagaatattcaacggcagaccagcccagaaaggaaccaccccatggattgccatgctgtcgcaccttaatggccaacctttctgtggcgggtctctgctgggctcctcgtggatcgtgactgccgcacattgccttcaccagtctctggaccccgaagatcccacattgcgggactcagatcttctgtccccctcggactttaagattattttagggaaacattggcggctgcgttcggatgaaaatgagcagcacctgggggtaaaacatacaaccctccacccacagtacgatcccaatacctttgagaacgacgtcgccctggtcgaactgctggaaagccccgtgctaaatgctttcgtgatgccaatttgtctgccagaggggccccaacaggagggcgccatggtgattgtctcagggtggggcaagcagttcttacaaagattccccgaaaccttgatggagatagagatcccaattgtcgatcacagcacttgtcaaaaagcatacgctcctctcaagaaaaaagtaacgagggacatgatctgtgccggtgaaaaggaaggtggcaaagacgcttgtgccggtgactccggggggccaatggtcacactcaatcgcgaacgcggccagtggtacctggttgggacagtgtcatggggagacgattgcggcaaaaaggataggtacggggtgtacagttacatacaccacaacaaggattggatacagcgggtgacaggggtccgaaattag

SEQ ID NO: 123304 - DNA, 1848 bp, Artificial Sequence
  Description of Artificial Sequence: Synthetic coding sequence
atgtctatcacatttcgctccgacttttctaacgaggaacggttcactgggttcgacgcccactacatggccgtggatgtggacgagtgcaaagagcgtgaagacgaagaattatcctgtgatcactattgccacaactatattggtggatattactgtagctgcaggttcggctacattctccacacggataatcggacctgtcgtgtcgaatgtagcgataatcttttcacacagcgtactggagttataacatctccggatttccccaatccatatcctaagagcagcgagtgtctgtatactatcgagttggaggaaggctttatggtgaatctgcagttcgaggatatatttgacattgaggatcaccccgaggtgccttgcccatacgactacattaagattaaagtcggcccaaaagtgctgggccccttttgcggagagaaagctccagagcccatatccacacaaagccactccgtcttgattctgttccactccgacaattcaggcgaaaaccgaggttggcgactgtcttacagagcggctggaaatgaatgccccgagctgcagcccccagtgcatggtaagattgagccatcccaagctaagtacttcttcaaagaccaggtcttggtgtcttgcgataccgggtacaaggtcctgaaagacaatgtcgagatggacacatttcagatagaatgtctgaaggacggcacctggagcaataaaatcccgacctgcaaaatagtggactgcagagccccaggagaactagagcatggtcttatcacgttcagtacacggaataaccttactacatacaaatctgaaattaagtactcatgccaagagccctattacaagatgttgaataataatacaggcatatatacttgctccgcccagggcgtttggatgaacaaggtgctgggaaggtcactgcctacctgcctccccgagtgtgggcagcccagtcgatcgctgccgagtctcgttaaacggatcatcggcggccggaacgctgagcctggtctgttcccatggcaggcactcatagtggtggaagacacctcccgagtcccaaacgacaaatggttcggctccggcgccctgctttccgcttcctggatcctaacagccgctcatgtcctgagatcacaaaggagagataccacagtgatccctgtgagtaaggagcacgttaccgtgtatctggggctgcatgatgttagggataagtccggtgccgtaaattccagcgcagcccgcgtcgtgcttcaccccgacttcaatatccagaactacaaccatgacatagcccttgtgcaactccaggaacccgttcccctgggcccccacgtcatgcctgtgtgcttgccacgactggagcctgagggtccagctccgcatatgctgggactggtggctggatggggcataagtaacccaaacgtaacagtcgatgaaatcatctcctcaggcacgaggactctcagtgatgtgttgcaatatgtgaaactacctgttgtacctcacgcagaatgtaagacgtcctacgagtctaggtctgggaattatagtgtcacagagaatatgttttgcgccgggtactacgaaggaggtaaggatacatgcctgggagatagcggcggcgcatttgtgatttttgacgatctttcccagaggtgggtggtgcaggggctggtctcatggggcgggcctgaagaatgcggcagtaaacaggtgtatggggtttatacaaaggtgtcaaactacgtggactgggtgtgggagcaaatgggcttgcctcagagtgtggtggagccccaagtagaacggtag

SEQ ID NO: 123305 - DNA, 249 bp, Artificial Sequence
  Description of Artificial Sequence: Synthetic coding sequence
atgttctgtgccgggtattacgaaggcggaaaggatacatgcctcggggactccggaggagctttcgtcatcttcgacgacctgtctcagcgatgggtggtgcaggggctcgtgtcctggggaggccccgaagaatgtggcagcaaacaggtgtacggggtctacaccaaggtctcaaactacgtggattgggtgtgggagcagatgggtctgcctcagtctgtggtcgagcctcaagttgaaaggtag

SEQ ID NO: 123306 - DNA, 1443 bp, Artificial Sequence
  Description of Artificial Sequence: Synthetic coding sequence
atgagcattactttccggtctgatttttcgaatgaggaaaggttcacagggtttgatgcccactatatggctgtggatgtagacgaatgcaaggagcgcgaagacgaggagctcagctgtgatcattactgccacaactacatcgggggctactactgttcatgcagatttgggtacatcctgcataccgataataggacatgtagagtggagtgctctgataacctcttcactcagcgcacaggcgtgatcacatctcccgatttccccaatccttaccctaagtcgtctgaatgcctgtataccatcgagctggaagagggcttcatggttaacctgcaattcgaagacatattcgatatcgaggatcatcccgaagtcccgtgcccatacgattacattaaaatcaaggtgggccccaaggtgttaggtccattctgtggggagaaggcccctgaacccatctccactcagtcccattccgtcctgatcctcttccatagcgataattctggtgagaaccgtggatggaggctgtcttaccgagcggccgggaatgaatgtccagaactgcagcctcctgtgcacggcaaaatcgagccctctcaggcaaagtacttttttaaagaccaggttttagtcagctgtgacaccgggtataaagtcctgaaggataacgtagaaatggataccttccagatcgagtgtcttaaggacgggacttggtcgaataaaattcccacttgtaagatcgttgattgtcgcgcccccggggagctggaacacggtctgatcaccttcagcacccggaacaatctcacaacatataagtccgagatcaagtactcatgtcaggagccatactataagatgctcaataataatacaggtatttacacttgtagtgcacaaggagtttggatgaataaggttctcggtcgcagcctgcctacgtgcctgccggaatgcgggcagcccagtcgttctttaccttcactggtcaaacggatcattgggggccggaacgccgagccgggtctttttccctggcaggcccttatcgtggtggaagacacctctcgagtgccaaatgataaatggtttggttcaggggcactactctctgcatcctggattctcaccgccgcgcatgtgttaaggtctcagcgccgagacacgacagtaattcccgtgtccaaggaacacgtgacagtttatctcggactacacgacgtgcgggacaagtcaggcgccgttaatagctccgcagcacgggtggtcctacaccccgactttaatatccaaaattacaatcacgacatagccctggttcagctccaggagccagtacctctgggaccccatgttatgccagtttgcctgcctaggcttgagcctcccgggggccgcttagggcacctgcagtcccagtgcgacagctag

SEQ ID NO: 123307 - DNA, 2061 bp, Artificial Sequence
  Description of Artificial Sequence: Synthetic coding sequence
atgagacttctcaccttactgggtctcctttgtggatcagtggcgactccactcggacccaagtggccggagcctgtgtttgggaggctcgcctcaccaggatttcccggtgagtacgccaatgaccaggagcgtcgttggaccttgactgcgcctcctgggtacagattgcgcttgtacttcacacactttgatctggaactgtcccacctgtgtgagtatgattttgttaagttgtcctcgggcgcaaaggtactagcaactttgtgtgggcaggagtctaccgatacggagagagctcctgggaaagacactttttactcactgggttcctccttagacataacttttcggtctgattattccaacgagaagccatttaccggattcgaggcgttctacgccgctgaggacattgacgagtgccaggtagctcccggtgaggcccctacttgcgatcatcattgccataatcatttgggtggattttattgctcttgtcgcgccggctacgtcttgcatcgaaataagcggacctgttccgcactttgcagcggtcaggtgttcacccaacgctcaggagagctcagctcacctgaatatcctagaccgtatccaaaattatctagttgtacatattcgatcagccttgaagaaggattctccgtgatcctggacttcgtggagagcttcgatgtagagacacaccctgaaaccctctgtccctacgactttctgaagattcagaccgatcgggaggagcacgggccgttctgtgggaagactctgccccacaggatcgagacaaagtcaaatacggtaactattacctttgtgactgatgaatctggggatcacaccggatggaaaatccactacacaagtacggcccagccctgtccataccctatggccccgcccaacgggcacgtgagccccgtgcaggcgaaatacatactgaaggacagcttcagcattttttgcgaaactggctacgagcttctgcaggggcatctgccactgaagtcatttactgcagtatgccagaaggacgggtcctgggacagacccatgcctgcctgcagtatcgtggactgtggtccccccgacgacctgccatctgggagagttgagtacattacagggccgggagtcacgacgtataaggcggtgatacaatacagctgtgaagagacgttctacactatgaaggtcaacgatggaaagtacgtgtgtgaagcggacggcttctggactagctcaaagggcgaaaaaagccttcccgtatgtgagcctgtgtgcgggctgtcagcccggacgaccgggggcagaatttacgggggccagaaagccaaacccggggacttcccatggcaagtgttaattctgggcgggacgacagccgcaggcgcattactctacgacaactgggttctgactgcggcgcatgctgtctatgagcaaaagcatgacgcttcagcactcgatattaggatgggcactttgaagcgactgagcccccactacacccaagcttggtctgaggctgtgttcatccatgaagggtacactcacgacgccggattcgataacgacattgcattgattaaactgaacaacaaggttgttattaatagcaacattacacctatctgtctgcctaggaaagaggccgagtctttcatgcgtactgatgatattggaacggcatcagggtgggggctcacacaacggggtttcttggccagaaatctcatgtatgtagacatccctatcgttgaccaccaaaagtgcaccgcagcatacgaaaaacccccatatccacggggttcagtgaccgccaatatgctttgcgctgggttggagagtgggggaaaggacagctgtagaggcgattcagggggagctctggttttcctcgattccgagacagaaagatggtttgtcggaggcatcgtctcttggggctcaatgaattgtggtgaggcaggtcaatacggtgtctacactaaggtgattaactacatcccttggattgagaacatcatctccgatttctag

SEQ ID NO: 123308 - DNA, 558 bp, Artificial Sequence
  Description of Artificial Sequence: Synthetic coding sequence
atgcgactgctgaccctgctcggactgctttgtgggtccgtggcgacccctctgggaccaaaatggccagaacccgtgtttggtcgcttggcctcaccggggtttcccggggagtacgcaaacgatcaagagagacgctggaccttaacggctcctccaggctaccgcctccgactatacttcacgcattttgatctagagctttcacatctgtgtgagtacgactttgttaagcttagcagtggagccaaggtgctcgccacgctgtgtggccaggagtccactgacaccgagagggcccccgggaaggacacattctattctctggggagctcccttgatataaccttccgtagcgactattcaaacgagaaaccctttactggatttgaggcattctatgctgcagaagatatcgatgaatgtcaagtggccccaggggaggccccaacttgtgatcaccattgccataaccacctcggcggcttctactgctcctgccgcgccggatacgtgctgcatagaaataagaggacttgttctgagcagtccctctag

SEQ ID NO: 123309 - DNA, 1089 bp, Artificial Sequence
  Description of Artificial Sequence: Synthetic coding sequence
atggccgcccccagagtctttcctctcagttgtgccgtgcagcagtatgcatggggaaagatggggtctaatagcgaagttgcaagactcttagcttcctcagatccgcttgcgcaaatcgctgaggacaaaccttatgcagagctttggatgggcacccatcccagaggagacgcaaagatcctagacaacagaatttcgcagaagactctatcacaatggattgccgagaatcaggattctctcggctccaaagtaaaagacactttcaatggaaacctgccttttctgtttaaggtattaagcgtcgagacccccttgtccatccaagcccaccctaacaaggagttggcagagaagttgcaccttcaggctccacagcactacccagatgctaatcataagcctgagatggctatcgctctaaccccattccagggactttgcgggtttcgtcctgtcgaggaaatcgtgaccttccttaaaactgccgctggtaacaacatggaagatatttttggagaattgctgctccagctgcatcagcagtacccgggggatattggatgctttgccatttacttcctcaacctcctgacgctgaagccaggtgaagcaatgttcctagaagctaacgtgccgcatgcctatctgaagggcgattgcgtcgagtgtatggcttgctctgacaacactgtccgagcaggtctcactccaaagttcatagacgtgccaaccctgtgtgaaatgctctcttacacgccgagctcgtccaaggatcgcctttttttgcccacccgcagtcaggaagatccatacctgagcatctacgatcccccggttccagacttcacaattatgaagacagaagttccagggagcgtgaccgaatacaaggtgctcgctttagactcggcttcaatcttgctcatggtgcaggggaccgtgatcgcatctacacctactacacagacacctattcctttgcaaaggggaggcgtgttgtttatcggagcaaatgaatcagtatcattgaaattaactgagcccaaagatctcctaatatttcgcgcttgctgcctgctgtag

SEQ ID NO: 123310 - DNA, 1272 bp, Artificial Sequence
  Description of Artificial Sequence: Synthetic coding sequence
atggctgctcccagagtttttccactgagttgcgccgtacaacaatatgcttggggtaaaatgggctctaacagcgaggtggcacgactgctcgcaagctccgatccactagctcagatcgctgaggacaaaccctatgctgagctttggatggggacacacccacgcggggatgctaagatcctggataatcgcatcagccagaaaacgttgtcccagtggattgcagaaaaccaagactccctcgggtccaaagtcaaggacacatttaacggcaaccttccctttctttttaaggtcctctccgtcgaaacccctctgtctattcaggcccaccccaacaaggaactggctgagaaactgcacttgcaggctccccaacattaccccgacgcgaaccataagcctgaaatggctatcgctcttaccccattccaaggactctgcggattccgccctgtcgaggaaatcgtcacttttctgaagaaagttcctgaatttcagtttcttattggcgacgaggctgcgacccacttgaagcaaacaatgtctcatgacagccaggcggttgcatcgtctctgcagtcttgcttttcccatcttatgaaaagcgaaaaaaaggtagtagtagagcagctcaatctgttggtaaagaggatctcccagcaggcggccgctggcaacaatatggaggacatctttggtgaactgctcctgcagttacaccagcagtacccaggtgacattggatgttttgcaatctatttcctaaacctgctgactctgaaaccaggtgaggccatgtttttagaggcaaatgttccacatgcatacctgaagggcgactgcgtcgaatgtatggcgtgctccgacaatacagtccgtgccggtctcacaccaaaattcatagatgttcctaccctctgtgagatgctgagttacaccccgtccagctcaaaagacagactgtttttgccgacaaggtcacaggaggacccctacctctctatttatgacccacctgtgcccgatttcacaatcatgaagaccgaagtgcccggcagcgtgacggaatacaaagtattagcccttgactctgcatccatccttctcatggtccaaggcaccgtgatcgcctccactcccacaactcagacccccattccgctccagcggggcggcgtcctctttattggagccaacgaaagcgttagcctgaagctgacagagcccaaagacttgctgattttccgcgcgtgttgcctgttgtag

SEQ ID NO: 123311 - DNA, 804 bp, Artificial Sequence
  Description of Artificial Sequence: Synthetic coding sequence
atgggaagcaattccgaggtggctagactcctcgcctcgtctgatccactggctcagatcgcagaagacaagccgtacgcagagctctggatgggtacccaccccagaggcgacgctaagatcctcgacaatagaattagccaaaaaaccctctcacagtggatcgccgaaaaccaggacagtttgggaagcaaagtgaaagatacatttaatggtaatctgccttttctgttcaaagtcctcagtgtggagacgcctttaagcattcaggcccatcctaataaagagctggccgagaagttacatttgcaggccccacagcattaccctgacgcgaaccacaaacccgagatggcgattgcactcaccccctttcaggggctgtgtgggtttcgacctgtggaggaaattgtgacctttctcaaaaaagtgcctgaatttcaatttctgatcggagatgaggccgctacccatttgaagcagacaatgagtcacgactctcaagctgttgcatcgagcctgcagtcttgtttcagccatctgatgaaatctgaaaaaaaggttgtggtggagcagctaaatctgctggtaaaacgcatttcacagcaagcggcagcgggcaataacatggaggatatcttcggcgagctgcttctgcagctacaccaacagtatcctggcgatattgggtgtttcgccatctactttctgaatctccttacccttaaacccggggaggctatgttcctggaggccaacgtacctcatgcatacctgaagggaggaccatggctgtgccactag

SEQ ID NO: 123312 - DNA, 1122 bp, Artificial Sequence
  Description of Artificial Sequence: Synthetic coding sequence
atggggacacacccacggggcgacgcaaagatcttggacaatcgaatctcccaaaagaccctcagccagtggattgcggaaaatcaggactcgttgggcagcaaagttaaggataccttcaatgggaacctgccgtttctctttaaggttctatcggttgagacgcctctctccattcaggcacatcccaacaaagagctggcggagaaacttcatttgcaggctccccagcattatcccgatgctaaccacaagccagagatggcaattgcccttacgcctttccagggcctgtgtggttttcgtcccgtggaagagatagtgacctttttaaagaaggtccccgagttccagttcctgatcggagatgaagccgctacccacctgaaacaaacgatgagccacgacagtcaggccgtggcctcatctttgcaatcatgcttctcacacctcatgaagtcagaaaaaaaagtagttgtggagcagttgaatctgcttgtcaagcgtatctcacagcaggcagccgctggaaacaatatggaagatattttcggagagttgcttctgcagctacaccagcagtatccaggagacattgggtgctttgctatctattttctgaatctgttgacccttaaacccggtgaggctatgtttctggaagctaatgtcccccacgcctatctcaaaggtgactgtgtggagtgcatggcttgtagcgacaataccgtgagagctggactgacccccaaatttattgacgtgcctactttgtgcgaaatgctcagttataccccatctagcagcaaggatcgtctgtttctgcccacgaggagccaagaagatccttatctgagtatatacgatcctcctgtccctgatttcacgatcatgaagactgaagtgcctggttcagtgacagagtacaaggttcttgctctggactccgcgagcatcctgctgatggtccagggaactgtcatcgcaagtacccccaccactcagactcccatacctctacagcggggcggagtgctcttcataggcgctaatgagtctgtctctctgaagctcacagaacctaaagacctcctcattttccgagcttgctgcttgttgtag

SEQ ID NO: 123313 - DNA, 4371 bp, Artificial Sequence
  Description of Artificial Sequence: Synthetic coding sequence
atgaggctgccgctgctcttagtgttcgctagcgtgatccccggcgccgtcttgctgctggacactagacaattcctcatttacaatgaggaccacaaaagatgtgtggacgcagtctctccttccgcagtccagactgccgcttgcaatcaagacgcggagtcccaaaaattcagatgggtctccgaatcccaaatcatgagcgtggcatttaagctgtgcctgggtgtaccgagcaaaactgactgggttgccattaccctgtatgcctgtgatagtaagagcgagttccagaagtgggagtgtaagaatgacacccttctcggcattaagggcgaggacttattcttcaattatggcaatcggcaagaaaagaacatcatgctgtataagggctcagggctgtggtccaggtggaagatctatggcaccacagataatctgtgctccagaggatacgaggcaatgtacacactgctgggcaacgccaatggcgccacgtgcgcatttccctttaaatttgagaacaaatggtatgcggattgtacatctgcagggcgctcagacggatggctgtggtgtggaaccactactgactacgacacggacaagctgtttggctactgtccactgaagtttgaaggctctgaatccctctggaacaaagatcccctcaccagtgtctcttaccagatcaacagtaagtcagcacttacctggcatcaggcccgcaagagctgccagcagcagaacgcagagctactgtcaatcactgagattcatgaacagacataccttaccgggctaacttcgagcctaacatcagggctctggattggacttaatagcctgtccttcaacagcggctggcaatggtccgaccgttcccccttccgctatctgaactggttgccaggatccccctctgctgagcccggaaagagttgcgtgagcctaaacccgggaaagaacgcaaaatgggaaaatctcgagtgcgtgcagaagttgggatacatttgtaagaagggcaacacaactcttaactcttttgtcatccccagcgagagtgatgttcccacgcactgtccctctcaatggtggccctacgcagggcattgttacaaaatccatagagatgaaaagaagatccagagggatgcccttacgacgtgtcgaaaggaaggtggcgaccttacaagtattcatacgatcgaggagctggacttcatcatcagccagctaggatacgagccaaacgatgagctgtggatcggactgaacgatatcaaaatccaaatgtacttcgaatggagcgatggaacccccgtcacctttaccaaatggttgcgcggagagccctcccatgagaacaaccgccaggaggattgcgtggtgatgaaaggtaaggacggctactgggccgatcgaggctgtgagtggccactagggtacatctgtaagatgaaatctaggagtcaggggccagagattgtcgaggtggagaaggggtgtcgaaagggctggaaaaaacaccacttctactgctatatgataggacatactctaagcactttcgctgaggcgaatcaaacttgcaacaacgagaatgcatacttgacgaccatcgaggaccggtatgagcaggcattcctcacttcctttgtcggcctcaggccggagaagtacttttggaccggtctgagcgacatccagaccaagggcacatttcagtggacaatcgaggaggaggtacggtttactcactggaatagcgacatgcctggtaggaagcccggctgcgtggccatgcggaccgggattgcaggcgggctgtgggatgtgctcaagtgcgacgagaaggccaaattcgtgtgcaaacattgggctgagggagtgacccaccctcctaaacccacaaccactcctgagccaaagtgtcccgaggactggggagcctcctcacgtacaagtctgtgtttcaagctttacgcaaaggggaagcacgaaaagaaaacatggtttgagtctagagatttctgccgcgcgctcggcggagatttagcttccatcaataacaaagaagagcagcagaccatttggcgcctcatcacagcgtctggtagctaccacaagctgttttggctaggcttaacatatggctccccgtcagaggggttcacttggtccgacggatcaccagtttcctacgagaattgggcctacggcgagcctaataattaccagaacgtggaatactgcggtgaactgaaaggggaccccaccatgtcttggaacgatatcaattgtgagcatcttaataattggatctgccagatccagaaaggacagaccccaaagccagagccaactcccgcgccgcaagacaacccccctgtcacagaagacgggtgggtcatctacaaggactatcaatactacttcagcaaggagaaggagaccatggataacgcaagggccttttgtaagcggaattttggcgacctagtatcaatccagtccgagagtgaaaagaaattcctctggaagtacgtgaataggaacgatgcccagtccgcttattttattggattacttatcagcctggataaaaaatttgcctggatggacgggtccaaagtggactatgtgagctgggctactggcgagccaaactttgcaaacgaagatgagaattgcgtcaccatgtattccaattccggtttttggaacgacataaactgtgggtacccaaatgccttcatttgccagcgacataactcctccataaacgccaccaccgtgatgcctaccatgccgtctgtgccctcgggctgtaaagagggctggaatttctatagcaacaagtgctttaagatcttcgggtttatggaagaagaaaggaaaaattggcaagaggctagaaaggcctgtattgggttcggcggaaatttagtctctatccagaatgaaaaagaacaagcctttctaacatatcatatgaaggacagtaccttctctgcatggaccggcctgaacgacgtcaattccgaacatacattcctctggactgatggacggggcgttcactacaccaactggggcaagggatatccaggggggcgccgctccagtctaagctacgaagatgccgactgtgtagtgataatcggaggagcgagcaacgaggccggtaagtggatggatgatacatgtgattccaagcgggggtacatttgtcagaccaggtccgatccttccttgaccaatccacctgccaccatccagacagatggcttcgtgaagtacggaaaatcatcctatagcctgatgaggcagaagttccaatggcacgaggctgagacttattgcaagctgcacaacagcttaattgcttcaatattggacccatacagcaatgcattcgcctggttacagatggaaacatctaacgaacgggtgtggattgcactgaactccaatctcactgataaccagtacacatggacagacaagtggagggtgcgctacaccaactgggcagccgatgagcctaagttaaagagcgcatgtgtctatcttgacttggacggctactggaaaactgcccactgcaatgagagcttttatttcctatgcaagcgatctgacgaaatcccagcgaccgagccccctcagctacctgggaggtgtcccgagagcgatcatacagcttggatcccctttcacggacactgttattacatcgaatcgtcgtacactagaaactggggacaggcttctctggagtgtctgcgcatgggcagttccctcgtgtcaatcgagtcggccgcagagtcctcgttcctgtcataccgtgtcgaacctcttaaaagtaagactaatttctggattggcttatttaggaacgtagagggcacctggctctggatcaataacagtccggtgtccttcgtgaactggaacactggagacccctcaggagaacgtaacgactgtgttgccctccatgcatccagtggcttctggagcaacattcattgcagctcctataagggctacatttgcaaacggcccaagataattgatgccaagcccactcacgagctattgaccactaaagccgatactcggaagatggatccttctaagccaagctccaacgttgccggagtggttatcattgtgatcttgctgattctgactggcgcaggtctggctgcttacttcttctacaagaaaagaagagtacatctcccgcaagaaggagccttcgagaatacactctattttaattcccagtcgagccccgggacatcagacatgaaggatttggttggcaacatcgagcagaacgaacactccgtcatctag

SEQ ID NO: 123314 - DNA, 4440 bp, Artificial Sequence
  Description of Artificial Sequence: Synthetic coding sequence
atgggacccggccgaccagcgccagcgccttggccacggcacctgctgcgctgtgtgctgttgctgggctgcctacacctggggcgccccggcgcacctggcgacgcagctctgccagagcccaatgtgtttctgatattttcccatgggcttcaggggtgtctggaggcccagggtgggcaggtgagagtgaccccagcctgtaacacgagcctgccagctcagcgatggaaatgggttagccgcaacagactcttcaatctgggcacgatgcagtgtctgggcaccggctggcccggaacaaacacaactgcctccctgggaatgtatgagtgcgaccgggaagccttgaacctgcgttggcactgtaggacactgggggatcagctgtcgctgctgcttggcgccaggacctcaaacatctccaaaccaggaacactcgagcggggggaccagaccagatccgggcagtggcgcatctacggttctgaggaggacctgtgtgccctcccataccacgaggtgtatacaatccagggaaacagccacggaaaaccttgtaccatccctttcaaatatgacaatcagtggttccacgggtgcacaagcacaggacgcgaggatggacacctttggtgcgcgaccacacaggattacgggaaggacgagcgttggggattctgcccaataaagtccaacgattgcgaaactttctgggacaaggaccagctcaccgattcctgctaccaatttaatttccaatcaacattgtcatggcgagaggcctgggcaagctgcgaacagcagggcgcggacttactttccattacggagattcacgagcagacttacatcaacggactgctaacaggttactcttcgactttatggatcgggctgaacgacctggacacctctggcggttggcaatggtctgataactcccccctaaagtacctcaactgggagtctgaccaaccagacaaccccagtgaggagaattgcggcgtcatccggaccgagagcagcggcggatggcaaaacagagattgtagtatagcgttgccatatgtttgcaagaagaagcctaacgcaactgccgaacccaccccacccgacagatgggcaaatgtgaaggtggaatgtgagccttcttggcaacccttccagggacactgctatcgcttacaggctgagaaacggtcgtggcaggagagcaagaaagcgtgcctgcgcggagggggcgacctcgtgagtatccacagcatggcagagcttgagttcatcaccaaacagatcaaacaggaggtcgaagagctctggattggactgaatgacctcaaactgcaaatgaatttcgagtggtccgacgggagcctggtgtcctttactcattggcaccctttcgagcccaacaattttagggactcactggaagattgtgtgacgatctggggcccagagggacgctggaacgacagtccttgcaatcagtcactcccctccatttgcaagaaagccggccagctgagccagggcgccgccgaggaagaccatgggtgcaggaaagggtggacatggcactcgccctcgtgctattggctcggcgaagatcaggtgacttactccgaggcccggaggttgtgtacggaccacggtagccaactggtaactataaccaaccggttcgagcaggcttttgtgtcctctttaatttacaactgggagggcgagtatttttggacagccctccaggacctaaattccaccggaagttttttctggctgtcaggtgatgaggtcatgtacacacattggaaccgggaccagccaggttatagcagaggcgggtgcgtcgccctggctacgggttccgcaatgggcttgtgggaggttaaaaattgtacatctttccgcgcaaggtacatttgtcggcagagcctgggtacgccagtgacccctgaattaccgggacctgacccaaccccatcacttacagggagctgtccgcagggatgggcgagcgataccaaactgcgctactgctacaaagtgtttagctctgaacgcttgcaggacaagaagagctgggtgcaggcccagggcgcctgtcaggagctcggtgcacaactgctgagtctcgcaagctacgaagaggaacattttgtagccaatatgcttaacaaaatcttcggtgagagcgaacctgagatccacgagcagcattggttttggatcggcctgaacagaagggatccacgaggtgggcaaagctggagatggagcgacggcgttgggttctcttaccataatttcgacaggagccgtcacgacgacgatgatattagaggctgcgcagtgctcgatttggctagcctgcagtgggtggcaatgcaatgtgatactcagttggactggatttgcaagattccaagagggacagacgtgcgtgagcccgacgattccccacaagggcgtagagaatggctgcgatttcaagaagccgagtataagttctttgagcatcactccacctgggcccaggctcagcgtatctgtacgtggttccaggctgagctgacttcagtgcactcccaggccgagctagatttcttatctcacaacctccagaaattcagccgggcccaggaacagcactggtggattggcctgcacacttctgagtccgatggccgctttcggtggaccgatggcagcattatcaacttcatctcctgggctccaggcaagccgcggcctgtaggaaaagataaaaagtgtgtgtatatgactgcatcacgcgaggactggggtgatcagaggtgtttgaccgctctcccatacatttgcaagcggtcgaacgtcaccaaagaaacacagccaccagacctgccgaccacagcgcttggagggtgccctagcgattggattcagttcctgaataagtgctttcaggtccagggccaggaaccacagtcccgtgttaagtggagcgaggcacagttttcttgcgagcaacaggaggctcaactcgtaaccatcacaaaccccctggagcaagcattcatcaccgcttctctgcctaacgtcacattcgacttgtggataggacttcacgcaagccagagagactttcagtgggtagagcaggaacctctgatgtacgccaattgggcaccaggagagccctccgggccatcacctgcaccatccggaaacaagcccacaagctgcgcagtggtgctacactctccctctgctcatttcacaggccgatgggacgataggtcttgtaccgaggagacccacggttttatatgccagaaagggacagatccgtctctgtccccatcccccgccgctttgccacccgccccaggtacggagctttcctacctcaacgggaccttcagacttttacagaagccgctgcggtggcatgacgctctcttgctctgcgaatcccgaaatgccagtctagcttacgttcctgatccatatacacaggccttcctgacccaggccgcaagaggccttagaactcccctgtggatcggactcgcaggtgaggaggggagtagaaggtacagctgggtgtcagaggagcccctgaattatgttggctggcaggatggggagccacagcagccaggcggttgcacatatgtggatgtcgatggtgcatggaggacaactagctgcgataccaaattgcagggcgctgtttgcggagtgagctcaggtcctcctcccccaagacgtatctcctaccacggcagctgccctcagggcttggctgattctgcttggatcccctttcgggagcactgctacagctttcatatggaactgctcctgggacacaaggaggcaagacagaggtgtcagcgcgcaggcggcgcggttctttccattctggatgagatggagaacgttttcgtgtgggagcaccttcaatcctacgaaggtcagagccgaggcgcttggctgggcatgaatttcaacccaaagggtgggaccctagtctggcaagacaacactgccgtgaattactctaactggggaccgccaggactgggcccttctatgttgtcccataacagttgctactggattcagtcgaacagtggcctgtggcgcccgggggcgtgcactaacattaccatgggagtggtttgtaagctcccccgggcagagcaatcatccttctccccatcagcccttcccgagaatccagctgctctagtggtagttctaatggcggtcctgctgctgttagctctgctcacggctgccctgattctctacagacggagacaatcgattgagcgcggcgccttcgaaggggcacgctattctcgtagttcaagttctcccaccgaagccacagaaaagaatattcttgtgagcgacatggaaatgaacgaacagcaggagtag

SEQ ID NO: 123315 - DNA, 1038 bp, Artificial Sequence
  Description of Artificial Sequence: Synthetic coding sequence
atgcccactgggcatctgggctcaccactcgctctggccctgctccctgtggccacaaaccggccggccgtacaatggtcgtgcactgctcctcagccaactagcctagccgctggcaccattggcgcagcccggcggcgacccatggcctcctccgcaaggagagctaggggctctcggcggtactcctgggtgagtgaggagcctcttaattatgtcgggtggcaagatggtgagccccagcagcctggaggctgcacatatgttgacgtggatggagcctggaggaccacctcatgcgacacaaagttgcagggcgcagtatgcggagtgtcatcaggcccccctcctcccagacgaatttcctaccatggatcttgtccccaagggctcgccgacagcgcctggattcccttccgggaacactgctacagtttccatatggaactcctgcttggccacaaagaagcaagacagaggtgccagagagctggtggtgccgtcctgtcaatcttggacgaaatggagaacgtgttcgtgtgggagcacctacaaagctacgagggtcagtcgagaggggcgtggctggggatgaacttcaatcccaaaggcggaactctggtgtggcaggacaacacggctgtgaactattctaactggggtccacctggtctgggaccaagcatgctgtcccataatagctgttactggatacagtcaaatagcgggctttggcggcctggggcctgtaccaacatcaccatgggagtggtctgtaagctgccacgggctgagcaatcatcatttagcccctccgctcttcccgaaaacccagccgctctggtcgtcgttcttatggctgtgcttctcttgttggccttgctcactgccgctctgattctatacaggaggcggcagtcaatagagagaggggcttttgagggggcacgatattcaaggagctcgtcaagtcccacagaggccaccgagaaaaacatattagttagcgatatggaaatgaacgaacaacaagagtag

SEQ ID NO: 123316 - DNA, 834 bp, Artificial Sequence
  Description of Artificial Sequence: Synthetic coding sequence
atgttcccgttttactcatgttggcgcactggtttactgttacttctgctggcggtcgcagtgagagagagctggcagacagaggaaaaaacatgcgacctggtaggagagaaagggaaggaaagtgaaaaggagttagcccttgtaaagcgcttaaagccattgtttaacaagtccttcgaatccacggttggccagggctctgacacatatatttacatttttagagtctgcagggaagccggaaatcataccagtggagctggcctggttcagatcaacaagtccaatggaaaagaaacagttgtggggcgcttgaatgagacccacatctttaatggctctaactggatcatgttgatttataagggaggcgacgagtacgacaatcactgcggaaaagagcagcgccgagcagtggtcatgatctcgtgcaaccgccataccctggcagataattttaaccctgtgtcagaagagagaggaaaggtacaggactgcttttacctattcgaaatggatagttccctagcatgtagccctgagatcagccacttgtctgtcggcagtatcctgcttgtgactttcgccagcttagtagcagtatacgtggtcggtggctttttgtaccagcgcctggtggtcggtgcgaagggcatggaacagttcccacacttggcattttggcaggacctgggaaatctggtggcggatggatgtgactttgtctgccgaagcaagcctaggaatgtgcctgctgcttaccgaggtgtgggggatgaccagctcggggaggagtccgaagagagagacgatcacctcctgcccatgtag

SEQ ID NO: 123317 - DNA, 279 bp, Artificial Sequence
  Description of Artificial Sequence: Synthetic coding sequence
atgttccccttttattcatgttggcgcactggcctgctccttctgctgttagccgtggcagtgcgtgaaagctggcagacagaggaaaagacttgcgacctggtgggggagaagggcaaggaatcagagaaagaattagctctggtaaagcgcctgaaacccttattcaataagtctttcgagagcaccgtgggccagggctcagacacatacatctatatttttcgagtatgtcgggaggctggaaatcacacctctggcgctggtcttgtccagtag

SEQ ID NO: 123318 - DNA, 330 bp, Artificial Sequence
  Description of Artificial Sequence: Synthetic coding sequence
atgtttcctttctattcctgctggcgcactggcctgcttctcttgcttctggcggtggccgtgcgagaatcttggcagaccgaagagaagacatgcgatttggtcggcgagaagggcaaggagtccgagaaggagctggccctagtcaagcgactcaagcccctattcaacaagagctttgagagcactgtcggacagggatcagatacatacatctatatatttagagtctgtcgtgaagccgggaaccatactagcggagccggccttgttcagattaacaagtcaaacgggaaggagacagtggttggccgactgaatgaaacctag

SEQ ID NO: 123319 - DNA, 747 bp, Artificial Sequence
  Description of Artificial Sequence: Synthetic coding sequence
atgtccctcttcccaagtttgcccctgctcctgctgtccatggttgctgcttcctattccgaaaccgtcacttgcgaagacgctcaaaagacttgtcctgcagtgatcgcatgcagtagtccaggcattaacggctttcctggtaaagatggccgggacggcaccaaaggggagaagggtgagcctggccaggggctgcggggactgcagggcccgcctggaaagctcggcccccccggtaaccctgggcctagtggctcccccgggcccaagggccaaaaaggcgaccctgggaaatcgcctgatggcgacagtagcctggctgcctcagaacgtaaggccctccagaccgagatggcccggattaaaaagtggctgacatttagcctaggaaagcaggtgggaaacaaattcttcctgactaatggagaaattatgaccttcgagaaggtcaaggccctttgtgttaagtttcaggcctccgtcgcaaccccgcggaacgcagcggaaaatggcgcaattcaaaaccttattaaggaggaggcctttctgggcattacggacgaaaaaactgagggccagttcgttgatttgacagggaaccggctgacttataccaattggaacgagggggaaccaaacaacgctggtagtgatgaagactgcgtgctgctcctcaaaaatggtcagtggaatgacgtaccatgctccacctcacacctggcagtctgtgagttccctatctag

SEQ ID NO: 123320 - DNA, 744 bp, Artificial Sequence
  Description of Artificial Sequence: Synthetic coding sequence
atggctgcagaggccgatgggccgctgaaacgactgttagtgcccattctcctgcctgagaaatgctatgaccagctgttcgtgcagtgggatcttctgcatgtgccatgtctgaagatcctgctaagcaaagggctggggctcggtatcgtcgctgggtcccttctggttaaattaccgcaggtgttcaagatcttaggcgcaaaatcggcggaaggactgtccttgcagtccgtgatgcttgagttggtggccctgaccgggaccatggtctacagcattacaaacaacttccccttctcaagctggggcgaggctctcttcctgatgctgcagaccattacgatctgttttctcgtgatgcactacaggggccaaaccgtaaagggcgttgcatttctggcatgctatggactcgtgctgttggtactgctgtcaccgcttacaccactcaccgtcgtgaccttgctgcaggccagcaatgtgcccgccgttgtcgttggaagactgctgcaggctgccaccaactaccataacgggcacaccggccaactatccgcgatcaccgttttcttgctgttcggtgggtccctagcccgaatctttacttcaattcaggagaccggcgatccactcatggcaggcacgttcgtcgtgagttcactatgcaacggtcttatcgccgcccaactgttgttttactggaacgccaagcccccccataagcagaagaaagcacagtag

SEQ ID NO: 123321 - DNA, 381 bp, Artificial Sequence
  Description of Artificial Sequence: Synthetic coding sequence
atggccgccgaggccgatggtcccctgaaaaggcttctggtgcctatcctcctgccagagaagtgctatgaccagctgtttgtgcagtgggacctgctgcacgtgccttgtctcaaaattctcctgtccaaaggtctcggcctgggcatcgtggccggaagcctgttagttaaacttccccaagtgttcaaaatcttgggggccaaatccgctgctggcttaaaaaaagaagatgaggcacggccagtacggagcgcatcaatgcgagtgagagggggtctcggagcatggggacaccaacagggtgaagggtgcatggagtgggagagccagggcgccggatccggatatcggtgggcagctgtaccaccaggcgcatag

SEQ ID NO: 123322 - DNA, 900 bp, Artificial Sequence
  Description of Artificial Sequence: Synthetic coding sequence
atggctgccgaagctgatggacctcttaagaggctactcgtacccattttgctccctgagaagtgctacgaccaactgttcgttcagtgggacctattgcatgtcccatgtctgaagatcctgctgagcaaaggcttgggacttggcatagtagccggtagcctgttagtcaaattgccccaggtttttaaaatactcggcgccaaatcagccgaaggattaagcctccagtctgttatgctagagctggtggcattaactggaacaatggtatattctataaccaataactttccattctcaagttggggagaggccttatttctgatgctccagaccatcactatttgctttttggtcatgcactataggggacagactgtgaaaggagtagccttcctggcttgctatggcctcgtgttgctcgtcctcttatcaccactcacacccctcacggtggtgccgtgctccggactgcagtgcgcgtgttgcgggggcggcgaggcttcgccaggctcccaccagttgcctcaaagagctcatcgacctgccctgagccaccactcacttccagctgtctgggggctaccagggcccaatttgcacttccactcaggaaatcggcggtctcctgacggttgggatctctgtggcctcctgtcactgcagaggccgcaccgacgccccgcagccctgttgcttgagtgtaaggcctctccacaggccgagaaaggagccgtggagcccgccacaggcgtgataccttttcccctgattcatccaacatcaggcttcagcccatccgagcccgcctgctggtgcgacttactaatccttcacagcagtgcacttgctgatttcctttcccagggattcctcctcgtggagacgaacggctag

SEQ ID NO: 123323 - DNA, 636 bp, Artificial Sequence
  Description of Artificial Sequence: Synthetic coding sequence
atggccgccgaggcagatggccctctgaaacgcctgcttgtgcctattctcctcccggaaaagtgctatgatcaactcttcgttcagtgggacttgctgcatgttccttgtttgaaaattttattgtccaagggactaggcttgggcatcgtggctggtagtttgttagttaaattgccacaagtgttcaagattctgggcgcgaagagtgcggaaggcctgagtttgcagtctgttatgctggaactcgtggcattgaccggaacgatggtctactcaattacaaataactttcctttttcctcatggggtgaggccctgttcctgatgctgcagactattaccatttgcttcctagtgatgcactatcgtgggcaaacagtgaagggagtcgccttcttagcgtgctacggactggtgctccttgtgctcctgagtccactcacccctctgaccgtggttaccttgcttcaggcatcaaacgtgcctgcggtcgtcgtggggcgactgctgcaggcagcaaccaataccacaaccggtacccaggccagcagccagccatcacagagcagctgctgcttgggcgcaccatggccggaaagtagtctgccgttccgaaagccagaaattccctag

SEQ ID NO: 123324 - DNA, 561 bp, Artificial Sequence
  Description of Artificial Sequence: Synthetic coding sequence
atggcggccgaagcagatggacctttgaagcggcttctggtcccaatcttgctgcctgaaaaatgctatgatcagttgttcgtgcagtgggaccttctgcacgttccatgcttgaaaatcttgctgtcaaaaggtctgggactcggcatcgtcgctggatcattgcttgtgaaactgccccaggtttttaagattctgggagcaaagagtgccgagggtctttcattacagtctgtcatgttggaattagtggccctgacagggacaatggtgtactctatcactaacaacttcccctttagatgtagatttccaagactcctgaggcccggaccagcaggcgcgtcacttacttcagatgctctggattgtagccacccagctcctggcttacagtgtgcctgctgcggcgggggggaggcctcccccggcagccatcaacttccacagagagcacacagacccgcactcagccaccattctctgcccgctgtgtggggcctgccaggccccaacctgcacttccacagcggcgtgagtatcccgttttctcagctctag

SEQ ID NO: 123325 - DNA, 2826 bp, Artificial Sequence
  Description of Artificial Sequence: Synthetic coding sequence
atggcggctgcacctgccctgaaacactggcggaccacactcgaacgggtcgaaaagtttgtttctcctctgtattttaccgattgtaatctcagaggtcgcctgtttggagcatcttgcccagtggctgtgctcagcagcttcttaactcccgagagattaccctaccaggaggctgtgcagcgagacttcagaccagcccaggtgggtgatagcttcgggcctacgtggtggacttgctggtttagggtggagctcacgatacctgaggcttgggtggggcaggaggtgcatctctgttgggaaagcgacggtgaagggttagtctggagagacggggaaccagtgcaaggactgacaaaagaaggcgagaaaacatcctacgttcttaccgatcggctaggcgagcgggatcccagaagtctcactttgtacgttgaggtggcatgcaacggactactcggcgctggcaagggctccatgattgctgcgcccgaccctgaaaagatgttccaattaagccgagcagagctggcagtgtttcaccgggacgtgcatatgcttctggtggatctcgaactccttctgggaatcgctaaagcgcaacagctggagtgggtcaaatcgaggtacccaggactgtactcccgaatccaagagtttgcttgtagaggacagttcgtccctgtgggcggtacttgggtggaaatggatggcaacttgccttcaggtgaggccatggttcggcagtttttgcagggtcagaatttcttcttacaggagtttggaaaaatgtgctctgagttctggcttcccgacacttttggttattctgctcagctgccacagattatgcatgggtgcggtattcgacgcttcttgacacaaaagctgagctggaacctagtcaactctttccctcatcacactttcttttgggagggtctggacggatccagagtgctggtacactttccccccggcgactcatacgggatgcaaggaagtgtggaggaggtgcttaaaacagtggctaacaacagagataagggtcgggccaaccattcagccttcctcttcgggttcggtgacggagggggtgggcctacccagactatgttggataggcttaaacggctatctaataccgatggcctccctcgagtgcagttatctagtcctcggcagttgttttcagcattggaatcggatagtgagcaactgtgcacatgggtgggcgagctgtttctggagctgcataacggcacatatactacacacgcccagattaaaaaggggaatcgggagtgcgagagaatacttcatgatgttgagctgctatcctcattggcccttgctagaagcgcgcagtttctttacccagccgcacagctgcaacacctatggagattgttgctgcttaatcagtttcacgatgtggtcaccggatcctgtattcagatggtcgcagaagaggctatgtgccactacgaggatataaggtcccatggtaatacccttctgagtgcagctgccgccgccctttgcgctggcgaaccagggccggagggactactgattgtcaacactttaccttggaaacgtatcgaggtgatggcactacctaagcccgggggagcgcattctctcgcacttgtcacggtaccttcaatgggctacgctccagtcccccctccaaccagcctgcagcccctgctcccacaacaacctgtgttcgtggtacaagagactgacggttccgtcaccctcgacaatggtataattagggttaagctggacccaacaggccggctaaccagcctggtgctggtggcatcaggtcgcgaggcaatcgctgaaggagcagttgggaaccagtttgtgcttttcgatgatgttcccctgtattgggacgcgtgggatgttatggactatcacctcgaaacaagaaagcctgttttaggacaggccggcacgcttgccgtggggacggagggcgggctgcggggatcagcttggttccttctccagatttccccgaattcaagactcagccaagaggtagtgctcgacgttgggtgtccttacgtgcgtttccacacggaagtgcactggcacgaagctcacaaattcctgaaagtggaatttcctgcaagggtgagaagctcgcaagccacgtacgagattcagttcggacatctccaacggcccactcactataatacatcgtgggattgggcccggttcgaagtgtgggcccaccggtggatggatcttagtgaacatggcttcggccttgcactcttgaatgactgcaagtacggcgccagtgtcagaggatcgatcctgagtctgtcccttctgagagcacccaaggccccagatgccacggctgatacgggcagacacgagttcacctacgccctaatgcctcacaagggttcatttcaggacgccggggtgatccaggccgcttatagcttgaattttcctcttctcgccctgcccgcaccctcccctgcaccagctacctcctggagtgccttctctgtttctagcccagccgtcgtcctggagaccgttaagcaggctgaatcttctccccagcgtagatctctggtactccgcctttacgaagcccacgggtcccacgttgactgctggttgcatctttctttgcctgtccaggaagcaatcttgtgtgacctgctggaacgtcctgaccctgccggtcatctgactctgagagacaacagactaaaactcaccttcagccccttccaagtgctgagcctgctgctggtgctccaacctccgccacattag

SEQ ID NO: 123326 - DNA, 3174 bp, Artificial Sequence
  Description of Artificial Sequence: Synthetic coding sequence
atggcagccgcgcccgccttaaaacactggcgaacgactctggaaagggtagagaagttcgtcagtcccttgtactttaccgactgcaatcttagaggacggcttttcggcgcctcttgtcccgtcgcagtcctcagttcatttttgacccctgaaaggttgccataccaggaggccgttcagcgggatttcaggcccgctcaagtgggggacagcttcggtcctacttggtggacttgctggttccgggtggaactcaccattcccgaggcttgggttggccaggaggtacatctgtgctgggagtccgacggcgagggcctagtgtggcgcgacggggaacccgtacagggtcttaccaaggagggcgaaaagacttcatacgtccttacagataggctcggcgaaagggacccaaggagccttaccctgtacgtggaagtggcctgcaatggcttacttggcgccgggaaagggtccatgatagcagccccagacccggagaagatgttccaactgtcacgggctgaactcgccgtgttccaccgagacgtacatatgctcctggttgacctcgaactcttactgggtattgctaaagggctaggaaaggacaaccagaggtcattccaggctttatatactgccaatcagatggtgaacgtctgcgatcctgcccagccagagacctttcctgtcgctcaggctctggccagccgctttttcggtcaacatggcggtgagtcccaacacactatacacgctacagggcactgtcatattgatacagcatggttatggccgtttaaggaaaccgtaaggaaatgtgctcgctcctgggtgaccgctttacagcttatggaacggaacccggagtttatcttcgcctgtagtcaagcacaacaactggagtgggtaaagagtcggtaccccggactgtacagccggattcaggaatttgcttgcagagggcagtttgtgccggtgggtggaacgtgggtcgagatggacggaaatcttcctagcggggaagctatggtgcgacaatttctccagggacagaactttttcctgcaggagttcgggaaaatgtgctccgagttctggctgccagacacgttcggctattccgctcagcttccccagatcatgcatgggtgcggcataagacgatttttaacccagaagctcagttggaatctggtaaactcattccctcaccatacgtttttctgggaaggcttggacggttcccgagtgctggtacatttccctcccggtgactcctatgggatgcagggtagcgtggaggaggtgctgaaaactgtggctaataatagggataagggaagggccaatcactccgcatttctgttcggctttggtgatggcggcggagggccgacacagactatgctcgatcgcctgaaaaggctctcaaatacggacggactgcctagagtgcagctgtcatcacccaggcagctatttagcgccctggagtccgactccgagcagctgtgtacatgggtgggagaactctttttggagttacacaatggcacatataccacccacgctcagataaaaaagggaaaccgcgaatgtgagcgaatactgcacgatgtggaacttctgtctagcttagctttggcccggagcgcccagtttttgtatcccgcagcgcagcttcagcacctatggcgtctcctcctactaaatcagttccacgacgtcgtgactgggagttgcatccagatggtggccgaggaggcaatgtgtcactacgaggacattcgctctcacggcaatactctgctgtctgctgccgccgctgccctgtgtgcaggagaaccgggccctgaagggttgctgatagttaacacactgccctggaagcgtatcgaggtgatggccttaccaaagccaggtggggcacattcactgggcctgacacctagtcccggggactccgcccagcacggcttatgctcctgcagctcccctcacctcaccgcggccccggccgctccagctgcttgtgttcgtagcgctcgagcgccgaccgattccgcgtcccggccgccccccaccaaaactgacggctcagtcacactcgacaacggaatcattagagtgaagttggaccccacaggccggctaacgagccttgtactggttgcctcgggaagggaggcaatcgcagaaggagccgtcgggaaccagttcgtgctatttgatgatgtgccactctactgggatgcatgggacgtgatggattatcacctggagacccgcaagcccgtgctgggccaggcaggcaccttggccgtgggcacagaaggggggttacgggggtccgcttggtttctccttcagatctcacccaattcacggctgtctcaggaggtagtcctcgatgtgggatgcccttacgtgaggtttcataccgaggtgcactggcacgaagcccacaaattcctcaaggtagagtttccagcccgcgtgcgtagcagccaggccacatacgaaattcagtttggccatctgcagagaccaacacactacaacacgagttgggattgggccaggttcgaggtgtgggctcatcggtggatggacctcagtgaacacgggtttggcctggccctacttaacgattgtaaatacggagcatcagtgaggggcagtatactgtctttgtccctgttgcgtgcccctaaagcaccggacgcaactgccgatactggcagacacgaattcacctacgcattaatgccacacaaggggtccttccaggatgctggggttatccaggcggcttacagcctcaatttcccactgctggctttacctgctccatctcccgcgcctgccaccagctggagcgccttttctgtgtcttcgccggccgtagtcctcgagacagtgaagcaggctgagagtagtcctcaacggcggtccttggtgctgagattatacgaagcccacggcagccacgttgactgctggctgcacctttccctcccagtgcaggaggcaatattatgcgacctgttggagaggccagatcctgccggccacctcaccttgcgcgacaatagattgaagctgaccttcagtccattccaggtgttgagcctgcttcttgtgctgcagcccccaccccactag

SEQ ID NO: 123327 - DNA, 3054 bp, Artificial Sequence
  Description of Artificial Sequence: Synthetic coding sequence
atggctgcagcccccgcgctgaaacattggagaactaccctcgagagagttgaaaagtttgtttctcccctgtacttcaccgactgtaacctgaggggccgtctcttcggggcaagttgtcccgtggccgtcctgagctcctttctcacacctgagcgactgccgtaccaggaggcagtccaaagggactttcggcctgctcaggtaggtgattccttcgggccaacatggtggacttgctggtttagagtggaactgaccatccctgaagcctgggttgggcaggaagtccatttgtgctgggaaagcgacggcgaagggctcgtgtggcgggatggagaacctgtgcagggtctgactaaggagggcgagaagactagctatgtattaaccgacagattaggagagcgcgatcctagaagcctgactctctatgtggaggttgcgtgtaacgggctgctgggggccgggaagggcagcatgattgccgcgcctgacccagagaaaatgtttcagctttccagagccgaattagccgtgtttcatcgcgacgtgcacatgctgctggttgacctagagctgctattgggtatcgctaagggtctggggaaggacaatcaaagatctttccaagcactgtacactgctaatcagatggtgaacgtgtgcgatcctgcccagccagaaaccttcccagtggctcaggcacttgccagccggttctttggccagcacggcggcgagagccagcataccattcacgctacgggccactgccacatcgacacagcgtggttatggccctttaaagagacggtccgcaaatgcgctcggagctgggtaaccgccctgcaattaatggagaggaaccctgaattcatctttgcctgtagccaggctcagcagctggagtgggtgaaaagtagatatcctggactgtactcacggattcaggaattcgcatgccggggtcagtttgttcccgtcggagggacttgggtggagatggacgggaatctgccaagtggcgaggccatggtgcgacaatttctccagggccagaatttttttctgcaggagtttggtaaaatgtgttctgaattctggttgccggatacttttggctatagtgctcagctgccccagattatgcatggctgcgggataaggaggtttcttacacagaagctgtcctggaacctggtcaactctttccctcaccacactttcttttgggaaggtctggatggctcaagggtactcgtccactttcctcctggggattcctacggaatgcagggctccgtcgaagaagtcctgaagacggtagcgaataaccgggacaaaggccgggctaatcactccgcatttctgtttggctttggcgatgggggcggcgggcctacgcagaccatgctggatcggctgaaacggctgagtaataccgatggcctgccccgggtacaactgtcttcacccagacagctattcagcgcgctggagtctgactctgagcagctgtgcacatgggtgggtgaattgtttctcgagcttcacaatggcacttatactactcacgcacaaattaagaagggcaacagagagtgtgagcggatcctgcacgacgtagaactgctttcgtccttagcattggctagatctgctcaatttctatatccagccgctcagctacagcacctatggcggcttctgttactgaaccagttccacgatgtggtgacgggctcatgtatacagatggtcgctgaggaggccatgtgtcattacgaagacattagatctcatggcaacacactcctcagtgcggccgctgccgcactctgtgcgggagagcctggacccgaaggactgctgatcgtcaatacactgccttggaaacggattgaggtcatggctctgcccaaacccggaggtgcccacagcctcgccttggtgacagtcccctccatgggttacgcgcccgtcccaccaccgaccagcttgcaacctctgctcccccagcagcccgtcttcgtcgtacaagaaactgatggctccgtgactctggacaacggtatcataagggttaagctagatcctacggggcgtctaacgtcactagtgcttgtggcctcaggccgtgaagccatagccgaaggagctgtggggaaccagttcgtgctcttcgatgacgtgccgttgtattgggatgcgtgggacgtgatggattaccacctggagactaggaagcctgtgctggggcaggccgggactctagctgttggaaccgagggcggtctcagaggatcagcctggttcctgctccagataagtccaaactcacgcctgagccaagaggtcgttctcgacgtggggtgtccatacgtgaggttccacaccgaggtccattggcatgaggcacacaagtttctgaaagtagaattccccgccagagtgcgatccagtcaggccacgtatgaaatccagttcggtcatctgcaaagaccaacccactataatacctcttgggactgggctcgttttgaagtgtgggcccaccggtggatggacctttctgaacacggcttcggcctagccctgctgaatgactgcaagtatggggctagcgtccgcggctccatactgtcgttaagcctattgcgtgcccctaaagcccccgatgccacagctgataccggacgacacgagtttacttacgccctgatgcctcacaaagccccttcacccgcaccagcgacctcatggtccgcttttagtgtttcaagcccggccgtcgttctggagacagtcaagcaagcagaatccagccctcagcggcgctcattagtgttacggctttacgaggcccatgggagccacgtggattgttggctgcacctctcccttccggtgcaggaggctatactgtgtgaccttcttgagagaccagaccccgccgggcacctgacacttagggataatcgcctgaaactcaccttctccccctttcaggtgctgagtctgctgctcgtgctccaacccccaccccactag

SEQ ID NO: 123328 - DNA, 1104 bp, Artificial Sequence
  Description of Artificial Sequence: Synthetic coding sequence
atgcctgtgggaggtctgctgcctctgtttagttctcccgcgggtggagtattgggcggtgggctgggagggggcgggggaaggaaaggtagtggcccagcggcattgcgcctgactgaaaagttcgtgctcttgctggtgttctccgcgtttattacactctgttttggcgcaatcttctttttgcccgacagcagtaaattactgtcaggcgtgctgttccacagtagtcctgcactccagccggctgccgaccacaagcccggccctggggcccgcgcggaggacgctgcggaggggcgggctaggagaagggaagagggagcccccggtgaccccgaagccgccttggaggacaacttagcccgcattagggagaaccacgagcgcgcacttagagaggcgaaggagactctccagaaacttcccgaggaaattcagcgggacatcctgttggagaaaaagaaggtggcccaggatcaactccgtgataaagctccattcagagggctcccacccgtagatttcgttccccccatcggcgtcgaatcgcgcgagcccgccgacgccgcgatccgggaaaaacgagccaaaatcaaagaagaaattgaggctagaaagggacaggccaactgtcctggatccagctcatcttgcgaggttgaaatccagatgatgaagcacgcatggaacaactataaagggtatgcctggggcctgaatgaattaaagccaatctctaaaggcggacatagcagtagcctgttcgggaacatcaaaggagctacaatcgtcgacgcactggatacactgttcatcatggagatgaagcacgagttcgaggaggcaaagtcatgggtggaagaaaaccttgattttaatgttaacgcggagatatctgtatttgaggttaacatacggtttgtgggaggtctgctcagcgcctattaccttagcggggaagagatctttaggaagaaagcggtcgaattgggggtgaaactcctgcccgcattccatacgccaagcggcatcccttgggcccttctgaacatgaagcgttggatgtgcaacattccccgggccatggaagccaccatctag

SEQ ID NO: 123329 - DNA, 1962 bp, Artificial Sequence
  Description of Artificial Sequence: Synthetic coding sequence
atgcctgtaggtggcctcctacccctgttctcctcacccgcggggggcgtcttgggcgggggcctgggggggggcggtggacggaaaggcagtggccctgcagccctccggctgacagaaaagtttgtgcttcttctggtattttcggcatttatcactctgtgtttcggcgcaatcttcttcctccctgacagctcgaaactcctgagcggagttttgttccattcaagtcccgccttacaacccgctgccgatcataagcctggccctggggcccgggccgaagacgccgctgaaggaagggcgcgacggagggaggagggggccccgggagacccggaggcagctttagaggacaatctggcgcgtatcagggaaaaccatgaaagagcattacgcgaggccaaggaaaccttgcaaaaactgccagaggaaattcagcgcgatatcttgcttgagaagaaaaaggttgcccaggaccaactccgggacaaggcaccctttagaggactgcctcctgttgactttgtgccgccaataggggttgaatccagagaaccggctgatgctgccatacgggaaaagcgcgctaagatcaaggagatgatgaaacacgcctggaataattataaggggtatgcctggggactgaatgaactcaagcctatatccaaaggaggccatagttcttcgctgttcggtaatatcaaaggcgccacgatcgtcgatgcgctggatacactattcatcatggaaatgaaacacgagtttgaagaggccaagtcgtgggtggaagagaatctggattttaatgtgaacgccgaaatcagtgtgttcgaagttaacatccgctttgtaggcggcctcctgtctgcatattatctgtctggggaggaaatctttaggaagaaggccgttgagctcggtgtcaagttattgccggcgttccataccccctcagggattccctgggccctattgaacatgaagtcaggaatagggcgcaactggccttgggctagcggaggaagtagcattcttgcggagttcggcactcttcacctggaatttatgcatctctcacacctgagcggaaatcccattttcgcagagaaagttatgaacatcaggaccgtcttaaacaaactcgaaaaaccccaaggactctaccccaactaccttaatccttcttcagggcagtggggccagcatcacgtgtcagtgggtggcctcggagatagtttctatgagtacctcctgaaggcatggctgatgagcgacaagaccgacttggaagcaaaaaaaatgtattttgacgcagttcaagccattgagactcaccttatccgcaagtcgagcagtggactcacgtacatcgccgagtggaaaggaggactcttagaacacaaaatggggcaccttacatgtttcgccggtgggatgttcgcactgggtgcggacgctgctccagaaggtatggcccaacattacttggagttgggcgctgagatagcccggacatgtcatgaaagttacaacaggacattcatgaagctcggcccagaagctttcaggttcgacggtggcgtagaagcgatcgctactcgccaaaacgaaaaatactatatcttaagacctgaagtgatggaaacgtacatgtatatgtggcgattgacacatgatccaaagtaccgcaagtgggcatgggaagctgtggaagcactggagaatcactgtcgcgtcaacgggggatactccggccttcgggacgtataccttttgcacgaaagttatgacgacgttcagcagtcatttttcttagcagagactctgaaatatttgtacttgatcttcagcgacgacgatttgctccccctcgagcattggatatttaattcagaagcacacctgctgcccatactgccgaaagacaagaaggaggtagaaattagagaggagtag

SEQ ID NO: 123330 - DNA, 579 bp, Artificial Sequence
  Description of Artificial Sequence: Synthetic coding sequence
atgttcgctctgggggcagatggatctagagctgacaaggcaggtcattatctggagctgggtgccgaaatcgcccgaacttgtcacgagtcttacgatagaacagcactcaagctggggccagaaagtttcaagtttgacggcgctgtcgaggcagtggccgttagacaagcggaaaagtactacatactgcggccggaggtcattgaaacctactggtatctgtggcgatttacacatgatcccagataccgtcagtgggggtgggaggccgccttggcaatagagaagtattgtcgtgtgaacggtgggttcagcggcgtcaaagacgtctattcatcaacgcccacccatgatgacgtgcaacaaagtttctttttggctgaaactcttaagtacctttacctactattttctggcgatgatctgttgcctctcgaccactgggtgtttaacactgaagcccatccgctgcccgtgctgcatttggccaacaccacacttagtggcacgtctcaaggcatgagaagacagaatccatacttccaggtgttgtacctgtattatcctgacgactag

SEQ ID NO: 123331 - DNA, 1926 bp, Artificial Sequence
  Description of Artificial Sequence: Synthetic coding sequence
atgacaaccccagcactgctcccactaagtggtcgccggattccacccctgaatttgggtccaccctcgtttccccatcacagagcgacactcaggctttccgagaagttcatactgttacttatactcagtgctttcatcactctgtgctttggcgccttctttttcttgcccgacagctcaaagcacaaaaggtttgacctcgggctggaggatgtgctcatcccgcatgtggacgccggaaaaggtgccaaaaacccaggcgtttttctcatccacggtcccgacgagcatcggcatcgcgaggaggaggagagacttagaaataagattagggcagaccatgagaaagcgttagaggaggccaaagaaaagctgcgcaagtcaagagaagagattagggcagagattcagactgagaagaataaagtggtgcaggagatgaaaattaaggaaaacaaacctctgccacccgtcccaatcccaaatttggttgggatccgggggggggaccccgaagacaatgacattcgcgagaagcgggaaaaaattaaagaaatgatgaaacacgcctgggataactatcgtacgtacggctggggtcacaatgaattaaggcccatcgctcggaaagggcactctcctaacatttttggctccagtcaaatgggagctactatagtagacgcacttgacacactctacataatgggtctgcacgatgagttcctggacggacaaaggtggatagaggataatcttgattttagtgtcaatagcgaggtttctgtgtttgaggttaatattcgattcatcgggggccttctggccgcttactacctctccggcgaagaaatttttaaaataaaggccgttcagctcgccgagaaactcctacccgctttcaatacccccactggcattccttgggcaatggtgaatctgaagtctggtgtgggaagaaactgggggtgggctagcgcagggagtagtattctcgcagagttcgggacactccatatggaatttatccacttgagctatctcaccggtgacctcacttactataaaaaagtcatgcatatcaggaagctgttgcaaaaaatggatcggcccaacggactctacccgaattatctaaacccccgaaccggaaggtggggtcagtaccacacaagtgtcggaggccttggtgattcattttatgagtacctgctcaaggcttggctgatgtccgacaaaaccgatcacgaggctagaaagatgtatgacgatgctattgaggctatcgagaaacatcttatcaagaagtctcggggtggccttacctttatcggtgaatggaaaaatgggcacctggagaagaaaatgggtcatctcgcctgttttgcaggcggtatgttcgcccttggcgccgacggatctcgggccgacaaagcagggcactacctcgagctgggtgcggaaatcgcgagaacatgccatgagtcctacgacagaacagccttgaagctcgggcctgaaagctttaagttcgacggggctgtggaggccgtggcagtgaggcaagctgagaagtactacatcctgagaccagaggtgatcgagacttattggtatctgtggcggttcacacacgatcccagatatagacagtgggggtgggaggcagcactggccattgaaaagtattgccgcgtaaacggtggtttctcgggcgtcaaggacgtctattcttctactccaacgcacgacgacgtacagcaatcattttttctcgccgagaccttgaaatatctgtacctactcttttctggcgatgatcttttgccacttgaccattgggtgttcaacaccgaagcacatcccctcccggttttgcatttggcgaacacaacattgtctggcaatcctgccgtgcggtag

SEQ ID NO: 123332 - DNA, 1128 bp, Artificial Sequence
  Description of Artificial Sequence: Synthetic coding sequence
atgggcctccacgacgaatttttggacggacagagatggattgaagacaacctcgacttttctgtgaatagtgaagtgagcgttttcgaggtaaacatccgttttataggggggctcctggctgcgtattatctgtcaggagaagaaattttcaagatcaaggccgtacaactggccgagaagctgctgcctgcttttaacacaccaacaggaattccttgggccatggtcaacttgaagtccggtgtgggacggaactggggctgggcgtcagcagggagttctatcctcgctgaattcggcaccctgcatatggaattcatccaccttagctacctgaccggagatctcacatattacaagaaggttatgcacatacggaaactattgcagaaaatggaccgccctaacggcttatatccaaactatctgaatccacggaccggacgatggggccaatatcacacgtcagtcggtggactgggggattcattctacgagtaccttctgaaagcttggctgatgtccgacaagaccgatcatgaggctagaaagatgtacgacgatgctatcgaggctatagagaagcatctgattaagaagagtagagggggcttgacgttcatcggggagtggaagaatggccacttagaaaagaaaatggggcacctagcatgctttgcaggtgggatgttcgctctaggtgccgacggaagcagagctgacaaagccggccactatctagagctcggcgctgagattgccaggacatgccatgagagttatgaccgcacagccctcaaattgggcccagagtctttcaagttcgacggggccgttgaagcagtcgcagttcggcaggcagagaagtactacatcctccggcctgaagtaatcgagacatattggtacctgtggcggttcacacatgaccccagatacagacaatggggttgggaggccgcgttggccattgagaagtattgccgtgtgaacggcggcttttcaggcgtgaaggacgtctacagctcaacacctacccacgatgacgtgcaacaatccttttttctggcagaaaccttgaagctagcgagctaccacgaacgaactgtgtttccggccgggtag

SEQ ID NO: 123333 - DNA, 615 bp, Artificial Sequence
  Description of Artificial Sequence: Synthetic coding sequence
tgaattaaaaagagtagaggcggtttaacttttattggcgagtggaagaacggccacctggaaaagaagatgggacacctcgcgtgtttcgccggcggcatgttcgctttaggggcagatggcagccgtgccgacaaagccgggcattatctggagcttggggccgagatcgctcggacttgtcacgagagctacgaccgtacggcccttaaactcgggccagaatcctttaagtttgatggagccgttgaagcagtcgccgttaggcaagctgaaaagtactacatactcagaccagaagtgattgaaacttactggtacctctggcggtttacacacgaccccaggtacaggcagtggggatgggaggcagcacttgccattgagaagtattgtagagtcaacggcggcttttcaggggtaaaagacgtctatagctccaccccaacccacgacgacgtgcagcagagcttttttctggccgaaaccctgaagtatttgtatcttctgttctctggagatgacctgctgccattggatcactgggtgttcaacacagaagctcaccctttgcctgtgctgcaccttgccaacaccaccctgagcgaatcttag

SEQ ID NO: 123334 - DNA, 294 bp, Artificial Sequence
  Description of Artificial Sequence: Synthetic coding sequence
gagaaatactgtcgggtcaatggcggattcagcggcgtgaaggatgtttactctagtaccccaacccacgacgacgtccaacagtctttcttccttgccgagaccctgaagtacctctatctgctgttttctggggatgacctgctcccgctcgatcactgggtattcaacacggaagcccacccattgcccgtgttgcacctggccaatacaaccctgtctgggacgtcccaggggatgaggcgccaaaatccatacttccaagtgctgtacctctattaccccgacgattag

SEQ ID NO: 123335 - DNA, 1035 bp, Artificial Sequence
  Description of Artificial Sequence: Synthetic coding sequence
taaatcagattcatcggcggccttctcgccgcctattacctgtccggcgaggagatctttaagattaaggctgtgcaactcgcagagaagcttctgcccgccttcaatacacccactggcatcccatgggccatggtgaatctgaagagtggggtcgggagaaactggggttgggccagcgccgggagctctatcttagcggagtttggaaccctgcacatggagtttatacacctgtcctacctgactggagacttaacctattataagaaggttatgcacattcgcaaacttctgcaaaagatggacagacctaatggcctgtacccaaactacctgaatcctaggactggtcgttggggtcaataccatacctcagttggcggtctcggcgattcattttatgagtatcttcttaaggcttggctgatgtctgataagactgatcacgaggccagaaaaatgtacgatgacgcaattgaggcaatcgagaagcacttaattaagaaatccagagggggcttaacctttattggggaatggaaaaatggtcacttagaaaaaaaaatggggcacctggcgtgtttcgccggcgggatgtttgccctgggagcggacggatctagggcagacaaggcaggccactatttagaacttggtgccgagattgcaagaacctgccatgagagttacgaccggactgctttgaagcttggaccagaatcgttcaaatttgatggggctgtcgaggcagtggctgtacgtcaggccgaaaagtactacatcctgcgccctgaggtaatcgaaacttactggtatctctggcgattcacccacgacccacgctacaggcagtggggctgggaggccgctctggccatcgaaaagtactgcagagtcaacggaggcttctcgggcgtcaaagacgtctacagcagtactcctacccacgatgatgtgcagcagagcttcttcctggctgaaactctgaaattagcaagctatcatgagaggacagtcttcccagcagggtag

SEQ ID NO: 123336 - DNA, 2100 bp, Artificial Sequence
  Description of Artificial Sequence: Synthetic coding sequence
atggcagcttgcgaaggccgccgatctggcgctctaggctccagtcagtccgatttccttacacccccagttgggggtgcgccttgggcagtggctacaaccgttgtgatgtacccacctcctcctcctccccctcaccgggattttatctctgtcaccctgtcctttggcgagaactatgacaattccaagagctggcggagacgcagctgttggcgcaagtggaaacagttgtccaggctacaaaggaacatgattttgtttctgctggccttcctgctgttttgtgggctgttgttctacatcaacttagctgaccactggaaggcgctggctttccgattggaggaggaacagaagatgcgacccgagatagccggcctcaagcccgcgaatcctccggtgctccctgctccacagaaagccgatacggacccggagaacttacccgagatatcctcacaaaagacccagcgacacatccagcgcggacccccacatctgcaaattagacccccttctcaagatctgaaggatggcacccaggaggaggctactaagcgtcaagaggcgcctgttgaccctcgaccagaaggcgatccacagaggaccgtgatctcgtggcgcggggcggtaatcgaacccgagcaagggaccgaattgccctctcgccgcgctgaagtgcccaccaagcctcctctcccccctgcccgaacgcagggaacacctgtccacttgaactaccgccaaaaaggggtgattgacgtgttcctccatgcctggaaaggctaccgcaagtttgcatggggccacgacgagctcaaacctgtctctcggtcattttctgagtggttcgggttgggacttaccttaatcgacgcactagatactatgtggatcctgggactgcgcaaggaatttgaggaagcgaggaaatgggtgagtaaaaagcttcactttgagaaggatgttgatgttaacctattcgagtccaccatcaggatccttggcggactgttaagcgcctatcacctgtccggggattctttattccttcgtaaggccgaggactttggcaatcgcttaatgccagcgttcaggactccctcaaagatcccttatagtgatgtcaacatcgggacaggcgtcgcacaccccccacgttggacctctgactcaaccgttgctgaggtgacttccatccagttggaatttagagagttgagccgcctgaccggggacaaaaagtttcaggaagccgtggagaaggtcacacagcatatccatggtctgtctggaaagaaagacgggctggtcccaatgtttataaatacacattcaggactgtttacccatctgggagtgttcactttaggagctagggccgactcctactatgaatatctgcttaaacaatggattcagggcgggaagcaggagactcaactgttggaggattatgttgaggcaattgagggcgttcgcacccacttgctgagacacagcgagccatctaagctaactttcgtaggagaactggctcacgggcggttttccgccaaaatggaccacctcgtttgtttcctgcctggcacccttgcgctcggtgtgtaccacggactgcctgcctcccacatggaactggcacaagagctaatggaaacctgctatcagatgaaccggcagatggaaaccggcctttctcctgaaatcgtacatttcaacctttacccacagcctggtcgcagagatgtggaagtgaagccggcggaccgacataatcttttacgtccagaaaccgtggaatccctgttctacctgtacagagtaacaggagaccggaagtatcaggactggggatgggagattctccagagtttctcgagattcacgcgggtaccaagcggagggtattcctccattaacaacgtacaggatccccagaaaccggaaccaagagacaaaatggaaagtttcttcctgggtgaaacccttaaatatttgtttctgctgttctcggacgatcctaacttactttcgctggacgcatatgtgtttaacaccgaagcgcacccactgcctatttggactcctgcctag

SEQ ID NO: 123337 - DNA, 1209 bp, Artificial Sequence
  Description of Artificial Sequence: Synthetic coding sequence
atgtggattctggggctacggaaggaattcgaggaggccagaaagtgggtctccaagaagctccatttcgaaaaagacgtagacgtgaacctatttgagagcacaatacggatacttggcggcctcttgtccgcttatcatctctcaggggacagccttttcttacgcaaagctgaagatttcggtaatcggttaatgcccgccttcaggaccccctccaagatcccatactcagatgttaatattgggacaggcgtcgcacacccgccccgctggactagtgatagcacagtagcagaggtaacttccatccagctggagtttagggagctctcacgccttaccggggacaagaaattccaggaggctgtggagaaagtaacacagcacatccacggtttgtcaggcaaaaaggatggtctggtccccatgttcataaatactcactcgggcctctttacacacttgggagtttttaccttaggagcaagggccgactcttactatgaatacttgctcaagcagtggatccaagggggcaaacaggaaacccagctgctagaagactacgtagaggcgattgagggggtacggacacacctgctgaggcatagtgaacccagtaagctcaccttcgttggcgaattggcgcatggccgtttttcagccaagatggatcacctggtgtgttttctgccaggaactcttgcactgggtgtgtatcacgggctgccggccagtcacatggagctggcccaggagctgatggaaacctgttatcagatgaatagacaaatggaaaccggcctgagtccagaaatcgtgcactttaatctgtacccacagccaggccggagagatgtggaagttaaacccgccgacagacataacttactgcgccccgagacagtggagagcctgttctacctgtaccgcgtgactggtgatagaaagtatcaggactggggttgggagatacttcagtccttctctaggtttacacgggtgccttccggcggctactcgtccatcaacaacgttcaggatccccagaagcccgagccacgagataagatggagtctttctttttgggagagacattaaagtatctgtttttactgttctccgatgaccccaacctcctatccttggacgcatatgtgtttaataccgaggcacaccctctgcctatttggacaccggcgtag

SEQ ID NO: 123338 - DNA, 2118 bp, Artificial Sequence
  Description of Artificial Sequence: Synthetic coding sequence
tgaccatgggcagttgcgacaactgtcgtaatgtatccacctccccctcctccacctcatcgggacttcatctccgtaacccttagcttcggagaaaattacgacaacagtaaaagttggaggagacggagctgttggcgaaaatggaagcagctaagcaggctgcagaggaacatgatcttgtttctgctggctttcctgttattttgtgggttactgttttatataaatctcgctgaccattggaaggccctggcgttccgtctcgaggaggagcaaaaaatgaggcccgaaattgccgggttgaagcctgctaatccacctgttttgccagcgccacagaaggccgacaccgaccccgaaaatctccctgaaatctcctcgcaaaaaacccagagacatattcaacgagggccaccacaccttcagattaggcccccaagccaggaccttaaggacggcacacaagaggaagctaccaagagacaggaagcgcctgtcgacccaagacctgaaggagatccacagcgcacagtgatttcttggaggggtgcagtcatcgaacctgaacaaggaacggaactcccctccaggcgcgctgaggtgcccaccaaacctccccttcccccagcccgaacccagggaacccctgtgcacctgaattataggcagaagggagtgatcgacgtcttcctccatgcatggaaaggctaccgtaaatttgcttggggccacgatgagctgaagcccgtgtccagaagctttagtgagtggttcggattgggactgactcttatcgatgcacttgacaccatgtggatcttgggcctgcggaaagagttcgaggaagcccgcaagtgggtgtcaaagaagcttcactttgagaaggatgtagacgtgaacctgttcgagtctaccattcggatacttggcggactgctgtctgcttatcatctgtccggagactcgctattcctgcggaaagctgaagatttcggaaatagactgatgcccgctttccgcaccccaagtaaaatcccctattcagacgttaacattggcacaggagtggcccacccgccaaggtggacaagcgattcaactgtggcagaagtgacgtctatacaattggaattcagggagctatcgcgactgacgggcgataagaaattccaggaagcggttgagaaagttacccagcacatccatggactgagtggtaagaaggacgggctggtgcctatgttcatcaacactcactctggactgttcacacacttgggagtgttcaccctgggcgcacgtgccgactcgtattacgaatatctcctcaaacaatggatccagggggggaaacaggaaacacagctccttgaagactacgttgaggccattgagggcgtgagaacccatctgttgcggcacagcgaaccctccaagcttacttttgtcggcgaattggcccacggcagattcagcgccaaaatggatcatttggtttgcttcctgcctggaacacttgccctaggagtgtaccacggcttacctgcatcccacatggagctagcccaggagttaatggagacgtgttaccagatgaatcgtcagatggaaacgggattgtcaccagaaatagtgcatttcaatctgtacccgcagcctggacggcgagatgtagaggttaagccagctgataggcacaacttgttacgtcccgaaacagtggaaagcttattctacctgtatagagtgactggagatcgaaaatatcaggattgggggtgggaaatcctgcagtccttctccagatttacccgggtgagtacatgcccccggccagcatggtccagaccaccagggcatagacacggatgggccgtcgggctcaggctggctcccctgttggtggtggcggtaacctggattagagagggtagagcctgtcgctctctgggcgttgccaccctccagctggggggtcccggaatcccgataccgacggagctccacggttgcgggacacagagcacctggcgtgggtgggcgccgctcatatttatctcgcagggccttagcagggagggtctttgttgtggcccctccatccccccagtgtag

SEQ ID NO: 123339 - DNA, 3435 bp, Artificial Sequence
  Description of Artificial Sequence: Synthetic coding sequence
atgaaacttagtaggcagttcaccgtgttcggaagcgcgatcttctgtgtggtgatcttctccttatacctcatgttggacagaggccacctggattatcccagaaacccgcgccgcgaagggagttttccgcagggccagttgtctatgctgcaggagaagattgatcatttggagaggctcctcgccgagaacaatgagatcatcagcaatataagggattccgtgatcaatctgtcagaatcagtggaggatgggcccaagtcaagccaaagcaacttctcccagggcgccggcagtcacctcttgccttcccaactatctttatcagttgataccgcggattgcctttttgcaagccaaagtggctcacataacagtgacgttcaaatgttagacgtttacagtctgatatcatttgacaaccccgatggcggcgtgtggaagcaggggttcgacattacttacgagagcaatgagtgggataccgaaccattgcaggtgtttgtcgtgcctcattctcacaacgaccccggatggctgaagacatttaacgattatttcagagacaagacacaatacatcttcaacaacatggtgctgaagctgaaagaagattcaagaagaaagtttatttggtccgagatttcttacctctccaagtggtgggatattatagacatccagaagaaggatgctgtgaagtccttgatagagaacgggcagctcgagatcgtcacaggcggttgggtcatgccagacgaagccacccctcattactttgctctgatagaccagctcatcgagggtcaccaatggctcgagaacaacataggtgtcaagccccgaagtggttgggctattgacccatttggtcacagtcccacaatggcatatctactaaatagagcaggcttaagccacatgctcatacagagagtgcattatgccgtgaaaaaacacttcgccctgcacaagaccttggagttcttttggcggcagaattgggacctgggcagcgtaactgatatactgtgtcacatgatgcccttctatagctatgatatcccccacacgtgtggacccgatcccaaaatttgttgtcagtttgacttcaagcgcctgcccggcggccgcttcggttgcccatggggcgtgccaccagaaaccatccatcctggcaacgtacaaagccgggccaggatgctgctcgaccaatatcggaagaagtctaagctatttcggactaaggtactgctcgctccgctgggggacgacttccgttactgtgagtacactgagtgggacttgcagtttaaaaattatcaacagctctttgattacatgaattcccagtcgaagttcaaggtgaaaatccagttcgggactttgagtgatttctttgacgccctcgacaaggcagatgagacccagcgcgataagggccagagcatgttcccagtactcagtggggactttttcacttatgctgacagagacgaccattactggagcggttatttcacttcacgccctttttataaacgtatggatcggataatggagtctcatctgcgcgctgctgagatcttatattacttcgccctccgtcaggcccacaagtacaagattaacaagtttctctcaagctctctgtacaccgctctgacggaagctcggaggaatttaggtctattccagcatcatgatgctatcactggaacagcaaaggactgggtggtggtcgattacgggacgcggctttttcacagtctgatggttctcgaaaaaatcattgggaacagcgccttcctcctgatactgaaggacaagttgacttatgacagctacagtcccgatacttttctggagatggacttgaagcagaaaagtcaagacagcttgccacaaaaaaacattattaggctatctgctgagccacggtacctggttgtgtataacccactggagcaggatcgtattagcctggttagcgtctacgtgtcttccccaaccgttcaggtcttctctgcttccgggaagcctgtcgaggtgcaggttagcgctgtgtgggacaccgcaaataccatctccgagacggcctacgagatctccttcagggcacacatccccccactaggcctgaaggtgtataaaattttggagagtgcaagctcaaacagccacctcgctgactatgttctctacaagaataaggttgaagacagtggcatattcaccattaagaacatgataaatacagaagagggcattacgctagaaaattccttcgtgctcctgagattcgatcagaccggactgatgaaacagatgatgacgaaagaagatggcaagcaccatgaagtcaacgtccagttcagttggtatgggacgacaataaaaagggataaatctggggcctatctgttcttgccggacggaaacgcgaagccatacgtgtataccacgccaccatttgtgagagtaacgcatggtcgcatttattcagaggtcacatgcttctttgaccatgtgacgcacagagttagactctatcatatccagggaatagaagggcagagcgtagaggttagcaatatcgtcgatattcggaaagtgtataaccgcgaaatcgctatgaagatttctagcgacatcaaaagccagaacagattctatacagatctaaatgggtaccagatccaaccgcgaatgactctgagtaagttaccgcttcaggcaaacgtgtacccaatgactacgatggcctatatccaggatgccaaacatcgactcaccctgttatcggcgcagtccctaggagtttccagcctcaactcaggacagatagaggttatcatggaccgaagactcatgcaggacgacaaccgagggctggaacagggtatccaggacaacaagattactgcgaatttgtttcgaatcttgcttgagaaacggagtgctgttaataccgaggaggagaagaaatccgtgtcctacccttcccttcttagtcacattacttctagcctgatgaatcacccggttatacccatggcaaacaaattcagtagccccacgctggagctccagggcgaattctcaccactgcaatctagcttgccctgtgacatccaccttgtgaaccttagaacaattcagagcaaggtgggtaatggtcattcaaacgaagccgcactgattctgcacaggaaggggttcgactgtcggttttcgtctaaaggcaccggcctgttttgtagtacgactcaaggaaaaatcttggtgcaaaaacttcttaacaaattcattgtcgagtccctgacacctagctctctctcgctgatgcatagccccccagggacacagaacatcagtgagatcaatttgagtcccatggagatctcaaccttccgcatccaactccggtag

SEQ ID NO: 123340 - DNA, 3453 bp, Artificial Sequence
  Description of Artificial Sequence: Synthetic coding sequence
atgaaactgaaaaaacaggtgactgtgtgtggcgcggccattttttgcgtcgccgtgttctcattgtatctgatgctggacagagtccagcacgatcccacacgccatcagaacggaggtaactttcccagaagccagatcagcgtgctgcaaaacaggatcgagcagctggaacaactcctagaagagaaccacgagatcattagtcatattaaggacagcgtcctcgagttgaccgctaacgcagaaggacccccggccatgctaccgtattacaccgtgaacgggagctgggtcgtccctccagagccacgaccaagctttttctcgatctccccacaggattgccaatttgcattaggcggacgcggccagaagcccgaactgcagatgctgaccgttagcgaagagctgccctttgacaatgtggatgggggggtttggagacaaggttttgatatatcatatgacccccacgactgggacgcagaggatctacaagttttcgtggtccctcactcccataacgaccctggctggatcaagacctttgacaaatattataccgagcaaacccagcatatcctgaacagcatggtgtccaagctgcaagaagatcccaggcgtcgcttcctctgggcagaggtaagttttttcgccaaatggtgggacaatatcaacgtgcagaagagagctgcggtaagaagactagtcggaaatggccagctggagatcgccacgggggggtgggtgatgcccgacgaagcaaactcacactatttcgctctcatagaccagttaatcgaaggccaccagtggctggagagaaacttaggagcgacacctaggtctggctgggccgtggacccctttggctattcaagcacaatgccctatttgttgcggagagctaacctgacgtcaatgctgatccagagggtccactatgcaatcaagaagcatttcgccgctacacacagcctggagttcatgtggcgccagacgtgggacagcgatagtagcaccgacattttctgtcatatgatgccgttctactcttacgacgtcccccacacatgtggccctgatcccaagatttgctgtcagttcgatttcaagagattgccaggcggtcgcatcaattgtccatggaaagtcccaccaagggccatcactgaagctaacgtagctgagagggccgctctgttgcttgatcagtataggaaaaagtcacagctctttcgcagtaatgttctgctggtacccctcggggatgactttcgctacgacaagccacaagagtgggacgcccaattcttcaattatcaaagacttttcgacttttttaattctcgccccaacctgcacgtccaggcacaatttggaactttgtccgactactttgatgcactttataagcgcacaggggtggagcccggggcgcggccccctgggtttccagtgttgtccggcgacttcttttcatatgccgatagggaagatcactattggacaggatactatacaagcagaccattttacaagtccctagatcgggtgctcgaggctcatttaagaggtgccgaagtactctattctctcgccgcggctcacgcaaggagaagcggtttggcaggccggtaccctctctccgacttcaccctgctcaccgaggccaggcggacactgggcctgttccaacaccatgacgccatcaccggaacagccaaagaagctgttgtggtggattatggagtccgcctccttaggagcctggttaatctaaagcaggtcattattcacgccgcccactacctggtcttaggagacaaggagacttatcactttgacccagaagcccctttcctccaagtcgacgatacacgcctctctcacgacgccctcccagaacgaacggttattcagctggacagtagcccaagatttgtcgttttattcaacccattggagcaggagcgcttctccatggtaagcctgctggtcaactctccaagggtgagggtgctcagtgaggaaggtcagcccctggctgtccagatttctgcccattggagcagcgctaccgaggcagtcccagacgtttaccaggttagcgtgccagtgcgactccctgctttaggccttggggtccttcaacttcagctcggactcgacggtcacagaacactaccctcatcagtccgtatttacctccatggccgccaactctctgtgagccgccacgaggcatttccactcagggtgattgatagcggcacctctgactttgccttatcaaatcgctacatgcaggtctggttctccggtcttactggattgctgaagtctattcgacgtgtggacgaggagcacgagcaacaagtcgacatgcaagtcctcgtgtatggcacgcggacctcgaaagacaaatctggggcctatttgttcctcccagacggcgaagcaaagccctatgtccctaaggagccccctgtccttcgagtgacagaaggacccttttttagcgaggtggtggcttattatgaacatattcaccaggccgtgagactctataacctgccaggtgttgaagggctctcactcgacatttcttctctagtggatattagagattacgtgaataaggagctggccctgcacatccacactgatatcgatagtcagggcattttcttcaccgatttgaacgggttccaggtccagccaaggcggtacctgaagaagctgcctctacaggcaaacttttatcccatgccagtgatggcgtatattcaggacgcacagaagcgactgacgctgcataccgcccaagccctcggagtcagtagcctgaaggacggccagctggaagttatcctggatagaagactcatgcaggacgataataggggcctcggccaaggacttaaagataataaaagaacctgcaatcgcttccggttgctgctggagcgccggaccgtgggctcagaggtgcaggactctcatagtaccagctaccctagcctgctgagtcacctaacatccatgtacttaaatgcgcccgctttggccctacctgtggcacgtatgcaactccccggacccgggttaaggtccttccacccgctcgcatcatcgttgccgtgcgattttcatctgctgaacctgcgcacacttcaagcagaagaagacacgctccccagtgctgagacagctttaatcttgcaccgcaaagggttcgactgcgggctggaggccaaaaatttgggcttcaattgtaccacctcccaagggaaagtcgctctgggttctctgtttcatggacttgacgtcgtgttcttgcagcctaccagcctgactttactgtatcccctggcgtcccccagcaatagcaccgatgtctatctggaacctatggaaattgcaacatttcgcctgaggctgggatag

SEQ ID NO: 123341 - DNA, 1023 bp, Artificial Sequence
  Description of Artificial Sequence: Synthetic coding sequence
atgcaggtgtggttttctggactcaccggactcctcaagccttacgtgcccaaagaacctcccgtgttgcgcgtgaccgaggggccattcttctctgaagttgtcgcatactatgagcacatacatcaagcggtcagactttataacctgccaggagtcgaagggctctccctcgatatcagctccctcgtggacatcagagactatgtgaacaaagagttggccctccatatccataccgacattgatagccagggtattttcttcactgacctgaacgggttccaagtgcagccaaggcggtacctgaagaagttgcccctgcaggctaacttctaccctatgcctgtgatggcctacatccaggacgcccaaaagcgtttgacgctccatactgcccaggccctgggcgtgtcttcactcaaagatggccagttggaagtgatactcgaccgccgcttgatgcaggatgataatcggggcctgggccagggcctgaaggataacaaacggacatgcaaccggtttagattgcttttggaaaggcgcactgtggggagtgaggtccaggactcccactcaacgtcgtacccaagtctactgagtcaccttacttcaatgtacctaaacgccccagcactggccctccctgtcgcccgaatgcagttacccggcccagggctgcggtcattccatcccctggcctcttcactcccctgtgatttccatctgctcaatctccgaaccctgcaggccgaagaagacacgttgccttctgccgagacggctctgatattacataggaagggatttgattgcggtttggaagcaaaaaacctcggatttaactgtactacatcacagggaaaggttgccctcggatctctgttccacgggcttgacgtggtcttcctccagcccacctccctaaccctgctctacccgcttgccagtcctagcaactcaacggacgtgtatcttgaacctatggagatcgctacctttcggctcagactcggctag

SEQ ID NO: 123342 - DNA, 1977 bp, Artificial Sequence
  Description of Artificial Sequence: Synthetic coding sequence
atgacctccgacatgacaagccctagatcgggcatgccctcctcctccacaacaaatgggtctttaacctcctcgactgctggcctcacgtctatgtgtcggggcgccgaagtgctgtacagcttggcagccgcccacgccaggcgctctggtctggccgggagatacccactgtctgacttcaccctattaacggaggcaagacggaccctagggctgttccagcaccatgacgcaatcactgggactgcaaaagaggccgttgtggtggattacggtgtacgacttctccggtctctggttaacctgaaacaagttatcatccacgcggcacactaccttgtcctcggggacaaagaaacttatcacttcgacccagaagcaccattcttgcaggttgatgatacgaggttgagccacgacgcactgcctgagcgtactgtgatccagctggacagcagtcccagatttgtcgtgttattcaaccctttggaacaggaacgcttcagtatggtttcgctgctggtgaacagccctagagtgcgagttttgtccgaagagggtcaaccattggctgtccagatatccgcccattggagtagcgcaacagaggccgtcccggatgtgtatcaggtttccgtaccagtgcggctccctgcccttggactaggggtgctgcagctccagctcggactagatggtcaccgaacgcttcctagtagtgtgcgaatatatctgcacgggcgccagctcagcgtgagtcgccatgaggcatttccattgagggttattgattctggcacctccgatttcgctctgtctaaccgatacatgcaggtatggttctctggcctgacaggcttactgaagagtataagacgggtcgatgaggagcatgaacaacaagtggatatgcaggttctggtgtatgggacccgtaccagcaaagacaagtcaggtgcttacttgttccttccagatggcgaggcgaagccgtatgtcccaaaagagccccctgtactgagagtgacagagggcccattcttctctgaggttgtggcctactacgagcatattcaccaagcagtccgcctgtacaatcttccaggcgttgagggactgtcgctggatatctcttccctggtagacatccgggactatgtgaataaagagctggccctgcacatccatactgatatcgatagtcagggcatcttcttcaccgacctgaacggctttcaggttcagccccgacggtatctgaaaaaactacccctgcaggccaatttttatccaatgccagtgatggcatatatacaggatgctcagaagcgcctaacactgcacaccgcacaggctctcggggtgtctagtctcaaggacggacaattagaggtgatcctcgatcgtaggctgatgcaggacgacaacagaggccttggacagggattgaaggacaacaaaaggacgtgcaaccgcttccggctgctcctggagcggaggactgtgggatccgaggtgcaggacagccatagcaccagttacccatcactactctcccacctaacctctatgtacctgaacgcacctgctcttgcactgcctgtagcccgcatgcaattgcctgggcccggcttgcgttctttccaccctctagcatcctctctaccctgcgattttcacctgttgaatttgagaacccttcaagctgaggaggacactctgccttctgctgagacagccctgatcttgcacaggaaaggattcgactgtgggcttgaggctaagaatctagggttcaactgtacaactagccaaggcaaagtcgccttaggaagcctgtttcatgggctggacgttgtatttctccagccaacttcgctcacattactctatccactggcctctcccagtaactcaactgacgtgtacctggagcctatggagattgcgacctttcgcctcagattaggatag

SEQ ID NO: 123343 - DNA, 219 bp, Artificial Sequence
  Description of Artificial Sequence: Synthetic coding sequence
atgaagctcaaaaagcaggtcaccgtatgtggagccgccatcttctgtgtcgctgtcttctctctgtacttgatgctcgatcgggtgcagcatgatcccacccgacaccagaatggaggaaacttccctcgaagccagatctccgtgctgcagaaccggattgaacaactggaacagctgctggaagagaatcacgagattatcagccacatcaaatag

SEQ ID NO: 123344 - DNA, 153 bp, Artificial Sequence
  Description of Artificial Sequence: Synthetic coding sequence
atgaagctgaagaagcaggtcaccgtgtgcggggctgcaattttttgcgtcgctgtgttcagtttgtaccttatgcttgatagggtccagcacgatccgacccgccaccagaatggcgggaacttcccgcggagccagatttctgtgctttag

SEQ ID NO: 123345 - DNA, 3192 bp, Artificial Sequence
  Description of Artificial Sequence: Synthetic coding sequence
atgctgccctactatactgttaacgggtcttgggtggtaccacccgagccccggccctccttcttcagtattagcccacaggactgtcagttcgccctagggggcagaggacagaaacccgaattacagatgctgactgtgtccgaagagctcccattcgacaatgtggatggtggtgtctggcgtcagggattcgatatcagctacgaccctcatgattgggatgcagaggacctgcaagtcttcgtggtaccacactcccacaatgatcccggttggatcaaaacctttgataagtactacacagagcagactcaacacattttgaactcaatggtgagcaagctgcaagaggatccccgtcggcggttcctgtgggcagaggtatcattcttcgctaaatggtgggacaacattaacgtccagaaacgcgctgcagtgcggaggcttgtaggcaacggtcagcttgagattgccaccggcgggtgggtcatgcctgatgaggcgaactcccattatttcgccctgatcgaccagctcatagaaggccaccagtggctcgaaagaaatctcggtgccaccccgcggtcggggtgggctgtcgacccctttggttacagtagtactatgccctatcttctgcgacgggccaaccttactagcatgcttattcaacgggttcactacgcaattaagaagcacttcgccgccacccacagcctggaattcatgtggcgacagacctgggacagtgactcctcaacggacattttctgtcatatgatgccattctatagttatgatgtgccccatacatgcggcccagatcccaaaatatgctgccaattcgattttaaaagactacctgggggcaggatcaactgcccttggaaggtgcctccacgcgccatcactgaggccaacgtcgcagagagggccgcactgcttctggatcagtaccgaaagaaaagtcagctgtttagaagcaatgtgctgttagtgccgctcggagacgatttccgatatgataagccacaggagtgggacgcccagttcttcaactatcagcggctgttcgatttctttaatagcaggcctaatctacatgtgcaagcgcaatttggtaccctttccgattatttcgacgccttgtacaaacgcacaggagttgaacccggtgcgagaccgcctgggtttcccgtgctgtctggagatttctttagttacgctgacagggaagaccattactggactggatattatacgtcacggcctttctacaagagcttggaccgcgttctggaagcacaccttagaggggctgaggttctctactctctggctgctgctcacgcaagacgatccggactagccgggagatatccactctccgatttcacgttgctcacagaagctcgaaggacacttgggctcttccagcatcacgacgccatcaccggaaccgcaaaggaggccgtcgtggtcgactacggcgttcggctccttcgctcgctggttaatctcaagcaagtgatcatccacgcagcgcattatctggtcctcggagacaaagaaacttaccatttcgaccctgaagcaccttttcttcaggtggatgatactagactctctcacgacgccttgccagagaggacagtgatccagcttgactcctctcctcggtttgtggtgttgtttaacccattagaacaggagcgcttcagcatggtctcactgcttgtaaattcaccgagagtgagggtgttgagcgaggagggccagcccttggctgtccaaatctctgcccactggagctcagccacagaagccgtgccagacgtgtaccaagtttcagtgcctgttagactgcctgctctgggtctgggggtactccagctacagctcggactcgacgggcacaggaccctgcctagctcagtgcgcatttaccttcacggacgccagctttctgtctccagacatgaagcatttccgttgagggtgattgattctggcaccagcgattttgctttgagtaaccggtatatgcaggtttggttttccgggctcaccggcttgcttaagtccatccgtagggttgatgaggaacatgagcagcaggtcgacatgcaggtgcttgtgtatggaactcggacatctaaggataagtcaggcgcctacctgtttctgccagatggagaagccaagccttatgtgccgaaagaacctccagtactgagggttactgaggggcccttcttcagtgaagttgtggcatattacgagcatatccatcaggctgtgagactgtacaatctacctggcgtagaaggcttaagccttgatatatcaagccttgtggatattcgtgactatgtaaacaaagaactggctctgcacatccatactgacattgactctcaaggcatatttttcactgacctgaacgggttccaggtgcagcctaggcgttacctgaaaaaactacctctgcaggcgaacttttacccgatgccagtgatggcttatatccaagatgcacagaaaaggctcactctgcacaccgctcaagctctgggtgtgtctagcctcaaagatggacaactggaagttattttggaccgaagattaatgcaagatgataacagaggactaggccaagggctgaaagataataaacgtacctgcaataggttccgcctgctgcttgagcggcggactgtgggcagcgaggtacaggactcccactcaaccagttatccaagcctgctttcacacttgacctcgatgtacctgaatgctcccgccttggcacttccagttgcgaggatgcagctccccggccccggactgcggtcatttcatccgctggccagtagtttaccttgcgattttcatctcctgaatctacgcacccttcaggctgaggaggatacattgccttctgcggaaaccgccttaatcctgcatagaaagggattcgactgcggactggaagcaaagaatcttgggttcaactgcaccacctctcagggcaaggtagcgcttgggtcattattccacggcctagacgttgtgtttctgcagccaacgtcactaacactgctgtaccccctggcttcaccatcaaacagtaccgacgtatatcttgagccaatggaaattgccaccttcagactacgtctagggtag

SEQ ID NO: 123346 - DNA, 231 bp, Artificial Sequence
  Description of Artificial Sequence: Synthetic coding sequence
atgaaacttaagaaacaggttaccgtctgtggcgccgccatattctgcgtagcagtttttagtctttacctcatgttggaccgcgtgcaacacgacccgacccgccaccagaacggcggaaatttccctcggtcccagatcagtgtgctgcagaatagaattgagcagctggagcagctgctggaagagaaccatgagattatctcacacatcaaggacagcgtcctctag

SEQ ID NO: 123347 - DNA, 363 bp, Artificial Sequence
  Description of Artificial Sequence: Synthetic coding sequence
atgaagctgaaaaaacaggtgactgtgtgcggcgcggctattttctgcgtagcagtcttttctctttatctaatgctagaccgggtgcagcacgaccccacaagacaccagaatggaggcaacttcccccggtctcagatctcagtgctgcaaaaccgcattgagcaactggagcaactgcttgaggagaatcatgagatcattagccacattaaggactcggtgctcgaactgactgcaaacgcggaaggccctccagccatgctgccctactacactgtcaacggctcttgggttgtgcctccagagccacgcccctcatttttcagcattagtccgcaggactgccagttcgctctatag

SEQ ID NO: 123348 - DNA, 3123 bp, Artificial Sequence
  Description of Artificial Sequence: Synthetic coding sequence
atggcagccgcccctgcccttaagcattggcgcactacactggaacgcgtggaaaagtttgtcagccccctgtatttcaccgactgtaacttaaggggacggctttttggagccagttgccccgtagcggttctaagtagttttctaacgccagagaggctcccctatcaggaggccgtccagcgcgacttccgtcctgcccaagtcggggacagcttcggaccgacctggtggacctgttggtttcgcgtggaacttacaatcccagaagcttgggtaggccaagaggtgcacctgtgctgggaatccgatggagaagggctagtctggagagacggcgaacctgtacaaggactaacaaaggagggggagaagacatcctacgtcctgacggataggctgggggaacgggacccacggagtctcaccctatacgtagaagtggcttgtaatggtctgttgggcgctgggaaggggagtatgattgcagcccccgaccctgaaaaaatgtttcagctttcgagagccgagttggctgtgttccaccgagatgttcacatgctgctggttgatctggaactcctcctgggcatcgccaaaggacttggtaaggataaccagcgctcctttcaggcgctttacactgccaaccagatggtgaatgtatgcgatccagcccaacctgaaacattcccagtagctcaggccttagccagtcggttcttcgggcaacacgggggcgaaagccagcatactatacatgcaactgggcattgccacattgacactgcttggctgtggccctttaaagaaaccgttcgcaaatgcgccaggtcttgggttaccgcacttcagttaatggaacgtaatcctgaattcatttttgcctgttcacaagcccagcagctcgaatgggtcaagtcgcgctaccctggactgtacagccgtattcaggagtttgcatgccgcggccagttcgtgccagtggggggcacctgggttgagatggatgggaatctgcctagcggcgaggcaatggtcagacagtttctgcaggggcagaattttttcctgcaagagttcggtaagatgtgcagcgaattttggctgccagacaccttcggatatagtgctcagttgccccagattatgcacgggtgcgggatcaggcgctttctgacacagaagctgtcatggaatctcgtcaattctttcccacaccacacgtttttttgggagggcttggatgggtctagagtgctcgtccattttcctccaggagacagttacggaatgcaggggtccgtggaggaggttctgaagaccgtagcaaacaatagagacaaaggccgagccaaccatagcgcctttctcttcggtttcggggacggcggcgggggaccaacccaaacaatgctggatcgactgaagcgactctctaacacggatggattgccgagagtacagctgtcatccccaagacaacttttcagcgcgctcgagtccgacagcgagcagctctgcacatgggtgggggaattattccttgaattgcacaatggaacctacaccactcatgctcagattaagaaggggaaccgtgaatgcgagcggatcttacacgacgtggagttgctgagctcgttggctctggctcgatctgcccagttcctgtaccctgccgcccaactgcagcacctgtggaggttactgctgcttaatcagtttcacgatgtggttacagggagctgtatccagatggtggctgaggaggctatgtgccactatgaggacattagaagccacggaaatacactcctctcagccgcagcagcagcactgtgcgcaggagaaccaggacctgaaggccttttgattgttaacacccttccttggaagcgcatcgaggtgatggccctccctaaacccgggggcgcacatagcctggccctcgtaaccgtgccatctatgggctacgcgcctgtgccacccccgacttcattgcagccacttctgcctcagcaaccagtgttcgtagttcaagaaactgacgggagtgttaccttagacaacggcataatcagagtgaagctggaccctaccgggcggctcacgtccctggtgctggttgcaagtggacgtgaggctattgccgaaggcgccgtcggcaatcagttcgtcctgtttgacgacgtgcctttatattgggacgcatgggacgtaatggattatcacctagaaactaggaaacctgtactcggacaggctggcactttggctgtgggcacagagggtggactgagaggatctgcgtggtttttactgcagatctctcccaattccaggttgagccaggaggtggtcctggatgtaggctgcccttatgtgcggttccacaccgaggtccactggcacgaggcacacaagtttctcaaggttgaatttcctgccagagtacggtcctcccaggccacatatgaaattcaattcgggcacctccagaggcccacacactacaacacctcgtgggattgggccaggtttgaggtgtgggcccatagatggatggacctctccgaacacggcttcggtctggcactgctgaatgactgtaaatacggggcctccgttcggggaagtatcctgtcgctcagcctgttgagggcccccaaggcccccgatgccactgccgacacaggtcgacatgagtttacctacgctctcatgccacataagggatccttccaagacgcaggcgtgattcaggcagcatactcgctaaacttccctttgctcgcgctgcctgcccctagtccagcccctgcgacctcgtggtctgctttctccgtgagtagtcctgctgtggtgttggaaaccgtgaagcaagctgagtcctccccccaacgccgtagtctcgtgcttcgcttgtatgaagcgcacggcagtcacgtcgactgctggttacatttatccctccctgtacaggaagccattctgtgtgacctattggagcgtccagacccagcagggcacctcacgctccgcgataataggttaaagttaactttctctccttttcaggtgctgtctctattgctggtgctgcagccacctccccattag

SEQ ID NO: 123349 - DNA, 630 bp, Artificial Sequence
  Description of Artificial Sequence: Synthetic coding sequence
atggctgccgctcccgccctgaaacattggcggaccactttggaacgtgtggagaaattcgtgagcccgctctacttcacagattgtaatttaagaggaagactgtttggagcctcctgccccgttgccgtgctgtcgtccttcctgaccccggagagactgccctaccaggaagcggttcagagggactttaggcctgcacaagttggtgattctttcggtccaacctggtggacttgctggttccgcgtcgaactgaccattccggaggcttgggtcggccaggaggtacacctgtgttgggagtccgacggggagggacttgtgtggcgggatggggaacctgtgcaaggcctgactaaggaaggtgagaagacaagctatgtcctgactgaccgtctgggcgagcgagacccacggtctctcactctgtacgtggaggtcgcatgcaacgggctgctgggtgccggcaaggggagcatgattgcggcaccggacccggagaaaatgttccagctgagcagagctgaactggccgtttttcatcgcgacgtgcatatgctattggtggatttggagctgctattgggcatcgccaaacccgggttcggaccgtctaagcgtctttag

SEQ ID NO: 123350 - DNA, 2910 bp, Artificial Sequence
  Description of Artificial Sequence: Synthetic coding sequence
atggccgaggacgacccctaccttggtcgtcccgagcagatgttccatctggacccttcacttacacacactatcttcaacccagaggtcttccagcctcagatggcactccccacagccgatggaccttatctgcagattttggaacagccaaagcagagaggctttcgctttagatatgtctgtgagggacctagtcatggtgggttacccggcgcttcaagcgaaaagaacaagaagagttatccccaggttaaaatctgcaattacgttggccccgccaaagtcattgtacagctggtcacaaatggcaagaacatccatctccacgcccattccctggtgggaaagcattgcgaggacgggatctgcactgtgactgccggaccaaaagatatggtggtgggcttcgccaatttgggcatcctgcacgtcacgaagaaaaaggtcttcgagacattagaagcaagaatgactgaggcatgtatcaggggctacaaccctggccttctggtgcatccagacctcgcttacctgcaggcagaaggagggggagatcgccagctcggcgaccgcgaaaaagagctcatcaggcaggcggccctccagcagaccaaggagatggacctgagcgtcgtccgactgatgtttaccgcgttcttgcctgacagtacggggtcttttacccgtcgcctggagcctgtcgtatccgatgcaatttacgattccaaagcacccaacgcttccaatcttaaaatcgtgcgcatggataggacagctgggtgtgtaacaggcggcgaagagatctaccttctttgtgataaagtgcagaaggacgacattcagattagattttacgaggaggaagagaacggcggcgtatgggaagggttcggggacttttccccaaccgacgtgcaccgccagtttgctattgtcttcaagactcctaagtacaaggacatcaatatcacgaaaccagcgtctgtttttgttcagctccgccgaaaatccgacctcgaaaccagtgagcccaagcctttcttgtattacccagaaatcaaagacaaggaggaggtgcagcggaagcgacagaaactcatgcctaacttctcagattctttcggagggggatccggcgcgggggccggggggggggggatgttcggaagtggagggggtggcggggggactggttcaaccgggccaggttattcctttcctcactatggctttcccacctacggagggattacctttcatcccggcacaacaaagtcgaacgccggcatgaagcatggaacgatggatacggagagcaagaaggatcccgaaggatgtgacaagtcagatgataagaacacagttaacctgttcggaaaggtgatagaaacgacggaacaggaccaagagccaagtgaggcaactgtggggaatggcgaggtgactttgacatatgccaccggaactaaggaggaatctgccggggtgcaagataacctgttcttggaaaaagctatgcagctggccaagcgccacgccaatgctctgttcgactatgcagtgactggggatgtaaagatgttgctggcagtgcaacggcatctaacagcagtccaggacgaaaacggggatagcgtcctacacctggcaatcatccacctccatagccagctcgtgagggacttactggaggttaccagcggactcatctccgacgacataatcaatatgcggaatgacttgtatcagaccccgctgcacctggcggtgataactaaacaggaagatgtcgtggaagacctgctgagggccggcgccgacctaagcttgctggatcgcctgggaaattccgtgctgcatctggcagctaaggagggacatgacaaggtgctgagtatcctcctcaagcataaaaaggccgcattactgcttgatcacccaaacggggatggcttgaacgctatccacttggcaatgatgagtaacagtttgccctgtcttcttcttctggttgcagcaggggccgacgtcaacgcacaggagcaaaaatcggggcgcactgcgttgcatctggcggtggaacatgacaacatatcactggctggctgccttctcctcgagggggatgcccatgttgactctaccacttatgacgggactacccccctacacatcgccgctggccggggatccacgcgattggctgccctcctcaaggcggccggcgcggatccccttgtcgagaattttgagcctctttacgacctggatgattcttgggagaacgcgggagaggatgaaggtgtagtgcccgggacaacgcccctagacatggcaacatcctggcaagtgtttgacattctcaacggcaagccatacgagcccgaatttacatccgacgacctgttggctcagggcgacatgaagcaactcgccgaagacgtaaagctgcaattgtacaagctgctcgagatccctgacccagacaaaaattgggccaccctggcccagaaactcgggttaggtatccttaacaatgcctttaggctttctcctgccccatccaagaccttgatggataattatgaggtgtccggcggaactgtccgagaacttgtagaggccctacgccagatgggttatactgaagcaatcgaggtgattcaggccgccagcagcccggttaagacaaccagtcaggcgcattcattgccactgtctccggcctcaactcggcagcagatcgatgaactgagagactcggactccgtttgcgacagtggtgtcgagacaagcttcagaaagctgagcttcaccgagtcactcacatcaggggcatccctgctaacccttaacaagatgccccatgattacgggcaagagggccccttagagggcaaaatctag

SEQ ID NO: 123351 - DNA, 1389 bp, Artificial Sequence
  Description of Artificial Sequence: Synthetic coding sequence
atggccaagttccgccgtcggacctgcatcatcttggcgctgttcatcctctttattttctcccttatgatgggacttaagatgctacgtccaaataccgcgactttcggcgcccctttcggactggatttgttgcccgagctgcaccagaggacgatccacttgggaaaaaatttcgactttcagaaatctgaccggataaattccgaaaccaacaccaaaaacctgaaatccgtggagattacaatgaagccaagtaaggcctcagagttgaatctggatgaactgccgcctctcaacaactatctccacgtcttctattactcgtggtatggaaaccctcagtttgacggaaagtatattcattggaatcacccagtgttagaacattgggatcccaggatcgccaagaactatccgcaggggagacataacccacctgacgacatcgggtcttccttctaccccgagctgggatcctacagctctagggacccgagtgtgattgaaacgcatatgcgacagatgcggtctgctagcatcggcgtactcgctctctcatggtatccgcctgacgttaacgacgaaaacggcgagccaaccgataatctggtgcccaccattctcgataaagcacacaaatacaacctaaaagtgaccttccatatcgaaccatattcaaatcgggacgatcaaaacatgtacaaaaatgtaaagtacataatcgacaaatacggcaaccacccggccttttaccgatataagacgaaaacgggaaacgcactgccaatgttctatgtttatgacagttatatcactaagccagaaaagtgggctaacctgttgacaacatccggcagccgctctatcaggaacagcccatacgatgggctgtttatagcactgttggtggaggagaagcacaaatacgacattctgcagtcgggctttgatgggatctacacatattttgccacaaacggatttacgtacggatcaagccatcaaaactgggctagtctgaaactgttttgtgacaagtacaacttgatctttatcccatctgttgggcccgggtacatagatacatcaattagaccctggaatactcagaataccagaaatcgaatcaacgggaagtactacgagatcggcttgtccgcagcacttcagacgcggccaagtcttatctccataacaagcttcaacgagtggcacgagggcacgcagatcgagaaagcagtaccaaagcgcacgagcaacacggtctatcttgattatcgaccccataagccggggctttacctcgagcttactcggaagtggtccgaaaagtatagcaaggaacgggctacctacgctctggacagacagctaccggtctcctag

SEQ ID NO: 123352 - DNA, 597 bp, Artificial Sequence
  Description of Artificial Sequence: Synthetic coding sequence
atggctaaattccggaggaggacatgcattatcctcgccctgtttattctctttatcttctctcttatgatgggcctcaagatgctccggcccaatacagcaacttttggggccccttttggccttgaccttctccctgagctgcatcagcgtaccatccacttgggcaaaaattttgattttcagaagtccgaccggattaactcagagaccaataccaaaaacttaaaaagcgtggagattacgatgaagccgtctaaggccagcgagctcaatctggatgagcttcccccactaaacaattatctgcatgtgttctactattcttggtatgggaatccccaattcgacgggaaatacatccactggaatcaccctgtattagaacactgggatcccagaattgctaaaaactatcctcagggtcgacataaccctcctgacgacataggctccagtttttatccagaactcggttcttattcgagccgagatccatctgtgatcgagacccatatgcgacagatgaggtcagcgtccatcggcaattactgcatttacatctatgtgtgtctgtgcctctatatttgcatctag

SEQ ID NO: 123353 - DNA, 624 bp, Artificial Sequence
  Description of Artificial Sequence: Synthetic coding sequence
atggccaaatttaggcggcgtacttgtataatcctagctttgtttattctgttcatcttcagcttaatgatgggtctaaaaatgctgcgcccaaatacggcgacttttggcgcgccttttgggttggatctgctccccgagctacaccagcgcaccattcatctgggcaagaattttgacttccagaagtccgatcgaattaactcagagacaaatactaaaaatcttaagtccgtcgagattactatgaagccttctaaagccagcgagctgaaccttgacgagctcccaccccttaacaattatctgcacgtgttttactatagctggtatggaaatcctcagttcgatggcaagtatatccactggaaccaccctgtgctcgagcattgggacccacgaatcgcgaagaactatccgcagggcagacacaacccacccgatgatattggctcaagcttttaccccgagctcgggtcctactcttccagggacccctccgtgattgaaacacacatgcgccagatgcggtcagcctccattggcaactactgtatttatatttgcgtgtttgtttcagtgtatatgcacataaacgattttctgtgtaactttacgagctag

SEQ ID NO: 123354 - DNA, 2379 bp, Artificial Sequence
  Description of Artificial Sequence: Synthetic coding sequence
atgatcacagttaaccccgacggcaaaatcatggttcggcgctgtcttgtgaccttgaggccattccgtcttttcgtactggggattggcttttttactttgtgctttctgatgacatccctcgggggccaattttccgctcggagacttggagatagtccctttactatccgcactgaggtgatgggcgggcctgaaagtagaggcgtgctcaggaagatgtctgatctcctggagttaatggtgaaacgcatggacgccctggctcgccttgagaattctagcgaactccacagggcaggtggcgacctgcactttcctgccgacagaatgcccccaggtgcggggctaatggagcgaattcaggcaattgctcagaacgtgagcgatatagccgtgaaggtggaccagatcctgaggcatagtcttttgctccacagtaaggtatccgagggacgtcgagatcagtgcgaagcccccagtgaccccaagttccctgattgcagtggaaaagtggaatggatgcgcgcacgatggacttctgacccgtgttacgctttcttcggggtggacggaaccgagtgtagcttccttatctacttatccgaggttgaatggttctgccctcccctcccctggagaaatcaaacagcggcccagagagctcccaaacctctgcctaaggtgcaggccgttttccgctctaacctgagtcacctgttggatttgatgggctctggcaaagagagcctcatcttcatgaagaagcgcaccaagaggctgacggcgcagtgggcccttgctgcacaacgcctagcgcagaaattgggtgccacccagagggatcagaagcagatcttggtccacatcgggttccttactgaggagtcgggggacgtgttctctccccgcgtgctgaaagggggccctctgggcgagatggtccaatgggccgatatactaaccgccttatacgtgctaggacacggtctccgcgtgacagtgtccttaaaggagcttcaaagtaacctgggggtgcccccaggacgagggtcctgcccgctcaccatgcctctgccgtttgatctgatttataccgactaccacgggctgcagcagatgaaacgccacatgggcttatccttcaaaaaatacagatgtagaatccgagtgattgacacctttggaaccgaacccgcgtataatcacgaggagtacgccaccctgcatggatacagaacgaactggggttattggaatctcaaccccaaacagttcatgacaatgttccctcatactcccgataacagcttcatgggttttgtttccgaagagctgaacgagactgagaaaagactcatcaaaggggggaaagccagcaacatggctgtggtgtatggcaaagaagcatccatttggaaattgcagggaaaagaaaaatttctaggcatcctgaataagtatatggagatccacggaaccgtatactacgaatctcagcggcctccggaggtacctgccttcgtgaagaaccatggccttctgccccagccggagtttcaacagctgctacgaaaggctaagctgtttatcgggtttggattcccttatgaaggcccagctcccctcgaggcgatagccaatgggtgtatattcctccaatcccgattctcacctccccacagctccttaaaccacgagtttttccgaggaaaaccgacctcacgggaagttttctctcagcatccatacgcagaaaactttattggaaaaccacatgtttggactgtggactacaataatagcgaggagttcgaggccgccattaaagccattatgcgaacccaagtggacccttatctcccgtatgagtacacttgtgagggaatgctggaaagaatccatgcctacatccaacatcaggacttctgtagggctcctgaccccgctcttccggaagcccacgcaccacagagcccatttgtacttgcccctaacgctacccatttagagtgggcgagaaacactagcttggccccgggcgcgtggccacccgctcatgcactgcgggcttggctggcggtccctgggcgcgcctgtactgatacatgtctcgaccatggccttatttgcgagcctagcttctttccatttctaaatagccaggacgcctttctcaagctgcaagtcccctgtgattccaccgaatctgagatgaatcacctgtaccctgccttcgctcagcccgggcaagaatgttacttacagaaggagccgctgttgttcagttgcgccgggtcaaacacaaaatatagacgactttgcccctgcagggactttaggaaaggtcaggtcgcgctgtgtcaaggatgtctgtag

SEQ ID NO: 123355 - DNA, 1338 bp, Artificial Sequence
  Description of Artificial Sequence: Synthetic coding sequence
atgttgaaaaagcaaagtgccggactcgtcctgtggggtgcaatcctgtttgtggcatggaacgctctgctcctgctgttcttctggacacggcccgccccgggaagaccaccttcagtctcagctctggacggtgatcctgcatccttgactagggaagtaatccgacttgctcaggatgcagaggtggaactagaacgccaaagaggcctcctgcagcagatcggcgatgccctctcaagtcagaggggtcgggttcctaccgccgcaccccctgctcagccaagggtgccagtcactccagcgcccgcagtgatacctattctggttattgcttgtgataggtccaccgttcgcagatgtctcgacaagttattgcactaccgaccctcagccgaactgtttccaataatcgtcagtcaggattgcggtcacgaggaaaccgcccaggctatcgctagctacggctctgccgtgacgcacatacgtcagcctgacctgtcgtcgatcgccgtgccaccagaccataggaaattccagggctactataagatagcgcgccactaccgatgggctctcggacaggtcttcagacagttcagattccccgcagccgtggtggtggaggatgacctggaagtggccccagatttttttgagtatttccgagccacataccctctactgaaagccgatccgagcttatggtgcgtgtctgcctggaacgacaacggtaaagaacagatggtagacgcaagccgcccagaactactgtaccgcactgacttctttccaggcctgggatggcttttgctagccgagttatgggccgaattggaaccaaagtggcccaaggctttttgggacgattggatgcgccgaccagaacagagacagggcagagcatgtattaggcccgaaatcagtcggactatgacgttcggtcgcaagggcgtgtcacacggccaattttttgatcaacacttgaaatttattaagttaaatcagcaattcgtgcactttacacagctagatctgtcctatcttcaaagggaagcatatgatcgagacttcttggcaagggtttacggagccccacaactccaggtggagaaagttcgcacaaacgatagaaaggagttaggcgaggtccgggtgcagtacactggcagggattctttcaaggcctttgctaaagcgctcggcgtcatggatgatctgaaaagtggtgtcccacgcgcggggtacagggggatcgttacgtttcaatttagaggacggcgtgttcatctggccccccccttgacgtgggagggttacgatccctcctggaactag

SEQ ID NO: 123356 - DNA, 1338 bp, Artificial Sequence
  Description of Artificial Sequence: Synthetic coding sequence
atgctgaaaaaacagagtgccggtctcgtactatggggcgccattctcttcgtggcatggaacgccctgctgctgctgttcttctggaccaggccagcaccaggccgccccccttccgtgtccgctctggatggtgatcctgcttcacttactagagaggtgatccgattggcccaggacgctgaggtagagctggagcgtcagaggggcctgttacaacaaatcggagatgccttgagttcccagcgtggcagagtgcccaccgcagcccctcctgcgcaaccacgcgtgcctgtcacaccagcacctgctgttatcccgatactagttatcgcatgcgaccgcagtaccgtgcgcagatgcctggacaagcttctgcattatagaccatccgctgagttatttcctatcatcgtcagccaggattgtggccatgaagagactgcccaagctatagcgtcctacggttccgccgtcacacatattcgccagcccgatctttcatccattgccgtgccacctgatcacaggaagtttcagggatattataagatcgctaggcattacagatgggccttgggccaggttttccgtcaattccggtttccagccgccgtggtggttgaagacgatcttgaggtggctcccgacttcttcgagtattttcgagctacttacccactgttgaaggccgaccctagcctgtggtgtgtgagcgcatggaacgataatggaaaggagcagatggttgacgcctcccggccagagttattgtacagaacagatttctttcccgggctgggctggctgctgttggctgagctgtgggcggaattagagcccaagtggccaaaggccttttgggatgactggatgcgccgccctgaacagcgacagggcagggcctgcatcaggccagagatctcccggacgatgactttcggtaggaagggagtgtcacatgggcaatttttcgaccagcatctcaaattcatcaagcttaatcagcagttcgttcattttacccagttggacttaagctatctccagcgggaggcatacgatagagactttttagcgagggtctacggcgcccctcagctgcaggtggagaaagtccgtactaacgatcggaaagagctgggggaggtgagagtccaatacacaggtagagatagcttcaaagccttcgcaaaggcactcggggtcatggacgatctcaagagcggagtgcctcgggctggatatcggggcattgtcacgttccagttccggggccgccgggtgcatcttgctccacctttgacatgggaaggctatgatccttcttggaattag

SEQ ID NO: 123357 - DNA, 1338 bp, Artificial Sequence
  Description of Artificial Sequence: Synthetic coding sequence
atgttaaagaagcagtccgccgggctggtactgtggggcgctattcttttcgttgcatggaacgctctcctcctcctcttcttttggacaagacccgcaccaggacgcccgccatctgtgtccgcgctggacggcgatccagcctccctcacaagggaggtcatacgtctggcacaggacgccgaggtggagctggagagacaaaggggactgttacaacagattggagatgctctgtcttcgcagagaggtcgcgttccgactgctgccccccccgctcagcccagggtgcccgtcacccccgccccggcagtgatccccattcttgtcatcgcgtgcgataggtccaccgtacggaggtgccttgataagctgctacactatcgccccagcgctgagttatttcccattatcgtgagtcaggactgtggccatgaagagacggcgcaagccatcgcttcatatggctcagcagtgacacatataagacagccagacctttcctccatcgccgtgcccccagaccatagaaaatttcaagggtattacaagatcgcaagacactataggtgggctctgggacaggtgtttcgccagtttaggttccccgcagccgtggtggtggaggacgatctggaggtggcccctgacttctttgagtatttcagggccacctatccattactgaaggccgatccatctttgtggtgcgtgtccgcttggaatgataacggtaaagaacagatggtagatgcatcccggccagaactgctatatcggaccgacttttttcctggattggggtggttacttttggcagagctgtgggctgagctggaacctaaatggcctaaagcattttgggatgactggatgaggcgccccgaacaacgccagggccgagcgtgtattcgccccgagatctcccgaacgatgacattcggcagaaaaggcgtgagccatgggcagttctttgaccagcatttgaaattcattaagctgaaccagcagttcgtccattttacgcagcttgacctgtcttacctgcagcgcgaggcatatgacagagactttctcgccagagtgtacggcgccccacaacttcaagtggaaaaagtgcgcaccaatgacagaaaggaactgggtgaggtcagggtccaatataccggccgtgacagtttcaaggcttttgccaaggcactcggcgtgatggacgatctgaagagcggagtgcctcgtgcaggctaccgtggcatcgtaaccttccaatttagggggcgccgtgtgcatctcgccccgcccctgacgtgggaaggctatgacccttcctggaattag

SEQ ID NO: 123358 - DNA, 1338 bp, Artificial Sequence
  Description of Artificial Sequence: Synthetic coding sequence
atgctcaagaaacagtcagctggtctggtgctgtggggcgctatcctgttcgtcgcgtggaacgctctgctgctcttgtttttttggacccgcccggcccctgggcgaccgccctcagtcagtgccctggacggagaccccgcatccctgactcgagaggtgattagactggcacaggacgccgaggtagaattggaacgccagcgcggactgctccagcagatcggggatgcgctgtcttctcagagaggaagggtacctactgcagccccacccgctcagccaagggttcctgtgacacccgccccggccgtgatcccaatccttgtgatcgcttgtgaccggagtaccgttcggagatgcttggacaagctgctacactacagaccctctgctgagctgttcccgattatcgtgagccaggattgtgggcacgaggaaacagctcaagccatcgcctcgtatggcagcgcggtgacgcacattaggcagcctgatctgtctagcatagcagtgcctccagatcacaggaagttccaagggtattacaagatagccagacactacagatgggccctggggcaggtctttcgccagttcaggtttcctgctgctgtggtcgtcgaggacgatctagaggtggcccccgactttttcgagtacttccgggccacttatcccctgctcaaggcagatccatctctctggtgtgtgtcggcgtggaatgacaacgggaaggaacagatggtggatgcttcacgacctgagcttttgtacaggactgatttctttcctggcttgggttggctgctcctcgccgaattgtgggcggagttggagccgaagtggcctaaggcgttctgggacgattggatgcgtcgcccggagcagcggcagggtcgagcctgtatcaggcccgagatctcccggaccatgaccttcggacgaaagggtgtcagccatgggcagttttttgatcagcacctgaagtttattaagttgaatcaacagttcgtccatttcacccagctagatctaagctaccttcaacgcgaagcatatgatcgcgatttcctcgctagggtgtacggagcccctcagttacaggttgagaaagtcaggaccaatgatagaaaggaattgggcgaagttagagtccagtataccggtcgtgattcatttaaggcttttgcaaaagccctcggggtgatggatgatctgaaaagcggggtgcccagagccggatacaggggcatagtgaccttccagtttaggggcaggagagtccacctggctcctcctctgacatgggagggttatgacccaagttggaattag

SEQ ID NO: 123359 - DNA, 1338 bp, Artificial Sequence
  Description of Artificial Sequence: Synthetic coding sequence
atgttgaagaaacagtccgcggggctagtgctgtggggtgcgatcctctttgtcgcatggaacgctctgcttcttttatttttctggaccaggcctgcgcctggacggcctccctctgtgtcggcactggacggagatcccgcttcgctgacccgcgaggtcataagactggcccaggatgcagaggtcgaattggaacggcaacgggggttgctccaacagatcggagacgctctatcgtctcagagagggcgggtgccgacagcagcacctccagcacagcctagggtccctgtgaccccagctcccgcagtgatccccattttggttattgcatgcgaccgatccactgtaagacgctgtctggacaagcttcttcactataggcctagcgccgagctgttccctatcattgtgagccaagattgtggccacgaggagacagcccaagctatcgcaagctatgggtctgccgtcactcatatccgccagccagatctgtcaagcattgccgtgccccccgatcatcggaaatttcaggggtattacaagattgccagacactaccggtgggccctcggccaagtgtttcggcagttcaggtttccagctgccgtggtggtcgaagacgaccttgaagtggctcctgacttttttgaatattttagagcaacctatcctttgctgaaagccgatccgtccctgtggtgcgtgagcgcctggaacgacaatggaaaggaacagatggtagacgcctccagacccgagctgctgtaccggacggatttcttccctggactgggatggctgcttctggctgaattgtgggccgagcttgaaccgaaatggccaaaagctttttgggatgactggatgcgccggccggaacagcgacagggccgtgcctgcatacgccccgagatcagcaggactatgacattcggccgcaaaggcgtgagccatggccagttctttgaccaacaccttaagtttataaaattgaaccagcagttcgttcattttacccagctcgacctgagctaccttcagcgcgaggcttacgacagggatttcctcgcgagagtctatggagctccccaacttcaggtcgagaaggtccgaacaaacgacagaaaagagctcggtgaagtccgagtgcaatacaccggacgagacagtttcaaagccttcgctaaagctctgggggtaatggacgacttaaaatctggtgttcctagggcgggctacagaggaatcgtaacctttcagtttagagggcgcagggtccacttagccccccctttgacatgggagggctacgatccgtcatggaattag

SEQ ID NO: 123360 - DNA, 909 bp, Artificial Sequence
  Description of Artificial Sequence: Synthetic coding sequence
atgctgaaaaagcagtccgctggactggtcctatggggagctatattatttgtcgcctggaacgccctgctgttgttattcttctggactcgtccggcgcccgggcggccacccagcgtcagcgcactggacggcgacccagcatctctgaccagggtctttaggcagtttcggtttcctgctgccgttgtcgtcgaagatgacctcgaggtggcccccgacttcttcgagtatttccgggccacgtacccactgctgaaagctgaccccagcctgtggtgtgtatctgcttggaatgataacgggaaggaacagatggtggacgcctctcgaccagagttgctgtataggactgatttcttcccaggactgggctggctcctactggctgaactctgggccgaattagagcccaagtggccgaaagctttttgggatgactggatgcgtaggccagaacagagacagggccgggcatgcatccgccctgaaatctccagaaccatgacattcggtcgaaagggggttagtcacggccagttcttcgaccagcacctaaagttcatcaaattgaaccagcagttcgtccactttactcagttagatctgagctatctccagagggaggcctatgatcgggatttcctagcccgggtctatggtgcacctcagttgcaggtggagaaggtgcgcacaaatgaccggaaggagttaggcgaagtgcgagtgcagtataccgggcgggatagtttcaaagccttcgccaaggccctcggagtgatggatgacctgaagagcggggtgccccgggccggatatcgcggaatagtgaccttccaattccgcggtcgccgtgtccacctggccccccccttaacttgggagggctacgacccatcctggaactag

SEQ ID NO: 123361 - DNA, 312 bp, Artificial Sequence
  Description of Artificial Sequence: Synthetic coding sequence
atgttaaaaaagcagtccgccgggttggtgctttggggcgctattctgtttgtcgcttggaacgctctcctcctgctcttcttttggactcgtccggcccctggacgaccgccctcggtgagcgctttagatggcgaccccgcctcattaacccgcgaggtgattcggctcgcacaggatgctgaagtcgagctcgagagacagcgagggctcctccagcagataggcgacgccctctcatcccagagagggagggtgccaaccgccgcaccacctgcgcaacccagggtgcccgttactccggcaccctag

SEQ ID NO: 123362 - DNA, 600 bp, Artificial Sequence
  Description of Artificial Sequence: Synthetic coding sequence
atgttgaagaaacaatcggcagggttagtgttatggggggctatactgtttgtggcttggaacgcactgctacttctttttttttggaccaggcctgcaccggggcggcctccttctgtcagtgctctggatggcgacccagcgagccttacccgtgaagtgattaggctggcccaagatgccgaggtcgaattggagagacagcgtgggctgcttcaacagatcggagatgccttgtcttcccagcgcggtagagtgcccaccgccgcaccccccgcccagcccagggtgcccgttacccctgcccctgccgtcatccctattctcgttatcgcatgcgaccggtcaacagttaggaggtgtttggacaagttactccattaccgcccatcagccgaactgttcccaattatcgtgtcccaggactgtggccatgaggaaacagcccaggccattgcctcttacggttccgcagtcacgcacatccgccagccagacctgtcctccatcgccgttcctcccgaccatcggaagttccagggatactacaagatcgcccggcactaccggtgggcactcgggcaagtgttccggcagtag

SEQ ID NO: 123363 - DNA, 336 bp, Artificial Sequence
  Description of Artificial Sequence: Synthetic coding sequence
atgctgaagaaacagagtgccggcctcgtgttatggggggccattctgttcgttgcctggaacgccctgctattgctctttttctggaccagacctgcccctgggcgtcccccatccgtctcggccctggacggagaccccgcttcgctcactcgcgaagtcatcaggctggcccaagacgccgaagtggaactggaacgccaaaggggattactgcagcagattggtgatgcactgtctagccagagaggaagagttcctaccgcagcaccacccgcccaacctcgagttccggttacacctgccccagctgtgattccaattttggtcatttag

SEQ ID NO: 123364 - DNA, 465 bp, Artificial Sequence
  Description of Artificial Sequence: Synthetic coding sequence
atgctgaagaaacagtcagccggccttgtgctgtggggcgccattttattcgttgcctggaatgccctgctacttctgttcttttggactcgtccagcacccgggcggccaccgtccgttagcgctctggacggcgacccagcttctttaactcgtgaagtgatcaggttggcccaggacgcagaggttgaactcgagcgtcagcgaggtctgctacagcagataggagacgccctttcctcccagagggggcgcgtgcccaccgctgccccgcccgcccagccccgcgtgccagtgactccagctcctgccgtgatcccgatcctggtaattgcctgcgaccgatcaacagtccggcgctgtctcgacaaactcctacattatcgccctagcgccgagctcttccctattatcgtgtcccaggactgtggacatgaggagaccgcccaggcaattgcctcatag

SEQ ID NO: 123365 - DNA, 105 bp, Artificial Sequence
  Description of Artificial Sequence: Synthetic coding sequence
atgctgaagaagcagagcgcagggctggtcttatggggcgctatcctctttgtcgcttggaacgcactcctgctgctttttttctggacaagacctgccccctag

SEQ ID NO: 123366 - DNA, 348 bp, Artificial Sequence
  Description of Artificial Sequence: Synthetic coding sequence
atgctaaagaaacagtccgccgggctggttctctggggagccatcctctttgtcgcatggaatgcgttgctgctacttttcttctggacacgacctgcccctggcagacccccgtcagtgtcagccctagacggagatcccgcgtccctgaccagagaagtgatccgattggcccaggatgctgaggtcgaactcgagagacaacgcgggctactgcagcaaattggggacgcactgagcagccagcgcggaagggtccccaccgccgcgcctcccgctcaaccaagagtcccggtgactccagccccagccgttatccctatcctagtaatcgcatgcgacagatag

SEQ ID NO: 123367 - DNA, 288 bp, Artificial Sequence
  Description of Artificial Sequence: Synthetic coding sequence
atgcttaaaaagcaaagcgctggtttagttttgtggggcgcgattttatttgtggcttggaatgctttgctgcttttgttcttttggacgcgccccgccccaggccgtcccccctcagtgtctgcattggacggggaccccgcttcactgaccagggaggtgattaggctggcacaggacgctgaagtggagctcgagagacaaagaggtctgttgcagcagataggcgacgcgctgagcagtcaaagaggacgcgttcccaccgctgcaccgccggctcagccttag

SEQ ID NO: 123368 - DNA, 384 bp, Artificial Sequence
  Description of Artificial Sequence: Synthetic coding sequence
atgctcaaaaagcaatctgctgggctggttttgtggggcgcaattctgtttgtcgcgtggaacgcccttctgctcctgtttttttggactcgtcccgctcctggaagacccccctctgtgagcgctctggacggcgacccggcgagtctgacacgcgaagtcattagacttgcacaggatgccgaagtcgagctggagagacagcgcggattgctgcaacagattggggacgccctcagctcacaacgcggcagggtgccgactgcagcacccccggcccaaccccgcgtgcccgtgacccccgcgcccgccgtgatacctatcctcgtgatcgcgtgcgaccgttccacggtgcggcggtgtctggataagctgctgcactag

SEQ ID NO: 123369 - DNA, 318 bp, Artificial Sequence
  Description of Artificial Sequence: Synthetic coding sequence
atgctgaagaaacagtccgccgggttagtgttatggggggccattctgttcgtcgcctggaatgcccttttactgttgtttttttggactagacccgcccccggaaggcccccctcggttagtgcgctggacggggaccctgcgagcctcacccgggaagtgattagactcgctcaggatgcagaagtggaactggaaagacagcgggggctccttcaacagatcggagacgcattatcaagccagaggggccgggttccaactgcagcaccccctgctcaaccaagggtgcccgttactcctgcgccggctgtttag

SEQ ID NO: 123370 - DNA, 1608 bp, Artificial Sequence
  Description of Artificial Sequence: Synthetic coding sequence
atgaggttgcgaaatggcactgtggcaactgcgctggctttcatcacctcctttcttacactctcctggtacacaacttggcaaaacggaaaggaaaagctcatcgcctaccagagggaatttcttgccctaaaagagcgattgaggatcgccgaacacagaatatcccagcggagctccgagttaaatacaatagtccagcagttcaagcgcgtgggagcagagactaacgggtctaaagacgctctgaacaaattcagcgataacacgctgaaactccttaaagagctgaccagcaaaaagtccctgcaggtgcccagtatatattatcacttgcctcacctgctcaaaaacgaagggtcattgcagcccgcggtacagataggaaacgggagaacgggggtcagcatcgtgatgggcattcctactgtaaagagagaggttaaatcgtatctcattgagacccttcactcgcttatagataatttatatccagaggagaagttggactgtgtgatagtcgtttttataggagaaaccgatattgattacgtgcatggagttgtggcaaatctagaaaaagagttttccaaggaaataagcagcggcttggtcgaggtgatttctccccccgaaagctattaccccgaccttacgaatttgaaggagacgttcggcgacagcaaagaaagggtacggtggaggactaagcagaatctggattattgttttctgatgatgtacgcccaggagaaaggcatctattatattcagctagaagatgatattattgtgaagcagaattacttcaacaccatcaagaattttgcgctccagctgtccagcgaggaatggatgatactggaattttcccagttaggtttcatcgggaagatgttccaggcccctgacctcacgcttatcgtggaattcatcttcatgttctataaagagaaaccaatcgattggctactggaccacatcttatgggtgaaagtctgtaatccagaaaaagatgcaaaacactgtgatcggcagaaagccaacctacgtatacgcttcagaccatccctatttcagcacgtcggattgcattcaagtctgagcgggaagatccaaaagctgaccgataaggattatatgaaacccctcctgctcaaaatacacgtaaacccacctgccgaggttagcacttctctgaaggtttatcaaggacacacactggaaaagacctatatgggtgaggatttcttctgggcgattacaccgattgcaggagattatatcttgttcaagttcgacaaacccgtgaatgtggaatcctacctgttccattctgggaatcaggagcacccgggagacatccttctcaacacgactgtggaggtgttacctttcaaaagcgagggcctcgagatatccaaagaaaccaaagataaaaggctggaggacgggtactttcgtatcgggaagttcgagaatggcgtggccgaaggaatggtagatccctcccttaaccccatctctgccttccggctgtccgtcatccaaaattccgccgtatgggcgattttgaatgagatacacatcaagaaggcgacaaattag

SEQ ID NO: 123371 - DNA, 1608 bp, Artificial Sequence
  Description of Artificial Sequence: Synthetic coding sequence
atgcgacttagaaacggtaccgttgcaactgccctcgccttcataactagcttcctcaccctgagttggtataccacgtggcagaatggtaaggagaagctcattgcataccagcgcgagtttctggctctgaaggagcgcctgagaattgctgagcatagaatctcgcagcggagtagcgagctgaacacgatcgtacagcaatttaagagggtgggcgccgaaaccaatggttcaaaggacgcattaaacaaattttccgacaatacactaaaactcctcaaggagttgacctcaaaaaagtcactgcaggtgccatccatatattatcacctgcctcacctcctgaagaacgaggggagcctacagccagccgttcagattgggaatggcaggaccggcgtctctatcgtgatggggatccccactgtcaagcgggaagtcaaatcttaccttatagaaaccctacactccctcatcgataacctttatccagaggagaaactcgactgcgtgatcgtcgtattcattggcgaaaccgacattgactacgttcatggagtcgtcgcaaacttggaaaaagagttttccaaggagatctcatccggactcgtcgaggtgatcagcccccctgagtcatattacccagacctaacaaatctgaaggagacttttggggactccaaagaacgtgtgcgctggaggacaaaacagaatcttgactactgtttcctgatgatgtatgcacaagaaaaaggaatctactacatccaacttgaggacgacattattgttaagcagaactacttcaacacaattaagaatttcgctctacagctcagcagcgaggagtggatgatcctggaattcagtcagctcggcttcattggcaaaatgttccaggcacccgatctgaccctgatcgtggagtttattttcatgttttacaaagaaaaacctatcgactggctgctcgatcatatcctgtgggtgaaagtttgtaacccggaaaaggacgcaaagcactgtgacagacagaaagccaatctgcgaatcagattcaggcctagcctgttccagcacgtgggcctccactcctcactgagtggtaaaatacagaagcttactgataaagactacatgaaaccccttctgttaaagatccacgttaatcctcccgcggaagtttcaactagcttgaaggtgtaccagggacacaccctggaaaagacttatatgggcgaggatttcttctgggccatcacgccaatagccggagactacatactttttaaatttgataaacctgtgaacgtggagtcctacctcttccatagcggtaatcaggaacatcccggcgacatccttttgaataccacagtcgaagttctaccttttaagtctgagggacttgaaatatccaaggagactaaagacaagagactcgaggacgggtatttccggatcgggaaattcgaaaatggcgttgccgagggaatggtcgacccatccctaaacccaatttctgctttccgtctgtccgtgattcagaattccgccgtctgggccatactgaacgaaattcacattaagaaggccacgaattag

SEQ ID NO: 123372 - DNA, 1608 bp, Artificial Sequence
  Description of Artificial Sequence: Synthetic coding sequence
atgcggcttaggaacgggacagtagctacagctctggcttttattacctctttcctgacactctcatggtataccacctggcagaatggaaaggagaaattaatagcttatcagcgcgagtttttagcgctaaaggagaggctgagaatcgcggagcacaggatttctcaacggagcagtgagttgaacaccattgtgcagcagttcaagagagtgggagctgaaactaacggcagcaaggacgccctaaataagtttagcgacaacaccctgaaattgttaaaggaattgacctctaagaagtcacttcaggttccatctatatattaccatttaccccacctgttaaagaacgaaggaagcttgcagcctgccgtccagatcggaaacggcaggactggagtttccattgtcatgggcatacccacagttaagagggaagtgaagtcctatctgatcgagactctgcactctctgatcgacaatctgtaccctgaggagaagctggattgcgtgatcgtggtgttcatcggcgagaccgacattgattatgtgcatggagtcgtggccaacctggagaaagaattcagcaaagaaatctcttctggactcgtcgaagttattagcccccctgagtcctactacccggatcttactaacttgaaagaaacctttggagacagcaaagaacgggtgcgctggcggactaaacagaatctggactactgtttcctaatgatgtatgcacaggaaaaaggcatctattacatacagcttgaggatgatatcatagtgaagcagaattactttaacaccataaaaaactttgcccttcagctgagtagtgaagaatggatgatccttgagttctctcagctgggtttcatcgggaagatgttccaggcccccgacctgacactgatcgtggaatttatattcatgttctacaaggagaagcctatcgactggctgttggatcatatactttgggtcaaagtctgtaacccagagaaagatgctaagcactgtgacaggcagaaagcaaaccttaggatcagattcaggcctagtctcttccaacacgtaggacttcatagctctctcagtggcaaaattcagaagcttacagataaggattacatgaaaccgctcctgctcaagattcacgtgaacccaccagccgaggtgagcacaagtcttaaagtgtatcaaggccacactcttgaaaagacctacatgggtgaagacttcttttgggctatcactcccatagcaggcgattatattctgtttaaattcgacaagccagtgaatgtggaatcctatttgtttcactctggtaatcaagagcacccaggcgacattttgctgaacaccacagttgaggttttgccttttaagagtgaaggcctggaaatcagcaaggagacaaaagataagcgactggaagacggatactttaggatcggtaagttcgagaacggcgtggcagagggtatggttgatcccagtctgaaccctatcagcgccttcagactgtctgtaattcagaacagtgcggtctgggccatactcaacgaaatccacatcaagaaagccaccaactag

SEQ ID NO: 123373 - DNA, 1272 bp, Artificial Sequence
  Description of Artificial Sequence: Synthetic coding sequence
atgaattattcaatcacagttagcattgtgatgggcataccgaccgtcaagcgggaagttaaaagctatctgattgaaacactccattcactgattgataacctctacccagaggaaaaacttgactgtgtcatcgtggtattcattggagagacagacatcgattatgtacacggcgttgtggcaaacttggaaaaagaattctctaaagaaatcagcagcgggttggtggaggtgatatcacccccagaaagctactacccggacctcacaaacctgaaggagacattcggagacagcaaagagagagtgagatggagaaccaagcagaaccttgattattgcttcttgatgatgtacgcacaggagaaaggcatttactatatccagctcgaagacgatatcattgtcaagcagaattacttcaacactatcaagaacttcgcattacagctgagctctgaagagtggatgattttggagttttcccagcttggctttattggaaaaatgtttcaagcccccgaccttacactcatcgtggaattcatctttatgttctataaagagaaacctatagattggctgttagatcacatactgtgggtgaaggtgtgtaaccctgagaaagatgctaaacactgcgaccgtcagaaggccaacctccgcatacggttccggccgtctctcttccaacacgtcggactacactccagtctgtccggaaaaattcagaagctcacggataaagattacatgaaacctctgcttctgaagatccacgtgaatccgcccgctgaggttagcacaagcctaaaagtataccagggacacactttggagaaaacatatatgggcgaggactttttctgggctataacacccattgctggagactacattctttttaagttcgataagcccgtgaatgtagagagttacttatttcattcagggaatcaggagcacccaggggacatactgctcaatacaacagtggaggtattgccgtttaaatctgaagggctggaaatatccaaggagaccaaagacaagaggctggaggatggctacttcaggatcggtaaatttgaaaatggagttgccgagggtatggtcgacccttccttaaacccaatcagcgctttcagactgtctgtgatccagaacagcgccgtctgggcaatccttaatgaacagcgcgtgttctctggctggtggcagaaaagtagagacaaggctgagggtcctcaggcacccttattgttttag

SEQ ID NO: 123374 - DNA, 1647 bp, Artificial Sequence
  Description of Artificial Sequence: Synthetic coding sequence
atgcgtctgaggaacggaacgttccttactctgctgctcttctgcctgtgtgctttcctttcactttcatggtacgccgctttgtccggacaaaaaggtgacgttgtggatgtatatcagagggagttcctggcactgcgggacagactgcacgccgctgagcaggagtccttaaagcgatcaaaggagctgaatttggtcctggatgaaatcaagagagctgtgtctgagcgtcaggcactccgagatggggatggcaatcgcacctggggccgactgaccgaagatccccggctgaaaccctggaacgggtctcataggcacgtgcttcacctgcctactgtcttccatcatctgccccatcttttggccaaggagagttcactacagccagcagtgcgcgtaggtcaaggccggacaggggtgtccgtggtgatgggcatccctagtgtgcggagggaggttcactcttatctgaccgatacgctccacagcctcatctctgagctgtcaccacaagaaaaggaggactcagtgatcgttgtcttaatcgccgaaacagacagccagtacacgtctgcagtcaccgaaaatattaaagccttgtttccgacggaaattcattcaggtctactcgaggtcatcagtcctagtccacatttttatcctgacttcagcagactgagagaatcctttggggatcctaaggaaagggtccggtggcggacaaagcagaacttagactactgcttccttatgatgtatgcgcaatcgaaagggatttactatgtgcagctggaagacgacatcgtggcaaaaccaaactacctaagcaccatgaaaaacttcgcactgcagcaaccttcagaagattggatgatcctggagtttagtcagctcggattcataggcaagatgttcaagtctctggacctgagcctgattgtcgaattcattttaatgttctaccgcgataaaccgattgattggttgctggatcacatcctatgggtcaaagtgtgtaatcccgagaaggatgccaagcactgcgaccggcagaaggcaaacctgaggatcagattcaagcccagtctgttccagcacgtggggacccattcttctctggccgggaagatacaaaagttaaaagacaaagacttcggaaagcaggcgctgaggaaggaacatgtgaaccctcccgccgaggtgagtacgtcactcaaaacctatcagcactttaccctagagaaagcctatctgcgtgaagattttttctgggcctttacaccagccgcaggagacttcatcaggttccggttctttcagcctctgcgtctggagcgcttctttttccggagcggcaatattgagcatccggaggataaattgttcaacacgagtgttgaggtgctcccttttgataatccacagtcggacaaggaggccttgcaggagggacgaaccgcaaccctgcgctaccctcgctcccccgacggttatctacagatcggcagtttctataagggcgtggcagagggagaggtagacccggcatttggacctttagaagcccttcggctctccatacagaccgatagtccagtttgggttattctttctgagattttcttaaagaaagctgactag

SEQ ID NO: 123375 - DNA, 1692 bp, Artificial Sequence
  Description of Artificial Sequence: Synthetic coding sequence
atgtctcgtgtagcagggacccggacagacgtgaatgagcttcttcagagatggacacccagatgtgtgcggtggcacactggcggcgcccggcgggtggccctagaccgccccctagtgacagcatgtctgccccccgccggcgacgttgtggacgtctaccaacgcgaattcctcgccttgagggaccgcctgcacgctgcggaacaagaatctctaaaaagatctaaagagctgaatctggtcctggatgagatcaaaagagcagtcagtgagcgtcaggctcttcgtgacggcgacggcaatcgaacctgggggcgcttgactgaagatccaagactcaagccttggaatggcagtcaccggcacgtgctccacctgcctacggtgtttcaccacctgccccacctcctagccaaggaatcctccttacagccagcagttagggtgggccaggggcgaaccggcgtctcagtggtaatggggatccctagcgtgagaagagaggtgcattcttacctgacagatacattacattccctgattagcgagctttcacctcaggaaaaagaagactctgtgatagttgtgctgattgctgagacagacagccagtataccagcgccgtcacggagaacattaaggcactgtttcccaccgaaatccactctgggctgctggaggtcatcagcccatccccacatttttatcctgatttcagcaggctgagggaaagttttggagatccaaaggagagagtgaggtggagaacgaagcagaacctggactactgctttctgatgatgtatgctcagtctaaaggaatctattacgtgcagctagaggatgatatagtggccaagccaaactatctctctacaatgaaaaatttcgcactccagcagccttctgaggactggatgatcctagagttctcgcagctgggattcatcggtaagatgtttaaatcactcgacttaagtctgatcgtagaattcattttaatgttctaccgtgacaaacccattgattggctgttagaccacatcctctgggtcaaggtatgtaatcccgaaaaggacgccaaacactgcgatagacagaaagccaatctaagaatccgattcaaaccaagtctattccagcacgtgggcacccactctagcctagctggcaaaatccagaagttgaaagataaagatttcggaaaacaggcgctccggaaggaacacgttaacccccccgcagaggtgtccacatctttgaagacctatcaacactttaccctggagaaggcatatttacgggaagactttttctgggccttcactccggctgccggggacttcatcagattccgtttcttccaacctctgcggctggaaagatttttcttcagatcagggaacatcgaacatcccgaagataagctcttcaacacgtcagtggaggtgcttccatttgacaaccctcagtcggataaagaggccctacaagaaggacgtacggctacactcagataccctcggtcccccgatggatatttacagattgggtctttttataaaggagtggccgagggcgaggtggaccctgccttcggccctcttgaggcgttgcgactaagcattcagacagatagcccagtctgggtcattctgtctgaaattttcctgaaaaaggctgactag

SEQ ID NO: 123376 - DNA, 1344 bp, Artificial Sequence
  Description of Artificial Sequence: Synthetic coding sequence
atgagatttaggatctataagcggaaagtactgattttgacactcgtggtggcggcctgcggctttgttctctggtcttctaatggaagacagaggaagaacgaggctcttgccccccccctactggatgccgagccagccaggggggcgggtggacggggaggggaccacccttcagttgccgtcgggatccgcagagtttccaatgtctccgccgccagtctggttcctgccgttcctcagcctgaagctgataaccttacccttagatacaggtccttggtctaccaactgaattttgatcagaccttgcgaaacgtcgacaaggccggcacctgggctccaagagagctggtactcgtcgtccaggtccacaaccgaccagagtatctgagattgctcctggactctctcagaaaagcccaggggatcgataacgtgctcgttatcttctcacacgatttctggtctaccgagataaatcaactgattgccggcgtgaatttctgccctgtccttcaggtgtttttccctttttccatccagctgtacccaaacgagttccctggttctgacccacgggattgcccaagagacttacccaagaacgcggcacttaagctcgggtgtattaacgctgaataccccgattcatttggccactaccgcgaggctaagtttagtcaaacaaaacatcattggtggtggaaactccactttgtctgggagcgggtcaaaatcctcagggactatgcagggctgatactgttcctggaggaggaccactacctcgccccagatttctatcacgttttcaaaaagatgtggaaactgaaacaacaggagtgtccagaatgcgatgtactcagtctgggcacttacagtgcgtctagaagtttctatggtatggcagataaggtggatgttaagacttggaagtctactgagcataatatgggcctggcactgacccggaacgcataccagaagcttattgagtgcactgacaccttctgtacatatgatgactacaattgggattggacactccagtaccttacagtgtcatgcctgccaaagttctggaaagttctggtcccccagatccccagaattttccatgccggagattgtggcatgcaccacaaaaagacctgcaggccctcgacgcagagcgctcagattgaaagtctcttgaacaacaataagcagtacatgtttcctgagactctcaccatctccgaaaagttcacagtcgtggccatatctccgccccgaaaaaatgggggatggggcgatattagagatcacgaattgtgtaagtcctatcgccgactgcaatag

SEQ ID NO: 123377 - DNA, 1362 bp, Artificial Sequence
  Description of Artificial Sequence: Synthetic coding sequence
atggagcgcacagagacaatgcggttccgtatttataagcgaaaggtcctgatattgaccttggtggtggcagcttgcggatttgtcctctggtctagtaacggcaggcagcgtaagaatgaggcccttgcaccccctctcctggatgcagagcctgccaggggggccggtggcaggggaggtgaccacccaagcgttgccgtaggcattcggagggtgagcaatgtgtcggccgcaagcctggttccagccgttccacaaccggaggccgataatttaaccctgcgctatagatctctggtgtaccagctcaacttcgatcagacccttcgaaatgttgacaaagcgggcacctgggctccccgcgagttggtgttggttgttcaggtacacaaccggccagagtacctgcgtttactcctggattctctacgcaaagctcagggtatcgacaatgtcctggtgatcttctcacatgatttctggtcaactgagatcaaccaactcatcgctggggtgaatttctgccccgtcctacaagtgttctttccttttagcatacagttgtaccctaacgagtttccgggaagcgaccctagagactgtcctagagacctccccaaaaacgcggctcttaagctgggatgcatcaatgcggaataccccgattcctttggacattaccgcgaggcgaaattctcccaaactaagcaccattggtggtggaagctgcacttcgtgtgggaacgcgtgaaaattctgcgggactatgcagggctcattctgtttctagaggaagaccactacctggccccagacttctatcacgtctttaaaaagatgtggaaattgaagcagcaggaatgcccggagtgtgatgttctgtctcttggaacctactccgcatccagaagcttttatggcatggcagacaaagtagatgtaaagacctggaaatctaccgagcacaatatgggcctggcgctgacacgcaacgcctatcagaagctgatagagtgcactgatacgttctgtacatacgacgactacaattgggattggacattgcagtatcttacggtttcctgtctgcccaaattctggaaagtgttggtgccacagatacctagaattttccacgccggagattgtgggatgcaccataaaaaaacttgtcggccttctacccagagcgcacagatcgagtccctcctgaataacaacaaacagtacatgttcccagaaacactgacaatttccgaaaaattcacagtcgtcgccattagccccccaaggaaaaacggcggttggggcgatataagagatcatgaactttgtaagtcttacagaagattgcaatag

SEQ ID NO: 123378 - DNA, 2373 bp, Artificial Sequence
  Description of Artificial Sequence: Synthetic coding sequence
atgatcaccgtgaaccctgatgggaagataatggtcaggagatgcttagttaccctgagacctttccgtctgtttgtactgggcatagggtttttcaccctgtgtttcctgatgactagccttgggggacaattcagtgctcgccggctaggggactctccattcactattcgaaccgaggtcatgggcggccctgaatccaggggcgtcctgagaaagatgtcagacctgctagagcttatggtgaaacgcatggacgccctggcccgactggagaattcctcagaactgcaccgagctggaggcgatctgcacttccccgcggacagaatgcccccaggcgctgggctaatggaacgcatacaagccatagctcagaatgtatctgatatagcagtgaaggtggatcaaatcctcagacacagtctgttattacacagtaaggtgtctgaagggcgcagagaccaatgcgaggcccccagcgatccaaaattcccagattgctccggcaaggttgagtggatgcgggcccgctggacaagcgacccatgctatgctttttttggcgtggatggaactgagtgttcttttctcatttacctctctgaagtcgagtggttctgccctcccttaccatggcgcaaccagacggcggctcagcgagctccaaagccactgccgaaggttcaggcagtgttccgcagcaacttgtcccaccttctggatcttatgggctccggtaaggaatctctaatcttcatgaagaagcggactaaacgactgacagcccagtgggctcttgctgcccagaggctggcccagaaactcggagcaacccagcgcgaccagaagcagatcttggtgcatatagggtttctcactgaggagagcggcgatgtcttcagcccacgcgtgctgaaggggggcccgctgggtgaaatggtccagtgggccgacattctcacagcattgtatgtcctaggccatgggctccgcgtcactgtgagcttgaaagagctgcagtctaaccttggggttcctccaggccgcggctcatgccccttgactatgccgttgccttttgatctgatatataccgactatcacggattacagcagatgaaacgacacatgggcctgagcttcaaaaaataccgctgcagaatccgtgtcattgacaccttcggcaccgaacccgcatataaccacgaggaatacgctacgctccacggttatcgcacgaactgggggtactggaatctcaatcctaagcagttcatgactatgttcccacacactccagataactctttcatggggttcgtgtcagaggaactcaacgagacagagaagagactgatcaagggcggaaaggcctccaacatggctgtggtttacggaaaagaggcttccatctggaagggcaaggaaaagtttttgggcatccttaacaagtacatggagattcatggtacggtgtattatgagtcccagcgtccgccagaggtgcccgccttcgtcaaaaaccacggactgctccctcagccggaatttcagcaattactgagaaaagctaagctgttcatcgggttcggctttccatatgagggccccgccccacttgaagccatcgctaatggttgcatctttcttcagagccggttcagccctccgcacagcagtctgaatcacgagttcttccgcggtaaacccacctcgagagaggtgttctctcaacatccttacgcggagaatttcataggtaagcctcatgtatggactgtcgactacaacaactctgaggaatttgaggctgcaatcaaagctataatgcggacgcaggtggacccttacctgccctacgagtacacctgcgagggtatgttagagcggatacacgcctatatccagcaccaggacttttgtagggcccctgaccccgccttgcccgaggcccacgcacctcagtcacccttcgtcttggcgcccaacgccacacatttagaatgggctcgcaacacatctctggcacctggagcctggcccccagctcacgctctgagagcttggctagctgtgccaggcagggcctgtaccgacacatgccttgaccacggccttatatgcgaaccttctttctttccttttcttaattctcaggatgcctttttgaaactgcaggttccatgtgactccacagaaagtgaaatgaaccacctttacccagcatttgcacagccaggacaggagtgttacctgcagaaggaaccccttttgttttcctgtgctggatccaatactaaatatcgcaggctgtgtccttgtagagatttccgcaaaggtcaagtggccttgtgtcaggggtgcctgtag

SEQ ID NO: 123379 - DNA, 1185 bp, Artificial Sequence
  Description of Artificial Sequence: Synthetic coding sequence
atgatcaccgtgaaccctgacggcaaaattatggtcaggagatgcttggttacccttcggcccttccgactgttcgttctcgggattggattcttcactctgtgctttctgatgacgtctctcggagggcagttttccgcacgacggttgggggattccccctttacaattaggacggaggtgatggggggtcctgagagtagaggtgtacttagaaagatgtctgatctattggagctgatggtaaagaggatggacgcgctggcccgtctcgagaatagtagtgaactacacagagccggcggagatctgcacttcccagcggaccgaatgccccccggagctggcttgatggaacgaattcaggctatcgctcagaacgtgtctgatatcgctgtcaaggtggatcagatccttaggcactctctgctcctgcactccaaagtgagcgaaggacgccgggaccaatgcgaagcgccttcagacccaaaattcccagactgcagcgggaaagtggaatggatgagagcaaggtggacgtccgatccatgttacgcgttctttggcgtggacgggaccgagtgttcttttctgatctacctcagcgaggtcgagtggttttgtccaccactgccctggcgaaaccaaacagccgcacagcgcgcccctaagccccttcctaaggtgcaagccgtgtttagaagcaacctgtcacacctgttggatcttatgggaagcggcaaagaatccctcatctttatgaaaaaaagaacgaaacgcctcacagcccagtgggccctggctgcgcagcgtttggcacaaaaactgggggccactcagcgcgaccagaagcagatcctggtccacattggcttcctgaccgaggaaagcggagacgttttctctccccgggtgctgaaaggtggcccattgggggagatggtccagtgggcagacatactgaccgctctttatgtgctcggccacggactcagggtaactgtgagtttgaaagaactgcagcggcaacgtcgcctgcgatcaagccaagagcaggccagatgcggtgtgatgggagcctgcgagaaaatgctcttggagggggatgtcgcgagcaatactctccttatcgagaagcccagcaaaaaagaaaccgagaaatgcccaaaaaatttagtgacctag

SEQ ID NO: 123380 - DNA, 2406 bp, Artificial Sequence
  Description of Artificial Sequence: Synthetic coding sequence
atgcatagcttcgtgaaacatctttgcagtcgatatgttgtggagcgacaggggacgatggctctgccagccttacttacacgtttgctgcccctccgccggctgttcgttctcggcataggattctttacactttgctttctgatgactagcctgggcggacagttctctgccaggcgtctgggcgacagtccctttaccatccgcacggaggtcatgggtgggccagagtctcggggagttctccgaaagatgtctgatctgctcgagctgatggttaagcgcatggacgcccttgcccgattagagaatagttcagagttgcatcgcgccggtggggacctccacttcccagcagaccggatgcctcctggcgccggcttgatggaacgtatccaggcaatcgcccagaacgtgagcgatatcgctgttaaagtggatcaaatattacggcacagcttgctgctgcacagcaaggtgtcagagggccggcgagatcagtgtgaagcaccctctgatcccaaatttccagactgcagcgggaaggtcgaatggatgcgtgcccggtggacaagcgacccatgttacgcattttttggggtagatggaaccgagtgctctttcctgatatatctctctgaagtggagtggttctgcccacctctcccttggaggaatcagaccgcagcacagcgagctcccaaaccactgcctaaggtgcaggccgtgttccggagcaacctttcccatttgcttgaccttatgggcagcggcaaggaatctctaatctttatgaagaaacggacaaaacgcctaacagcacagtgggccctcgccgcccagcgcctcgcacaaaaactgggggccactcagagggatcagaaacagatccttgtgcacattgggttcctgaccgaggagtctggggacgtgttctcccctcgcgtgctaaagggcggtcccctgggggagatggttcagtgggccgacatattaactgcactatacgtgctcgggcacggcctccgtgtgactgtgtccctaaaagagcttcaatctaacttgggggtgccccctggcaggggctcatgccctctcacaatgccactgcctttcgatctgatctacaccgactaccacggcttacagcagatgaagagacatatggggctatccttcaagaaataccgctgccgaattagagttattgatactttcgggacggagccagcctataaccacgaggagtatgcaactctgcacgggtatagaacgaattgggggtactggaatttgaaccccaagcaatttatgactatgtttccccataccccagataatagctttatgggctttgtttcagaagagttgaacgaaacagagaagcgcctgatcaaggggggtaaggctagtaatatggcagtagtttatgggaaagaagccagcatttggaaaggaaaagaaaagttccttggcatcctgaacaagtatatggagatccacggtaccgtgtactacgagtctcaaaggccacccgaagtccccgcttttgttaagaaccacggacttctgccacaacctgagttccagcaacttcttcggaaggctaagctctttatcggattcggtttcccgtacgaaggccctgccccccttgaggcaattgcaaacggatgcatctttttacagtccaggttcagtcctccccactcctccctcaaccatgagttttttcgtggcaagccgaccagcagggaggtgttctcccagcacccttacgcagagaactttatcggcaaaccccacgtgtggacagtcgactataacaattctgaggaattcgaagcagcgatcaaagctatcatgcgtactcaggtggatccttatctcccctatgaatatacctgcgagggaatgctagagcgcatccatgcttatatacagcatcaggacttctgccgagctccggatccagccttgccagaagcacacgcgccccaatcgcccttcgtgctcgcacccaacgccacacacctggaatgggctcgaaacacctctcttgcccctggggcctggcctcctgcacacgccctgagagcatggctcgcagtgcccgggagagcatgtaccgatacctgcctcgatcacgggctcatctgcgagccttcattctttccctttcttaatagtcaggatgcttttctgaaactccaggtcccctgtgattcaactgagtccgagatgaaccacctctaccccgcctttgctcagccgggacaagaatgctacctgcagaaggaaccactgctcttcagctgcgcgggtagcaacactaagtaccggcgtctctgtccctgcagggactttaggaagggtcaggtcgctctctgtcaaggctgtctgtag

SEQ ID NO: 123381 - DNA, 1602 bp, Artificial Sequence
  Description of Artificial Sequence: Synthetic coding sequence
atgaagatgcggcgctataaacttttcctgatgttctgtatggccgggctgtgcttgataagcttccttcacttctttaagactctgagctacgttacgttcccgagagagctggcgagtctgtctccgaatctggtgagctcttttttttggaacaatgctcctgtcaccccccaggcgtctccagagccaggagggccggatttgctgcggacccccctgtactctcacagtcccctgcttcagccactccctccctcaaaggccgctgaggagttgcatagggtggatctagtcctgccggaggacacaacagagtattttgttcgtaccaaggccggcggagtgtgcttcaagccgggaacgaaaatgttggaacgtccccccccaggacggccggaggaaaagcccgaaggagctaacgggagctcagccagaagaccaccccgctacctgcttagtgcgcgtgaacgtaccggcgggagaggcgcacgtcgcaaatgggtcgaatgcgtgtgtttacccggttggcatgggccttcctgtggagttcctactgtcgtgcagtacagtaacctacccaccaaagaaaggctggtgccacgagaggtaccccgacgtgtaatcaacgccataaacgtcaaccacgaattcgacttgttagacgtgcggttccacgagctgggggatgtggtcgatgctttcgtcgtttgtgagagtaatttcaccgcatacggggagcctcgacctctgaagttccgcgaaatgctgaccaacggtaccttcgagtatattcggcataaggtgctatacgttttcttggaccacttcccaccgggtggccggcaagacggttggatcgccgacgattatctcaggacgttcctcacacaggacggagtgtcgcgtcttagaaacctcaggcctgacgacgtcttcattatcgatgacgcggacgaaatccccgccagggacggtgtgttgttcctgaaactgtacgatgggtggacagagccctttgcttttcatatgcgtaaatccctgtacggattcttctggaagcaacctggcacgctggaggtggttagtggctgtaccgtcgacatgctacaggccgtttacgggctggatggcatccggctccgacggcgacagtactataccatgccaaactttcgccagtacgagaataggaccgggcacattctggtgcagtggtccctcggaagccccctccattttgctggatggcactgctcctggtgcttcactccggagggcatctatttcaaactggtatcagcccaaaatggcgatttccctcgttggggggattacgaagataagcgggatcttaattatatccggggtctgattcgaaccggagggtggttcgatggaacccagcaggagtacccccctgcagatccttcagagcacatgtatgcgcctaaatatcttctcaagaactacgatcgatttcattatctgttggacaatccttatcaggagccacggagtacagcggctggaggatggcgacatagagggccggaagggaggccacctgcgcgaggtaaattggacgaggcagaagtctag

SEQ ID NO: 123382 - DNA, 327 bp, Artificial Sequence
  Description of Artificial Sequence: Synthetic coding sequence
atggagtcttgtagttgccaccccggatctggcgtgcaatggagagaccacggctctctccaactcccccctcccggctttaaaatgaagatgcgaagatacaagttatttttaatgttctgcatggccgggctttgtctcattagctttctgcacttcttcaagaccctctcatatgttacattcccccgcgagctggcctccttgtcacccaacctcgtcagctctttcttctggaacaacgccccagtgactccccaggcgagtcccgaacccgggggccctgatttgttgaggacacctctgtacagccactccccgctgtag

SEQ ID NO: 123383 - DNA, 486 bp, Artificial Sequence
  Description of Artificial Sequence: Synthetic coding sequence
atgaagatgagaagatacaagctcttcctgatgttttgcatggcagggctatgcctcattagcttccttcacttctttaagactctctcatacgtcacattcccccgggagctggcctctttaagccctaaccttgtcagttcattcttttggaataacgcccctgtgaccccccaggctagccctgagcccgggggccctgacttactgcggactcccctgtactcacacagccctctcctccagcctctgccgccttctaaggccgccgaggagctgcacagggtggacctggtcctgcccgaggatacaacagagtattttgttagaactaaggctgggggagtttgtttcaaaccaggcacgaagatgttggagagaccgcccccagggcggcctgaggagaaacctgagggagctaacgggtcaagtgcccgcaggccacctcggtatctcctgagcgctcgggaaaggaccgggggatag

SEQ ID NO: 123384 - DNA, 1044 bp, Artificial Sequence
  Description of Artificial Sequence: Synthetic coding sequence
atggtgagcagccaaaaactggaaaagccaatagagatgggttcttctgaacccctacccatcgctgacggcgacagaaggcggaagaagaaacgacgtggacgggcaaccgattccctcccaggcaagttcgaggatatgtacaagctgacatctgaactgcttggagagggcgcatacgccaaggtgcagggcgctgtctcgttgcagaatggtaaagagtatgctgtgaaaatcatcgaaaaacaagcaggccattctcgctcccgcgtattcagggaagtcgagactctgtatcaatgccagggtaacaagaacattctggaactgatcgaattctttgaggacgatacaaggttctacctggtgttcgaaaaactgcagggcggatcaattttggctcacatccaaaaacagaagcattttaatgagcgggaggcctcaagagtggtgcgcgatgtggccgccgctctcgattttcttcatacaaaggggattgcccatcgcgacctgaaacctgagaatatcctgtgcgagagccctgaaaaagtgagcccggttaagatttgtgacttcgacttgggcagcgggatgaagcttaacaattcctgtaccccaattacaactcctgagctcaccaccccttgcggatctgctgagtacatggccccagaggtggtcgaggtgtttacagatcaggccacgttctatgataaaaggtgtgatctgtggagcctgggagttgttctttacatcatgctcagcggctatccaccgtttgtcgggcactgcggggcagactgcggatgggaccggggagaagtctgtcgggtctgtcagaataagctgttcgaatccatacaagaggggaagtatgaattcccagacaaggattgggctcacatcagttcagaggcaaaggacctgataagcaagcttctggtccgagacgccaagcaacgcctctctgcagcacaggtgctgcagcacccctgggtgcaaggtgaacagcaacacaacggccctgacgctcttcgcagctag

SEQ ID NO: 123385 - DNA, 990 bp, Artificial Sequence
  Description of Artificial Sequence: Synthetic coding sequence
atggcaaaaagcatgcctagcaaatccagccgcaacaagcagggaacagttggcgtgggatgcttcgaaagatggaggcggtgtatctcagttcgcgaaacttcctctatcctcgcccacatccagaaacaaaaacacttcaacgaacgcgaggcttccagggtggtgcgagacgtcgcagcagccctggactttttgcacaccaagggaatcgcccacagagacctcaaacctgagaacatcctctgcgagtcacccgaaaaggtcagcccagtaaaaatatgtgattttgatctgggttccggtatgaagttgaataatagctgtactcccattaccacccccgaattaacaacaccgtgcggcagcgccgaatacatggcccccgaggtcgtcgaggtgttcactgaccaggcgacattttatgacaagcgatgcgacctgtggtcactgggcgtggtcttatacattatgttgagcggataccccccgtttgtgggtcactgtggcgccgactgtggctgggatcgaggcgaagtgtgtcgcgtgtgtcagaataagctgtttgaatccatccaggaaggcaagtacgaatttcctgataaagattgggcccacatcagcagcgaagccaaggatttgatcagcaagttgctggtgagagacgccaaacaacgcctaagcgcagcgcaagtgttacagcacccctgggtccagggacaggccccggagaagggattgccgacaccacaagtccttcagagaaatagctccactatggatttgactctgttcgctgctgaggcaatcgcccttaatcgtcagttgagtcagcacgaagagaacgagctggcggaagagccagaggccctggctgatggcctgtgttccatgaagttgagcccgccctgtaaaagtcggttggctagaaggagggccctggctcaggccggtcggggtgaagaccgttctcctccgactgccctgtag

SEQ ID NO: 123386 - DNA, 1275 bp, Artificial Sequence
  Description of Artificial Sequence: Synthetic coding sequence
atggtttcatcacagaagctggaaaagcccatcgagatgggttcatccgaaccactccccatcgccgatggagacagaaggcggaaaaaaaaaagaagagggcgcgccacggacagcctccctggcaagttcgaagacatgtacaaactcacgtctgagcttctcggagaaggcgcatatgctaaagtgcagggtgctgtcagtctccagaatggaaaggaatacgctgtaaagatcattgagaagcaagccggccacagcaggagtcgagtattccgcgaagtcgaaacactgtatcagtgccagggcaacaaaaatatcttggagctgatcgaattcttcgaagatgatacacgcttttacctggtcttcgagaaactccaaggagggtccattctagcccacatccagaaacagaagcacttcaatgaaagagaagcgtcccgggtggtgcgggatgttgctgccgcgctggactttctccacaccaagggcatcgcccatcgcgatctgaagccagagaacattttatgcgagagcccggaaaaagtgtcacctgtgaaaatatgcgacttcgatttgggcagtgggatgaaacttaataacagctgtacgcccattaccacccccgagctcactacaccctgcggtagcgccgagtatatggctccagaggttgtcgaagtgtttaccgatcaggctacattctatgataagaggtgcgatctttggtctttgggggtagtcttgtatatcatgttgtccgggtacccaccattcgtgggtcactgtggagcagattgtggttgggatcgtggcgaggtctgtagagtctgccagaataagctttttgagtctatccaggaaggtaagtatgagttccctgacaaagactgggcacacataagctccgaagccaaagatctgatcagcaaactcttagtcagagatgccaagcagcgtctctcagccgcacaggtattgcagcacccctgggttcagggtcaggcccctgagaaggggttacctacgccccaggtgctgcagcgtaactcgagtacaatggacttaacgttattcgctgccgaagcaattgccctgaaccgccagctttcccagcacgaggagaatgagcttgctgaagaaccagaggccctggccgatgggctctgctccatgaaactctccccaccgtgcaaaagtaggctagcacgccggcgggcgctggctcaggccggccgaggagaagaccgctcgcctcctacagcattatag

SEQ ID NO: 123387 - DNA, 1398 bp, Artificial Sequence
  Description of Artificial Sequence: Synthetic coding sequence
atggtgtcgtcacagaaactagagaaacccatcgagatgggaagtagtgagccactccccattgctgatggcgataggcggcgaaagaagaagcgacgtggacgcgcaacagacagtctccctggcaaattcgaggatatgtacaagctgacttcagagttgctgggggaaggcgcttatgcaaaggtgcagggcgctgtcagtttgcagaatggaaaggaatacgctgtgaagataattgagaagcaagccggtcacagtcggagcagagtgttccgcgaggtggaaactctgtaccagtgccagggcaataaaaacattctggagctgatcgaattctttgaggatgatacgaggttctatctggtgtttgagaagctgcagggcggctcaattctggcacacatacagaaacaaaaacactttaatgaacgagaggcttctagggtggtcagagatgttgctgcagctctggactttctgcacaccaaagacaaagtaagcctgtgtcacctgggttggtcagccatggccccatctgggctgacagccgcccccacttctttgggctcttccgatcctcccaccagcgcctctcaggtcgctggcaccacaggaatcgcccatagggacctgaagcccgagaatattctgtgtgaaagccccgagaaggtttcccctgtgaagatttgtgatttcgatctcggctccggtatgaagttgaacaactcttgcactcccatcactaccccagaattaactaccccttgcggcagcgccgaatatatggcgcccgaagtggtggaagttttcaccgatcaggctacgttttatgacaaaaggtgcgatctctggagcctgggcgtggtgctgtacatcatgttgtccggctacccaccatttgtggggcattgtggggccgactgtggatgggataggggggaggtctgcagagtgtgtcaaaataagctatttgagtcaatccaggaagggaaatacgaattccctgataaagattgggctcatataagttccgaagctaaggacttgatttccaagctgcttgtgagggatgcaaagcagcggctaagcgccgcccaggtgttacagcacccatgggtgcagggacaggctccggagaagggcctccctacaccccaggtcctacagcgaaatagctctaccatggacttgacattgtttgccgccgaggctattgctctgaatcgccagctcagtcagcatgaagagaacgagctcgccgaggagcccgaggcactggccgacggtctgtgtagtatgaaattgagccccccttgcaaatctcggctggcacgtcggcgagcattggcacaggccggccggggcgaagacagatcgcctcccacagccctttag

SEQ ID NO: 123388 - DNA, 1044 bp, Artificial Sequence
  Description of Artificial Sequence: Synthetic coding sequence
atggttagttctcagaaactggagaaacctatagagatggggagcagtgaaccgctccccatcgccgatggagaccggaggcggaaaaaaaaacgtcgtggcagggctactgacagcctgcccggaaaattcgaagacatgtacaagctgactagtgaactgttgggcgaaggggcttacgctaaagtgcaaggagcagtgagcctccagaatgggaaagagtatgccgttaagatcatcgagaaacaggccgggcattcaagatccagagtcttccgagaggtggaaacactgtaccagtgtcaaggaaataaaaatattcttgagcttattgagtttttcgaagacgatacccgcttctatttggtatttgagaaactacagggtggctccatcctcgcccatattcagaagcagaagcatttcaatgaacgcgaagcctctcgcgtcgtaagggatgtggctgccgcccttgacttcctgcatacaaaaggtattgcacacagagatctaaaacctgagaacatactttgtgagagtccggagaaggtgtctcctgtcaagatctgcgatttcgacttaggtagtggtatgaagctgaataacagttgtacccccatcacaactccagagctcaccaccccctgcggcagcgccgaatatatggctccggaggtggtggaagttttcaccgaccaggcgacattttacgataagcgctgcgacctctggagtttgggcgtggtgttatatataatgctttctggatacccaccatttgttggtcattgtggcgcggactgtggctgggatagaggggaagtctgtagagtgtgccagaacaaattattcgagtctatccaggaggggaagtacgagtttcccgataaggattgggctcatatcagttccgaggctaaggacctaatctcgaagctcctggtgcgggatgctaaacagcgcctgtctgccgctcaggtcctacagcacccttgggtgcagggcgaacagcaacataatggccccgatgccctgcgttcatag

SEQ ID NO: 123389 - DNA, 537 bp, Artificial Sequence
  Description of Artificial Sequence: Synthetic coding sequence
atggtctcaagccagaaactggaaaaacctattgaaatgggatccagcgagccactgcctattgctgacggtgatcgacgcagaaaaaagaaacgaagaggccgcgcaacggactctctgcccggaaagttcgaggacatgtacaagcttaccagcgagcttctcggtgagggcgcctatgcaaaagtccagggcgccgtttccctgcagaatggcaaagaatacgcggtaaaaatcattgagaagcaggctgggcattctcggagccgtgtgtttagggaggttgagacgctgtatcagtgccagggcaataagaatattcttgaactaatcgagtttttcgaagacgacacaagattctaccttgtttttgagaaactccagggcggcagcatcctcgcccacattcagaagcagaaacatttcaatgaacgggaggcctcacgagtcgtcagagatgttgcggcggcgcttgactttttgcacacgaagggtatcgcacaccgggacctgaaaccggaaaatatcctctgctag

SEQ ID NO: 123390 - DNA, 306 bp, Artificial Sequence
  Description of Artificial Sequence: Synthetic coding sequence
atggtgtccagccagaagctggaaaagcctatcgagatggggtcatctgaacctctccctatcgcggatggcgacagaaggcggaaaaagaagaggaggggtagggccacagactctctgccaggcaaatttgaagacatgtacaagttgacgagtgagcttctgggcgagggggcctacgcaaaggtacaaggtgccgtgtcactacagaacggcaaggagtatgccgtgaaaatcattgagaagcaagcaggacattcaagaagcagagtgtttcgcgaggtggagaccctgtaccagtgctag

SEQ ID NO: 123391 - DNA, 303 bp, Artificial Sequence
  Description of Artificial Sequence: Synthetic coding sequence
atggtgtcctcccagaaactcgagaagccaattgaaatggggtcctctgagccgctgcccatcgctgatggggaccgccggcggaaaaagaagaggagaggacgcgcaactgattcactgcccgggaagtttgaagacatgtataagctgacaagtgagctgctgggcgaaggcgcctatgcaaaagtccaaggggctgtgagcctccagaatggcaaagaatacgctgtaaagataatcgagaagcaggctggacactctaggtcacgcgtcttccgagaggtcgaaacactctatcagtag

SEQ ID NO: 123392 - DNA, 402 bp, Artificial Sequence
  Description of Artificial Sequence: Synthetic coding sequence
atggtaagctcccagaagctggaaaagcctatcgagatgggttcgtctgagcccttgcccatcgcagacggggatcgaaggcggaagaaaaagaggaggggtcgcgcgacagactcgcttcccggaaaatttgaggatatgtacaaactcacctctgaactactgggggaaggcgcctatgccaaggtccaaggcgccgtaagtttgcagaacggtaaggaatacgccgtgaaaattatcgagaagcaggcaggccacagcaggtctcgggtgttccgggaggttgaaaccctctaccagtgccagggaaataagaacatcctggagttaattgagttcttcgaagacgacacccgtttttacctggttttcgagaagctccaggggggcacgtaccgttag

SEQ ID NO: 123393 - DNA, 1398 bp, Artificial Sequence
  Description of Artificial Sequence: Synthetic coding sequence
atggtgcagaaaaaaccagcggagctccagggcttccaccgtagttttaaggggcagaacccctttgagctcgccttttcgttggaccagccggatcacggcgacagcgatttcggcctccagtgttccgcccgccctgatatgcctgcttcccaaccgatagatatccctgacgccaagaagcgaggtaagaaaaagaaacggggccgagccactgactccttcagcggacgcttcgaagacgtttatcagctgcaggaggatgtgctgggcgaaggcgcgcacgctagagtccaaacatgcatcaacttaattactagccaggaatacgcggtaaagatcatcgagaagcagcccggtcacatacgctccagggtctttagagaagttgagatgctatatcaatgtcagggccaccgtaacgtcctggagctgatagaattctttgaagaggaggaccgcttctatctagtgttcgagaaaatgagaggcggtagcatcctaagtcacatccataagagacggcattttaatgaattggaagctagcgtcgttgttcaagacgtcgcgtccgccctagacttcctccacaacaaaggcatcgctcatcgggacttgaagcccgagaacatcctttgcgaacacccaaaccaggtgtcgcccgtgaaaatatgcgactttgacctcggttctggaataaagcttaatggggactgtagtccaatttcaacaccagagcttctgaccccttgcggaagcgccgagtacatggcccctgaagttgtcgaagcgttttccgaagaagcttccatctatgacaaaagatgcgacttgtggtctctgggagtcatcctctacattctactgtccggttaccccccatttgttggcagatgtggatcagactgtggctgggaccgcggcgaagcctgccccgcatgtcagaatatgcttttcgaatctatccaggaaggcaagtatgagtttcctgataaggattgggctcacatctcttgtgcagctaaggatctgatttcaaaactgctcgtgagggacgccaagcagcgtctgagcgccgcacaagttcttcagcacccctgggtccagggctgcgcacccgagaataccctgccaacccccatggtcctccaacggaacagttgcgcgaaagatctgacgtcatttgctgccgaggccattgctatgaataggcagctggctcagcacgacgaagatctggcagaagaagaggctgcagggcagggacaacctgtgctagtccgtgcgaccagcagatgcctgcagctgtctccccccagccagagcaagctcgcgcaacgtcggcagcgcgccagcctgtcatccgctcctgtagttttagttggtgatcacgcatag

SEQ ID NO: 123394 - DNA, 1245 bp, Artificial Sequence
  Description of Artificial Sequence: Synthetic coding sequence
atggtccagaagaaacctgccgaactgcaggggttccacaggtcattcaaggggcagaatccattcgagctggctttctcactcgaccagccggatcacggcgacagcgactttggcctacaatgctcggcgaggccggatatgcccgcctcccagcccattgacatccccgacgccaagaaaagaggtaagaagaaaaagcgggggagagccacagattctttcagcggacgcttcgaggatgtgtatcagctccaagaggacgttcttggagaaggagctcacgccagagtacagacgtgtatcaacttgattactagtcaagagtatgctgtaaagatcatagagaagcaaccgggacacattagatcacgggtgtttcgggaagtggaaatgctgtaccaatgccagggtcacagaaacgtcctagaattaattgagttcttcgaagaagaagatcggttctatctggtcttcgagaagatgcgagggggctccatactaagccatattcataaacgcagacacttcaacgagctcgaggcttctgtagtcgtgcaggatgtcgccagtgctttggattttctgcacaacaagggaatagctcatagagacttaaagcccgagaatatcttatgtgagcacccaaaccaggtgtcccctgtcaagatctgtgactttgatttgggtagtggtattaagctgaacggtgactgctctcctatttccacaccggagctactcacaccctgcggaagtgctgagtacatggctcctgaagtggttgaagcatttagtgaggaggcaagtatttatgacaagcgctgcgacctttggtcacttggagtcatcctttatattctgctgtccggctacccaccgtttgtggggcgatgtggaagcgactgcggttgggatagaggcgaggcgtgtcctgcgtgccagaacatgctgtttgagtccatccaggagggaaagtacgaatttcctgataaggactgggcacacatttcgtgcgccgctaaggatctcatatctaagctgctagtccgagacgccaaacagcggctgagcgcagctcaggtgctgcagcacccctgggtgcagggctgtgcccccgaaaacactctgcccacgcccatggttctccagagatgggattcccacttcttgctgccgccacatccttgtaggatacacgtgcggccaggcggcctggttagaacggtcaccgtaaatgaatag

SEQ ID NO: 123395 - DNA, 1005 bp, Artificial Sequence
  Description of Artificial Sequence: Synthetic coding sequence
atgctgtaccagtgtcaaggccatcgcaatgtccttgagcttatcgagtttttcgaagaagaggatcgtttttacctagtgtttgagaagatgcgcggaggctccatcctcagccacattcataagcggcgccactttaatgaactcgaggcgagcgtggtggttcaggacgtcgcctccgctctcgatttcttacataacaagggaatcgcacaccgagatcttaagcccgaaaatattctgtgcgaacaccctaaccaagtgagtccggtgaagatttgtgactttgatcttggctcagggattaaacttaatggagattgttctcccatttccacgcctgaactccttaccccttgcggatctgcagagtacatggcaccggaagtggtcgaggccttctcagaagaggctagtatttacgacaagcggtgtgatctctggagcctgggcgtaatcctgtacatattattgtcgggctatcctccatttgtggggcgctgcggttccgactgcgggtgggacagaggcgaggcttgtcctgcctgccagaacatgctctttgagtccatacaggaaggtaaatacgagttcccagacaaagactgggcacacattagttgtgccgcgaaagatttgatttctaagctgctggtgagggacgctaagcagcggttgtcagctgctcaggtactgcagcacccctgggtgcaggggtgtgctccagaaaacacgctgcccacccctatggttcttcaaagaaattcttgcgcgaaagatctgacgtcttttgcggccgaagccattgcaatgaaccgccaactggctcagcacgacgaggacctcgcagaggaagaagcagctgggcagggacagccagtactggtgcgcgcaacatctcggtgcttgcaattatctcctcctagccagtccaaacttgcccagcgacggcagcgtgctagcctctccagtgcgcccgtggtcctcgtgggagaccacgcttag

SEQ ID NO: 123396 - DNA, 1218 bp, Artificial Sequence
  Description of Artificial Sequence: Synthetic coding sequence
atgcccgcctcacagccaattgatattccggacgccaaaaaacgggggaagaagaaaaagcgcggtcgggcgacagattccttcagcggccgattcgaagatgtttatcagctgcaggaggacgttctgggggaaggtgctcatgcccgggtgcagacatgtattaacctcatcacatctcaggagtacgccgtcaaaataatcgagaagcagcctggccatattcgcagccgcgtgtttagggaagtcgaaatgctgtaccagtgtcagggccataggaatgtcctagagttaatagaaaagatgaggggtggcagcatactttcccacattcataaaaggaggcattttaatgagctggaggccagtgtcgtggtccaagacgtggccagcgctctggattttttgcacaacaaagggatcgctcacagggatctaaaacccgagaatattttgtgtgaacaccccaaccaggtcagcccggtgaaaatatgtgactttgatctggggtctggtatcaaactgaatggagactgtagtccaatatctacccctgaattgctcaccccctgcggatcggccgaatatatggcccctgaggtggttgaagctttttcggaagaggcctcaatttacgacaaaagatgcgatctatggtctcttggcgtgatcttatatattctcctgtccggatatcccccattcgtgggacgctgcggctcggactgtggctgggatcggggcgaggcatgcccggcctgccagaatatgctgtttgagagcattcaagagggcaaatatgaattccctgacaaagactgggcccacattagttgcgctgcaaaagacctcatcagcaagctgttagtgagggatgccaagcagagactctcagccgcacaggtcctgcagcacccttgggtccaggggtgtgctcctgaaaataccctaccgaccccgatggtcctgcaacgaaatagctgtgccaaagatctcacttcttttgcagctgaagccatcgccatgaacagacagctggcccaacatgacgaggatctggcagaagaagaggcggccggacagggccagcctgtgctcgtcagggcaacctcccggtgcttgcagttatctcccccttcacagagcaaacttgctcagcggagacagcgagcttctctttcctccgccccagttgttcttgtgggcgaccacgcctag

SEQ ID NO: 123397 - DNA, 2388 bp, Artificial Sequence
  Description of Artificial Sequence: Synthetic coding sequence
atgtctgctcggacacctctccctaccgtcaatgagcgcgacactgaaaatcatacttcggttgacggctatacagagccccacatacaaccaaccaagagctcctctagacagaacatccccagatgtcggaacagcattactagtgccacggacgagcaacctcatatcggaaattatcggcttcagaaaactatcggcaaaggaaatttcgcaaaggtgaaactagccagacacgttctcacaggcagagaagtggccgtgaagattatcgacaagacccagctgaatcccacatccctgcaaaaattatttcgcgaggtgaggatcatgaaaatcctgaaccatccaaatatcgtgaaattgtttgaggtcattgaaacagagaaaaccctgtacctagtaatggaatacgcgagcgggggagaggttttcgactacctcgttgctcatggacgaatgaaggagaaggaggctagagcaaagttcagacagattgtgagcgccgttcaatactgtcaccagaagtatatcgtccatagggatcttaaagcagaaaatctgctgttagacggcgacatgaacattaaaattgccgacttcggatttagcaatgagtttaccgttggcaataaattggacacattctgtgggtccccaccttacgccgctcccgagctgtttcaggggaagaaatatgacggacccgaggttgatgtgtggtctctgggagtcattctgtacacactcgtgtcgggatctctgcctttcgatggacagaacttgaaggaactacgtgagcgggtgctcagaggtaaatacagaataccattttacatgtcgaccgattgtgagaatcttctgaaaaagttactcgtgttaaatccgatcaagcgaggatccttggagcaaatcatgaaagataggtggatgaacgtgggtcatgaagaagaggagctgaaaccatatacagaaccggatcctgacttcaatgacacaaagcggattgatattatggtaacaatgggttttgcccgggacgaaataaatgatgctctgattaatcagaaatacgacgaggttatggcgacatacatcctgctgggcagaaaaccccctgaatttgaaggcggagaatccctgagctctggcaacttgtgccagcgatctcgcccgtcctccgacctcaataactccaccctccagagtcctgctcacctgaaggtgcagcgaagtatctcagctaaccaaaagcaacggcggttttctgatcatgctggaccgtccatccccccagcagtttcgtatactaagcgtcctcaggccaattctgtcgagtccgagcaaaaagaggagtgggacaaggacgtggctaggaaactggggtcgacgacagtgggcagcaaaagtgagatgacagcctctccgctggtgggccccgagagaaagaaaagctccaccattccatctaataatgtgtactcaggcgggagtatggcgcgcaggaatacatatgtctgcgaacggaccactgataggtacgtggcgttacagaatgggaaggattcatctttgactgagatgtccgtgtcttctataagctcagccgggagttcagtggcgtcagcggtacctagcgcaagacccagacaccagaaatctatgtcaacttcggggcaccctattaaagtgacactcccaaccatcaaagatggctctgaggcataccgccccggcacgacgcaaagagtacccgccgcctcacccagtgcacactcgatctcaacagctacacccgatcggacccgattcccacgggggtcttcctcacgctctacgtttcacggagaacagttacgggagaggcgcagcgtggcttataacgggcccccagcaagccccagccatgagacgggagcctttgctcatgcccggagagggaccagcaccggaatcatctcaaaaattacatctaaattcgtgcgccgtgaccctagcgagggggaggcgtcaggccgtactgacacgtcacgctccactagtggcgagcccaaggagagggacaaggaagagggaaaggatagcaagccaagatctctccgcttcacatggagcatgaagacaacatcttccatggacccaaacgatatgatgcgagaaatccgtaaggtgctggatgccaataattgcgattatgagcaaaaggaacgtttcctcctcttctgcgtgcatggggatgctcggcaagacagcctcgtgcaatgggaaatggaggtgtgtaaactgccaaggctctctttgaacggtgtgagattcaagagaataagtggcacttccatcgcttttaagaacatcgcatccaagatcgccaacgaactgaagctgtag

SEQ ID NO: 123398 - DNA, 2277 bp, Artificial Sequence
  Description of Artificial Sequence: Synthetic coding sequence
atgtccgcccgaacgccccttcctaccgtgaacgagcgagacacagaaaaccacacttctgtggatggctacactgaaccacacatccagccaaccaaatcttcatcacgacagaatattcctcgatgcagaaactcaattaccagcgccaccgacgaacagccccatattggtaattataggctgcagaaaaccatcggcaaaggcaatttcgccaaggtgaaactcgccaggcacgttctgacaggccgcgaagtcgccgtaaaaataattgataaaacacagctgaatccaacctctctgcaaaaattatttcgcgaagtgcgcattatgaaaattctcaaccatcccaacatcggagaggtgtttgattatctggtagcacatggaagaatgaaggaaaaagaggctcgggctaagttccgacagatcgttagcgctgtacagtattgccatcaaaaatacattgtccaccgcgatctgaaagccgaaaaccttctgctggatggggacatgaacatcaaaattgccgacttcggcttcagcaatgagttcacagtgggtaataaacttgacaccttttgtggctccccaccttacgccgctcccgaactgtttcagggcaaaaaatacgacggacctgaggtagacgtgtggtcactcggggtgattctatacacattggtgtccgggtcgctgccttttgacgggcaaaatctcaaggaactccgggaacgtgtgctgaggggcaagtatagaatacccttctacatgtcaaccgattgcgaaaatctgcttaagaagctgcttgtcttaaatcccatcaagagggggtccctggaacagatcatgaaggaccggtggatgaacgtgggacatgaagaggaagagctcaaaccttataccgagcccgatccggattttaacgacaccaagcgaatcgatatcatggtaactatgggattcgcccgggacgaaatcaacgacgctcttatcaatcaaaaatatgatgaagtcatggctacatatatcctgctcggaaggaaaccacctgaatttgaaggaggagaaagcctcagcagcggcaacttgtgtcagagaagccgccctagctccgatctgaataatagcaccttgcagagtcctgcacacctgaaagtccagcgctcaatctcggcgaaccaaaagcaacggagatttagcgatcacgcaggcccatcaataccccccgccgtatcctacaccaaaaggcctcaggctaactcagtggaaagcgagcagaaggaggagtgggacaaggatgtggctcggaaattagggagcactacagtgggctccaagagcgaaatgactgcaagcccattggtggggccggagaggaagaagagttccactatccctagtaataacgtctattctggaggctccatggctcgcaggaacacctatgtttgcgagcgcacgacggaccgttatgtagctctgcaaaacggtaaagattccagcttaaccgagatgtcagtatccagcatcagctcggccggctcttccgtggcgagtgccgtgccttccgctcgaccaaggcaccagaaatcaatgtcgacaagtggtcacccaatcaaggttacattgcctaccattaaggatggcagcgaggcctaccggcctggcacaacgcagagagtgcctgccgccagtccatctgcccactctatatctacagccacccctgatagaacacgattcccccggggaagcagctcgcgtagtacctttcacggagaacagcttcgagagaggcggtcagtggcttataatggtccacccgcaagtccctcccacgagaccggggcttttgctcacgctcgcaggggcactagcaccggcatcatctcaaaaatcaccagcaagtttgtccgccgcagcaccagcggcgagcctaaggagagggacaaggaggagggcaaggactcaaaaccccgctctttgcggttcacatggtcaatgaaaaccacaagcagcatggaccctaacgacatgatgcgggaaatcaggaaagtccttgacgccaataactgcgactacgagcagaaagagcgctttctgttgttctgcgtgcacggagacgctagacaggactctctggtgcaatgggagatggaggtctgtaaacttccacggttaagtttgaacggagtgagatttaaacgcatcagcggtacaagcattgccttcaaaaacatagcgtccaaaatcgcaaatgaacttaagttgtag

SEQ ID NO: 123399 - DNA, 1938 bp, Artificial Sequence
  Description of Artificial Sequence: Synthetic coding sequence
atggagtacgcatccggcggggaggtgttcgattatctagttgcccacggaaggatgaaggaaaaggaagctcgggctaagtttcgccagatcgtgtccgccgttcagtactgccatcagaagtatatcgtgcacagagatctgaaggccgaaaatttgctccttgatggagatatgaacatcaaaatcgctgacttcggatttagtaatgagttcacagtcggaaacaagttggacactttctgtgggtcccccccttatgctgctcccgaactgttccaggggaaaaagtatgatggacccgaggttgacgtatggtctctcggagtgattctctatactctcgtgtccggatcccttccattcgatggacagaatctgaaggaattgcgtgaacgggtgctacgggggaagtaccggatccccttttatatgtccacagactgtgagaacttgctgaaaaaacttctggtgctcaatccaatcaagcgcggttcactggagcaaattatgaaggaccgttggatgaacgtgggccacgaagaagaggaattgaaaccctacaccgagccagaccctgatttcaacgacacaaaacgcatagacataatggttacaatgggcttcgccagggacgagattaacgatgctctgatcaaccagaagtacgacgaagtgatggcaacatacattctcctaggccgcaagccccctgagttcgaggggggcgaaagcttgagtagcgggaacctctgtcagagaagccgtccaagtagtgacttaaataacagcactttgcagtcccccgcgcatctgaaggtacagcggtctatctctgccaaccagaagcaaagaagattttcagaccatgctgggcctagtatcccaccagctgtaagctacaccaagcggcctcaggccaactccgttgagtccgaacaaaaagaagagtgggacaaggacgtggcccggaaactcggctcgactacagtcggctcaaaatctgagatgaccgcttctcccctggtcggtcccgaaaggaagaagagcagtaccattccaagcaacaatgtctactctggtggcagcatggcccgaaggaatacctatgtatgcgaacggaccactgacagatatgtggccctccagaacgggaaggacagttccctcacggaaatgtcagtgtcctctatctcctcagccggaagttccgtcgcttctgcagttccttccgcccggcccagacaccagaaatcgatgtctacatctggccaccccataaaggtcaccctgccgactatcaaggatggatctgaggcatacagaccagggacaacccaaagggtgcccgctgccagcccaagtgctcatagcatatccacagccaccccggacagaacccggtttcctagagggagttcaagtcgcagtaccttccacggcgaacaactaagggagcgacggagtgtggcatataacgggccgccagcctctccctcacatgagacaggagcatttgctcatgccagaaggggcacctcaacaggtataatctctaagattacatccaagttcgtgagaagatcaactagtggggagcctaaggagagggacaaggaggaggggaaggattctaaaccccgatcgctgcgttttacctggtccatgaaaaccacgtctagcatggatccaaatgatatgatgcgcgagatcagaaaggttctagatgccaacaattgcgattacgagcaaaaagagcgtttcctgctcttctgcgtgcacggcgacgccaggcaggatagtcttgtccagtgggagatggaggtgtgcaagctgccacgattatctctcaacggggttcgatttaagcgcatcagtggcacatctatagcctttaagaacatcgcttcgaaaatcgcgaacgaactgaaactctag

SEQ ID NO: 123400 - DNA, 2340 bp, Artificial Sequence
  Description of Artificial Sequence: Synthetic coding sequence
atgagctctgcacgcactccactgcctaccttgaacgagcgcgacacggagcaaccgacgctggggcatcttgattcaaaaccgagctccaagtctaacatgataagaggtcggaactctgctactagcgcagatgagcaaccccacatcggaaactatcggctcttgaaaacgatcggaaagggaaattttgcgaaagtgaagctggcaaggcacatccttaccgggaaggaagtggccgtgaagatcatcgacaagacacagctcaactcatcatcactacagaaactatttcgcgaggtgcgcatcatgaaagttctgaaccatccgaatattgttaagctctttgaggtaatagagactgagaaaacactctacctggtgatggaatatgcctcggggggcgaagtctttgactatctcgttgcacatggcaggatgaaagagaaagaagcacgcgccaagtttaggcaaattgtcagcgcagttcaatattgtcaccagaagttcatagtgcaccgcgatctcaaagccgagaatcttttgcttgacgccgacatgaacattaagatcgctgatttcgggttctctaacgaatttacattcgggaataaacttgatacgttttgtggctccccgccatatgctgctccagaactgttccaggggaagaagtacgatggacccgaagttgacgtgtggtccctaggggttatcctgtacacattagtctcagggtccctccctttcgacggccagaaccttaaagaactcagggaacgggttttgagaggaaaatatcggatccctttttacatgtcaaccgattgcgagaatctgctgaaaaaattcttaattcttaaccctagcaagcgtggaacacttgagcaaattatgaaggatcgctggatgaatgttggacatgaagatgacgagctgaaaccatatgttgagcccctccccgattacaaggatccacgacggactgagctcatggtctcaatgggttatactcgcgaagagatccaagattccctggtggggcagcgttataatgaagtgatggcgacttacctgcttctgggctacaagtcctctgagctcgagggcgataccattaccctcaagccacgcccttcggctgaccttactaattccagtgccccttctccctcccataaggtccagaggtcggtgtcagctaatcccaagcagcgacgcttcagcgatcaggccgctggcccagctattcctacttccaattcttattctaaaaaaacacagagtaacaatgccgagaataagagacctgaggaagacagagaatccggccgtaaggcttctagcacagctaaagtgcctgctagccccctgccgggactggagcgcaagaagacaaccccaactccgtctaccaactcggtcctctctacctccacaaatcgctcgcgaaactctccattgctggagagggccagtcttggccaggccagcatacagaatggtaaagactccctgactatgccaggctctcgggcgagcacagccagcgccagtgccgctgtgtctgctgcccggcctaggcagcatcagaaatccatgtcggcttccgttcatccaaataaagcctcggggctgccaccaaccgaatctaattgcgaggtgccacgaccgtccactgctccccagagggttccagtagcctcaccaagcgcccataatatttcctcatccgggggggccccagatcgtacaaacttcccaaggggcgtgtcctcacggtctactttccacgccggacagttgcggcaggttcgggatcagcagaacctgccctatggcgtgactccggccagcccatccggccactcacaagggcgccggggagcatcggggtcgattttctcaaagttcaccagcaaattcgtgcgtcgaaacttgaatgagcccgaatccaaagatagggtggagactctccggccccacgtagtgggttctggcggaaacgacaaagaaaaagaagaattcagagaagcaaagccgcggagcctgcggttcacctggtccatgaagactaccagcagtatggaacccaacgagatgatgcgcgaaattaggaaggtgcttgacgcaaatagttgccagagtgaactgcacgagaaatatatgctgttatgcatgcatgggacccctggccacgaagacttcgtccagtgggagatggaagtgtgcaaactcccacgcctctccctgaacggcgtcaggtttaagcggatttcaggcacctctatggcctttaagaatatcgccagtaagatcgctaatgaactgaagctgtag

SEQ ID NO: 123401 - DNA, 2130 bp, Artificial Sequence
  Description of Artificial Sequence: Synthetic coding sequence
atgagctctgctaggactccccttcccacactgaatgagcgggacaccgagcagccgacactaggccacctggatagcaaacctagctctaaaagcaatatgattcgaggtcggaatagcgcaacctccgcagatgaacagccacacataggaaactataggctcctgaagaccatagggaaaggcaattttgccaaggtgaaactcgcaagacatattcttactgggaaagaggtcgctgtgaaaattatcgacaaaacgcagctgaattcatcttccctccagaagctgtttagagaagtcagaatcatgaaggtgttgaaccatccaaatatcgttaagttgtttgaggtcatcgagacagagaagacactttatttggtcatggagtatgcatctggcggagaggttttcgactaccttgtggcacatgggcggatgaaagaaaaagaagcgagagccaaattcagacagatcgtatctgcagtccagtattgtcatcagaaattcatagtccaccgggacctaaaagcagagaacttgctgttagatgcagacatgaatattaagatcgcagacttcggtttctcaaatgagtttacattcggtaacaagcttgacactttctgtggctctcccccatatgcagcaccggagttattccagggcaaaaagtacgatggaccagaagtggatgtgtggtcacttggtgtgattctgtacacgctcgtgtccggctctcttccatttgatggccagaatcttaaagaattgcgggagagggttctgaggggtaagtaccgcataccattctacatgagcacagactgtgagaatctgctgaagaaattcctgatcttaaatcccagcaaacgaggtactcttgagcagatcatgaaggatcgctggatgaatgttggccatgaagatgacgagcttaaaccatacgtcgagcctctgcccgattataaggaccctagaaggactgaactcatggttagtatggggtatacaagagaagagattcaagatagtctggtgggacagaggtacaatgaggtgatggctacttatctcctgctgggctataaaagttcagagttggaaggcgacaccataactctgaaaccccgtccatctgctgacctgactaactcaagtgccccctccccctcacacaaagttcaaagatcggtctcagcaaaccctaaacaaaggagatttagtgaccaggccggcccagctattcctacctcaaattcgtattccaaaaaaacccagtcaaacaacgccgagaacaaacggccggaggaagacagggaatccggacgcaaagcaagcagcaccgcaaaggtgccggcctctcctctgccaggcctggagaggaagaaaacgactccaacacccagtaccaactccgtactgtctacaagcactaatcgaagcaggaactctccgctgctggaacgagcaagtttgggtcaggcctcaattcagaacggaaaagattccaccgccccgcagagggtacctgttgcctctccttctgcccacaatatctctagcagcggcggagcccccgaccgtaccaattttcccaggggcgtgtccagccgctctacctttcacgctggtcagctgaggcaagtgcgcgatcagcagaatcttccttatggggtcacgcccgctagcccaagcgggcattcccagggacgaagaggagcatctggcagcatattcagtaagttcaccagtaaattcgttaggcggcctcacgtggtcggctctgggggcaatgataaagaaaaggaagagtttagagaggccaagccacgatctttgcgcttcacctggtcaatgaaaaccacttctagcatggaacctaacgaaatgatgcgtgagattaggaaagttctggacgccaactcctgccagtctgaattgcatgagaagtatatgttgctctgtatgcatggtacgcctggtcacgaggactttgtccagtgggaaatggaggtttgtaaactccctcgtctgtctctgaacggggtgaggttcaagcgcatctcagggacctccatggcttttaaaaatatcgcatctaaaatagcaaacgagctcaagctatag

SEQ ID NO: 123402 - DNA, 2160 bp, Artificial Sequence
  Description of Artificial Sequence: Synthetic coding sequence
atgtctagcgcccgaacaccattgcctactctcaacgaaagggacactgagcagccaaccctgggacacctcgactccaagccatccagcaagagtaatatgattagaggcaggaacagtgctactagtgccgacgagcagcctcatatcgggaactatcgcttattgaagacgatcggtaaagggaatttcgccaaagtgaagctagctcgtcacatactgaccggcaaagaggtggccgtcaaaataatcgacaagactcagctaaacagttcatctttacagaagttattccgcgaggtgcgtatcatgaaggtccttaatcatccaaatattgtgaaactctttgaagtgattgaaactgagaagactttatatctggtgatggagtacgctagcgggggagaagtctttgattacctggtggcccatggcagaatgaaagagaaggaggcgcgcgctaagtttcgtcagatcgtttccgccgtccagtactgtcatcagaagttcatcgtccatagggacctcaaggcagagaacctgcttctggacgccgacatgaacatcaagatcgcagacttcggtttctccaatgagttcaccttcgggaacaaacttgacactttctgcggcagcccaccatacgccgcccctgagctgttccaggggaaaaagtatgacggtccagaggtcgacgtatggagtctgggcgtcatcctgtataccttagtgtcggggagcctgcctttcgatggtcagaacctgaaggagttaagagagcgggtattacgcggcaagtacaggatccctttttacatgagcaccgactgtgaaaacctcctgaagaaattcctcatcctcaatccctcgaaacgtggtaccttggaacagattatgaaggatcgctggatgaatgtgggacacgaggacgatgaactgaagccctatgtcgagccgctgcctgattataaagaccccagaaggaccgagctgatggtgtctatgggatatactcgggaggagattcaggacagcttggttggccagagatacaacgaggtgatggccacatatctcctgctggggtacaagtcatctgagctggaaggcgacactatcaccctcaaaccccggccgagcgccgacctcacaaacagcagcgccccttctccctcccataaggtgcagcgcagtgtgagcgcgaaccccaaacagcggagattctctgaccaggctgctggacccgccatcccgaccagcaattcttattccaaaaagactcaaagcaataatgctgagaacaaacgcccagaggaggatagagaatccggacgcaaggcaagctctaccgcgaaagtacctgcttctcccttacccggactggagcgcaaaaaaacaactcccaccccctcaacaaacagcgttcttagtacgagcacaaatagatccaggaattcccccctcttagagcgggcctccctgggccaggctagcatacagaacggaaaagacagtacagctccccaacgggtccccgtggctagcccatccgcacataatatctcctcgtcggggggtgctcctgaccgcactaattttccgcggggtgtatctagcagatctacttttcacgctggacaactacggcaggtccgagaccaacaaaacctgccatatggcgtcactccagcttctccatccggtcactctcagggccgccgaggagcctcaggatccattttttcaaaattcacctccaaatttgtgagacgaaatctgagcttcagattcgcacgcaggccacatgtggttggctctgggggcaacgataaagagaaagaggagttcagagaggctaaacccagatcactacggttcacttggtccatgaagactacctctagtatggaacccaatgaaatgatgagggagatccggaaggtgctcgatgcgaactcatgtcagtcagagctccacgaaaagtacatgctgctttgcatgcacggaacaccaggacacgaagacttcgtccaatgggagatggaggtctgtaagctcccacgactgagcctgaacggagtccgatttaaacgcatatcaggcacctcgatggcatttaaaaacattgcttctaagatagccaacgagctcaaactttag

SEQ ID NO: 123403 - DNA, 2322 bp, Artificial Sequence
  Description of Artificial Sequence: Synthetic coding sequence
atgtcaagcgcaaggacaccactgccaactctgaacgagagagatactgaacagcccactctcggtcacctggactccaaaccatcctctaaaagcaatatgataagaggtcgtaactcggctacatcagccgacgagcagcctcatataggaaactaccgcctactcaagacaataggaaaggggaacttcgcaaaagtcaagctagccaggcatattctgactgggaaggaggtggcggtcaaaataattgacaaaacacagctcaattccagtagtctgcagaagctgttccgagaggtccgtatcatgaaagttctaaatcacccgaatatagtgaagctcttcgaggtgatcgaaactgaaaagacgctgtacttggttatggagtatgcctctggcggggaagtgtttgactaccttgttgctcatggacgaatgaaggagaaggaagctagggcaaagttcagacagatcgtgtccgccgtccagtactgccaccagaagtttatcgtccacagggatttaaaggcagaaaacctgcttctggacgcagatatgaatatcaaaatcgccgattttggattctccaatgagtttacgttcggaaataaactggacaccttctgtggaagtcctccgtatgcagcccctgaactctttcaaggtaagaaatatgacggtcccgaggtcgacgtctggtcacttggtgtgatcctctacacgctggtttcgggttcactccctttcgacggccagaatttaaaggagctgagagagcgagtcctccgaggaaaatatcgtatcccgttttatatgtccacggactgcgagaacttgctgaagaagtttcttatcctcaacccgtcaaaacggggcactctggagcagatcatgaaagataggtggatgaatgtgggccacgaagatgatgagctcaagccatacgtggagccgctccccgactacaaagatcccagacggaccgaactcatggtgtccatgggctataccagagaggaaatacaggactccctcgttgggcagagatacaatgaggtgatggcgacctacctgctcctggggtataagtcctccgagctcgaaggggacacaatcaccctcaaaccaagaccaagtgcagacctgaccaactcgtcagccccgtcgccatcccacaaagtccagcggtctgtgagcgcgaaccccaaacagcggcggtttagcgaccaggccgctggtcctgcaattcccacttctaatagctattccaagaaaacgcagtcgaacaatgcagaaaataagcggccagaagaggaccgagagtctggccgcaaggcctccagcacagcgaaagtacccgcctctcccctgcccggactggagcgtaaaaaaacaacaccgacaccatccactaactctgtgctgagtacctctaccaacaggagccggaattctccgctgctggagcgagccagcctcggacaagcttctatccagaatgggaaagatagtttgactatgccggggagtagagctagcacagcctccgcgtctgctgctgtgtcagctgcacgaccaagacagcatcagaaaagcatgtcagcttcagtccaccctaacaaggccagcgggctgccaccaaccgagtctaattgcgaggtgccgcgccctagtaccgcccctcaaagagtgcctgtggccagtccaagcgctcacaacataagctcatccggaggggcacctgaccgcaccaacttcccaaggggtgtttcaagtcgcagtacctttcacgcgggtcagctcagacaggtgcgcgaccaacaaaatctcccttacggggttacgcccgctagtccttctggacatagccagggccgtcgaggcgcctccgggtcaatttttagtaaattcactagcaaattcgttcgacgaaaccttagctttcggttcgctcggagacctcacgtggtggggagcgggggaaacgataaggaaaaagaggagtttcgcgaggcaaagcctcggtccctgcgttttacttggtccatgaagacgacctcgtcaatggaacccaacgagatgatgcgcgaaatccggaaggtactggacgctaatagctgtcagagcgaactccatgaaaaatatatgctcctatgcatgcacggcacccccgggcacgaagatttcgtgcaatgggagatggaggtctgcaagttgcctaggctgagtctgaacggagtgagattcaaaaggatctcggggacttctatggccttcaagaacatcgcgagtaaaattgctaacgagctgaaactttag

SEQ ID NO: 123404 - DNA, 2076 bp, Artificial Sequence
  Description of Artificial Sequence: Synthetic coding sequence
atgatcaggggtcgtaatagtgccacgagtgccgatgagcagcctcacatagggaattatcgacttctcaagacgattggcaagggcaatttcgctaaagtgaagctggctagacacatattgaccggcaaggaagtggctgtcaaaatcattgataaaacacaactcaactcctcatccctacaaaagttatttcgtgaggtgcgaattatgaaagtgctcaaccaccccaacatagtcaaactgttcgaagtaattgagacggaaaagacactttatctggttatggaatacgcctccggtggggaagtctttgattatttagtagcccacggtcgaatgaaagagaaagaagcaagggctaaatttcgccagattgtttccgccgtccagtattgtcaccagaagtttattgtgcacagagatctcaaggctgagaacctgctcctggacgccgacatgaatatcaaaatagccgattttggattttctaacgagtttacctttggaaacaagctagacactttttgcggctcccctccatacgcggctcccgagctattccaaggcaagaaatacgacgggccagaggtggacgtatggtcattgggggtgatactgtataccctggtgagtggcagtttgcccttcgatggccagaatcttaaggaactgagggagagagtactccgagggaagtatcgcatacctttctacatgagtaccgattgtgagaatctgcttaaaaagttcttaattttaaacccgtccaaaagggggactcttgaacaaatcatgaaagatcggtggatgaacgttgggcatgaagacgacgaactcaaaccgtatgtggaacctctacccgattacaaggatccacggagaactgaactaatggtttccatgggctacacacgggaagaaatccaggacagcctcgtcggccagagatacaatgaggtaatggcaacctatctcctgctagggtacaagagttccgagctggagggcgacacgatcacccttaaaccacgaccttctgccgatctcaccaattcgtccgctcccagcccttcgcacaaagtgcagagatccgtgtccgccaaccctaaacagcgtcgattctccgatcaagcaggacccgccattcctacttccaatagttactcaaagaaaacacaatcgaataatgcagagaataaaaggccagaggaagatagagaaagcggcaggaaggcctcaagcaccgccaaggtaccagcctcccctttacccggcttggaaaggaagaaaacaactcctacacctagtacgaactccgttctgtctacctctacaaatcgatctcggaattcaccacttctggagcgcgccagcctggggcaggccagcattcaaaacgggaaagacagtaccgcaccccagcgggtccccgtggcatccccctccgcccataacatctcatcctcgggcggcgctccagataggactaactttcctcgaggagtttcgtcacggagcacattccacgcaggacagcttagacaggtgagggaccagcaaaaccttccgtacggggtgacccccgcctcaccatctggacactcccagggcaggaggggagccagcggttccatttttagcaagttcacctcgaaattcgttcggcgcaacctcaatgaaccagaaagtaaggatagggtcgaaacactgcgcccccatgtggtaggttctggcgggaacgacaaggaaaaagaggaatttcgcgaagcaaagccccggtcgctgcgctttacctggtccatgaagaccacctcttcaatggaacctaacgaaatgatgagagagatcagaaaggtgctggatgctaactcttgtcaaagcgagctgcacgagaagtacatgctgctctgcatgcacgggaccccagggcacgaggactttgtacaatgggagatggaagtatgtaaactccctcgactatcattaaacggcgtacggtttaaacggataagtggcacctccatggccttcaagaatattgcatcgaaaatcgctaacgagcttaaactgtag

SEQ ID NO: 123405 - DNA, 2367 bp, Artificial Sequence
  Description of Artificial Sequence: Synthetic coding sequence
atgagttcggcccggacaccactgcctacgttaaatgagcgcgataccgagcagcctactctgggacatctcgactccaagccaagcagtaaatccaatatgatccgcggcaggaactccgcaaccagcgcagacgagcagccacatataggcaattaccggctgttaaaaaccattggcaagggaaactttgcaaaggtgaaattggcccgccatatcctgaccgggaaggaagtagccgtgaagatcatagataagactcaactgaacagttcctcccttcagaagctttttcgggaggtgcgcattatgaaggttctgaatcatcctaacattgtgaagttgttcgaggtcatcgagaccgagaagacactgtatctcgtcatggagtacgcttcaggaggtgaggtgtttgactatttagtggctcacgggagaatgaaggagaaagaggcacgagctaagtttaggcagatagtctctgctgtgcagtattgtcatcagaaatttatcgtccatcgtgatcttaaagctgaaaacttgctcctggacgctgacatgaacatcaagatagctgattttggcttttccaatgagttcacctttggaaataaactggacacattctgcggctctcctccctatgcagcacccgaactttttcaaggcaagaaatatgacggacctgaagtcgacgtgtggtctctgggggtcatactctacaccctagtgtcggggagtctgccatttgatgggcagaacctaaaggagctcagggaacgcgtactaagaggaaagtaccgcattccattctacatgtctaccgattgtgagaaccttctcaagaaatttctaattctcaatccttctaagagaggcacactggaacagataatgaaggaccggtggatgaacgtgggacacgaagatgacgagctgaaaccttacgttgagcctctgccagactataaggacccacgccggacagagctgatggtttctatgggctacacaagagaggagatacaggatagcctggttggccagagatacaatgaggtaatggcaacttacctgcttctaggctacaagtcctcagaattagaaggcgatacgattacactaaaaccacggccttctgccgacctgactaatagttctgccccatcgccttcccacaaagtacagagatccgtaagtgctaatccaaagcaaagacgattttctgatcaggccgctggaccggctatccctacatccaactcttactcaaaaaagacccagtccaacaacgccgagaataagcggcctgaggaggaccgcgagagtggacggaaagcttcatcaactgctaaagtcccggcgagtcctttacctggtctggaacgcaagaagaccacacctactcccagcactaacagtgtcctctcaacgagcaccaatcggagccggaacagccccctcttggagcgggcctcattaggccaggccagcattcaaaatgggaaggattccttgaccatgccaggaagccgcgcatctacagcctccgcaagtgccgcagtgagcgctgcgaggccgcgccagcatcagaaatccatgtcagctagtgtgcatccaaacaaagcatctggcctgccccctacagaatccaactgtgaggtgcctcggcctagcactgctcctcagagagtgccagtcgcttcacccagtgcacacaacatcagctcatccggcggcgcacccgatagaacaaactttcctagaggggtgtcgtcacgtagcactttccatgccgggcagctacgccaggtgagagaccagcaaaacctgccatatggggtcaccccagcctccccctctggccatagtcaaggacggcggggagccagtggttctatattctctaagttcacatccaaatttgtacggcgcaacctatcattcagattcgctcgcagaaatctcaatgaacctgaatccaaggaccgtgtggaaactctcaggccccatgtggttggaagtggtggtaacgataaggagaaggaggagttccgcgaagctaaacctcgctcactgcgtttcacatggtctatgaaaaccacgtcatctatggagccaaatgagatgatgagggagatccgcaaagtgctcgacgccaattcctgccagtccgaattacacgagaaatacatgctcctatgcatgcacggtaccccggggcacgaggacttcgtgcagtgggagatggaggtatgtaagctgcctaggctctccctcaatggggtaaggtttaagcggatctcggggacatctatggccttcaaaaacatcgccagtaagatcgcaaacgagctgaaattgtag

SEQ ID NO: 123406 - DNA, 2076 bp, Artificial Sequence
  Description of Artificial Sequence: Synthetic coding sequence
atgatccgcggtagaaatagcgctacaagtgctgatgagcaaccacacatcgggaattaccgtttgctgaagactattggcaaaggcaactttgctaaagtgaaactggccaggcacattctcacaggcaaggaggtggccgttaagattattgacaagactcagctgaactcatcctctctccagaagctgttcagagaagttcggataatgaaagtcctgaaccaccctaatatcgtcaagctgttcgaggtgatcgaaacggagaagactctctacttggtaatggagtacgcctcaggaggcgaagtattcgattacctggtggcccatggccgaatgaaagaaaaggaggcccgggcaaagtttcgccaaatagtgagtgctgtgcaatactgtcatcagaaatttattgtccacagagatctaaaggcagaaaacttgctactggacgccgatatgaacataaaaattgcggacttcggcttctcaaacgaattcacctttggaaataagttggatacattctgtggctcgcctccgtatgctgcccccgagttatttcagggcaaaaaatacgatggtccagaggttgacgtatggagtctgggcgtaatcctgtacacactagtcagcggttccttgccatttgatggccagaatttgaaggagctgagagagagagtgctgcgcggtaaatataggatccccttttacatgtcaaccgactgtgaaaacctactgaagaagttcctaatcctgaacccttctaagcgcggaacactggaacagataatgaaagaccgctggatgaatgtcggccacgaagacgacgagctgaagccttatgttgaacctcttccagattataaggatccccgcaggacagagctgatggtgagtatggggtacacgcgcgaggagatacaggatagtctggttgggcagagatacaacgaggtgatggcgacttatctgctccttggttataaaagctcagagctcgagggcgatactattacgttgaagccccgtccctcagccgatctcactaacagctcagcaccgtcccctagtcacaaggtccagaggagtgtgagtgcaaaccctaagcagagacggttctccgaccaggctggcccagccatccctactagcaattcctactcaaaaaagactcagtcaaataacgctgaaaacaaacggcctgaagaggaccgagagagtggtcgcaaagcgagctctacagcaaaggtgcccgcatcccctctccccggcctcgagcgtaaaaaaacaacccctacaccctcaaccaactcagtgctctctacatcgaccaatagatcgcggaactctcctcttcttgagcgagcaagtctgggccaggccagcatccagaacggcaaggatagcacagcccctcagcgcgtgcccgttgcatctccatctgctcataatatcagtagctccggaggtgcccccgaccggacaaacttcccacgcggagtgtcctctagatctacctttcacgcaggacagctgaggcaggtccgggaccagcagaacctgccatatggcgttacccccgcctctccttcaggtcactctcaaggacgaagaggggcttcaggctcaatcttttcgaagtttactagcaagtttgtgagacgaaatctcaatgaacccgagagcaaggaccgcgtggagaccctgcggccacatgtggtgggatccggtggcaacgataaggagaaggaggaatttcgggaggctaaaccccggagtctccgctttacatggtccatgaaaacgacaagttcgatggaacccaatgagatgatgcgagagattcggaaagtattggatgccaacagttgccagtcagaactgcacgagaaatacatgctgctctgtatgcacggcacccccgggcacgaggactttgtgcagtgggagatggaagtctgcaagctgcctagactaagcctgaacggagtgaggtttaagcgcatcagcggtaccagcatggcctttaagaacatcgcatctaagatagctaacgaactcaagttatag

SEQ ID NO: 123407 - DNA, 2205 bp, Artificial Sequence
  Description of Artificial Sequence: Synthetic coding sequence
atgagctctgctaggaccccactgcccacccttaacgagagggacaccgagcagccaactctggggcacctggattccaagcctagctccaagtccaatatgattcgaggccgaaattccgcaacctctgccgacgaacagccccacataggcaactacagactcctcaagaccatcggcaaagggaattttgccaaggttaagctggcgcgccacattcttacaggcaaggaggtggctgtgaaaatcattgacaaaacacagctcaatagcagcagcctgcaaaaactgtttagggaagtaaggatcatgaaagtccttaatcaccctaacatcgtgaaactgtttgaagtgatcgaaactgagaagacactataccttgttatggagtacgcatccggtggcgaggtgttcgattatttagtggcccacggccgcatgaaggagaaggaggcgagagccaaatttcggcaaattgtgagcgcagttcagtattgtcatcagaaattcattgttcatcgcgatttaaaagccgagaacctactccttgacgccgatatgaacattaagattgccgactttgggttcagcaacgaatttacattcggaaacaagttagataccttctgtgggagccccccctacgctgctccggaactttttcaggggaaaaaatatgatgggcctgaggttgacgtgtggagcctaggcgttatcctgtacaccctggtgagtggctcattgccatttgatggccagaacctcaaagaattgcgggagagggtgctacgcggcaaataccgaattccgttctacatgtccactgattgcgagaacttgctcaagaagttcctgattctcaatcccagcaagaggggaaccctcgaacagatcatgaaagaccgctggatgaatgtagggcacgaggacgatgagctcaagccatacgttgagcccctgcccgactataaagacccgcgaagaaccgagctgatggtgtcaatgggatacacacgagaagagatccaagacagccttgtggggcagagatacaatgaggttatggccacctaccttctgcttgggtacaaatcgtcggagctggagggcgacacgatcacacttaaaccccgtccatccgctgatctcacgaattcatcagcgccctcacctagccataaggttcagaggtctgtgtctgctaacccaaagcagagacggtttagcgaccaagccgccgggcccgctattccaacttctaactcatattccaaaaagacgcagagcaacaatgccgagaacaagcggcctgaggaagaccgcgaatctgggcgcaaggccagctcaacagccaaagtgccagccagccccttgcccggtttagagcgaaagaagaccacgcccaccccgagcacgaatagcgtcctgtccaccagtactaatcgctcgcggaacagcccattgctggaacgagcttccctgggacaggcatctatccagaacggaaaagactccaccgccccacagcgagtccccgtggcttccccttccgcccacaacatcagcagctccgggggggctccggaccgcacaaacttccccagaggtgtgtcctctagatccacatttcacgccggccagctgaggcaggtgcgagatcaacagaacctcccttacggggtgacaccagccagccctagcggacactcccaggggaggcggggagccagtggatcgattttctccaaattcacatcgaaatttgttagacggaacctgtcatttcggttcgcgcgccgcaacctaaatgaaccagaatccaaagaccgggtcgaaactttgcgaccccacgtggttgggagcgggggaaatgacaaagagaaagaagagttccgagaggctaagcccagaagtctgagatttacgtggtcaatgaaaacaacatctagcatggagcccaacgagatgatgagagaaatccggaaggtcttggacgcaaatagctgtcagtcagagttgcatgagaagtatatgctgctctgcatgcacggcacccctgggcatgaagatttcgtccaatgggaaatggaggtatgcaaactgcccaggttgtcattgaatggtgtgcggttcaaaaggatctcgggcacgagcatggcgttcaaaaacattgcttcaaaaatcgcaaacgagctgaagctctag

SEQ ID NO: 123408 - DNA, 2343 bp, Artificial Sequence
  Description of Artificial Sequence: Synthetic coding sequence
atgtcttctgcgagaaccccactgccgacactaaatgagagggataccgagcagcccacattgggacacctcgactctaaaccctcaagtaaatctaatatgattcgaggtaggaatagtgctactagtgccgatgaacagcctcacataggaaattatcgtcttctgaaaacgatcggcaagggcaactttgccaaggtcaaacttgcaagacacatcctgaccggcaaggaagtcgccgtgaaaatcatagataagacccagctcaacagtagttctttacagaagttgttcagggaagtgaggattatgaaggtgctgaatcaccccaatatcgtgaagctcttcgaggtcatcgagactgaaaagactttgtacttagttatggagtacgcctctgggggcgaggtttttgattacctggtggctcatgggcgaatgaaggaaaaagaagccagagcaaaattcagacagatcgtgtctgccgtgcagtattgccaccagaagtttattgtgcaccgcgatttgaaggccgaaaacctgcttctggacgccgacatgaacattaaaattgcagattttggctttagcaatgaatttacctttggaaataagctcgatactttctgcggttctcctccctacgcggcgccggaactgttccagggtaaaaaatatgatggtccggaagtggatgtgtggagtcttggagtgattctgtataccctggtatccgggtctctgcctttcgacggacaaaacctgaaggaactgcgggagagagtgctccggggtaaataccgcattcccttttacatgagcacggactgtgaaaatctgctgaagaaatttctgatattaaacccttctaaacgcggcacactggaacagataatgaaagacaggtggatgaacgtgggacacgaagatgatgagctgaaaccctacgtggagcctttgccagattacaaagatcctcgccgtaccgagcttatggtgtcaatgggttatacacgagaggagatccaagatagtctggttggccagagatacaatgaagtgatggcaacatatcttctgttaggctacaagtcaagcgaactcgagggagacacaattactctcaagcctcgaccatcagctgacctaacaaattcttccgccccaagcccaagccataaggtgcagaggtccgtgtcggccaacccaaagcagaggaggtttagcgatcaggcagggccagcgatacccacaagtaactcttattccaagaagacgcagtccaacaacgcagagaacaagcgtcccgaggaagatcgcgaatccggccgaaaagccagtagtacagctaaagttcctgcttctcctcttccaggactcgagcgcaaaaaaactacaccaacaccctctaccaactccgttctatcaacctccacaaatcgctccaggaactcgcccctgctcgagagggcaagcctgggacaggcatccatccagaacggcaaggattccctgaccatgcctgggtctagagcctcaactgccagcgcatctgccgcagtcagcgctgcgagaccccgccagcaccagaagtccatgtctgcttccgtgcatccgaacaaagcttcgggcctgccgccgacagagtccaactgcgaagtgcccagaccccgccaggtcaccgctccacagagagtaccagtggcctctccatcggctcataacatttcttcctccggaggcgctcctgacaggaccaacttcccccgcggagtcagtagccgatcaacgtttcacgccggacagctccggcaggttcgtgaccaacagaacctgccgtacggggtgacacccgcaagcccatcaggccacagtcaaggcagaaggggcgccagcggttctatcttcagcaaatttacttcgaaatttgtgcgccgtaatctgaacgaaccggagagcaaagatcgagttgaaaccctccgacctcacgtcgtgggatccggtggaaatgacaaagaaaaggaagaattcagggaggcaaaaccccgctctctgaggtttacatggtctatgaagactactagtagcatggaaccaaatgaaatgatgcgtgagatcaggaaggtgctggatgccaatagctgccagtctgagttacacgaaaagtacatgctgttatgcatgcacgggacaccggggcacgaggatttcgtgcaatgggaaatggaagtgtgcaaattgcccagactgtcactgaatggggtgagattcaaaagaattagcggcacctcaatggcattcaagaacattgcgtctaagattgctaatgagctgaaactgtag

SEQ ID NO: 123409 - DNA, 126 bp, Artificial Sequence
  Description of Artificial Sequence: Synthetic coding sequence
atgagctcagcgcggacaccgctgccaacattgaacgagcgcgatacggagcagcccactctgggacatcttgattctaagccgtcaagcaaaagcaacatgataagaggccgcaactccgcctag

SEQ ID NO: 123410 - DNA, 2175 bp, Artificial Sequence
  Description of Artificial Sequence: Synthetic coding sequence
atgtcctccgcccgcactccactcccaacacttaacgagcgcgatacagagcaaccaacccttgggcatctggatagcaagccttccagtaaatccaacatgataaggggaaggaacagtgctacttctgccgacgagcaacctcatattggtaactacaggctgttaaagaccattggcaagggtaattttgcaaaggtcaagctggcaaggcacatactgaccggcaaagaggtcgcagtaaagatcatcgataaaacacagcttaactcttcatcactccagaagctgtttagggaagtgcggatcatgaaggtgctcaatcaccccaacatagtaaagctctttgaggttattgaaactgagaaaacgttatacctggtgatggagtatgcctctggcggcgaggtgttcgattacctggtggcacatggccgaatgaaggaaaaggaggccagagcaaaatttagacagattgtgtcagcggtgcagtactgtcaccagaaatttatcgtacaccgggatctcaaggccgagaacctgcttctcgatgctgacatgaatattaagattgccgactttggcttctctaacgagtttacattcggcaataaactcgacacattctgcggatcccccccctacgcagcgcccgagctctttcaggggaaaaagtacgacgggccggaagtggacgtgtggagtctaggggtgatcctgtataccttggtttccgggtctctgcctttcgatggccaaaacctcaaagagctgcgggagagggtccttcggggtaagtatcgaattcctttctacatgagcacggactgtgagaatctactcaaaaaatttttgatcctgaacccatccaaaagaggtactctggagcagataatgaaggatcgatggatgaatgtcgggcatgaagatgacgaactgaaaccttacgtggaacccctccccgattataaggacccaaggaggacagagctcatggtatctatgggttacacccgggaggagatccaagattctctcgtaggccagcgatacaatgaggtcatggccacatatctgcttctggggtacaagagcagtgagttagagggtgatacaattactttgaaacctagaccctctgccgatctcaccaactccagcgccccatcccctagtcacaaagtccagagatcagtgagtgctaaccccaagcaacgaaggttctcggatcaggcagggcccgcgatcccaacatctaactcatattccaagaaaactcagtcaaataacgctgaaaataagagacccgaggaagatcgggagtccggccggaaggcaagctccaccgctaaagttcctgcatcacccttgcccggattggagcgcaaaaagacgactcccacaccatctacaaattctgtgctctcaacttctaccaaccgttcccggaattcacccctgctcgagagagcctccttgggccaggcctccattcaaaatggtaaggactcaacagctccacagagagtcccagtcgcttcaccctcggcacacaacatctcaagcagcggtggggcccctgaccggactaacttcccacgcggtgtgagctccaggagcacattccacgccggacaactgcgccaagtgcgggatcaacagaatctcccgtacggagttacaccagctagcccgtcagggcatagtcaggggcgcaggggtgctagtggctcaatattcagtaagtttacgtccaagttcgtgcgacgtaaccttaacgaacctgaaagcaaggatcgcgttgagacgctcagaccccacgtagtcggcagcggcggaaatgacaaagagaaagaggagtttagggaggccaaaccgcgcagcctgagattcacctggagcatgaagacaacgtcttcaatggaacctaatgagatgatgcgggaaattcggaaggtgctcgacgctaatagctgccagtccgagctccacgagaaatatatgctgctctgtatgcatggtactcccggacacgaagactttgtgcagtgggaaatggaagtgtgcaagctgcctcggctttccctgaacggcgttaggttcaaaagaatctccggcacttcaatggcatttaaaaacatcgcgtcaaagatcgctaacgagctgaagctatag

SEQ ID NO: 123411 - DNA, 186 bp, Artificial Sequence
  Description of Artificial Sequence: Synthetic coding sequence
atggaggttgcagggagcccgttcccatttctacagagtgtcgcttgtctgctcacactcgctcatatacctgcagtaggaaacattctgcagcatcggagacgtggggctggccctacgcttgggcaccttgactcaaagccttccagtaaaagcaatatgatcagggggcgcaatagtgcctag

SEQ ID NO: 123412 - DNA, 339 bp, Artificial Sequence
  Description of Artificial Sequence: Synthetic coding sequence
atgattcgggggcgaaactctgctacatctgccgacgagcagccgcacatcggtaactaccgactgttaaaaaccattggtaaaggcaactttgcgaaggtcaaactggccaggcatatcctgaccggaaaggaggtggcagtaaagatcatcgacaaaacacaactaaattctagtagtctccagaagctgtttcgggaggtcagaataatgaaggtacttaatcatccaaacatagtgaagttgttcgaggttatagaaaccgagaagaccttgtacctggtcatggaatatgccagtggaggcgaggtttttgattatctcgtggcacacggatag

SEQ ID NO: 123413 - DNA, 486 bp, Artificial Sequence
  Description of Artificial Sequence: Synthetic coding sequence
atgattagaggcagaaactccgcaacctcagctgatgaacagccacacatcgggaattaccggttgctgaaaactattggtaaggggaacttcgctaaggtcaagcttgccaggcacattctgacaggtaaagaggtagcggtaaaaatcatagacaagactcagctcaactcctcctcgcttcaaaaactttttcgagaggtccgcattatgaaggtgctaaaccatcccaacatcgtcaagctgtttgaagttatagaaactgagaaaactttgtacctggtcatggagtacgcttctggcggagaggtcttcgactacctggttgcgcacggccgaatgaaggaaaaggaggcccgggccaaattcaggcagattgtgagcgcagtgcagtactgtcatcagaaatttatcgtacatcgtgatcttaaggcggaaaatttactgctggatgccgatatgaatatcaagattgcagacttctag

SEQ ID NO: 123414 - DNA, 276 bp, Artificial Sequence
  Description of Artificial Sequence: Synthetic coding sequence
atgggtggccagaggaacacaagcgtagggaatatagtgcagaggtggagggaccacgtggtttgtcagaaggccggcgtgatctatagcgggaggaaggcacaggagcacggcactggccgcacagacttcactcctgctcaaagactgatgatgccaacactgggccatctggactccaagccatccagtaaaagcaatatgattagaggccggaattccgcaaccagcgctgatgaacagccacatattggaaactatcggcttctcaaatag

SEQ ID NO: 123415 - DNA, 2238 bp, Artificial Sequence
  Description of Artificial Sequence: Synthetic coding sequence
atgatcaggggacggaactcagctacgagcgcagatgagcagccacatattggcaactatcgtttactgaagactataggaaagggaaatttcgccaaagtaaagcttgctcgccacatcttgacaggaaaggaggtggccgtgaagatcattgacaagacccagctgaactcatcctccctgcagaagctctttcgggaggtacgcattatgaaagtgctcaatcaccccaacatagtgaaactgttcgaggtaattgagacagagaaaacactatatcttgtgatggagtacgcaagtggcggcgaggtgttcgactacttggtagcccacgggagaatgaaagagaaggaggctagggctaagttccggcaaattgtttccgccgtccaatactgccaccaaaagttcatcgtccaccgtgatttaaaggctgagaacctgctattggacgcagatatgaatatcaagatagccgattttgggttcagtaacgaattcacatttggtaataagttggatactttttgcggcagccccccgtacgcagccccggaactgttccaggggaagaaatatgatggccccgaagtagatgtgtggagtctgggtgtgatcttgtatacactcgtgtctggctccctgcccttcgatggccaaaatttgaaagagcttcgcgagagggttctgagaggcaagtaccggatccccttctatatgtccaccgattgtgaaaacctgctgaagaagtttctgatcctgaaccctagtaagagaggtacgctggaacagattatgaaggatagatggatgaacgtgggtcatgaagacgatgagctgaagccctacgtggaacccctgccagattacaaggatccaaggcgtacagagttgatggtgtctatgggctataccagagaggagatacaggacagcctggtaggccagcgctacaacgaagtcatggctacatatctcctccttggctataagtcctccgaactcgaaggtgacaccattaccctaaaacccaggccctcagccgatctgaccaactccagtgccccctccccttcccataaggtccaacggtccgtgtcagcgaaccccaagcagagaagatttagtgaccaggcgggtcccgcaatccctacaagtaactcatactctaaaaagacccagtctaacaacgcagaaaataaaagacctgaggaggaccgcgagagcggcagaaaggctagctctacagcaaaagtccctgcttctcctttgcctggacttgagagaaagaagactaccccaacaccttctaccaacagtgtgttgagtacgagcactaatcgctcacgtaacagcccacttcttgagcgcgcttcccttggacaggcttcaatccagaatggcaaagactctctgacaatgcccggatcacgtgcgtctacagcttccgcgagtgccgccgtgtcagctgcgcgcccaaggcaacatcagaagagcatgtcggcttctgtgcaccctaacaaggcatccggacttcccccaaccgaatcaaactgtgaagtccccaggccctcaaccgcacctcagcgtgtgccagtggcttctccctcagcccacaatatctcgagcagcggaggtgcaccagatcggactaatttcccgcggggagtttcttctcgctcaacattccatgccggacagttaaggcaggttcgggatcagcaaaatctcccatacggagtgacccccgcatcaccatctggccactctcagggccggcgcggtgctagcggatctattttcagtaaatttactagtaagttcgtaaggcggaacctgaacgaaccagagagcaaagatcgtgtggagacactgcggccccacgtagtgggctccggaggcaacgataaggaaaaagaggagttccgtgaagccaagccccgtagtctgagatttacatggagtatgaagacaactagcagtatggagcccaacgagatgatgcgtgagattcggaaggttctcgacgctaacagctgccagtcagagctgcatgagaaatacatgctgctctgtatgcacggaacaccaggacatgaggatttcgtgcagtgggagatggaggtgtgtaaactgccgcgcttgagcctaaatggcgtccgtttcaagcgtatttcaggcactagcatggccttcaagaatattgcatccaagatagcaaacgaacttaagctgtag

SEQ ID NO: 123416 - DNA, 4128 bp, Artificial Sequence
  Description of Artificial Sequence: Synthetic coding sequence
atggaaggcgaccgcgtcgccggtagaccagtactgtcgagcctcccggtgctactcttactcccattgctgatgctgcgcgctgccgccctgcatcctgatgagttattcccacacggggagtcttggggcgaccagcttttacaggagggtgacgatgagtcatctgccgtcgtgaagctggctaaccctctgcatttctacgaagctaggtttagcaatctgtatgttggtaccaatggcatcatctcaacacaagattttccacgcgagacccagtacgttgactatgacttccccacagacttccctgccatagctcccttcctcgccgacatagacacgagccatggccgcggtcgggtcctgtatagagaagatacatctcccgcagttctgggtctggccgcacggtacgttcgggccgggtttccccgctctgcccgcttcacgcccacccacgcatttttagcaacctgggagcaggtgggcgcctatgaggaagttaagcggggcgctctaccatcaggcgagcttaacacatttcaggcagttttggcctcggacggaagcgactcttatgcactcttcttgtacccagccaacggcctccagttcctggggacacggccaaaggaatcgtataatgtccagctgcaattgccggcaagagtcgggttctgcagaggcgaagctgacgatttgaagtccgaggggccgtacttttctctcacttctacagagcaaagtgtgaagaatctttaccagctttccaatctcggaattcctggagtgtgggcgttccacatcggctctacttctcctctggacaatgtgcgacctgctgctgtgggagatttgagcgccgcccactcctctgtgcccctcgggcgcagcttcagccacgctactgctttggaatctgattacaatgaagacaacctggactactatgatgtcaatgaagaagaagcagaatacctgccaggcgagcccgaagaggccctgaatggacactcatctattgatgtgtccttccagtccaaagtggatactaagcccttagaagaaagctccacccttgatccacacactaaagaagggacgagcctgggcgaagtggggggcccagacctgaagggccaagtggaaccgtgggacgagagagagactagatccccagcccccccagaagtagatcgggattcactggcccctagctgggagacacccccgccatatcctgaaaacggatctatacagccataccctgatgggggcccggtgccttcggagatggatgtgcccccagcccatcctgaagaggaaatcgttttacgctcatatccggcaagtggacatacaacgccgctgtcgcggggaacgtatgaggttgggctcgaggataacatcggttccaacacagaggtcttcacatacaacgccgctaataaagagacgtgcgaacataaccacaggcagtgtagtcgccatgccttttgtaccgattacgcgaccggattttgttgccattgccagtccaaattctacgggaacggaaagcattgccttcccgagggcgctccccatcgggtgaatgggaaggttagcggacacctgcacgtcgggcacaccccggtgcatttcacggatgtggacctccacgcatacatcgtagggaatgacggacgcgcctacaccgcaatcagccacatcccacagcctgctgctcaggcactgttacctcttacccctattggcggtttgtttgggtggctgtttgcacttgaaaagcctgggagtgagaatggtttcagcctggctggagccgcatttacccatgatatggaagttactttctaccccggcgaggaaacggtacgtattactcagactgctgagggtctggatccagagaattatctttctattaagactaatattcagggacaggtgccctatgtgagtgccaattttacggcgcacatttcaccttataaagaattgtatcactactctgacagcactgttacctccacgtctagccgtgactacagtctgaccttcggggccataaatcagacctggagctatcgaatccatcaaaacatcacttatcaagtttgccgccacgcaccaagacacccatccttcccaactacgcagcaactcaatgtggacagagtcttcgccctgtacaacgacgaagagcgagtgctcaggttcgccgtgacaaatcagattgggcctgtcaaggaggactcagatccaaccccaggaaatccgtgttatgacgggagtcacatgtgcgataccaccgcccggtgccaccctggaacaggtgtggactacacttgcgaatgcgcgagcgggtaccagggcgacgggaggaattgcgtcgatgaaaatgaatgcgctacgggatttcaccgatgtggcccaaactcagtgtgtatcaatttaccgggaagttataggtgtgagtgcagatccggatatgaatttgcggatgatcgccatacttgtattctaataacgcctcccgcgaacccttgtgaagatggtagccacacatgtgctcctgccggccaggccaggtgcgtgcaccacggaggctcaacattctcatgtgcgtgtctgccaggctatgctggcgacgggcatcaatgtaccgacgtggatgagtgctctgagaaccgctgtcatccagcagccacctgttacaatactcccggtagctttagctgtagatgtcaaccgggttactacggcgacggatttcagtgcattcccgattccaccagctccctgacaccatgcgaacagcagcaacgccatgctcaagcacagtatgcgtaccccggagcacgctttcacattccacagtgtgatgaacagggcaacttccttccgttacagtgccacggatccacaggattttgttggtgcgttgacccggacggacatgaagtgccaggaactcagacgcctcctggcagtacacctccccactgcggcccaagccccgagcctacgcagcggcctccaacgatttgtgagcggtggcgcgagaacctgctggaacattacgggggcactcctagagacgatcaatacgtaccacagtgtgacgatctgggccatttcataccactccaatgtcatgggaagagcgacttttgttggtgcgtggacaaagatgggcgggaagttcagggtacgcgcagccaacctggcacaacacccgcatgcatccccacagtggcccctccaatggtgcgccccacaccaagaccagacgtgactcccccaagcgtgggtacattcctgctctatactcagggacagcagatcggctatctcccacttaatggaacaaggctgcagaaagacgcagcaaaaactctgttgagtctacacggaagcattattgtcgggattgattatgactgcagagaaaggatggtgtattggactgacgtcgcaggaaggaccatctctcgagctgggctcgagctgggtgcagaaccagagaccatcgtgaattccggactgatttcacctgaggggttggccatcgatcacatccggcggacgatgtattggaccgactctgtcctcgacaaaatcgagtctgctctcctggacgggtccgaacgaaaggtattgttctataccgatctggtcaacccgcgggccatcgcagtcgaccccatccggggcaacctttactggaccgattggaacagagaggcccctaagatcgagacttcctccttggatggtgaaaacaggcgcattctgattaacacagatataggattgcccaatggccttacatttgaccccttcagcaagctgctttgctgggcggatgccggcacgaagaagctcgagtgcactttgcccgatgggacaggtaggagggttattcaaaataacctgaagtacccgttctcgatcgtttcatatgctgaccacttctatcacacagattggaggagggacggcgtggtgagcgttaacaagcactccgggcagttcaccgacgagtacctcccagagcagaggagccacctgtacgggataaccgctgtgtacccatactgtcctacaggtcggaaatag

SEQ ID NO: 123417 - DNA, 2190 bp, Artificial Sequence
  Description of Artificial Sequence: Synthetic coding sequence
atgtcgacacgcacgccgcttcccaccgtgaatgaacgtgataccgagaaccacacctcccacggagatggcaggcaggaagtcacatctcggacatcgcgttctggggccagatgcagaaatagtattgcttcttgcgctgatgaacagcctcatattgggaactaccggcttctgaaaacaatcgggaaggggaattttgctaaggttaagctggctagacacattctgacagggcgagaagttgccatcaagattatcgacaaaactcaactcaaccccactagtctccaaaaacttttcagagaagttcgcattatgaagattcttaaccacccaaatatcgtgaagctcttcgaggtgattgagacggagaagactttgtacctgatcatggaatatgcctccgggggggaagtgtttgattacctggtagcgcatggccgcatgaaggagaaggaggctagatccaaattccggcagatcgtgtctgccgttcagtactgccaccagaagcgaatcgtgcacagagatctgaaggctgagaaccttttactggacgccgacatgaacattaagattgccgactttggcttttctaatgaatttactgtgggggggaagcttgataccttctgtggttcacccccctatgctgcgccagagctgtttcagggtaagaagtatgacgggcccgaagtcgacgtctggagcctaggagtgattctctacacattggtgagcggaagcctgccattcgacggacagaatctgaaggagcttcgcgagcgggtactgagaggtaagtaccggatccctttttatatgtccaccgactgcgagaatctcctgaaacgtttcttggttcttaatcccatcaagagaggcactctggagcagattatgaaggatcgatggattaacgctggacacgaggaggacgagctcaagccctttgtcgagcctgagttggatatctctgatcagaagcggatcgatataatggtcggcatgggctatagccaggaggagattcaggagtcactgtctaagatgaaatatgacgagattaccgccacctatctgctgttgggacgcaaaagctcagaactggacgcctcggatagttcttcttcatcaaacctcagtctggcgaaagtgagaccaagtagtgacttgaataactccacaggtcagtctccccatcacaaggtacagcgctccgtctttagttctcagaagcaaaggcggtactctgaccatgctgggcccgcaattcctagcgtggttgcttatccaaaaagaagccagacatccacggcagattctgacctaaaagaggacggtattagctcgagaaaaagttctggttcagcagtgggaggtaaggggattgcccctgcctctcccatgcttggcaacgcctctaatcccaataaagcggatattccagaacggaagaagtcatctactgtcccttcctctaacaccgcctctggcggtatgacccggagaaatacctacgtgtgtagcgaacggactacagcagacaggcattcagtgatccaaaacggtaaagagaacagcactatcccagaccagcggacaccggtggcttcgacccatagcattagttcagctgcaacaccggatcggatcagatttcctagaggcacggctagcagaagtacctttcacgggcagccccgtgagagaaggactgctacatacaacgggccgcccgcctccccttccttgagccacgaggccaccccactttctcagactaggtctagagggtcaactaacctgttctccaagctgacgagtaaactgactaggagcagaaacgttagtgccgagcagaaggacgagaataaggaggctaagcctcggtcactccgatttacgtggtcaatgaagacaacctcttccatggatcccggggatatgatgagggaaattagaaaagtcctcgacgccaataactgcgattatgaacagcgcgaaaggtttttgctgttttgcgttcacggcgatggccatgcggaaaacctggtgcagtgggaaatggaggtgtgtaagctgccgcgactgtcactgaacggtgttcggttcaaacggatatccggtactagtattgctttcaaaaatatcgcctcaaaaatcgccaatgagctgaaactgtag

SEQ ID NO: 123418 - DNA, 1338 bp, Artificial Sequence
  Description of Artificial Sequence: Synthetic coding sequence
atgaagtacgatgaaataaccgctacttacctgcttctgggcaggaagagctctgagctggatgctagcgacagctcctcatccagcaacctttcattagctaaagtccgaccatcaagcgacctaaacaactctaccggtcaatcaccccaccacaaggtccagcgcagcgtctttagcagtcaaaagcaaaggcgctatagcgaccacgcgggtcccgcaattcccagtgtcgtggcctatccaaagaggtcccagactagcactgccgattctgacctcaaggaggacgggatttcgtcccggaagtcaagtggaagcgcggtcggcgggaagggtatcgctccggcttctccaatgctgggcaatgcctctaacccgaacaaggcggacattcccgagcgcaaaaagtccagtaccgtgcctagtagcaacacagccagtgggggaatgacaagaagaaacacgtatgtgtgctcagagcggactactgccgatcgccactccgtcattcagaacggtaaagaaaacagcctcacagagatgttcgcttacgccgccagtcccgccagtgtctgtaccagtacttgccgcttgcgacaccagaagtccatgtctatgtcagcctccggacacccgaagatgatgctgcctcctatagattccgagggtgataattttaaggccatcactattccagaccagaggactcctgtcgcttccacgcattccatatccagcgcagcaactcccgaccgtatacgcttccctcgggggacagcatcgaggagtacttttcatgggcagcccagggaaaggagaactgcaacctacaatggaccaccagcatcccctagcctttcccacgaagccactcccctgagccagactagatcaagaggctcaacgaacctcttctctaagctgacttccaaactcacaaggcgcctgccaactgagtatgaacgaaatggccggtacgagggatcatcacggaacgtgtctgcagaacagaaagacgagaataaagaagcaaagccccgctccttgcgctttacttggagcatgaaaactacctcttcaatggatccgggcgatatgatgagggagatccgtaaggtacttgatgcaaacaattgtgattatgagcagcgcgagcgatttctgttattctgcgtacacggagatggacacgccgagaatcttgtgcagtgggagatggaggtgtgtaagctgccaagactcagcctcaatggggttcggtttaaacgcattagcggcacctcgatcgcatttaaaaatatcgcctcaaagatagccaatgaactaaagttgtag

SEQ ID NO: 123419 - DNA, 2259 bp, Artificial Sequence
  Description of Artificial Sequence: Synthetic coding sequence
atgtctacaaggacaccattgcctaccgtgaacgagcgagacaccgagaatcacactagccatggcgacggcagacaggaggtaacttcacgtacatctagatccggtgcccgatgccgaaactctatagcctcctgtgcggatgagcagccacatattggcaattatcgtttgctgaagactatcggaaaagggaattttgcaaaagtgaagttggcccgccatatattaacaggacgtgaagtggcaatcaagattatagacaagacacagcttaatcccacttctctgcagaagctgttccgagaggtgcgaatcatgaagatccttaatcaccctaacatcgtgaagctgtttgaagtcatagagacagaaaagacgctatacctgattatggagtacgcgagtgggggtgaggtcttcgattatctggttgcacatggtaggatgaaagagaaagaggccaggtctaaattccggcagggatgtcaggccggtcaaactattaaagtgcaagtgagctttgatctactgtccttaatgttcaccttcatcgtttctgctgttcagtactgccatcagaagagaattgtccatcgcgatttgaaggccgaaaatctactattggatgctgacatgaatattaagatcgccgatttcggcttctccaatgaattcaccgtgggtggtaagttagacacattttgtgggtctccaccttatgccgcacccgagctgttccagggcaagaagtatgatggtcccgaggtcgacgtttggtctctgggcgttatcctttacactttagttagcggctctctcccattcgatgggcagaaccttaaggaactccgggaacgtgtcctcagaggcaagtacagaatccccttctacatgtccaccgactgcgagaacctcctgaaacggtttcttgtccttaatcccataaagcggggcaccctggagcagattatgaaggaccgttggattaacgcggggcacgaagaggacgagctgaagcctttcgtagagcctgaactggacatctcggaccagaaaagaatcgacataatggtgggcatggggtacagccaggaggagatccaggagtctctcagcaagatgaagtatgacgaaataacagctacctacttgctgctggggcgcaaaagctccgagcttgacgcctccgactcttccagctcttcgaacctgagccttgctaaggtcaggccctcaagcgatctgaacaattcaacagggcaatccccccatcataaggtacaacggagtgtgttcagctcccagaagcagagaaggtattctgatcacgctggtccggccatcccctccgtcgtcgcctatccgaagcgatctcagacttctaccgcggattccgatcttaaggaagatggaatttcaagccgaaaatcaagcggttccgcagtgggaggaaaagggatcgcaccggcaagccccatgctcggcaatgcaagcaatcctaacaaggcagatattccggaacgcaagaagagctctactgttcctagctcaaataccgccagcgggggcatgacaagacggaatacttacgtatgctccgagcgcactacagctgatagacactccgtgattcagaacgggaaggagaactctaccatccctgatcagagaactcccgtggctagcactcactccatcagtagcgcagcgacccccgatcggattaggtttcctcggggcaccgcctcgcgttctacctttcatggccagcctagagagcgtaggaccgcaacctacaatggacctcccgcttcacccagtctctctcacgaggctacaccactgagtcagactcggtctcgcggcagcacgaatttattcagcaagctgacttctaaacttacacgctcaagaaacgtgtctgccgaacagaaggacgaaaataaagaggccaaacctcggtccttgaggttcacgtggtctatgaagacaacctcctcaatggatccaggcgacatgatgcgagaaattcgcaaggttctggatgccaataattgcgactacgaacagcgcgagcgatttctgctattctgtgtccacggcgatggccacgccgaaaacttggtccaatgggagatggaagtctgcaagcttccgagactatccctcaacggcgtccggtttaaacgaatctcggggacaagtattgcctttaaaaacattgcctccaagatagccaatgagctgaagctctag

SEQ ID NO: 123420 - DNA, 2262 bp, Artificial Sequence
  Description of Artificial Sequence: Synthetic coding sequence
atgtctacccgaacacctttgcccaccgtgaatgagcgtgacacagagaatcacacgagccacggagacggtcgccaggaagtgacctcccgaacctctcgttccggtgcgcggtgcagaaattctattgcatcctgtgcggacgaacagcctcatataggaaactacagactgcttaagaccataggcaagggcaattttgcaaaggtcaagcttgccagacatatcttgacggggcgcgaagtggccattaagatcattgataagacacagttaaacccgacttcccttcagaagctgtttcgcgaagtcaggatcatgaagatattgaatcatccaaacatcgtgaagctgtttgaggtgatagagacggaaaaaactctttacctcatcatggagtatgcaagcggcggtgaggttttcgattaccttgtggcgcacggaagaatgaaggaaaaggaagcccggagcaagtttcgccagattgtctctgctgtgcagtactgtcaccagaagagaattgtgcacagggacttaaaggccgagaaccttctgctggacgcagatatgaacattaagattgccgatttcggcttctcgaacgagttcacagtgggaggaaagctcgacacgttctgtgggtcacccccctatgctgcaccggaactgttccagggcaagaaatatgatggccccgaggtggacgtttggagcctgggcgttattctgtacacactcgtctccggttccctccccttcgacggacagaatctgaaagagcttagagagagagtgctgagggggaagtaccgtataccgttttacatgtcaaccgattgtgagaaccttcttaagagatttctggtgctcaatcctattaaaaggggaacgttggaacagatcatgaaggataggtggattaacgctgggcacgaagaagacgagttaaagccttttgtcgaacccgaactggatatcagcgatcaaaagcgcatagatattatggttgggatggggtattctcaagaggagatccaggagtccttgtccaaaatgaagtacgatgagatcaccgccacttacctgcttttagggcgcaagagcagcgagctggatgcctccgactctagctccagctcaaacctttctctggcgaaagtgcgtccctcttctgatctgaataacagcactgggcaaagccctcaccacaaagtgcagcggtcggtctttagctcacaaaaacaaaggagatattccgatcatgccggcccagccatcccttccgtggtagcctaccccaaacgctcgcagaccagtactgcagacagtgacctaaaggaagatggcatctcctcccgtaaaagtagtggcagtgctgttggtgggaagggtatcgccccggcatcacccatgcttggaaacgcttcaaaccccaacaaggccgatatccccgagcgcaagaagtcgagtaccgtgcccagctcaaataccgcttccggcggcatgactcggagaaacacctatgtatgcagcgagagaacaactgccgacagacatagtgtcatacagaacggcaaagagaacagtaccataccagaccaacgtacgcctgtcgcatccacacacagcatcagctccgcagccacaccagataggataaggttcccccggggcacggcatcccggtccacctttcacggccagccaagagagcgcagaaccgccacgtacaacggacctcctgctagcccctcactcagccatgaagcaacccctctttctcaaaccagaagcaggggctccacaaacctgttctctaagttgacatctaaacttacgcggcgcaacatgagtttccgattcatcaaaagacttccaacagaatacgaacgaaatggtcggtatgaaggcagttcccgcaacgtttctgctgaacagaaagatgaaaacaaagaagcaaagcccagaagtctcaggtttacctggtcaatgaagaccacttccagcatggacccaggagacatgatgcgggagatcagaaaagtgctggacgcaaataactgtgactatgagcaacgggagagattcctcctgttttgtgtgcacggggatgggcacgctgaaaacctggtgcagtgggagatggaagtttgtaaattgccgcggctgagcttgaacggggtccggtttaaacggatcagcggcacgtcaattgcattcaagaacatcgcctcgaagatcgctaatgagctcaaactgtag

SEQ ID NO: 123421 - DNA, 1980 bp, Artificial Sequence
  Description of Artificial Sequence: Synthetic coding sequence
atgtctacacggactccactgccaacagtgaatgagcgggatacagagaaccacacttcacacggcgatggcaggcaagaggtgacaagccgcacctccaggtccggtgcgaggtgcaggaactctatcgccagttgtgctgacgagcagccgcacatcgggaattataggctcctaaaaaccatcggtaaaggtaatttcgctaaagtgaaactggcaaggcacatcttaactgggagggaagtggctattaagataatagataaaacccagctaaatcctacttcactccagaaactgtttcgcgaagtgagaatcatgaaaatccttaatcatccaaacatcgtcaagttatttgaggtaatagaaacagaaaaaacgctgtacctaatcatggagtacgcctccggaggggaagttttcgactacctcgtagcacacgggagaatgaaggagaaggaggcgagaagcaagttcaggcagattgtgagtgctgttcagtattgtcaccagaaacgcattgtccacagagatttgaaggagctccgtgaaagagtcctgaggggtaaataccgaatcccgttttacatgagcacagactgtgaaaatctgctgaagcgatttcttgtgctgaatcccattaaacggggaacactggagcaaattatgaaagaccgttggatcaacgcaggtcacgaagaagatgagctgaaaccattcgtggagccagaactcgatatctccgaccagaaacggattgacatcatggttggcatgggctactctcaggaagagatacaggagtctctatccaaaatgaagtacgatgagatcaccgccacttacctcctgttgggcaggaagtcgtcagagctggacgcctccgattcttcatccagttcaaacttgagtttggcgaaagtccgccccagcagcgacctgaacaacagcaccggccagtcccctcaccacaaagtgcaaagaagcgtcttcagtagtcaaaagcaacggaggtacagcgatcacgcaggccctgccattccaagtgttgtagcgtatcctaagcggtcacagacctccacagcagatagtgatctgaaggaggatggaatctcgtccaggaagtctagcggctctgctgtggggggcaagggtatcgctccagccagtccgatgctcggaaacgccagtaaccccaataaggccgacatccccgagagaaagaagtcgtccaccgtacctagctctaacaccgcaagtggtggcatgaccagacgcaacacttatgtatgctcggagcgcacgacagctgataggcactctgtgatccaaaatgggaaggaaaattctactatccccgaccagcgaactccagtggcctctacccattcgatttcttctgcggccacccccgatcgcatccgcttcccccgcggaaccgccagtcggtccacgttccatggacagccaagagaaagaagaaccgccacctacaatggacccccagcctcgccgtctttaagtcacgaggctacgcctctgtcccagactcgcagtaggggaagtactaacctgttttctaagttgacatctaagcttacacgccggaatatgtcattccggttcattaaatcacgcaatgtgtccgcagagcagaaggacgagaacaaagaagctaaaccacggtctctgcggttcacatggtcaatgaagaccacttcgagcatggatcctggtgatatgatgcgcgagatccggaaggtattggatgccaacaactgtgactatgaacagcgtgaaagattcctgcttttttgtgtgcatggggatggtcacgccgaaaatctggtgcaatgggaaatggaagtctgcaagctgcccagactgtccctgaacggagtgaggtttaagcgaattagtggtaccagtatagcgtttaaaaatatagcctcaaaaatcgccaacgaactgaagctgtag

SEQ ID NO: 123422 - DNA, 2235 bp, Artificial Sequence
  Description of Artificial Sequence: Synthetic coding sequence
atgagcactcgcactcctctaccgaccgtgaacgagcgggacacagagaaccacacatcacacggtgacggccgccaagaagtgacaagccgaactagccggtccggtgccagatgtagaaattcaattgcctcctgcgccgatgagcaacctcacatcgggaactaccggctgttgaagactatcggaaaggggaatttcgccaaagtgaagctggcccggcacatcctcaccggcagggaggttgccattaagattattgacaagacccagctgaacccaacctctctgcagaagctatttagggaagtgagaataatgaagatcctgaatcatcccaatatcgtcaagctgttcgaggtcatcgagactgaaaagactctttacctgataatggagtacgcttccggtggggaggtgttcgactacctggtggcccacggccgaatgaaggagaaggaggcccgaagtaagtttaggcaaatcgtgagcgctgttcagtattgtcatcaaaaacgtatagtgcacagagacctgaaagcagaaaatctgctgcttgatgccgatatgaatattaaaatagcagatttcggtttctcaaacgagtttaccgtaggcggtaaattggacactttctgtggctccccgccctacgccgctcctgagctatttcaaggtaaaaagtatgatgggccagaggtcgacgtgtggtctttgggcgtgattctttacacattggtaagtggatccctccctttcgacggccagaatctcaaggaactgagggagcgggtgttgcgcggcaaatatcgcatccctttctacatgagtaccgactgtgagaatctgctgaagcgctttctcgtgctgaatccgatcaagagggggaccctcgagcagataatgaaggatcgttggattaatgccggtcacgaggaggacgaactgaaaccttttgtcgagcctgaattggatatctcagatcaaaagaggattgatatcatggttgggatgggatactcccaggaagagattcaggagtctttgtccaagatgaagtatgatgaaatcaccgccacgtacttgctccttggacggaaaagttcagaactggatgcctctgatagttcctcaagctccaatttgtccctagcaaaggttcgcccttcgagcgatcttaataattccacaggccagagtccccaccacaaagtgcagcgctctgtgttttcaagccaaaagcagaggcgatactccgatcacgcgggacctgctatccccagcgtggtcgcatatccaaagagatctcagacatccaccgctgactctgatcttaaggaagacgggatttccagccggaagagttctggctcagctgtgggcggtaaaggtattgcccccgcctcccctatgctgggcaatgcgtccaaccccaataaggccgacatcccagagcgcaaaaagagctcaacggtgcctagctctaataccgcttccggaggcatgaccagacgtaacacttacgtgtgcagcgagcggactaccgctgatcgtcatagtgtcattcagaacggcaaagaaaattctaccatcccagatcagaggactccagtcgcatcaacacatagcatttcttctgccgcaactcctgatcggattagattccctcgcggaacagccagccgttccacttttcatggccagccaagagaacgccgcaccgctacttacaacgggcccccagcttccccatctctttcccacgaagccacccctctgagtcagacaagatctcggggtagcaccaaccttttctccaaattgacatccaagctgacaagacgcctgcccaccgagtacgagaggaacggacggtacgaggggagcagtaggaacgtctccgcagagcaaaaggacgagaacaaggaggcaaagccacgttccctgcgattcacctggtcaatgaagacgacctcgagcatggatcctggcgatatgatgcgcgaaattaggaaggtgctggatgcaaacaactgcgattatgaacagcgggagagattcctgctgttctgtgtccacggcgacggtcacgcggagaatctggttcaatgggagatggaggtgtgcaaactgccccgcctctctcttaacggagtgcggtttaaacggatcagcgggacctcgatcgcctttaagaacattgccagtaagattgccaatgagttaaagttgtag

SEQ ID NO: 123423 - DNA, 1518 bp, Artificial Sequence
  Description of Artificial Sequence: Synthetic coding sequence
taagtagatgtatggagcctcggcgtcattctgtacacactggtcagtggtagcttgccctttgacggccagaatttgaaagaactgagagagagagtactgaggggcaagtatcggatccctttctatatgtctaccgactgcgaaaaccttctgaaacggtttttggtcctaaaccccattaagcggggtaccctcgagcagatcatgaaggacagatggatcaacgccgggcacgaagaagatgaactgaagcccttcgttgagcctgagctggatatctccgatcagaagagaatcgacatcatggtgggtatgggatatagccaggaagaaattcaagagtctctgagcaaaatgaagtatgacgagatcaccgctacatacttactgctgggaagaaagagcagtgaagttcggccatcgtccgaccttaataattcgacgggccaatctcctcaccacaaggtgcagaggtcagtattttcctcacagaaacagagaagatactcagatcacgccggtccagcaatcccaagcgtggtcgcatatcctaagcgaagccagactagtaccgcagattctgatctgaaagaggacgggatttcgagcaggaagtccagtggcagcgccgtgggcggcaagggcattgcgcccgcatcaccaatgttaggaaatgcttctaaccccaataaagccgacattccagaaaggaaaaaatcaagcacggttcccagttctaacaccgcctcaggggggatgacacgccggaatacttacgtctgcagtgaaagaaccaccgctgatcgtcattccgtgatacagaatgggaaggagaattctacaatcccagaccagcggacccctgtggcctctacccattccatctccagcgcagcaactcctgaccgcatacgtttccccagggggactgccagcaggagcacattccatgggcagccacgtgagaggcggaccgccacttacaatggtccaccagcctcacctagcctgagtcatgaggcaacacctctttcccagacccgatctcgcggtagcacaaacttgttcagtaagctgacgtccaagctgacacgccggaacatgtcattccgtttcataaagcggctccccactgagtacgagcggaatggacggtacgagggcagtagtaggaacgtgtccgctgagcagaaagacgagaacaaggaggctaaaccccgctcactccgcttcacatggtctatgaagacaacatcgagtatggatccgggtgacatgatgcgcgaaattcggaaagtgctcgacgctaacaactgtgactatgagcaaagggagcggtttctgctcttttgtgtccacggcgacggccacgccgagaatttagtgcagtgggaaatggaagtgtgtaagctgcctaggctgtctctgaatggcgtcaggttcaaaagaatcagcggcacctcaatcgctttcaagaatattgcaagtaaaatcgccaacgagctcaaactatag

SEQ ID NO: 123424 - DNA, 2259 bp, Artificial Sequence
  Description of Artificial Sequence: Synthetic coding sequence
atgtcctcccggacggtgctagctccaggcaatgacaggaactcagacacccacggaactctcgggtccggcagatctagcgacaagggaccttcatggagcagcagatcattgggcgcgcggtgccgaaattcaattgccagctgtccagaggaacagccgcacgttgggaattacagactgctgcgaactattgggaagggtaactttgcgaaagtgaaattagcccgtcacatcctgacaggcagggaggtcgcaattaagatcatagataaaactcagctgaatcccagcagcttgcagaagctttttcgtgaggtgcggattatgaaagggctgaatcacccaaatatagtgaagctgttcgaagtcatcgagacggagaagacactctacctggtgatggagtacgcgtcagccggagaggtatttgattacctagtgtcccacggtcgcatgaaagaaaaggaggccagggccaaattccgccaaattgtgtcagccgtacactattgccaccagaagaatattgtccatagggacctaaaagccgaaaacttattgttggacgccgaggctaatattaagattgctgattttggtttttccaatgagtttactctcgggtccaaactggatacattttgcgggtctccaccatatgcagctcctgaattattccagggaaaaaaatatgatgggccagaggtggacatctggagtctgggtgtaattctgtatacactggtgagcggctctctgcccttcgacgggcacaacctgaaggagctcagggaaagggtgcttcgtggtaagtacagggtgccattttacatgagcaccgactgcgagtctatcctgaggaggtttctggtgctcaatcctgccaagaggtgcacactggagcagattatgaaggataaatggataaacatagggtacgaaggggaagagctgaaaccttacaccgagccagaggaagattttggagataccaaacgaatagaggtgatggttggaatgggttatacacgcgaagagatcaaagagtccctgacaagtcagaagtacaacgaggtgaccgctacttatctcctcctgggacgaaaaactgaagagggtggtgacagaggggcccctggcctagcgctggctcgggtcagggctccaagcgacacaaccaacggcacttctagcagtaaggggacatcccatagcaaaggccagagaagctcctctagtacctatcaccgtcagagacggcattctgatttctgcggcccatcccctgcgcctctccatcctaaaaggagccccaccagtaccggcgaagctgagcttaaggaggaacgtctcccggggcggaaggctagctgctcaaccgccgggtccggttcaaggggactccccccttcttctccaatggtgtcctcagcacataacccaaacaaagcagagatccccgagcgccgaaaagactctaccagtacgcctaataatttaccaccttctatgatgacaaggagaaacacttacgtatgcactgaacgcccaggagcagaaagaccctctttattacctaatggtaaggagaattcaagcggcacaccccgtgtgcccccggctagcccttcatcacacagcctggcccctcctagtggagaacgatcccgactagccaggggctctaccatccgctctactttccatggtgggcaggtgagggacaggcgggccgggggcggtgggggcggtggggtccagaatggccctccagcttctccgacgcttgcccacgaggcagctccactcccggccgggcgccctagacctaccaccaacctgttcaccaagcttacctccaaactgacacggcgcgtggcggatgaaccagaacgcatcggcggcccagaagttacctcatgccacctcccttgggatcagacagagactgctccccggctactcagattcccatggagcgtgaaactgacaagttccagaccccctgaagctttaatggctgctctccgtcaggctacggcggccgctagatgtaggtgtcggcagccacagcctttcctgctggcatgcctgcatggcggtgcagggggtcccgaaccactgagccatttcgaagttgaagtctgccagctgccacggccggggctgagaggcgtactgttccgaagagtagccggaacagcgttggctttccgtactctggtgactaggattagcaatgacttggaactatag

SEQ ID NO: 123425 - DNA, 1389 bp, Artificial Sequence
  Description of Artificial Sequence: Synthetic coding sequence
atgagttctcggactgtgttggcccccggcaatgacagaaactctgacacccacggcacacttggctctgggaggtccagcgataaaggcccaagctggtcatcccggtccctcggtgccagatgccgcaactccatcgccagttgtcccgaagaacaaccacatgttggaaactatcggttgctgcgtaccatcgggaagggaaactttgctaaggtcaaattggccaggcatatcctgacggggcgggaggtggccatcaagattatagacaagacgcagctcaacccctcgtctctgcaaaagctgttccgggaggtgaggattatgaagggcttgaaccatcctaacattgtgaagctttttgaagtcatcgagactgagaagaccctgtacctggttatggagtacgcatcggctggcgaacctccaactttgagcgctctccctctttgtcaccttccacttcccctccacttgactcttacccctctagggttgtgtcccgccggggaagtatttgattatctggtgtctcacggtagaatgaaagagaaggaagcacgagctaagttcaggcagatcgtatcagctgtgcactactgccatcagaagaacatagtgcacagagacctgaaggctgaaaatctccttctggatgccgaagccaatattaaaatcgccgatttcggatttagcaacgaatttactctgggttctaaactggatactttctgtggaagcccaccttacgcggcccccgaactcttccagggaaagaaatacgacggtccagaagtagacatctggtccttgggagtgattctctacacactcgtgtcagggagtctgcctttcgacggccataacctgaaggaactcagagagcgtgtgctgcgcggaaagtatcgcgtgcctttttacatgagcaccgattgcgagtcaattctgcggaggttcctggttctgaatcctgccaaacgttgcaccctcgagcaaattatgaaggataagtggataaacatcggttacgagggggaagagcttaaaccttatactgagccggaagaggattttggcgacacaaaacggatcgaggtcatggtggggatggggtatacccgggaggaaatcaaagagagcctcacctcccagaagtataatgaagttaccgccacttaccttctgcttggtagaaaaactgagccagacgaacacggagggggcggggctgaaggaggagctgccgcaaggcccgagggagagttgcaacatagaggcgagtgggaatccagagcagctcccttacaaccgcatggacaacagcggccacaacctcagcaaggtcgcgacccacgcgcagcggaaggccaacacgaacatccatag

SEQ ID NO: 123426 - DNA, 2067 bp, Artificial Sequence
  Description of Artificial Sequence: Synthetic coding sequence
atgagctcccgaaccgtcttagccccaggtaacgatcggaatagcgacacccacgggactctggggtcgggccgctctagtgataaaggtccgagctggtcctcaagatccctcggagcccggtgcagaaactccatagccagctgccccgaggagcagcctcacgtagggaattatcgactgctgaggactattgggaaaggcaattttgcgaaagtcaaactcgcaagacatatattgaccggcagagaagtggcaattaaaattatcgataaaacccagctgaatccatcatcgttgcagaagcttttccgtgaggtcagaatcatgaaaggacttaatcacccaaacattgtgaaactgttcgaggttatagaaacagaaaaaacactgtacctcgtcatggagtacgccagcgctggggaggtgttcgactacttagtgtcacacgggcgtatgaaagagaaagaagcgagggccaaattccgccagatagtctccgccgttcactattgccaccaaaagaacatcgtccatagggatctaaaagcggagaatctgctgttagatgccgaggccaatataaagatcgccgactttggatttagcaacgaatttaccttgggtagcaagcttgacaccttctgcggatctccgccatatgctgcacctgagttattccaaggaaagaaatatgacggtccggaagtcgacatctggtccctcggagtgatcctttacacactggtgtctgggagcttaccatttgacggccataacttgaaggaactcagggagcgcgttctgcggggaaaataccgtgttcccttctacatgtccacggactgcgagtctatcctgcgtcgcttcctagtgctcaatcctgctaagaggtgcacactcgagcagattatgaaggataagtggattaatatcgggtatgaaggcgaagaactcaaaccctatactgagccggaagaggattttggagatactaagcggatcgaagtcatggtaggaatggggtataccagggaggagattaaagagagtttaaccagccagaagtataatgaggtcaccgccacatacctcctgctgggtagaaagaccgaagaagggggggaccgtggagcacctggactggcactggccagggtccgcgcaccgtcagacacaaccaacggcacctcatccagtaaaggcacatcacacagcaaggggcagcgcagctccagttccacttatcataggcagcggcggcatagcgacttctgcggacccagcccagctccgctccatcctaagagatcacccacctctactggcgaagcggaactgaaggaggaaaggctgccaggtcgcaaagcaagctgtagtactgctgggtctggctctcgtggactccctcccagctctcccatggtctcatctgcgcataatcctaacaaggctgaaatcccagaacggaggaaagattcgacgtcaactccgaacaaccttccaccctccatgatgaccaggcggaatacttatgtctgcacagagaggccaggagccgagagacctagtctgcttccaaacgggaaggagaattcatccggtactcccagggtgcctcccgcttccccctctagccactcactagctccaccttccggggaacgctctagactggcgagaggctcaactatcagatcaacattccacggcgggcaggtcagagatagacgggccgggggcggtggaggtggaggcgtgcagaatgggcctccagctagccctacccttgcacacgaggcagctcccctgcccgccggcaggccccgacccactaccaacctatttactaaattgacctctaagttaacacgcagagttactttagatccaagtaagaggcaaaacagtaatcgctgcgtgagcggcgcgagcctaccccagggctccaagataaggagccagacaaatctccgtgagtctggcgacctgaggagtcaagtggcgatttaccttggaattaagcgaaagcctcctcccggatgttctgacagtccaggtgtctag

SEQ ID NO: 123427 - DNA, 240 bp, Artificial Sequence
  Description of Artificial Sequence: Synthetic coding sequence
atggctgcgctgcgccaggccaccgcagccgctagatgccgttgtcgtcagccccagccctttttacttgcatgtttacacggaggtgctggagggcccgagcctctctcacattttgaggtggaggtgtgccaacttccccggccaggcctgagaggagttctttttcgcagggtcgccggcaccgcattggcattcaggaccctcgtgacgcgcatctcaaacgacctcgagctatag

SEQ ID NO: 123428 - DNA, 1032 bp, Artificial Sequence
  Description of Artificial Sequence: Synthetic coding sequence
atggccgcggctacagagcttaatcgaccatcaagcggagacagaaaccttgagcgtaggtgtaggccaaacctgtctcgagaagtgctatatgagattttccggtcccttcacactctggttggacaacttgatttaagggacgacgtcgtgaaaataacaatcgattggaacaaactccagtctctcagtgcttttcagccggcgctgctattttcagccctggaacagcatatcctgtacctccagccttttctggccaaattgcagagccctatcaaagaggagaacacgacagctgtggaagaaataggaagaacggagatgggtaataaaaatgaggtaaacgacaaatttagcatcggagatctccaggaagaggagaaacacaaggagtccgatttacgggacgtaaaaaagacacagatccattttgaccccgaggtggtacagataaaggctggtaaagccgaaatcgatagacgaatctcggcattcattgagagaaagcaggcagagatcaacgagaacaacgtgcgcgagttctgcaatgtaatcgactgtaatcaagaaaactcttgtgcccggactgacgcaatattcaccccttatcctggtttcaagtcacacgtgaaagtgagcagagtggtaaacacctacgggccacaaactcgtcctgaggggatacccggttctggacacaaacctaactccatgttgcgagactgcgggaatcaggcagtggaagagagactgcaaaatatcgaagctcacttgcgtttacagacaggaggcccagtaccccgtgatatataccaaagaattaagaagctagaggacaaaatcctggagctcgaagggataagtcccgaatatttccagagcgtgtcgttcagtgggaagcggaggaaggtgcaacctccacagaattactccctggccgagctcgatgagaagatttctgctctgaagcaagccctcctaagaaaaagtcgtgaagctgagtccatggccacacatcatctcccctag

SEQ ID NO: 123429 - DNA, 1035 bp, Artificial Sequence
  Description of Artificial Sequence: Synthetic coding sequence
atggctgctgcgactgagctcaatcgaccctcaagtggagacagaaaccttgagaggaggtgccgtcctaacctgagcagggaggtgctgtatgagatcttccggtctctccacacgctggtgggtcagctcgatcttagggacgacgtggttaaaatcaccattgattggaacaagttacagagtttgtccgccttccaacccgcacttctcttttccgccctggagcaacacattttgtacctacagcccttccttgcaaagctgcagtcccctatcaaggaggaaaatacaaccgccgtggaggagatcggacggacagaaatgggaaataaaaatgaggtgaatgacaaattctctattggagacctgcaagaggaggagaaacataaagagtccgacctgagagatgtcaagaagacccagatccacttcgacccagaggtggtgcagattaaggcagggaaagctgagattgaccgtcggataagcgcattcatcgaaaggaagcaggccgaaatcaacgagaataacgtgagagagttttgcaacgtcatcgattgcaaccaggagaattcttgtgctcggactgatgctatcttcactccttatcccggattcaaaagccacgtcaaggtaagccgagtggtcaatacatacggcccccagaccagaccagaaggcatacccggctctgggcacaaaccaaatagcatgttgagggactgcggtaaccaggcagtagaggaaagactccagaatatcgaggctcacttgcgattgcagaccggagggcccgtgcctcgcgacatctatcagaggattaagaaattagaagataaaatcctggaactagaaggcatttctccggagtacttccagagtgtatctttttctggaaagaggcggaaagtacagccacctcagcagaactacagtctggccgaattagatgagaaaattagtgccttaaagcaagccctgttaaggaaatcgcgggaggcagaatctatggcaacccatcatctcccctag

SEQ ID NO: 123430 - DNA, 4944 bp, Artificial Sequence
  Description of Artificial Sequence: Synthetic coding sequence
atggtccaaaagaagaagttctgtccgagattgctggactatctcgtgatcgtgggagcccgccatccaagcagtgactccgtggcccagacaccagaactgctgcgccgttatccgcttgaagatcatactgagttccctctccctcccgacgtggtgttcttttgtcaacccgagggatgtctctccgttcggcagcggagaatgagtctgcgcgatgataccagctttgtctttaccctcacggacaaggatacaggcgtaacccgctatggcatctgcgtgaatttctaccgctccttccagaaaaggatctcaaaagagaaaggagaggggggagctggcagccggggcaaagaaggtacacatgctacttgtgcgtccgaagagggaggcactgagtctagtgagtcagggagcagcctgcagcctctgtccgctgatagtactcctgatgttaaccagtctccccgggggaaacgaagggctaaagccggcagtcgcagtcggaacagcacattaacctccctgtgtgtcctgtctcactacccgttcttctcaacattcagagagtgtttgtacacattgaaacggcttgtggactgctgctcagagaggctgctgggaaaaaaactggggattccacggggcgtccaacgggacactatgtggagaatattcacaggctcccttcttgtcgaagaaaagtcgtcagctctgctccatgatctccgagagatcgaagcttggatttacagactgttacgtagtccagtgcctgtgtctggccagaaacgggtggacatcgaagtcctgccccaggagcttcagcccgccttgacatttgctctaccagatccaagcaggtttacactggtcgatttccctttacacttgccccttgaattactgggagtcgacgcgtgcctgcaggtcctgacttgcattctcttggaacataaagttgtgctccagtcacgggattacaacgccttgtccatgtccgtgatggccttcgtggcaatgatatatccactggagtacatgtttccggtgatcccattattaccaacctgcatggcctctgcggagcagcttctactagccccgaccccttatatcataggagttcctgctagcttttttctgtataaactggattttaagatgcctgatgatgtgtggttggtcgaccttgattcaaatagagtaattgctcctaccaatgctgaggtgctgccaatcttgcccgaacctgaatcattagagctaaaaaagcatctgaaacaggccttggctagtatgtctttgaatactcagccaatcttaaatctcgaaaaatttcacgagggtcaggaaattccacttctgctgggacgtccgagcaatgatctccagagtacaccctcaactgagttcaatccgctgatatatggaaacgacgtggactcagtcgatgtcgcaactagagttgcaatggtccgctttttcaactccgcgaatgtcttacaggggtttcaaatgcacacaaggacactgaggctcttccccagacctgtggtagctttccaggccgggtcattcttggccagccgacctagacagacaccttttgccgagaaactggctagaacacaagcggtggaatactttggtgagtggatcctgaaccctacgaattacgccttccagcgcatacataacaacatgtttgatcccgccctaattggggataaacccaaatggtatgcacatcagctgcaacctatccactaccgggtgtacgacagcaatagccagctcgcagaagctttaagcgtgccacctgagcgagatagtgactcagagcctacagatgatagcggaagcgactccatggactatgatgattcctcgtcaagttacagcagcctgggcgatttcgtgtccgagatgatgaagtgtgatattaacggcgacacgcctaacgttgatccgttaactcatgcggctttgggcgatgcctctgaggttgaaatcgatgaactacaaaaccagaaagaggccgaggagcctgggccagattccgagaacagccaggaaaatccacccctgcgaagcagtagtagcactacagcctcaagctctccaagcaccgtgatccacggggcaaatagtgaacccgcagactccacagaaatggatgataaggccgccgtaggggtgtctaaacccctcccatcggtgcctccatccataggtaagagcaacgttgatcgtcgccaggccgaaatcggggaagggtctgtgcgacggaggatctatgataatccttattttgagccacaatatggatttccgcccgaggaagatgaggatgagcagggcgaatcatatacacccagattttcccaacacgtgtctggcaaccgggctcagaaacttctcagaccgaattcgctgcgtctggcatccgatagtgacgccgagtccgactctcgggcctcatcccccaactcgacagtaagcaatactagcaccgagggcttcggtggcatcatgagctttgccagcagcctctacagaaaccactccacgagcttcagcctctcaaatctgactcttcccacgaagggggcacgagaaaaagccacccccttcccaagcctgaaggttttcggcctgaacacccttatggaaatcgtgaccgaagctggccccggatcaggagagggaaataggcgcgccttggttgaccagaagtcttcagtgattaagcacagtccgaccgttaaacgtgagccccccagcccacagggtaggagttctaactcgtccgagaatcagcagttcctcaaggaagtcgtacactccgtgctggacgggcaaggggtgggatggttaaacatgaagaaggtgcggaggttgttggagtcagagcaactgagggtctttgtgctgtcaaaactcaatcgcatggtccaaagtgaagacgacgcccgtcaggatattatccctgacgtggagatttctcgcaaagtttacaagggtatgctcgacctgcttaaatgtaccgtgctttccctggagcagtcctatgcccatgccggcctcggcgggatggcgtctattttcggcctgctcgaaatcgcccagacccactattattccaaagagccggataaaagaaagcgtagtcctaccgaaagcgttaatactcctgtaggcaaggatcctgggcttgcgggtagaggggatcctaaagccatggcgcaactgcgggtccctcaactgggccctcgtgcgcctagcgccacgggcaaaggtcccaaggagctagacacaaggtccttgaaggaagaaaactttatagcctcaattgagctgtggaacaaacatcaagaggtgaagaagcagaaggcgctcgagaaacaacggcccgaggtaattaagccggtgttcgacctgggggagaccgaagagaaaaagagccagataagtgcagattctggagtcagtctcacgagcagttctcagcgtactgaccaagactcggttattggcgtcagccccgctgttatgattcggtcatccagccaggactccgaagtctctactgtggtttcaaattccagtggggagactctgggcgctgactcagacctgagcagtaacgctggcgatgggccgggaggggagggttcagtgcatctggcctcgagtagggggaccctttcagactccgagatcgagacaaattccgctactagcacaattttcggaaaggctcactcgctgaagccaagcattaaggagaagctcgccggatcaccaattagaacatcggaggacgtttcccagagggtgtacctttacgagggtcttcttggaagagataagggatcaatgtgggaccagctggaagacgctgccatggagacctttagcatttctaaggaacgaagcactctctgggaccagatgcaattctgggaggacgcctttctggacgcagtgatgctggaacgcgaggggatgggcatggaccaggggccacaggagatgatagatagatatctgtccctgggggaacacgaccggaagaggctcgaggatgacgaagaccgccttctggcgacactgctccacaatctgatcagctatatgctgctgatgaaggtgaataaaaacgatattagaaaaaaagtgagacgtctcatgggcaagagccacatcggactcgtctactcgcagcagattaatgaggtcctggatcagcttgcaaacctgaacgggcgcgatttgtctatctggtctagtggctccagacacatgaaaaaacaaacgttcgtggtccacgcgggcacggataccaacggggacatattcttcatggaagtgtgtgacgattgtgtggtacttcgctctaacatcggcaccgtgtacgaaaggtggtggtacgaaaaactgatcaacatgacctattgtcctaagacaaaagtgctttgcctttggagaaggaatgggagcgagacccagctcaataagttctatacgaagaagtgccgtgagctatactactgtgttaaagattctatggaacgcgcggcggctaggcagcagtcgattaagccgggcccagaactcggaggcgagttccctgtgcaggatttaaagaccggagagggcggactgctgcaggtaacgctggagggcatcaacctgaagttcatgcacaaccaagtgttcatcgagctgaaccacataaagaagtgcaatactgtcagaggtgtgtttgtgcttgaggaattcgtccctgagattaaagaggtcgttagccataagtacaagacccccatggcacatgagatttgttatagtgtgctctgtttattttcttacgttgccgctgtgcatagctccgaggaggacctcaggacaccaccgaggccggtcagttcatag

SEQ ID NO: 123431 - DNA, 4767 bp, Artificial Sequence
  Description of Artificial Sequence: Synthetic coding sequence
atggtgcagaaaaaaaagttttgtcctcggctgctagactaccttgttatcgtcggagctcggcatcctagctcagacagcgtcgcccagacacccgaacttcttcgaaggtatccccttgaggaccatacggagttcccactgccgcccgacgtggtgtttttctgtcagccggagggatgccttagcgttagacaaagacgcatgtccctgagggatgataccagttttgtgtttacgctgacagataaagacaccggagttacccgatacggcatttgtgtcaacttctaccgttcatttcagaaaaggatctcaaaagaaaaaggggaggggggtgctggaagcagagggaaagagggcacacatgctacgtgtgcctcagaagaaggaggcacggagtcctcggaatcaggctcttcgcttcagcccttgagcgccgatagcactcctgatgtcaatcaatccccgagagggaaacgacgggcgaaggccggatcccggtcaagaaattccacccttacgagcctgtgtgtgctctcacactacccctttttctccacttttcgcgaatgcctgtatacgctcaagcggctggtggactgctgttctgagcgtctgctcggcaaaaagttaggtattcccaggggcgtccaacgcgatactatgtggcgcatttttacagggagcctgctcgtggaagagaagtcctcggcactgctgcacgatctccgagagattgaagcatggatctatcgcctgctccgctcacctgtccccgttagtggccagaaacgcgtagacatcgaagtgctcccccaggagctgcagcctgcgctgacattcgctctgcccgatccttcacggttcacactggtcgacttccctctgcacctcccactggagctactcggtgtggatgcttgtctacaggtcttgacctgcatcctgctggagcacaaggtggtccttcagagccgtgattacaacgcattgagtatgtcagttatggcgttcgtggcgatgatctacccattagagtatatgtttccagtgattccgctgttacctacctgcatggcatctgccgagcagctactcctcgcaccgaccccctacataattggggtgccagccagcttttttctctacaagcttgattttaaaatgcccgacgacgtctggctcgtggatttggactctaaccgagtgattgcccctactaacgctgaggttctgccgattctgccggagccagagtctctcgaactcaagaagcacctgaagcaggcattagctagcatgagtctgaatacccaaccaatcttaaacctcgagaagttccacgagggacaggaaatacccctcttgctgggacggccatctaatgatctacaatcaaccccttctacagaattcaatccgttaatctatggtaatgacgtggattctgtggatgtggccacacgggtagccatggtaaggtttttcaactctgctaatgtgctccagggatttcagatgcatacacgtactctgcgcctcttcccccgtcccgtggtggcttttcaggccggaagtttcctagcctctcggccccgtcagaccccatttgcggagaaactggcccgtactcaagccgttgagtactttggagagtggatcttaaatccaacaaactatgcctttcaacggatccataacaatatgttcgaccccgcccttatcggcgacaagccaaagtggtacgcccatcagttgcagcccatccactacagggtttatgattccaacagtcaactggctgaagcattaagtgttccgcccgagagagactcggattccgaaccgaccgatgactctggatcagacagtatggactatgacgattcgtcctcttcctactcatccctaggggatttcgtatccgagatgatgaaatgtgacatcaacggagacacgccgaatgtggacccgcttactcatgctgctctgggcgatgcgtccgaggtagaaatcgatgaactccagaaccagaaggaagcagaggagcctggaccagattccgagaactctcaggaaaaccccccactccggagcagcagtagtacaacggcctccagctctccgtcaacggtcattcacggggccaattcagagcctgcggacagcacggagatggacgacaaggctgccgtgggagtgtcgaaacccctcccttcggtccccccttcgattggcaagagcaacgtggaccgccgccaggccgaaataggcgaggggtcagtgcggcgccggatctacgacaatccctatttcgaaccacaatacgggtttcctcctgaggaggatgaggatgaacagggtgaatcctacactcccaggttttcacaacacgtgagcggcaaccgggctcaaaagctgctaagaccgaacagtcttagattagcttccgactctgacgcggagagtgatagtagagcatcctcccctaattccaccgtgagcaatactagcacagagggtttcggcggaattatgtccttcgcttccagcctgtacaggaaccatagcacctccttttctttatcaaatctcaccttgccaactaagggggctagagagaaagctacacccttcccctccctgaaggggaatcgtcgggccttggttgaccagaaatcaagtgtgataaaacattcaccaaccgtgaaacgggagcctccaagcccccagggacggagctccaattccagcgagaaccagcagttcctgaaggaagtcgtgcatagcgttctggatggacagggagtgggctggcttaatatgaagaaggtacgacggcttcttgaaagtgagcaactgagagtgtttgtattatcaaagctgaatcgcatggtgcagtcggaggacgacgcccggcaagatattatacctgatgtcgagatcagtcggaaagtgtataaaggcatgctggacctgctaaaatgcactgtactgtcacttgagcagagctatgcgcatgctggcttgggagggatggccagcatttttggacttctggagatcgcccaaacgcattactacagcaaggaaccagacaagcgcaagcgtagccctaccgagtctgtcaacacgcccgttggaaaagaccccggattggccgggcggggtgaccctaaggcaatggcacagctgcgggtaccacagctcgggccgagggccccgtcagctactgggaaaggtcccaaggaacttgacactcggtccttgaaagaggaaaattttatcgcttccataggtccggaggtgatcaagccagtgtttgatctcggtgagactgaggagaagaaaagtcagatctctgctgattcaggagtctccctgacttcttcctcacagcgcaccgatcaggacagtgtcatcggcgtgagtccagctgttatgatccgttcaagcagtcaggacagcgaagtgagtacagtcgtcagtaatagcagcggggaaaccctcggggctgactctgacctgtcttcaaacgcgggcgacggccccggtggggaaggcagtgtccatcttgcttcaagccggggtacattaagtgacagtgagatcgagacgaattctgcaacctctactattttcggcaaagcccactcacttaaaccatcgataaaagagaaattagcaggctcccccatccgtacctccgaggatgtctcacagcgggtatacctgtacgagggtctgctgggaaaggagcgcagcaccctttgggaccagatgcagttctgggaggatgcgtttctggacgccgttatgttggaacgcgagggaatgggcatggaccagggacctcaagaaatgattgacagatacctgtctctcggagagcatgatcgcaaaaggctcgaagacgacgaggatcgcctcctagccactctcctgcacaatttaatttcttatatgctgctgatgaaagtcaataagaatgacatccgcaaaaaagttcgtaggttaatgggtaaaagtcacataggactagtctatagtcagcagatcaacgaggtcctcgaccaactggctaacttaaacgggagggatttaagcatatggagctctgggagccgtcatatgaagaaacagacattcgtagtgcacgctgggacagataccaatggtgacatctttttcatggaagtgtgcgacgactgtgtggtcttgagaagcaatattgggactgtctatgaacgttggtggtatgagaaacttatcaatatgacctattgcccaaagacaaaagtcttatgtctttggcggcgcaatgggagcgagacacagctaaataagttctatactaagaaatgtagagagctgtactactgcgtgaaggactctatggagagggcggctgcccgacagcagagcatcaaacccggtcctgagctcggcggggagtttcccgtgcaagacctgaagacaggagaaggcggactcctacaagttacattggaggggattaatctgaagtttatgcacaatcaggtgtttatcgagctcaaccacattaagaaatgcaatacggtccgcggcgtatttgtgctggaggagttcgtccctgaaatcaaggaagtcgtgtctcacaaatacaagacccccatggcccacgagatatgctacagcgtgctgtgtctcttttcctacgtggcagccgtacatagctctgaagaggacctgagaacgcctcccaggccggtgtcttcgtag

SEQ ID NO: 123432 - DNA, 4827 bp, Artificial Sequence
  Description of Artificial Sequence: Synthetic coding sequence
atggttcaaaagaagaaattctgcccaaggctgctcgattacttagtgattgtgggtgcccgtcatccttctagcgattcggttgcccagacaccagagctgttaagacgctatccccttgaggaccacaccgaattccctctgccgcctgacgtcgtctttttctgccagcccgaaggttgtctgagtgtccgccagaggaggatgtcgctgcgcgatgacacatctttcgtgttcacactgacagacaaagatacaggcgtgacaagatacgggatttgtgtcaatttctaccgcagtttccagaaacgcattagtaaggaaaagggagagggaggtgccggaagcaggggtaaagagggaactcatgcaacgtgcgctagtgaagagggaggcaccgagtcttcggagtctggcagctcactgcaacccctgagtgccgattccactcctgatgtaaaccagtcgccccgaggcaaaaggcgtgcaaaggcagggtctcgcagccgcaatagtaccctaaccagcctctgtgttttgtctcactatcccttcttcagcacctttagggagtgcctgtacaccctaaagcgactggtggactgctgctccgagcgactccttggtaaaaagctcgggataccccgcggtgttcaacgcgacaccatgtggcggattttcaccggcagtctgttggtcgaggagaagtcgagtgccctgctgcacgatcttcgggaaatcgaggcatggatctaccggctcttacggagccccgtgcccgtgtcagggcagaaaagggttgacatcgaagttctgccacaagagctgcagcctgctctgacctttgctttgccagatcctagcaggttcacgctcgttgattttcccctgcatctgcctttggagcttctgggcgtggacgcctgccttcaggtgctgacttgtattctcctagagcataaggttgttctccaatcacgcgactataatgccttgagcatgtccgtgatggctttcgtggcaatgatttaccccctggagtacatgttcccggtgatcccacttctgccgacgtgcatggccagcgccgaacaactgctgctggcccccaccccctacattattggggtccccgctagcttcttcctgtataagctcgatttcaagatgccagacgatgtgtggctggtggacctcgattcaaatcgggtgattgcccccacaaacgctgaagtgttgccaatcctgccagagcctgagagcctggaactcaaaaaacacttgaaacaggctctggcgtctatgtcacttaatactcagccaatactcaatttggagaagttccacgaaggccaagagattccattactcttgggccgcccgagcaacgatctccagtctaccccttcaacagaatttaacccgctcatctacggtaatgacgttgacagcgtagatgtggccacacgtgtagctatggtgcggttttttaactccgctaacgtgctgcaaggcttccagatgcacactagaactttaaggctgttcccgcgccccgtggtcgcattccaagcgggcagttttttggcctcccgcccgcggcagactccttttgcagagaagctggctaggactcaggccgtagagtattttggggagtggattttgaatcctaccaactacgctttccagaggatccacaataacatgtttgacccggctctcatcggagacaagccaaaatggtatgcccaccagctgcaaccaatccattacagagtgtacgatagcaactcccagctcgccgaagctttatcggtccctcctgagagagattccgacagtgaacccaccgatgattctgggtctgattccatggactacgatgactcctcatcgagttactccagtctcggggactttgtcagcgaaatgatgaaatgcgacatcaacggtgacacgccaaatgtggaccccctgactcacgctgcactcggagatgctagcgaggtggaaattgatgaactccagaatcagaaagaagccgaagaacctgggccggacagcgaaaacagtcaagagaacccacctctgcggtcttccagttctactacagcttcatctagccccagcacggtgatccacggcgcaaacagtgaacctgcagactctacagaaatggacgacaaagccgcggtaggtgtctcaaaacccttgccttccgtgcccccctccatcgggaaatccaatgtggatcgcaggcaggctgagatcggtgaggggtcagtgaggcgcagaatctacgataacccatattttgagccccagtatggattcccaccagaggaagacgaagacgaacagggggaaagctatactccacgattcagccagcatgtgagtgggaacagagcccagaaattgctaagacctaactccttgaggctggcatcagacagcgacgctgaatcagatagccgggctagcagtcccaacagtacagtgagtaacaccagtacggaaggcttcgggggaattatgtcattcgctagctcactgtatcgcaaccatagtacttctttcagcttgagtaatctgaccctgccaactaagggagcaagggagaaggccaccccatttcccagcctgaaagtctttggactgaatacacttatggagattgtcacagaagcgggccctggttcaggcgaaggaaaccggagagctctggtggaccagaaaagctccgtcattaagcactctccaaccgtgaagcgcgagcccccatctccacagggaagaagctcaaattcctccgaaaaccagcagttccttaaagaggtggtacatagcgtgctcgacggccagggggtaggctggctcaacatgaaaaaagtgcgacgcctgctcgaatcagagcagttgagggtatttgttttaagcaaactcaacaggatggtgcaatccgaggatgatgcaaggcaggatataattcccgacgttgagatatcccgcaaggtgtacaaggggatgctcgacctcctgaaatgcacagtgctgtctctggaacagagctacgcccacgcagggctaggtggtatggcgtcaatcttcggcctgctcgaaattgcccagactcactattactcaaaggaaccagacaaacggaagagatctcctaccgaatcagtcaatacgccagtgggcaaggaccccggactggccggaaggggcgatcccaaggctatggctcagcttcgcgttccccagctgggtcctagagccccatctgcgacagggaaggggccgaaagaactggatactcgaagtctcaaggaggagaactttatcgcatctattgggcccgaggtcatcaaaccagtgtttgacctaggtgagaccgaagaaaagaaaagccagattagcgccgactcgggcgtcagcctgacatctagcagccagaggaccgatcaggacagtgtgattggtgtctcacccgccgttatgattagaagcagcagccaggactctgaggtgtcaaccgtggtatcaaacagctccggtgaaactttaggggctgactctgacctgtctagcaatgcaggtgacggcccaggaggtgaaggatcggtgcatctggctagttctaggggcacactgagcgattcagagatagaaaccaactcagctacgagcaccatcttcggcaaggcccattcattgaagccctctatcaaagagaaactagcagggtctcccatccgaaccagcgaagacgtgtcacagcgtgtatacttatatgaggggttactgggcaaggagcggagcacgctgtgggatcagatgcagttctgggaggacgccttcctagacgcagtgatgctggagcgggagggcatggggatggatcaagggccccaggagatgatcgaccggtatcttagcttgggagagcacgaccgtaaaaggttggaggatgacgaagacaggctgctggccactcttcttcataatctgatcagctacatgcttctgatgaaggtcaataaaaatgacattaggaagaaagtgagacggctcatgggtaagtctcacatcggactggtctatagccagcagattaatgaagtgctggatcagcttgctaacctcaatgggcgggaccttagtatttggagctcagggagccggcacatgaagaaacagacatttgtggtccacgccggtactgataccaatggcgacatcttttttatggaggtttgcgacgactgtgttgtcctgcggtcgaacatcgggactgtctatgaaagatggtggtacgagaaacttatcaacatgacttattgccctaagactaaagtattgtgcctgtggaggagaaatggtagtgagacacagctcaataagttttatactaagaaatgtagggaactctattactgtgtgaaagactctatggagcgggctgctgcaagacaacagagcatcaaacccggccctgaactagggggagaatttcccgttcaagatcttaagacgggcgagggagggctcttacaggtcactctggaaggcattaacttgaagtttatgcacaatcaggttttcatcgagctcaaccacattaagaagtgcaacaccgtccgcggagtgtttgtgctagaggagtttgtgcctgagataaaggaggtagtgtcccacaaatataagactcccatggcgcatgagatctgttattctgtcctgtgcctctttagctatgtggcggccgtacattcctctgaagaggatctgagaacccctccaaggcctgtatcgagttag

SEQ ID NO: 123433 - DNA, 4746 bp, Artificial Sequence
  Description of Artificial Sequence: Synthetic coding sequence
atggtgcaaaagaagaaattctgtccaaggctccttgattatcttgtcatcgtaggagccagacatccaagctcagacagcgtcgcacaaactccagaactgctgcgacgctatccactcgaggaccacaccgagtttccacttcctcccgatgtggtgtttttttgtcagccggaggggtgccttagcgttcgccagcggaggatgtctcttcgagatgatacctcctttgtctttaccctgacggataaagatactggagtgacgcggtatggcatctgcgtaaacttctacaggagctttcagaaaagaatctcaaaagagaagggcgaaggtggcgccggctctaggggaaaggaaggaactcatgcaacctgcgcctccgaggaagggggcactgagtcctcagaatcaggatcctcgttgcagcctctgtccgcagacagcacgccagacgtgaaccagagtccccgggggaaacgccgagccaaagctgggagtagaagcaggaatagcaccctgactagcctttgtgtgttatcccactatcctttctttagcacctttcgggagtgcctgtacactttgaagcggttggtggactgttgctctgagcggctgctggggaagaaattaggcattccacggggcgttcagcgcgataccatgtggcgcattttcacaggctccctgttagtagaggagaagtccagcgctctactgcacgatcttcgcgagatcgaggcatggatctatagactgcttaggtcccccgtacccgtgagcggtcagaagcgcgttgatatagaagtgttgccccaggaactacaacccgccctgacttttgccttacccgatccgtctcggttcacactcgttgattttcctctgcacctgccactcgaacttctgggagttgatgcatgtctgcaggtcctgacatgcatcctgttagagcacaaggtcgtgcttcagtcaagagactacaacgcgctttcgatgtccgtgatggcctttgtggcgatgatttaccccctggagtacatgtttcctgtgatccccttgctaccaacttgtatggcctccgctgagcagctcctgctggcccctaccccgtacatcatcggggtccccgcgtcattctttctctataaactcgacttcaagatgcctgatgacgtgtggttagtggaccttgatagcaaccgtgtcatagctcctacgaacgcagaggtgcttcctattttaccggaacctgagtcactggagttgaaaaaacaccttaaacaggcgttagcctcgatgtcgctgaatactcagcctattctgaacttggaaaagttccacgaaggccaagaaatccctctcctgctggggagacccagtaacgacttgcagagtacaccttctaccgaatttaatcccttgatctacgggaacgacgtggacagtgtggatgtggctactagggtggctatggtgcggtttttcaatagcgccaatgtcctccagggattccaaatgcatactcgcaccctccgcttgtttccccggccggtggtggcttttcaggctggctcctttctggcaagcagaccacgtcagacgcccttcgctgaaaaactagcccgcacacaggccgtggaatactttggggagtggatccttaatcccactaattatgccttccagcgtattcataacaacatgttcgatcctgcattgatcggggacaagcccaaatggtacgcacaccaactgcagccgatccactaccgcgtgtacgattctaactcacagctcgcggaggccctgagcgtgccccccgagcgcgatagtgatagtgaaccgacagacgactccggctcggatagcatggactacgacgacagtagttcctcatactcaagtctgggcgatttcgtaagtgaaatgatgaaatgcgatatcaatggagatacaccaaatgttgacccactgactcacgctgccctcggggacgcgtccgaggtggagatcgatgaattgcaaaatcagaaagaagctgaagagccgggccccgactccgaaaatagtcaggagaacccccccttaaggtcatctagttcaacaactgccagtagttccccatctacagtgatccatggcgccaactccgagcctgcagactccactgaaatggatgacaaggccgctgtcggtgtgtcgaagcccctgccctccgttccaccgagcataggaaagtctaacgtcgatagacggcaggcagagataggggaagggagtgtgcgacgcagaatatacgataacccttactttgaacctcagtacggttttcccccagaagaggatgaagatgaacagggagagagttacacaccacgcttctctcaacacgttagcggcaatagggcccagaagcttctgaggccaaactcactcagactcgcctctgactcagatgccgaaagcgattcacgagccagcagcccaaacagtaccgtgtccaacactagtaccgaaggatttggtgggataatgagttttgcatctagcctgtacagaaaccactcaacaagcttttcactctccaatttaacactaccaaccaagggggcccgcgaaaaggcaacacccttcccatccctaaaggtgtttggccttaacacgttgatggaaattgtaacagaagccggcccaggctctggcgagggcaatagacgagctctagtggatcaaaaatcttctgtgatcaagcacagtcccactgttaaaagagaaccgccttcaccacagggacggagttctaattcctccgaaaaccagcagttcctcaaagaagtggtccacagtgttctggacggccagggggtaggttggctgaacatgaaaaaggtgaggcgcttactggagtctgagcagctgcgagtattcgtcctctctaaactcaaccggatggtgcaaagcgaagacgatgccaggcaggatattatacccgatgtggaaatctctagaaaagtatataaaggaatgttggacctgctcaagtgtacagttctgagcctagaacagagttatgctcatgctggtctgggcggcatggccagcattttcggcctgctggagatcgcccagacacattattacagcaaagaaccagacaagcgaaaaaggtcgcctacagaatccgtgaatactccagtgggcaaggaccccgggctcgccggtcgcggcgatcccaaggcgatggcacagctgcgcgtcccacagctgggccccagagcaccaagcgccactgggaagggcccaaaggaacttgatacgagatccctcaaagaagagaatttcattgcttctatagaactatggaacaaacatcaggaagtgaaaaaacagaaagcactggagaagcagcggccggaggtaattaagccagtgtttgatctaggcgaaactgaagagaagaaatctcagatcagtgccgacagcggagtgagtctcacctcttcatcacagcgaacagatcaggactcagtgattggagtgagtcctgctgtcatgattcgttcctcctctcaggatagtgaggtgtccactgtggtcagcaactcatccggagaaaccctgggagctgatagcgatcttagtagcaatgccggcgatggtcccggtggcgaaggctctgttcacttggcctcttcacggggcaccctctcagattccgaaatcgaaacgaatagtgctacaagcacaattttcggtaaggcccatagccttaaaccatcaatcaaggaaaaactggccggttctccaatacgtacatccgaggatgttagccaacgagtgtacttgtatgagggactcctaggacgagacaagggatccatgtgggatcagttggaggacgccgccatggagactttttctattagtaaagagcggtccacgctatgggatcaaatgcaattttgggaggatgcattcctggatgctgtgatgttagagcgcgagggcatgggaatggatcagggcccgcaggaaatgattgatcggtaccttagcctgggagaacatgatcggaaaaggctcgaagacgatgaggatcgattgctggcgactctcctccataaccttataagttacatgttgctcatgaaggtgaacaaaaatgatatcagaaaaaaggtccgtcgcctgatgggaaagagccacataggactcgtttacagccagcagattaacgaggtccttgatcagttagccaatctgaacgggcgagatctctcaatttggtctagtgggtcgcgccacatgaagaaacagacgttcgtagtccatgccggcactgataccaatggggatatattctttatggaagtgtgcgacgactgtgtcgtactgcgctctaacataggcacagtgtacgagcgctggtggtacgaaaaattaatcaacatgacatattgtccaaaaaccaaggtcctctgcctttggcgccgcaacggatcggagacccagctcaataagttctacaccaagaagtgccgggaactgtactattgtgtgaaagattccatggagagagctgcggctcgacaacagagtatcaagcctgggcctgagctggggggtgagttccccgttcaggatctcaagacaggggagggtgggcttctacaggttactcttgaaggcattaatttgaagttcatgcacaaccaatttcttaagctgaaaaaatggtag

SEQ ID NO: 123434 - DNA, 4440 bp, Artificial Sequence
  Description of Artificial Sequence: Synthetic coding sequence
atggtgcagaaaaagaaattttgccctaggcttttagactacctggttattgtcggtgccagacacccgagttccgactctgtggctcagactcccgagttactgcgaaggtaccccctggaagatcacaccgagttcccactgccacccgatgtagtctttttttgccagcctgaaggatgtctgagtgtgcggcagaggcgcatgtccctcagggatgacaccagctttgtcttcaccctgaccgacaaggacaccggggttaccaggtatgggatttgcgtgaatttctaccggtcattccagaagagaatttcaaaagaaaaaggtgaaggaggcgcaggatctagggggaaagaagggacacatgccacctgcgcctctgaggagggcgggacagagtcttcagaaagcggtagttccctccagcctttgtcagccgatagcacacccgacgtgaatcagtcaccccgcggtaagagacgcgcaaaggcgggctcccgcagcaggaacagcactcttaccagcctgtgtgtcctctctcactacccattcttctctacctttcgtgagtgtctgtacactctcaaacgcctggtggactgctgctccgagcgactgttggggaaaaaacttgggatcccaagaggtgtccaacgagacaccatgtggcgcatattcacaggatcactgctcgtagaggagaagtcgagtgcacttctgcacgacctgagggaaatcgaagcatggatatatagattgctaagatctcctgttccagtaagcggacagaaacgggttgacattgaagtgctgccccaggagctccagcccgccctgactttcgcactgcctgacccatctcggtttaccctcgtggattttccgctgcatttacccctggaactgttaggagttgacgcctgcttgcaggtgctgacttgcatcctattggagcataaggtggtcctccagtctcgggattataacgctctgagcatgagcgtgatggccttcgtagctatgatttaccccctggagtacatgtttccagtgatcccactcctgccaacatgcatggcgtcagccgaacagctgctgttggccccgactccctacattatcggcgtgcccgccagtttcttcttgtataagcttgactttaaaatgcccgacgacgtctggctcgtagatctcgactccaatcgcgtaatcgcccctacaaacgctgaagtgctaccaatcttgcccgaacctgaaagcctggaacttaaaaagcacttgaaacaggccctggctagtatgagccttaacacgcagccaatcctaaatctcgagaagttccacgagggacaggagattccactgctcctggggaggcccagcaatgatctccagtccacacctagcactgagttcaacccgttgatttacggaaatgacgtggactctgtggatgtggccacacgggtcgccatggtccggtttttcaattctgcaaatgtactacagggtttccagatgcacacacggaccctcaggctgttccccaggcccgtcgtagcattccaggccggatctttcttagcgtctcggcccagacagaccccattcgctgagaagctagcgaggacccaagcggtcgagtacttcggggagtggatactcaatcctacaaactacgcattccaaagaattcacaacaacatgttcgaccccgcacttatcggcgataagccaaaatggtacgcacatcaacttcagcctatccattatcgtgtctacgactctaacagccagctcgcggaggccctctcggtcccaccggaacgggacagtgattctgagcccactgacgatagcggctctgattcaatggattacgatgacagttcgtccagttactcctccctgggcgacttcgtgagtgagatgatgaaatgcgacatcaatggtgacactccaaatgttgatccgctgacccatgcggctctgggcgatgcttcagaggtggagatcgatgaactgcaaaatcagaaggaggcagaagagcccggaccagattcagagaatagccaagagaatcctccattgcgtagcagcagttccaccacagcctcttccagcccaagcaccgttattcacggcgctaatagcgaacccgccgacagcaccgaaatggatgacaaggcagctgtgggtgtgtctaaacccttaccttcagtcccaccaagtatcggtaagagcaacgttgaccgcagacaggctgaaattggcgagggcgctcagaagcttcttcggcccaatagcctgagactggcatctgactcagacgccgagtccgactccagggcttcatctccaaactctaccgtgtccaacacttccacagagggattcggcggcataatgagcttcgcctctagcctctatcgcaatcactccacatctttctctctttctaacttgaccctcccaacaaagggtgcccgcgaaaaagcgacaccattcccaagtcttaaaggaaatagacgggctttagtggatcagaaatcttccgtgattaagcacagccctaccgttaaacgggagcctccatccccccagggcaggagtagcaactcttctgagaatcagcagtttctcaaggaggtggtccatagcgtgctcgatggacagggggtggggtggttgaacatgaaaaaggtcaggaggctgttggaaagcgagcagctccgggtgttcgtcctttcaaagttgaacagaatggtacagtccgaagacgacgcccgacaagacataatcccagatgtggagatttcacggaaggtctataagggcatgctagatttactcaaatgtactgtactttccctggaacaatcctacgcccatgccgggcttggtggaatggcctcaattttcggtctgctggaaatcgcgcagacccactattactctaaggagcccgataagcggaaacgaagtccaacggaatcagttaatacacctgtcggtaaggatccgggcctagcagggaggggcgacccaaaagccatggcccaattaagagtgcctcagctgggaccaagagcaccatcagctaccggaaagggtcctaaagaacttgatacgagatcactgaaagaagaaaatttcattgcttccatcggcccagaagtgataaagcctgtgttcgaccttggggaaacagaggaaaaaaagtcacaaatttcagctgattcgggggtatcgctcactagctcgagtcagagaaccgaccaggacagtgtcattggcgttagcccagccgttatgattcgttccagttcacaagactccgaggtgtctactgtggtcagcaacagtagcggcgagaccctgggggctgactccgatctgtcttcaaacgctggggatggcccaggcggcgaaggctccgtccacctggccagctcccgcggcaccctgagcgactccgaaatagaaaccaatagtgctacaagcacgatcttcgggaaggcccacagtctgaaaccctctatcaaggagaagctggccggctcacccatccgtaccagcgaagacgtctcacagcgcgtatacctctacgagggccttctcggaaaagaacgctccacattgtgggaccagatgcagttctgggaagatgctttccttgatgcggtgatgttggaacgggaaggcatgggcatggaccaaggtccacaggaaatgatagacagatacttatcactaggcgagcacgatagaaagcgactcgaggacgacgaagatagactattggcaacgctgctgcacaatctgatttcgtatatgctgttgatgaaggtgaataaaaacgatatacgtaagaaggtccgcaggttgatggggaagtcccacatcggtttggtctattcccagcagataaacgaagtgctggatcagctcgccaacttaaacggtcgagacctgagcatctggagttccggaagcaggcacatgaaaaagcagacattcgtggtgcatgccgggacagataccaatggagacattttcttcatggaagtgtgcgatgattgtgtggtgttgcgctctaacattggaacagtgtatgaacgctggtggtacgagaaactgattaacatgacatactgccccaagactaaggtactgtgcctttggagacgcaatggcagcgagactcagctgaataagttttataccaaaaagtgcagagagctctactactgcgtgaaggacagcatggagcgggcggcggcgcgccagcagtctataaagccaggtcctgaactggggggagaatttcctgtgcaggatctcaaaacaggcgagggcgggctcttgcaggtgacactggagggtataaatttaaagttcatgcacaaccaactccttaggcggctgcgatggtag

SEQ ID NO: 123435 - DNA, 4626 bp, Artificial Sequence
  Description of Artificial Sequence: Synthetic coding sequence
atggtgcagaaaaaaaaattttgcccacgactgttagattaccttgtgatcgtgggggcacggcaccccagctcagattctgtagctcagacccccgagctcctacgcaggtacccgctggaagaccacacagaatttccactgcctcctgatgttgtattcttctgtcagccagaagggtgtctgagtgtcagacagcggcggatgtcccttagggacgataccagcttcgtgttcaccctaactgacaaggacaccggcgtgacaaggtatggcatctgcgtgaatttctataggtcgtttcagaaacgaatcagtaaggagaaaggcgagggaggagctgggagtcgcggcaaggaaggaacccacgctacctgcgcttctgaagaaggagggacggagagtagtgagagcggctcctcgctgcagccactttcagcagattcgacccctgacgtcaatcagtcacctagaggtaagcgccgcgctaaggccgggtcaagatctaggaatagcacccttaccagcttatgcgtcctgtctcattacccattcttcagtacatttagagagtgtctgtatacccttaaaagattggttgattgttgtagcgagcggcttctgggcaaaaaattgggcatcccgcgcggcgtgcagcgggacaccatgtggagaatctttactggttccttgctcgtggaggaaaagtccagtgctctgctgcacgacctgcgggagatagaggcgtggatatacaggctgcttaggagccccgtgcccgtgtctggccagaagagagttgacattgaggttcttccgcaggagctgcagccagctctgacgtttgcactgcccgatcctagtaggttcactctagtagatttccccctgcacctaccactggagcttctgggagtggatgcctgcttgcaggtgctgacttgtatcctcctggagcacaaagtggtcctgcagtctcgtgactataacgctctctctatgtcagtcatggcttttgtagccatgatctatccgcttgaatacatgttcccagtgattcctctgttgcctacttgcatggcatcggccgagcagctgctactcgcgcctacaccatacattatcggcgttcctgctagtttcttcctctacaagcttgacttcaagatgcccgacgacgtctggcttgtggatcttgactctaatcgcgtgattgcccctacaaacgccgaggtgctcccaattcttcctgagccggagtccctggaactaaagaagcatctgaaacaggctctggcctcaatgtctctgaacacccagccaatcctcaatctggagaaatttcacgaagggcaggagattcccctcctcctcggcaggcctagtaatgatttgcaatccacacccagtacagagtttaaccccttaatctatggaaacgacgttgattcagttgatgtcgcaacccgtgtagctatggttaggttttttaatagcgcaaacgtgttgcaggggttccagatgcatacaaggacgctccgccttttcccccggcccgtagtggcattccaggccggatcatttctggcttccaggcccaggcagacccccttcgcggagaaactagcccgaacacaagcggttgaatacttcggcgagtggatccttaacccaacaaactatgcatttcaacggatccataacaatatgttcgacccagctctaatcggcgacaaaccgaagtggtacgcccaccagcttcagccgatacactacagagtatatgactcaaattctcagttagctgaagctctgagcgtgccacctgagagggacagtgattctgagcccacagacgactccggcagtgactcgatggattatgatgactcgagttcatcttattcttctcttggagattttgtaagcgaaatgatgaaatgtgacataaatggggacacacccaatgtcgatcctttgactcatgcagccttaggggacgccagtgaagtggagatcgacgagctccagaaccagaaggaggcagaggaaccagggcctgactctgagaattcacaggagaatccaccattgcggtcttcaagtagcacaactgcatcctcatcccccagcactgtaatccacggagccaactccgaacctgctgactccactgagatggacgacaaggccgccgttggagtatccaagcccctcccctcagtgcctccttccatagggaagagcaatgtggaccggcggcaggctgaaattggagagggcgctcagaagctgctcaggcccaattccttgcggctagcttccgactcagatgccgaatccgattcacgtgcaagctcaccaaactcaacagttagtaataccagtaccgagggattcggcgggatcatgagctttgcttcctccttgtacagaaaccacagtaccagcttctcattgtctaacctcaccctgccaacgaagggcgctagggaaaaggcaactcccttccctagcctcaaagggaacaggagagcccttgtagatcaaaagtccagtgttattaaacactctcctacagtgaaaagagagcccccgtctcctcagggacggtctagtaattctagcgaaaaccaacagtttcttaaggaagtggttcactctgtgcttgacggccagggcgtcgggtggctgaacatgaagaaagttcgtagactcctggagtctgagcagttgagagtgttcgtgcttagcaagctgaatcgcatggtgcagtccgaagacgatgcacgccaggacataattccggatgtcgagatcagcagaaaggtatataaggggatgctggatctcctgaagtgtacagtcttgtccctagagcagtcatacgcccacgcaggccttggcgggatggctagcattttcggtctacttgagattgctcaaactcactactatagcaaggaaccagacaaaagaaagcgaagcccaacagagtcggtgaatacacccgtgggtaaggatcccggattagcgggtaggggtgatcctaaggctatggcccagcttcgggtgcctcaactcggcccccgcgcaccatccgctaccgggaaggggcctaaagagctagacactcgctccctgaaggaggaaaacttcatagcctcaatcggccccgaggtcatcaagccagttttcgaccttggagaaaccgaagaaaagaagtctcaaatcagtgcagattcgggagtgtccctgacatcaagctctcagcggacagaccaggactcagtgattggtgttagtcctgctgtgatgattcgatcttcatcccaggactccgaggtgtctaacagcagcggagagacgctgggtgctgatagcgacctgtcatccaatgccggggacggccctggtggtgaaggcagcgtgcatctggcaagctcccgtggaacactttccgactctgagatcgaaactaacagcgccacgtccaccatctttggaaaagctcacagtctgaaacctagtattaaggaaaagttggctggctctcctattcgcacaagtgaggatgtaagtcaacgggtttacttgtatgaagggctcctgggcaaggaaagatccactctgtgggaccagatgcaattctgggaagacgcgtttttggacgcagttatgcttgaacgtgagggcatgggaatggaccagggcccacaggaaatgatagatcggtacctgtccctgggcgagcatgacagaaagcgccttgaagacgacgaggacaggctacttgcaactctcctgcataacctaataagctacatgctactcatgaaggtcaataagaatgatatacgtaaaaaagtcaggaggctgatgggcaaaagccacatcggtctggtttatagccagcagataaacgaggtcctcgatcagcttgcaaatttgaacggtcgcgatctgtcaatttggagttcgggctctagacacatgaaaaagcagacattcgtggtccatgctggcaccgacacaaacggggacatcttcttcatggaggtgtgcgatgactgtgtcgtcctccgttctaacataggcacggtgtatgaaagatggtggtatgaaaagttaattaacatgacctactgtcccaaaaccaaggtactatgtctgtggcgtcgcaacggtagtgaaacgcaattgaacaagttctataccaaaaaatgtcgggaactgtactattgtgtgaaagattcgatggaacgcgccgccgccagacagcagagcatcaaacctggccctgaattgggaggcgagtttcccgtgcaggacttgaaaacaggcgaaggtggtctcttgcaggttacgctggagggcattaatcttaagttcatgcacaaccaggttttcatcgaactgaatcacataaagaaatgcaatactgtgaggggagtttttgttttagaggaatttgtccctgagattaaagaggtagttagccataaatacaagacgcccatggcccacgaaatctgttattcagtgttatgtctattctcgtacgtagctgccgttcattcaagcgaagaggacctgagaaccccgcctcgacctgtcagctcatag

SEQ ID NO: 123436 - DNA, 4764 bp, Artificial Sequence
  Description of Artificial Sequence: Synthetic coding sequence
atggtgcagaaaaaaaagttttgtccccgcctgcttgattatctcgtgatcgtcggagcgagacacccatcttcagatagcgtggcacaaacccccgagctgttgcgaagatatcccctagaggatcacacagagttccccctgccaccagacgtggtgttcttttgtcagcctgagggatgtctgtctgtgagacagcgccggatgtcgcttagggatgacacatcgttcgtgttcacactgaccgacaaagacacaggagttactcggtatggcatctgcgtcaacttttacagaagcttccagaaacggatttcgaaggagaaaggtgagggcggggctggtagccgtgggaaagaagggacacatgcaacttgtgccagcgaagaagggggaacagagtcatccgaaagcggcagcagcttgcagcccttgtcagccgattcgacacctgacgtcaaccaaagccctcgcggaaaacggcgtgctaaggctggaagtcgatcacggaactcaacgctcacatctctatgcgttctgtcccactacccctttttctccacctttagagaatgcctttacactctaaagaggctagtggattgttgcagtgagcggctgctcggcaagaagctaggtattccaaggggggtacagagggacactatgtggcgaatcttcaccggtagtctgcttgttgaggagaagagctccgccctacttcacgaccttcgtgagattgaagcatggatttatcgcctccttcgatctccggtaccagttagcgggcaaaaaagggtcgatattgaggtgcttcctcaggaattgcagcccgctctgaccttcgctttgccggatccaagtagatttaccttagtcgacttccccctacaccttccgctagagctgctcggggtggatgcctgcctgcaggtgctcacatgtatccttttggagcacaaggtcgtgctgcagagccgagactacaatgccctctccatgagcgttatggcttttgtcgccatgatataccccttggaatacatgttccccgtgattcccctgctgccgacctgtatggcctctgccgaacagcttctgcttgcccccaccccttacattataggtgttccggcttcttttttcctttacaagctggattttaagatgcctgacgacgtgtggctggtcgacctcgactcaaatcgcgtaatcgctcccaccaatgctgaggtgttacctatcttgccggaacctgagagcctcgagctgaaaaagcacttgaagcaagcactggcctctatgtccttgaatacgcaacccattttgaacctggaaaagttccacgaaggtcaggaaattcccttactccttgggcgaccttcaaacgatcttcaatctacgccatcaactgagtttaaccctctgatctacgggaatgatgttgacagcgtggacgtggccacgcgagtagcaatggttagattctttaatagcgccaacgtgttgcagggcttccaaatgcataccagaactctgcgcctcttcccacgccctgttgttgccttccaagccgggtcctttctcgcgagtcggcctagacagactccgtttgccgaaaaactcgcacgcacacaagcggttgaatactttggcgaatggattctgaatccgaccaactacgccttccagcggattcacaataacatgttcgatcccgcgctaataggcgataaaccaaagtggtatgcccaccaactgcagcccattcactacagagtgtatgactccaattcacagctggctgaagccctgagtgtcccaccagagcgggattcagatagcgagcccaccgacgactctggttctgattccatggattacgatgattcatcttcctcttactcatcgctaggcgactttgtgtcagagatgatgaaatgcgatataaatggtgatacccccaacgttgatcccctcactcacgcggctctcggcgatgcaagcgaagtcgaaattgatgagttacagaatcaaaaggaggcggaagagccgggccctgatagcgagaactcccaagagaacccgcccctgcgtagcagctccagtacaactgctagttcaagtccttccactgtgattcacggcgccaacagcgaacccgccgacagtacggagatggacgataaagctgccgtcggtgtttccaaacctcttccgagtgtccccccttcaattgggaagtccaatgtagataggcgtcaggctgagattggagaaggcagcgtgagaagacgtatctacgacaacccctactttgaacctcaatatggttttcctcccgaggaagatgaggacgaacagggcgaatcctacaccccacgtttctctcagcacgtctcagggaacagagcacagaaattactcaggcctaactcgctgcgcctagcgagcgattccgacgctgagtctgactccagggcctcctctcctaatagtaccgttagtaacactagcactgaaggctttgggggcatcatgtcgttcgcatcctcgttataccgcaatcactccacatccttctcacttagtaacctgactttacctaccaagggggcccgggagaaggccacccctttccccagcctgaaaggcaatcgaagggcactggttgatcaaaaatcctcagttattaaacacagcccaactgtgaaacgcgagcccccctcgccccaaggacggtccagcaattcctccgagaaccaacagtttctgaaggaggtcgtacatagcgtgttggacgggcagggcgtgggctggttgaacatgaagaaggtgagaagattgctcgagagcgagcagttacgggtctttgttctatccaagttaaatcggatggttcagagcgaggacgacgcccgccaagatattatacctgacgtggagatcagcagaaaggtctataaaggtatgctcgaccttcttaagtgtaccgtcctatctctagaacagtcgtatgcccacgctgggctgggcggaatggcctccatttttggccttctggaaatcgcacagactcactactactccaaagagccagacaaacggaagagatctcctacagaaagcgtcaacaccccagtgggtaaagaccctgggctcgcaggccgcggcgacccaaaggccatggcacaattgcgggtgccccagctcggtcccagggctcccagcgccacaggtaaaggacccaaggaactggatacacgtagtctcaaagaggaaaacttcatagccagcattggccccgaagtcatcaagcctgtctttgacctaggagaaaccgaagaaaagaaaagtcaaatcagtgccgattccggggtgtcgctcacctctagctctcaacgtactgaccaggactccgtcataggggtatcgcctgccgtgatgattagatcgtcgagccaggactctgaggtgagcacagtgtctaattccagcggcgagacactgggcgcagattctgatctgtcatcaaacgccggggacggccctggtggtgagggatcggtgcacctcgcatcttcgagagggactctgtctgacagtgagatagaaaccaattcagctacctcaacgattttcgggaaagcccactccctcaagcctagcatcaaggaaaagctggcaggctcacccatccgcacctcggaggacgtatcccaacgagtttatctctacgagggcctgctgggaaaggagcgtagcacactctgggaccagatgcagttttgggaggacgcattcctcgatgccgtgatgctcgaaagagaaggaatggggatggaccagggcccacaggaaatgatcgaccggtacttgtctctgggggaacatgaccgcaaacgtctggaggatgacgaggaccgcctgctcgcgactctgttacataatttaatttcctacatgctcttgatgaaggtgaacaaaaacgacatccggaagaaagttaggagattgatgggcaagtctcacattggcttagtctatagtcagcaaatcaacgaggtgctggaccagttagccaacttaaacggcagagacctctctatttggagctctggaagccggcacatgaagaagcaaacattcgtggtgcacgccgggacggatactaacggagatatcttcttcatggaggtgtgcgatgattgtgtcgtgctgcgcagcaacatcgggaccgtgtatgagaggtggtggtacgaaaagttaatcaatatgacttattgtcccaagacaaaagtcctgtgtttatggcgaagaaatgggtctgaaacccagctgaacaaattttacacaaaaaaatgccgcgagctttattactgcgtcaaggatagcatggagagagctgcagcgcggcagcagtctatcaagcctggtcctgagctcgggggggagttcccagtacaagacctcaagaccggcgaaggcgggctgcttcaggtgaccctcgaagggattaatctcaagttcatgcataatcaagtctttattgagcttaaccatatcaaaaaatgtaacaccgtgcggggggtgtttgtccttgaggagttcgtcccagaaatcaaggaagtggtttcccataagtataaaactcccatggcacacgagatctgctattcagtcctatgcctcttctcctacgttgccgctgtgcattcctccgaggaggaccttagaacccctccccgccctgtctcatcttag

SEQ ID NO: 123437 - DNA, 4638 bp, Artificial Sequence
  Description of Artificial Sequence: Synthetic coding sequence
atggttcaaaagaaaaagttttgccccaggctgctggattatctggtcatcgtgggggccaggcatccttcctccgattctgtggctcaaactcccgagctcctgagacgctaccccctggaagaccataccgagtttccccttcccccggatgttgtatttttctgtcagcctgagggatgtctaagcgttaggcaacggcgtatgagtctccgggatgacacttcatttgtgtttacgctgacagataaggacacgggagttaccagatacggcatctgtgtgaatttttatagaagtttccagaagagaatttcaaaagagaaaggggagggtggggcagggtccaggggtaaagaaggaacccatgcgacatgtgcgtccgaggagggaggtactgagtcttcagaatctgggtcatccctacaaccactgtcagctgactctacccccgatgtcaaccagtcccccagagggaaacgcagagcaaaggccggttcaagatccaggaacagcacattgacatccttatgtgtgctgtcccattatccgttcttctctaccttcagagaatgcttgtacacactgaaacggctggtggattgctgtagtgaacggctgctgggtaagaaactgggtatcccccgaggcgtgcagcgagacacgatgtggagaatttttactggatccctcttggtggaggaaaaatcttctgcgctgctacacgatctcagagagatcgaagcgtggatctacaggctcttgaggtctcctgtcccggtgtccggccagaaacgggtggacatcgaggtcctgccgcaggagctgcaacctgctcttaccttcgctttgccagacccaagccgcttcacacttgtggacttcccactgcacctgcctcttgagctgctgggggttgatgcctgtcttcaggtgctaacctgtatcctcctcgaacataaggtagtcttgcagtcacgcgattataacgcactgtccatgagcgtcatggccttcgtggcgatgatatatccccttgagtatatgtttcccgtgatacctctgttgccaacatgtatggcaagcgcggagcagttgttgcttgccccaaccccttatatcattggcgttcccgcctcatttttcttgtataagctggacttcaaaatgccggatgacgtttggctggttgacttggacagcaatcgagttattgcccctacaaatgccgaggtgcttccaatactgccggaacctgagagtctggagcttaagaaacacctgaagcaggccctcgctagtatgagcctcaatacacagccaattctaaatctggaaaaatttcatgaaggacaggagatcccgctcctcctcggccggccctccaacgacctccagagcacgccttcaacagagttcaatccactaatttacggcaatgatgttgattctgtggacgttgccacccgggtggccatggtgcggttcttcaactctgccaacgtgttacaaggatttcaaatgcatacccgaaccctccgactattccccagacctgtggtcgcattccaggctggatcttttctcgctagcagaccaagacagaccccgtttgctgagaaacttgcccgcacccaggctgtcgagtatttcggcgaatggatccttaatcctaccaactacgcctttcagaggatccataataatatgtttgacccagccctaattggcgacaaaccaaagtggtacgcccatcagctccaaccgatccactaccgcgtgtacgactccaacagccaactggctgaagccctatcagtacctccggaacgtgacagtgactctgagcccacagatgacagcggaagtgattcaatggactatgatgattcttcgagctcatacagctcacttggggattttgtgagcgaaatgatgaagtgtgatatcaatggagatactccaaacgtggatcccttaacacacgccgcactgggcgacgcttccgaggtggagattgatgaattgcagaaccagaaggaggctgaggagccagggcccgactcagagaactcccaagaaaatcccccacttcgatcgagcagctctactaccgcatccagttcccctagcaccgtaatccacggagcgaattcagagccagccgattccacggagatggacgacaaggccgccgtgggagtgtcgaagccacttccctctgtaccaccatccatcgggaaatctaacgtagatcggaggcaggctgaaattggggagggagcccagaagctcttgaggccgaatagcctgagactggcgtccgactccgatgccgaatccgattctcgagctagctcacccaactccaccgtatcaaacacatcgacagagggctttggtgggattatgagttttgcttcttcactgtatcgtaatcattctacgagcttttctctttccaatttgacccttcctaccaaaggtgcacgcgaaaaagcaacaccgttcccctctctcaaaggaaatcgcagggctctggtggaccagaagagtagcgtgatcaagcattcacctacagtaaagcgtgaacccccaagccctcaggggaggtcctccaactcaagcgagaaccaacagttcctcaaggaggttgtccattccgtcctggatgggcagggcgtcggctggctcaatatgaagaaagtgcggcgcctgctagagtctgaacaactgagagtcttcgtgcttagtaaattaaatcgcatggtgcaaagcgaggacgacgctcgccaggacattattcccgacgtggaaatcagtcgcaaggtctacaaagggatgttagatctattaaagtgtactgtgttgtcactagaacaatcttacgcacacgcaggtttaggggggatggcaagcatcttcgggctactggagattgcacagactcattactattctaaggagcccgacaagagaaagaggagtccaacagagtccgtgaacaccccagtgggcaaggacccgggcctggccgggaggggcgaccctaaagcaatggcccagctccgggtcccccagttgggccctcgggccccaagcgctacagggaaagggcctaaggagttagatacccgctcactcaaagaggaaaatttcatcgcaagcattgggcctgaggtcattaagccagtctttgaccttggcgagacggaagaaaaaaaaagccagatttctgcagattccggcgtttcattgaccagttcttcccagcggacagatcaggacagtgtaatcggcgtctcacccgctgtcatgattcggagcagctcccaggactctgaggtgagcacagtagtgtctaatagcagtggtgaaaccctgggtgccgatagcgatttatccagtaatgccggcgacgggcctggaggagagggatccgttcacctggcatcctctcgtggtacactctccgattcagaaatcgaaaccaattccgcaacatccactatcttcggcaaggcacactccctgaaaccctcgattaaggagaaactagctggaagtcccatcagaacatctgaggacgtctcgcagagggtgtatttatatgagggcttgctaggcaaagagcggtcgactttgtgggaccagatgcagttctgggaagacgccttcttagacgccgtcatgctcgaacgtgaggggatgggcatggatcaaggcccgcaggagatgattgacagatacctgtcattgggggaacatgacaggaagcggctggaagacgatgaagatcggcttttggctaccttacttcacaatcttatttcctatatgctgctcatgaaagtcaataaaaatgatatccggaagaaagttcggcggttaatggggaaaagccacatcggactggtttactcccagcaaattaatgaagttctggaccaactggcaaatctgaatgggcgggacctgagcatttggagctcaggatccaggcacatgaaaaagcagacatttgttgtgcacgctggaacggacactaatggcgatatcttctttatggaggtgtgcgatgactgcgtggtcctacgaagtaacatcgggaccgtttacgaaagatggtggtacgagaagcttatcaatatgacctactgccctaagacaaaagttctgtgcctctggcgaaggaacggttctgagactcagctgaataaattctacactaaaaaatgccgcgagctctattactgcgttaaagactctatggagagagccgccgctcgccagcagagtatcaagccaggacccgaactaggaggtgagttccccgtccaagatctgaagacaggagaagggggcctcctacaagtcacattggagggaatcaatctcaagtttatgcataaccaggtgttcattgagctgaatcacatcaaaaaatgtaatacagtgaggggggtatttgtcctggaggagtttgtgcccgaaatcaaagaggtggtgtcacacaagtataagacccccatggctcatgagatctgttactcggtgctgtgtctgttttcttatgtggcagcagtgcactcttctgaagaggacctcaggaccccccctcggcccgtttcctcctag

SEQ ID NO: 123438 - DNA, 4440 bp, Artificial Sequence
  Description of Artificial Sequence: Synthetic coding sequence
atggtgcaaaagaaaaagttttgccccagactcctggactacctggttattgtgggtgctcggcatccatcttcagatagcgttgcgcagacgccagagctgttacggcgttacccactcgaggaccacactgagttccccctccccccagacgtcgtatttttctgtcagcccgagggttgcctaagcgtacggcagcggagaatgagcctgcgagacgacacaagcttcgtgttcactttgaccgataaggacacaggggtgacacgatatggcatctgcgtgaatttttaccgctcctttcagaagaggatttccaaagaaaaaggcgaagggggggccgggagtaggggtaaggagggaacgcacgccacgtgtgcctcagaggagggcgggacggagagttcagagagtggttcaagtctgcagcctctgagcgccgattctacacctgatgtcaaccagtctcctagagggaagcgaagagccaaagcgggctcacggagccgcaattccaccttgactagcctctgtgtcctttcacactaccctttcttctccacattcagagagtgcttgtatactctcaagcgcctagtcgactgttgtagtgagaggcttttaggcaaaaagctggggatcccaagaggggttcaaagggacactatgtggcggatcttcactggctccctgctggtggaagagaagtcctcagctctgctgcacgacttgagagaaatcgaggcttggatatatcgcttgctgagatctccagtgccagtgtccggacagaagcgcgtagacatcgaagtcctgccccaggaattacaaccagctctgacatttgccctcccagatcctagtcgatttactctcgtcgacttcccactccatctgcccttagagctcctgggagtcgacgcttgtctccaggtacttacatgcatcctgctggaacacaaagtcgttctccagagccgtgattataacgctttgagtatgagtgttatggcgtttgttgctatgatctatccactcgaatacatgttccctgtgatccctctgctgcctacttgtatggctagcgctgaacagctgcttctagcccctactccttatatcatcggtgtgcctgcgtctttcttcttgtataagcttgactttaaaatgccagatgatgtgtggctcgtagatctagattcgaatcgggtaatcgccccaacaaatgctgaggttctgcccatcctacccgaaccagagagtctggagttgaaaaaacatttgaaacaggccctcgctagtatgtccttgaatacacagcccatcttgaacctggagaagtttcacgaagggcaggaaatccctctgctgcttggaaggccttcaaacgatctgcaaagcactcccagcaccgagtttaacccattaatttacggtaacgatgttgattctgttgacgtcgccacaagggttgctatggttagattctttaatagtgccaacgtcctgcagggcttccagatgcacacacgcaccttgcgcctctttccgcgtcctgtcgtagcttttcaggccggcagctttttggcatctaggccacgacagaccccttttgcggaaaagctggctaggactcaggccgtagaatatttcggtgaatggatcctcaaccctacaaactacgctttccaacggatccacaacaatatgttcgaccccgcattaatcggcgataagcccaagtggtatgctcaccagctgcagcctattcactaccgagtctacgactcaaactcacagctcgccgaagcattatccgtgccccctgaaagagacagtgatagcgagcccaccgacgacagcggctccgatagtatggactatgatgactcgtcttcgtcttactctagcctgggtgacttcgttagcgagatgatgaagtgcgatatcaacggagatacacccaatgtcgaccctctcacgcacgctgctctgggggacgcgtctgaggttgaaattgatgagctacagaatcagaaggaggcagaggaacctggcccggatagtgagaactcccaggagaaccctccactccggtcttcttcttccacaacagcgtctagtagcccaagcaccgtgatacacggggcaaactccgagcctgctgattcaaccgagatggacgataaggcagcggtgggcgtgtcaaagccgttaccatcagtgcctcctagcattgggaagagcaacgtggatagaaggcaggccgaaatcggagaaggggctcagaaattgctgcgtcccaattccttacgcttggcctccgacagcgacgctgagagcgatagccgcgcttctagcccaaactccacagtttccaatacgtccactgagggtttcggtggtataatgtcctttgccagcagcctttacagaaaccacagtacttccttttccctgtctaacttgactctccccacaaagggagcacgcgaaaaggccactccatttccgtccctcaagggcaatcgaagagccttggtggatcaaaagtcatcagttatcaagcacagtccgacggtgaaacgggaacccccttcaccccaggggcgtagctctaattcgagcgaaaaccaacagttcctgaaagaagtggtgcatagcgtgctggacggacagggggtcgggtggctaaacatgaaaaaggtgaggagattactcgagtcagaacagctgagagtgtttgtactgtccaagttaaaccgaatggtgcaatccgaagatgacgcacgccaggacattatcccagatgtcgagatctcacgtaaagtttacaagggtatgctagaccttttgaaatgcaccgtcttaagcctcgagcaaagctacgcacacgccggactgggcggcatggcttccatctttggtctgctggagatcgctcagacccattattactcaaaagagcccgacaagaggaagaggtcacccacagagtccgtgaacactcctgtcggtaaggaccctggactggctggaaggggcgaccccaaggctatggctcaactaagagtacctcagctggggccgagggcaccctcagctaccggaaagggtccaaaggagttggatactcgtagtctgaaggaggagaacttcattgcatccatcggtcccgaggtgatcaaaccagtgttcgatctgggagaaaccgaagagaaaaaatctcagatatcagcagatagcggggtgagccttacatcaagcagtcagcgcaccgaccaagatagtgtgatcggagtgagccccgccgtcatgattcgcagtagctctcaggactcagaagtgtcgacagttgtgagcaattcctctggagaaaccttgggagcggattcggacctgtcctcgaatgctggcgacggccccgggggagagggcagcgtgcacttggctagttctcggggaacgttatccgactccgaaatagagaccaacagtgcgaccagcaccatctttggcaaggctcattccctcaaaccaagcattaaagagaagttagctggctccccaatcaggacctctgaggacgtttcccagcgggtctatctatatgaggggttgctcgggaaagagcgtagcacgctgtgggaccagatgcaattttgggaagatgcttttctggatgctgtcatgctcgagagagaggggatgggtatggaccaggggccccaagaaatgatcgataggtacctcagcctgggggaacacgatcgaaaacggctggaggacgacgaggaccgattgttggccaccctcctgcacaatcttatcagctacatgttgttgatgaaggtgaataagaatgatattcgcaagaaggtgcggcggctcatggggaaatcacacataggactggtttactcacaacagatcaacgaggtacttgaccagctcgcaaatctcaatgggagggacctgagcatatggagcagcggatctaggcacatgaaaaaacagactttcgtcgtgcacgctgggaccgataccaacggagacattttctttatggaagtgtgtgacgactgtgtggttctcaggagcaatatcggcactgtctacgagagatggtggtacgaaaaactaattaacatgacttactgtcccaaaacgaaagtgctctgtctctggagacgcaatggatcagagacgcagctcaataaattctataccaagaagtgtcgcgagctgtactactgtgtcaaagactccatggagagagcggccgcgcgccagcaatcaatcaaaccgggcccagaactcgggggcgaattccctgtgcaggacttaaagacgggcgagggtggcttgctccaggtgacactggaaggcataaacttgaaattcatgcacaatcaattcctgaaacttaaaaagtggtag

SEQ ID NO: 123439 - DNA, 4698 bp, Artificial Sequence
  Description of Artificial Sequence: Synthetic coding sequence
atggtgcagaaaaaaaagttttgtccacgcttgctcgattacctcgtgatcgtcggagcccggcaccctagttcagacagcgttgctcagacgccagagttgttgcgtcgctaccctctggaagaccataccgaattccccttacctcctgatgtggtcttcttctgccagcctgaaggctgcctcagtgtgagacagaggcgcatgtcgttaagggatgacacctcgttcgtgttcaccctgacagataaggataccggggtgacccgatatgggatctgcgtgaacttctacaggtccttccagaagcgcatttccaaggagaagggtgaaggcggagctggtagccgtggcaaggaaggtacgcatgcgacttgtgcctccgaggagggcggaaccgaatcatccgagtccggatctagcctccagcctctgagcgcagattcaaccccagatgtaaaccaaagcccgagaggtaaacgccgggctaaggcaggctcccgatcacgcaattctacccttacatctctgtgcgtacttagccattatccattttttagtacattccgagaatgcctttacacccttaagaggctggtagattgctgctccgagcgcctgctaggtaaaaagctaggcatcccgcgcggggttcagagggataccatgtggcggatttttacggggagtctgctagtggaggagaaaagctctgccttgctgcacgatctcagggaaattgaggcttggatctatagactgttaagatcccccgttcccgtcagtggacagaagagggtggacatcgaggtgctgccacaggaattgcagcctgctctgacattcgcccttcccgatcccagtagatttacgctagtggactttcctcttcacctgccccttgaactgctaggagtagacgcctgcctccaggtcctaacctgcattctattggagcataaggtcgtcctacagtcgcgggactacaacgcactttctatgagtgtgatggcttttgtggccatgatctacccactcgagtatatgttccctgtcataccgctcctgcctacctgtatggcctctgctgaacagctattgttggcacctaccccgtacataattggtgtcccagcttcattcttcctgtacaagctagacttcaagatgcctgacgacgtatggttagtggacctggattcaaacagagtgatcgcccctaccaacgccgaggttctccctatcctgcctgagccagagtctctcgagctgaaaaagcacctgaaacaggctctggcctcaatgagtctgaatacccagcctatcttgaacttagaaaagttccacgaaggtcaggagattcctctcttgctcggccggcctagcaacgatttacagagtaccccatcgaccgagtttaatcccctgatttatggtaatgacgtggattctgtggatgtagctacccgtgtcgctatggtacggttttttaactctgcaaacgtccttcagggttttcaaatgcatactcggacactcaggctgttccctagacccgtggttgccttccaagctggaagtttcctggcctcccggcctaggcaaacgccttttgctgaaaagctagcccgcacccaggccgttgagtattttggcgaatggattctgaaccctaccaactacgccttccaaaggatccacaataatatgtttgatcctgcattgatcggagataagcccaagtggtacgcgcatcagcttcaacccatccattatcgcgtctatgactcaaattcacagctcgccgaggcgctgtctgtacccccagagagagatagcgattcagagcctacagacgacagcggcagcgattctatggattacgatgactcctccagctcttactccagcttaggcgacttcgtaagtgagatgatgaagtgtgacattaatggggacactccaaacgttgatcctttaacgcatgccgctctgggcgacgcttctgaggtcgagatcgatgaactgcagaaccagaaggaagccgaggagcccggacccgactcagagaactcccaggagaaccctcccctgcgctcttcatcatctactacggcctcgtcaagtccctctacagtgatccacggcgctaatagtgaacccgcagacagcacagaaatggacgataaggccgctgtgggtgtatctaagccattgccctcagtacccccctcgatcggaaagagtaacgtggacagaaggcaggcggagatcggagagggcgcgcaaaagttgttgaggccaaattcactgcgtctggcttctgactccgatgcagagtccgatagccgcgcctcctcacccaactctacagtctccaatacttctacagaaggtttcggtgggatcatgagcttcgcaagctcgctctatcgaaatcacagcactagcttttcactttcaaatctcacactgccgacaaagggggctagagagaaagcaaccccctttcctagtctgaaagtgttcggacttaacacacttatggagatcgtcacagaagccggcccgggctccggggagggtaaccggcgggccctggtcgatcaaaagagttctgtgattaaacacagtcctacagtgaagagggagcctccatccccccagggccgttcatcaaactccagcgagaaccaacagtttcttaaagaggtcgtgcacagcgtgcttgatggccagggggtaggatggctgaacatgaagaaggtacgccgcttgctggaatcagagcagcttagggtattcgtcctgtctaagttgaacaggatggtccaatcggaggatgatgcccggcaggatattatcccggatgtggagattagtaggaaagtgtataaaggcatgctggaccttctcaagtgtacagtgctgagtttagagcagagctatgcccacgctggactcggcgggatggcctccatttttggtctgctggagatagcacagacccattactattctaaagagcccgataagaggaagagaagccctaccgagagtgtaaatacgcccgtgggcaaggacccgggtcttgccggcagaggggacccaaaagccatggcccagctcagagtcccccagctcggccctagagcaccctctgcaacggggaagggccccaaagagttggacactcgtagcctgaaagaagaaaacttcatcgccagcattggccccgaagtaattaagcccgtctttgacctcggggaaacagaagagaagaaatcgcaaatctcggcggacagcggcgtgagtctgacgtcctcttcccagcgcacggaccaagattcagttatcggcgtgtctcctgcagtgatgattcggtcctctagtcaagattccgaggtatctacggtcgtttctaatagtagcggcgaaacgctgggcgctgatagtgatctatccagtaatgctggtgatggacctggtggggaggggagcgtacacctggcttcatcacgtgggaccctctcagatagcgagatagaaacaaattcagctacgagtaccatctttggaaaggcacactcactcaagccatcaatcaaggaaaagttggcaggttccccaataagaacaagtgaagatgtctcccagcgtgtgtatctgtatgagggactgctgggtaaagaacgatcgacactctgggaccagatgcagttttgggaggatgcttttctggatgcggtgatgctggagagagaaggaatggggatggatcagggacctcaggagatgatcgaccgttatctgagtctcggggagcatgatcgaaagcggttggaggacgacgaagatagactgctggcaacgctgctgcataatctgatctcttacatgttattgatgaaggttaataaaaatgatatcagaaagaaagttcgccggctgatggggaagtcccatatcgggcttgtctacagccagcagatcaatgaagtattggaccagctcgccaatctaaatgggagggatcttagcatttggagcagcggtagtcgtcacatgaagaagcagacatttgttgtacatgctgggactgataccaacggggacatcttctttatggaagtgtgcgacgattgcgtcgtattacgtagtaacattggtaccgtgtatgagcggtggtggtacgagaagctgattaacatgacctactgccctaagactaaggtgctgtgcttgtggagacgcaacggtagtgaaactcagctgaataaattttacactaagaagtgtagagagctgtactactgcgtgaaagattccatggagcgtgccgcagctcgacagcagtctattaagccaggacccgagctgggtggcgagtttcccgtgcaggacctcaaaacaggcgaaggcggactgctccaagttaccctcgaggggataaacctgaagtttatgcataatcaagtctttatagaacttaaccacatcaagaaatgcaatacagtgaggggggtctttgtcttagaggaattcgtgcccgaaattaaggaagtggtcagccataaatataaaactcctatggcacacgaaatttgttactccgtactgtgccttttctcgtacgtcgccgcggtccactcatctgaagaggatcttcggacgccacctcgccctgtatcttcgtag

SEQ ID NO: 123440 - DNA, 588 bp, Artificial Sequence
  Description of Artificial Sequence: Synthetic coding sequence
atgggttctcaatctagcaaggcaccaagaggtgatgtgaccgccgaagaagccgcaggtgcctcacctgccaaagcgaatgggcaggagaatggccatgttaagtctaatggggacctttcccctaagggcgagggcgaatcgcctcccgttaacgggacagatgaggccgccggagcaaccggggacgcaatcgaacccgcgccaccctcacagggggcggaagcgaaaggggaggtgccacccaaagaaacccccaagaagaagaagaagttctctttcaaaaagccattcaagctctccggattgtcttttaaacgcaaccgaaaagaggggggcggggacagttctgctagctctcccacagaggaagaacaagaacagggtgagatcggcgcctgttcggatgagggcaccgcacaggaaggaaaagcagccgcaacgccagaatcccaggagcctcaagccaaaggtgcagaggccagtgccgcctcagaagaggaagccggaccacaggctactgaaccatctacaccttccggtccagagagcggccccacaccggcttctgcagagcagaatgagtag

SEQ ID NO: 123441 - DNA, 1377 bp, Artificial Sequence
  Description of Artificial Sequence: Synthetic coding sequence
atgtccaatgatggccgctcccgaaaccgcgaccggcgatacgacgaggtgccctctgatctgccctaccaggatactaccatcagaacacaccccaccctccatgacagtgagcgggccgtgagcgcggatcccctacctcccccgcccttgccactgcaaccaccgtttggtcccgatttttatagctcggacaccgaagagcctgcaatcgccccggacctgaagcccgttaggagatttgtgccggatagttggaaaaatttcttccgaggtaaaaagaaagatcctgagtgggataaacccgttagcgacatccggtacattagtgatggagtggaatgtagcccaccagcctctccagccagaccaaatcatcgctccccactgaacagctgtaaggacccctacggcgggagcgagggaactttttcttctaggaaggaggccgatgccgtatttccacgcgatccatacgggtctttagatcgccatactcagacagtccgaacgtattcagagaaggtcgaggagtacaatctgcgctattcgtacatgaaatcctgggccgggctcctccgcattctcggagtggttgaacttctgctcggcgccggagtcttcgcctgcgtgaccgcttacatacataaggacagcgaatggtataatttatttgggtatagtcagccctatggaatgggtggcgtcgggggcttaggcagtatgtatggaggctactattacactggtcctaagactcccttcgttttggtagtcgcagggttggcttggataactactattatcatcctggtgctgggtatgtcgatgtactatcgaacaattctcctggattcaaactggtggcctttaaccgaatttggtatcaacgtagctctgtttatcttgtatatggccgccgcaattgtgtacgtaaacgatacaaataggggcgggctttgttactatcctctttttaacacacccgtaaacgcagtgttctgtcgcgttgaggggggtcaaatagctgccatgatttttctctttgtgaccatgatcgtgtacctgattagcgctctggtctgcttaaagttgtggcggcatgaagcagctagaagacaccgcgaatacatggaacagcaagaaatcaatgagccctccttatctagtaagagaaaaatgtgtgaaatggctacaagtggtgatcgtcagcgggactctgaagtgaatttcaaagaattgcgcaccgccaaaatgaaaccggagttgcttagtgggcatattccccccccgcgccccgcaaattttttcgtttttctggtggagatggggtttcatcgcgtcagccaggatgatctggatcttctcacctcatag

SEQ ID NO: 123442 - DNA, 1677 bp, Artificial Sequence
  Description of Artificial Sequence: Synthetic coding sequence
atgagtaatgatgggcgctccagaaacagagatcgacgctacgatgaggtaccgagcgatttgccttatcaggacaccacaatccggactcaccccaccctgcatgattccgagcgtgcagtctcagcagatcccttgcctccgcctccccttccccttcagcctccattcgggcctgatttctatagctcagataccgaggaacctgcaatcgcacccgatctgaaaccagtgcggcggtttgtgccggattcttggaagaacttctttcgaggaaagaaaaaggaccccgaatgggacaagcccgtctccgacatcaggtacataagcgacggtgtcgaatgttcccctccagcttcaccggcacggccaaaccacaggagtccgttaaactcttgtaaggacccttacggcggctccgaaggaacattcagttcccgcaaggaggctgacgccgtattcccgcgtgatccatatgggagcctggatcgccatacacagacggtacgaacatacagtgagaaggtggaagagtacaatctgaggtactcctacatgaaaagctgggccgggctactgcgtatcctcggcgtggtagaactgttactgggcgccggcgtgttcgcttgcgtgactgcatacatccataaagacagcgagtggtacaatttgtttggctattcccagccatacggcatgggaggcgtgggcgggctgggatccatgtacgggggctattactacacaggccccaagacaccctttgttcttgtggtggctggacttgcttggattactactatcattatattggtgctgggcatgtctatgtactatcggacaatcttattagatagtaattggtggccgctgactgagttcggaatcaatgtcgccctctttatactttatatggcagcagctatcgtatacgtaaacgacactaatagaggcggactctgctactatcccctgtttaacactcccgtaaatgctgttttctgtagggtggagggtggtcagatcgctgcaatgatctttctctttgtgacaatgatcgtgtatttgattagcgctcttgtgtgtttgaagctctggaggcatgaggctgctcggaggcatagagagtacatggagcagcaggagatcaacgagccctccctctcctcaaagcgcaagatgtgcgagatggcaacctctggggaccgacagcgcgacagcgaggtgaatttcaaggagttgaggacagcaaaaatgaaacctgagctcctttctgggcacatacctccaggccatattccaaaacccattgttatgcctgattacgtcgcaaagtatcccgtgatccagacggacgacgaaagagagcgttataaagctgtgttccaggatcaattctctgagtacaaggaacttagcgctgaggtgcaggcagtgctacggaagtttgatgaactggatgccgtgatgagtcgactgccccatcactccgagtccaggcaggaacacgagcggatctcaagaattcatgaagaattcaaaaaaaaaaaaaacgatcccacttttctcgagaaaaaagaaagatgtgactacttgaaaaataaactgtcccatattaagcagaggattcaagagtatgacaaggtaatgaactgggacgtgcagggatatagctag

SEQ ID NO: 123443 - DNA, 1329 bp, Artificial Sequence
  Description of Artificial Sequence: Synthetic coding sequence
atgtcaaatgatgggcggtcccggaatagggacagaaggtatgatgaggtcccatcagacctgccctatcaagatactaccatccgaacgcacccaacattgcatgattccgagcgggccgtgagtgcagaccctttgccccccccaccccttcccttacaaccgccattcggtccagatttctattcgagcgataccgaagaacctgccatcgctcctgacctcaaacccgtgcgtaggttcgtgccggactcatggaagaacttcttccgtggtaagaagaaggaccctgagtgggacaagcctgttagcgatatccggtatatcagcgatggggtcgagtgctctccaccggcttctccggccagacctaatcacaggagccctttgaactcatgcaaagacccatacggcggatcagaaggcacgtttagcagccgcaaagaggccgatgcggtgttcccacgtgacccttacgggagtttggacaggcacacccaaacagtccggacatactccgagaaggtggaagaatacaacctgcgatattcctacatgaagtcctgggcaggtctcctcaggatcctgggggtggtagagctgttactgggagcaggagtcttcgcctgcgttacagcgtatatccataaagactcagagtggtacaacctgttcggatacagccagccttacgggatgggtggtgtagggggcctgggatctatcgcactagtctgtcttaagctgtggcgccatgaagccgcacggcgacaccgagagtacatggaacagcaggagatcaacgaaccatctctttccagcaagcggaaaatgtgcgagatggccacatcaggcgaccgtcagcgcgattccgaggtcaacttcaaggagttgaggaccgcgaaaatgaagcccgagctcttgtcaggccatatcccccccgggcacatcccgaagcccattgtcatgccggactatgtggctaaatatcccgtcatccagacagatgatgaaagagagcggtataaagcagtcttccaggaccagttttctgaatacaaagagctctcggctgaggtgcaggctgttttaagaaaatttgatgaactggacgccgtaatgtccagactgccacaccacagcgagtcaaggcaggagcatgaacgtattagccgcatccatgaagaattcaagaagaagaagaatgatcctaccttcctggagaagaaggaaaggtgtgactatcttaagaacaagctgtcccatatcaagcagcgtatacaggaatacgataaggtcatgaattgggacgttcagggatattcttag

SEQ ID NO: 123444 - DNA, 1641 bp, Artificial Sequence
  Description of Artificial Sequence: Synthetic coding sequence
atgagcaacgacggccgttcccggaatcgagaccggagatatgatgaggtgccgtctgacctcccctaccaggacacaaccattaggactcatccaacgcttcacgattcggaacgggcagtgtccgctgaccccctgccacctccaccactgcccctgcagcctccatttggccctgatttctattcttctgacacagaagaacccgccattgctcccgacctcaaaccagtgaggcgcttcgtgcctgattcttggaagaacttttttaggggtaaaaagaaagaccccgaatgggacaagcccgtaagcgatatccgctatatttccgatggcgtggagtgcagtcctccagcctcccctgccagaccaaaccatcggagtcctctgaacagttgtaaggacccatacggcggctcggagggaacatttagttcccgaaaggaggccgatgccgtatttccccgggatccttatggctccctcgacaggcacacgcagacagtcagaacctactcagagaaggtcgaggaatataatctacgatactcttacatgaagtcttgggcaggactgctaaggatactcggagtggtagaattgctgctgggagcaggggtctttgcgtgcgtcacagcctatatacacaaagatagcgaatggtataacttgtttggatattctcagccttatggtatgggtggcgtggggggccttgggtcaatgtatgggggctattattataccggccctaagactccttttgtgttagtcgtcgcagggctagcttggattactacaatcattattctcgtgttagggatgtccatgtattatagaacaattctgctggacagcaactggtggcctctgacagagtttggtatcaacgtagcccttttcatcctgtatatggctgccgcgattgtgtacgtgaatgacactaatcggggcgggctctgttactacccgctgttcaatacgcctgtgaatgccgtgttctgtcgggttgaaggtgggcagatcgccgccatgatctttctcttcgtgacaatgatagtgtacctcataagtgcactggtctgcttgaaattatggcgacacgaggcagcccgtagacaccgggagtatatggaacagcaggaatgcgagatggcaacttcaggagacagacaacgggatagtgaggttaattttaaagagttacgtacagctaaaatgaagccagagttgctgagcgggcatatacccccgggccacatccccaagcctatcgtaatgccagactatgtggcaaaatacccagttatacagactgatgacgaaagagagaggtacaaggctgtgttccaggatcagttttccgaatataaagaactgagcgcggaggtgcaggccgtgctgaggaaatttgacgagctcgatgctgtgatgtctcgactcccccatcattcggagagtagacaggaacacgagaggatttcccgtattcacgaggagtttaagaagaagaagaacgaccccacattcttggaaaagaaagaacgatgtgactacctgaagaataagctctctcatattaagcaaagaatccaggaatacgacaaggttatgaattgggacgtccaaggctactcatag

SEQ ID NO: 123445 - DNA, 1551 bp, Artificial Sequence
  Description of Artificial Sequence: Synthetic coding sequence
atgtctaacgatggaagaagtagaaatagggaccgacgatatgatgaagtgccgtccgatttgccttaccaggatacaaccatccggacccaccccactcttcacgactccgagagagcagtcagcgcggacccactaccgccccctccgctcccgctgcaaccgccattcgggcctgacttctattcgagtgatacagaggaacctgcaattgctccggatcttaagcctgtgaggcgcttcgtgcccgatagttggaagaactttttccgtgggaagaagaaggaccctgaatgggacaaacctgtcagtgacattcggtacattagcgacggagtggagtgtagcccacccgcctctcccgcccggcctaatcacaggagccccctaaactcttgcaaggatccatatggcggatccgagggaacctttagctctcggaaggaggcagacgcagtgttcccccgcgacccatatgggtctttggatcgacatacgcaaacggtccgcacttactccgagaaagtggaggaatataacctacgttatagttatatgaaatcctgggccggtttactgaggatcctgggcgtggtggaactgctccttggggcaggagtgttcgcctgtgttacagcatacatacataaagatagcgaatggtacaacctcttcggatactcccagccctatggcatgggcggcgtaggcggtcttggatccatgtacggcggttactattatactggccccaaaacccccttcgtgttagtggttgctggtttagcctggatcaccacaatcattatcttggtgctgggcatgtcaatgtattatcgaacaatcctactggactcaaactggtggccccttaccgagttcggaataaatgtggcgctttttatcctgtatatggcggccgctatagtgtacgtcaatgacaccaaccgcggcgggttgtgttattatcctctgttcaacacacctgttaacgcagtattctgtcgggtcgaaggcggccaaatcgctgccatgatattcttattcgtgacaatgattgtctacctgataagtgccctagtgtgtctgaaactttggcgtcacgaggccgcccgaagacacagggagtatatggagcagcaggagatcaatgagcctagtctcagttctaagcgtaaaatgtgtgagatggccacgagcggcgacagacagagggatagtgaggtgaatttcaaggaactaagaacagcaaaaatgaagccagaattactgagcggccacatcccccccggacacattcctaagcccattgtaatgcccgattacgtggccaagtaccctgtgattcagacagatgacgaaagagaaagatacaaggcagtcttccaggaccagttttctgagtataaagaactgtcagcggaagtccaggccgttctgaggaagttcgacgaactcgacgctgtgatgtctcgccttcctcatcattctgagtccaggcaggagcacgaacgcatttctagaatccacgaggagtttaagaagaagtag

SEQ ID NO: 123446 - DNA, 438 bp, Artificial Sequence
  Description of Artificial Sequence: Synthetic coding sequence
atgtctaacgacggtcgtagccggaatcgcgatcgtcggtacgatgaggtgccgagcgacctcccataccaggacaccaccatcagaacacaccccacattgcatgactccgagcgcgctgtatccgctgatcccctgcctccgcctccgcttccactccagccaccgttcggccccgatttctattcaagtgacactgaggagcctgcaatagcacccgatttgaagcctgttaggaggttcgtcccagattcctggaagaattttttccgaggcaagaaaaaggaccccgaatgggataagccagtgtccgatatccggtacatctcggatggggttgagtgttcccctcccgcatcacctgcaagacctaaccacaggtcccccctgaactcatgtaaggatccttacgggggcagtgaaggcacatttagctag

SEQ ID NO: 123447 - DNA, 1206 bp, Artificial Sequence
  Description of Artificial Sequence: Synthetic coding sequence
atggaggaccccagcggtgccagggagccccgcgcgcgcccacgagagcgagatcccggccggagaccccatcctgaccaagggagaacccatgatagaccaagggatagaccaggagatccccgccggaagaggtcgagcgacggcaaccgtcgtcgggacggggaccgcgaccccgaaagagatcaagagcgcgacgggaacagagatcgcaaccgcgacagggaaagggagcgggagagagaacgggacccagatcgcggtccccgaagggacactcatcgtgatgccggtccccgcgccggagagcacggggtctgggagaagcccagacaatctcgtactagagacggtgcccgcgggttgacgtgggatgcggcagctcccccaggcccagctccatgggaagcccccgagccccctcagccccagcgcaagggtgaccctggcaggcgtcggccggagtctgagcctccctccgaaaggtatttgccttctacaccccggcccgggagagaggaggttgagtattaccagtccgaagccgaagggctcttggagtgccacaagtgcaaatacctctgcaccgggcgcgcctgctgccagatgttggaagttctcctcaacttactgattcttgcctgctccagtgtttcttatagctcaacaggcggctatacaggcataacaagtctgggaggaatctattattaccagtttggtggtgcatacagtggatttgacggagcagacggtgagaaagcgcaacaactagacgtacagttttaccagttaaaactgccaatggtgaccgtcgccatggcctgttccggggcactgaccgcattgtgttgcctctttgttgcaatgggcgtgctgagggtgccttggcactgtcctctgctattagttactgaagggttgctggacatgctgatcgcaggtggttacatccccgctttgtacttctatttccactatctcagtgctgcgtatggcagcccagtgtgcaaggaaagacaggcattgtatcaaagtaagggctacagcggtttcggctgttcgttccacggagccgatataggggccggaatattcgctgcactaggaatcgtcgtctttgctctgggggctgtccttgctatcaaggggtatcgtaaggtgcgaaaattaaaagaaaaaccggccgaaatgtttgaattttag

SEQ ID NO: 123448 - DNA, 1233 bp, Artificial Sequence
  Description of Artificial Sequence: Synthetic coding sequence
atggaggaccccagcggagcacgtgagcccagggcacggccaagagaacgcgatccggggcggcggcctcaccctgaccagggacgaacgcatgatcggccaagggatcgcccaggggaccctagacgcaagaggagcagcgacggaaataggcgacgggacggcgacagggaccctgagagagaccaggagcgcgatggcaacagagaccgtaaccgtgatagagaacgggagcgcgaacgcgagcgggatcccgaccgtggccctaggagggatacccaccgggatgccgggcctagagccggcgagcatggtgtttgggagaagccccggcaaagtcgcacacgcgatggtgcccgtggactgacctgggatgctgctgcccctcctgggcctgccccgtgggaggcacccgaaccaccacaaccacagcgaaaaggggatcctggtcgacgccggcctgagagcgagccaccctcggaacgctatctgccctcaacgccacggccggggcgggaagaagtcgagtactaccaatctgaggccgaagggctcctcgagtgccataaatgcaaatacctttgtactggccggggagtggtccagatcgtggaggtcgtattgaacggtatggtcctcatctgcatcgtggcatcttacttcgtgttggcaggattcagtgcctctttcagcagcggggggggcttcgggaataactattatagtcctttcgagggcactgagctcgagcaggttaggcagctcgaccagcagtacaccatcctgcgttcccccctcatctacggaggtgtcgccgtgtcactaggattaggtgttcttacgatgggcgtgctgttgcagggggcgaagagccggactatgctgtccggtaagtggctgctgacagaggccgcctttagcttgctggcagctgtggggtactgcacagggatcggggtctatctacatgtggctctgcagataaacagcactgacacatgtaagaccagggagcgcctctatgctaggaaaggacttacatggatggactgccagctcgcaggcaccgacggcgccgctgccacctttgcatgtttgttggtcatcatgtacggcgcaagtgtcgtactggcactacgcagttatagggagcaaaagcgctacaaaggctcgagagagcagccaggttcttacagcgatgctcctgagtatctgtggtctggcacactatag

SEQ ID NO: 123449 - DNA, 978 bp, Artificial Sequence
  Description of Artificial Sequence: Synthetic coding sequence
atggacggctccaacgtgacgtcatttgtggtggaagaaccaacaaatataagtactggtcggaatgcctccgttggaaacgcccacaggcagatacccatcgtgcattgggtcattatgtccatttcaccagtcggtttcgtcgagaatggcatcctactttggtttctctgctttaggatgagaagaaacccgttcaccgtgtacattactcacctttctattgctgacataagtttgctattttgcattttcatcctttctattgattacgctctagattatgaactcagtagtgggcactattacacaattgtcactctcagcgttacgtttctatttggatacaacacaggtttgtatcttctgacagctatatcggttgaacgatgcctgtctgttttgtatcctatctggtaccgttgccaccgcccgaagtaccagtctgcccttgtttgcgcactgctgtgggccctgtcatgtttggtgaccaccatggaatacgtgatgtgtatcgatcgggaagaagaaagtcatagccggaatgattgccgagccgtgatcatttttatcgccatcctgtccttcctcgtgttcacacctttaatgttagtgagctccacaatcctagtggttaaaattagaaaaaatacctgggcaagccactcgtctaaactgtacatagtgattatggttaccatcattatctttctgatcttcgctatgcccatgaggctgctctacttgctgtattatgagtactggtctactttcggcaacctgcatcatattagtctgctatttagcactatcaatagctccgcaaacccgtttatctatttctttgtggggtcatcaaagaagaagaggttcaaggagtctctgaaggtcgtcctgactcgggcattcaaagacgagatgcagcctcggcgtcagaaggataactgcaatactgttactgtggaaaccgtggtttag

SEQ ID NO: 123450 - DNA, 1137 bp, Artificial Sequence
  Description of Artificial Sequence: Synthetic coding sequence
atggtatggggtaagatctgttggttctctcaacgggcagggtggaccgtgttcgctgagtcacagatttccctgtcttgctcgctgtgtctgcacagcggtgaccaggaggcgcagaaccccaacctggtctcccagttgtgtggagtctttctgcagaatgagacaaacgagacaattcacatgcagatgtccatggctgtgggccaacaggctctgccgttgaacattatcgcccccaaggctgttttggtttctctgtgcggcgtgctgttgaacggaaccgtcttttggctgctctgttgtggagctacgaacccctacatggtctatatcctccacttggtggcggccgacgtcatctacttgtgttgctctgcagtgggcttcctgcaagtgacacttctgacatatcacggcgttgtcttcttcataccagatttcttggcaatcttgagcccgtttagtttcgaggtatgtctgtgtttgctcgtggccatctcaaccgagaggtgcgtctgcgtgctgtttcccatatggtatcggtgtcataggccaaaatatacgtccaacgtcgtctgcacactgatatggggacttcctttctgtatcaatattgttaaaagtttgttcctgacctattggaaacacgttaaggcttgtgtgatatttcttaaactgtccgggctgttccacgctatcctgtccctagtgatgtgcgtgtcgagtctgacacttctcatcaggtttctctgctgctcgcagcagcagaaggcgactagggtgtacgccgttgtgcagatttctgctcccatgttcctattgtgggcactccctttatccgttgctccgttgatcacggatttcaagatgttcgtgactacctcgtacttaattagcctgttcctcataatcaattctagtgctaacccaattatttacttttttgtcggctcactgcgaaagaagcggctgaaggaatcgctgcgcgtgatactgcagagagccttggctgacaaaccagaggtgggccggaacaagaaggcagcaggaatagaccctatggaacaaccgcactccactcagcacgtagagaatctgcttccaagggagcacagagtcgatgtggaaacatag

SEQ ID NO: 123451 - DNA, 1137 bp, Artificial Sequence
  Description of Artificial Sequence: Synthetic coding sequence
atggtttgggggaagatctgttggttttcccagagggcaggttggactgtttttgccgagagccagatcagtctttcatgtagtctctgcttgcacagtggggaccaagaggctcaaaaccctaatctggtgtcacagttgtgtggagtattcctacaaaatgagaccaacgaaacaatacacatgcagatgtccatggctgttggacaacaagctctgcccctgaacatcatagctccaaaggccgtgctggtgtctctttgtggcgtgttgctgaatggcactgtgttttggctcctgtgctgtggggcaacaaacccttacatggtctacatcctacacctggttgccgccgacgtgatttacttgtgttgtagcgcagtgggcttcctgcaggtgacccttttgacgtaccacggcgtggtttttttcatacctgatttcctagctattctgtccccattcagcttcgaggtgtgcctttgcctgttggtagctattagtactgagaggtgtgtgtgtgtgctgttcccgatctggtataggtgtcatcgccccaagtataccagcaacgtcgtatgcaccttaatttggggtctacccttctgcattaacattgttaaaagtctatttctgacctactggaagcatgtgaaggcctgcgtgatcttcctgaagcttagcggtctatttcatgcaatccttagtttggtcatgtgcgtctctagccttactttacttattagatttctctgctgctcacagcagcagaaggccacgcgtgtatatgctgtcgtgcaaattagtgctcctatgtttctgttatgggctcttccactgagtgtcgcacctctcattacagactttaaaatgttcgtgaccacctcctatctgatttctctttttttaatcataaatagttctgctaatccaatcatctactttttcgtcggatcccttcggaagaagcgattgaaggagagcctgcgcgttatcttgcaacgcgcgttggccgataagccagaggttgggagaaataagaaggctgctggaattgacccaatggagcagccccattcaacacagcacgtcgaaaaccttctccccagagaacatcgcgtagacgttgagacgtag

SEQ ID NO: 123452 - DNA, 1137 bp, Artificial Sequence
  Description of Artificial Sequence: Synthetic coding sequence
atggtatggggaaaaatctgctggttcagccagcgggctggttggacggtttttgccgaaagccaaatctccctcagctgttccctgtgccttcactcgggggatcaggaggcccagaatcctaacctggtttcgcagctttgtggagtgttcttgcagaacgaaaccaacgagactatccatatgcagatgagcatggctgtcgggcagcaggcactgccgcttaatatcattgctcctaaagcagtgctagtgtcattgtgtggggtcttattgaacggcacagttttctggctcctgtgctgcggagctacaaacccctacatggtgtacattctgcacctggtcgccgcagatgtcatctacctctgttgtagcgctgtaggcttcctgcaagtgactctgctgacatatcacggtgtggtgtttttcatcccggactttctggcaatcctgtcccccttcagcttcgaagtgtgcttgtgtttattggtggccatcagcacagaacggtgtgtgtgtgtactcttccccatatggtataggtgccatcgacccaaatacacatctaatgtcgtgtgcacactcatctggggactgcctttttgcatcaatatcgtcaaaagcttgtttctgacttattggaagcatgtgaaggcctgcgtgatttttttgaaactctccggactgttccatgcgattcttagcttggtgatgtgcgtatctagtctaactcttctgattagattcctctgctgctcccagcagcagaaggccacccgcgtgtatgctgttgtacaaatttctgctccaatgttcctgctgtgggccttgccactttctgtcgcgcctctcatcacggacttcaaaatgttcgtcaccacctcatatctgatttccttgttcttaattatcaacagctcagctaatccaattatatatttctttgtgggctccctgcgcaagaagaggctgaaggaatcattgagagttatcctgcagagggccctggcagacaaacctgaagtagggcggaataagaaagccgccggaatagaccctatggagcagccccattccactcagcacgtggagaatttactgccacgcgaacaccgggtggatgtcgaaacctag

SEQ ID NO: 123453 - DNA, 1137 bp, Artificial Sequence
  Description of Artificial Sequence: Synthetic coding sequence
atggtctgggggaaaatctgttggttttcccagagagccggttggaccgtgttcgcagagagccagatctccctttcttgcagcctctgcctgcactctggggatcaggaggcacagaaccccaatcttgtgtcccagctctgcggcgtttttctgcaaaacgaaaccaatgagaccattcacatgcaaatgagcatggccgtgggacagcaggcattacctctgaacattattgccccgaaggctgtgctagtgtcgctgtgcggtgtcctcttgaacggaactgtattctggctgttgtgctgcggcgctaccaacccttatatggtttacatcctgcatctcgtggctgccgacgtgatctacctgtgctgctcagccgttggcttcctccaggtaacactcctgacctatcacggcgtggtgttctttattcccgatttcctcgcaatcctatcccctttctcattcgaggtgtgcctttgtctccttgtcgccatctctacggagcgttgcgtgtgcgtgctcttccccatttggtatcggtgtcacaggccaaagtacacctccaacgtcgtgtgtacactgatctggggcctgcccttctgcattaacatcgtgaaaagcttgtttcttacctactggaaacacgtgaaggcttgcgtgattttcctcaaacttagtggccttttccatgctatccttagtttggtgatgtgtgtgtcctcactgacgttattgatcagattcctgtgttgttctcaacagcagaaagccacccgagtgtacgcagtggtccaaatctcagctcctatgtttctgctttgggccctgccgctgtccgttgcccccttgattacggacttcaaaatgttcgtgaccacctcctatttaatttccctttttctgattatcaattcttccgccaaccctattatttatttctttgtcggaagcctccgcaaaaagaggctgaaggagagcctgcgcgttatcctgcagcgcgcattggctgacaagcccgaggttggccgcaacaaaaaggccgccggcatcgacccgatggaacagccccatagcactcagcacgtcgagaatctgctgccacgagaacatagggtagacgtggaaacctag

SEQ ID NO: 123454 - DNA, 1137 bp, Artificial Sequence
  Description of Artificial Sequence: Synthetic coding sequence
atggtttgggggaaaatctgttggttcagtcaaagggccgggtggacggtgttcgctgagtctcagatatcactgagttgttctctgtgcctacatagtggcgaccaggaagcccagaaccccaacttggtatctcagctttgtggagtctttttgcagaacgaaactaatgagaccatccatatgcagatgtctatggccgtaggccagcaagctctgcccctgaacattattgctcctaaagcagtcttggtgagcctttgcggagtgttgctcaacggcaccgtgttttggctcctttgctgtggcgccaccaatccatacatggtgtatatcctgcacctggtggctgcagatgtaatctatctctgctgcagcgcggtcggatttttgcaagtgacacttctcacctaccacggagtcgtcttttttatcccagatttcttagctattctgtcccccttttcctttgaagtttgcctgtgtctgctcgtggcgatctcgaccgagcggtgcgtttgcgtgctattccccatttggtaccgatgccatcgtccaaagtacactagtaatgtggtgtgcactcttatctggggtctgcctttctgcatcaacatagtgaagagccttttcctcacctattggaaacacgttaaagcatgcgtgatctttcttaagttgtccggactgtttcatgcaatactgtccctcgttatgtgcgttagctctctgacgttgctgattcgatttctgtgttgttctcaacagcagaaagcaacgcgcgtatacgctgtggtgcagatcagcgccccgatgttcctgctgtgggccctcccgctgtccgtcgccccccttatcacggacttcaagatgtttgtgaccacaagctacctgatttcactttttctgatcattaattctagcgctaatcccatcatctatttctttgtggggtccctgcggaaaaaacgtctgaaggagagtttgagagttattctgcaacgggccttggctgacaaacccgaagtaggtaggaataagaaggccgcaggtattgaccctatggaacagccacattctacacaacacgtggagaacctccttcccagagagcaccgggttgatgttgaaacctag

SEQ ID NO: 123455 - DNA, 1137 bp, Artificial Sequence
  Description of Artificial Sequence: Synthetic coding sequence
atggtgtggggaaagatctgctggttttctcaacgagccggttggaccgtattcgctgagagccagatttctctttcttgcagtctgtgtctccactccggtgaccaggaagcccagaaccccaacctggtgtcccaactctgtggcgttttcttgcagaatgaaaccaatgaaacaatccatatgcaaatgagcatggctgtcggacaacaagctctccccctgaacattattgcacctaaggccgtcctcgtgtccttatgtggtgtgctgctgaacggcacagttttttggttactatgctgcggcgccacaaacccatacatggtgtacattctccacctcgttgccgcagatgttatctacctttgctgctccgcggtgggcttcttgcaggtgactctattgacttaccatggtgtagtcttctttatcccagatttcttggcaattctttcacctttttcttttgaggtctgtctgtgtctgctcgttgctatctcaaccgagagatgtgtgtgcgtcctgttcccgatctggtatcggtgccaccggcctaagtatacgtccaacgtggtctgcacccttatctgggggctgcctttctgcatcaacatcgttaaaagcctgttcctgacatactggaagcatgtgaaggcatgtgtgatattcttgaagctgtccgggctgtttcacgccattcttagcctcgtgatgtgtgtcagttctctgacactgttaatcaggtttctgtgctgcagccagcaacagaaagcaacgagagtttacgctgtagtgcagatcagcgcacctatgtttctgctctgggccttgcccttatctgttgctcccctgattaccgatttcaagatgttcgtaaccactagttacctgatctccctgtttctcataatcaatagttccgcaaaccctatcatttatttctttgtgggcagcctgaggaaaaagcggctgaaggagagcctccgagtgattcttcagcgggccctcgcggacaagcccgaggtgggtcggaacaagaaggcggccgggatcgacccaatggaacagccgcacagtacccagcacgtcgaaaacctcctgccaagggagcacagggtggatgtggagacatag

SEQ ID NO: 123456 - DNA, 1137 bp, Artificial Sequence
  Description of Artificial Sequence: Synthetic coding sequence
atggtgtggggcaagatatgttggttctcacaacgcgccggctggactgtgttcgcagaatcacaaatttctctttcctgctccctatgtttgcactccggggaccaagaggctcagaacccaaatttggtctctcagctgtgtggtgtgttcctccaaaatgaaactaacgagaccatacatatgcaaatgtcgatggccgtgggccaacaggctctgcctctgaacatcattgcccccaaagccgtgcttgtgagcctctgtggcgtgttgctgaatggcacagtattctggttgctctgttgtggggcaaccaatccatacatggtgtacattctccacctcgttgcggcagacgttatctacttatgctgctccgcggtgggctttctgcaagtcactttgttgacataccatggcgttgtcttcttcatcccagatttcctggctatactatctccgttcagctttgaggtttgtctttgcttgctggtggctatctcgaccgagcgctgtgtttgcgtattgttccctatatggtacagatgtcaccgacccaagtatacttctaacgtagtctgtacactgatctgggggctgcctttttgcataaatattgttaaatccctgttcctgacctattggaagcatgttaaggcttgcgtcatttttttgaagctgtccgggctctttcacgccatcctgagtttggtcatgtgtgtgtccagcttgacactactcatcagatttctctgttgctcacagcagcagaaggccactcgtgtgtacgccgtcgtgcagataagtgccccaatgttcttgctgtgggctctccctctgagcgtagcaccactgataacagattttaaaatgtttgtgaccacatcttatttgatctccctgttcttaattatcaactccagcgcgaacccaatcatttattttttcgtcggtagtctgaggaaaaaaaggctgaaggagtcactgagggtaatactgcaacgggctctggctgacaaacctgaggtcggacgaaacaagaaagccgccggtatcgaccctatggaacagccacactccactcagcacgtggaaaacctgttgccacgggagcatcgcgtcgatgtcgaaacctag

SEQ ID NO: 123457 - DNA, 1137 bp, Artificial Sequence
  Description of Artificial Sequence: Synthetic coding sequence
atggtctgggggaagatctgttggttctcccaacgggccggatggacagtctttgccgagagccaaatttcgctgagctgttctctgtgcttgcactcaggcgaccaggaggctcagaatcccaacttggttagccagctatgtggagtctttctgcaaaacgagaccaatgagactattcatatgcagatgtccatggctgtgggccaacaggccctgcccttaaacattatcgccccgaaagccgtgcttgtgagcctctgcggcgtgctgttaaatggcacagtattttggctgttgtgctgcggagctacaaatccatacatggtgtatattctacatctggtcgccgccgacgtcatctatctttgttgtagcgctgtcggctttcttcaggtcaccctgctgacataccatggcgtagttttcttcatccctgacttcctagcgattcttagtccttttagctttgaggtgtgcctctgtctcctggtcgctatctccactgaaagatgcgtctgcgtgctgttccccatttggtaccgctgtcataggccaaagtataccagtaacgtggtgtgtactctgatttgggggctgcctttctgtataaacattgtcaagtccctgtttctaacgtactggaaacacgtgaaggcttgcgtaatcttcctgaagcttagcggcctgttccacgccattctgtcactggtgatgtgcgtgagttcactgaccctgctgatccgtttcctgtgttgcagtcagcagcaaaaggcgaccagagtatatgctgtggtgcaaatctctgcaccaatgtttcttctgtgggctctgcctttatctgtcgcgcctctcattaccgacttcaaaatgtttgtgacaactagctacttgattagtctttttcttataattaactccagtgcaaatcctataatctacttctttgtgggctcactgaggaaaaagcggcttaaagaaagtctacgcgtgatcttgcaaagagccctggctgataagcctgaagttggcagaaataaaaaggccgcaggaattgaccccatggagcagcctcactccactcaacatgtggagaacctgctgccccgagagcatagagtggacgtggagacctag

SEQ ID NO: 123458 - DNA, 966 bp, Artificial Sequence
  Description of Artificial Sequence: Synthetic coding sequence
atgaatcagaccctcaatagctcaggaaccgtggaatctgcactgaactacagtcgggggagtaccgtacatacagcatatttggttctgagtagtctggccatgtttacatgcttgtgtggcatggccggcaacagcatggtcatctggcttctggggtttaggatgcatcggaatcctttctgcatttatatccttaacctggcagccgccgatctgttgtttctgtttagtatggcatcaaccctgtcactggaaacccagccactggtgaataccaccgacaaggtacacgagctaatgaaaagactgatgtacttcgcctacacagttggactgtctcttttgaccgcaatctcaactcagcggtgcctctccgtattgttcccaatctggtttaagtgtcaccggccacgacacttaagcgcctgggtttgtggcctgctgtggactttatgtttgttaatgaacggtctgacttcttccttttgtagtaaatttctgaagtttaacgaggatcgttgtttccgggtggacatggtgcaggctgccttgatcatgggcgtgcttaccccagtcatgacgttgtcgagtctcaccctttttgtgtgggtcagacggtcctcacagcagtggagacgtcagccaacacgattgtttgtggtggtcttagcctcagttcttgtgtttcttatctgttcactccccttgtcaatctattggtttgtcctgtactggctgagtctcccacccgagatgcaagtgctctgctttagtttatctcgcctgagctcaagcgtgtccagcagcgcgaacccagtgatctacttcctggtcggctcgcggaggtcccataggctcccgacacggtcattgggcaccgtgctgcagcaggcactcagggaagaacccgagttagagggaggtgagacccccaccgtcggcacaaacgaaatgggcgcatag

SEQ ID NO: 123459 - DNA, 936 bp, Artificial Sequence
  Description of Artificial Sequence: Synthetic coding sequence
atggagcctcgcgaggcaggacagcatgtcggggccgccaacggcgcacaagaggacgtggctttcaacttgatcatactcagtcttacagaaggactgggactggggggcctgctgggtaatggggctgtgctgtggttactgtcctcaaatgtgtatcgaaatccgttcgccatctacttactcgacgtggcctgcgctgatctgattttcctcggatgtcacatggtggccattgtgccggacttgctccagggacggctggattttccaggatttgttcagacttcgctagccacactgagattcttctgctatatcgtaggtctgtccctgctggcggcagtctcagtggagcagtgcctcgccgccctttttcccgcttggtatagttgcagacgtccgcggcacctaacgacctgcgtgtgcgctctcacgtgggcattatgtttgttactgcacttacttctctctggagcctgtacgcagtttttcggggagccctcccggcacctctgcaggactctgtggttggtggcagctgtcctcctggctctgctgtgctgcaccatgtgtggcgcttcccttatgctactgttaagagttgaaagaggtccacagaggcctccacccaggggttttcctggcctgatcctgctgacagtgcttttattcttgttctgtgggctccccttcggaatatactggctttctcggaatctgctctggtacatcccccactacttctatcacttcagcttcctgatggccgccgttcattgcgcagccaagccagtggtgtatttctgcctgggatcagcccaggggcgtagacttccactcaggctggttctgcaacgagccctcggagatgaagccgagctgggggctgtaagagaaacaagccgtaggggtttagtagatattgccgcctag

SEQ ID NO: 123460 - DNA, 939 bp, Artificial Sequence
  Description of Artificial Sequence: Synthetic coding sequence
atgatggagccgcgggaagctggtcagcacgtcggcgccgccaacggggcacaggaggatgttgcctttaacctgattatcctgtccctgactgaaggcctggggctcggcggactgttaggaaatggagctgtcctgtggttactctcttccaatgtgtataggaatccgttcgctatttacttgttggacgtcgcctgcgctgatctgatcttcctgggctgtcacatggtggctatcgttcctgatttactacagggtcggttggacttccctggctttgtccaaactagtctggcaacgctgaggtttttctgctatattgttggactgagtctgctagcagccgttagtgttgagcaatgccttgctgccttgttcccagcgtggtacagttgtcgccgccctagacatctgacgacttgcgtgtgcgccctcacttgggctctgtgtcttctgctacatctgcttctgtccggagcatgcacccagttctttggtgaaccgtctcgccatctgtgcagaacgctttggctggtcgccgcggtgcttctcgcgctcttgtgttgtactatgtgtggggcatccttgatgcttctgctgagagtggaaagagggccacaaagaccccctccccgtggttttcctggcctgattctactcacagtgctcctgtttctgttttgcggtctcccattcgggatctactggctgtctagaaatttattatggtatattccacactatttctatcacttttcctttctaatggcagccgtgcattgtgctgccaaacctgttgtgtatttctgccttggctccgcccagggtcgaagactacctttgcgcttagtgctgcagagagctttaggagacgaagctgaactcggagctgtccgggaaacttccagacgcggactcgtggacatagccgcatag

SEQ ID NO: 123461 - DNA, 1032 bp, Artificial Sequence
  Description of Artificial Sequence: Synthetic coding sequence
atggcgggaaattgctcttgggaagcccacccaggtaataggaataaaatgtgcccgggattaagcgaggcccccgagctttactcaagaggattccttacaatagagcagatcgccatgctacctccaccagccgttatgaactacatattccttcttctgtgtctctgtgggttggttggaaacggtctggttctatggttctttgggttctctatcaaacggaatccattcagtatctactttctgcacttagcatctgctgacgtgggctatctgttcagcaaagccgtgttctctatcttaaacaccgggggtttcctgggaacctttgccgactacattaggtctgtctgcagggttctgggcctctgcatgtttctgactggggtctccctcttaccagctgtctccgccgagagatgcgcgagcgtgatcttccccgcctggtattggcggcgacgtcctaagcgcctcagcgccgtggtatgcgccctcctgtgggtgttatcgttgctggtgacatgtctgcacaattacttctgtgtgttcctggggcgcggggcacctggagctgcgtgccgacatatggacatatttctgggcatcctcctgttccttctctgctgccctctgatggtcctgccatgcctggcactgattcttcatgtagaatgtagagcccgccgacgccagagatcggccaaactcaaccacgtgatactggccatggtgagcgtgttcctggttagtagcatttatttaggaattgactggttcctcttttgggtttttcagattcctgccccttttcctgaatatgtcaccgatctgtgtatctgcataaactcctctgccaagcccatcgtgtattttttggccggcagggacaagtcacagaggttatgggaacccttgagagtcgtgtttcagcgggcactcagagacggcgctgagctcggagaagcaggcgggtcgacacctaacaccgttaccatggagatgcaatgcccaccaggcaacgcctcgtag

SEQ ID NO: 123462 - DNA, 948 bp, Artificial Sequence
  Description of Artificial Sequence: Synthetic coding sequence
atggctggcaactgctcctgggaggcccatcctggtaacaggaataaaatgtgccctgggttgtccgaggcacctgagctttatagccgaggatttctgacaattgagcaaatcgccatgctcccacccccagctgtgatgaactatatcttcctgttactgtgtctttgcggattggtcggaaacggactggttttgtggttcttcggcttcagcattttgaacacgggcggttttctgggtaccttcgctgactatatccgatctgtgtgccgggtcctgggtctctgcatgttccttaccggtgtatccctgctccccgctgtctccgctgagaggtgtgcgtctgtgatattcccagcctggtattggcgacgtcgtcccaaacggctatcggccgtcgtatgcgcactgctgtgggtgctctcgctgctggtgacttgcctgcacaactacttttgcgtgttccttggaaggggggcacctggagcggcctgtcgccatatggacattttccttggcatccttttgttcctcctgtgctgcccattaatggtgcttccgtgcctggcactgatactgcacgtagaatgtcgcgctcggcgtaggcaacgatccgccaagctgaaccacgttatccttgccatggtgagcgtgtttctggttagttctatttacctgggcatcgactggttcctgttttgggtctttcagatccctgcgcctttccctgagtatgttaccgacctgtgtatctgtatcaatagctccgccaaacccattgtttactttttagcgggacgcgataaaagccagcgactctgggagccactccgggtcgtgtttcagcgcgctctgagggacggggcagaactgggggaggcaggcggatcgaccccaaacacagtaaccatggaaatgcagtgtccacccgggaatgcctcttag

SEQ ID NO: 123463 - DNA, 1032 bp, Artificial Sequence
  Description of Artificial Sequence: Synthetic coding sequence
atggccggcaactgtagctgggaagctcacccaggtaacagaaacaagatgtgtccaggattatctgaggctccggagctgtactctcgggggttcctgacaatagaacagattgccatgctcccgcccccagcagtgatgaattatatcttcctgcttttatgtctttgtggattggtggggaatggccttgtgctctggtttttcggctttagcataaaaagaaaccccttctcaatctacttcctccacctcgcatccgcggacgtcggctacctcttctccaaagctgtgttcagcatactgaacaccggtggttttctcggcacatttgctgattacattcgaagtgtgtgtcgggtgctcgggttgtgtatgttccttaccggtgtttctttactgccggctgtgagcgcggagagatgcgcatctgtgattttccctgcctggtattggaggcgtcgacccaaacggctcagtgcggtggtgtgtgctcttttgtgggtactcagcctgctggtcacttgccttcataactacttctgcgtgttcctcggccggggagctcctggggccgcttgtagacatatggacatcttcctgggcatcttgctctttttgttgtgctgtccactgatggtgctaccttgcctcgcactgatcctgcacgtggaatgtagagctaggcgacgacagaggagcgcaaagcttaaccacgtaattctcgcaatggtgagcgtcttcttagtgtcaagcatctacctcggtattgactggtttctcttttgggtgttccagatccccgcccccttcccagagtacgttaccgacctgtgcatctgtattaacagctctgcaaagcccattgtttattttttggcagggagggacaaatcacagaggctctgggagcctcttcgggttgtcttccagcgggcccttagagacggcgctgaactgggggaggccggcgggtctactcctaatacggtaactatggagatgcagtgccccccaggaaatgcttcgtag

SEQ ID NO: 123464 - DNA, 870 bp, Artificial Sequence
  Description of Artificial Sequence: Synthetic coding sequence
atgtttgggctcttcgggctttggcgtacctttgattctgtggtattttacttaacactcatagtcggactcggcggacctgtaggaaatggcctcgtgttgtggaacctaggctttcgtatcaaaaaaggtcctttctctatctatctgctccatctcgcagctgcagactttctattcctgtcttgccgagtcggcttctccgttgcacaagcagcactgggggcccaggatacactctatttcgttttgacattcctctggttcgcggttgggctgtggttattggccgctttctctgtcgagcggtgcctgagcgatctgtttcccgcctgctatcagggatgtaggccccggcatgcctccgctgtcctgtgcgcactggtgtggacgccaactttacccgccgttccactccccgccaacgcttgtgggttgctcagaaactccgcctgtccgctggtttgcccacggtatcacgtcgctagcgtgacctggtttttggtgctggcaagggtagcatggaccgctggtgtggtcctattcgtgtgggtcacatgttgttccactaggcctaggccccgcctttatggtatcgtgctcggtgcgctgttgttattgttcttttgcggactcccatccgttttctactggagtctgcagccgttgctgaacttcctgctccccgtgtttagccccctggcaaccctcttggcatgcgtgaactccagttctaagcccttgatctattctggcctggggcgacagcctggcaaaagagagcccctgcgatccgtactcagacgggcactcggggaaggtgcagagctaggagcaaggggacagtcactccctatgggcttactgtag

SEQ ID NO: 123465 - DNA, 969 bp, Artificial Sequence
  Description of Artificial Sequence: Synthetic coding sequence
atggatccgactatcagtacactggacacggagctgactcccattaatggcactgaggagaccctttgctataagcagactctatctctcaccgtgcttacttgtatcgtcagcctggtgggactcacaggaaatgccgtcgttctgtggctcctgggatgtcgcatgcgacgcaacgctttctccatctacatcttaaacctcgccgccgcggacttcctatttctcagcgggcgcctcatttattccttgctgagcttcatatcaattcctcacaccattagcaagatcctctaccccgtcatgatgtttagctactttgctggactctcatttctgtccgctgtgtccacagagagatgcctgagtgtactgtggcccatatggtacagatgtcacagacctacccatctgtctgctgttgtgtgcgtgctgctgtgggccctgagtctgcttagatctatcctggagtggatgctgtgcggttttctgtttagcggcgctgactccgcgtggtgccagacttcagactttattactgtggcttggctgatatttttatgcgtagtgctttgcgggagttccctggtccttttaatcagaatcctgtgcgggtctagaaaaatccctctgacacgactgtatgtgacgattcttctgaccgtgctggtgttcctgctgtgtggactgccctttggcatacagtttttcctgttcctgtggatccacgtcgatcgtgaagtgctgttctgccacgtgcaccttgtgagtatattcctgtctgccctgaattcatctgccaatcctattatctactttttcgtcggaagcttccgacagcggcagaataggcagaatctgaagctggtgctgcagcgagcactacaagatgcgtcagaggtcgatgaaggaggcgggcaactccccgaagaaatcttggagctgtccggctcacgactagagcagtag

SEQ ID NO: 123466 - DNA, 993 bp, Artificial Sequence
  Description of Artificial Sequence: Synthetic coding sequence
atggaccccaccactcctgcctggggcactgagtccacaaccgtgaacgggaatgaccaggcactacttctcctgtgcggtaaagagaccctcatccccgttttcctgattctcttcattgcgctggtgggtctcgtaggaaacggcttcgttttatggctacttggatttcggatgcgtcggaatgccttttccgtctacgtcctgtccctggcaggagccgactttctgtttctctgtttccaaatcattaattgcctggtttatctctcaaatttcttctgcagcatatcgatcaatttcccatcctttttcactacagtaatgacctgcgcatatctcgctggactctctatgctctcgaccgtgtctaccgagcgctgtctgagtgtcctttggcccatttggtacaggtgtcgtcggcctcggcacctgagtgccgtcgtgtgcgttctgttgtgggccctatccctgctgttgtctattcttgagggaaagttctgcggcttcctgttttctgatggagacagtgggtggtgtcagactttcgatttcattacggctgcatggctaatatttcttttcatggtgttgtgtgggagttccctggctctgctcgtgagaatcttatgcggtagcagaggcctcccattgacccgcctgtaccttacaattctgctgactgtactggtgtttctgctttgtggcttaccttttgggattcagtggttcctgatcctctggatctggaaggatagtgacgtgctgttttgtcacattcatcctgtgagcgttgtgttgagtagcttaaactcaagcgcgaaccccattatctacttcttcgtgggatcattccgaaaacagtggcggcttcagcaacctatactgaagctggcactccagcgtgctctccaggatatcgcggaagtcgatcactcagagggatgttttcgccagggaactcctgaaatgtctcggtccagcctggtgtag

SEQ ID NO: 123467 - DNA, 969 bp, Artificial Sequence
  Description of Artificial Sequence: Synthetic coding sequence
atggacagcaccatcccagtgctgggcacagagctgacgcccatcaacggacgggaggagacaccatgttacaagcagacgctatcatttaccgggttgacttgcatcgtaagtcttgtcgccctgaccggcaatgccgtggtgctgtggctgttggggtgcaggatgcggaggaacgcagtaagcatctacattcttaacctcgtcgcggccgacttcttatttttgagtggacatattatttgtagccccctgagattgatcaacatccgacatcctatctccaagattctgtctcccgtaatgacatttccatacttcatagggctttcgatgctgtccgccattagcacagagcgctgtttgtcgattttgtggcccatatggtaccattgcagacggccgcgatatctgtcctccgtaatgtgcgttctgctgtgggccctgtctctgctaagaagtatcttggagtggatgttctgcgattttctcttctcaggagccaatagcgtgtggtgcgagacatctgacttcataaccatagcatggctcgtgtttctgtgcgtggtcttgtgcggttcttctcttgtgcttctggttagaattctgtgtggatcacgcaaaatgccactcacaagactttacgtcaccattctactgacagtgcttgtctttttattatgtggactcccctttggtatccaatgggctctgttttctcggatccacttggattggaaggtcttgttttgccacgtccacctggtcagcatctttttgtctgcactgaactccagtgctaatccaattatatacttctttgtgggttcattcagacaacgtcagaaccgacagaatcttaagcttgtgttgcagagagccctccaggacaccccggaagtggacgagggcggggggtggctgccacaggaaactttagagctgagcggatcaaggttagaacagtag

SEQ ID NO: 123468 - DNA, 741 bp, Artificial Sequence
  Description of Artificial Sequence: Synthetic coding sequence
atggactcaacaatcccggtgttgggcacggagctgactccaatcaatgggcgcgaggaaactccttgctataaacagaccctgtcctttacaggcctgacatgtatcgttagtttggtggctttgaccgggaatgctgtcgtgctgtggctgctcgggtgcaggatgcggcggaacgcggttagtatatacattctgaatctggtggcggcagacttcctctttttatctggtcatattatatgtagcccactgaggctgatcaacatcaggcaccccatatccaagattctgtcccccgtaatgaccttcccctatttcattggcctttccatgctgtctgccatctctacggagaggtgcttgtccattctctggccaatctggtatcattgcagaagaccccggtatctctcatctgtaatgtgcgtgttgttatgggcactgagccttctccggtccattcttgaatggatgttttgtgactttctattttcaggtgccaacagcgtttggtgcgaaacatccgattttatcactatcgcctggctcgtctttctgtgtgttgtgctttgcggttcatcactagtcttgctggttcgtattctctgcggaagtcgtaagatgccgctgactcggctgtatgttacaatcctacttaccgtgctggtattcctcctatgtggtctgccctttggtatccagtgggccttgttcagccgcatccatctcgactggtag

SEQ ID NO: 123469 - DNA, 969 bp, Artificial Sequence
  Description of Artificial Sequence: Synthetic coding sequence
atggaccccacagtgccggtttttggcaccaagctgacacctatcaatggaagagaggaaacgccatgctataaccagacactgtcctttaccgtcctgacgtgtattatcagccttgtgggcctcacaggcaacgcagtggtgctctggctgctgggttatcgtatgcgccgcaacgctgtgtcaatctacatcctgaatttggctgccgctgacttcctgtttctgtcattccagataataagactccctcttaggctgatcaatatctctcacttgatcaggaagatcttggtgtccgtgatgaccttcccatactttacagggctttccatgctgtccgccatttctacggaaagatgcctgagcgttttgtggccgatctggtacaggtgcagaaggcccacccatctctcagccgtggtgtgtgtgctgctctgggggctgtccctgttattcagcatgctggaatggagattttgcgactttctcttcagtggggctgatagtagctggtgtgagactagtgacttcatccccgttgcttggcttatattcctttgcgtagtgttatgcgtgagtagtctcgtgttgctcgtgcggatcctgtgcgggtcccggaagatgccccttacgagactttatgttaccatcctgttgaccgtactggtgttcctgctctgtggattgcccttcggcatattaggggcgctgatctatagaatgcatctcaaccttgaggttctgtactgtcacgtgtacctcgtttgtatgtctctgtcttctctcaattcatcagcgaacccaattatctatttctttgtgggatccttccgtcaaaggcaaaatagacagaatctgaaattggtgctccagcgtgccctccaggataaacctgaagtcgataaaggagagggtcagttgcctgaagagtcacttgaactgtccgggtctagacttggcccatag

SEQ ID NO: 123470 - DNA, 3051 bp, Artificial Sequence
  Description of Artificial Sequence: Synthetic coding sequence
atggtcctgcccacatgtcccatggctgaatttgccctgcctagacacagcgccgttatggaacgccttcgaagaagaatcgagctttgccggcggcaccactcaacttgcgaggcacgctacgaagccgtttcacccgagaggcttgaactagagagacagcacacttttgccctgcaccaacggtgcattcaggccaaagcaaagcgcgcagggaaacatagacagccccccgcggcgactgcccctgcacccgcggccccagctcccagactggacgcagctgacgggccagagcatggacgccctgctacccatttacacgataccgtgaagagaaacctagatagtgctacttccccccagaacggagatcagcagaatggctacggggacctctttccaggacataagaagacccggcgagaggcaccactcggcgtggcaatctccagtaacggccttccaccggcctctcccctcggtcagtccgacaaaccttctggagccgacgccctccagtcttcagggaagcatagtctcgggctggactccttgaataagaagaggctggcagattccagtctacacctgaacggtgggagtaatccctctgagtcatttcctctttcgttgaacaaagagcttaaacaagaaccagtggaggacctaccatgtatgattactggcaccgtgggtagtattagccagagtaatctcatgcccgatctgaatctaaacgagcaggagtggaaggaattgatcgaggagctgaaccgcagcgtgccagacgaggacatgaaagatctgtttaatgaggatttcgaagaaaagaaagaccctgaatccagcggttcagccacgcaaacaccattggctcaagacattaacattaagaccgagttttcacctgccgcgttcgaacaagaacagctcggatctcctcaggtccgcgcagggtctgctggacagacttttctgggcccatcctccgctcccgtgtcaactgacagcccatccttaggaggaagccagactctattccacaccagtggacagcctcgtgctgataatccaagccccaatctcatgcccgccagtgcgcaagctcaaaacgcgcagcgggccttggcaggagtggttttgccctcccaggggcccggcggcgcctccgaattgagcagtgcccatcaactgcagcaaatcgccgccaagcagaagcgtgagcagatgctgcaaaacccacagcaagcgacccccgctccagcccccggccagatgtccacatggcaacagacaggaccgtcccatagctccctggacgtaccctatcccatggagaagcccgcaagtccatcatcttataagcaagatttcactaactccaagctgctgatgatgccttctgtaaataagagcagccctagaccagggggcccctatctgcagcccagccacgtaaacttgctgtctcatcagcctcctagcaatcttaaccagaacagcgctaataatcagggcagcgtgctagactatggcaatacgaagcctttaagccactacaaggcagactgcgggcagggttcccccggaagcggacagtctaaaccagccttaatggcatacttaccacaacaactcagtcatatctctcacgagcaaaacagtcttttcctgatgaagcctaagccaggaaacatgccattcagaagtttagtcccccccgggcaggagcaaaacccttccagcgtgcctgtccaagctcaggctacctccgtgggcacccaacctcctgccgtctccgtggcttcttcacacaactcctccccatacctgagtagccaacagcaggcagccgttatgaagcaacaccagctcttactggaccaacaaaagcaacgggaacagcagcaaaagcatctccagcaacaacagtttctgcagcggcagcagcacctgttagccgagcaggagaaacagcagtttcagagacatcttacccgcccaccacctcagtatcaggacccgacacaggggagcttcccgcagcaagtaggtcaattcaccggcagctctgccgctgtgcctggcatgaataccctcggaccatcaaactctagttgccccagagtttttccccaggctggcaatctcatgcctatgggccctggccacgcgtccgtgtcttccttgcctaccaactcgggtcagcaagatagaggcgtcgctcagtttcctggatcccagaacatgccccagtcaagcttgtacggcatggcctctgggattacccagattgtcgcccagccacccccccaggccaccaacggccatgcccacattcctcgccagactaatgtgggacaaaacacatcagtgagcgccgcctacggacagaattctctcgggagcagcggcctgagccagcagcataataagggcaccctgaatccaggtctcactaagccccctgtgcccagggtatcaccggctatgggcggccagaacagttcttggcagcatcagggtatgccgaacctgagtgggcagactccaggtaatagtaatgtgagcccatttaccgccgcttcaagctttcatatgcagcagcaggcacacttgaaaatgtcctccccccagttttctcaggctgttcccaacaggcccatggcccccatgtcgtccgccgcagccgttgggagtctcctgccgccagtgagcgcacaacagcgaactagcgcccctgcccctgctccaccccctaccgcaccccagcagggcctgcccggactcagtcccgccgggccagaactgggggcattcagccagtcccctgcctctcagatggggggccgcgccggtcttcactgcacacaggcctatcccgttcgcaccgcaggacaagagcttcccttcgcctactccggtcagccaggaggctctggtttatcatccgtcgccggacacactgacttgattgatagcttgttgaaaaatcggacaagcgaggaatggatgtccgacctggacgatcttttaggctcccagtag

SEQ ID NO: 123471 - DNA, 2286 bp, Artificial Sequence
  Description of Artificial Sequence: Synthetic coding sequence
aggggtaaacagtggggtcggggcggtggtgagagaccccgtcttgaagttggctctaaacgacgcttgggtgtcggaccttccggagccgggggtaaaccagccgccgcacgtgaacccgctcccttgccatcaggcgcctggaggggccgcgaggcagagcggggttccagaggggagcgaagcccccaatgccagcccgcccctagagggccggctcccggacccgctagggccgcccgcggcccctggtgttgtcctcccgcgccttggaggtcctcacgttgtcggggaacagcccgcagctggtcggcatttgctggggcgtcctcttgcgccggagccaccaccgcgccggcaaggcccgctgccccggcccccaggttagatgcagccgacggcccagagcatggtagaccagctacgcacttgcacgataccgtgaagcggaatctggattctgcaacttccccacagaacggagaccagcagaacgggtacggagatttgttccccggccataaaaagacaagacgtgaagctcctctgggcgtagcaatctcgagcaacgggctgcctcctgctagtccacttggccagtcagacaaaccgtcgggcgccgatgctctacaatcctctgggaaacacagcctgggcctggactccttgaataaaaaaagactggctgatagcagcctgcatctgaacggcgggtctaacccttccgagtcatttcccttgtcgctgaataaggagctcaagcaagagcctgtggaggacctgccctgcatgataacggggaccgttggctccatttcccaatccaaccttatgcctgatctgaatctaaacgagcaagagtggaaggagcttatcgaggagcttaacagaagtgttcctgacgaggacatgaaggacctgtttaatgaagatttcgaggagaagaaggatccggagtcatcggggagtgcgactcaaacccctctcgctcaggacatcaatataaagactgaatttagcccagcagcgttcgaacaagaacagctggggtccccacaggtgagagctgggtcagccgggcagaccttcctggggccctcttctgccccggtgtccaccgacagtccctcgctgggcggctcccaaactttgtttcataccagtgggcaacccagggcggataatccatcccctaatctgatgccagccagcgcacaggcccagaacgcgcagcgcgctctagctggagtagtgctaccatcccagggccccggcggcgcatcagaactgtcaagcgcccaccagctgcagcaaatcgccgcaaagcagaagcgtgagcaaatgctccaaaaccctcagcaggccaccccagccccagcgccaggacagatgagcacatggcagcagactggtcccagccattcatcgctggatgtgccttaccccatggagaaacctgccagcccgtcttcctacaagcaggacttcacaaatagtaagctgttgatgatgcctagtgtgaacaaaagttcacccagacccgggggcccctacctgcagcccagccacgtgaacctcttgagccatcaacctccttcgaacttgaatcaaaactcggctaacaaccaggggtccgtactcgactatggaaacacgaaaccgttgtcacactacaaggcagactgcggccagggcagccccggatcaggccagtccaagccggcattgatggcctacctaccacagcagctctctcatatttcacacgaacagaattcactctttctcatgaagcctaagccaggcaatatgccttttcggtccttggttcccccaggccaggaacaaaacccctcatctgtacccgtgcaggcgcaggccacgagtgtgggcacacagccgcctgcagtgagcgtggcctcttcccataattcaagtccgtatttgagctctcagcagcaggcggcagtgatgaaacaacatcagttattgctcgaccagcagaagcagagagaacaacagcagaagcacctgcagcaacagcaatttctccagaggcaacagcaccttcttgctgagcaggaaaaacagcagttccagcgtcacctgacgagaccacctccccaatatcaggatccaacccaagggagctttcctcagcaagtaggccagttcactgcgcagggcctgtcatgcgctctcccaatgatccactccactgaagtgctgatttcctcgttatgtaatggatctgcaggcctgagcgccgctcagcgaagctggtag

SEQ ID NO: 123472 - DNA, 3471 bp, Artificial Sequence
  Description of Artificial Sequence: Synthetic coding sequence
atgggtgatactgcgcccccacaagctcccgccggtggtctggggggggcttctggtgccgggcttttgggaggaggctcagtaacccccagggtacatagtgccatcgtggagcgtctgagagcacggatagctgtgtgtaggcagcatcatctctcttgtgaagggcggtacgagagagggcgagccgagagctctgatcgggagcgtgagtccactcttcagctgctgtccctagtgcagcacggtcagggcgctaggaaggctgggaagcacactaaagccactgcgacggccgccacaaccacagccccacccccgccgccagctgcgcccccagcggctagtcaggcggccgctactgccgcaccaccccctccacctgattaccaccaccaccatcagcagcatctgcttaattcaagtaacaatggcggctcaggagggatcaacggagagcagcagccccccgcttcgacccccggcgaccaacgaaactcggcccttattgccctgcaagggtctctgaaacggaagcaagtggtgaacttaagcccagcaaattccaagcgacctaatgggttcgttgataatagcttcttagatatcaaaagaattcgggtgggggaaaacttgtcggctgggcagggcggattgcaaattaataacggccagagccagatcatgtccggaacgcttcccatgagccaggcaccgctgcgcaagacgaacactcttccttcacacacccattcacctggtaacgggctttttaatatgggtttgaaggaagtcaagaaggagccgggcgagacgctgtcctgctctaagcacatggacggacaaatgacccaggagaacatttttcccaatcgctatggtgatgacccaggcgagcagttaatggatcctgaactgcaggagcttttcaacgagcttacaaatatcagcgtcccacccatgtccgatttggagctcgaaaatatgataaacgccaccatcaagcaggatgatccatttaatatcgatctcggtcagcagtcccaacgatctacacctaggccgagtcttcctatggagaaaatagtcataaaaagcgaatatagccccggactcacccagggcccgtccggatcaccacagctgcgccctccttctgcagggcccgctttttccatggccaattccgccctgtcaacaagtagcccaattccctctgtgcctcagtcacaagcacagccacagaccggttcaggagcctcccgcgcacttcctagctggcaagaagtcagtcacgcccagcagctgaaacagattgcagctaaccgccaacaacacgcccgcatgcagcaacatcaacagcagcatcaacccaccaattggtcagccctgccgtcgagcgcagggccgagcccaggaccattcggacaggagaaaatcccaagccccagttttggacagcagacattctctccacagagttcaccaatgcccggtgtggcaggaggtagtggccaatctaaagttatggccaactacatgtacaaggccggacccagtgcacaagggggtcatctggatgtcttgatgcagcagaaaccacaagatttgagtcggtccttcattaacaatccacaccctgctatggagcctaggcaggggaacaccaagccattgtttcacttcaactcggaccaggccaaccagcagatgccttcagtcttacctagccagaacaaaccaagtttattgcattacacccagcagcagcagcagcagcagcagcagcagcagcagcagcagcaacagcagcagcaacagcaacaacagcagcagcagcagcagcaacagcagcagcagcagtcctccatcagcgcccagcagcagcagcagcagcagtcctccatcagcgcccagcagcagcaacaacaacaacagcagcagcagcaacagcagcaacagcagcagcagcaacagcagcaacagcagcaacagccctcgagtcagcctgcacaaagcctgccttcccaacctctgctgcgttcccctctgccgttacagcaaaaactcctgctgcagcagatgcaaaatcaaccaattgcagggatgggatatcaggtaagtcaacaacagagacaggatcaacacagcgtggtcgggcaaaacactggaccatccccttcacccaacccttgttctaatccaaatactggatctggctacatgaactcacaacagagccttctaaaccagcagctcatggggaaaaaacagaccctacagcgacagattatggaacagaagcaacagctactgcttcagcagcagatgttggcagacgctgagaagattgccccgcaagaccagatcaatagacacctgtcacgacccccccccgattacaaggaccagcggcgcaacgttggcaacatgcagcccactgcccagtactccgggggatcttctaccatctccttgaactcaaaccaggccctagcaaatcccgtgtcaacgcatactattctgaccccgaatagttccttattatcaacctcccatggcacccgcatgccttccctcagtactgctgtgcagaacatgggcatgtatggtaacctgccctgcaatcagccaaacacctattccgtgacatccgggatgaatcagctgacacaacagagaaacccgaagcaactgctggccaaccaaaacaaccccatgatgccgagacctccaacactcggcccaagcaataacaataatgtcgcaacgttcggggccggaagtgtggggaactctcagcagctgcgaccgaacctcacgcacagcatggcctccatgcctccgcaaagaacctcaaacgtgatgattacttcaaacacaaccgcaccaaattgggcttcacaagaaggaacaagcaaacagcaggaagccttaaccagcgccggagtgagatttcctacaggcaccccagcagcttacacaccgaatcagtcccttcagcaagctgtaggaagccagcagtttagccagcgggctgtggccccccccaaccagcttacccccgctgtgcagatgagacctatgaatcaaatgagccaaactctaaacggccagaccatgggcccactgagagggctcaatttgagaccgaaccagctgtctacccagatcctgcctaaccttaatcagagcggcaccggtctaaaccagtcccgaaccggtatcaatcaacccccatctctcactccatcgaacttcccttcgccaaatcagtcatcacgagcatttcagggaacagatcactctagcgatttagctttcgattttctctctcagcagaatgataacatgggacctgctctcaacagtgacgccgattttattgacagcctgttaaagacagagcccggaaatgatgattggatgaaagatatcaatctggatgaaatcttagggaataatagctag

SEQ ID NO: 123473 - DNA, 3471 bp, Artificial Sequence
  Description of Artificial Sequence: Synthetic coding sequence
atgggagacaccgcaccacctcaagcaccagccggcggccttggtggcgcctccggtgccggccttctggggggaggatcggtaactccaagagttcactctgcaattgttgagagactcagggccaggattgctgtctgtaggcagcatcacttatcttgcgaaggtaggtacgaaaggggcagggccgaaagctctgaccgcgaacgcgaatccacacttcagctcctttcgctcgtgcaacacggacaaggcgccagaaaggccggcaagcacaccaaggctacagcgacagccgctacaacaactgcacctccaccaccaccagcagcgccaccagctgcttctcaggccgcagcgaccgccgcccctccgcctccaccagactaccaccaccatcaccagcagcatctgcttaatagttccaacaatggaggctctggtggtatcaatggagaacagcagccaccggcatcaacacctggagaccaaagaaactccgcgctcattgcgctgcagggtagcctgaagcgtaaacaggtcgtaaacctgtcacccgcgaattctaagaggcccaatggcttcgtagataatagctttctagacattaagagaattcgtgttggcgaaaacttgtccgctgggcagggtggacttcagatcaacaatggtcaatcacagatcatgagcggcactctccccatgagccaggccccactgaggaagactaatactctaccgtcacacacccacagtcccggtaatggcctgttcaatatgggcctgaaagaagtgaagaaagagcccggcgagaccctgtcttgtagcaagcatatggatggtcagatgacccaggaaaacatcttcccaaatcgctatggtgacgatccgggcgaacagctgatggacccggagttgcaggaactcttcaacgagctgacaaacattagcgttccccctatgtccgaccttgaactggaaaacatgataaatgctaccattaaacaggacgaccccttcaacatcgatctcggtcagcagtcccagcggagcacacctcgcccctcactgcccatggagaaaatcgtgattaaaagcgaatactcccccgggctgactcagggcccaagtggctcacctcagctgagacctccaagcgccggacccgccttctcaatggctaatagcgccctttccacctcctcacctatcccatcagtcccccaatcccaagctcagccccaaacaggctctggggcatctcgagccctgcctagctggcaggaagtgtcacacgcacagcagctaaagcagattgcggctaatagacagcagcacgctcgcatgcaacaacaccagcaacaacaccagcccacaaactggtcagctctgcccagtagtgctggcccaagcccaggccccttcggccaggaaaagataccgagcccaagcttcggccagcaaactttcagccctcagagttccccaatgccaggcgtagccgggggaagcggccaaagcaaagtgatggccaactacatgtataaagctggaccaagtgctcagggcggccacctcgacgtgcttatgcagcagaaacctcaggatctgtctcggagttttattaataacccgcacccagccatggaaccaaggcaaggcaatacgaagcccttattccatttcaactctgaccaagctaaccagcaaatgcctagcgtccttccatcccagaataagccctcactattacattacacacaacagcagcagcagcagcagcaacaacaacagcagcaacaacagcagcagcagcagcagcagcagcagcagcagcagcagcaacagcaacagcagcagcagtcgtccattagcgcccagcagcagcagcagcagcagtcatcaatctctgctcagcagcagcagcagcagcagcaacagcagcaacagcaacagcagcaacagcaacagcaacagcagcagcagcaacagcaaccaagttcccaacccgcacagtcacttccttcccagcccttgttacggagccctttgccattacagcagaagctcctgctgcagcagatgcagaaccagccaatagccgggatgggttatcaagtgtctcagcagcaaagacaggaccaacactccgtcgtaggccagaatactggtccctcacctagtccaaatccttgctccaacccaaatactggatccggttacatgaactcacagcagtctctactgaaccagcagctgatgggtaagaagcaaaccctccagaggcagattatggaacaaaagcagcagctgctgctgcagcagcagatgttggccgatgcagagaagatcgccccgcaggatcaaattaacaggcacctgagcagaccgcccccggattataaagaccaacgacggaacgtaggtaacatgcaacctactgcacaatatagcggcggatcctcaaccatcagccttaactccaaccaggcactagcgaatcctgtaagcacgcacactatcctgactccaaattctagtctgctgtctacctctcatggcactcgaatgcctagtctcagtactgccgtgcagaatatgggaatgtatgggaatctgccctgtaaccagcccaatacgtactcagtcacatcaggtatgaatcagttaacccagcagcggaatccgaaacaactgctggctaaccaaaacaatccaatgatgcccaggccacccacactaggcccaagcaataacaacaatgtcgcaacctttggtgccggctccgtcggtaattcccagcagctacgccccaaccttacccatagtatggcctccatgcccccacagcggacctcaaacgtgatgatcaccagtaacaccacagccccaaactgggctagtcaagagggtacatcaaagcagcaggaagcactcacctccgccggcgttcggtttccaaccggtacccccgccgcttatacgccaaaccagtctctccagcaggccgtgggatcacagcagttctcacagagggcagtcgctccccctaatcagcttactcctgctgtccagatgcgtccaatgaatcagatgagtcagacgctgaatggtcagaccatgggcccccttcggggattaaacctgcgcccaaatcaactgagtacccagatattacccaatctaaaccagtcaggcactgggttgaatcaaagccgcacagggattaatcagcccccttcactaacacccagcaacttcccatcaccaaatcaaagcagtagagcgtttcaaggtaccgaccactcatccgatctcgcgttcgatttcctttcccaacagaatgacaacatgggcccggcactcaactccgacgccgatttcatcgatagcctgttgaagacagaacctggaaatgacgattggatgaaagacatcaatctcgacgagatacttggcaataacagctag

SEQ ID NO: 123474 - DNA, 1632 bp, Artificial Sequence
  Description of Artificial Sequence: Synthetic coding sequence
ttacaagagactgtcaaacggaagttagagggagccaggagcccgctgaacggggatcaacagaatggggcgtgcgatgggaatttctcgcctaccagtaaaaggatccggaaggacatcagtgctggaatggaggccatcaacaatctaccgtctaatatgccactgccctctgctagccccctgcaccagttggacttgaaaccatcgctcccgctccaaaattcagggacacatacgcctgggctgctcgaagatctgtcgaagaatggcagacttccggaaattaagcttccagtcaatggatgtagcgacctcgaggactccttcacaattctgcaaagcaaggatctcaaacaggagcccctcgatgaccccacgtgtatcgacactagtgagacaagcctctcaaaccaaaataaactgttcagcgatatcaacttaaacgaccaggagtggcaagagcttattgatgagttggctaacactgtgcctgaggatgacatccaagaccttttcaatgaggatttcgaggaaaagaaagagcccgagttcagccagcccgcgactgagacgcccctctcccaggagtctgctagcgtgaagagcgatccaagccactcacctttcgcacacgtctctatggggtccccacaagcacgcccatcctcgtcagggcctcccttctcaaccgtttctaccgcgacatctctgccatcagttgcatccaccccagccgcacccaatccggccagctcgcctgccaattgcgcggtgcagtccccgcaaacccccaatcaggcacatacgcctggacaagctcccccgaggcctggtaatggctatttacttaatcctgctgccgtgactgtggctggttcagcaagtggccctgtggcagttcctagtagcgacatgagtccggccgagcagctgaaacagatggccgcccagcagcagcaacgggccaagctgatgcagcaaaagcaacagcaacaacagcagcagcagcagcagcagcaacagcagcagcaacagcaacaacagcagcaacaacagcagcactccaatcagaccagcaactggagccctctgggaccacccagcagtccctatggcgccgctttcactgcagaaaagccaaattcccccatgatgtacccacaggcatttaacaatcagaaccctatagtcccccccatggccaacaatctacagaaaacaacaatgaacaattatcttcctcagaaccatatgaatatgatcaatcagcagcccaacaacttaggcaccaacagtttgaataagcaacataatatactcacatacggtaacaccaagccactcacacattttaacgccgatctcagccaacggatgactcctcccgtggccaaccccaataaaaatcctctgatgccatacatccagcagcagcagcagcagcagcagcagcaacagcagcaacagcagcaacagcagcccccacccccacaactccaggcacctcgcgcccacctctccgaggatcaaaagaggctactccttatgaaacagaagggagtaatgaatcagccgatggcctacgctgctctgccctcccacgggcaggagcagcagcctgttgggtag

SEQ ID NO: 123475 - DNA, 831 bp, Artificial Sequence
  Description of Artificial Sequence: Synthetic coding sequence
atgtctcccgcggagcagctcaaacagatggctgcccagcaacaacagcgggctaagctgatgcagcaaaagcagcagcagcaacagcagcagcagcagcaacagcaacagcagcattctaatcagacttcaaattggtcccccctggggccacccagttccccttacggagcagcttttaccgcagaaaaacccaattcccctatgatgtaccctcaggcgttcaacaaccagaacccgatcgtgcctccaatggctaacaacctacagaagaccaccatgaataattacttacctcagaatcacatgaacatgattaaccagcagcctaataacctggggaccaacagtctgaacaaacagcataacatcctgacttatgggaacacgaaaccgctcacacactttaatgctgacctttcacagaggatgacacctccagtcgccaacccaaataaaaatccactgatgccctacatacaacagcaacagcaacaacaacagcagcagcaacagcagcagcagcagcagcagcccccaccgccccagctccaggcccctagagcccatctgagcgaggatcagaaacgcctgttactcatgaagcagaaaggcgtgatgaaccagccaatggcctacgcagccctccctagccatggacaggtctctgtaaaggtgacgcattctagctcctcttcttgcggtgcctttgattgtagatgcgtcatgttttataaatctaccgtggtcggatccaattgtctgcagaaaactagtctccatccacaggtggttgcacgttttggagtctttttttttcacttcagttag

SEQ ID NO: 123476 - DNA, 3417 bp, Artificial Sequence
  Description of Artificial Sequence: Synthetic coding sequence
atgggagatttcgctgcccctgccgccgcagcaaacgggagctccatctgtataaactcttctcttaactcgtccctgggcggggcgggaatcggagtgaataatacccctaactctacccccgccgctccctcttccaatcaccctgctgccggcggatgtggcgggtcgggagggccaggaggcgggtcagctgcagtaccgaagcatagtactgttgtggaacgcctgaggcagaggattgaaggttgtagaagacaccacgttaactgtgagaacaggtatcagcaggcccaggtggagcagttggaactggagaggagggacactgtgtcattgtaccagcggaccctggaacagcgcgctaagaagtccggggcaggaactggaaaacaacagcacccgagcaagcctcagcaggacgccgaagctgcctccgccgaacaaagaaaccacaccctgatcatgctccaggaaaccgtaaagcggaaactggaaggtgcccgctcacctctgaatggagatcagcagaacggcgcttgcgatgggaactttagccccacatcgaaacgcattcgaaaggacatctccgcaggaatggaggccatcaataacttgccttccaacatgcccctcccctctgcctccccgttacatcagcttgatcttaaaccctctcttcctttgcaaaactctggcacacatacccccgggcttctcgaggatctgtccaagaatggccgactcccagaaattaaactccccgtcaacggctgttcagacctcgaggatagcttcacaattctgcagtcgaaggacctgaagcaggaacctctagatgatcccacttgcatagatacttccgagacgtccctatcaaatcagaacaagctgtttagtgatatcaaccttaatgatcaggaatggcaggagctgatagatgaactggcaaacactgtgccagaggatgacatacaagatttgttcaacgaggatttcgaagaaaagaaggagcccgagttctcacagcccgccaccgagaccccattgtcccaggagagtgcatccgtcaaatcggacccatcccattccccgtttgcacacgtatcaatgggctcccctcaggcccggcctagctctagtggtcccccgttctctaccgtgtccacagctacttcactaccaagtgtcgcaagtacaccagcggcacccaatcccgcttcatctccagccaattgcgctgtacagtcgccacagaccccgaatcaagcgcatactccgggacaggcccctccaaggccgggtaacggatacctgttgaacccagccgcagttacggttgccggatctgcttcagggcctgttgccgtcccatcttcggacatgagccctgcagagcaactgaagcagatggccgctcagcagcagcaacgggccaagctgatgcaacagaaacaacaacaacaacagcaacaacagcagcagcaacaacagcagcagcagcagcagcaacaacaacaacaacagcagcactcgaaccagacctctaactggtctcccctaggacctccctcatctccttatggcgcggcatttacagcagaaaaaccgaatagtcccatgatgtacccccaggcatttaataaccagaatccaatagtgcccccaatggccaacaatctccaaaagaccacaatgaacaattacctgccacagaaccacatgaatatgattaaccagcagcccaacaatctgggcacaaatagcttgaacaaacagcacaacattctgacatatggaaatacaaagccactgacacactttaacgcagacctgtctcaacggatgacgcctcctgtggcgaatcccaataagaacccccttatgccatatattcagcagcagcagcaacagcaacagcaacaacagcagcagcagcagcagcaacagcccccccctcctcagcttcaagctccaagagcccacctttccgaggaccagaagaggctgttgctaatgaaacagaaaggtgtaatgaaccagccgatggcttatgccgcgctcccatctcatggacaagagcaacatccagtaggactaccaagaaccactgggccaatgcagagcagcgtcccccctggtagtggcggcatggtcagtggggcctcgcccgccggccccgggtttctgggctcccagccgcaggcagctatcatgaaacaaatgctgatcgatcaaagggcccaactgatcgagcagcagaagcagcagtttctcagagagcagaggcagcaacaacagcagcagcagcaacaaattctggccgaacaacagttgcaacaaagccacctccctcgccagcacttgcaaccccagcggaatccatacccggtgcagcaggttaaccagttccagggctccccacaagacatagctgcagtccgcagccaggctgctcttcaaagcatgagaacctcaaggctgatggcacagaacgctggtatgatgggcatcggcccaagccagaaccctggcacaatggccacggcggcagcccagtccgagatggggctcgcaccttacagtactacccctacctctcagccgggaatgtataacatgtccactggtatgacacaaatgctacaacaccccaaccagtccggcatgagcatcacacataaccaagcacaggggccccggcaacccgcctctgggcaaggggtgggaatggtgtcaggttttggtcagagcatgctggtgaactctgcaattactcaacagcaccctcagatgaaggggcctgtcgggcaggccttgcctcggcctcaggccccacccagattacaatctttaatgggaaccgtgcagcagggagcccagtcctggcagcagaggagcctgcagggtatgcctgggaggacctccggagaacttggaccatttaacaacggtgcttcgtatcccctgcaggcgggccagccccggctgactaaacagcattttcctcagggactaagtcagtcagtcgtggatgcaaatacgggtacagttcggaccctgaatccagctgctatgggacgacagatgatgccgagtcttccaggacaacagggcaccagtcaggccaggcctatggtgatgagtgggctcagccagggcgtgccagggatgccagcgttttcgcagccacccgcacagcagcagatcccaagcgggtcgtttgccccttcgtcacagtctcaggcctacgaaaggaatgcgcctcaggacgttagctataattacagcggcgatggtgccggaggctcatttccgggtctgccggacggggcagatctggtcgactcgatcatcaagggcggcccaggagatgaatggatgcaagagctggatgagctgttcggcaacccctag

SEQ ID NO: 123477 - DNA, 1338 bp, Artificial Sequence
  Description of Artificial Sequence: Synthetic coding sequence
gaacaacatccagtgggtctgccacgcactacgggacccatgcagtctagcgtgccccctgggagcggcgggatggtttccggagcttccccggccggacctggttttcttggcagtcagccccaggcggccatcatgaagcagatgttgatagaccagagagcccaattaatcgagcagcaaaagcagcagtttctcagagaacagcgacagcagcagcagcagcagcaacagcagattctagccgagcagcagctacaacaatcccacctcccacgtcaacacttgcagccacagaggaatccctatcctgtgcagcaggtcaatcagttccaaggctcacctcaggatatcgccgccgttcgcagtcaggccgctctgcagtctatgagaacatctaggctcatggcacagaacgccggcatgatgggtatcgggccatcgcagaaccccggaacgatggctacagccgccgctcagagcgagatggggttggccccgtactctactaccccaacttcacagcctggtatgtacaacatgtcaactggaatgactcaaatgctgcagcacccaaatcagtcagggatgtcaatcactcataaccaagcccaggggccccggcagcccgcaagtgggcagggcgtcgggatggtgtccggatttgggcagtccatgttggtaaattctgccattacccagcagcatcctcagatgaaggggcccgtgggtcaggccctccctaggcctcaggcacctcctagattacaaagcctgatggggacagtccagcagggggcccaatcctggcagcagaggtccctgcaaggcatgcctggtcgaacaagtggcgagctagggccgtttaataacggagcctcctatcctctgcaggctgggcaacctaggcttactaaacagcactttccgcagggcctttctcagtccgttgtggacgctaataccggtaccgtccgcacattgaatccagccgctatgggcaggcagatgatgccatcccttcctggccaacaggggactagccaagcgcgtccaatggttatgtctgggttgagtcaaggggtccccgggatgcctgcattctcccagccaccagcacaacagcaaatcccatctggcagctttgcccccagctctcagagccaggcgtacgaacggaatgcccctcaggacgtaagctacaactacagcggggacggagccgggggatccttccccggcctgcctgacggagccgatctggtcgattccattatcaaaggcggccccggcgacgagtggatgcaagaactcgacgagctgttcggcaacccctag

SEQ ID NO: 123478 - DNA, 2325 bp, Artificial Sequence
  Description of Artificial Sequence: Synthetic coding sequence
atggacgactggaagtctaggctggtgataaaatcaatgttgccccattttgcgatggttgggaaccgccaggagccaagaaagctgcaggagagtggtaagaagccgagctggatggaggaagaagacctgagctttttatataagagcagccctggcagaaagcaccagggcacagtgaaaagaagacaggaagaggaccatttccagttccctgatatggctgatggaggatatcccaacaagattaaacgcccctgtctggaggatgttacccttgccatgggacctggcgcccacccaagcaccgcctgcgctgaactccaggtaccccctctaaccatcaatccgtcgcccgccgctatgggcgtcgccggacagagcctgctgctcgaaaataatcctatgaacggcaatattatgggctctccattcgtcgtcccccagactacagaggttggcctaaaagggcccaccgtgccctactatgagaagattaatagcgtgcccgcagtggaccaagagttgcaagagctgctcgaagaactcacgaagattcaggacccaagcccgaatgaacttgacctggagaagattctgggcacaaaaccagaggagccattggtgctggatcatccacaggccaccctatcaacaacccctaaaccaagtgtccagatgagccatcttgaatccctagcatcgagcaaggagtttgctagttcttgctctcaagtaaccgggatgtctctccagattccaagctcatccacaggtatttcttattcaatcccttcaaccagcaaacaaatagtctccccctcgtcctctatggctcagagcaagagtcaggtacaagcaatgctgccagtggcattgccgcctctgccagtgccccagtggcaccacgctcatcaacttaaagcgctggcggccagtaagcagggaagcgctaccaagcaacagggtccaaccccgtcctggtctggcctccccccccctggcctgagccccccgtatagacctgtgccgtccccccatcctccccccctcccgcttcctcccccgcctcctccattttccccgcagtcactgatggtttcatgcatgtcttcaaataccctgtccggctcaactctgagaggaagtcccaatgcactgctgagcagtatgacaagctccagtaatgcagccctgggtcccgctatgccctacgctcctgagaagctcccttcacccgccctgactcagcagccccagttcggtccacagagcagtatcctcgctaatctgatgtcctccactataaagacaccacagggccacctgatgtccgctctccccgcttccaatcctggccctagccctccttaccggcctgaaaaactgagttcacccggactgcctcagcagagcttcaccccacagtgttccctgatcagaagtctcacccccacctcaaatttactctcccagcagcagcaacagcagcagcaacagcaacaggccaacgtgatattcaagcctatttccagtaattcatcaaagactctttcgatgatcatgcagcagggtatggccagctccagcccgggtgccaccgaacctttcacattcgggaatactaaacctcttagccactttgtctccgaaccaggacctcaaaaaatgccatctatgcctaccacttctcggcaaccatctttgctccactacctgcagcaacctacacccacccaggcctcaagtgcgactgcatccagtacagcaacggccacactacagcttcaacaacagcagcagcagcagcagcagcagcccgaccactctagcttccttctacagcagatgatgcagcagccacagagattccaaaggtctgtagcaagtgacagcatgcctgcccttccccggcaaggatgttgtcatctcttcgcctggacctccgctgctagttccgtgaagccccagcaccagcatgggaattccttcacctctcgccaggatcctcagcctggggatgtctctccctccaatatcacccacgttgacaaagcctgcaaactgggggaagcccgacaccctcaggtgagtctgggtaggcagcctccctcgtgccaggcactgggatccgaatcttttctgcctgggagtagctttgcccacgaactcgcccgtgtcacttcgtcatattccacaagcgaagctgctccctgggggagctgggaccccaaggcatggcggcaggtccccgctcctctactgccctcttgcgacgccacggcccgagggaccgagattaggtcttacgggaacgatccctag

SEQ ID NO: 123479 - DNA, 411 bp, Artificial Sequence
  Description of Artificial Sequence: Synthetic coding sequence
atggatgactggaagtctaggctggtgatcaagtccatgctgccacactttgctatggtgggaaacagacaagagcccaggaaactgcaggagtctggcaaaaagccctcttggatggaggaagaagacctgtcattcctgtataagagttctccaggccgcaagcaccaaggtacagtcaaacgacgccaggaagaggaccactttcagtttcccgacatggccgatggtgggtatcctaataaaatcaaaaggccgtgcttggaagacgtaacactggccatggggccgggcgcgcatccctcgaccgcctgcgccgaactgcaagttcctcccctgacaataaatccttctccggctgccatgggcgtggcaggtcagtccctcctgctggagaacaatccaatgtag

SEQ ID NO: 123480 - DNA, 2325 bp, Artificial Sequence
  Description of Artificial Sequence: Synthetic coding sequence
atggatgattggaagtcgcgactggtgatcaaatcaatgctgccacattttgcgatggtaggtaataggcaggagccgcggaagctccaggagtccgggaagaagcctagttggatggaagaagaggacctctctttcctgtataagagcagccctggccgaaaacaccagggcacagtaaagcggaggcaggaagaggaccactttcagttcccggacatggcggacggcggttacccaaacaagataaagagaccatgtctggaggatgtaaccctggccatggggcccggtgcccatccctccaccgcatgcgcagagctgcaagtcccaccccttaccatcaatccctcccccgccgccatgggcgtcgcaggccagtcattgctgctggagaataaccccatgaacggaaacattatgggttcgccattcgtggtgcctcagactactgaggtgggactaaagggcccaactgtgccatactatgaaaagattaactcagtgcccgcagtggaccaagagcttcaggagttactcgaggagctgaccaaaatccaggacccgagccctaacgagctggacctcgaaaagatactcggcactaaaccagaagagcccctagttctggatcaccctcaagcaaccctgtctacaaccccaaaaccgtcggtccagatgtcacacctggagagtttagcttcatctaaggagttcgcatcatcttgtagtcaggtcactggtatgtccctgcagattcctagttcttcaacaggtatttcctacagcatcccgagtacctccaagcagatcgtaagcccttctagcagcatggcacagagtaagagccaggtgcaagcgatgttgccagtcgccctgccccctctgccagttccccaatggcatcatgcgcatcagctaaaagccctggccgcctccaagcaaggctccgctactaagcagcagggcccaaccccatcatggagtgggctccccccgcctggcctatcccccccataccgccctgtgcccagcccacaccctccccctcttcccttacccccaccaccaccgcccttttcaccccagtctctcatggtgtcttgtatgagtagtaacacattgagcggctccacactcagggggtcaccaaacgccctgctctcatctatgacctccagtagcaacgccgcactcggccctgccatgccttatgccccggaaaaactgccaagtccagcactgacacaacagccgcagttcggaccgcaaagttccatcctggctaatttaatgagctctactattaaaacgccacaaggccatcttatgtccgctctgcctgcctccaaccctggcccatcacctccataccgtcctgagaagctgagctcccctgggctcccacagcagagctttacaccccagtgttctttgattcgatctcttacacctacaagtaacctgctcagtcagcagcagcagcagcagcagcagcagcaacaggcgaacgtgatatttaagccaatcagttccaactcctcgaagactttgtctatgataatgcaacaagggatggcttcttcaagtcctggcgctaccgagcccttcacattcggcaacaccaagccactgagtcactttgtgtccgaaccagggccccaaaagatgccctcaatgccgacaacatctaggcagccatctttgttgcactacctccagcagcccacacctacccaagccagcagtgcaactgcaagctccacagcaacagccacactgcagctccagcagcagcagcagcaacagcagcaacagcctgaccatagttccttcctgctgcaacagatgatgcagcaacctcagcggtttcagaggtccgtcgcctccgatagcatgcccgctctccctagacaaggatgctgccatctgtttgcctggacgtctgcagcttctagcgtgaaaccccaacaccagcacggaaatagctttacctcaaggcaggacccacagccgggcgatgttagccccagcaacatcacgcacgtagacaaagcatgcaagcttggtgaagcgcgtcatcctcaggtttcactagggagacagccgccaagctgtcaggctctcggcagcgaatcgttcctgcctggttctagcttcgcacacgagctcgcccgggtaaccagctcctatagcacatcagaagcggccccctggggctcctgggaccctaaagcatggaggcaggtccccgcacccttattgccctcatgcgatgccaccgctagaggaaccgagatccggagctatggtaacgacccatag

SEQ ID NO: 123481 - DNA, 2250 bp, Artificial Sequence
  Description of Artificial Sequence: Synthetic coding sequence
atggacgattggaaatcgaggttggtcattaaaagcatgctgccccacttcgccatggttggcaacagacaagaaccgaggaaactgcaagagtctggaaccgtcaagcgtaggcaggaggaagatcacttccaattccccgatatggccgacgggggatatccaaacaaaataaagcgaccttgtttggaggacgtgacattagccatgggccccggagcccacccaagtactgcttgtgcagaacttcaggtgccccccttgaccatcaatccctcgccagccgcaatgggggtcgccggccagtctctcctgttagagaataaccctatgaacggcaatataatgggatcaccctttgttgtcccccagaccaccgaggttggacttaaaggaccaactgttccatactacgaaaagatcaacagcgtgcctgcggtcgatcaagagctgcaggagctgctggaggagcttacgaaaatccaggatccgtctccaaacgagttggatctggagaaaatcctgggcactaaacctgaggagcctctggtcttggaccaccctcaggccacgctgtccactacccctaaaccatcagtccagatgtcacatcttgagagcctcgcctcatctaaagaatttgcgagttcatgtagtcaggtaacggggatgtccctgcagatcccctcatccagcacaggaatctcttattctatccctagtacctctaagcaaattgtgtcacctagttcaagcatggctcaatccaagagtcaggtccaggccatgttgcccgtggcgttgcccccactgccagttcctcagtggcaccacgctcatcagcttaaagcattggcagcaagcaagcagggtagtgccaccaagcagcagggaccgacaccatcatggagcggcttaccaccgccaggcctgtcaccgccctacagacctgtgccaagtccccatccgccgccccttccactcccccccccgccgcctcccttttctccacagagcctcatggtctcatgcatgtcgtccaatactttgtccggatccacactccgcggctctccgaacgctctgctgtcttctatgacatccagcagcaacgccgccctgggtcctgctatgccgtatgctcccgagaagctgccttcgccagcactgactcagcaaccccagtttggacctcagtcctcaattctcgctaatctcatgagctctacaattaaaacaccacagggacacttaatgtctgctctcccagcctcaaaccccggtccgtcacccccctaccgccccgagaagcttagcagtccagggttgccccagcagtctttcacacctcagtgctccttaatacggtctctaacaccaacaagtaatctgctatcccagcagcaacaacagcagcagcagcagcagcaagccaatgtgatcttcaagccaattagctctaattcctccaagactctgtctatgatcatgcagcagggaatggcgagctcctcaccaggggccaccgagccctttacattcgggaacactaagcctttatcgcattttgtaagcgagcctggcccacaaaagatgccatcaatgcctaccacctcacgccagccctctttgctgcattacctgcagcagccaactccaacgcaggcatcctcagccacggctagttcaactgctaccgcaacgctccagcttcagcagcagcagcagcagcaacagcaacaacctgatcacagcagctttcttttacagcagatgatgcagcagccacagaggtttcaaagatcagtggcatccgacagcatgcccgcgctgccccggcaaggctgctgtcatctcttcgcatggacatccgctgcctcttcggtcaagccccagcaccaacacggcaattccttcacatcccggcaggacccccagccgggcgacgtgagcccaagtaatattactcacgtggataaggcctgcaagctgggtgaagctcgacacccccaagtgtctcttggcagacagccacctagctgccaggccctgggttctgagtcgttcctccccggctcttccttcgcacacgaattggcaagggtgacctcttcatactctaccagtgaggctgccccttggggcagttgggatcccaaggcttggcggcaagtccccgcgcccctcctgccatcatgtgacgcaacagcccgtggtacagaaatacgctcttatggaaacgatccatag

SEQ ID NO: 123482 - DNA, 2997 bp, Artificial Sequence
  Description of Artificial Sequence: Synthetic coding sequence
atggatgactggaagtccaggcttgtcatcaaatctatgctgccccacttcgccatggtaggaaataggcaggaaccacggaaacttcaggagtccggaactgtaaagcgtagacaggaggaagaccatttccagttcccagatatggcggatgggggatatcccaacaaaatcaagcgcccttgtctggaggatgtgacactagccatggggccgggcgctcacccttctaccgcttgtgccgagctgcaggtcccccccctgacaatcaatccttctcccgctgcaatgggcgtggctgggcaatccttactgctggagaacaatcctatgaacgggaacattatgggctcaccttttgtggtgccacaaacgacagaagtgggattaaaagggcctacagttccgtactacgaaaagatcaattcagtgcctgcggtagaccaggaactgcaagagctgcttgaggaactcacaaaaatacaggacccaagcccaaatgagctggatcttgagaaaatactgggcaccaaaccggaagagccactggtgctcgatcacccacaggctacacttagtaccactcctaagccctctgttcagatgtcacacctagagtccctggcgagttctaaggagttcgctagcagttgttcccaggtgaccggcatgagcctgcagatcccctcgagctcaactggcatatcctacagcatcccctccacctctaaacagatcgtctcccctagctcctccatggcacagtccaagtcacaggtgcaggccatgcttcctgtcgccctccctcccctcccggtccctcagtggcaccacgcccatcaactgaaggccctggctgcctctaaacaggggagcgcaaccaaacagcagggacctactccatcctggtccggattaccccccccgggactcagtcctccctacaggccagtcccctctccccatccaccacctcttcccctgccacctcccccccctccattctcaccccaatccctgatggttagttgcatgagttccaacacactatccggaagcactctgagaggtagtcccaatgctttgctgtccagcatgacctccagcagcaatgccgccctgggccctgctatgccctatgcaccagaaaagttgccctcgcctgcattgacacagcagccacaattcggaccacagtcaagcatccttgccaacctgatgagcagtacaattaaaacaccacaaggccacctcatgtcagccctgccggccagtaatccagggccctctcctccctataggcccgaaaagttgtcgtcaccaggactcccccagcagtctttcactccgcaatgttccctgattaggagcctgacacccactagcaacctgctgtctcagcagcagcaacagcagcaacaacaacagcaggccaacgtcatttttaagccaatctctagcaatagcagcaaaactcttagcatgataatgcagcagggcatggcctccagttcaccaggcgctaccgagccgttcacattcggcaataccaaaccgctgtctcactttgtgtccgagcccggcccacagaaaatgccaagcatgcctaccacttcgcgacaacctagcctcctgcattacctgcaacaaccaacaccaacccaggcatcctctgctaccgccagctccacggccaccgccaccctgcagctgcaacaacaacagcagcagcagcaacagcagccggaccacagttcctttctgctgcagcagatgatgcagcagccacagcggtttcagcggtccgtggccagcgactcgatgccagccctgccgcgacagcaggaggagcagaggtccggtctgatggctatgacacccgagcgccaaaacgcatacattagtcaacagatgagcccattcgaggcagtccaagagcaagttacctccaagtgctccagaatcaaagcctcgccccccagctctaagcacctcatgcccccacgcaccggcctactgcagaacaatttgagtccgggcatgatccccctgactcgccaccagtcatgtgagggaatgggagtgatcagtcctacactcgggaagcgacaagggatctttaccagcagtccgcagtgtcccatcctcagtcactcgggccagaccccccttggccgtttagatagcgtatgtcaacacatgcaaagccccaaggctactccccccgaggtacctctgcccggattctgcccctcatcccttggtacgcaaagcctctctcctcaccagcttcgccggccatctgttccccgaatgcccactgcgttcaataacgccgcttgggtgactgccgctgctgctgtgaccacggctgtgtctgggaaaactcccctatctcaagttgacaactctgtacagcaacattccccatccggccaagcttgtctgcagcgccccagcgactgggaagcacaggtgccagccgcaatgggcactcaggtgccactcgcaaataatccttccttctctttactggggagccagtcccttcgtcagagtcctgtgcagggacccgttcctgtcgccaatacaacaaagttcctgcaacaggggatggcttcatttagccctctgtcgcccatccagggtattgagcctccctcctacgtcgccgccgccgccacagcagccgctgccagcgcagtggccgccagccagttcccaggccctttcgaccgaaccgatattcctcccgagctacctcctgctgactttttgaggcagccgcagccccccctgaacgacctgatttcctccccagattgtaacgaggtcgatttcattgaggctctcctgaaagggtcctgcgtgtctcccgatgaagattgggtgtgcaatctgcggctcatcgatgatattttggagcagcacgcggctgcgcaaaacgcgacagcacaaaacagcgggcaagtgacgcaagacgccggcgctctttag

SEQ ID NO: 123483 - DNA, 1941 bp, Artificial Sequence
  Description of Artificial Sequence: Synthetic coding sequence
atggaggaggaggacctctcatttctctacaaatcaagccctgggaggaagcatcaggggactgtaaagagaagacaggaggaggatcacttccaattccctgatatggccgacggcggctatcccaacaagatcaaaagaccctgcctggaggacgtgaccttggctatgggcccaggtgcgcatccttctactgcatgcgctgaactgcaggtgccccccctgacaattaacccgtcaccagccgccatgggggtggcgggtcagagtttgctgctggaaaacaacccgatgaacgggaatatcatggggtctccattcgtggtgccccagactacggaggtcggcttgaaaggccctactgtcccctattacgaaaaaatcaacagtgtccctgccgttgatcaggagctccaagaacttcttgaggaattgactaagattcaggacccctcccccaatgaattagatttggaaaagatcctgggcaccaagccggaagaaccccttgttcttgaccacccacaggccaccttgtccactacgccgaagccttccgttcagatgtctcacttagagagtctcgcttcatccaaagagtttgcatccagctgctcacaggtgactggaatgtctctgcagatcccctcttcatctacaggaatttcttactccatcccttccacaagtaagcagatagtaagcccatctagctccatggcacaatcaaaatcgcaggtgcaggctatgctgcccgtggcattacctcccctacctgttccccagtggcaccatgcacaccaattgaaggcgctcgccgctagcaagcagggatctgccacaaagcaacaaggccctacgccaagctggagcggactgccccccccaggcctctcacccccatatagacccgtcccgtccccccacccacccccgctgcccctgcctccaccacctcccccttttagtccacagtctctaatggtgtcatgtatgtctagtaataccctctccggctctacgctgcggggctcacccaacgcgcttttatccagcatgactagctcttcaaacgcggcccttggaccggctatgccttatgctccagagaagttgccctcccctgccctgactcaacagccacagttcggaccccagtcgtcgatcttggctaacttaatgagcagtactatcaagaccccacaggggcacctcatgtctgcccttcctgcaagcaaccctggtccctctcctccatacagacccgaaaagctctcaagtcctggcctaccccagcagtccttcaccccccaatgctccttgctgcactatcttcagcagcccacacccacccaagcatcttcagctacggccagcagcactgctacagctactctgcagctgcagcagcaacagcagcaacagcagcagcagcctgaccatagttccttcttacttcagcagatgatgcagcagccacaaaggtttcagagatctgttgcctcagattctatgcccgctctcccccggcagggctgttgtcacctgttcgcatggacgtcagcggcctcaagtgtcaagccccagcaccagcatggaaactcctttacttctaggcaagatccccagccgggtgatgtgagtccctcgaatatcacgcatgtcgacaaagcatgtaaactcggtgaggcgcgtcatcctcaggtgtccctagggagacagccgcccagctgccaggcgctgggctctgagagcttcctgccaggaagtagtttcgcccacgagttggcacgcgtaactagcagctacagcacctctgaggccgcgccgtggggatcgtgggacccaaaagcatggcgccaggtgcctgctccccttctgccctcatgtgatgctactgcccgcggaacagaaattcgcagctatggaaacgacccttag

SEQ ID NO: 123484 - DNA, 645 bp, Artificial Sequence
  Description of Artificial Sequence: Synthetic coding sequence
atgataatgcagcagggaatggcatcgtcgagtccaggtgcgacggaacccttcacttttgggaataccaagcccctatcccatttcgtgagtgagccaggaccgcagaagatgcctagtatgcctaccacctctagacagcctagccttctccattatctgcaacagccaaccccaacccaggcaagttctgcaactgcttcgtccaccgccacagccactttgcagctccagcagcagcagcaacagcagcagcagcagccggaccattcgtcgtttctcctccaacagatgatgcaacagccgcagaggttccagaggtcggtagcctcagactctatgccagccctgccacgccaaacccacgtggacaaggcctgtaagcttggcgaggcacggcacccacaggtgagcttgggacgccagccgccctcttgtcaggcattaggctccgagtccttcctgccaggatcctcctttgcccatgagcttgctcgggtgacgtcttcctactccactagtgaagctgccccatggggaagctgggacccaaaggcatggcgccaggtaccagcccctttattaccctcctgtgatgctaccgcccgaggcaccgaaatacgcagttacggtaatgacccatag

SEQ ID NO: 123485 - DNA, 1956 bp, Artificial Sequence
  Description of Artificial Sequence: Synthetic coding sequence
atgaaggactatgatgaactgctgaagtattacgaattacacgagaccattggaactggcggtttcgcaaaggtaaaattggcttgccacatcctgacaggtgagatggtcgcgatcaaaatcatggataaaaataccctgggatctgacttgcctcgaatcaagaccgagattgaggcgttaaagaacctccgccaccagcatatatgtcagctgtaccacgtgctcgagactgccaataaaatcttcatggtgctggaatactgtccaggcggtgaattgtttgactatatcatcagtcaggaccgactaagcgaagaggagaccagagtggtgtttcggcagattgtgagtgcagttgcctatgttcactcccaagggtacgcccatcgcgacttaaaaccagagaatctgctttttgacgagtatcataagctcaaactgatagactttggtctgtgcgccaaacctaaaggcaacaaggattaccacttgcaaacatgttgcgggtcactcgcatatgccgccccagagctgatacagggtaagtcttaccttggtagtgaggcagacgtttggagcatggggatcctgctctatgtgctaatgtgtggcttcctcccctttgatgacgataacgtcatggcgttgtacaagaagataatgcgcggaaaatacgacgtcccgaaatggcttagcccctcaagcatactcctgcttcaacagatgcttcaggtggacccgaagaaacgaatctcaatgaaaaacctcctgaatcacccatggatcatgcaagattacaattatccggtggaatggcagagtaagaatccatttatccatctggacgatgattgtgtaactgaactgtccgtacaccacaggaacaatcgccagaccatggaggatctcatttccctttggcagtacgaccacctgacagccacctacctgctattattagcgaagaaagcccgggggaagccagtcagactgagactctcctctttctcctgtgggcaagctagtgcaacgccctttaccgacatcaaatccaataattggagcctggaagatgttactgcgagcgataagaactacgtcgccgggctgatagactacgactggtgcgaagatgacctctccaccggcgctgccacgccacggaccagccaattcactaaatattggacagagtccaacggcgttgaaagcaaatctctcacccccgccctgtgcagaacccccgcaaacaagttgaaaaacaaggaaaatgtgtacacacctaagtctgccgtcaaaaatgaagaatatttcatgtttccagagcccaagacgcctgtgaataaaaaccagcataaaagagagatcttaacaacaccgaaccggtatactactccatcaaaagccagaaaccagtgcctgaaggagacgccaatcaaaattccggtgaactcaactgggactgacaagttgatgaccggggtgatctctccagagcggcgctgccgtagcgtggaactggatcttaaccaggcccatatggaggagactcctaagcgcaagggtgcaaaagtgttcggttctttggaaagaggcctagataaggtgattaccgtgctcaccaggtccaaacgaaaaggatccgcccgcgacggcccccggaggcttaagttacactacaacgtaacgactacaaggttggtgaaccctgaccaattgctgaatgaaatcatgtcaatactgccaaaaaagcatgtagattttgtccagaagggatacaccctgaagtgccagacacagtcagacttcgggaaggtaaccatgcagttcgagctcgaggtgtgccagctgcaaaagccagacgtggtcggtatacgaagacagcgcttaaagggtgatgcctgggtgtataagagactggtcgaggacattctctcttcatgtaaagtgtag

SEQ ID NO: 123486 - DNA, 1743 bp, Artificial Sequence
  Description of Artificial Sequence: Synthetic coding sequence
atgatgaacttctccaacattatgaactacatgaagctgttaggacaatattgcccgggaggcgagctgttcgattatatcatttcacaggatagactatcggaggaggagaccagggtcgtattcaggcagatcgtctctgccgttgcttacgtgcactcacagggctacgctcatcgcgacctcaaacccgagaacctgctgttcgacgaataccataaactgaagctgattgacttcgggctatgtgccaagcccaagggaaataaggactaccacctgcagacttgctgcggctccctcgcctatgccgcccccgagctgatacaagggaaatcctatctcggttcagaagccgatgtgtggagcatgggtattcttctatacgtgctaatgtgcggttttctgccattcgatgatgacaacgtaatggcgttatacaagaagatcatgaggggcaaatacgatgtccccaagtggttatctccatcgtccattttgctattacaacagatgctgcaggtcgatcccaagaaacggatctcgatgaagaaccttttgaaccacccctggatcatgcaggactataattacccggtggaatggcagtctaagaacccctttattcacctcgacgacgactgtgtgaccgaattgtccgtacatcatagaaataacaggcagaccatggaggacctcattagtctgtggcagtacgaccaccttaccgcaacctatcttctgttactcgccaagaaggctaggggcaagcccgtccgcttacgcctctcttctttcagctgtgggcaggcctctgccactccctttaccgacatcaagagcaataattggagtctagaagatgtgacagcctcagacaagaattatgtcgcggggctcattgactacgattggtgcgaagacgacctgtcaacaggggcagccacccccagaaccagccagtttacaaaatactggactgagagtaacggagtggagtccaagagtctcacccctgcactgtgtcgcactcctgctaataaactaaagaacaaggaaaatgtatacactcctaaaagtgcagtcaagaatgaggagtactttatgtttcctgagccaaagactcctgtaaacaagaaccagcataaaagagagatacttacgaccccaaataggtataccaccccaagcaaggctcgcaaccagtgcctcaaagagaccccaataaaaattcccgtcaattccaccggcaccgacaaattgatgaccggtgtgatttcaccagagcggcgatgccgcagtgtggaactcgatctaaaccaggcccacatggaagaaactcccaaaagaaaaggggccaaagtgttcgggtctctggaaagaggactcgacaaagtcattacagtccttacacgcagcaagagaaaggggtctgcaagggacggtccacggaggctgaagttacactacaatgtgaccacaactcgactggtgaacccagatcagctcctgaatgagattatgagtatcctgccaaaaaaacacgtcgatttcgtgcaaaagggatacacactcaaatgtcaaacccagtcggacttcggcaaagtcactatgcagtttgaacttgaagtatgccagcttcaaaagcccgatgtggtggggattagacgccagcgcttgaaaggagacgcctgggtctacaagcgcctcgttgaagatatcctgagcagctgcaaggtgtag

SEQ ID NO: 123487 - DNA, 1812 bp, Artificial Sequence
  Description of Artificial Sequence: Synthetic coding sequence
atgaaggattatgacgaactgctgaagtactacgaattgcatgagaccatagggaccggtggctttgccaaagtgaagctcgcctgccacattctgacaggcgaaatggttgctatcaaaatcatggacaaaaatacactgggcagcgacctccccaggattaagactgaaatcgaagccctcaagaacctgcgccatcagcacatatgccaactgtaccatgtgctcgaaaccgcaaacaaaatttttatggtcctggaggaaaacctcctgtttgacgagtaccataagctcaaactcattgattttgggttgtgtgctaaaccaaagggtaacaaggactaccacctgcagacgtgctgcggatccttagcctatgctgccccagagctcatacagggtaagtcttacctgggttccgaggccgacgtttggagcatgggcatccttctctacgtgctcatgtgcggctttttaccatttgatgatgacaatgtcatggcattgtacaaaaagattatgaggggcaaatacgacgtgcccaaatggctgtccccctcttctattctgctcttgcagcaaatgctgcaggtggatcctaagaaacggatctccatgaagaatttgcttaatcacccctggatcatgcaggactacaactatccggtcgagtggcagagcaagaacccctttattcatctggatgacgattgcgtcactgagctatccgtccaccaccgcaataaccggcagacaatggaagatttgatatctctgtggcaatacgaccaccttactgcgacgtacctccttcttttggccaaaaaagcaaggggtaaacctgtgagattgagactttcttctttctcctgtggacaggcttccgccactccttttactgacattaagtcgaataactggtctttggaagacgtgacagcaagcgacaagaattacgtggccggactgattgactatgattggtgtgaggatgacctgagcaccggagcagctacaccccgaactagccaatttacaaagtattggacagagagtaatggagttgagtctaaatctctgacgcctgctctgtgtcggacacctgctaacaagctgaagaacaaggagaatgtttacacacccaaaagtgccgttaaaaatgaagaatatttcatgttcccagagcccaagactccagtcaataagaatcaacataagcgggagattctgacaacaccaaaccggtacacgactccttcgaaagcccgcaaccagtgcctcaaggagaccccgatcaagatacctgtgaattccacaggcacagacaaactgatgactggcgtgatctctccagaaagaagatgcaggtctgtggaactagacttgaatcaagcccacatggaggagaccccaaagcgcaagggcgccaaggtgttcggctcgctcgagcgcgggctggataaggttatcaccgttctgactagatctaagagaaagggaagtgcaagggacggccctcgacgtctcaaactgcattacaacgtaacgaccacacgcttggttaaccccgatcagttgttgaatgagataatgagtattctgcctaagaagcatgtcgatttcgtacaaaaagggtacactctgaagtgtcagacacagagcgatttcggaaaggtgacaatgcagtttgagctggaagtttgtcagctgcagaagccagacgtggtggggatccgtcgtcagcgactgaaaggggacgcctgggtatacaagaggttggtcgaagacatactctcgtcctgtaaggtatag

SEQ ID NO: 123488 - DNA, 1563 bp, Artificial Sequence
  Description of Artificial Sequence: Synthetic coding sequence
atggtacttgaagagaacctgctctttgacgagtatcacaagctgaagttgattgattttggactctgtgccaagcctaagggcaacaaggattatcacctccagacttgctgtggctctctggcttacgcggcacctgaactgattcaggggaaaagttatctgggctcagaggcagatgtgtggagcatggggatacttttatatgtcctgatgtgcgggtttcttccattcgacgacgacaatgttatggccctgtacaaaaaaataatgaggggaaaatacgacgtccccaaatggttatcaccatcctcaatccttctcttgcagcagatgttgcaagtggacccaaagaaacgcatctcaatgaaaaacttgcttaaccatccatggattatgcaagactacaactaccctgtggagtggcaaagcaagaatcctttcattcaccttgatgatgactgcgtgacagagctgagtgtacaccaccgaaataaccgtcagacaatggaggacctcattagtctttggcaatatgaccatctgaccgcaacatacctgctgctgctcgcaaagaaggcaagaggaaagccagtcagattgcggctctcatccttcagttgtggccaagcttccgccacccctttcactgatattaaaagcaacaactggagtctcgaggacgtcaccgcctcagacaagaattatgttgcgggcctgattgactatgattggtgtgaggatgacctcagcaccggcgctgcgaccccaagaacaagtcagtttacaaagtactggactgagtccaacggtgtggagtctaaaagccttacccccgccctgtgtcgaactccagcaaataagctgaaaaacaaagagaatgtctatacccccaagtccgccgtgaagaacgaggaatattttatgtttccggagcccaaaacaccagtaaataaaaaccagcataaacgagagatcctgaccaccccaaaccgttatacgaccccctcaaaggcccgtaatcaatgtctaaaggaaacacctatcaaaattcctgtgaattctaccggcacagataaattgatgaccggcgtgattagccccgagaggcggtgtcgatccgtcgagctggatctgaaccaggcccatatggaagagaccccaaaacgcaagggagccaaagtgtttgggagtcttgagaggggattagataaggtcatcaccgtactgaccagaagcaagcgtaaagggtcagcgcgtgatggaccaagacgcttaaaactccactacaatgtaaccactacacgattggtgaaccctgatcagctgttgaacgaaattatgtcaatcctcccgaaaaaacacgtggatttcgtccagaaaggttacacgctaaagtgccagactcagagcgactttggaaaggtgactatgcagttcgagctcgaggtctgccagttacagaagcccgatgttgtcggcatcagaagacagaggctcaagggtgacgcctgggtctataaaagactggtggaggacattctgagctcgtgtaaggtgtag

SEQ ID NO: 123489 - DNA, 1374 bp, Artificial Sequence
  Description of Artificial Sequence: Synthetic coding sequence
atgggcattctcctctacgttctaatgtgtggatttttaccttttgacgatgacaacgttatggcactatataagaaaattatgagagggaagtatgacgtgcctaaatggttgagcccctctagcattcttctcttgcagcagatgctgcaagtggacccgaagaagcggattagtatgaagaacctgctgaatcacccatggatcatgcaggattataattatcccgtggaatggcagtctaaaaacccctttattcacctcgatgacgactgtgtgacagagcttagcgtgcaccaccgcaacaataggcaaaccatggaggacctcatatctctgtggcaatatgaccatctgactgccacctacttgttgctgcttgccaaaaaggcacgcggtaagcctgtccgactgcggttatcaagtttttcttgtgggcaggcgtctgcgactccgttcaccgatattaagagtaataactggagcttggaagatgtgaccgctagcgataagaactacgtggccggtttaattgactacgattggtgtgaggatgatctgagcacgggggcggcgacaccccgcactagccagtttacgaagtattggacagagagcaacggagtagaatcaaagtctctgaccccagccctttgccgaacaccagccaacaaactgaagaataaggagaacgtttacactcctaagtctgccgttaaaaatgaagaatactttatgtttccggagcccaagactcctgttaataaaaaccagcataagcgggagatcctcaccacacccaatcgatataccacgccttctaaggccaggaaccagtgcctcaaggagactccgattaaaatccccgtgaattccactggtaccgacaaactgatgactggcgtgatttctcccgagagaagatgtagaagcgtggagctggatctgaaccaagcccacatggaggaaacccccaagcgtaaaggagccaaagtctttggctcactggagagaggattggacaaggtgatcaccgtcctgacaagaagcaagcgaaaggggagtgcgcgggacggacccagacgcttgaaattgcactacaatgttacaaccaccagactggtcaaccctgatcagttgttgaacgagatcatgagtatactgccgaagaaacatgttgattttgtccagaagggctacactctaaagtgtcagacacagagtgacttcgggaaagtgacaatgcagtttgaacttgaagtgtgtcaactccaaaagccagatgtggtcggcatacggaggcagcggctgaaaggtgacgcctgggtatacaagcgtctcgtggaagacatcctcagcagctgtaaggtgtag

SEQ ID NO: 123490 - DNA, 1833 bp, Artificial Sequence
  Description of Artificial Sequence: Synthetic coding sequence
atgaaggactacgacgagcttctgaagtactacgagctgcacgaaacaatcggaactgggggctttgcaaaggtaaagctggcctgtcatattctgactggggaaatggtggccattaaaatcatggataagaacacattagggtccgacttacccagaattaagacagagattgaggccctcaagaacctcagacatcagcatatttgtcagctgtatcacgtcctggagacggctaacaaaatatttatggtgctagagtattgccctggcggagaactatttgattatatcatatcccaggaccgattatccgaggaagagacccgcgtggtgttccgtcagattgtgtccgccgttgcttatgttcattcccaggggtacgcacaccgcgatctaaagcccgagaacctgttgttcgatgagtatcataaattaaaactgatagactttggcctgtgtgccaagccgaagggaaacaaagactaccacctacagacctgctgtggctccctggcctatgcagcgcctgagctcatccaaggcaaaagctacctgggctcagaagcggacgtgtggagtatgggcatcctgctgtatgttctgatgtgcggttttttgccttttgatgacgataacgtgatggcgctgtataagaagatcatgagaggtaagtacgacgtgcccaaatggctctccccttcctccatcctgctactgcaacagatgcttcaggtggaccccaagaaaaggattagcatgaagaacctgctgaatcacccgtggatcatgcaggattataactaccctgtcgagtggcagagtaaaaaccctttcatccacctggacgatgactgtgtaacggagctctctgtacaccatcgtaataaccgtcagaccatggaggacttgatatcgctgtggcagtatgaccatttgactgcaacgtacctgctactgttggccaagaaagcccgcgggaagcctgtgcgactgcggctctcctctttctcctgtggccaagcatccgcgactccgttcacagatatcaagtttaccaagtactggacagagagtaatggagtagagtccaagagcctgacccccgcattatgtcgtactcccgctaacaagctaaaaaataaggaaaacgtgtacacccccaaaagcgccgtgaagaacgaggagtatttcatgtttccagagcctaagaccccagtcaataagaatcagcacaagcgggaaattttgaccacccctaaccgctatactacaccctcaaaagccagaaaccagtgtctgaaggagactccaatcaaaatccctgttaacagcaccggcacggacaagctgatgacaggcgtaatatctccagagcgccggtgtcgaagtgtggagctggatctgaatcaggcacatatggaggagacaccaaagagaaaaggcgcgaaggtgtttggctccctggagaggggcctcgataaagtgatcaccgtgctgactaggtccaaacgaaaaggatccgcccgggacggccctcggagattgaagcttcactacaatgttacgacaacaaggctggttaaccccgaccaattactcaacgaaataatgagtatcctcccgaaaaaacacgtcgactttgttcagaagggctatacgctgaagtgtcaaacgcagtccgactttgggaaagtgactatgcagttcgaactggaagtttgtcagctgcagaaaccagatgtcgtcggtattagaagacagcggttgaagggggacgcttgggtttataagcggctcgtagaagatatactgagctcgtgtaaagtgtag

SEQ ID NO: 123491 - DNA, 1860 bp, Artificial Sequence
  Description of Artificial Sequence: Synthetic coding sequence
atgatgaacttctcgaacatcatgaactatatgaagcttctgggacagtccgacttgcccaggatcaagaccgagatcgaggcacttaaaaatctgcgacaccagcacatttgtcaactctaccacgtcctggagacggcaaataagatcttcatggtgttggaatactgccccgggggcgagctctttgattatatcatctctcaggacagactcagtgaagaagagacaagagttgtgttccgtcagatcgtgtctgccgtagcttatgtgcattctcagggttacgcccatagggacctcaaaccagagaacctattgttcgacgaatatcacaaactgaagctgattgattttgggttatgcgccaaacccaagggcaacaaggattaccacctccaaacatgttgcggaagcctggcttatgccgctcctgaattgattcaagggaagagctacctgggcagtgaggcggacgtgtggtcaatgggcattctgctgtatgttttaatgtgcggatttttgcctttcgacgatgacaacgtgatggcgctgtataaaaaaatcatgagaggtaagtacgatgttccaaagtggctttctccaagttccattttactcctccagcagatgctccaagtggatcccaagaaacgtatttctatgaaaaacttgctaaatcacccttggatcatgcaggactacaactaccctgtggagtggcagtctaagaacccctttattcacctggatgatgactgcgtgacggagctgtctgtgcaccatcgcaataacaggcagaccatggaagatctaatttcactctggcagtacgatcacctgaccgctacttatctactgctccttgccaaaaaggcaagggggaaacctgtcagattgcgcctcagctcattttcgtgtggacaggcgagcgcgacacctttcaccgacatcaaaagcaacaattggagcctggaagacgtgaccgctagtgacaagaattacgtcgccggcttaattgactacgactggtgcgaggatgacctttcaactggggctgctacacctcgcaccagccagtttacaaagtattggacagaatccaatggggtggagtctaaatccctgacacccgctctttgtaggacacctgccaataaactcaagaacaaggagaatgtctacaccccgaagagcgctgtaaagaacgaggagtactttatgttcccagagccaaaaactcctgtgaataaaaaccagcacaaacgggaaattctgacaactcctaataggtacaccaccccctctaaggctcgcaaccagtgtctgaaggagactcctataaaaataccagtgaacagcaccgggaccgacaaattaatgacaggggtgattagcccagaacgacgctgcagaagtgtggaactggatctgaatcaggcccatatggaggagacacccaagcgtaagggcgcgaaggtctttggatctcttgagcgtggcctggataaggtcatcactgtcttgacccgctcaaagaggaaggggtctgcgcgggacggaccccgtagacttaaactgcactataatgttaccaccacgcgcctggtcaaccccgatcagctactgaatgaaatcatgtcgatcctgccaaagaaacacgtcgactttgtgcagaaagggtatacactgaaatgccagacacagagcgactttggaaaggtcacaatgcagttcgagctcgaggtgtgccaacttcagaaacccgacgtcgtggggattcgccgacaaagattgaagggggacgcttgggtctataaaaggttagtcgaggatatccttagctcctgcaaagtgtag

SEQ ID NO: 123492 - DNA, 1743 bp, Artificial Sequence
  Description of Artificial Sequence: Synthetic coding sequence
atgaaggactatgacgagctgctgaaatactacgagcttcacgagaccatcggtacaggcgggttcgccaaagtgaagctggcctgtcacattctgactggcgaaatggttgcaattaagataatggataagaacactcttgggagtgacctgccaaggatcaagactgagatcgaggcactcaagaatctgagacaccagcatatttgtcagctttatcatgtgctcgagacagctaataagattttcatggttctcgaagggaacaaagactatcatttacagacatgctgtgggtcactggcgtacgccgcccccgagctaattcagggtaaatcttacttggggagtgaggcagacgtttggtctatgggcattttgctttatgtgctgatgtgtggcttcctcccttttgatgacgataacgttatggcattgtacaaaaagattatgcgagggaagtacgatgtccccaaatggctgtccccgagctcgatcctccttctgcaacagatgctacaggtcgaccccaagaaaaggatctctatgaagaatctactaaaccatccttggattatgcaggactacaactaccccgtggagtggcaatccaagaatcctttcattcacttggacgatgattgtgtcacagagctaagcgtgcatcatcgaaataacagacagacaatggaggacctgatctcactgtggcaatacgatcatctcactgcaacctatctgctgcttttagccaaaaaggctagggggaagcctgtccgtctgcgcctcagtagtttttcttgcggccaagctagcgccactcccttcacggatatcaagtccaacaactggtcccttgaggacgtgaccgcctctgataaaaactacgtcgcgggactgattgactacgattggtgcgaagacgacttgtcaaccggcgccgccaccccacgaacatcacaatttaccaagtactggaccgagagtaatggcgttgagagcaagtctctgaccccagcgctctgtaggactccggcaaataagcttaagaacaaggaaaacgtatacaccccaaaatcagccgtcaagaacgaggagtactttatgtttcctgagccgaagacccctgttaataagaaccaacataagcgcgagatcctaaccacccccaaccgttacaccacaccttcgaaagctaggaatcagtgcctgaaagagacccccatcaaaatccccgtgaacagcaccggaaccgataaattgatgaccggcgtgatttccccagaacgccgttgcaggtctgtggaactagatctgaaccaggcacatatggaggaaacgcctaagcgtaagggagctaaagtttttgggagcctcgagcgcggtcttgacaaagtgattacagtgcttacaaggtccaaacgtaagggaagtgccagggacgggcctaggagactcaaactacattacaacgtcaccactactcggcttgtgaatccagatcagctgctgaacgagatcatgagcattcttcctaagaaacatgtggactttgttcaaaaaggatatactctaaagtgccagacccaatcagatttcgggaaagtgactatgcaatttgagctggaggtgtgccagctccagaagcccgacgttgtgggtatccgccggcaaaggctgaagggcgatgcgtgggtgtacaagcggctggtggaagatattctatcttcatgtaaagtatag

SEQ ID NO: 123493 - DNA, 1491 bp, Artificial Sequence
  Description of Artificial Sequence: Synthetic coding sequence
atgcgagttctgagcggcacctctcttatgctatgttccctgctattattgctgcaggcattgtgttctccagggctagcaccacagagccgggggcacctatgcagaacgaggcccacagatctagttttcgtggtcgattctagtcgaagcgtgcggcccgtggagtttgaaaaggtgaaggtctttctctcacaggtgatagagtccctggatgtaggaccaaacgccacaagggtcggcatggtgaattatgcttcgacagttaagcaggagtttagcttgagagctcatgtttcaaaggccgcgttattgcaggctgtccgtagaatccagccgttgtccacgggtaccatgacaggtctggccatccagttcgccattaccaaagcttttggcgatgctgaaggggggcgaagccggtcacctgatatctccaaggtcgtaatcgtggttactgacggtagaccccaggatagcgttcaggatgtgtccgcccgtgctagagctagcggtgtggaactgttcgccatcggcgtaggttctgtagacaaggccaccttgcggcagatcgcatcggaacctcaggacgaacacgttgactacgttgagtcgtactccgtgatcgaaaagttgtccaggaagttccaggaagcattctgcgttgtatctgacctttgtgctaccggggaccacgactgcgagcaggtgtgcatttcctccccgggatcttatacatgcgcctgccatgaagggtttactttgaattccgacgggaaaacctgcaatgtctgcagcggcggcgggggtagtagtgctacagatttagtctttttgattgacggatcaaagtccgttcgcccagagaacttcgagcttgtgaagaagttcatcagccaaatcgttgacacccttgacgtcagcgataaactggcccaggttgggctcgtccagtactcttctagtgtaagacaggagttcccgctggggagatttcacaccaaaaaggacatcaaggcagccgtgcggaacatgtcatatatggagaaagggactatgacaggcgctgcccttaaatacctcatcgacaattcctttactgtgagtagtggcgcccggcccggagctcaaaaggtcggcatcgtgtttacagatgggaggagtcaagactatatcaatgacgccgctaaaaaggccaaagacctcgggtttaagatgttcgctgttggcgtgggcaacgccgtggaagacgaactgcgggagatcgcaagtgaaccagtggcagagcactatttctacaccgccgatttcaagaccatcaaccagatcggtaagaagcttcagaaaaaaatctgtgtggaggaggatccctgtgcttgtgagagcctggtgaaatttcaggccaaagtcgaagggttattgcaggctctgacgcggaagttagaagccgtttctaagagacttgcaattctggagaatactgtagtttag

SEQ ID NO: 123494 - DNA, 2874 bp, Artificial Sequence
  Description of Artificial Sequence: Synthetic coding sequence
atggaaaagatgctggctgggtgttttttgctgatactgggacagatcgtccttttacccgcagaagcccgcgagagatcccgtggccgaagtatttcacgggggagacacgcacggactcacccccagacagctttgctcgaatccagctgcgaaaataagagggctgatcttgttttcatcattgacagcagtagaagtgtgaacacccacgactacgctaaagtgaaagagtttatcgtggacatcctccaattcctcgacatcggacctgacgttacgcgcgtgggattgctgcagtacgggtctaccgtcaagaacgagttttccctgaaaacatttaaacgaaagtccgaagtggagagagccgtcaagaggatgcggcatctgtctaccggaactatgaccggactagctatccagtacgcactgaacatcgcattttccgaggcagagggagccagacctctgcgggagaatgtgccccgcgttatcatgatcgttactgatggccgtccccaggattcagtggcagaggtggcagcaaaagccagggacacgggaatattgatctttgcgatcggcgttgggcaggtggatttcaacactctgaagtcaatcgggtccgaaccacacgaggaccatgtgtttttggtcgctaatttttcacagatcgagactctcaccagtgtcttccaaaagaagctgtgcacagctcacatgtgtagcaccctcgagcacaattgtgcacatttttgtattaacattcctggatcatacgtttgtcgttgcaagcagggatacatccttaactccgatcagaccacatgtcgaatccaggatttatgtgcgatggaggatcataactgtgagcagctctgtgtgaacgttcctggctcatttgtatgccagtgctactctggctatgcacttgctgaagatggcaaaagatgcgtagctgttgattactgcgcatctgaaaaccacggatgcgaacacgagtgtgtcaatgccgacggatcctacctttgccaatgccacgaaggtttcgcactgaacccagataagaaaacctgcaccaaaatcgactactgtgctagctccaaccacggctgtcagcacgaatgcgttaataccgacgacagctacagctgtcattgtctgaagggatttaccctgaaccctgacaaaaagacttgccgccggataaattactgtgctctcaacaaacctggctgcgagcatgagtgtgtaaacatggaggaatcctattactgtagatgtcatcgggggtatactctcgaccccaacggcaaaacctgctcccgcgtggatcattgcgcccagcaggaccatggctgtgaacagctgtgcctcaacaccgaggactcctttgtttgtcagtgtagcgaggggtttctcattaacgaggacctgaaaacatgctctagagtggactattgcttgctgagcgaccacgggtgtgaatactcgtgtgtcaacatggacaggtcttttgcctgccagtgtcccgaaggccatgtgctgcgatcagatggaaaaacttgtgcaaagctcgactcgtgcgccctcggggatcacggatgcgagcatagttgcgtgagcagcgaggacagttttgtttgtcagtgttttgagggctacatcttgcgggaagatggcaagacgtgtcgtagaaaggatgtatgccaggctatagaccacggatgtgaacacatctgcgtgaactccgacgacagttatacatgcgaatgcctggaggggttccgcctggccgaggatgggaagcgttgccgcaggaaagatgtgtgcaaaagtacccaccacggctgcgaacatatctgtgtgaacaatgggaattcctacatctgcaagtgtagtgaagggttcgtgctggctgaagacggtcggcggtgcaagaagtgcacagaggggcctattgaccttgtctttgtcattgatgggagcaaaagcctgggcgaggagaactttgaggtggtaaagcagttcgtgaccggcataatcgacagcttaactatctctccaaaagctgcccgcgtgggactgctccagtactccactcaggtgcacactgagttcaccttacggaactttaacagcgcaaaggacatgaagaaagctgtcgcccacatgaaatacatggggaaagggtctatgaccggcctagccctgaagcacatgttcgaaagaagcttcacacaaggggagggcgctcgcccactgagcacacgtgtgcctagggccgcgattgtgttcacagatggcagggctcaggacgatgtgtccgaatgggcgagtaaggccaaggcgaacggaataaccatgtatgctgtgggcgtcggcaaggccatagaggaggaactgcaggaaattgctagcgagcccactaacaagcatctgttttacgcggaggacttctccacgatggacgaaatttcggagaagttgaagaagggaatttgtgaggccctcgaggacagtgacggccggcaggactcacctgccggagaactgcccaagactgtccagcagcccaccgaatccgagcccgtgacgataaacattcaggacctcctttcttgttctaacttcgccgtgcagcaccggtatctcttcgaggaggacaacctcctgcgttccacacagaagctgtcccattctaccaaaccctctggaagtccactcgaggagaaacatgaccagtgcaagtgtgaaaatttaatcatgttccaaaatcttgctaatgaagaagtccgcaagttaacccaaagactgttggaagaaatgactcagcggatggaagctctagagaataggctgcgataccgttag

SEQ ID NO: 123495 - DNA, 2754 bp, Artificial Sequence
  Description of Artificial Sequence: Synthetic coding sequence
atggagaagatgctggctggctgttttctcctgattctgggccaaattgtcctcttacctgcagaggctcgtgagaggagtcgaggacggtctatctcacgaggacggcacgctcggacgcatccgcagaccgcgctcctggagtccagctgtgaaaacaaaagagcagacttggtgttcatcatcgatagctctagaagtgtcaacacccacgattacgcaaaagtgaaggaatttatcgttgatatactgcaatttctcgatatcgggcctgatgtcacaagagtgggtctgctgcagtacgggtcaactgttaaaaacgaattttccctgaagacatttaagcgcaagagcgaggttgaaagagccgtgaagcgaatgcgccatctatccacaggtaccatgactggcttggccattcagtatgctttgaatatcgctttttcagaagccgagggtgcacgtcccctcagggaaaatgtaccccgggtcatcatgatcgtgactgacggacggccacaagatagtgtcgccgaagtggctgctaaggcgcgggacaccggcattctgatttttgccatcggggtgggccaggtggactttaacacgctcaagtcaatcggctccgagccacacgaagatcacgtgtttctggttgcaaacttctctcagatcgaaacactgactagcgtgttccagaaaaagctatgcacagcccatatgtgttctacactcgaacacaactgcgcccatttctgcatcaacattccaggatcttacgtttgtaggtgcaagcagggctacatcttaaacagcgaccaaacaacatgccgaattcaggatttgtgtgcgatggaagaccacaactgcgaacagctgtgcgtcaacgtgcctggttcattcgtatgtcagtgttactccgggtacgccttggcggaagacggcaagcgatgcgtggccgtggactactgtgctagtgaaaaccacggatgcgaacacgagtgtgtcaacgctgatggaagctatctgtgtcagtgtcatgagggctttgctctgaaccctgataagaaaacctgtacccggatcaactactgcgccctaaacaaaccaggttgcgagcacgagtgcgtcaacatggaggaaagctattactgtcgctgtcatcggggatacaccctcgacccaaacgggaagacctgtagtagagtggaccattgcgcccaacaggaccatggttgtgaacaactctgtcttaataccgaggactcttttgtgtgtcagtgctcggagggttttcttatcaatgaggacctaaaaacatgctctcgagtcgactactgtttactgagcgaccacggctgcgaatactcctgcgtcaacatggaccggagcttcgcttgccagtgcccagagggacacgtcctcagaagcgacggaaaaacttgcgctaagctcgactcatgcgcactaggggatcacgggtgtgaacactcctgcgtctcatctgaagacagttttgtgtgtcaatgctttgagggctacatcctccgggaagacgggaagacctgtcgtagaaaagacgtgtgtcaagcgatcgaccatggctgtgaacacatctgcgtgaactcagatgactcatacacttgcgagtgcctggagggatttaggctggcagaggatgggaagaggtgccgccggaaagacgtctgtaaatcaacacatcacggatgcgagcacatctgcgtcaataacggcaactcatatatctgtaaatgttctgaaggatttgtccttgctgaggacggacgaaggtgtaaaaaatgtacagaaggacccatcgatcttgtttttgtgatcgacgggagcaagtccctgggcgaggaaaacttcgaagtcgtgaagcagtttgttactgggatcatcgacagcctaacaatttcgcctaaggcagccagagtgggcctcctccagtattctactcaggtgcacaccgaattcaccctgcgaaattttaatagcgcaaaggatatgaaaaaggcagtcgcccacatgaaatatatgggcaaggggtccatgacaggcttggccctgaagcacatgttcgaaaggagcttcactcagggggaaggcgcgaggccgctgtcgacgcgcgtgccccgagctgcgatagtcttcacagacggccgcgcacaggacgatgtgtctgagtgggccagtaaagcgaaggccaacgggatcacaatgtatgctgtgggagtcggaaaagccattgaggaagaactgcaagagattgcatctgagccaactaataaacacctcttttacgccgaggatttttccaccatggacgaaatctccgagaagctcaaaaaagggatttgcgaggcgctggaggattccgatggtcggcaggatagcccggctggcgagctaccgaaaactgtccagcaaccgacagaaagcgagcctgttaccataaacatacaagaccttctctcctgttccaactttgccgtgcaacaccgatacttgttcgaggaggataatcttctccgctctacgcagaaactatcacactccactaagccttccggaagcccactcgaggagaagcatgaccagtgcaagtgtgaaaacctgattatgttccagaatctggccaacgaggaagtccggaagttaactcagcgctacctgcttgaagagatgacccaaagaatggaagccctggagaatcgcttgcggtatcgttag

SEQ ID NO: 123496 - DNA, 348 bp, Artificial Sequence
  Description of Artificial Sequence: Synthetic coding sequence
atggaagaccacaactgcgagcaattgtgcgtgaatgtgcccggctcttttgtgtgtcagtgttatagtggttacgccctcgccgaggacggcaaacgatgtgttgcagtagattactgcgcaagcgagaatcacggttgcgaacacgagtgtgtcaacgcagacggctcatatctctgccaatgtcacgaggggtttgctctgaatcccgataaaaaaacgtgtacgaagatcgattattgcgcaagcagcaaccacggctgtcagcacgagtgcgtaaatacagatgacagctacagttgccactgcctgaagggatttaccctcaatcctgacaagaaaacctag

SEQ ID NO: 123497 - DNA, 2871 bp, Artificial Sequence
  Description of Artificial Sequence: Synthetic coding sequence
atggagaaaatgctagccggctgcttcctacttattctcgggcaaatagttcttctcccagccgaggcgcgggaaagatcccgcggccgatccatatccagagggcgtcacgctcgaactcaccctcaaaccgcgttactggagagtagctgcgaaaataagagggcagacctggtattcatcatcgactcttcaagaagcgtgaatactcacgactacgcgaaagtaaaggagttcatcgtggacatcttacaatttttagacatagggcctgacgtgacgagagtgggactcttacagtacggctctaccgttaaaaacgaatttagtttgaaaaccttcaagcgcaaaagcgaggtagagagggcggtgaaacgcatgagacacctgagcacgggcaccatgaccggattggcaatacagtatgcgcttaatatcgctttcagtgaagccgagggcgcccggcccttgcgtgaaaatgtgcctcgagttataatgatcgtgacggatggtagaccgcaggatagtgtggcggaggtcgccgccaaggccagggatacaggcattctcatcttcgcaatcggagtgggccaggtcgacttcaacactctcaaatcaattgggagcgagccccatgaggaccacgtgtttctcgtggcaaatttctcgcaaatcgagactctgacttctgtgtttcagaaaaaactctgtaccgctcacatgtgtagcaccttggagcataattgcgcacacttttgcattaatatacccggctcttatgtttgtaggtgtaaacagggctatatcctcaactccgaccaaacaacatgccgtatccaggacctttgtgcgatggaagaccacaattgcgaacagctgtgcgttaacgttccgggaagcttcgtgtgtcaatgctactccggttatgccctggcggaggacggcaagaggtgcgtcgccgtggactactgtgcatctgaaaaccacggctgtgaacacgaatgtgtaaatgctgacggatcctatctatgccagtgtcacgaggggttcgctctgaatccagacaagaagacctgcacgaagatcgactactgcgcaagctcaaaccatggctgtcagcacgaatgcgtgaataccgacgacagctactcctgtcattgcttaaaaggtttcaccctcaacccagacaagaaaacgtgtaggcgtatcaactactgtgctctgaacaagcccgggtgcgagcacgagtgcgttaacatggaggagagttactactgccgctgccatagaggctacactctggatcccaatggaaagacctgttcccgggtcgaccattgtgctcagcaggaccatggctgcgagcagctatgcctcaacacggaggacagttttgtgtgccagtgttccgaaggcttcctcatcaacgaggacctgaagacctgtagtagggtagactactgcctgctcagcgatcatggttgtgagtattcttgtgtgaatatggacagatcctttgcatgtcagtgccctgaaggacacgttctgcggtccgatggaaagacctgcgcaaagctagattcctgcgccctgggcgaccacggttgcgagcattcatgcgtgagttctgaagactcatttgtatgccagtgtttcgaaggttatatcctccgcgaagatggaaagacctgtaggcgaaaggacgtgtgccaagccatcgatcatggctgtgagcacatatgcgtaaacagtgacgacagctacacttgtgagtgtctcgagggctttcgtcttgcagaggacggtaaacggtgcagaagaaaagatgtatgcaagtccacacaccacggttgcgagcatatctgtgttaataacggtaactcctacatctgcaaatgctctgaagggttcgtgctcgcggaggacggacgtcgatgcaaaaagtgcacggaaggtcctattgatctcgtgttcgtgattgacgggtctaaatcactgggcgaagagaattttgaggtcgttaagcagtttgtcacaggaattattgacagcctgacaatctcccctaaagccgcacgagtgggcttgttacagtattccacccaggtccacacagagttcacactgcgaaattttaactcggccaaagatatgaaaaaggccgtcgcacacatgaagtatatggggaaaggtagcatgaccggacttgctttaaaacatatgttcgagcgctcctttacacagggggagggagcccgacccctttcaacccgggtgcctagggcggccattgtgtttaccgacggacgcgcacaggatgacgtgtcagaatgggcatccaaggcgaaggcgaacggtattaccatgtacgccgtcggcgtgggaaaagcaatcgaggaggaattacaggagatcgccagcgaacctaccaataagcacttgttctacgcagaagacttttctacaatggacgagatcagcgaaaagctcaaaaaggggatctgcgaggcgctggaagattcagacgggaggcaggacagtccagcaggagagttgccaaaaaccgtgcagcagccaacggaaagtgaacccgtgaccataaacatccaagacctcctgtcttgctcaaatttcgccgttcaacaccgatatctgttcgaggaagataacttgctgcggagtacccaaaagttaagccactccaccaaacccagtggttctcccctagaggagaaacatgaccagtgtaaatgcgagaatctgatcatgttccaaaatctagccaacgaggaggtgcgcaaactcacacaaaggctagaagaaatgacccagagaatggaggctctggagaaccgcttgcgctatcgctag

SEQ ID NO: 123498 - DNA, 2814 bp, Artificial Sequence
  Description of Artificial Sequence: Synthetic coding sequence
atggagaagatgctggcaggctgctttttgcttatcctgggacagattgtcctgctgccagccgaggctagagagagatccagaggtcggtccattagcaggggccgacacgccaggacgcatccacagactgctctgcttgagtcctcgtgcgaaaacaagcgagcggaccttgtgttcattattgacagctctagaagtgtgaatactcatgattacgcaaaggtgaaagagttcattgtggacatccttcagttcctggatattgggcctgacgttactagagttggactcctccagtacggatctactgttaagaatgagttttccttaaagaccttcaaacgcaagtcagaagtcgagagggccgtgaagcgcatgagacacctgagcaccgggactatgacaggcttagccattcagtacgctctcaacatagcattcagcgaggctgagggtgcccggcccctacgcgaaaacgtacccagagtaatcatgatcgtgacagacgggcggccgcaggatagcgtggccgaggtggccgctaaggcccgcgataccggcattcttatatttgccattggcgtgggacaggtggatttcaacacactaaaatctataggctcagaaccccacgaggatcatgtcttcttggtagccaacttctcccaaattgaaacgctaacatcggtatttcaaaaaaaactgtgcacagctcacatgtgtagtactttagaacacaattgtgcccacttttgcataaatattcctggaagctatgtctgcaggtgtaaacaggggtacatactgaattcggaccagacaacctgtaggatccaggacttgtgcgctatggaagatcacaactgtgagcagctgtgcgtgaacgtgcccgggtccttcgtgtgccagtgttacagcggttacgcactcgctgaggatggcaaacggtgtgttgctgttgattattgcgcgtcggagaatcacggatgtgagcatgaatgcgtgaatgctgatgggagttacctgtgccaatgccacgagggattcgcactgaatcccgacaagaaaacatgcaccaaaatcgactactgtgctagtagtaaccatgggtgccagcatgagtgcgtgaacacggacgattcatatagttgtcactgcctgaaaggattcacactcaacccagataagaaaacttgtagaagaattaattactgtgccttaaacaagcctggctgcgaacatgagtgtgtgaatatggaagagagttactactgcagatgtcaccgcggatacaccttggatcctaatgggaaaacgtgctcccgagtcgaccactgtgctcaacaggatcatgggtgtgaacagctgtgtctgaacaccgaggacagctttgtgtgccaatgttcagaaggcttcctgatcaatgaggatcttaagacatgtagccgagttgactactgcctgctgtcagatcacgggtgcgaatatagttgtgtgaatatggacaggtcctttgcctgtcagtgtcccgaggggcatgtgttgcggtccgatggcaaaacgtgtgccaagctcgatagttgcgccctcggcgatcacggatgcgagcattcttgcgtgtcttcggaagacagcttcgtgtgtcagtgctttgaaggctatatattgagggaggacggaaagacttgtcgtaggaaagatgtgtgtcaggctatagaccatgggtgtgaacacatctgtgtgaacagcgacgactcttacacttgcgaatgtctggagggtttccgtctcgctgaagatggaaagaggtgcaggaggaaagatgtttgcaagtcgactcaccacggttgcgagcacatctgcgtaaacaacgggaacagttatatttgcaaatgtagcgaggggttcgtgctggctgaggacggacgcaggtgtaagaagtgtaccgagggtccgatagaccttgtatttgtgatagatggtagcaagagtctgggagaggaaaatttcgaagtggtaaaacagttcgtgactggaatcattgactcgcttacaatcagtccgaaggcagccagagtaggcctcctgcagtacagcacccaggtgcataccgagttcacactgcggaacttcaactctgccaaggatatgaaaaaggccgttgctcatatgaagtacatgggaaagggttccatgactgggctagcacttaaacacatgtttgagcgtagttttactcaaggggaaggtgcaagaccactctcaacacgggttccccgcgccgccattgtgtttaccgacggcagagcccaagacgatgtgtccgaatgggctagcaaggcaaaggcgaatggaatcaccatgtacgcagtaggagtcgggaaggctattgaagaggaattgcaggagatcgccagtgagccaaccaataagcacctattctacgcagaggacttcagcaccatggatgagatctctgaaaaacttaagaagggtatttgcgaggctctggaggatagcgacgggcggcaggatagtcccgcaggggagctacctaagaccgttcagcagccgacagtccagcacagatatctgttcgaggaagacaatcttctgaggtccacacaaaagcttagtcactccaccaagcccagcggatccccactggaggaaaagcatgatcagtgcaagtgcgagaacctgattatgttccagaacctggctaatgaagaggtgagaaagctgactcaaaggctcgaggagatgactcagcgcatggaggccctggagaacagattacgttatcgctag

SEQ ID NO: 123499 - DNA, 2019 bp, Artificial Sequence
  Description of Artificial Sequence: Synthetic coding sequence
atggaggatcacaactgtgagcagctgtgtgtgaacgtacctgggtcatttgtctgccaatgctacagcggctacgccctggccgaggatggtaagagatgcgtagcagtagattactgtgcgagtgagaaccatgggtgcgaacacgagtgcgtgaatgctgacggaagttatttgtgccagtgtcacgagggatttgcgctcaatcccgataagaaaacctgtacgaaaattgattattgtgccagctcaaatcacggctgccagcatgaatgtgtgaataccgatgactcttactcgtgccactgtctaaaaggctttactcttaatccagacaagaagacttgcaggaggatcaattactgcgccctgaataaaccaggttgcgagcacgagtgcgtcaatatggaagagagctactactgtcgatgccataggggttatactctggaccctaatggcaaaacatgctctcgggtagatcactgtgctcaacaggatcatgggtgtgaacaactgtgccttaataccgaggactcctttgtgtgtcagtgttcagagggctttctgatcaatgaggacctgaaaacatgctcccgcgtggactactgcctgctcagcgatcacggctgcgagtacagttgtgttaacatggatcggtcttttgcttgtcagtgtcccgaggggcatgtgttgagatctgacggcaaaacgtgcgccaaactagactcttgtgccctgggagaccacggctgtgagcactcctgcgtgagcagtgaggactccttcgtgtgccagtgctttgagggctatattctccgcgaagacggcaagacatgtcgtcggaaggacgtgtgccaggctatcgaccacggctgcgagcacatctgtgtaaactcagacgatagctacacttgtgaatgcctggaaggctttcgcctagcagaggacggcaagcggtgtaggcgcaaagacgtctgcaagagcacccaccacggctgcgagcacatttgcgtaaataacgggaactcatacatttgtaagtgctcagaggggtttgtgcttgccgaggatggtcgcagatgcaaaaagtgtaccgaggggccaatcgatcttgtgttcgtcatcgatggtagtaaaagtctgggggaggaaaactttgaagtggtgaagcaattcgtgaccgggatcattgactctcttactatttcccccaaagccgcacgcgttgggctgctccagtattctacgcaagtgcatacagaattcacactgaggaattttaacagcgccaaggatatgaagaaagccgtagcccacatgaaatacatgggtaaggggagtatgaccgggctggccctgaagcacatgttcgagaggtcatttacgcagggagagggcgcgcgccctctgagtacccgagtcccgcgcgcagctatcgtcttcactgacgggcgtgcacaggatgatgtgagcgaatgggcctctaaagctaaagctaatggcattacaatgtatgccgtgggcgtgggtaaggcgattgaagaagaactccaggagatagccagtgagccaactaacaagcatctgttttacgctgaggatttttcaactatggacgagatttccgagaagctgaaaaagggcatttgcgaagccttggaagacagcgatggcaggcaggacagtcccgctggcgagctgcctaaaacagtgcagcagccaactgagtcagaacctgtgacgattaatatacaggacctcctgtcttgctctaacttcgcggttcagcataggtatctgttcgaggaggataatctcctcaggtctactcagaagctctctcactccaccaagccctccggttcccccttggaggagaaacatgatcagtgcaaatgcgaaaacttaattatgtttcaaaatcttgccaatgaagaggtgcggaaactgacacaaaggctggaagaaatgacccagcgaatggaagccttagagaacaggctgcgttataggtag

SEQ ID NO: 123500 - DNA, 2748 bp, Artificial Sequence
  Description of Artificial Sequence: Synthetic coding sequence
atggaaaagatgctggctgggtgttttttacttattcttggccagatagtccttctgccagccgaagcacgcgagcgctcacggggccggtctatctccagagggaggcacgctcggacacaccctcagaccgctctgctcgaaagctcttgtgagaacaagcgggccgatcttgtgttcatcatcgactcttcccggtcggtcaacactcatgattacgccaaagtgaaagagttcatcgtggatatactgcagttcctcgatattgggcccgacgtgacccgtgtcggcctgcttcagtatggatcaaccgttaaaaacgaattttccctcaaaacttttaagcggaagtctgaggtggagcgcgccgtcaagcggatgagacatctgtccactgggaccatgactgggctggcaatacagtacgctctgaacattgccttctctgaggctgagggggccaggcccttacgcgagaacgtcccgagagtgatcatgattgtgacggacgggaggccccaagacagtgtagccgaggtagccgctaaggcccgtgataccggtattctgatcttcgctattggggtggggcaggtcgatttcaacacccttaagagcataggttccgagccacacgaagaccacgtgttcctggtcgccaatttcagccagatcgaaaccctgacatctgtatttcaaaaaaagctttgcactgctcatatgtgctcaaccctcgagcacaattgcgcgcacttctgcatcaacattccaggctcttatgtttgtagatgcaaacaggggtatatccttaattctgaccagacaacatgtcgaatacaagacctttgtgctatggaagaccacaactgcgaacagctttgcgtgaacgtgccaggctccttcgtgtgccagtgctacagcggctacgctctagccgaggacggaaaaagatgtgttgcagtcgactattgcgcttccgagaatcacggctgtgagcacgaatgcgtaaacgctgacggatcctatttgtgtcagtgtcatgaaggattcgcactgaatccagacaagaagacgtgtacaaggataaactattgcgcccttaataaaccgggctgcgaacatgagtgtgtgaatatggaagagagctactactgtcgatgtcatagaggctatacactcgaccccaatggcaagacatgtagtagagtggaccattgcgctcaacaggatcatggctgtgaacaactgtgtctgaatactgaggattcatttgtttgccagtgttcagaggggtttctcataaatgaggacttgaagacctgctctagagtagattattgcctgctttcagatcatgggtgtgagtactcatgcgtgaatatggatcgaagtttcgcttgccagtgccctgaagggcacgttcttcgctcagatgggaagacatgcgcgaagctggactcctgcgcactcggagatcatgggtgtgaacacagctgtgtttctagtgaagattcatttgtgtgccagtgctttgagggttatatccttagggaggacggaaagacttgcaggagaaaggacgtgtgccaggcaatcgatcatggctgcgagcacatctgcgtcaactcagacgattcttatacctgcgagtgcctagagggttttcggttggccgaagacgggaagcgatgtaggcgtaaggacgtctgtaagagcacccaccacggatgcgaacacatttgtgtcaataacggcaactcttatatctgtaaatgtagcgaaggctttgtgttagccgaggatggaagaagatgcaaaaagtgcacggagggccctatcgaccttgtcttcgtgatagatggctccaaatcgttgggcgaagagaatttcgaagttgtcaagcaatttgtgacaggtatcattgatagtctgaccatttccccaaaggcagcacgggtgggccttttacagtactccacccaggtacatactgagttcacattgcgaaattttaatagcgccaaggacatgaagaaagctgttgcccacatgaagtacatggggaaagggtcaatgaccggacttgcactcaagcacatgttcgagcgtagtttcacccagggagagggcgctaggcccctgagcaccagagtgcctagagccgcaatcgtgtttacagatggtagggctcaggatgacgtgtctgagtgggcatccaaggcaaaggccaatggaataaccatgtatgcagtaggggtgggcaaagcaatcgaggaagagttacaagaaatcgctagtgagccaacaaacaagcacctgttttatgcggaggatttttccactatggatgagatctcagagaagttgaaaaagggaatatgtgaggccctcgaggattccgacggaagacaagatagcccagcaggagagctgcccaagaccgtgcagcaaccaacagaaagcgagcccgttactataaacattcaggacttactcagctgctcgaactttgctgtgcagcaccgctacctgttcgaagaggacaaccttctgcggtcaacccaaaagctgtcgcactctactaaaccgagcggatctcctttagaggaaaagcatgatcagtgcaaatgcgaaaacctgatcatgtttcagaacctggctaacgaggaggtgaggaaattgacacagcgattggaagagatgactcagcgcatggaagctctggagaaccggttacgctacagatag

SEQ ID NO: 123501 - DNA, 1461 bp, Artificial Sequence
  Description of Artificial Sequence: Synthetic coding sequence
atgccacgacctgcccccgcgagacgtttgccagggttactgctcctgttgtggcctctcctcctcttaccgagcgccgcacccgatccagtcgcgcgcccaggttttagacgtctcgagacccggggccccggaggaagccctggtagaaggccatccccagctgcaccagacggcgccccggcgtctgggactagcgaacctggcagagctcgcggtgccggggtatgtaaaagtcggcccctcgacctggtgtttattattgattcctccagatcagtgaggcctctagagtttacaaaagttaaaacttttgtgagccggataatcgacaccctggacattgggcccgccgatacacgtgtcgccgtcgtgaattacgccagcacagtgaagatcgaattccaactgcaggcctatacagacaagcaatctctgaagcaagcagtgggaaggatcaccccccttagcacgggaactatgtccggcctggctatccagactgcaatggatgaagcctttaccgtcgaggcgggagcgagggaaccatcctcaaacattcctaaagtcgccatcatagtgactgatggccggcctcaagatcaggttaatgaagttgccgcccgggcacaggcctctggtattgagctgtatgcagtgggagtagatcgggccgacatggctagccttaagatgatggcaagtgagccactggaggaacatgtgttttacgtggaaacatacggagtcattgagaagctgagtagccgctttcaggagaccttttgcgccctggacccttgcgtgctgggaacacatcagtgtcagcacgtgtgtatttctgatggtgagggtaagcaccattgcgagtgctcacagggatacacgttgaacgctgacaagaaaacctgctcagcactcgacaggtgcgccctgaatactcatgggtgtgaacatatttgtgtgaatgaccgcagcggatcataccattgtgaatgctacgaaggatacaccctaaatgaagaccgcaaaacttgcagcgcccaggataagtgcgccttaggaactcacggatgccaacacatatgtgtgaatgacaggaccgggagtcatcactgtgagtgctatgagggatatacgctgaatgccgataaaaaaacgtgctccgtgcgagacaaatgcgctctgggttcacacggctgtcagcacatctgcgtatcagacggagccgcctcctaccattgtgactgttatcccggctacacacttaacgaggataaaaagacctgcagcgctacagaagaggccaggcgcctagtgagcactgaggatgcttgtgggtgcgaagcgactcttgcgttccaggataaggtaagctcctatctgcaacgcttgaataccaaactggacgacatactcgagaagctgaaaataaacgagtacggccaaatacaccgctag

SEQ ID NO: 123502 - DNA, 1335 bp, Artificial Sequence
  Description of Artificial Sequence: Synthetic coding sequence
atgccacgccctgccccagcacgccgccttcccggactcctcctgcttctgtggccattattgctcctgccttccgctgcgccagatcccgtggcaaggccagggtttaggagactggagactagaggtcccggcggatctcccggccgtcgcccaagtcccgccgcaccagacggggcaccggccagcggcacctccgaacccggtcgagcacgcggcgctggagtgtgcaagtcccgccctctggacctagtgttcatcatagattcatctcggtctgttaggcctcttgagtttacaaaagtgaagacatttgtgagcagaattattgatacgctggacattggccccgcagataccagggtagccgtcgtaaattatgccagtaccgtcaagatcgagtttcagctccaggcttacactgacaaacagtctcttaaacaggccgtcggcaggataacgcccctgtcaaccggtactatgagtggtctggccatccagaccgcaatggatgaagcctttactgtagaggctggtgcacgagaacctagctccaatatccctaaggttgctatcatcgtgactgatggaagaccccaggaccaggtgaacgaggtggctgccagggcacaggcgagcggtattgagttgtacgccgttggcgtggatcgcgctgatatggcttccctgaagatgatggccagtgaacccttagaggagcatgttttttatgtggaaacatatggcgtgatcgagaaactgagtagtaggtttcaagaaaccttttgtgcattggaccgctgcgctctgaatactcatggctgtgaacatatctgcgttaatgacaggagcgggtcataccattgcgagtgttacgagggatacacgctaaatgaggaccgtaaaacgtgttccgctcaagacaagtgcgctctcgggacccatggatgtcagcatatttgtgttaatgacaggactggctcacaccactgtgagtgctacgaaggctacacccttaacgctgacaagaagacctgtagtgtcagagacaagtgcgccctgggtagccacggatgtcagcacatttgcgtctccgacggagcagcgtcataccactgcgattgctaccctggctatacactgaatgaggataaaaaaacgtgcagcgcaacagaggaggcccgccggctggtctctactgaggacgcttgcggatgtgaagccaccctggccttccaggacaaagtcagttcctatctgcagaggctcaacacaaagttggatgacatccttgagaaactgaagatcaacgagtacggacagattcaccgctag

SEQ ID NO: 123503 - DNA, 1869 bp, Artificial Sequence
  Description of Artificial Sequence: Synthetic coding sequence
atgcgcgggctcctctgttggccagttctgctgctgctgctgcagccttgggaaacacaactgcagcttacgggcccgagatgccacactggaccccttgaccttgttttcgtcatagatagctcaaggtccgtgagaccctttgagtttgagaccatgagacagtttctgatgggcttactgcgcggcctcaatgttggtccgaacgccaccagggttggagtgattcaatactcgtctcaggtgcagtccgtcttcccactccgggctttctcacgtagggaagatatggagcgcgcgataagagacttggtgccattagcccagggcacaatgactggcctagcaatccagtacgccatgaatgtagcttttagcgtggccgaaggcgcgaggcccccagaagagagagttccacgcgtggctgtcatcgttactgatggaagaccccaagatagggtggcagaggtggccgcacaagccagggcccgcggaatcgagatctatgccgtgggagtccagcgcgctgacgttgggtcgctgagagccatggcttcacccccactggatgagcatgtgtttctggtggagtctttcgacctgatccaagaattcggcttgcagttccagagtaggctgtgtggtaaagaccagtgcgctgaggggggtcacggttgtcagcaccaatgtgtcaatgcctgggcgatgtttcactgcacctgtaatcccggctataagctggctgcggacaataagagctgcctcgctattgacctgtgcgctgaaggcactcacggctgcgagcatcactgtgtcaacagccctggaagctatttctgccactgtcaggttggctttgtcctgcagcaagaccagcggagctgtagagcaatcgattattgttcctttgggaaccattcttgtcagcatgagtgtgtgtcaacccctggaggaccacgctgtcattgtcgcgaagggcatgatctgcagccggacggacgctcatgccaagtgcgcgacctgtgcaacggtgtcgatcatgggtgcgaattccaatgtgtgtctgaaggcctgagctaccgctgtctttgtcccgaaggtcgtcagctgcaggcagacgggaagtcttgtaaccggtgtagagaagggcatgtggacctcgtgctgctggtcgatggcagcaagagtgtgcgcccgcaaaactttgagttggtaaaacgttttgttaaccagatcgttgactttctggacgtctccccagagggcacacgagttggcctcgtacagtttagttccagggtaagaaccgaatttcccctcggtcggtacgggaccgccgccgaagtcaagcaggcagtgctggctgtggaatatatggaacgcggcacaatgaccggactggccctgcgccacatggtggaacactcctttagtgaagcccagggcgcacgtcccagagctttgaacgtaccacgggtgggcctcgtgttcactgatggcaggtcacaagacgatatttccgtgtgggctgccagggcaaaagaggagggtattgttatgtatgccgtgggggtcgggaaggcagtggaggctgagttacgagagattgcatcagagcccgccgaattgcatgttagttatgcccccgacttcggtactatgacccatctgctggagaacctgaggggttcgatttgccctgaggaagggatcagtgcaggaactgaactgcgttccccctgcgaatgtgagagtttggtcgagtttcaggggcgaactctgggcgcgctcgagtctctgacgctgaacctggctcagttgaccgccaggctggaggacctcgagaatcagctggccaatcagaagtag

SEQ ID NO: 123504 - DNA, 1746 bp, Artificial Sequence
  Description of Artificial Sequence: Synthetic coding sequence
atgagagggctgctatgctggcctgtgctgctcctgttgttgcaaccatgggagacccagctacagctgactggaccccggtgccacacgggacctctcgacctcgtgttcgtaatcgatagcagtcgaagtgttcggccctttgagtttgagaccatgagacagttcctgatggggcttcttagaggcctaaacgtgggaccaaatgccacaagggtcggagtgatccaatatagctctcaggtacaaagtgtgttccccctccgggccttttctcgtcgcgaagatatggagcgcgccatacgggacttagtgcctttggctcagggcaccatgaccggcttagctatccagtacgcaatgaacgtggcattttcagttgcagagggagcccgtccgcccgaggagcgtgtgccgagagtggccgtgattgtgaccgacggaaggccacaagacagagtcgccgaggttgccgcgcaggcgagggcacggggcatagagatttacgccgttggggtgcagcgggctgacgtcggcagtctgcgagctatggcctctccccccctggatgaacatgtctttctcgtggagtccttcgacctgatacaggaattcggacttcaattccaatcacgcctgtgtgcaatagacttatgtgctgagggcactcacggttgtgaacatcattgcgtgaatagcccgggctcctacttttgtcactgccaggtagggttcgtgctgcagcaggaccaacgatcatgccgggccattgactattgtagtttcgggaatcacagctgtcaacatgaatgcgtgtcaacccccggggggcctcgctgccattgtagagagggacatgacttgcagccagatgggcgctcctgccaggtgcgagacctctgcaatggcgtggaccacggctgcgagttccagtgcgtgagcgaggggctgtcgtacaggtgcttgtgccccgaggggagacagcttcaggcagatggcaagagctgcaaccgttgccgggaaggccatgtggacctggtgcttctggtggatggaagcaaatcagtgcgcccccagaacttcgagttggtgaagcgctttgtgaaccagatcgttgattttctcgacgtgtctccagaagggaccagggtggggcttgtacaattctcttcccgcgtgcgtacagaattccctcttggcaggtacggcacagccgcggaagtaaagcaggcggttctagccgtggagtacatggagaggggaactatgacaggtctagcgctccggcacatggtcgagcattccttctctgaggcccagggtgcccggcctagagcactgaacgtgccaagggtcgggctcgtatttacagatggcaggagccaggacgacatatctgtttgggccgcaagagccaaggaggagggcattgtaatgtatgcagttggtgtggggaaagcagtggaggccgagttaagagagatagcctccgagcccgctgagcttcacgtgagctacgcccctgatttcgggaccatgacacacctgctggagaacttaagaggatctatctgccccgaagaggggatatcagctggtacagaactccgcagcccctgcgagtgtgagtctctggtggaatttcagggccgcacactgggggccctggagtccttaacattaaacctggcccaacttaccgcccgcttggaggatcttgaaaatcagttggctaaccagaaatag

SEQ ID NO: 123505 - DNA, 1500 bp, Artificial Sequence
  Description of Artificial Sequence: Synthetic coding sequence
atgagaggcctgctttgttggcccgtgctgcttcttcttttgcagccctgggaaacccaactccagcttacaggcccaagatgccacaccggccccctggatctcgtgttcgttatcgacagctctcgctcagttaggccttttgagtttgagacaatgcgccaatttctgatgggcttgctgaggggcctgaacgtcggacccaacgccacccgagtgggcgttatccagtatagcagccaagtgcaaagtgtttttccactgagagccttctcccgtagggaagacatggaacgggccattagggatcttgttcctcttgcccaagggacgatgaccggcttggctatacagtatgccatgaacgtcgccttttccgtagccgagggtgcccgcccacccgaggaacgggtaccccgcgtggcagttatagttaccgacggcaggccccaggatagagtggctgaggtcgctgctcaggcgcgggcacggggcatagagatctacgctgtcggagttcagagggctgacgtgggaagtctgcgcgcgatggcatcgccccccctcgacgaacacgtgttcttggttgagagcttcgatcttattcaggaatttggcctgcaatttcagtctaggctctgcgtgcgggatctgtgtaatggcgttgatcacggctgcgagttccagtgcgtgagtgaagggctcagttacagatgtctgtgtcctgagggccggcagttgcaggctgatggcaaaagctgcaaccgctgtcgtgaggggcacgttgatttggtgcttttagtcgacggcagcaaatcagtgagaccacaaaacttcgaacttgttaagaggtttgtaaatcaaattgttgatttcttggatgtctcacctgagggtacgagagtcggactcgtgcagttttccagcagagtgcggacggagtttccactggggcggtatggaacagctgccgaagtgaagcaagcagttttggcggtcgagtacatggagagagggacaatgactggactagccctcagacacatggtcgaacatagcttcagcgaagcccaaggggcccggcctagagcattgaatgtcccccgggtgggactcgttttcaccgacggtcgttctcaggacgatatctccgtgtgggcagccagggctaaagaggaaggcatcgtcatgtacgccgtcggggttggcaaggccgtagaggctgagcttagagaaatcgcctctgagccagccgagctccacgtgagttacgctcctgactttggaactatgacacatcttctggagaacctgcgcgggtcaatctgtcccgaagaagggatttctgccggcacggaactgcggtccccctgtgagtgtgagtctcttgtagaatttcagggccgcacactgggggccctggaaagtctcaccctgaacctagcgcagcttacagccaggttggaggacctcgagaaccagctcgccaaccagaaatag

SEQ ID NO: 123506 - DNA, 1623 bp, Artificial Sequence
  Description of Artificial Sequence: Synthetic coding sequence
atgcgaggccttctctgttggccagtgctgctacttctactgcagccctgggagacacagctgcagcttactgggccaagatgtcatacgggcccactggacctggttttcgtcattgactcctctagaagcgtgagacccttcgagttcgaaacgatgcgccaattcctcatgggacttcttcgggggttgaacgttggtcctaacgccacccgagtaggcgtgatccaatattcctcacaagtgcaatcagtgtttccattacgcgcattcagtcgccgggaagatatggaacgcgccattagggacctggtccccctggcacagggtacaatgacaggtctggctatccaatacgctatgaacgttgccttcagcgtggccgaaggcgcccggccacctgaggaaagggtgcctcgggttgcggtcattgtgaccgatgggcggccccaggatagagtagccgaggtagccgcccaggccagagcgcgcgggatagagatctacgccgtaggggtacagagggctgatgtgggttctctgcgtgcaatggccagcccaccacttgacgaacacgtgtttctcgtggaatcattcgacctgatccaagaattcggactccagttccagtccaggctgtgtgcaattgattactgctctttcgggaatcactcctgccaacatgaatgtgtttctacacccgggggaccccgctgccattgtagagaaggccacgatctccagcccgatgggcgctcctgtcaggtgcgtgacctgtgcaatggggtcgaccacggatgtgaattccagtgcgtttcagaaggtctctcatacagatgtctgtgccccgagggccgacagttacaggcagacgggaagtcctgcaatcgatgtcgggaaggacatgtagatttggtgctcttagtggacgggagcaagtcggtacggccccagaatttcgaactggtcaagaggttcgtgaatcagattgttgatttcctcgacgtgtcaccagaaggaactcgagtgggattggtgcagttcagctctagagtccggacggagtttcctctgggccgctacggtacagccgccgaagttaagcaggctgtgctggccgtggaatacatggaacgaggcacgatgaccgggttggccttgcggcatatggtggagcattcattttcagaggcccagggtgcccgcccgcgcgctttgaatgtgccacgagtgggcctcgtgttcactgatggaagatctcaggatgatatatcagtgtgggccgctagggctaaggaggagggcatcgtcatgtatgccgtcggtgtcggcaaggcagtggaggccgagctacgtgaaatcgcttctgagcctgccgagctgcatgtgagttacgcacctgattttgggaccatgacgcacctccttgaaaatctcaggggatccatctgccccgaagaggggattagcgccgggaccgagctccggagcccttgcgaatgtgagtcactggtcgagtttcagggaagaactctgggggcattggagtccctgacgctgaacctggcccagctcactgcgagacttgaagacctagaaaatcagctggctaatcagaaatag

SEQ ID NO: 123507 - DNA, 1299 bp, Artificial Sequence
  Description of Artificial Sequence: Synthetic coding sequence
atgcgcggcctcttatgctggcccgtgctcctgctcttgcttcagccgtgggaaacacagcttcagctgaccggaaaggaccagtgtgctgaagggggccacggctgccagcatcagtgtgtaaacgcttgggctatgtttcattgtacatgcaacccagggtataagctggctgccgataacaagtcctgtttggccattgacctgtgtgcagagggcacacatggctgcgagcatcattgcgtaaactcacccggttcgtatttttgccactgccaagtcggatttgtgctccagcaggaccaacggtcgtgccgagcaatcgactattgttcctttgggaaccactcatgtcagcacgagtgcgtgtccacacctggggggccaaggtgccattgccgggaaggccacgatctgcaaccagacggccgcagttgtcaggtccgcgacttgtgtaacggagtggatcatggatgtgagtttcagtgtgtcagcgagggtctatcataccggtgcctctgccctgagggccggcaactgcaagcagatggaaagtcatgcaacagatgcagggagggacatgtggacctggtgctgttggtggacggatctaagtcagtgcgccctcagaactttgaattagtcaagcggttcgtcaaccaaatcgttgatttccttgatgtatcccctgagggcacaagagttgggctcgtgcagttcagtagcagagtccggacagagttccctctgggtcggtatggcactgctgccgaggtaaaacaggctgtgttggcagttgagtacatggagcggggcaccatgaccggcctggcgctgcgacacatggtggagcactccttttccgaggcccaaggcgcgcgcccacgggcattgaatgttccaagagtgggactggtgttcacagacgggcggagccaggacgacatctcagtttgggcagcgcgagcaaaggaagagggcatcgtgatgtacgcagtgggggtgggaaaagcagtcgaggccgaactgagggagatcgcttcggagcccgcggagctgcatgtttcatacgctcccgactttggaacgatgacccatctcctcgagaacctgagggggtccatatgtcccgaggaggggatttccgcaggcacggagctgagatctccatgcgagtgcgaatcccttgtggaatttcaaggacgcactcttggcgccctggagtccttaaccctgaatctagcccagctgacagctaggctggaagatttggagaatcaactggcaaaccaaaaatag

SEQ ID NO: 123508 - DNA, 1299 bp, Artificial Sequence
  Description of Artificial Sequence: Synthetic coding sequence
atgcgaggactgctatgctggccagtgctcctcctactgctccaaccctgggagacacagcttcagcttacgggcaaagaccaatgcgccgaagggggacatggatgccaacatcagtgcgtgaatgcttgggccatgttccactgcacctgtaaccctggatacaagctggccgcagataataaaagctgcctggccatcgatctttgcgctgaaggcacacacgggtgtgagcatcactgtgtcaattcaccaggcagttacttttgccactgccaggtggggttcgtgctgcagcaagaccagaggtcctgccgggccattgactactgttcatttggtaatcatagctgtcagcatgagtgtgtcagcactcccggtggccctagatgccactgccgggaaggccatgacctccagcccgatggacgatcgtgccaggtccgagatctgtgtaacggagtggatcacgggtgtgaatttcagtgcgtctccgaaggcttgagttaccgatgtctatgccctgaggggaggcaactacaggccgacggcaaatcgtgtaacaggtgtagggaaggccacgtcgatctggtcttgcttgtggatgggtcaaaaagtgtacgtccccagaacttcgagctggtcaagagattcgtcaaccagattgtcgattttttagacgtgtccccagagggcactagagtgggactggtccaattctcctctcgcgtgagaacagaattccctctgggacgatatggcaccgctgccgaggttaagcaggctgtgctggcagtggaatatatggaaagggggaccatgacgggacttgcgctgaggcatatggtagagcattcattctcagaggctcagggcgctcggcctagggctctgaacgttcctcgggtggggctggtgttcacggacggcaggagccaggacgacatctccgtctgggcagccagagccaaggaagaaggcatagtgatgtacgcagtgggtgtaggaaaagctgttgaggccgagttgagggagattgcgagcgagccagccgaattacacgtttcatatgcacctgacttcggaacaatgacccacttgttagaaaacctgcggggttccatttgccccgaggaaggcatcagcgctggaaccgaattgcggtctccatgcgagtgcgagagcttagttgaattccagggccggacgctgggggccctggagtcccttaccttaaatttggctcagttaacagcacgactcgaagaccttgagaaccagctggccaaccagaagtag

SEQ ID NO: 123509 - DNA, 1869 bp, Artificial Sequence
  Description of Artificial Sequence: Synthetic coding sequence
atgagagggttgctatgttggcctgtcttgttgcttcttttacagccgtgggagacccaactgcagctgacaggccctcgttgtcataccggccctctagatttagtctttgtaattgattcttccaggtccgtgcggcctttcgagtttgagactatgcgacagttcctgatggggcttttaagggggcttaacgtcgggcctaatgctacgcgcgtcggagtgattcaatactcttcacaggttcagtcggtgttccctctgagagccttttcaaggcgagaagacatggaacgtgccattagggatttggtcccattggcacagggcactatgaccggcctggctattcagtatgcaatgaatgtggccttcagtgtggccgagggggcccggccacctgaagagcgcgtcccaagagtggccgtgattgtcacggatggaagaccgcaggatcgcgttgctgaggtagcagctcaggcccgcgctcgcggcattgagatatacgcagtgggtgttcagcgagcagatgtgggatcgctgcgtgctatggcctcgcctcctcttgatgagcacgtgtttttggtcgagtcctttgacctaatccaggaattcggcctgcagttccagagccgactgtgtggaaaggaccagtgcgcagagggaggccacggctgtcagcaccagtgcgtgaacgcgtgggcaatgttccattgcacttgtaatccaggttacaaattggctgccgataataagagctgcctggcaatcgatctgtgtgccgaaggaacccatggctgtgaacaccactgcgtcaatagtccaggaagttatttctgtcactgtcaagtgggctttgtgcttcaacaagaccagcgaagttgtcgcgccatcgattactgttctttcggcaaccactcttgtcagcacgaatgcgtctctactccaggcggaccacgttgccattgccgggaagggcacgatcttcagcctgacggaaggtcttgccaagtccgagatctttgtaacggcgttgaccatggctgtgagttccagtgcgtgagcgagggactcagctacagatgtctttgccctgaaggtaggcagctccaggcagacggaaaatcctgcaatcgatgccgggagggacacgtcgacctggtactcctcgtggatggaagcaaatcagtacgtccccagaattttgagctggtgaagaggttcgtcaatcagatcgtggattttcttgatgtttccccagagggtacacgggtcgggctcgtgcagttctcttctcgggtgaggactgaatttcctttagggaggtacggtaccgctgctgaggtgaagcaggctgtccttgccgtggagtatatggagagaggaaccatgactggactggccctaaggcacatggttgagcactcattttcagaggcgcagggggcgcgtccacgggcgttgaacgtacctagagttggattggtgttcactgatgggcgctcccaggacgacatatctgtctgggccgccagggctaaagaggaaggaattgtgatgtacgctgtgggtgtgggtaaagccgtggaggcggagctgagagagattgctagtgagcccgctgagctccatgtgagctatgctcctgacttcgggacaatgacccatctcctggagaacctgcgaggctctatatgcccagaggagggaatctccgccggtaccgagctgcgctcaccatgcgagtgtgagagcttggtcgaattccaaggacggacactgggggccctcgagagcctcacactcaacctcgcgcagctgacagctaggctggaagacctcgaaaatcaactggcaaatcaaaaatag

SEQ ID NO: 123510 - DNA, 1746 bp, Artificial Sequence
  Description of Artificial Sequence: Synthetic coding sequence
atgcgcggtttgctttgttggcccgtcttgctcctgctgttacaaccctgggaaacccagctgcagctcacgggacctcggtgtcataccggtcccctggatctcgtgtttgttatagacagctctagatcagtgcgaccctttgagttcgagacaatgcgacagtttctcatgggtctcctgagaggcctcaacgtggggcccaatgctacaagagtcggcgtgatacagtattccagtcaggtgcagtctgtgtttccacttcgagctttctcacgtcgagaggacatggaaagggctataagagatttggtgcctctagctcaggggactatgacgggcttggctatccaatatgctatgaatgtggctttttctgttgctgagggagccaggccacccgaagaacgagtacctagagtggcagttattgtcacggacggccggccccaagatcgggtggcagaggttgcagctcaggctagggcccgtgggatcgagatatatgctgtcggggtgcaacgggcggacgttggatctcttcgggctatggcatcccctccattggatgaacatgtgttccttgtcgagtcttttgacttaattcaggaatttggtttacagttccagtcacgtctgtgtgctattgacctctgtgcagaaggcactcacgggtgcgagcaccattgtgtgaacagtcccggctcctatttttgccattgtcaggtcggatttgtcctccagcaggatcaaagatcctgcagggctatcgattattgctctttcggcaatcattcctgccagcatgagtgtgttagcactcccggtggacctaggtgtcattgccgggagggacacgatttgcaacccgacgggcgaagctgtcaggttcgcgacctctgtaatggagttgaccacggatgcgaattccaatgcgtgagcgagggtctctcttatcggtgcttgtgccctgagggccgccagttgcaggcggatggcaaatcttgtaatcgttgccgagaggggcatgtggacttagtccttctagtggatggcagcaagtccgtccgaccccagaacttcgaactagtgaaaaggttcgtgaatcagattgtggacttcttagacgtttcgcctgagggcacaagggtcggtcttgtgcagttttctagccgcgtgcgcactgagttcccacttgggcggtatggtacagcagctgaagtgaaacaggctgtactcgctgttgagtacatggaacgcggcactatgacaggtcttgctctgagacatatggtggagcactctttttcagaggcccagggtgcacgtccccgtgccttaaacgtcccacgcgtgggtcttgtgttcaccgacggaaggtcacaggatgatatttctgtgtgggccgctcgggccaaagaagaaggcatcgttatgtacgcggtgggcgtgggcaaagccgtggaagccgaactgagggagatcgccagcgagccggcagaattacacgtaagctacgcgccggatttcggaacgatgacccatctgttagagaatctgcgcggaagtatctgccccgaggagggaatcagcgctggcacagagcttaggagtccttgcgaatgcgagtcactggtggagtttcaaggacggaccttaggcgcccttgagtcccttactcttaatctcgctcagctaaccgcccgcctggaagatcttgaaaaccagttggcgaaccagaagtag

SEQ ID NO: 123511 - DNA, 852 bp, Artificial Sequence
  Description of Artificial Sequence: Synthetic coding sequence
atgtcaaaatcctttcagcagagttcactaagcagagacagccagggccacggccgcgacttgagcgctgccgggattggccttctggctgctgctacacagtccctctcaatgttgctggaaagcgaagatgaactactggttgatgaagaagaagctgcagcgctccttgagtcgggttccagcgtgggcgacgaaactgacctggcaaacctgggcgacgtcgccagcgatggaaaaaaggaaccatccgataaggccgtgaagaaggacggcagtgcaagtgccgccgcaaagaaaaagctgaagaagaggcgattcccaggctccatggagggatttgtgaccctcgacgaggtaggtgatgaggaagattctgaattacagaagcttaggaagagtggcatggccttcaaatccggagacaagaatgacgacggtcttgtggagattaaggtggacaaaattgaggaactggaccaggagaacgaggcagcactagagaatggcattaaaaacgaggagaacactgaacctggagcagaaagttctgagaacgccgacgatccaaataaagatacctctgagaatgctgacggccaaagtgatgagaacaaggacgactatactatcccggatgaatatcgtattggcccctatcagcccaacgtacccgtgggtatcgactacgttattcccaagactggattctactgtaaactgtgcagcctcttctataccaatgaggaagtcgccaagaacactcactgttccagcctgccacattaccagaaattgaagaaatttctcaacaagctggcagaggaaaggaggcagaaaaaagagacctag

SEQ ID NO: 123512 - DNA, 2544 bp, Artificial Sequence
  Description of Artificial Sequence: Synthetic coding sequence
atgtcgaaatcctttcagcaatctagcctgtcccgcgactcccaggggcacggacgggacctctctgctgccggtatcgggttgctggctgccgctacccaaagcctgagcatgcccgcctctctgggccggatgaatcaggggactgctcgattggccagcctgatgaatctggggatgtccagcagtctgaatcagcagggagcccacagtgcattgtcttccgccagcaccagctcccacaatctacagtctatcttcaatatcggatcccgaggacctctgcccttatcctctcagcacagaggggatgcggatcaagcctctaacatccttgcatcctttggcctcagcgctcgggacttggatgagttgtctagataccctgaggataaaataacccccgaaaacctgccccaaattctgctgcagctcaaacgccgaaggacagaggaggggccgaccctttcatacggaagggatggacgttccgctacacgggaaccaccttacagggtgcctcgcgacgattgggaggagaaaagacactttcggcgcgattcctttgatgacaggggccctagccttaatcccgtgctggactacgatcacgggtccaggtcccaggaatccggctattatgacagaatggattatgaagatgataggttacgggacggggagcggtgtagagacgattctttctttggcgaaacctcacataactaccacaaattcgattccgagtatgagcggatggggagagggcccggacctctgcaagagaggtcgttgttcgaaaaaaaaaggggcgcccctcccagttccaatatcgaagatttccacggcctccttccaaaaggctacccgcacctgtgtagcatctgcgacctgccagtccatagcaacaaggagtggagtcagcatatcaacggtgcttctcattcccgcagatgtcagctgcttctggagatttatccagaatggaatccggataacgacacaggtcacacgatgggggacccatttatgcttcaacagtcaactaacccagcacctggcatcctaggacccccacctccaagtttccacctgggcggccccgccgtggggccccgtggcaatctgggggccggtaatggtaatctccaaggcccacggcacatgcagaagggcagggtagaaacaagtcgcgtggtccatattatggactttcagcgcgggaagaacctgagatatcagttattgcagctcgttgagccatttggcgtcatcagcaatcatctgatattaaataagatcaatgaggctttcattgagatggctaccactgaagacgcccaagcagccgtcgattattacactacaacgccggcattagttttcgggaagcccgtgcgcgtccacctgagccaaaagtacaaacgaatcaaaaaacccgaaggaaagcccgaccagaagtttgaccaaaaacaagagctgggtcgggttattcacctatccaacctgccccattccggctatagcgacagtgccgtcttaaagctggctgaaccctacggcaaaataaagaattacatcctaatgcgtatgaaaagccaggcattcattgaaatggaaactagagaagatgcaatggccatggttgatcactgcttgaaaaaggcgctgtggtttcaggggcgatgcgtgaaagtagacctcagcgaaaaatataaaaaattggtcctgaggattccaaacaggggcatcgatctgctcaagaaggacaaatcccggaagagaagttatagcccagacggcaaggagagcccttccgacaagaagtcaaaaaccgatgggtcccagaagactgaaagctccacagaaggcaaggaacaggaggagaaatctggtgaggacggagaaaaggacacaaaggacgaccagacagaacaggagcctaatatgctattggaaagtgaggacgaactgctggtagacgaagaagaagcagctgctcttctggagagtggatcaagtgtgggggatgagactgacctggccaaccttggagatgtcgcttccgatggaaagaaggagccaagcgacaaggccgttaagaaggacggcagtgcatctgcagccgcaaaaaagaagctgaagaaagttgacaaaattgaagaattggaccaagagaatgaggcggccctagagaatggtataaaaaacgaagagaacacagaacctggtgccgagtcaagcgaaaatgctgatgatccaaataaagatacgtctgagaacgctgacgggcagtcggacgaaaataaggacgactacacaatcccggatgagtaccgcatcggcccataccaacctaacgtccctgttggcatcgattacgtgattcccaaaactggcttctactgcaaactgtgtagcctattttacacaaacgaagaagtcgctaagaacacacactgctcaagccttccgcattatcaaaaacttaagaaattcttgaacaagctggctgaggagagacgccagaaaaaggagacctag

SEQ ID NO: 123513 - DNA, 2544 bp, Artificial Sequence
  Description of Artificial Sequence: Synthetic coding sequence
atgtcaaagtccttccagcagtcatcactgagtagagactctcagggtcatggcagagatctctctgctgccggtattggccttcttgcagcagctacacaaagtcttagtatgcccgctagtctgggcaggatgaatcagggcacagccagactggcaagcctgatgaacctggggatgtcatccagtctgaaccagcaaggcgcacacagcgcactctcaagcgccagtacgtcctcacacaatttgcaatcaatcttcaacattggatctcgagggccattgcctctctcttcccagcacagaggcgatgctgatcaagcgtctaatatcctcgcaagcttcggccttagtgcgagggatcttgatgagctgtcccgctatcctgaggacaagattacacccgaaaatctgccacagatcctgcttcagttaaaaagaaggagaactgaagaagggcctacactaagctatggccgggacggacggagcgcaaccagggaaccaccgtatcgggtgccaagggacgattgggaagagaagaggcacttccgaagggattccttcgatgatcgggggccctctcttaatcccgtccttgactacgatcacggctccaggtcacaggagtccggatattatgatcgaatggactacgaagatgatcggcttagagacggcgagcgctgtcgagacgactcattcttcggcgaaacaagtcacaattatcataaatttgacagcgagtatgagagaatgggaagaggaccaggacctctgcaagaacggagccttttcgagaagaagaggggcgcaccccctagctccaatattgaggactttcatgggctgctcccaaaaggatatccacacctgtgtagtatttgtgatctcccggtccatagtaacaaggagtggtcccagcacataaatggagcttctcattcacgccggtgccaactgctgctcgaaatctatcccgaatggaacccggacaacgacacgggtcatactatgggggaccctttcatgctgcagcagagtaccaaccctgcccctggcatccttgggcccccaccacccagttttcacctgggcggccccgcagtgggacctcggggcaatcttggggcgggcaatggaaatctgcagggcccacgtcacatgcagaaaggtcgcgtggagacatctcgtgtggtgcacatcatggacttccagaggggtaaaaaccttaggtaccagttgttacagctggtggaacctttcggggtgatttctaatcacctgatcctgaacaagattaacgaagcctttatcgagatggccaccaccgaggatgcccaagctgcagttgactactatactactacacccgccctagtgtttggcaagccagtgagggtccacctgtcacagaaatacaagaggatcaagaaacccgagggcaagcctgaccagaagttcgatcagaagcaggaactgggccgggtgattcatctctccaatctacctcatagtggatacagcgattccgccgtcttgaagcttgctgagccgtatggtaagatcaaaaattacattcttatgcgcatgaagtctcaggccttcatcgaaatggaaacacgagaggatgcgatggctatggttgatcactgtctgaagaaagctctctggttccagggtaggtgcgtgaaagtggatctgtcagaaaaatataaaaaactcgtgctgagaatccctaacaggggtattgacctgctcaagaaggacaaaagccgtaagcggtcgtactcccctgacggaaaggagtctccctcagacaagaaatctaaaactgacgggagccagaagacagaaagcagcactgagggcaaagagcaggaggagaaatcaggtgaagatggtgaaaaagataccaaggacgatcagacagagcaggagcctaacatgcttttggagagcgaggacgaactcttggtggacgaggaggaggcagctgccctgctcgagtcagggagttcagtcggtgatgagacagatctagctaatctgggcgatgttgcatccgacgggaaaaaggagccctcggataaagccgtcaagaaggatggatctgcaagcgccgccgccaagaagaaattgaagaaggtggataaaatcgaagaactggatcaggagaatgaggcagcgctggagaacgggataaaaaacgaagaaaacacagaacctggagctgaatccagcgagaatgccgacgacccgaataaagacacaagcgagaatgcagacggacagagcgatgagaacaaggatgactatacaattccagatgagtatagaataggaccctaccagccaaatgtgcccgtgggcatagactacgtgattccaaagacaggtttctactgtaagctctgctcactgttctacacgaacgaagaggtggctaagaacactcattgcagttccctgcctcactatcagaaactgaaaaaattcctcaacaaactcgccgaagagagacgccagaaaaaggagacctag

SEQ ID NO: 123514 - DNA, 300 bp, Artificial Sequence
  Description of Artificial Sequence: Synthetic coding sequence
atgtctaagtcatttcagcagtcctctctgagccgggattcacaggggcacgggcgtgacttgtccgccgccgggattggcctcctcgcagccgctacacagagcctgtctatgcccgcctccctggggcggatgaaccagggaaccgctcgtctcgcctccctgatgaacctcggcatgagtagcagtctgaaccaacaaggcgctcactccgcactgtcatctgcatccacctcctctcacaacttgcagagtatctttaacattggcagcaggggtcctctcccactatcttcttag

SEQ ID NO: 123515 - DNA, 1530 bp, Artificial Sequence
  Description of Artificial Sequence: Synthetic coding sequence
atgggagacccctttatgctccaacagagcacaaacccagcgcctggtatcctggggccaccacccccttcttttcacttgggcgggcccgcggtaggacctcggggtaacctcggggccggaaatggtaatcttcaagggcctcgccatatgcagaagggccgagttgagacttcgcgggttgtgcacatcatggattttcagcgggggaaaaaccttcgctaccagctcttacaactggtcgaaccctttggagtgatatcgaaccatctgatcctcaataagattaatgaagcatttattgaaatggctactacggaagacgctcaagccgccgtggattattataccactacccccgcattagtgttcggcaagcctgtgcgggtccacctctctcagaaatataaacgcatcaagaaacctgaaggaaagcccgatcagaaatttgaccagaagcaggagttaggcagagtgatccacctttccaatcttccccactcagggtattcagactcggcggtcttgaagctagctgagccgtatggaaagatcaaaaattatattttgatgagaatgaaatctcaggcattcatagagatggaaacacgagaagatgcgatggctatggtggatcactgccttaagaaggccctttggtttcaggggaggtgcgtgaaggtggatctgtcagagaaatataagaagctcgttctgcgcataccaaacagagggattgacctgctgaaaaaagataagtcaaggaaaagaagttacagcccagacggtaaggagtctcccagtgataagaagtccaaaactgacggcagtcaaaaaacagagtcctcgactgaaggcaaagaacaggaggaaaagagcggggaagacggcgaaaaagatactaaggatgaccagacagagcaggaaccgaatatgcttctcgaatccgaagatgaacttttggtggacgaagaggaagcagcagcactgctggagtccggaagcagtgtgggagacgagaccgatctggcaaatctgggtgacgtcgcctcagacggcaagaaagaaccaagtgataaggccgtgaaaaaagacggcagtgcaagcgcagctgccaagaaaaagctgaagaaagtcgacaagatagaggagctcgaccaggagaatgaagccgccctcgaaaatgggattaagaacgaggaaaacaccgagccgggagcagagtcatccgagaacgcagacgacccaaacaaggacacatctgaaaatgcagatggacagtccgacgaaaataaggatgactatacaattccagacgagtacagaattggcccgtaccagccaaacgtgccagtcgggatcgactacgtcattccgaagactggattttattgcaaactctgctctctattttacaccaatgaggaggttgccaagaatacacactgctcatccctccctcattatcagaaactcaaaaagtttctgaataagctcgccgaggaacgacgtcagaagaaagaaacgtag

SEQ ID NO: 123516 - DNA, 264 bp, Artificial Sequence
  Description of Artificial Sequence: Synthetic coding sequence
atgagcaaatccttccagcagtcatcgctctctcgcgattcccagggccatggacgggacttaagcgcagcaggaatcggcctgctggccgcagctactcagagcctctccatgcccgcatccctaggcaggatgaatcaggggaccgcccggctggcttctctgatgaacctgggaatgagctcttctctcaatcagcaaggtgcccacagcgcactatcatcagccagcaccagcagccacaatctgcagagtatattttag

SEQ ID NO: 123517 - DNA, 1680 bp, Artificial Sequence
  Description of Artificial Sequence: Synthetic coding sequence
atgctaggggctcaatggcgtaggaaccagccgagccgcgccgctgaggaatggagccaacatattaacggcgcctcccactcgcgtcggtgccagttactactagagatctatccagaatggaatcctgataatgatactggacacacaatgggcgacccattcatgctgcaacagtccactaacccagctcccgggattctggggccaccacctccaagctttcacctggggggccccgccgttggtccacggggaaaccttggcgctggcaatggaaatcttcagggccctcggcacatgcagaagggccgggtggagacttctcgggtggttcacattatggactttcaacggggtaagaatcttcggtatcagctgctgcaacttgttgaacctttcggtgtcatctccaaccatctcattttgaataaaatcaacgaggcctttattgagatggccacgacggaggacgcccaagcagcagtggactattacacaacgacgcccgcactcgttttcggcaagcccgtccgggtacacctctctcagaagtacaagcggatcaagaaacccgaaggcaaaccagaccaaaaattcgatcagaagcaagaactgggccgcgtcattcatctgagcaaccttccacattccggatactcagactccgctgtgcttaagcttgctgaaccctatggtaagataaagaattatatcttgatgcgcatgaagtcacaggccttcatcgaaatggagacacgggaagacgccatggcaatggttgatcactgtctaaaaaaagctctctggttccagggtagatgcgtcaaagtcgacctgtccgagaaatacaaaaagctcgtgcttcggattcctaaccggggaattgatctgcttaaaaaggacaagtcgagaaagcgatcctattcaccggacggaaaagagtccccctcggacaaaaagtcaaaaaccgatggaagccagaagactgaaagctccaccgagggaaaggagcaagaagagaaatccggcgaggacggtgagaaggataccaaggacgaccagacagaacaggaacctaacatgctgctggaaagcgaagatgagctactcgtcgatgaggaggaagctgccgccctgctcgagtcgggcagttccgtgggggatgagacagacttagcgaacctgggcgacgtcgccagtgatggaaaaaaagagccctctgacaaggctgttaagaaagacggaagtgcctcggccgccgccaagaagaagcttaaaaaggtggacaagattgaggaactcgatcaggagaatgaggcagcactggaaaatggcattaagaacgaagaaaacactgagccgggtgccgaaagcagcgaaaacgctgacgatcctaataaggatacatccgagaacgccgatggtcagagcgatgagaacaaagacgattatactattcctgacgagtatcgcatcggcccatatcaacctaatgtgcctgtaggcatcgactacgttattcctaaaaccggcttttattgcaagctatgttccctcttctacacaaatgaagaggtggccaaaaatacgcactgttcatctttgccccattatcaaaaactcaaaaagttcctgaacaaactcgctgaggaacgcagacaaaaaaaggagacctag

SEQ ID NO: 123518 - DNA, 237 bp, Artificial Sequence
  Description of Artificial Sequence: Synthetic coding sequence
atgagcaagagtttccagcagtcaagcctgagccgggactcacagggacacggacgagacctctcagccgctggcattggtctgctagccgcagccacacaatcactgtcaatgccagccagcctgggtcgcatgaatcagggtacagcccggctagcgagccttatgaatcttgggatgagctcttccctgaatcagcagggcgcccacagcgcactgtcgtcggctagcacatag

SEQ ID NO: 123519 - DNA, 1302 bp, Artificial Sequence
  Description of Artificial Sequence: Synthetic coding sequence
atgagtaagagtttccaacagtcctctctgtcacgcgattcccagggacatgggagggatttgtcagccgcgggcattggcttgctcgctgccgctactcagagtctgtctatgcctgcctccctgggcagaatgaatcaaggcaccgccagactcgcaagtctcatgaatctcggcatgagctccagtctaaaccaacagggtgcccattcagctctttccagtgcgtcaacttctagccacaatctccaatcaatcttcaatataggttcaagaggcccactcccgctgtccagtcaacataggggcgacgcagaccaagccagtaatattctggcttcgttcgggctttctgcacgggacctggacgagctgtcccggtaccccgaggataagatcacccccgaaaatctgccacagatcctgctgcagctgaaaagacgccgcacagaggaagggcctacgctctcctatgggagggacgggaggtccgctaccagagagcccccctatagagtgcctagggatgattgggaggaaaagcggcatttcaggcgagacagcttcgatgaccgcggaccttccctgaacccagtcctggattatgaccacgggtcacggtcccaggagtctgggtattacgatcggatggactacgaagatgataggctccgagacggggagcggtgccgagacgactcctttttcggcgagaccagccataactaccacaagttcgacagtgaatatgagagaatgggcaggggcccagggcccctccaggaacgaagcctgttcgaaaagaagaggggcgcgccccccagtagtaacatcgaagatttccacggcctcttgcccaaggggtaccctcacctgtgctcgatttgtgatctcccagtccacagtaataaggaatggagccagcatatcaacggcgccagtcacagcaggagatgccagctgctgctagaaatctatcccgaatggaaccctgataacgataccgggcatactatgggggacccgttcatgctgcagcagtctacaaatcctgctccggggatcctgggccccccgccccccagctttcacctgggtgggcctgctgtgggcccgcgtggcaatctcggagcaggaaacggaaatctgcagggcccacggcatatgcagaaaggtagagttgaaaccagtagggttgttcatattatggactttcagcgcggcaaaaatctcagataccaactgctccagctggtggagcctttcggcgtgatttcaaatcaccttatactgaacaagtag

SEQ ID NO: 123520 - DNA, 1530 bp, Artificial Sequence
  Description of Artificial Sequence: Synthetic coding sequence
atgggggacccttttatgctgcagcaatctacgaatcccgctcccgggatcctgggacctccgcctccatcttttcacttaggaggtcccgcagtgggccctaggggaaacctcggtgcaggtaacggaaatctgcagggaccgcggcacatgcagaagggccgcgtggaaactagccgggtagtccatatcatggactttcagaggggaaagaatctcagatatcagcttctgcaactcgtggagcccttcggggtgatttcaaaccacctgatcctcaacaagattaacgaggcgtttattgaaatggcaacgactgaggacgcccaggccgccgtcgactactacaccaccaccccagccctggtgttcggtaagcctgtgcgagtgcatctgtcccagaaatacaagcggattaagaaaccggagggcaaacctgaccagaagttcgatcaaaagcaggagttgggacgggtaatacacctgtcaaatctgccccacagcggctactccgatagtgcagttctaaaactcgctgaaccatacggtaaaatcaagaattacatattaatgagaatgaagagccaggcctttatcgagatggagactcgggaggacgccatggctatggtcgaccactgtctgaaaaaagcactgtggttccaggggagatgcgtgaaagttgatctgtccgagaagtataaaaaacttgttctgaggatccctaatcggggcattgacctgctgaagaaggataaatcccgtaaacgaagctactcacccgacggaaaggaaagcccttccgacaagaagtcaaagaccgatggaagccagaaaaccgaatcatccacagagggaaaggagcaagaagagaagtctggggaagacggcgaaaaagataccaaagatgaccagaccgagcaggagccaaacatgttgttggaaagcgaggacgagctgcttgtagatgaggaagaggcagccgccctgctagagagtggatcttccgtgggagacgaaaccgatcttgctaacctgggcgatgtggcatcagatggtaaaaaggagccgtccgataaggcggtcaaaaaggacggaagcgccagcgctgctgcaaagaagaagctcaagaaggtggacaaaatcgaagagctggatcaggaaaacgaggccgccctggagaacggaattaagaatgaggaaaatacggaaccaggggccgaaagctctgagaacgccgacgatccgaacaaggatacttccgaaaatgccgacggtcagagtgatgaaaacaaggacgactataccatcccggacgagtatcggatcggaccctaccaaccaaatgtgcctgtcggtattgattatgtgattccaaaaacaggattttactgtaagctatgttcactcttttacactaacgaggaggtggccaaaaacacacactgctcttcgctgccccactatcaaaagctcaagaagttcttaaacaagttggccgaggagaggaggcaaaaaaaagaaacgtag

SEQ ID NO: 123521 - DNA, 144 bp, Artificial Sequence
  Description of Artificial Sequence: Synthetic coding sequence
atgtcgaaaagcttccaacagtcctcccttagcagagatagccagggccacgggagggacttgtctgcagctggaatcggcctcctggcagcagctacccagtcgctatccatgcccgccagcctaggaaggatgaatcaatag

SEQ ID NO: 123522 - DNA, 237 bp, Artificial Sequence
  Description of Artificial Sequence: Synthetic coding sequence
atgtcaaagagctttcaacagtcctcgctttccagggacagtcaggggcatggacgggacctgtcagctgctggcatcggccttttggctgctgcaacccagtctctgtcaatgccagccagcttaggaaggatgaaccagggtactgcgcggcttgcgtccctaatgaatctcggaatgagctcatcgctcaatcagcagggagcgcactccgcactgagctcagcaagcacttag

SEQ ID NO: 123523 - DNA, 2544 bp, Artificial Sequence
  Description of Artificial Sequence: Synthetic coding sequence
atgagtaagagctttcagcagtcatccctcagtcgtgatagtcagggccatggcagagacctctctgctgcaggcattggtctgctcgccgctgccacccagtcactgagtatgcctgcttctttagggcggatgaatcagggaaccgctcggctggcgtccctgatgaatcttgggatgagcagctcgttgaatcagcagggagcccactccgctctgagttccgcatccacgtcttcccacaatctgcagtcaatctttaatattggaagcagaggaccactgcccctgtcttcccagcaccgcggagacgcagaccaggcctcgaatatcctggcctcttttggactgtctgctagggatctcgacgaactgagtagatatcccgaggacaaaattaccccggagaatctgccccaaattttgctgcagctgaaacgcagacgtacagaagaagggcctaccttgtcttacggcagggacggtcgatcagctacccgcgagccgccctatcgcgtccctagagatgattgggaggagaaaaggcactttagacgcgattccttcgacgacagaggccctagcctgaaccccgtactcgattacgaccacgggtcccgctcacaggagtccgggtactatgatcgcatggactatgaggacgatcgactgcgcgatggagagcggtgccgtgatgattctttttttggtgaaacaagccacaattatcacaaattcgattccgagtatgagcgcatgggccggggccctggtcccctgcaggagagatccctgttcgagaagaaacggggcgccccgccgtcctcaaatatagaagacttccacgggttattgcccaagggctatccacacctctgctcaatctgcgatttgccagttcactctaacaaggaatggtcccaacacatcaacggcgcttctcattcaagacgctgccagctgttgctggagatatatcctgagtggaatccagacaacgataccgggcacaccatgggagatcccttcatgttgcaacagtctaccaacccggcccctggtatcctgggaccgcctcctccatcatttcatctcggtggtccagctgtgggccctcgcggcaacctgggcgccgggaatggcaacctccagggacctcgacacatgcagaaaggccgcgtggagacctctagagtggtacacattatggatttccaaaggggaaaaaacttgagataccagttgctccagctggtggagccgtttggagtgatatctaaccacctgatcctgaacaaaatcaacgaggctttcatagaaatggcgaccacagaagatgcgcaggccgccgtggactattacactactacgccggccctggtgtttggtaagcccgtgcgggtgcacctcagtcagaagtacaaacggattaaaaagcctgagggcaaaccagatcagaagtttgaccaaaagcaagaattgggtcgggtgatacacctcagcaacttgccccacagtggatattcggattctgctgtcctgaagttagcagaaccctacggcaaaattaagaattatatcctcatgcggatgaagagccaggcctttatcgagatggaaaccagagaggacgccatggccatggtagatcactgcctcaagaaggctctttggttccagggtcgctgtgtgaaggtggatctgtcggagaagtacaagaaactggtgctgaggatacctaaccggggcatcgatttgctgaaaaaggacaagtcacgcaaaagatcatatagtcccgacgggaaagaaagccctagtgataagaaatctaagacagatggtagtcagaaaacagaatccagcacagaaggaaaggagcaggaagagaaatcgggggaagacggcgagaaagataccaaagatgaccaaacagagcaagaacccaacatgttgctggagagtgaggacgagctgctggtagacgaggaggaagccgccgctcttctcgaaagcggcagcagcgtgggagatgagacagatttggctaacctgggagacgtggccagcgatggcaaaaaggagcccagcgataaggccgttaaaaaggacggtagtgcgagtgccgccgctaagaaaaagctcaaaaaggtggacaagatagaggagctggaccaggaaaacgaggcggccctcgaaaacggaataaaaaatgaggaaaatactgagccaggcgccgagtcatcggagaatgccgatgatcctaacaaggatacgagcgaaaacgccgatggacagagcgacgaaaataaggatgactatacaatacccgatgagtaccgaattggaccttaccagcccaatgtcccagtcggaatcgattatgtaatcccaaagacgggcttctactgcaagctctgctctttgttctacactaatgaggaggtcgcaaaaaatacccattgctctagtctgccacactaccaaaagctcaaaaaatttctgaacaagctggctgaggaaaggagacagaaaaaagagacttag

SEQ ID NO: 123524 - DNA, 30 bp, Artificial Sequence
  Description of Artificial Sequence: Synthetic coding sequence
atgagcaaatcttttcagcaaagcagctag

SEQ ID NO: 123525 - DNA, 303 bp, Artificial Sequence
  Description of Artificial Sequence: Synthetic coding sequence
atgagcaagagcttccagcagtcgtctctcagtcgtgattcgcaaggtcatggtagagatctcagtgctgccggaatcgggctgctggctgctgctacccaatccttgtcaatgccggcttcactgggaagaatgaatcagggcacagcaaggctggcttctttgatgaatctgggtatgtcgtcctccctcaaccaacaaggcgctcactccgcgctgagttccgctagtactagcagtcataaccttcagagtatcttcaatattgggagccgggggcctctcccgttgtctagccaatag

SEQ ID NO: 123526 - DNA, 324 bp, Artificial Sequence
  Description of Artificial Sequence: Synthetic coding sequence
atgtccaagtcttttcaacagagctctctgtctcgcgacagccagggacatggacgagatcttagcgcggcgggcattgggctgctggctgctgcaacccaatcactctctatgcccgcatccctagggcgaatgaatcagggcactgccagactggcctccctgatgaacctcggtatgagtagctcccttaaccagcagggggcacattctgcgctgtcttcggcgtccaccagctcccataatctacagagcatcttcaacattggttcccgagggcccctgcctctgtccagtcagcatcgcggcgatgctgaccaatag

SEQ ID NO: 123527 - DNA, 1578 bp, Artificial Sequence
  Description of Artificial Sequence: Synthetic coding sequence
atgcgcgttttctgtgtggggttgttactattcagcgtcacctgggccgcgcctacattccaacctcagacagagaagacgaaacagagctgcgtcgaggaacagagacaggaggagaaaaataaggataatatcggctttcaccacctgggcaaacgcatcaaccaggagctgtcttctaaagaaaacatcgtgcaagaaaggaagaaggatctgtcactcagtgaagccagtgagaataagggctcttccaagtcccaaaactacttcactaacaggcagcgactcaacaaggaatatagtatctcgaacaaagagaacacacacaacgggctgaggatgtctatttatcctaagtcgactggtaacaagggctttgaggatggggacgatgctatttccaaactgcatgatcaggaagaatacggcgcagccttgatccgcaataatatgcaacacatcatgggcccagtgactgcaattaagctgctgggcgaagaaaacaaggagaacacgccaaggaatgttttgaacatcatccccgcctcaatgaactacgctaaagctcatagcaaggacaagaaaaaacctcagcgggactctcaagctcaaaaatctccagtcaaaagcaagtcaactcaccggatacagcacaacattgactatctgaagcacctgtcaaaagtcaaaaagatcccctccgacttcgagggctccgggtatactgacctacaggagagaggtgacaacgatatttcccctttcagtggagacggacaacccttcaaagatattcctggcaagggggaagccactggccccgatctggaggggaaagatattcagactggtttcgccggaccctctgaggctgagtccacgcacctggacacgaagaaaccggggtacaacgagattccagaaagggaggaaaacgggggcaacacaattggcacgagagacgagactgccaaggaagctgatgctgtggacgtatctctcgtggagggttcaaatgatataatgggatccacaaacttcaaggaactacccgggcgagaaggtaaccgggtggatgcgggtagtcaaaacgcacaccaagggaaagtggaatttcattatcctcccgcgccgtctaaggagaaaaggaaggagggaagttcagatgcagctgagagtacaaattataatgaaatcccgaaaaacggtaaggggagcactcgaaagggggtcgaccactccaaccgtaatcaggccacattgaatgagaaacaaagatttccatcaaaggggaaaagccagggactgccgataccctccagaggcctagataacgagatcaaaaacgagatggactcctttaatggacccagtcacgaaaacattatcacccatggccgaaagtaccactacgtgcctcacaggcagaacaatagcaccagaaacaaaggcatgccacagggaaagggcagttgggggaggcagccgcactcgaatagacggttcagctcacgcaggcgtgatgacagctctgaatctagtgattcaggctcttcctccgagagcgatggggactag

SEQ ID NO: 123528 - DNA, 1578 bp, Artificial Sequence
  Description of Artificial Sequence: Synthetic coding sequence
atgagggttttttgcgtgggtctgcttctattcagtgtcacctgggccgcccctaccttccagccccagacggagaagacaaagcagtcatgcgtggaagaacagcgacaggaagaaaaaaataaggataacattgggtttcaccatctgggtaagcgaattaaccaggaactgagcagcaaagaaaacatcgtgcaggaaagaaaaaaggatttaagtctgtcagaagcctctgagaataaagggtcctccaagtcgcagaactacttcacgaatcggcaacgcctaaataaagagtacagtatctcaaataaagagaatacacataatggcctccggatgagcatttacccaaagtccaccggaaataagggtttcgaggacggagatgatgcaatctcaaaactccacgaccaggaggagtatggcgcagcacttatcagaaacaatatgcagcatataatgggacccgtgacagccatcaaactcctgggcgaagaaaataaagaaaacacacctcgcaatgttttaaacatcattcccgcctcaatgaattacgcgaaggcccactccaaagataaaaaaaagccccagcgggacagtcaagcccagaagtctcctgtgaaaagcaagtctactcatcgaatacagcataacatcgactacctcaagcatctttctaaggtcaaaaagatcccatccgattttgagggcagcggctatacagatctgcaggagcgtggcgataacgatatcagtccttttagtggagacggacagcctttcaaagatatcccaggcaaaggcgaagccacaggccccgatttggaagggaaggacatccagaccggattcgcgggcccatcagaggccgagagcacacacctcgatactaagaagcctggctataatgagataccagagagggaagaaaacggtgggaatacaatcgggacccgcgatgagactgctaaggaggccgacgctgtggacgtgtccctcgttgagggttccaatgacatcatgggttcaactaattttaaggagttaccggggcgggaaggcaaccgggttgatgccgggtcccagaacgcccatcaggggaaggtagaatttcactacccgcccgcccccagcaaggagaagcgcaaggaagggtcatcggatgccgccgagagcacgaactacaacgagatcccgaagaatgggaaaggaagcaccagaaagggcgtcgaccacagtaatcggaatcaggctactctgaacgagaagcagcgttttccctccaagggaaaatctcagggtctacccatcccatcccgcggcctggataatgagataaagaatgagatggactcttttaatgggcccagccatgagaacattatcactcatggacgaaaataccactacgttccccatcgacagaacaatagtacaaggaataagggcatgccccagggcaaagggagttggggccgccaacctcatagcaatcgacgattttcatcacgccgaagagatgattcttctgagagctcagatagcggcagttcctccgagtccgatggagactag

SEQ ID NO: 123529 - DNA, 828 bp, Artificial Sequence
  Description of Artificial Sequence: Synthetic coding sequence
atgagggtgttctgtgtgggtttgctcctcttctccgtcacgtgggccgcccccactttccagcctcaaaccgaaaaaactaagcaatcttgcgtcgaagagcagcgtcaggaagagaaaaataaggataatattgggttccaccacctgggcaaaagaatcaatcaggagctttcctctaaggaaaacatcgtgcaggagaggaagaaggatttgtcgctgagcgaagcaagtgagaacaaaggttcctctaagagtcagaattacttcaccaatcgccagaggctcaataaagagtattccataagcaacaaagagaacacccacaatggcctcagaatgtccatttaccccaagtctactggtaataaaggctttgaggacggggacgacgcgattagcaaactgcatgaccaggaagaatatggcgcagccctcattcggaacaatatgcagcacattatggggccagtgacggccattaaactgctgggcgaagaaaacaaggagaacactccacgtaatgtcctcaatattattccagcatccatgaattacgccaaagcacattcaaaagataagaagaagccccagcgcgactctcaggctcagaagagccccgtgaaatctaagagcacccacaggatacagcataacattgattatctgaagcacctgtcaaaggttaagaagatcccgagcgactttgaaggctctgggtacacagatctccaagagcggggtgataacgacatttcccctttttctggcaccgcaaacctactccgaacatttctcgttaaggaaaaactgctcgtgctgacctag

SEQ ID NO: 123530 - DNA, 1239 bp, Artificial Sequence
  Description of Artificial Sequence: Synthetic coding sequence
atgtcgatctaccccaagtcgaccggtaacaagggcttcgaggacggtgacgatgcgatcagtaaactacacgaccaagaagaatatggcgctgcacttatcagaaacaacatgcagcacattatggggcctgtgaccgccatcaaactgcttggtgaggagaataaggaaaatactccgagaaacgtgctgaatatcatcccggcaagtatgaactatgccaaagcccactccaaagataagaaaaagccccagcgcgattcccaggcgcagaagagtccagtaaagtctaaaagcactcaccgtatccagcataatatcgattacttgaaacatctcagcaaggtcaaaaagattccatctgatttcgagggatcggggtacacagatttacaagagcgaggcgacaacgatattagcccgttttctggcgacggacagcctttcaaagacattccaggcaaaggagaagccacggggccggacttggaaggaaaggatatacagactggttttgccgggccgtccgaagcggagtcaactcacctggatacaaagaagcccggctacaatgagattccggagcgggaggaaaatggcggcaataccatcggaactcgcgatgagaccgccaaagaagccgacgctgtagacgtgtccctggtagaaggctctaacgatatcatgggctctaccaactttaaagaactgcctgggcgtgaggggaacagagtagacgctggttctcaaaacgcccatcagggcaaggtggagttccattaccccccagctcccagcaaagagaaacggaaggaagggtcttctgacgcagcggagtctaccaactacaacgaaatacccaaaaatggcaaggggtctacaagaaaaggcgtggaccactccaatcggaaccaggctaccctgaacgaaaaacagcgctttcccagtaagggaaagagtcagggattacctatcccaagtagaggcctcgataacgagatcaaaaatgagatggatagctttaacggaccatcccatgaaaatatcattacccatggccgcaaataccactatgttcctcacagacagaataactctactcggaataagggcatgccacaagggaaaggttcatggggcaggcagcctcactccaaccgaagattcagcagtagacgccgagatgacagctctgagagctccgacagtggtagctcatccgaatccgatggcgactag

SEQ ID NO: 123531 - DNA, 1239 bp, Artificial Sequence
  Description of Artificial Sequence: Synthetic coding sequence
atgagcatctatccgaaaagcaccggcaataaagggtttgaggacggtgacgacgccatctcaaaactacatgatcaagaagagtacggcgccgctcttattcggaacaacatgcagcacatcatgggtcctgtaacagcaattaagctgctgggagaagaaaacaaagagaacacacctcggaacgtcctcaatatcatccctgcatcgatgaactatgcgaaagcccacagcaaagacaagaaaaagccacaaagggattcgcaggcacagaaaagccctgtgaagtcaaaaagcactcaccgcatccagcacaatatagactacctgaaacatctgagtaaggtgaaaaaaatccccagcgattttgagggtagtggctataccgacctgcaggaacgtggggacaatgatatcagcccctttagtggagacggacaacctttcaaggatattcctggtaaaggagaggcgacaggaccagatttggaaggtaaggatatccagacgggattcgctggaccctccgaggccgaatcgactcatcttgacaccaaaaaaccagggtataacgagatcccagagcgcgaggagaatggcggtaatacaatcggtacacgggacgaaactgcaaaagaagcagacgccgttgacgtgtcgctggttgaggggagtaacgatattatgggctcaaccaacttcaaggaattgcccgggcgtgagggaaatcgagtggacgcaggaagccagaacgcgcaccaaggcaaagtggagtttcattaccccccggcgcctagtaaagaaaaacggaaagaaggaagtagtgacgctgctgagtcaaccaattataacgaaatccctaagaatggaaagggtagtacgcggaagggcgtcgatcactccaacagaaaccaagcgactttgaatgagaaacagcgctttccatccaaaggcaaatctcagggcctgcccatcccctcgcgcggcttagacaatgaaatcaagaatgagatggattccttcaacggtcctagccatgaaaacatcattactcacgggcgaaaatatcactacgttcctcataggcagaacaacagtactcgaaataaggggatgccacaaggcaagggatcctggggccggcagccacactcaaataggagattcagctcccggcgcagagacgactcttctgaatctagcgattctggatcgagcagcgagtccgatggcgactag

SEQ ID NO: 123532 - DNA, 312 bp, Artificial Sequence
  Description of Artificial Sequence: Synthetic coding sequence
atgaagtccttaatcctgctcgcaatactggccgcccttgccgtcgtaaccttgtgttacgagtcccacgagtccatggaatcatatgaactcaacccatttatcaatcgtcgtaatgccaacacctttatctccccacagcaaaggtggcgcgcgaaggtccaggaaagaattcgagaaagaagcaagcccgtacatgaactcaaccgcgaggcttgcgacgattacaggctgtgtgaacgctacgccatggtgtacgggtacaatgccgcatacaaccggtactttaggaagagaagaggaacaaagtag

SEQ ID NO: 123533 - DNA, 945 bp, Artificial Sequence
  Description of Artificial Sequence: Synthetic coding sequence
atgggcccacttatcaaccgatgtaaaaaaattctgctaccaaccaccgtgcctcccgctactatgcgcatttggcttttgggagggctgctcccattcctgttgttgctaagcggacttcaacggcccacggagggctccgaggttgctattaagatcgacttcgatttcgccccaggatcgttcgacgatcagtaccagggctgctcaaaacaggtgatggaaaaactgactcagggagattacttcaccaaagatattgaggcccagaaaaactattttcggatgtggcagaaggcgcacctcgcttggctgaaccagggtaaagtgcttccccagaatatgacaaccacgcatgccgtagccatcctcttctataccctgaattcaaatgtgcactcggattttactagggcgatggcgagtgtggccaggactccccagcagtatgaacgatccttccatttcaagtacctgcattactaccttacctctgccatccagctgttgcggaaagacagtattatggaaaatggaactttatgttatgaagttcattaccgcacaaaagacgtccattttaacgcttacaccggagctacgatccggttcggacagtttctctccacttctctgcttaaagaggaggcacaagagttcggtaatcaaacactgtttacaatatttacttgtctgggagcccccgtgcaatacttcagcctgaagaaggaagtgttgattcccccatacgaactgttcaaagtcatcaatatgtcctatcacccacgcggggactggctccagctgaggagtaccggaaatctctccacatacaattgccagctgcttaaagcttcaagcaaaaagtgcatccccgatcccattgccatcgcaagtctctcattcttgacgtcagtaattatcttttcaaaaagtcgcgtttag

SEQ ID NO: 123534 - DNA, 1749 bp, Artificial Sequence
  Description of Artificial Sequence: Synthetic coding sequence
atgagcattgagactctgctggaagctgcccgatttctggagtggcaggctcagcagcagcaacgagcccgcgaagaacaagaacgcctgcggcttgaacaggagagggaacaagagcagaagaaggcaaactctctggctcgactggctcacactttaccggttgaggaaccccggatggaagctccaccactgcctctgtctcctcccgcccctcccccggccccgcctccccctctagctactccggctcccctaacagttataccaatcccggtagtgaccaattcccctcagccattgcctccacctcccccgctgccagcggcagctcaaccattgcctctggctccacgccagcctgctctggtgggggcccctggcctcagcataaaggaaccagcaccgttgccttctcggccacaggtgcccacaccggcaccactccttccagattcaaaggccacaattccacctaacggctcacctaaacctcttcagccactccccacccccgtcctcaccatcgcaccccacccgggagtccaacctcagctcgcaccgcaacagcctcccccacccacactcggaaccttgaagctggccccggccgaggaagtcaagtccagtgagcagaagaagagacctggcggaattggcactagagaagtgcacaataagctggagaaaaatcgaagagcacatctcaaggaatgttttgaaacccttaagcggaatattccaaacgtagacgataagaagactagcaatctttccgtcctgcgcacggccctgagatacatccaatctcttaagcgcaaggaaaaggaatacgaacacgagatggagaggcttgcccgagaaaagattgcgacccaacaacgcctggctgaacttaagcacgaactgtctcaatggatggacgtgctggaaatcgaccgggtgctgaggcagacggggcaacccgaagacgatcaggcttcaacttccaccgctagtgaaggcgaagacaacatcgacgaagacatggaagaggacagagcaggcctggggcctccaaagctctctcataggccgcagccggagcttctgaagagcacactcccccccccatcaacaacccccgctccactgcctccccatccccatccgcaccctcactccgtggcactgcctcccgcgcaccttccagtacagcaacagcagccacaacagaaaaccccactgccagcacccccgcctccccctgccgctccagcacaaactcttgtccccgctcccgctcaccttgtggctaccgcaggtgggggtagcaccgttattgcccacactgcaactacccatgcctctgtgatccagaccgtaaaccacgtattacaggggccaggtggtaaacatatagcacatattgcaccaagcgcaccatcccctgctgtacagctggcacccgcgacccctcccatcgggcatatcacagttcatcccgcaacacttaaccacgtcgcccatctgggctcacaactgcctctttatccccagccagtggcagtgtcccatatcgcccacacactgtcccatcagcaggtgaatgggacagcgggattgggcccccctgctactgtgatggccaaaccggctgtgggcgcccaggttgtccaccatccccagctggttgggcaaacagtgttgaatccagttactatggtgactatgccttccttcccggtgtccactcttaaactggcttag

SEQ ID NO: 123535 - DNA, 1749 bp, Artificial Sequence
  Description of Artificial Sequence: Synthetic coding sequence
atgtctattgaaaccctcctggaagctgccaggttcctcgagtggcaagctcagcagcagcagcgcgccagggaagaacaggaacgtctgcggttagaacaagaaagagagcaggagcaaaagaaggccaattcactcgcccgtctcgctcacacacttcccgtggaggaaccacggatggaggcaccacccctaccgcttagcccccctgcaccccctcccgccccacctcctccactggcaactcctgcaccattgaccgttattcccattcctgtggtgaccaactctcctcagccgttacccccaccgccccctctgccagccgcagctcagcccctgccacttgctccccgacagcccgccctggtgggcgctcccgggcttagcatcaaggaacctgctcccctcccttcccggccacaggtacccacacctgcaccactgttgcccgatagtaaggccacaattccccctaatggatctcccaaaccactacagcctctccccaccccagtgcttaccattgccccacaccccggtgtgcaaccccagctcgcgccccagcagccccctcctccgactctgggcaccctcaagctcgctcctgcagaggaggtgaaaagctccgagcagaagaagagacctgggggcataggaacccgggaggtgcacaacaaattggagaagaacagacgcgcccatctgaaggaatgttttgagacgttaaaaaggaacattcccaatgtcgatgataagaagaccagtaatctctccgtgttaaggaccgccttgagatacattcagagtctgaagcgcaaggaaaaagaatacgagcatgaaatggaacgccttgctagggaaaaaatcgccacccagcaaaggctggcagaactcaagcacgagctcagccagtggatggatgtgctcgaaatagatagagtgctccggcaaactggacagcccgaagacgatcaagccagcacctccactgcttccgaaggtgaggataatattgatgaagacatggaggaggacagggcgggactggggcctcctaagctttcccacaggccgcaacccgagctactgaagtctactctgcccccgccatccaccacacctgcgcccttgcccccacaccctcatccccacccccatagcgtggccctgccacctgcacacttacccgtgcagcagcagcaaccccagcagaagacccccctccctgccccgcctcccccgcccgccgcccccgctcaaactctggtgcccgcaccagctcacctggtggcaaccgcagggggaggctctaccgtgattgctcataccgcaactacccatgcatccgtcatccagaccgtcaaccacgtgctccagggccctgggggtaagcatatcgcccacattgctccatcagcgccatcccccgccgtgcagctggctccggcaacgccaccgattgggcatatcacggtccatcctgcaacgctgaaccacgttgcgcatcttggctcccagttgccactgtaccctcagcctgttgccgtgagtcacattgcccacactctcagccaccagcaggtgaacggaaccgcagggctgggccctccggcaaccgttatggcaaaacccgcggtgggcgcccaggtcgtccaccatccacagctcgtgggccagacagtgctgaatccagtaacaatggtgacgatgcccagttttccagtgtctaccctaaaactggcctag

SEQ ID NO: 123536 - DNA, 594 bp, Artificial Sequence
  Description of Artificial Sequence: Synthetic coding sequence
atggagcccttggcctctaacatccaggttttgctccaggccgccgagttcctcgaacgcagggagcgagaggctgagcacggatacgcttcactctgcccccaccgaagccccggtcccattcatagacggaaaaaaaggcccccccaagctcccggggcgcaagatagtggcagatggcgggcccagttaaaacggtgtttagagagattaaagcagcaaatgccgctcggcgccgactgcgcgaggtacacaacactttccttgctgcgtcgggcacgcatgcatattcagaagcttgaagatcaggagcagagggccagacagcttaaagaacgcctgcgttccaagcaacagagcctacaacgccaactcgaacaactcagaggcctggcaggagcagccgagagagaacgtctacgcgcagattccctggattcatccgggctgtcatcagagcgctctgactcagatcaggaggagctcgaggtggacgtggagtctcttgtgttcggaggggaagcagaactgctcagaggcttcgtagcaggacaagaacattcctatagccacggaggcggcgcgtggctatag

SEQ ID NO: 123537 - DNA, 1167 bp, Artificial Sequence
  Description of Artificial Sequence: Synthetic coding sequence
atggaacctctcgcttctaacatccaagtcctgctgcaggctgctgagttccttgagcgaagggaaagagaagcagagcatgggtacgcatctctctgcccacatcgatcccctggtcctatccatcgacgaaagaagagaccacctcaggctcctggcgctcaggacagcggtcgctcggtacataatgagctggaaaagcgcaggagggcacaactgaagcggtgcctcgagcgcctcaaacaacagatgcccctcggtgcagactgcgcccgatacactaccctttccctgttgcgccgagcccgcatgcatatccagaaacttgaggaccaggagcaacgggctagacagctgaaggagcggcttcgctctaagcagcaatcgctgcagagacagctcgagcagttacgcgggctggcaggggcggctgagagagagcgtctacgcgccgactccttggactcctctggactgagctcagaaagatctgactccgatcagggagaatgccctgaggccgaaggtttgtgcgggccacgcggagagccaggactcttgactggcccgctcccagctcagcggtcttggcgatggatgtggagggcgtggtgcctcggggtgaggccttcttgctgtggggcttccagccctgcccggtccaccgccacacgcaccgcggcagccccaggatatgatgtgccccatcctgggagggccagcgcattatactcctgccaagcacatctaccaggaaggtctccaccacaggcgttcagggccgcgaggtctcacctgctggagtggactaagcggaccctggtgtgggagcaggttctgccaaaacaccccgcagcgggctgtcaggctggtccgctggagggaaaaggacaggactctagcggcccgccctggacaccagctgggcaggccgcatgggcacgcgctcaagcttttggcagcgctgccccaaaggggactggatctctcctagggctgtttccgtcttggacaaggccaccagccttcgcaagccataagctttattccatcttcataaagtctctattccacaacttcccaagcatcgtgctgcccaatgagaacgggggtaccccaaatcaccgtccaacaggacgcggaaacaatataagttctcatcactag

SEQ ID NO: 123538 - DNA, 582 bp, Artificial Sequence
  Description of Artificial Sequence: Synthetic coding sequence
atggaacccctcgccagtaacatccaggtcctgctgcaagcggccgagttcctagagcgacgagaacgtgaagccgagcacgggtacgcttcgctgtgccctcataggtcccctggccctatccatcgccgtaaaaaaagaccaccgcaagcacctggcgcacaggactctggaaggtctgtccataatgaactggaaaaaagaagaagagctcaactgaagcgatgcctggaaaggctcaagcagcagatgcccctaggcgccgactgcgccaggtatactactctgagcctgctgcgaagagctaggatgcacattcagaaactcgaggaccaggagcaaagggcaagacaattgaaagaaaggctgcgttcgaagcagcaatccctccagcggcagttagaacagttgcgcggtttggccggtgctgccgagcgagaacgactgcgcgcagacagtcttgacagcagcgggctgtcctctgagaggtccgactcagaccaggtgctgccaaacgagaacggtggcactccaaaccatcggccaaccggcaggggcaacaacataagctcccaccactag

SEQ ID NO: 123539 - DNA, 621 bp, Artificial Sequence
  Description of Artificial Sequence: Synthetic coding sequence
atggaacctttggctagcaatattcaggttctcctgcaagccgccgaatttttggaaagaagagagagggaggccgagcatggctacgcctccctgtgtcctcaccggtctcccggaccgattcatagacgcaagaagaggcccccccaagctcccggcgctcaggactctggtaggtccgtccataatgagctggagaagcggagacgcgcacaactgaagcgctgtttagaacgactaaagcagcagatgcccttaggcgccgattgtgctaggtacactaccctctccctgctgcgcagggcgcggatgcatatccagaaactggaagatcaggagcagcgagctcgccagctgaaggaacggctgcgttccaagcagcagagcctgcagcgccagctcgaacagctgaggggtttggccggggccgccgagcgcgagagactgagggctgatagcctggattccagtggtctgagttccgaacggagcgatagtgaccaagaggagctcgaggttgacgtggagtcattagttttcggaggcgaggccgaactattacgcggctttgtcgcaggtcaggaacattcttacagccacggagggggggcgtggctctag

SEQ ID NO: 123540 - DNA, 621 bp, Artificial Sequence
  Description of Artificial Sequence: Synthetic coding sequence
atggagccactggcctccaatattcaggtcctcctccaggctgcagagttcctggaacggcgagagcgggaggcggaacacggatacgcatccctgtgtccccaccgatcccccgggccaatacaccggaggaaaaagcgccccccccaagcacccggagcacaggacagcgggcgctccgttcacaacgagctggagaagagaaggagagcccagctgaaaaggtgtcttgagcgtctgaaacagcagatgccccttggggctgactgcgcccgatataccacactgtcactcctccgccgcgcccggatgcatatacaaaaactcgaggaccaagaacagcgcgcccgacagctgaaagagcgtcttagaagtaaacaacagagtctgcaacgccagctggagcagctgcgaggactcgccggtgccgccgaacgtgaaaggctccgggccgatagcctggactctagcggcctctctagcgaaagaagcgacagtgatcaggaggagctggaagttgacgttgagtccttggtgtttggcggggaggcagaactgctaaggggcttcgtagccgggcaagaacactcatactctcatggaggaggagcctggctctag

SEQ ID NO: 123541 - DNA, 768 bp, Artificial Sequence
  Description of Artificial Sequence: Synthetic coding sequence
atgattcaggcaatacaggtgctacgatttcacttgctcgagttggagaaggtacacgaactgtgcgataatttctgtcatcgctacatctcttgcctcaaaggaaaaatgccgatcgatctggttattgacgagagagatggaagctccaagtccgaccatgaagaacttagcgggagctccaccaatcttgcagaccataatccatcctcgtggcgagatcacgacgacgctacctccacgcactcagcaggaacacccggtccatcatctggcggacatgccagccaatccggggataacagcagtgagcagggtgacggcctggacaattcagtggcctctccgggaacgggcgatgatgatgacccggacaaagacaagaagaggcaaaaaaaaaggggcatcttccccaaggtggcgaccaatattatgcgcgcctggctgtttcagcacctgacacatccctatcccagcgaagagcagaagaagcagctcgctcaggatactgggctaaccattctccaagtgaataattggttcatcaatgctagacggcgcattgtacagcctatgatagaccagtctaacagggccggattcctactagacccgagtgtgagtcaaggagcggcctattccccagaagggcagccgatgggatcctttgtgctcgatggacaacagcacatgggcatacggcccgccggcccaatgtctggaatgggcatgaacatgggaatggatggacaatggcactatatgtag

SEQ ID NO: 123542 - DNA, 9081 bp, Artificial Sequence
  Description of Artificial Sequence: Synthetic coding sequence
atggaagagaagcagcagattatccttgcaaatcaggacggagggaccgttgccggcgcagctcccacattcttcgtcatacttaagcagcccggaaacgggaagacagatcagggaattcttgtcactaatcaagacgcatgtgctttagcctcttctgtgtctagtcccgtgaaatctaaaggaaaaatctgtctgccggcagattgtaccgtgggagggatcacagttactctggacaacaacagtatgtggaacgagttctatcaccggtccaccgaaatgatcctgacgaaacagggaaggaggatgttcccctactgtcgctattggattacgggactagattctaatctcaagtacattctggtcatggatattagtcctgtcgacaaccaccggtataagtggaatggccgctggtgggaacccagcggcaaggcagagccgcacgtcctcggtagagtcttcattcacccagagtctccgtccactgggcattactggatgcaccagcccgtcagcttctataagctcaaattaactaataacacactggatcaggaaggccatattatcctgcacagcatgcacagatatctgccaagactgcatttggtgcccgccgagaaggcagtagaggtgatccagctgaacggccccggcgtgcacacgttcacgtttccccagacagaattttttgcagtaacagcttatcagaacatacagatcacccagttgaaaatcgattacaacccattcgccaagggttttagggacgacgggctcaataacaagcctcaacgggacgggaagcaaaaaaattccagtgatcaggaaggcaacaatatcagctcttccagcggacaccgggtcagacttacagaagggcagggatcagaaatccagccaggagacctggaccctctgtcaagaggtcatgagacatccggcaaaggcttagagaaaaccagcctcaatattaagcgagatttccttgggtttatggacactgactcggctctgtcagaagttcctcaactgaagcaggagatctctgagtgtcttattgcttcctcctttgaagatgatagtagagttgctagtcctcttgaccaaaacgggtcattcaatgtcgtcataaaggaggaaccattagacgattatgactacgagcttggggaatgccctgaaggggtcacagttaagcaggaggagacggacgaggagaccgacgtgtatagcaattcagatgacgaccccattctggagaagcagctcaagcgacacaataaggtagacaatcccgaggccgaccatctaagtagcaaatggctcccctcctctccctccggagtggccaaggccaaaatgttcaaactggacaccggaaaaatgcccgtggtctacttggagccgtgcgctgtgacccgatctaccgttaagatttctgaactgcccgataacatgctttccacttctagaaaagataagagcagcatgctcgctgagctggagtacctgcctacctacatcgagaactccaacgaaacagccttttgtttaggtaaggagagtgagaatgggctgcgtaagcattcccccgatctacgcgtggtgcagaaatacccgctgttgaaggagcctcaatggaaataccctgatatctccgacagtattagcacagagcgtattctcgatgactccaaagattctgtcggtgattccttatccggaaaggaggatttaggtcggaagaggactactatgctcaagattgctactgccgcaaaagttgtaaacgccaatcagaacgcatcccctaatgttcctggaaagagaggtcgtccacgaaagctaaaactgtgtaaagccggccgtcctccaaagaacacggggaagtcattgatttctacaaaaaacacgccggtttcccctgggtcaacctttcccgatgtgaagcctgatcttgaggacgtcgatggggtgctgttcgtgtcttttgaaagcaaagaggccctcgatatccacgctgtggacgggaccacagaggagagcagcagcctccaggcatccactacgaatgatagtggatatagagcccgcataagtcagctcgaaaaggaactgattgaagacttgaaaacactgcgacataaacaggttattcatcccggactccaggaagtgggtctgaaactgaatagcgttgatcctacgatgagcatcgatttgaaatacttaggggtccagctgccacttgcgcctgccaccagtttccctttctggaacctcacgggtacaaaccctgcctcacctgatgccggcttcccattcgtgagccgaaccgggaagaccaacgacttcaccaagatcaaaggttggcgcggaaaattccactctgcatcggccagcagaaatgaggggggcaattcagaatcatccctgaagaacagatcagccttttgcagcgataagttggacgagtacctggagaatgaaggaaagctgatggagacctccatggggttctcttccaatgcccccacttccccggtcgtgtatcaactgcctaccaagtcaacctcatacgtgcggaccctggactccgttctgaagaaacagtccacaatctcaccttcaacctcttactccctgaagccacatagtgtgccccctgtgtccagaaaagctaaaagccagaacaggcaggctactttctccggccgcacaaagtcctcctacaagagcatcttgccctaccctgtgtcacccaagcagaaatactcccacgtaatccttggggacaaagtaacgaaaaattcttccggcatcatctctgaaaaccaggccaacaacttcgtcgtgcccaccttggacgagaatattttcccaaagcagatatccctgcgtcaggctcagcaacaacaacagcagcaacagggctcccgccccccaggactttctaaatcacaggtcaaactgatggatcttgaagattgtgccttgtgggaaggcaaaccacgaacttacattacagaggaaagggccgatgtgagtcttaccaccctcctgactgcccaggcttcgttaaagaccaagcccatacacactattattcggaagcgggcccctccttgcaacaatgacttttgtcgactgggatgtgtctgttcctctctggctctggagaagagacaacccgcacattgtcgtaggccggactgtatgttcggctgcacctgtctgaagaggaaggtggtcctggtcaaaggcggaagtaagactaaacacttccagaggaaagccgctcatcgtgaccctgtattctatgatacgctgggcgaggaggctcgcgaggaagaggaaggcattcgagaggaggaagagcagttgaaagaaaagaaaaagagaaagaagctagagtacacaatatgcgaaacggaaccagaacaaccagtgcgacactacccactctgggtcaaggtggagggcgaggtggaccctgagccagtgtatataccaacaccctctgtcatcgagcccatgaagccgctgttgttaccgcagcccgaggtgctcagtcctactgttaaaggtaaattactgacaggcattaagtctcctagatcctatacacccaagccgaatcctgtgatcagggaagaggacaaggatccagtttatttgtattttgagtcgatgatgacttgtgcccgcgtgcgcgtatatgagcgaaagaaggaggaccaacggcagccgtcttcatcatcttcgccctctccctcctttcagcaacagacgtcatgccatagtagtccggagaaccacaataacgccaaagaacctgacagtgagcaacagccactgaagcaactaacgtgtgacctcgaagacgatagcgataagttacaggagaaaagctggaagagctcctgtaatgaaggagaaagtagctccacatcctacatgcatcaacgtagtccaggaggacctaccaagctcattgagataatttctgattgcaactgggaggaggacagaaacaaaattttaagtattctcagccagcacatcaactcgaatatgcctcagagcctcaaagtcgggagctttatcatagaactcgcatcccagaggaaaagtcgaggcgaaaagaacccgccagtgtactcgtctcgcgtgaagatctctatgccatcttgtcaggaccaggatgatatggccgagaagagcggctcagaaacaccggatgggcccctctcccccggcaagatggaggatatttcccctgtacagaccgatgcactggacagcgtgcgggagcggctgcatggagggaagggccttcctttctacgctggcctatcacccgcgggaaaactcgtcgcatataagaggaagccaagttctagtacatccgggttgatacaggtggcctcaaacgcaaaagtcgccgcctcccgaaaaccccgaacgctcttgcctagtacttccaacagcaagatggctagcagctccgggaccgctactaaccgacccggaaagaacctgaaagcttttgtgcccgccaaacgcccaatcgctgcaagaccttctccaggaggagtgttcacacagtttgttatgagcaaagttggtgcgctgcaacaaaaaattccgggggtgagtaccccacagacactggccggaacccaaaaattttccatcagaccctctcccgtcatggtggtgactcctgttgtgagctccgaacctgttcaggtttgtagtcctgtcaccgccgccgttaccactaccaccccgcaggtttttctggagaacaccacagcagtcacaccaatgacggcgatttctgatgtagaaaccaaagaaacaacatattcatccggagcaacaactactggcgtagtcgaggtgtcagagaccaacactagcacaagtgtgaccagcacccagtctacagcgaccgtgaacctgacaaagactactggcattaccaccccagtggccagcgtagctttcccgaagagtcttgtggcaagcccaagtactattactctgcctgtcgccagcaccgcatcaaccagcctcgttgtggtaaccgcagccgcctccagcagcatggtcaccacacccactagctctctcggctctgtgcctattatactgagtggaattaacggttcaccgcccgtctcccagcgtcctgagaacgccgcccagatccccgtggcgaccccacaggtctcccctaacacagtgaagagggccgggccccggttattgcatcctaacggacagatcgtacagttgctgcctctgcaccaattgcgcggctctaatacacaaccaaatcttcaacccgtgatgttcaggaacccaggatcggtgatgggaattcgcttacctgctccaagcaagccaagtgaaactccacccagttctacgtcaagcagcgctttcagtgtcatgaacccagtgatacaggctgtgggtagctcatccgccgtgaatgtgattacacaggcaccaagcctcctctcttccggagcctccttcgtgtcccaggctgggacacttacccttcgcatttcgccgcccgagccacagtcttttgcaagtaagaccggctcagaaacaaagataacctactctagtgggggccagccggtaggcaccgccagcctgataccactacaaagtggcagtttcgcattactgcagttacccggacaaaagcctgtaccaagcagcatcctgcagcacgtcgccagccttcagatgaagagggaaagtcagaacccagaccagaaagatgaaacaaacagtatcaagagagagcaagaaacaaaaaaggtgctccagtctgaaggagaggcagtcgacccagaagctaatgtgattaagcaaaattcaggagctgccacttccgaagaaacactgaacgacagccttgaggatcgaggcgaccaccttgatgaagaatgcttaccagaggagggatgtgcaactgtgaagccttctgagcactcctgcatcactgggtctcacacagaccaggactacaaggacgttaatgaagaatacggcgctcgcaaccggaaatcctctaaagaaaaagtggcggtattggaagtgagaacaatttctgagaaagcctctaacaagactgtacagaatctatcgaaagtgcaacaccagaaattgggcgatgtgaaagtggaacaacaaaaaggatttgataatcccgaggaaaattctagcgaattccccgtcacattcaaggaggagagtaaattcgaactttccggaagcaaggtgatggagcagcagagcaaccttcagcccgaagccaaagaaaaggagtgcggagactctttggagaaggatagggagcggtggaggaagcacttaaaaggccctttaacgcgaaagtgcgttggcgcttcgcaagagtgtaaaaaggaagcagatgagcagttaatcaaagaaaccaaaacctgccaggagaattccgacgttttccagcaggagcaggggataagcgatctattggggaaatccggcatcactgaagacgccagggtccttaagactgagtgcgattcttggtcgagaatttccaatccctctgccttcagcatagtgccacgtagagctgcaaagagctcacgaggaaacggccacttccaggggcacctgttgctcccgggtgagcaaattcaaccaaagcaggaaaaaaaaggtggccgctcctctgcggattttacagtgctcgacctggaggaggatgatgaagacgacaacgaaaagactgatgatagcattgatgaaatcgtggatgtggttagcgactaccagagtgaggaggtggacgacgtcgagaagaataactgtgtggagtacatagaggacgatgaggaacatgtggatattgagaccgttgaagagctctcagaggagatcaacgtcgcacaccttaaaaccacagctgcacacacgcagagcttcaaacaacctagttgtacccatatctcagctgatgagaaggctgcagagaggagtcgtaaggctccacctattccactcaaactgaagcccgattattggtccgacaaactgcagaaggaggccgaagcatttgcatactaccgacggactcacaccgctaatgagcggcgtcggagaggtgagatgcgcgatttgttcgagaaactgaagatcactctgggcctgctgcactcttctaaggtcagcaaaagtctgatcctgacgcgggccttttcagagatccagggattgaccgaccaagccgataaattgatcgggcagaagaacttgctgacccgcaaaagaaatatcttgataaggaaggtgagctcactctcagggaagacagaggaggttgtattaaagaaacttgagtatatttacgcaaagcagcaggcactcgaggctcagaagagaaagaagaagatggggagtgacgagttcgacattagccccaggatctcgaagcagcaggaggggagttctgcgtcttcggtggacttgggtcagatgtttattaataatcggcgggggaagcctctcatcctgtctcggaagaaggatcaggctactgagaatacttcacctcttaatacgccacacacaagcgccaatctggttatgaccccccagggacagttactcactctaaaggggccactgtttagcggtcccgtggtcgccgtgagccctgacttgctggagtctgacctgaaacctcaggtggcgggtagcgcggtggcactacctgagaatgatgacctatttatgatgccacgaatagtcaacgttacatctctggccaccgagggggggctggttgacatgggcggaagcaaataccctcacgaagtacctgattccaaaccaagcgatcatctcaaggacaccgtccgcaatgaggataacagtctggaggataaaggccggatctcatcgcgtggtaacagagatgggagggtaaccttgggccctacacaggtgtttctggctaataaggactcgggttacccccaaatcgtggacgtcagcaacatgcagaaagcacaggaatttctgcccaaaaagatcagtggcgatatgcgagggattcagtacaagtggaaggagagcgagtcgaggggtgagcgagtcaagtcaaaggactcttccttccataaactcaagatgaaggatctcaaggacagctccatagagatggagttacgcaaggtcacttccgctatcgaagaggctgccctcgatagttctgagcttctgacaaatatggaagatgaggatgatacagatgaaactctgactagcctgctaaatgagattgctttcctgaaccaacagctgaatgacgattcagtggggctggccgagcttcctagttctatggatacggagtttccgggtgacgcgcgacgcgcctttatcagtaaggtgccgccaggcagtcgagctacgttccaagtagaacatctgggcacaggtcttaaggagctcccagatgtccagggcgaaagcgactcgatcagtcccctgttgctgcatctcgaagatgacgacttctccgagaacgaaaagcagctcgctgaacccgcttcagaacctgacgtgctgaagatcgtaatcgactccgaaattaaggactcactgctctcgaacaagaaagcaatcgatgggggaaaaaacacttcagggctgcctgccgaacccgagagtgttagctcaccacccacattacacatgaaaaccgggctcgagaacagcaatagcacagatacattatggcgccctatgccaaaactggctcccctcggcctgaaggtggccaacccctcttctgacgctgacgggcagtctctgaaggttatgccatgtctagctccaatcgccgctaaagtcggtagcgtgggccacaagatgaacctgaccggtaatgaccaggaaggcagagaaagtaaagttatgcccaccctagcaccagttgtggcgaagctggggaattccggagcgagcccctccagcgccggcaagtag

SEQ ID NO: 123543 - DNA, 8571 bp, Artificial Sequence
  Description of Artificial Sequence: Synthetic coding sequence
atggaagaaaagcaacagattattttagcgaatcaagacgggggcaccgtagccggtgctgcccccactttcttcgttattttgaagcagcccggcaatggaaagaccgaccagggcatacttgtcaccaatcaggatgcttgcgctcttgcctcctccgtgagtagcccagttaaatctaagggcaaaatctgcttgcctgccgattgcaccgttggaggaatcaccgtgaccttggacaacaactcgatgtggaacgagttttaccaccgatctacagaaatgatcctcactaagcaggggcggcgtatgttcccatattgccggtactggatcactgggctggacagcaacttgaagtatatattggtgatggacattagtcctgtggataatcaccggtataaatggaatggtcgctggtgggagccctctggaaaggctgaaccccacgtactggggcgggtgtttattcaccctgagtctccctccaccgggcattattggatgcaccagccggtttccttttacaagctgaaactgaccaacaatacacttgaccaggaggggcatatcatccttcattctatgcataggtatcttccaaggctgcatctggtgccggctgagaaagccgtggaggtgattcaactaaacggccccggcgtccacaccttcacatttcctcagactgaattcttcgccgtgaccgcctaccagaacatacagatcacccagctgaagatagactataacccttttgctaaaggctttcgcgacgacggcttgaacaacaagcctcagagggacggaaagcagaaaaactcgtcggaccaggaaggcaataatatatcatcctcgtcaggccatcgagttaggctgaccgaagggcagggaagtgaaatccaacctggcgacttggacccactcagtagagggcatgagaccagcggtaagggactggagaagacatctctcaacatcaaacgcgattttttgggttttatggacacggacagcgcattaagcgaggttcctcagctgaaacaggagatctctgaatgtctgattgcttcttccttcgaggatgatagtagagtggcctcgcccctggatcagaacggctcattcaacgtggttatcaaggaagagccactggacgattacgattatgaactgggagaatgtcctgagggagtaacagtgaaacaggaggagacggacgaagaaacagatgtgtattctaattctgatgatgatccgattctggaaaaacaactgaagcgccacaacaaggtggacaatcccgaggccgaccacttgagctctaagtggctgcctagctcgcccagcggcgtggcaaaagcaaagatgttcaaacttgatactggaaaaatgcccgtagtctaccttgagccatgtgccgtaacacggagcacagtgaaaatatctgagctgcctgataacatgctttcgaccagccgaaaagacaaatcctccatgctagccgaactggaatatttaccgacctacatcgagaactctaacgagaccgcattttgtctcgggaaggagtcagaaaatggactgaggaaacatagcccagacctgcgcgttgttcagaagtatcccctcctgaaggaaccccagtggaagtatccggatatttcggacagcatatccaccgaacggatcctggatgactctaaggatagtgttggcgactcattatcgggaaaagaagatttaggccgcaagagaaccaccatgcttaaaatcgccactgctgccaaggtggtcaacgccaaccagaacgcctcgcccaatgtacccgggaaacgcgggcggcctcgaaagcttaaactgtgcaaggctggcagaccgcccaaaaataccggaaaaagtctgataagcacaaaaaatactcccgtatctcccggttccacattcccagacgtcaagccggatctggaggatgttgacggcgttctcttcgtatccttcgagtctaaggaggcactggacatacacgctgtggacggcacaaccgaggaatccagctcattgcaagcaagcacaacgaacgactccgggtatagggctaggattagtcaactcgagaaagaactgatcgaggacctcaaaacattaagacataagcaggttatccaccccggactccaggaggtgggcctgaagttgaactcagtggatcccaccatgtcgattgatctcaagtatttgggagtgcagctgcccttagcacctgccacctcatttcccttctggaacctgaccgggaccaatccggcaagccctgacgcaggtttcccatttgtgtccagaaccgggaagacaaatgactttaccaagataaagggatggaggggcaaatttcattctgccagtgcatcacggaatgagggtggaaattcagagtcctctctcaaaaataggagtgccttttgctcggacaaattggatgagtatctggaaaacgaaggtaaattaatggagacaagtatgggattctcttctaacgctccaacaagccctgttgtgtaccagctgccgactaaatctacctcctatgtgcgtacgcttgacagcgtgcttaaaaagcagagcacaatctcccctagcacttcatacagcttaaagccacactcggttcctcctgtgagccggaaagcaaaatctcagaatcgccaagctactttctccggccggactaaatctagctataaatccattctcccatatcccgtatctccaaagcaaaaatactctcatgtgatactcggcgacaaggtaaccaaaaactcttcaggaatcatttctgaaaatcaggctaataacttcgttgtgccgacactggacgaaaacatcttcccaaaacagatttctttgcgccaggcacagcaacagcaacagcaacagcagggtagtcgcccacctggactgagcaagagccaggtaaaattaatggatctggaagattgtgctctgtgggaaggcaaaccgagaacttatattaccgaggagcgagccgacgtgtccctgactaccctccttaccgcgcaggctagcctcaaaacaaagcccattcacactatcatccggaagcgtgctccaccctgtaataacgacttctgccgtctcgggtgcgtctgctcctccctcgccttggagaagcgccagccggcccactgtagacggcctgattgcatgttcggttgcacatgcctaaagaggaaggtggtcctggtgaagggaggcagcaaaaccaagcacttccagcgcaaggccgctcaccgcgatcccgtgttctatgatactcttggcgaggaggcacgcgaggaagaagaaggcatccgggaggaagaggagcaactaaaagagaagaagaaacgtaagaaactagagtatacgatttgcgaaacagaaccagagcaacccgtacggcattaccccctatgggtgaaggtggagggtgaggtggatcccgaaccagtttacatccccacgcccagcgtaattgaaccgatgaaaccgctactattgcctcagccggaagtgctttcccccacggtcaagggtaagctgctgacagggatcaaatcaccgcgatcttacacacccaaacctaatcctgtgattagagaggaagacaaggaccctgtttacctgtattttgaaagcatgatgacctgcgcaagagtgcgggtctacgaaagaaagaaggaggatcagcggcagccgagtagtagtagctctccctcaccttctttccagcaacaaacgtcatgtcactcatcccccgaaaatcacaacaacgcaaaggaacctgacagcgagcagcagccgttgaagcagttgacatgtgatctagaagatgatagtgacaagctgcaggaaaagagctggaaatcatcctgcaatgaaggagaatccagctccacaagctatatgcaccagcgcagtcctggcggtccaacgaaactgattgagatcatttctgattgcaattgggaagaagatcggaacaagattttgtccattctctctcagcacataaattcaaacatgcctcagagccttaaggtcggatcctttatcattgagctcgcctctcagagaaagtcaagaggtgagaagaacccccctgtttattcctcaagggtgaaaatcagcatgccatcatgccaggaccaagatgatatggccgagaaatccgggagtgaaaccccagacgggccactctccccgggcaagatggaagacatttcgcctgtgcagactgatgccctcgatagcgtccgagaacgtctgcacggagggaaaggtctgcctttctacgctggcctgtctccagcggggaaactcgtggcatataagcgcaagcccagctcatccacttctggcctgatccaggtggcttctaacgccaaagtcgcagccagccggaaaccccgcactcttttaccatccacaagtaactccaagatggcttcgagcagcgggaccgctacaaatcggcccggcaagaatctgaaagcttttgtccccgcaaaacgcccaatagaaaacgcagctcagattcccgtggctacacctcaggtttcccctaacactgtgaagagggcggggcctcgcttgcttctgataccggtccaacaaggatcccccacccttcggccagttagcaacacacaactgcaggggcaccgcatggtgctccagcccgtccgctctccctctggcatgaatctgttcaggcaccccaatggccagatagtacagcttttgcctcttcaccagctccggggaagtaatactcaacccaatctccagcccgtcatgttccgcaaccccgggagcgtgatgggcatccgactccccgccccaagcaaaccaagcgagacaccaccctcatcgaccagcagcagtgcgttttctgtgatgaaccccgtcatccaagccgtcggtagctcctccgcggtaaacgtgataactcaggctccttccctgctgagttctggggcctccttcgtgtctcaagctggcacgctgactctcagaatttctcctcctgagcctcagagctttgctagtaaaacaggttccgagactaagattacttacagcagtggggggcagcctgtagggactgcgagccttatacctctccaaagcggctcctttgctctgcttcagttgcctggccagaagcccgtgcccagctccatcctccagcatgtagccagcttgcagatgaagcgagaatctcaaaatcccgaccaaaaggatgagactaattcaataaagcgagagcaagaaactaagaaagtcttacagtctgaaggcgaagcagtcgatccggaggctaatgtaatcaagcagaacagcggagcggcaacgtcggaagagactctgaacgacagccttgaggatcgaggggaccacttggatgaggaatgtcttccagaggagggttgtgctacggtgaagccctcagaacatagttgcataaccggaagtcataccgatcaggactacaaagacgtaaatgaagagtatggtgctagaaacagaaagagctctaaagagaaggtggctgtcctcgaagtgcggactatatccgaaaaagcctctaacaaaacggtgcagaatctgagcaaggtgcagcaccagaagctcggagacgtgaaagtggagcagcagaaaggcttcgataacccagaagagaacagtagcgaattccctgtgacttttaaggaggagtctaaatttgaactcagcggatcaaaggtcatggaacagcagtctaacctgcaacccgaggcaaaggaaaaggaatgcggcgacagtctcgaaaaggaccgggagagatggcggaagcacctaaaaggccctctgactcggaagtgtgtgggggcttctcaggaatgtaaaaaggaggccgacgaacagctgattaaagagacaaaaacatgccaggaaaacagtgatgttttccagcaggagcagggcatcagcgacttactggggaagtcaggaatcaccgaagatgcacgggtgctaaagactgagtgcgactcttggtccaggattagcaatccatccgcgttcagtattgtccctcgaagggccgccaagagttcccgcggcaacggacacttccagggtcacttgctactgcctggtgaacagattcagccaaaacaggaaaaaaagggcgggcgctctagtgctgattttacagtcttggatctcgaggaggacgatgaggacgataacgaaaagaccgatgattctatcgacgaaattgttgacgtcgttagcgattatcaaagcgaagaagtggatgacgtggaaaaaaataactgcgtggagtatattgaagatgatgaggagcatgttgatattgagacggtggaagagctctcagaggagataaacgtggcacacctgaagaccacagccgcacatactcaaagtttcaaacagcctagctgtacacacatttcagccgatgaaaaagccgctgaacggtctcgcaaggcaccgcctatcccccttaagttgaagcctgattactggtccgataagcttcagaaggaagcggaggctttcgcgtactaccgccgcacccacacagccaatgagcgccgtcgacggggggagatgagggacctctttgaaaagctcaagatcactctggggctcctgcatagcagcaaggtctccaagtcccttattctgactcgtgcatttagcgagattcagggacttaccgatcaggccgataaactgatcgggcagaaaaacctgctgacaaggaagcggaatattctgatacggaaagtctcaagcctaagcggcaaaactgaagaggtggtcctcaagaagcttgaatacatctacgctaaacaacaggcattggaggcccagaaaagaaaaaagaagatgggaagtgatgaattcgacatcagcccgcggatctccaaacaacaggagggaagttccgcttcttccgttgatttaggccagatgtttatcaataacagacgtggaaaacctctgattctgagcaggaagaaagatcaagctaccgaaaatacgagtcccctcaacacccctcacacctcagccaacctcgtaatgacacctcaagggcagttgctaaccttgaaggggcccttattcagcgggcctgtggtagcggtgtcacccgatctgctggaaagtgatctcaaacctcaggtggctggatcagcggtcgctcttccagagaacgacgatctctttatgatgcctcgcattgtcaacgtcacctccttagcaaccgaagggggcctcgtcgatatgggcggttccaaatacccacatgaggtacccgatagtaaaccctctgatcacctcaaagatactgtccggaacgaagacaattctctcgaagataaaggccgcatatcctcaagaggcaaccgggatggacgggtgactctggggccgactcaggtgtttttagccaataaggactccggatacccgcagatcgtcgacgtgtccaacatgcagaaagcacaagaatttctccccaaaaagatcagtggtgatatgaggggaattcaatacaagtggaaggagagtgaaagcagaggcgaacgcgtgaaaagcaaagattcgtccttccataaacttaagatgaaagaccttaaagactcctccatcgagatggaactgaggaaggtgacatccgcaatcgaagaggctgctctggattcttccgaattactaactaacatggaggacgaagacgatacagatgaaaccttaacaagcctgctgaacgagatcgcatttttaaatcagcagctcaacgatgattcagtgggtctagctgagctgccaagtagcatggacaccgaattcccaggagacgctaggcgcgcctttattagtaaggtgccacctggtagtcgggcaaccttccaggtagaacacttgggcactggactgaaggaacttcccgatgtacagggagagtccgactctatctcccctttgttactacacctggaggatgacgatttttccgagaatgaaaagcagctggctgagcctgctagtgagccagacgtgttgaaaatcgtcattgattccgagataaaagactctctcttaagtaacaagaaggcaatcgacggcggcaagaatacttccggccttcctgctgaacctgagtctgtgtcatccccgcctactcttcacatgaagacgggcctggaaaatagtaatagcaccgacactctgtggcggcctatgccaaaactggctccacttgggttaaaggtggccaatcctagctccgacgcagatggacagtcactgaaagtgatgccatgcttggcacctattgctgccaaggtcggaagcgtcggacataaaatgaacctcactggtaatgatcaggaaggaagagagagcaaagttatgcctactctggcacctgtggtagcaaaattgggaaacagcggagccagtccctcaagcgctggcaagtag

SEQ ID NO: 123544 - DNA, 687 bp, Artificial Sequence
  Description of Artificial Sequence: Synthetic coding sequence
atggagcgagtgaagatgattaacgtccagagactcctggaggctgctgaattcctagaacgccgcgaacgcgaatgcgaacatgggtacgcctctagttttcccagcatgccaagcccccgcttgcaacacagtaagccaccacggaggttatctcgggcccagaagcatagctcaggaagctctaatactagcactgctaacaggtctacccataatgagctcgagaagaaccgccgcgcccacctgagactgtgtcttgaacgccttaaggtgctgatccctctagggcccgactgcacccggcacaccaccttgggcctacttaacaaggctaaggcccatatcaagaagctggaagaggccgagaggaagtcccaacatcagttggagaacctggaacgggaacaacgctttttgaaatggcgtctggaacaattgcagggaccccaagaaatggagaggatcaggatggacagcattgggagcacaatcagctccgaccgaagcgactctgaacgcgaggaaatagaagtagatgtggagagcacagagttcagccacggagaggtcgataacatttctactacctctattagtgatattgatgaccactcaagcctccccagtatcggctcagacgagggttattctagcgcctccgtcaagctcagctttaccagctag

SEQ ID NO: 123545 - DNA, 888 bp, Artificial Sequence
  Description of Artificial Sequence: Synthetic coding sequence
atgggcaagcggggtcgaccaaggaaggaagcacggtgcgagggcgctgggcttgcacctgctgctccgcctgcagtgccaccagcggttgctgctcctcaacctcctgccctaccggaggaccctgctggggcaaaacccagatgtcctttttctgacatctttaatacgtcagaaaattctatggagaaacatatcaacacttttttgcagaatgttcagatcttactcgaggcagcttcctatctcgaacagattgagaaagagaataagaagtgtgagcacggatacgcatcctctttcccttccatgcctagcccccgactgcagcactcaaaaccacctaggagattatctcgcgcccagaagcacagctccgggtctagcaatactagtactgctaaccggtccacacataatgaactggaaaagaatcgcagagcacatcttcgcctgtgcctcgagagactgaaggtgcttattcccctgggccccgactgcactaggcatacaacactgggcctgctcaacaaggccaaagctcacattaaaaagctcgaggaagccgaacggaagtcacagcatcagctggaaaacttagagcgagaacagcgattcctgaagtggcgcctcgagcagcttcaaggcccccaggagatggaacggatccgaatggactcgataggctcaacaatatccagcgacagaagcgactccgagcgggaggagatagaagttgatgtagaatccaccgaattcagtcacggcgaggtcgataatatttccacaacttcaatcagcgatattgatgatcattcgtctctccctagcatcggttctgacgagggctactcctctgcctctgtgaagcttagttttactagctag

SEQ ID NO: 123546 - DNA, 549 bp, Artificial Sequence
  Description of Artificial Sequence: Synthetic coding sequence
atgccctctccccgtcttcagcactcaaagcccccacgacgacttagccgtgctcagaaacacagttcgggatcctcaaacacatcaacagcaaacaggcgcgcccacttgcggctgtgcctggaacgactcaaagtattgattcctctggggcctgactgcaccagacacacaaccctgggacttcttaataaggcgaaggcccatattaagaagctggaagaggcggaacgtaagagtcagcaccaacttgaaaatctggaaagggagcagcgattcctaaaatggagactcgaacagctccagggcccacaggagatggaacgaatcaggatggattctatcggctccacaatctcgtctgacaggtccgattccgagcgcgaggagatcgaagtggacgtggaaagtacagagttttcccacggggaagttgataatatcagcactactagtattagcgacattgatgaccacagttcactgccttcgattggatctgatgaaggatactccagcgcttcagtaaagctctccttcacttcttag

SEQ ID NO: 123547 - DNA, 579 bp, Artificial Sequence
  Description of Artificial Sequence: Synthetic coding sequence
atgccaagccctcggctgcaacactctaaaccccctcgtaggctgtcgagggcccagaaacacagtagtgggtcttctaatactagcaccgctaacagaagcacacataatgagcttgaaaaaaaccggcgtgcccacctccgcctgtgtctggaaaggctgaaagtgctaatcccgttaggtcccgactgtacacgccacacgacactgggtctgctgaacaaagcaaaggcccatattaagaaattggaggaagccgagcggaagagccaacaccaactggaaaacctggaacgtgaacagcgattcctgaagtggaggctggaacagttacagggaccacaagagatggaacgaattaggatggactccatcggatcgacaatctcctctgataggagcgactcagagagggaggaaatcgaagttgatgtggagtccacggagttctcccatggggaggttgacaacattagcaccacctccatctcagatattgatgaccactcctctctcccatcgatcgggtcagatgagggctacagttctgcttccgtgaagttgtcctttacaagctag

SEQ ID NO: 123548 - DNA, 579 bp, Artificial Sequence
  Description of Artificial Sequence: Synthetic coding sequence
atgccttctccaaggctgcagcattctaaaccaccacgccgactatctagggctcagaaacattcaagcggatcatccaatacctccaccgctaatcggtcaactcataacgagctagagaagaacaggcgcgcgcatttgcgcctatgtctagagagattgaaggtgctgattccacttgggcctgactgtacacgtcatacaacccttggcctgctcaacaaagctaaggctcacataaagaaactggaagaggccgaacggaagtcccagcaccagctagaaaacctggaacgcgaacaacgattcctcaagtggaggttagagcaacttcaaggccctcaggaaatggaaagaatcaggatggattcaataggatcaaccataagtagcgatcgctcagacagtgagagagaagaaatcgaagtcgatgtcgagtctactgagttctctcacggagaggtcgataatatctcgacaacaagcatcagtgatattgatgatcacagctctctcccttcgatcgggagcgacgagggatactcctctgccagcgtgaaactgtcttttacctcatag

SEQ ID NO: 123549 - DNA, 579 bp, Artificial Sequence
  Description of Artificial Sequence: Synthetic coding sequence
atgccctcaccccgtctgcagcactccaaaccaccccgacggctctctcgggcccaaaagcactctagcgggtcaagtaacacatccacggcaaataggagcacccacaatgaactggaaaagaacaggcgggcgcatctacgcttgtgcctcgagcgcttgaaagtgcttattccattgggccccgattgcactaggcacaccactctgggtctgctgaataaggccaaggctcatattaaaaaacttgaggaggcagagcgtaagtctcagcatcagctcgagaatctggagagagaacagaggttcctgaaatggcgcttagaacagctccagggcccacaggaaatggagagaatcagaatggacagcatcggtagcactataagctcggaccggtctgatagcgaacgagaagagatagaggtggacgtagagtctaccgaattcagccacggcgaggtcgataacatttcaacgactagcattagcgatattgacgatcatagctccctgccgtccattggatcggatgagggttacagctcagcatccgtgaaactgtcattcacaagctag

SEQ ID NO: 123550 - DNA, 657 bp, Artificial Sequence
  Description of Artificial Sequence: Synthetic coding sequence
atggaacgggttaagatgatcaatgtgcaacggttactcgaggcagctgagtttttggaaagaagggagagggaatgtgagcatggatacgcttcaagctttccaagcatgccaagcccccgcctgcaacactccaagcctccacggcggctgtcacgggcgcaaaaacattcaagtgggagcagcaatacgtctaccgcgaatcgaagagctcacctgagattgtgcttggagcgactgaaggtcctaattcccttgggtcctgattgcacacgacataccactctaggcctacttaataaagctaaggctcatatcaagaaactggaggaagccgagcgcaagtctcaacaccagctcgagaacctggagcgcgaacagcggtttcttaagtggcgcctggaacagttgcagggtcctcaggaaatggaacggatccgaatggattccattggaagcactattagcagtgaccggagtgactccgagcgtgaagaaatcgaagtcgacgttgaaagcaccgagttctctcacggagaggtcgacaatatttctaccaccagcatctctgatatcgatgaccacagctctttgccaagcataggatctgatgagggatactccagcgcctctgtcaaactcagttttactagctag

SEQ ID NO: 123551 - DNA, 657 bp, Artificial Sequence
  Description of Artificial Sequence: Synthetic coding sequence
atggaacgggtcaagatgatcaatgtccagagactccttgaggccgctgaatttctggagaggcgcgaacgagagtgtgagcacggttatgcatcctccttcccgtctatgcctagtcctcgactgcagcactcgaaaccaccacgccgcttgtctagagcccagaagcattcctccggatcttcgaacactagcacagctaatagaagggctcatcttagattgtgccttgagagattgaaggtgctgattcccctgggtccggattgcacacgacacacgacactggggctacttaataaagctaaggcacatatcaagaagctggaagaagccgaaaggaagtcgcagcaccagctggagaatctagagcgggagcaaaggtttttgaaatggcggctcgagcagctccagggaccccaggagatggagcgaattaggatggattctatcggttccactatttctagcgataggtccgactctgagcgcgaagagatagaggtcgacgttgagtctacagagttctctcatggtgaagtcgataacatcagtacaaccagcatctcagatatcgacgatcatagttcccttccctccattggctccgacgagggatacagctccgccagcgtcaaactctcctttacgagctag

SEQ ID NO: 123552 - DNA, 357 bp, Artificial Sequence
  Description of Artificial Sequence: Synthetic coding sequence
atgcctagcccccgtcttcagcacagcaagcctccccggcgactgtcccgtgcccagaagcacagcagtggaagcagcaatacctccacggccaacaggtcaactcacaacgaactcgaaaaaaacaggagagctcacttgcgcctgtgcctggagcggctaaaggtgctgatcccgttgggccctgattgcaccagacacactaccctaggccttctcaacaaggccaaagcccacataaagaagttggaggaagcagaaaggaaaagccagcatcagcttgagaacctggaaagagagcagagattcctgaaatggcgattggagcagcttcaggggcctcaagaaatggaatag

SEQ ID NO: 123553 - DNA, 681 bp, Artificial Sequence
  Description of Artificial Sequence: Synthetic coding sequence
atgggcaaacgagggcgaccaagaaaagaagcgcgatgcgaaggcgcaggcctggcgccggccgcgccgcccgccgtgccccccgcggttgccgcgcctcagcctcctgcgctgcccgaggatccagcgggcgcgaagccaagatgcccctttagcgatatctttaatactagtgagaactccatggagaaacatatcaataccttcttgcaaaatgttcaaatcctcctggaggcagcttcttacttagagcaaattgagaaagaaaacaaaaagtgtgagcatgggtacgcctcttcttttccctctatgccatccccacgattgcagcattctaagccaccccggcgcctgtcgagggctcagaaacattcctctggatccagcaacacatcgacagcaaataggcgagctcatttgagattgtgtctcgaacgacttaaggtgctgattcctctcggtcccgactgcacgaggcataccacccttggcctcctgaataaagccaaggctcatattaaaaagttagaggaggcagaacgtaagtctcaacatcagttggaaaacctggaaagggaacagcgctttcttaaatggaggctcgagcagctgcaaggccctcaggaaatggagcggatccgcatggacagcatcggctctactatcagttctgatagatag

SEQ ID NO: 123554 - DNA, 897 bp, Artificial Sequence
  Description of Artificial Sequence: Synthetic coding sequence
atgactgagccaggggccagcccggaagatccttgggtcaaagcaagcccagtcggtgctcacgcaggggaaggccgcgctgggagagcacgggccaggcgcggagcaggccgcagaggcgccagtctcctgtctcctaagtctcccactctgtccgtgccccgaggctgccgtgaagactcgagccatccagcctgcgccaaggtcgagtacgcttacagtgataatagtttagacccggggttgttcgttgaaagcacacggaaaggaagcgtcgtgagtcgcgctaattctatcggcagcacaagtgctagctcggtaccaaacactgacgatgaggatagtgactatcatcaagaagcctacaaggaatcctataaagatcgcaggcggagggcccatacccaggccgaacagaagcgccgcgacgctataaagagaggctatgacgatctgcagaccatagtgccaacgtgtcagcagcaagatttctccatcggatcccagaagctgagcaaagccatcgtgttgcagaagaccatcgactacatccagttcctgcataaggagaaaaagaaacaggaggaggaagtgtccacccttcgtaaggacgtaaccgccctcaagatcatgaaagtgaactatgaacaaatcgttaaagcacaccaggacaatccacacgaaggagaggaccaggtgtcagatcaagtgaaatttaatgtctttcaggggattatggatagtctgtttcaaagttttaacgcttccattagcgtagcaagcttccaggagttaagtgcctgtgtctttagctggatagaggaacactgcaaaccccagactctgagggaaatcgtgatcggggttctgcaccagctcaaaaaccaactgtattag

SEQ ID NO: 123555 - DNA, 645 bp, Artificial Sequence
  Description of Artificial Sequence: Synthetic coding sequence
atgaccgagccgggggcttcccctgaggatccttgggtgaaagtagagtatgcttacagcgacaactcgctggaccctgacgatgaggactctgactatcaccaagaggcatacaaagagtcctataaggatagaagacggagagcccatactcaggccgaacagaagcgtagagatgccatcaaacgtgggtacgatgatttacagaccattgttcctacctgccaacagcaggatttcagcatcggaagccagaaactgtctaaggcgatcgttctccaaaagactattgactatattcagtttctgcataaagaaaaaaagaagcaggaagaagaagtaagtacattacgcaaggatgtgacagccctcaagatcatgaaagtgaactacgaacagatcgttaaggcgcatcaggacaatccccacgagggcgaagatcaggtgtcagatcaggtgaagttcaacgtgttccagggaatcatggactctctgttccagagcttcaacgcatctatctctgtggcttccttccaagagcttagtgcctgcgtcttcagctggatagaggaacactgcaaaccgcaaaccctcagggagattgtcatcggagtgctccatcagctgaagaaccagctttattag

SEQ ID NO: 123556 - DNA, 735 bp, Artificial Sequence
  Description of Artificial Sequence: Synthetic coding sequence
atgactgaacctggtgcctctccagaggatccttgggtgaaagtggaatacgcgtattctgataattctctggatcctggcctgtttgtggaatccacaagaaagggctctgttgtctctcgagccaacagtatcggaagcaccagtgcatctagtgtcccaaatacagacgatgaggatagcgattaccatcaagaagcctataaggagagctacaaagataggcgacgccgagcacatacgcaggctgaacagaaaaggcgggatgctattaagcggggttatgatgacctccaaacaattgtaccaacctgccagcagcaagatttctccatcggatctcagaagttgagtaaagcaatagtcctccagaaaacaattgattacatccagttcctgcacaaggagaaaaaaaaacaggaggaggaggtctcgactctccgaaaggacgtcaccgcgctcaagatcatgaaggtgaactacgaacagatcgtgaaagcccaccaggataacccacatgagggcgaggaccaagtgtccgaccaggttaaatttaacgtctttcagggtattatggatagtctgtttcagtcctttaacgcttcaatatcggtggcgtcctttcaggagctctccgcatgtgtgtttagctggatagaggagcattgcaagccccagaccctccgcgagatcgttatcggcgtgcttcaccagctcaagaatcagttgtattag

SEQ ID NO: 123557 - DNA, 2826 bp, Artificial Sequence
  Description of Artificial Sequence: Synthetic coding sequence
atggctgaggccaatcccagaagaggcaaaatgcgcttccggaggaatgccgccagctttcctggcaatttgcacctcgtgttggtactgcgtccaactagctttctgcagcggacatttacggacatcggattctggttctctcaggaagatttcatgctgaaattgcccgtggtgatgctttcctccgtgagcgacttactcacttacatagatgacaagcagctcactcccgaattgggggggaccctgcagtactgtcattcagagtggataatctttaggaatgccattgaaaacttcgccctgacagtgaaggaaatggcccagatgctgcaatcatttggcaccgagctagccgaaacagagctccctgacgatatcccatctattgaagaaattttggccatccgggccgaaagatatcatctgttaaaaaacgacataaccgccgtcacaaaagaaggtaaaatcttgctgacgaaccttgaggtgccagatactgagggcgctgtcagcagtcgtctagaatgccatcgccagataagcggggattggcaaacgatcaataagctccttacgcaggttcatgatatggaaacagcattcgatggcttctgggagaaacaccagttaaaaatggagcagtacttacaactgtggaagtttgaacaagactttcagcaactggtgacagaagtggagtttttgctgaaccagcaggcagaactggcggatgtgaccggaactatcgcacaggtgaagcagaaaataaagaagctcgagaaccttgatgagaactctcaggaactcctgtccaaggcgcagttcgtcatcttgcatgggcacaaactcgcagccaatcatcattatgctttggacctcatatgccagaggtgtaatgagctcaggtacctgtccgatattctagttaacgagatcaaggccaagcgaatacagctcagccgaaccttcaagatgcacaaactcttgcagcaagcacggcagtgttgcgatgagggggagtgcctgctggccaatcaggaaatagacaagttccagagcaaggaggatgctcaaaaagctttgcaagatattgaaaatttcttagaaatggccttgccattcatcaactacgaacccgagacgctccagtatgaattcgatgtcatcctgtccccggagctgaaagtacagatgaagaccattcagctaaaattggagaacatacgaagtatattcgaaaatcagcaggctgggtttagaaatctggccgataaacacgtgcgacccatccagttcgtagtccctactccggagaacttagtgaccagcggaacaccgttttttagcagcaagcaggtgggggttggctattcttttttccaggcctgtaaactgttcagcaaaggcaaaaagacctggcggcagaatcagtctaatctgaagattgaggtagtgccggactgccaagagaaacgttcctccgggcccagttccagcctggacaatggcaattctttggacgtgctgaagaatcacgttctgaacgagctgattcaaaccgagcgggtatatgttagagagctgtacaccgtactgctcggataccgtgccgagatggataacccagaaatgtttgatctgatgccacccttactcaggaataagaaagacatactttttgggaatatggctgagatctacgagttccataatgatatattcctgtcgtcactggagaactgtgcccatgctccagagcgtgtgggaccctgttttctggaaaggaaggacgactttcaaatgtatgcgaagtattgtcagaataagcccaggtccgaaacgatttggcggaaatactcagagtgcgcttttttccaggagtgccagcggaagctgaagcaccgacttcgcctggacagctatcttctaaagccagtgcaacgtatcaccaagtatcagttactcctgaaggaactccttaagtattccaaagactgcgaaggctccgccttgctgaaaaaggccctggacgccatgctggatttgttgaagtctgtcaatgatagcatgcaccagatcgccattaacggctatatcggcaacctgaacgagttaggtaaaatgatcatgcaaggaggctttagcgtgtggattggacataagaagggggccaccaagatgaaggatctggcccggttcaagccgatgcagagacacctgttcctctacgagaaagccattgtgttctgcaaacgcagagtggagtcgggggagggaagtgacagatacccttcttacagtttcaaacattgctggaagatggacgaagtcggcatcaccgagtatgtcaagggagacaatcggaagtttgagatctggtatggcgaaaaagaggaggtctacattgtgcaggcctctaacgtggatgtgaaaatgacctggttgaaagaaattcgaaatatactgctcaaacagcaggaactcctgacggtgaaaaagcggaaacagcaggaccagctaaccgagcgcgacaagtttcagatcagcctgcaacagaacgacgaaaagcaacagggggcctttatttcaacagaagaaaccgagctggaacacacctcaactgtcgtagaagtgtgtgaagctatagcctccgtccaagcagaggcaaacactgtgtggacagaggccagccaatccgcagagatcagcgaggaacctgcagagtggtcctccaactatttttatcccacctacgatgaaaatgaagaggagaatcgccctctcatgaggcctgtaagtgaaatggccctgctctactag

SEQ ID NO: 123558 - DNA, 2583 bp, Artificial Sequence
  Description of Artificial Sequence: Synthetic coding sequence
atggctgaggccaaccctcggcgcgggaaaatgcgctttcgtcgaaacgccgcttcattccccggtaacctccatctggtcttagtgctacgacctaccagcttcctccaacggacgttcacagacatagggttttggttctctcaagaagactttatgctgaaactgcctgtggtgatgttgagttccgtgagcgacttgctaacatatatcgacgataagcagctgacacccgagttgggcggcactctccagtactgtcattcggagtggatcattttccggaacgctatcgaaaatttcgcattaaccgtgaaggaaatggcacagatgctgcagagctttggaactgaactggccgagacggagcttccggacgatattccttcaattgaagaaattctggcaataagagctgaacgataccacctgcttaagaatgacatcaccgccgttaccaaagagggcaagatccttctaacaaacctagaagtacctgataccgagggagccgtgagctctcgcttggaatgccaccggcagatttcaggtgactggcaaaccatcaataaactgctgactcaagtgcatgatatggaaactgccttcgatggtttctgggagaagcaccagttaaaaatggaacagtacctccagttgtggaagttcgagcaggactttcaacagcttgttaccgaagtcgaattcctgctgaatcagcaagcggagttggccgacgttacaggtaccattgcccaggtgaaacagaagatcaaaaagcttgaaaacctggatgagaattctcaggaacttctgtctaaagcacagtttgtcattctgcatggccataagctcgccgctaatcaccactacgccctcgacctcatctgccagcggtgtaacgagctgcggtacttgagtgatatactcgttaacgagatcaaagccaagcgcatccagcttagccgaacatttaaaatgcacaagctattacagcaggcaaggcaatgttgcgacgagggcgagtgtctcctggcaaaccaggaaatcgataaatttcagagcaaggaagatgctcagaaagccctccaggacattgaaaatttcttggagatggccctgccctttatcaactatgagcctgagacattacagtatgagtttgacgtcattctcagtcccgagctgaaagtgcagatgaagacaattcagttgaaactcgaaaatatcagatcaatatttgaaaatcaacaagccggtttcaggaacttggctgataaacacgtgcgccccatccagttcgtggtgcctactccagagaatctggtcactagcggcaccccattctttagttctaaacagggaaagaagacttggagacaaaaccagtcaaacttgaaaatcgaggtggttccagactgccaggagaagaggtctagcggcccatcaagctccctggacaacggcaactccctggatgtgctgaagaaccacgtcttgaacgagttgattcaaacagagcgagtatacgtgcgggaattgtacactgttctgttgggttatcgggccgaaatggacaacccagaaatgttcgaccttatgcctcccctcctacggaacaaaaaggatattcttttcggtaacatggctgagatatacgaattccataatgacatattcctgtcctctctggaaaattgtgctcatgcccctgagcgtgtggggccatgcttccttgagagaaaagacgacttccagatgtatgcaaaatactgccagaacaaaccgaggtctgaaactatctggcggaagtattccgaatgtgccttctttcaagaatgtcagagaaagttgaaacacaggctcagactggatagctacctgctgaaacctgtacagcgcattactaagtaccagttattacttaaggagcttctgaagtactctaaagactgcgaggggagtgccctcctgaagaaagcgctggatgcgatgcttgatctcctgaagtccgtcaacgattctatgcaccagatcgctataaacggctacataggcaacctcaacgaacttggaaaaatgattatgcaaggggggttctccgtgtggatcggacataagaaaggcgctactaaaatgaaggacttggctcggttcaaacccatgcagcgccacttattcctttacgaaaaggctatcgtcttctgtaaacgccgggtggagagcggtgaagggagtgacaggtacccttcttatagcttcaaacattgttggaaaatggacgaggtaggtatcacagaatatgtcaaaggcgataacaggaaattcgagatctggtacggtgaaaaggaagaggtgtatattgttcaagccagcaatgtggacgtgaagatgacatggctgaaggagatcagaaacattttgcttaagcagcaggaattgctgaccgtgaaaaagaggaaacagcaggaccagctgactgagcgagacaagtttcagatcagcctgcagcagaacgacgaggacttgtgtagacgctggctgtcttacattgacgaagccaccatgtctaacgggaaatag

SEQ ID NO: 123559 - DNA, 2778 bp, Artificial Sequence
  Description of Artificial Sequence: Synthetic coding sequence
atggccgaagctaatccccgccggggcaagatgcgcttcagacggaacgctgcctcttttccgggcaatcttcacctggtcctggtcctgcggcctacctcgttcctgcaacgaaccttcaccgacattggattttggttctcccaggaggacttcatgctcaaactgccagtggtcatgctcagcagtgtgagtgacttgctgacatacatcgatgacaaacaactgacgcctgagcttggtgggaccttgcaatactgccattctgaatggatcattttcagaaatgcaatagagaactttgcgttaaccgtgaaagaaatggctcagatgttgcagtccttcgggacagagttagccgagactgagcttcccgatgacataccttccatcgaagagattctggcaatccgggctgagcggtaccatttattgaaaaatgacattacggccgtgactaaggagggaaagattctgctgaccaatctggaggtgccagacacagagggcgcagtgagcagccggctggaatgtcacaggcagatttctggtgactggcagactattaacaagctgctgactcaagttcacgacatggagactgctttcgacggcttctgggaaaagcatcagcttaagatggaacagtacctgcagctttggaaattcgaacaggacttccagcagttggtgacagaggtcgagttcctgctgaatcagcaggcggaactcgccgacgtgaccggaacaatcgctcaagtgaagcagaagataaagaaattagagaacctggacgagaattcccaagagctgctgtcaaaggcccaattcgtaatccttcacgggcacaaacttgccgcgaaccaccattatgctctagaccttatctgccagcgctgtaacgagctcaggtatcttagcgatatcctggtgaacgagatcaaggccaagagaattcagctatcacgaacattcaaaatgcacaagctactacagcaggccaggcagtgctgtgatgagggcgagtgcctgctggcaaaccaggagatcgataaattccagagcaaggaggatgctcagaaggctcttcaggatatcgaaaacttcctggagatggcgctacccttcatcaactatgagcccgagaccctgcaatatgagttcgacgtcattctcagccccgaactcaaagtccagatgaagaccatccagctgaagcttgaaaatattcgatccatctttgagaaccagcaagccggctttaggaatctggcggataagcatgtaagacctatacaatttgtggttcctaccccggagaacctcgttacaagtggaacccctttcttctcaagtaaacaaggcaagaagacttggagacagaatcagtctaacctcaaaattgaagtagtgccagattgtcaggaaaaaaggtcctctggaccaagctcatctctcgataacggaaatagtctggatgtgctcaagaaccacgtactcaatgagctcatccagacagaaagggtctacgtgagggagctctatactgtgttgttgggttacagggctgaaatggataatccagaaatgtttgacctgatgccccccctgctgcgtaataaaaaagatatcttgtttggcaacatggcagagatctatgagttccacaacgacatatttctatcaagcctggaaaattgtgctcacgccccagagagggtcggaccctgttttttagagcggaaagacgacttccagatgtacgcaaagtattgtcagaacaagccgcgaagcgaaacaatctggcgaaaatacagcgagtgcgcattcttccaggagtgtcagcgaaagctgaaacatagactccgactggatagctacctcctcaaacccgtgcagaggatcactaaatatcaacttctgttaaaggaactgctgaaatacagtaaggactgcgaaggctcagcattgctgaagaaggctctggatgccatgctggatctgctgaagtccgtgaatgactccatgcatcaaattgcaataaatgggtacatagggaacctgaatgaactggggaagatgataatgcagggtggctttagcgtctggatcggacacaagaaaggtgccaccaagatgaaagatttggccagatttaaacctatgcagcgccacctcttcctttacgagaaagcgatagtgttctgcaagaggcgtgttgagagtggggagggatctgaccggtatccgtcctactccttcaaacactgttggaaaatggatgaagtgggcattaccgagtatgtcaagggcgacaaccgtaagtttgaaatctggtacggcgagaaagaggaagtctacattgtgcaggcctccaacgtggatgttaaaatgacctggctgaaagaaatccgtaacatcctcttaaagcagcaagagttactgacagtcaagaagcgcaaacagcaagatcaactgaccgaaagggataaatttcagatcagcctccagcagaatgatgaaaagcagcagggcgctttcattagtaccgaggaaacagaactcgaacatacctccaccgtggtggaggtatgcgaggccattgcttccgtccaggccgaagctaacacagtttggacagaagcatcacaaagcgcggagatctcagaggagccggccgaatggagttcgaactatttctacccgacctacgacgagaatgaagaagagaatcgtccgctgatgaggccagtgtcggaaatggccctgttatattag

SEQ ID NO: 123560 - DNA, 3213 bp, Artificial Sequence
  Description of Artificial Sequence: Synthetic coding sequence
atgcctcaggcggcggcctcggctccatggacaagcgtaagctgtggccgtatccctggactaccccagaatccggatggctgcacctttatgcccatagcccaagctatccccctccaagtggatatggctatggcactgcagcgcgttcgcattgctgaaaaatacggaaaaaattacctatgtctgctgcaggccgtctttgttgccgagacggatctcctgttacgaattaaggatatcagtcactttttgatgcaggatatcgcttttcttagtggtggtagggggaaggacaatgcatggattatcactttccccgagaactgtaattttcggtgcatccccgaggaggttatcgcgaaagtgttgacgtacctaaccagtatcgcgcgccagaacggaagcgacagccggtttactatcatcctggatcgtcggttagacacttggtcaagcctgaaaatttcccttcagaagattagcgctagcttccctggcaaccttcacctcgtccttgtcctgcggcccacatccttcctgcagcgcacgtttactgatatcggcttctggttctcacaagaagacttcatgctcaaactgccagtcgttatgctgtctagcgtgagcgacctcttaacttatatcgacgacaaacaactaacgcctgaacttggcggcacgctccaatactgccacagtgaatggattatattccggaacgccatcgagaactttgccttgaccgttaaagagatggcccagatgcttcagtcattcggcaccgaattagcagagacggagctccccgacgacatcccctccatcgaagaaattctggctattagagccgaaagatatcatctgttgaagaacgatattactgctgtgacgaaagaggggaagatcctattgacaaatctggaggtaccagacacagaaggagccgtgagcagtagattagagtgtcaccgccagatctccggcgattggcagaccatcaataagctcctgacacaggtacatgatatggaaaccgcctttgacggattctgggagaaacaccagttaaaaatggagcagtaccttcagttatggaaattcgagcaggactttcagcagcttgtcacagaagtggaatttttactgaatcaacaggccgaactcgctgacgtgactggcacaattgcccaggtgaaacagaagattaaaaaactggaaaatcttgacgagaactcacaggaactcctcagcaaagctcagtttgtcatactccacggccacaagctggctgcaaatcaccactacgcattagatctcatatgccagaggtgtaatgaattacgatacctttcagacatcctggtaaatgagataaaagcaaagcgaattcagctctccagaacattcaagatgcataaactgcttcagcaggcacgacagtgctgcgacgaaggggaatgcctgctcgcgaaccaagaaatagacaaattccagagcaaagaagacgcacagaaagcgttacaggatatcgaaaactttctggaaatggccctgcccttcatcaactatgaacctgagacccttcagtacgaattcgatgtaatcctgagtccggaactgaaggtacaaatgaaaaccatccaattaaagctggagaacatccgctccatctttgaaaatcagcaggcgggcttccggaatcttgccgataaacatgtgcgtcccatccagttcgtggtgccaacaccagaaaacttagtcacaagcggaacaccattctttagcagcaagcaaggaaagaagacctggcgacagaaccagtcaaatctaaaaattgaagtggtgccggattgccaagaaaagcgctcttctgggccgagcagcagcctggataatggcaattcactagatgtcctgaaaaaccacgtgctcaatgagttaatccagaccgagcgggtgtatgttagggagctgtataccgtgttgttgggataccgggcggaaatggacaatcccgagatgttcgatttaatgcctccactgttgcgaaataagaaggatatattgttcggcaacatggccgagatttacgaatttcacaacgatatcttcctctcctcactagagaactgtgcacacgcccctgaacgcgtagggccgtgcttcttagagaggaaggacgactttcagatgtacgccaaatattgccaaaataaacctagatcggaaaccatctggcggaagtacagcgagtgcgcctttttccaagaatgccagaggaaactcaaacacaggttgagacttgactcctaccttttaaaaccggtgcagaggatcactaaataccaattactgttaaaagagctgcttaaatactcaaaagactgtgagggctccgcactgctgaaaaaagccctcgatgcaatgctcgatctgctcaaatctgttaacgacagcatgcaccagattgccattaacgggtatatcggcaacctcaatgagctaggcaaaatgattatgcaaggcggattctctgtgtggattggacataagaagggggccacaaaaatgaaggatctagctcgcttcaagcctatgcagagacatctgtttctgtacgagaaagcaatcgtgttctgtaaacggcgtgtggaaagcggcgagggcagtgatcggtacccttcctactctttcaagcactgttggaaaatggatgaggtgggaattactgagtatgtgaagggggacaaccggaaattcgagatatggtatggagaaaaggaggaggtttatatcgtacaggcttctaatgtcgatgtgaaaatgacttggttgaaagaaattcggaacattttgctgaaacagcaggagctgctgacagttaaaaaaaggaaacaacaggaccagcttactgagagggataagtttcaaatttctcttcagcagaacgacgaaaagcaacaaggggcttttatctcaacagaggaaaccgaactagagcatacctcgacggtggtggaagtctgcgaggccattgcttccgtgcaggcagaagcaaacactgtctggaccgaggcatctcagagcgctgagatctccgaggagcccgccgagtggagtagcaactacttctatcccacttacgatgagaacgaggaggaaaaccggccactgatgagacccgttagtgagatggccttgctctactag

SEQ ID NO: 123561 - DNA, 2958 bp, Artificial Sequence
  Description of Artificial Sequence: Synthetic coding sequence
atgcaggacattgcgtttttaagtggtggtcgaggcaaggataatgcttggatcattacgttccccgagaactgcaattttaggtgcataccggaagaagtgatagctaaagttcttacttatttaacgagcatcgctagacagaatggaagcgactcgagattcacaatcattttggacaggcgtttggacacatggagctctttgaagatttcacttcaaaagatttcggcgtccttccctggaaatttgcacctcgtgctagtattgcgcccgacttcgttcctccagcgaacgttcaccgatattggtttttggtttagtcaagaggacttcatgcttaagctgcccgtagttatgctgtccagcgtctctgatttacttacctacatcgatgataagcagctgacccctgaactgggaggcactcttcagtattgccactctgaatggattatctttagaaacgctatcgaaaactttgcactcacagtcaaggagatggcccagatgctccagtccttcggaaccgagcttgcagagaccgaactacctgatgacatcccatccatcgaggagatccttgccatcagggcagaaagatatcacttgctcaagaatgacattaccgccgtcacaaaagaaggaaagattcttttaaccaacttagaagtgccagatactgagggcgcagtaagctcaagactggagtgtcataggcaaattagcggagactggcaaaccataaataagcttcttacccaggtgcatgatatggaaacagcctttgatggattctgggaaaagcatcaattgaaaatggagcagtatctccagctgtggaaatttgagcaggactttcaacagctcgttacggaggtggaatttctcctcaatcagcaggctgagctcgcagacgttacaggcacaatagcccaagtcaagcaaaagattaagaaactcgagaatctcgatgagaacagtcaggagctccttagcaaggcgcaatttgtgatccttcacggacataagcttgcagctaaccaccactacgctttggacttgatctgccagaggtgcaatgagctgcgctacctatcagatatcctggtgaacgaaattaaagccaagagaattcagctgagcagaaccttcaagatgcataaactgctgcagcaagcaagacagtgttgtgacgaaggagagtgcctgctggccaaccaggaaattgataagttccagagcaaagaggacgcgcaaaaggctttgcaggacatcgagaacttcctagagatggccctgccatttatcaactacgagcccgagacactgcaatatgagtttgacgtgatactctcccctgagctgaaagttcagatgaagaccattcaattgaagttagagaacatccgctctatctttgagaaccagcaggctgggttcaggaacctggcagataagcacgtgagaccaattcagttcgtcgtgcctaccccagagaatctcgtgacatccgggaccccctttttttcctcgaagcagggaaagaagacctggcgacagaatcagtctaacttgaagatagaagtggttcctgactgccaggaaaagcgatcaagtgggccgagctcctccctggataacggcaactctcttgacgttctgaagaatcacgttcttaatgagctgatccagaccgaacgggtctatgtacgggagctctacactgtgttgctgggataccgagcagaaatggataatcctgaaatgttcgatcttatgcctccactgctgcgcaataagaaagacatcctgttcgggaacatggcggagatttacgaatttcataacgacatttttctgtccagcttggagaactgtgctcatgcccctgagcgggtggggccgtgtttcctggagcgtaaggacgattttcagatgtatgcaaagtattgtcagaataagccaagatccgaaaccatctggaggaagtattccgagtgcgcattttttcaggaatgtcagagaaaactgaagcatagacttcgtttagatagttacctgctcaagcccgtccagaggatcactaaataccagctgttactgaaggagttgttaaagtattctaaggactgtgaggggtctgcgctgctcaagaaagctcttgatgctatgctcgatctgctaaagtccgtcaatgattccatgcatcaaatagccattaacggctacatagggaacctgaacgagctcgggaaaatgattatgcaaggggggttttcggtgtggatcggacacaaaaaaggggctacaaagatgaaggatctggcccggttcaagccaatgcagaggcatctatttttatacgagaaggctattgtcttttgcaagaggcgggttgagtctggcgaaggctccgacaggtaccctagttactcttttaagcattgttggaagatggatgaagtggggataaccgagtatgtcaagggtgacaacagaaaattcgaaatctggtatggagaaaaggaggaagtgtacatcgtgcaagcatctaacgttgatgtgaagatgacctggctgaaggaaattcgaaacatactgctgaaacaacaagaactcctcaccgtgaagaaaagaaaacagcaggatcagctaaccgagagagataagtttcagataagcctgcagcagaacgacgaaaaacaacagggcgctttcattagtaccgaagaaactgagttggagcatacctcgaccgtggtagaagtttgtgaggcaatagcaagcgtgcaagccgaagccaataccgtgtggaccgaggcttcacagtccgccgaaattagtgaagagccagccgagtggagttctaattatttctatccaacctacgatgagaatgaagaggaaaatcgccccttgatgagacccgtgagcgagatggcactgctatattag

SEQ ID NO: 123562 - DNA, 1290 bp, Artificial Sequence
  Description of Artificial Sequence: Synthetic coding sequence
tagcacgtgctcaacgaattgattcagacagaacgggtgtacgtccgagaactgtataccgtgctcttgggctatcgcgctgaaatggacaacccagagatgttcgacctcatgccaccactgctgcggaataagaaggatattttgttcggtaatatggccgaaatctatgaattccacaacgacattttcctttcctcccttgaaaactgcgctcatgccccagagagggttggaccttgtttcttggagagaaaggacgacttccagatgtacgcaaaatattgccaaaataaaccaagatcagagactatctggcggaagtactccgaatgcgcgtttttccaagagtgccaaagaaagttgaaacatcgactcaggctggacagttacctattaaagcccgtgcagcgcattaccaagtaccagctgctcctgaaagaactgttgaagtactccaaggattgtgaaggcagcgccctgctgaaaaaggccttggacgctatgctcgacttgctgaaatccgtgaatgattccatgcatcaaattgctatcaacggctacatcggcaacctgaatgagctcggtaaaatgattatgcagggcggattcagtgtttggattggtcataagaaaggcgccaccaagatgaaagatctcgcacggtttaagcctatgcaaagacatttattcctgtacgaaaaggctatcgttttttgcaagagacgggttgaatccggggagggatccgatcgttatccttcctacagcttcaaacattgctggaagatggacgaagtgggcatcactgaatacgtaaagggcgacaaccgaaaatttgagatctggtatggagaaaaagaggaagtgtatatcgtccaagctagtaatgtcgacgtgaaaatgacctggttaaaagagattcgcaacattctgctgaagcagcaggaattgctcactgttaaaaaaaggaagcaacaagaccagctcacagagcgagacaaatttcagatcagtttgcagcaaaacgatgagaagcagcagggcgcgttcatttctactgaggaaacagaactcgaacacacctcaactgtggtcgaggtttgtgaggctattgcttctgtccaggctgaggcaaataccgtctggacagaagcgagtcagtcagccgaaatttctgaagaacccgctgagtggagttctaattatttttatcccacctatgatgagaatgaagaggaaaaccgacctttgatgcggcctgtttcagagatggctctgctctattag

SEQ ID NO: 123563 - DNA, 1587 bp, Artificial Sequence
  Description of Artificial Sequence: Synthetic coding sequence
gtgcagatgaagaccatccagctgaagctggagaatatcagaagcatcttcgaaaatcagcaagcgggcttcaggaatcttgcagacaaacacgtcaggccaatacagttcgtcgttccaaccccggaaaacctcgtgacgtctgggacccccttctttagtagcaaacaggggaagaaaacatggcggcagaatcagagcaatctgaagatcgaggtggtaccggattgtcaagagaagcgatcttccggccccagcagtagtctcgataacggcaactccctcgatgtgctgaaaaatcatgttctgaacgagttgatccagacagagcgggtttacgtcagggaattgtacaccgtgctgctgggctaccgtgcggaaatggacaaccctgagatgttcgatctgatgccaccgttgcttcgcaacaagaaagacatcctcttcggaaatatggccgaaatctatgaatttcataacgacatttttctgagcagcctagaaaattgtgctcacgctccagagagagtgggcccgtgtttcctcgaacgcaaggacgattttcagatgtatgctaaatactgtcaaaacaagccgcgcagcgaaactatttggcgaaaatactcagagtgtgcattcttccaggagtgtcagcggaaattgaagcacagattgcggctggactcttacttgctgaagccggtgcagcgaattacaaagtaccagctgttactgaaggaactcctgaaatactccaaggactgcgaaggatcagctctgctcaaaaaagccctagatgccatgctggacctactgaagtccgttaatgattctatgcaccagatcgcgatcaacggatacatcggaaatctgaatgaactgggcaagatgatcatgcagggaggctttagtgtttggatcggacacaaaaagggcgctacgaaaatgaaggaccttgccaggtttaagccaatgcagcgccatctgtttctttacgaaaaagccatcgtcttttgtaagaggcgtgtagagagtggggaaggctcagaccggtatccaagttattcgttcaagcattgttggaagatggacgaagtgggtatcaccgaatacgtaaagggcgataatcggaaattcgagatctggtacggagaaaaggaagaggtgtatatagtgcaggccagcaacgtggatgtcaaaatgacctggttgaaggaaataaggaatatccttctgaagcaacaggagctactgacagtgaagaagaggaagcaacaggaccagctgactgaaagagataagtttcaaatttctctgcagcagaacgatgagaagcagcagggtgcattcatttcaaccgaggaaactgagttggaacacaccagtaccgtcgtggaggtatgcgaggctattgcttcagttcaggcagaagctaacactgtctggacagaggcaagccagagcgccgagataagcgaggagcccgcagaatggagctcaaattacttttatcccacgtacgatgaaaatgaggaggaaaatcgacctctgatgaggccagttagcgagatggcccttctgtactag

SEQ ID NO: 123564 - DNA, 3006 bp, Artificial Sequence
  Description of Artificial Sequence: Synthetic coding sequence
atgcaggatattgcctttcttagcggagggcgcggaaaggacaatgcgtggattattaccttccccgaaaactgtaacttcaggtgcatccctgaagaggtgattgctaaggtgctgacctacttaaccagcatcgcgagacagaatgggtccgattcaaggttcacgatcatattggatcgtagactagacacgtggtcctctctaaagatatcgctgcagaagatcagcgcctcgttcccgggtaacctgcatctggtgctggtgctccgtccaacgtcctttctccagagaaccttcacagacatcggcttttggttcagtcaggaagattttatgcttaaacttcccgttgtcatgttatcatctgtgtctgatctgttgacttacatagatgacaaacagctcacccccgaactgggtggcaccctgcagtattgccatagtgaatggattatttttagaaacgccattgagaacttcgcacttacagtcaaagaaatggcccagatgcttcagtctttcggcacagagctagcagaaacagagctacccgatgacattccaagcattgaagagattcttgcgatcagagccgaaaggtaccacctgctaaagaatgatataactgcggtaactaaggaaggtaagatcctgctgactaatttagaggttcctgatacagagggcgcggtgagttctcgccttgaatgtcataggcaaatcagcggggattggcagaccatcaacaaactgttgacacaagtacacgacatggagacagcttttgatgggttttgggagaagcaccagctcaaaatggagcagtacctccagctatggaagttcgaacaggattttcagcagctggtgacagaagtggagtttctcctgaatcaacaggccgagctggcggacgtaacgggaactatcgctcaggtcaagcagaagatcaagaaactggaaaaccttgacgagaatagccaggagttactgagcaaggcacagtttgtgattctgcacgggcacaaactggcggctaaccatcattacgccctcgacctgatttgccagcgctgtaacgaattacgttacctgagcgacattctggttaatgagatcaaagccaagagaatccagcttagcagaaccttcaagatgcacaagctcctgcagcaggcgaggcaatgctgtgatgagggggagtgtttgcttgccaaccaagagatcgacaagtttcagtccaaggaggacgcgcaaaaagctttgcaggacattgagaattttcttgagatggccctaccctttatcaattatgagcccgagaccctgcagtacgaattcgatgtgatcttgtctccagagctgaaggtgcagatgaaaacaatccagctgaaattagagaatatcagaagcatttttgagaatcaacaggccgggttccgtaaccttgccgacaaacacgtgaggcccattcaatttgtagtacctacacccgagaatcttgtgacttctggtaccccattcttcagttccaaacaggtgggcgttggatactctttcttccaggcatgcaagttgttctcaaaaggcaaaaagacatggcgccaaaatcagtctaacctgaagatagaggtcgtccctgattgtcaggagaagaggtccagcggcccatctagctccctggacaacggcaattctctggacgtgctcaaaaaccatgttttaaacgagctaattcagactgaaagggtttacgttcgggaactgtataccgttttactcggttaccgtgcagagatggataacccagaaatgttcgatttgatgccgcctctgctgaggaacaagaaggacatcctctttgggaatatggccgaaatctatgagttccataatgacatttttctgtcatctctggagaactgcgcccatgcaccagaacgagtgggaccatgttttttagagcggaaggatgattttcaaatgtatgccaagtattgtcagaacaaaccccgtagcgagaccatttggagaaaatactcagaatgcgccttttttcaggagtgccagaggaaactcaagcaccgcctcagactggatagttacctcctcaaacctgtgcagcggatcaccaagtaccagctgctgctgaaagaattactgaaatactctaaggattgcgaggggagtgcccttctcaagaaagctctggacgcgatgctggacttgttgaagtctgttaacgactccatgcatcagatagcaatcaacggatatatcggaaacctaaacgagttgggcaagatgatcatgcagggcggcttctcagtgtggattggacataagaaaggcgctactaaaatgaaagacctcgctaggtttaagcctatgcagcggcacctattcctgtatgagaaagccatagtgttttgtaagaggcgagtggagtctggagaaggttcagaccgctacccaagctactcctttaagcactgctggaagatggatgaagtgggcatcactgagtacgttaagggcgacaataggaaatttgagatttggtatggcgaaaaagaagaagtgtatatcgtgcaggcaagcaacgttgatgtgaagatgacgtggcttaaggagatccggaacatactgttgaaacagcaggaactgctgaccgtgaaaaagcggaagcagcaggatcagctgacggaacgcgataaatttcaaatctcactgcaacaaaatgacgagaagcaacagggggcattcataagcaccgaagagacggagctggagcacactagcacagtggtggaggtttgcgaggctatcgcatctgtgcaggcagaggcaaatacagtctggacagaggcctcccagtctgctgagattagcgaagagccagcggaatggtcgagcaattatttctaccctacatatgatgaaaacgaagaagagaatcgaccactcatgaggcctgtcagtgagatggccttactctactag

SEQ ID NO: 123565 - DNA, 2958 bp, Artificial Sequence
  Description of Artificial Sequence: Synthetic coding sequence
atgcaggatattgcatttctctccgggggcaggggtaaggataatgcctggataattacattccccgaaaattgtaactttcgctgtatccccgaggaagtgattgccaaagtgctgacttacttgacctctatcgccagacagaatggcagcgactctaggtttaccatcatactggatcgacgcctcgatacctggagctccctcaagattagccttcagaaaatcagcgcgtccttccccgggaatctgcatctggtgctcgttttgagacctacgtcatttctacaaagaacattcactgacatcgggttctggttctctcaggaagacttcatgctcaagctgccagtggtaatgctttcctccgtgtcggatttgcttacttacatcgatgataaacaactaacaccagaactgggcggaacgcttcagtactgccatagcgagtggattatatttcgcaacgctatcgagaacttcgcgctaacagtcaaggaaatggctcagatgctgcagagcttcggaaccgaactagccgaaacagaacttcccgatgacataccaagcatcgaagagatcctagctatccgggccgagcgataccacttactaaaaaatgatattaccgctgtcacaaaggaaggcaaaattctcttgactaaccttgaggttccagacactgagggagccgtgagctccagactggaatgtcacagacagatatctggcgactggcagactattaacaagctcctcactcaggtccacgacatggagaccgctttcgacggcttttgggagaagcaccaacttaagatggaacagtacctccaactctggaaattcgagcaggatttccagcaactggtgacagaggtggaatttctgttgaaccagcaggcagagctggcggacgtgaccgggactatcgcacaagtgaagcagaaaataaaaaagcttgaaaaccttgatgaaaattcgcaggagctcctttctaaagcgcagtttgtgatcctgcacgggcataagctggctgccaatcatcattatgctttagaccttatatgccagagatgcaatgagttgagatatctatccgacatcctggtaaacgagataaaggccaagaggatccagctgagcaggacatttaaaatgcacaagctccttcagcaggcccgacagtgctgcgacgagggagaatgtctgttagctaaccaggaaatcgataagttccagtctaaggaagacgctcaaaaggccctgcaggacatcgagaactttttagagatggcgttgccttttatcaattacgagcctgagacattgcagtacgagtttgacgtaatcctcagccctgaattgaaggtgcagatgaagactattcaattaaagctggagaacatccgttccatctttgagaaccaacaggccggctttagaaatctcgccgacaaacacgttagacccatccaattcgtggtacccacccccgagaaccttgtaaccagtggaacaccctttttttcaagcaagcaggggaagaaaacctggcgccaaaaccaaagcaatctgaagatagaagtggttccagactgccaggagaagaggagtagtggcccttcatccagcttggacaatgggaatagcttggatgtcctcaaaaatcatgtgttaaatgagctgatccaaactgagcgagtgtatgtgagggaactctatacagtgctgttggggtacagagctgagatggacaatcccgagatgttcgatcttatgcccccactactgcggaacaagaaagacattctttttgggaatatggcagagatctacgaattccacaacgacattttcttgagctccctcgaaaactgcgcacatgctcctgagagggtcggcccctgtttcctggagagaaaggacgattttcagatgtatgcaaaatattgtcagaacaaaccccgctccgagactatctggcggaagtactcggagtgtgcattctttcaggagtgtcaacgcaaactgaagcaccggttgcgtctggactcatatctgctgaaacccgtccagcggattacgaaatatcagttattgctgaaggaactgctgaaatactccaaggattgtgagggaagcgctcttcttaaaaaggccctggacgccatgctggacctgctgaagtccgtcaatgattctatgcaccagatcgctatcaacgggtatatcggcaacctgaatgagcttggcaaaatgatcatgcaggggggattctcagtgtggattggacacaaaaagggagccaccaagatgaaggatctggctagattcaaacctatgcagaggcatctatttctctatgagaaagccatcgtcttttgcaagcggcgcgtggaatctggtgagggcagcgacaggtacccgtcctattccttcaaacattgctggaaaatggacgaggtgggtattactgaatacgtaaagggcgacaacagaaagttcgaaatctggtatggggagaaggaggaggtttatatcgtccaggcctcgaatgtggacgttaagatgacttggctcaaggaaataaggaatattctgcttaagcagcaggagctgctcacagtcaagaaaaggaagcagcaagatcagcttacggagagagacaagtttcaaatttcactacagcagaacgatgagaagcagcagggagcttttatcagcaccgaggagaccgagcttgagcacacatccacagtggtagaagtctgcgaggccatcgccagtgtgcaggcagaggccaataccgtgtggactgaggcctctcagagcgccgagatcagcgaggagcccgctgaatggtcctctaactacttttatccgacatacgacgagaacgaagaagaaaatcgaccactcatgagacccgtctccgagatggctttattgtattag

SEQ ID NO: 123566 - DNA, 2466 bp, Artificial Sequence
  Description of Artificial Sequence: Synthetic coding sequence
atggcagaggctaaccctaggcggggcaaaatgaggttccggcgtaacgccgcctccttcccaggcaacctacacctggtcctagtgttgagaccgacctcatttcttcagcgcacctttacagatatcggcttttggttttctcaggaagactttatgctgaagctccctgcaattgaaaatttcgccttgacagttaaagagatggcacagatgctccaatcattcggtactgaacttgccgagaccgagctgcccgacgacattccatcaatagaggaaattttggcgatccgggccgaacggtaccatcttctcaaaaatgatattacggcagtgaccaaagagggcaaaattctgctgactaacctagaagtgcctgacacagagggcgccgtgtcatcgcgtctggaatgccatcgtcagatcagcggcgattggcagaccattaacaagctcctcactcaggtccatgacatggagaccgcattcgatgggttctgggaaaaacaccagctcaagatggaacagtacctgcaactctggaagtttgaacaggacttccaacagctagttactgaggtcgaatttctgctcaaccagcaagccgagttggcagacgtaacgggaaccatagcccaggtcaagcagaagattaagaagctagaaaatctagacgaaaactctcaggagctcctgagcaaggcccagtttgtaattctacatgggcataaactggctgccaatcatcactacgcgcttgaccttatctgccaaaggtgcaatgagctcaggtacttatcagacattctggtgaacgagattaaagcgaaacgaatccagttgagcagaacctttaaaatgcataaacttctgcagcaagcccgacagtgctgtgatgaaggggagtgcctgctggctaaccaggagatcgacaagtttcagagtaaggaggatgcccaaaaggctttgcaagatatcgagaattttctggagatggcacttccattcatcaactatgagcccgagacactacagtacgaattcgatgttatcctgtcccccgagctgaaggtgcaaatgaagaccatacagctgaaattggagaacatccggagcatttttgagaaccagcaagccggctttcgcaacctcgcagataaacatgtgcgcccaattcagttcgttgttcccacaccggagaaccttgtaacctcaggtaccccatttttttctagcaagcaggggaagaagacttggaggcagaatcagagtaacctgaaaattgaggtggtgcccgactgccaggagaaacgatcttctggtccttctagcagtctggataacggcaactcactggacgtcctaaagaaccacgtcctgaatgagcttattcagaccgagcgcgtatatgtccgcgagttgtatactgtcttgcttggctatagggccgagatggataaccctgagatgtttgatctcatgcctccacttctgcgaaataaaaaagacatcctctttggtaatatggcagagatctacgagtttcataacgacattttcctttccagtctggagaattgtgcgcatgcacccgaaagagtgggcccttgctttttggagaggaaggacgactttcagatgtatgctaagtattgccagaataaaccaaggagtgaaactatttggcgaaaatattcagaatgcgcgttctttcaagagtgtcagaggaaacttaagcatcgtctgagacttgatagctacttgctcaaacctgtccagcgcattacgaaatatcagctgctgcttaaggaactgctgaaatatagtaaagactgcgagggctccgcactcctcaaaaaggcacttgacgcaatgctagacctgctcaagtccgtgaacgactctatgcaccagattgctatcaacggatatatcggcaacctgaacgaacttgggaagatgatcatgcagggaggcttctctgtttggattggccataaaaagggagcaacaaagatgaaagatctcgcccgatttaagcctatgcagcggcatctgttcctgtatgaaaaggctatcgtcttctgtaagcggagggtggagtctggagaggggagcgacaggtacccgtcatatagctttaaacattgctggaagatggacgaggtgggtatcacagagtatgtgaagggtgataatcgcaaattcgaaatctggtatggagaaaaagaggaagtctacatcgtgcaggccagtaacgtcgacgtcaaaatgacctggctgaaagagatccgtaacatcctccttaagcagcaggaacttctgacagtgaagaaacgcaagcagcaggatcaactgacagaaagagacaagttccagatttccctgcagcagaatgatgaagatttgtgtcgacgttggctctcatatatagatgaggctaccatgagtaacggcaagtag

SEQ ID NO: 123567 - DNA, 2955 bp, Artificial Sequence
  Description of Artificial Sequence: Synthetic coding sequence
atgaccgtgcgcagattgtctctgctctgtcgcgacctttgggcattatggctgcttctgaaagctggggcagatgagatcatgcaccaagacatagtccccttgtgtgcagcagatatccaggatcagctcaagaagagattcgcttatctaagcggtggacgaggacaggatggttccccggtgatcacattcccagattaccctgccttctctgaaatccccgataaagagtttcagaacgtcatgacctacctcacctcaataccgagcttacaggatgccggtattggctttattctggttatcgaccgccggagggataagtggacatctgtgaaggcttctgtgctcaggattgctgccagttttcccgctaatcttcagttagtcctggtcttgcgtcctaccgggttttttcaacgcactcttagtgacattgcctttaaatttaatcgcgatgatttcaaaatgaaggtcccagtgatcatgctgtctagcgttcccgatctgcacgggtacatcgataaatcgcaacttactgaggacctgggcgggacgctggattattgtcacagtcgatggttgtgccagcgaaccgccatcgaatcattcgctttgatggttaaacagactgctcagatgctgcagagcttcggtactgagctggctgagactgagctccctaacgacgtgcaatcgactagctctgtgctgtgcgcacacacagaaaaaaaagataaggccaaagaagacctcagactcgccctgaaagagggtcatagtgtgctggaatctcttagggaactccaggctgagggctcagagccttctgtcaaccaggaccaattggacaatcaggcaacggtacagaggttgcttgctcagctcaatgagacagaggctgctttcgacgagttctgggcgaaacatcaacaaaagttagagcaatgcctacagctgcgacactttgagcaagggtttcgcgaggttaaagccatcctagacgcggcatcacagaagatcgctaccttcaccgatatcggcaattctctggcccacgtggaacacctgctcagggacctggcttcttttgaggaaaagtccggcgttgccgtggagcgcgcccgggccctgtccttagatggggaacaactgatcggcaacaagcattatgcagttgattccattcgacctaagtgccaagagctcaggcacctttgcgaccagttttcagccgaaatcgccaggaggagaggattattatccaaaagcttagaactgcataggcgcctggagacctccatgaaatggtgcgacgaagggatctatctgctggcctcccaacccgtggacaagtgtcagtcccaggacggcgctgaagcggctctccaggagattgagaagttcttagaaaccggtgcagagaacaagatccaggagctgaatgcgatttataaggagtatgaaagcatcctcaatcaggaccttatggaacacgtgcgaaaggtctttcagaaacaggcatcaatggaggaagtttttcaccgtcgacaggcttctttgaaaaagctagcagccagacagacacggcccgttcaacctgtagccccaagacctgaggctttggccaagtcaccatgtcctagtcccgggatacggcgggggagcgagaactcctcatcagagggaggggccctgcgaagagggccctacagaagggcaaagtctgagatgtctgaaagtaggcagggcagagggtccgccggagaggaagaggagtcactggctatcctaagacgccacgtcatgtctgagctgctggataccgaacgagcatatgttgaggaactgctgtgcgtgctcgaaggctacgccgctgagatggataatccgttaatggcccacttgctgagcaccggccttcacaacaagaaggatgtactatttgggaatatggaagaaatctatcactttcacaacaggatctttttgcgtgaactggaaaactacaccgactgccccgagctggtcggacgatgcttcctggaaaggatggaagattttcagatctacgaaaaatactgccagaataagcctcgctctgaaagcttgtggagacagtgctctgattgtccattctttcaggagtgtcaaagaaaacttgatcacaagcttagtctggattcttaccttttgaagcctgttcaaagaattacgaaatatcagctgcttctcaaagagatgctcaaatattctcggaattgtgagggcgcagaggacctgcaagaggccttgagcagcattcttggcatcctgaaagctgtgaatgactcaatgcatcttattgccattaccggatacgacggtaacctgggcgacctcggtaaactattgatgcaaggtagcttcagcgtgtggaccgatcacaaacggggtcataccaaagtgaaggaactggcgcgattcaaaccaatgcagagacatctgttcctgcatgaaaaagcagtgctcttctgtaagaaaagggaggagaatggtgagggctatgaaaaagccccgagttattcctacaaacaatcgctcaacatggccgctgtcggaattacagaaaatgttaaaggtgatgctaaaaaattcgagatctggtacaatgctagagaggaggtgtacatcgtccaggcacctactcctgagattaaggctgcctgggtcaatgaaatcaggaaagtccttacttctcagctccaggcttgcagggaggcctctcagcaccgtgctctcgagcagagccagagtctaccgttacccgcacccaccagcacgagccccagccgcggcaacagtcgcaacattaaaaagctggaagaaaggaaaacagaccccttgtctctggaaggttatgtgtccagtgccccgctgactaagccaccggaaaaaggcaaagaaccctag

SEQ ID NO: 123568 - DNA, 3390 bp, Artificial Sequence
  Description of Artificial Sequence: Synthetic coding sequence
atggccgaaaaaggcgcatcacggggcactctgagaagactttggtcactgcccagaaggcgacgagggaccgccggccggtcccgcccagatgagattatgcaccaggacattgtccctttgtgtgctgccgacatccaggatcagctgaagaagcggtttgcctacctgtccggcggacgagggcaggacggttcccccgtaataacgttccccgattacccagccttctcagagatccctgacaaagagtttcagaacgtaatgacgtacctgactagcataccttccctgcaggatgctggcatcggtttcattttggtgatcgacaggcgcagagataaatggaccagcgtgaaagccagcgttctgcggatcgccgctagtttccctgctaaccttcaactagtgctagtgctgcgacctacaggtttttttcagcgaaccctgtccgatattgcctttaagtttaatagagatgatttcaaaatgaaagtccctgtcatcatgctctccagcgtgcctgacttacatgggtacatcgataaatcacaactgacggaggacctcggaggcactctggattactgccatagccgatggctgtgccagaggacagctattgaatcgtttgccctcatggtcaagcaaacagcccaaatgttacagtctttcggaacagagctggctgagaccgaattgccaaacgatgtgcagagcacaagttcagttttgtgcgctcataccgagaagaaggacaaggccaaggaggacctcaggctggctctgaaagaaggtcacagcgtacttgaatcactgagggaattacaggccgagggtagtgaaccgtccgtaaatcaggatcagttggataaccaagccactgtccaacgactcctcgctcagttaaatgagacagaagcggcattcgacgaattctgggcgaaacatcagcagaagttggagcagtgcctgcagcttcgccacttcgagcaagggttccgcgaagttaaggctattcttgacgccgcttcccaaaagattgctactttcacagatatcggcaacagcctggcgcacgtggaacacctgttaagagacctggcttctttcgaagaaaagagtggagtcgctgtagaacgcgccagggcactctcactcgacggagagcagctgataggcaacaagcactacgctgtggacagcatccgtccgaagtgtcaggaactaaggcacttatgtgatcagttctctgccgagatcgcaaggaggagagggctgctgtccaagtcactggagcttcataggaggctggaaactagtatgaagtggtgcgacgagggaatctacctgctcgcttcccagcctgtggacaagtgtcagtctcaggacggggccgaggctgcccttcaggaaatcgagaagttcctggagacaggcgccgaaaataaaattcaggagctgaacgccatctataaggagtacgaatccatcttaaatcaggacctgatggagcacgtgcgtaaagtctttcagaaacaggcttcaatggaggaagtatttcacagaagacaagcatcattgaagaaattagccgcccgacagactcgcccagtgcaaccggtggcgcccagacccgaggccttggctaagagtccatgccctagcccaggtatccgccggggatccgaaaactctagcagcgaaggaggggctttaaggagggggccttacaggagagccaagtctgaaatgtctgagtcaagacaaggcagaggctcggcaggggaagaagaggaatcactcgcgattcttcgaagacatgtgatgagtgagctgctagacacagaaagagcttacgtggaagagcttctgtgtgttcttgaggggtacgcggccgagatggataatccccttatggctcatctgctgtccaccggtctgcataataaaaaagacgtgctgttcggcaatatggaggaaatttatcatttccacaacaggatctttttgcgagagctggaaaattatacagattgtccggagctggttggccgttgcttcctggagcgcatggaggacttccagatctatgagaaatactgtcagaataaacccagatccgaaagtctgtggaggcagtgctctgactgcccatttttccaggagtgccagcgcaagctggatcataaattgagcctggactcatatctgctgaaacctgttcaacgtatcacaaagtaccagttgctactaaaagagatgctgaaatattcaagaaactgtgagggtgctgaagaccttcaagaagctcttagttctatactgggaatcctgaaggccgtgaatgactccatgcatctgattgctatcaccggctacgacggcaatctgggagacttggggaagctgttgatgcaaggtagtttctctgtttggactgaccataagcgaggacacaccaaagtcaaggagttggctcgtttcaagccaatgcaaagacacctgttcctccacgaaaaagccgtgttattctgcaagaaacgagaagaaaacggagaaggttacgaaaaagcacccagttacagttacaaacaatcacttaatatggctgctgtcggcatcaccgagaatgttaaaggggatgctaagaaattcgagatatggtataacgccagggaagaggtgtatatagtgcaagctcccacaccagagatcaaggctgcctgggtcaatgaaatacgcaaggtgctgacaagccagctccaggcctgccgcgaagcctcccagcatagggccctggaacagagccagagcctgccattgcccgcgcctaccagcacatctcccagccgtggaaacagcaggaacattaaaaaactcgaagaacggaaaactgaccctctcagcctcgagggctatgtaagcagcgccccactgaccaagcctcctgaaaagggcaaaggatggagcaagacttcccatagcctggaagcacctgaagatgatggcggctggtctagcgcagaggaacagattaactcttcagacgccgaagaggatggaggattgggaccgaagaagttagtacctgggaaatacaccgttgtggcggaccatgaaaaaggcggccctgatgcattgagggtgcgctctggcgacgttgtggaattggttcaggaaggcgacgagggcttgtggtacgtcagggacccgaccaccggaaaggaaggatgggtccctgcttcttctcttagcgtgaggcttggtccctcaggaagcgctcagtgtctctcctctagtgaatcatctcctggatccgcagtgcttagtaacagctcatcctgcagcgaagggggtcaggccccattcagcgacttgcagggttag

SEQ ID NO: 123569 - DNA, 3549 bp, Artificial Sequence
  Description of Artificial Sequence: Synthetic coding sequence
atggccagagttgagtcacccgtccccgcggccagagccagcctcacgggtagttgtgtgctgggacaggctatgcctctaaggggcggcgccggccctagccctgcctctcacggcccaacccacggcccctccgatcccaggacctgcctgcccggacggggtgctgggggcatgcggccacacggccggggcgcactaggctgctgtggcctgtgctccttttatacatgccacggtgcagctggggatgaaattatgcaccaggatattgttcctctttgcgccgctgatattcaggatcaactgaagaaacgttttgcttatctctcaggagggagaggacaggatggaagtcccgtgataacctttcccgattatccagctttttctgagatccctgacaaggagtttcagaacgtgatgacttatctcaccagtattccgtccctgcaagacgcaggtattggattcattttggtaattgataggcggagagataagtggacaagtgttaaagcatcagtattgcggatcgccgcaagctttcccgctaacctgcagcttgtacttgttctccgccccacgggctttttccaacgcaccttgagtgacatcgcttttaagttcaacagggatgatttcaagatgaaagtccccgtgatcatgctttcctcggttcctgacctccacggatacattgataagtcgcagcttacggaggacctgggggggactctggactattgtcattcccggtggctgtgtcagagaacagctattgaatccttcgctctgatggtgaaacagactgcccagatgctgcagagctttgggaccgagctggccgagacggagctccccaacgacgtgcaaagcaccagcagcgtattgtgtgcccacacagaaaagaaagacaaggccaaagaagatctgcgactcgccttaaaagaggggcactccgtcctcgaatccttaagggaactgcaagccgagggcagtgagccctcagtgaatcaagaccagctggataatcaagcgactgttcaaagactcctcgcccaacttaacgaaactgaagctgcatttgatgagttttgggcaaaacaccagcagaaactggaacaatgcctccagctgcggcatttcgaacaaggtttcagggaagttaaagccatcctggatgccgcgagtcagaaaatagctacattcacggatatcgggaattctctggcacacgtggaacatctgctgcgcgatctggcctcatttgaagagaaaagtggggtggccgtggaaagggcacgggccctgagtctagatggggaacaactgatcgggaacaaacactatgcggtggattcaattaggcctaaatgtcaggaacttaggcacctttgtgaccagttctccgccgaaattgctagacggcgtgggctcctatcaaagtcactggagttgcatcgacgcctggaaactagcatgaaatggtgtgacgaagggatatacctgctggcaagtcaaccagtggataagtgtcaaagccaggacggggcagaagccgcactgcaagagatagaaaagtttctggaaacaggcgcggagaacaaaatccaggagctgaatgctatatacaaggagtatgaatctattctcaaccaggatctgatggagcatgttcgaaaggtatttcagaagcaggcatctatggaggaggtgtttcaccgtagacaggcctcgctcaaaaaactcgccgcgcgccagacccggccagtgcagcccgtggccccccggcctgaggctctggcaaagagtccttgcccttctcccggcatccgccgaggttccgagaactccagcagtgagggaggggcactccgcagagggccttataggcgagctaagagcgagatgtccgagtcccgacagggccggggctcagccggggaagaagaagaaagcttagcgatactgcgacgccacgtaatgtcggagttgctggataccgagcgggcatacgtggaggaactcctttgtgtactggagggctatgctgccgagatggataatcctcttatggcccacctgctgagtaccggactccataataagaaggacgttctgtttggcaatatggaggaaatttaccactttcataatcgtatcttcctccgagagttggagaactacacagattgtccggagcttgtggggcgctgtttcctggaacggatggaggactttcaaatctatgagaaatactgccagaacaagcctaggtcagaatcactgtggagacaatgtagcgattgcccgttctttcaagagtgtcagcggaagctggaccacaaactgagcctagatagttacttactgaagccagtgcaacgcattacgaagtatcagcttctacttaaagagatgcttaagtattcacggaattgcgaaggagccgaagacttgcaggaggcactctcttcgattctgggcattctgaaagccgtcaacgactctatgcacctcatcgctatcacaggatacgatggaaacctgggagatctaggcaagttactgatgcaaggatcattcagtgtgtggaccgaccataaacggggacacactaaggtgaaagagcttgcaagatttaagcccatgcagaggcatctgttcctgcacgagaaagccgtcctgttctgcaagaagcgcgaagagaacggggagggctacgagaaagcgccctcctatagctataagcagtcactcaacatggccgccgtcgggatcactgaaaatgtaaagggagacgcaaagaagtttgaaatctggtataacgcaagggaggaagtctacattgtccaggctcccacaccagagataaaggccgcatgggttaatgagattcgcaaggtgttaacatctcagttacaggcctgcagagaggcatcccaacatagggcactggagcaatcccagtctctgcccttacctgcgccaactagcacctccccatcacggggcaactccagaaacatcaagaaactggaggaaagaaagaccgaccccctttccttggaaggctatgtttcttccgccccacttactaaacccccagagaagggaaaagggtggagcaagacgagtcactccctcgaggcgccagaggatgacggcggctggtcctccgcagaggagcagattaactcttcagatgctgaggaagatggggggctgggacctaagaagctggtgcctggaaaatacactgtagtagctgatcatgagaaaggtgggccagatgccttgcgagtccgttcaggcgacgtagtggagctggttcaagagggggatgaagggctctggtacgtcagggaccctacaaccggcaaagaaggctgggtccctgcatcttccttatcagtgcgtctgggaccctccggctccgcccagtgcctgtcctcttctgagtcctctccggggagcgccgtccttagtaattcttccagctgtagcgagggaggtcaagcacctttttcagacttacagggatag

SEQ ID NO: 123570 - DNA, 3414 bp, Artificial Sequence
  Description of Artificial Sequence: Synthetic coding sequence
atgtttgactgctggcgctttatcttatgtaagcgcccagggtctaactcatacagcagtcctcagcgtcccaacgaggcaaaaaaagaggaaaccgatcaccaaatcgacgtgagcgatgtcattcgcctcgtacaagacaccccggaggcaacagcaatggccactgatgaaatcatgcaccaggatatagttccgttgtgcgcagctgacatccaggatcagttaaaaaagaggttcgcttacttaagtgggggcagagggcaagatggctctcccgtcattacttttcctgattacccagccttcagtgaaatccccgataaagagttccagaacgtgatgacttacctaacttcaatcccctcacttcaagacgctgggataggattcattctggtaatagatcgtaggagggataagtggacctcagtcaaagcttccgtcctgcgtattgcagcctcatttccagccaatctccagttggtactggtgcttcggcccaccgggttctttcagaggacactgtctgacatcgcgttcaaattcaacagagatgattttaagatgaaggttcctgtgatcatgctaagttctgtgccggatctgcacggttacatcgataagagccagttaacagaagatctggggggtacgctcgactactgtcactcacgctggctgtgccagcggacagccattgaatcatttgcattgatggttaagcaaacggctcagatgcttcagtcctttggcacggagctggctgaaacagagctgcctaatgatgtccagtctacatcctccgtgctgtgtgcacatactgagaagaaggataaagccaaagaagacctgcgtctggccttaaaggaaggccattctgtgctggagagtctgagagagctgcaagccgagggttccgaaccgtctgtaaatcaagatcaactcgacaaccaggccaccgtgcaacgcctcctcgctcagctaaatgaaacagaagctgccttcgacgagttttgggctaaacaccagcagaaactggagcagtgcctccagctgcggcatttcgaacagggctttcgcgaagtgaaagccattctggacgctgccagccagaaaattgctaccttcactgacataggtaatagtctcgcccacgtggaacacttgctgagagacttggcatcgtttgaagagaaaagcggtgttgcagtagagcgagccagagcgttgtctcttgatggagagcagctgattgggaacaagcactatgccgtagattccattcgcccgaagtgccaggagctgaggcacctttgtgatcagttttccgccgaaatagctcgtaggcgtggcctgctgagcaagagtctggaactgcatcgtcggctggagacttccatgaagtggtgcgatgaaggtatttacctgctggcgtcacaacccgtggacaagtgccagtctcaggacggcgctgaagcagccctacaggaaatcgagaaatttctggaaacgggagccgagaacaagattcaggaactcaatgctatttacaaagaatatgaatctatattgaaccaggatttgatggagcatgttaggaaagttttccagaaacaggcatcgatggaggaagtgttccatcggaggcaggcctccctgaagaagttagccgcgcggcagacccggcccgtccaacctgttgcaccaaggcccgaagccttagctaagtcgccctgcccaagccctgggattcgccggggttcggagaacagctcatccgagggcggagcccttcggagggggccctaccgccgcgccaagtcggagatgagcgagtccagacaagggcgtggctccgccggcgaggaggaagaaagtctggccatcctgcgacgccacgtgatgtcagaactcctggacacggagcgggcatatgtcgaggagctgctgtgcgtcttggagggctacgctgcagagatggataatcctctcatggcacatcttctgtctactgggctgcataataagaaagacgtgttatttggtaatatggaagagatctatcacttccataaccgtatctttttgcgcgagctggagaattacactgattgcccagagttggtggggcgctgcttcctagagcggatggaagactttcagatttacgagaagtactgccagaacaaaccccgcagcgagtccctctggagacagtgctcggactgtcccttttttcaggaatgccaacgcaaactggaccataagctttccctggattcctacctattgaagccagtgcaacgtatcacaaagtatcaactcctgttgaaagagatgttaaagtactctcggaactgtgagggcgcggaagatttgcaggaggccctctcgtcaattctgggcatcttaaaagcagtgaacgacagcatgcacctgatcgcaataaccggatacgacggtaatctcggcgatttgggtaagctgctgatgcaggggtctttttccgtgtggaccgatcataaacggggacacaccaaagtgaaagagctggcccgtttcaaacccatgcagaggcacctttttctgcatgagaaggccgtgctgttctgcaaaaagcgcgaggagaacggcgaaggttacgagaaggctccgtcctattcatataagcaatcactgaatatggccgcagtgggaatcactgagaacgtcaaaggggatgcgaagaagttcgaaatttggtataatgcccgcgaagaggtgtacatcgtgcaagcacctacccccgagatcaaggctgcctgggtcaatgaaattaggaaagtgctgacaagccagttacaggcttgtcgagaagccagtcagcaccgcgccctggagcagagtcaaagtctacctctcccggccccaacttctacaagccctagcagaggaaattcccggaatattaaaaagcttgaagagcgaaagactgaccccctgagtctggaaggttatgtatcatcagcaccactgactaaaccccccgagaaaggtaaaggctggagcaagaccagccactcgctggaagctccagaagacgatggcggttggtccagcgcagaagagcagatcaatagttcggatgccgaggaggatggcggattaggccccaagaagctggtacctggaaagtatacggtggtggcagaccacgagaaaggcggaccagatgcactgcgcgtaaggtccggcgacgtcgttgaactggtacaagaaggcgacgaaggtctgtggtacgttagagatcccaccaccgggaaagagggctgggtgcctgctagcagtctgtcagtccgtctgggaccttctggatcggctcagtgcctctctagcagcggaaaagcccatgttccaagagctcatccatag

SEQ ID NO: 123571 - DNA, 2382 bp, Artificial Sequence
  Description of Artificial Sequence: Synthetic coding sequence
tagagtcagaaaatagccactttcacagacatcgggaactccctggcgcatgtggagcatctactcagggatctcgctagcttcgaagaaaagagcggtgtggcggttgagagagctcgggccctgtcactggacggcgagcagctaattggaaacaaacactatgctgtcgacagcatccgccccaagtgtcaggaactacgccatctctgcgaccaattctcagctgagatcgctcggaggcgtggtctgttaagtaagtccctggaattacatagaagacttgagaccagtatgaaatggtgcgacgaggggatttatctgttagcatctcagccagtcgataaatgtcagagtcaggacggcgccgaggccgcactccaggaaatcgagaagttcctcgaaaccggagcagaaaacaaaatccaggagctgaatgctatctacaaggagtatgagagcatcctgaaccaggatttaatggagcacgtgaggaaagtgtttcaaaagcaagccagcatggaagaggtatttcatcggcggcaggcaagtctcaagaagctggcagccaggcagacacggcccgtccaaccagttgcccctcgacctgaagccctggccaaatctccatgtcccagcccagggatccgacgcggctctgaaaatagctcatccgaggggggggcactgcggaggggcccttatagacgggctaagagtgagatgagcgagtctcgacagggccggggtagcgccggggaggaggaagaatccctggccatattgagacggcacgtaatgtcagagttgctcgatacggaaagagcttatgttgaggagttgctgtgtgtcttggaggggtatgctgccgagatggacaatcctctcatggcacacttgctgtccaccggcctgcacaataaaaaggacgtgctgttcggtaacatggaggagatctaccacttccacaacagaattttcctgagggagctggagaactataccgactgtcctgaactcgtgggccggtgttttttagaaaggatggaggacttccaaatttacgagaaatattgccagaataaacccaggtcagaaagcttatggcggcagtgttctgactgcccattctttcaggaatgtcagcgcaaattggatcacaagctctcactagactcgtacctactgaagccagtgcaaaggatcaccaaatatcaattgttgctgaaggaaatgctgaaatactcacggaattgcgaaggggccgaggacctccaagaagccctctcttcaattttaggtatcctgaaggccgtcaatgattccatgcatctcatcgccatcaccggatatgacggaaatctgggtgatctcggtaagctcttaatgcagggttctttttcagtctggactgatcataaaagaggccataccaaggtcaaagaattggctcggttcaaacccatgcaacgtcacctctttctgcacgagaaagccgttctgttctgtaaaaaacgagaggaaaatggcgaggggtatgagaaagccccatcatatagttataagcagtccctgaacatggcagcagtcggcattactgagaacgtgaagggtgatgcaaaaaaattcgaaatatggtataacgcccgggaagaagtgtacatagtgcaggcaccaacacccgagatcaaagccgcctgggtgaacgagatccgaaaggtattgactagccagttacaggcgtgtcgggaggcttcgcagcatcgagctttggaacagagccaaagcctccctctgcctgctccaacttcaacttcaccaagcaggggcaattcaagaaacataaagaagctagaggagcggaaaacagaccccctcagtctggaaggttacgtcagcagcgcaccactcacaaaacctccagaaaagggaaaggcatctccaacctcgccagataagaaagcaaagcgacacgaggtgaagtccgatcctaccccatttggtgtgagaggctggtccaaaacctcgcactcactcgaggcaccggaggacgatggtggatggagtagcgcagaggagcagattaattcctcagacgcggaggaggatgggggcctgggacccaaaaagctggtgccaggtaaatacacagtggtggccgaccacgagaagggcggcccagatgccctgcgggttcgcagcggagatgttgtcgagcttgttcaggaaggagatgaagggctgtggtatgttagagacccaaccacaggtaaagaggggtgggtgcccgcatcttctctatctgtacggttgggtccatctggctcagcacagtgtctgtcctcaagcggaaaggcacacgtgccgagggcacacccatag

SEQ ID NO: 123572 - DNA, 3291 bp, Artificial Sequence
  Description of Artificial Sequence: Synthetic coding sequence
atgcctctccgagggggagctgggccatccccagcttctcatgggccgactcacggaccaagcgatccgcgcacctgcttgccaggccgcggggcaggaggaatgcggccccacggccgcggagcgctgggatgttgcggactctgcagcttttatacctgccacggtgctgctggtgacgaaattatgcatcaggacattgtgccactatgcgcagcagacatccaagaccagttgaagaagcgcttcgcttacctgagtggagggcggggccaagacggctccccggtcattaccttccccgattaccccgcattttccgaaatccccgataaggagttccagaacgtgatgacctatttaacatctattccttctctgcaggacgctggcattgggttcatccttgtgattgataggcgccgagacaagtggaccagtgtgaaggcctctgttcttcggattgctgccagctttcctgccaatctccaactcgtgctcgtcttaagacctacaggcttcttccagcgaacgctttccgacatcgcctttaaattcaatcgggatgactttaagatgaaagttcccgtgattatgctgagcagtgttccagatctgcatgggtatatcgataaaagtcagctgacagaggatttaggcggcacactggattactgccatagtcgctggctgtgtcaacgaacagcaatagagtccttcgctcttatggtgaagcagaccgcccagatgttgcagtccttcggcactgaactggctgaaactgaattgcccaacgacgtccagagcactagttcggtgttgtgtgctcatacagaaaaaaaggacaaagcaaaggaagatctgcgtttggcattgaaggagggccattcggtgctcgagagcttgcgcgagttgcaggccgagggcagtgagccctcggtcaaccaggatcagctggacaatcaagctactgtgcagcggttactggcccagcttaatgagaccgaggctgctttcgatgaattttgggccaagcatcagcagaagctggaacaatgtctacaacttcgccactttgagcagggattccgcgaagtcaaagcgattctggatgccgcaagccagaagatcgcaacgttcaccgacattggaaattctcttgcgcatgtggagcacctcttaagagacttagcatcctttgaggagaagtctggcgttgcggtggagagggccagggccctttcgcttgacggtgaacagctgattggcaataagcactacgctgttgattctattagacccaaatgccaagagctgcggcacttgtgcgaccagtttagcgcagaaatcgctagaagaagaggattgctctccaagagtctggaactgcacaggaggttggagacttccatgaaatggtgcgatgagggaatctacctgctggcttcccagccggtggacaaatgccagtcccaagacggtgctgaggcagctcttcaagaaatagagaagtttctcgaaacaggcgccgagaacaaaatccaggagctgaatgctatctataaagagtatgagtccattctgaaccaggatcttatggaacacgtgagaaaagtgttccagaaacaggcctctatggaagaggtgtttcacagaagacaggcctccctcaagaagctcgctgccagacagacacgccctgtgcagcctgtcgctccaaggcccgaggccctcgccaaaagtccatgccccagccctgggatccgcaggggtagcgagaatagtagctccgaagggggcgctctgcggcgggggccatatagaagggccaaatcggagatgtccgagtctcgccaggggcggggcagtgccggggaggaggaagaaagtctggccatcctacggcgtcatgtgatgtccgagctcttagatactgagcgcgcttacgtggaggaactgttgtgcgtcctggagggttacgccgccgaaatggataaccccctgatggcacatctcctgagcacggggctacacaacaagaaggacgtgctgtttggaaacatggaagaaatatatcacttccacaaccgaatcttcctgcgcgaactagaaaactatactgattgtccagagctggtgggaagatgcttcctggaacggatggaggattttcaaatctacgagaagtactgtcaaaacaagcccaggtccgagtctttatggcggcagtgcagcgattgccctttctttcaagaatgtcagaggaagctcgaccacaagctgagcttggacagttatctcttgaagcccgtgcagcgcattacaaaatatcagctcctgctgaaagagatgctcaaatactcaaggaactgtgagggcgccgaggatctccaagaagctttgtcgtcaattcttggcatcctgaaagccgtgaacgattccatgcatctgatcgcaatcaccggttatgacgggaacctcggcgacctgggcaaacttctgatgcagggcagcttttccgtgtggaccgatcacaagcgcggtcataccaaagtgaaagagctcgctcgattcaagccgatgcagcgccatctctttctgcacgaaaaagcagtcttgttctgtaagaaacgggaggagaacggagagggctacgagaaggccccctcctattcttacaaacaatcactgaatatggccgccgtagggattacggagaatgtcaagggtgatgcaaaaaaattcgaaatctggtacaacgcaagggaagaggtctatatcgtacaagcacccactccagaaattaaggctgcttgggtaaatgagatccgcaaagtccttacctctcagctacaggcatgtagagaagcttcccagcaccgggccttggagcagagccagtcgcttccactgccggccccaaccagtacgtctccgagtcgagggaactcccgcaacattaagaaactggaggaacgcaagaccgacccactgtccctagagggctacgtctcttccgcgcctctcacaaaaccgcctgagaaggggaaaggctggtcaaagacctctcattcactcgaagcccctgaggatgatggtggctggtcttccgcagaagagcagatcaactctagtgacgccgaggaagatgggggattgggtccaaagaagttagtgccaggaaagtatactgtggtggcagaccatgaaaaggggggccccgacgcccttagagtacgatcaggtgacgtcgtcgaactcgtgcaggaaggtgatgaagggctctggtag

SEQ ID NO: 123573 - DNA, 411 bp, Artificial Sequence
  Description of Artificial Sequence: Synthetic coding sequence
atgcaccaagacatcgtgcccctgtgtgctgcggatatacaggatcagttgaagaagaggttcgcatacttgtcaggcgggcggggccaagacggatcccccgtgatcacatttcctgactatcccgcattttcagagatcccggacaaggaattccagaacgtcatgacctatctcacgtcaatcccatccctgcaagacgcaggcatcggttttattcttgtgatcgaccggaggcgggataaatggacgagtgtgaaggccagcgttctccggatcgccgcctcatttccagccaatctgcagttggtgcttgtgctgcgaccaaccggcttcttccaacgaaccttgagcgatatagctttcaagtttaaccgtgatgatttcaaaatgaaggtccccgtgatttag

SEQ ID NO: 123574 - DNA, 3372 bp, Artificial Sequence
  Description of Artificial Sequence: Synthetic coding sequence
atgaccgtacgccgcctctctctcctgtgcagagatctgtgggcactttggctcctactcaaagctggtgctgatgaaattatgcatcaagacattgtcccactgtgtgccgccgacatacaggaccagctaaagaagagattcgcctatctctcgggcgggcgcgggcaagatgggtcccccgttattacattccccgactacccggcattttccgagattcctgacaaggaattccagaacgttatgacttacttaaccagcatcccttccctgcaagatgctggcataggctttatactggttattgatagaaggcgcgataaatggacttcggtgaaagccagtgtgctgcgcattgctgcatcatttccagccaacctgcagctggtgttagtgttacgcccgacgggtttcttccagagaaccttaagtgatattgcgttcaagtttaacagagacgacttcaagatgaaggtccccgtcatcatgcttagcagtgtgcctgatctccacgggtacatcgataagagtcagctgactgaggatctggggggcaccctagactattgccattctagatggctctgtcagagaaccgccatagaatctttcgcgcttatggtgaagcagactgctcagatgctccagagctttggtactgagctggcggagacagaactgcccaacgatgtccaatcgacgagttccgttctttgtgcccacactgaaaagaaagacaaagcaaaggaggatctgagattggccctgaaggaaggacacagcgtgctggaaagcctgcgggagctacaggctgagggaagcgagcctagcgttaaccaggaccagctggacaaccaagcaacggtacaacgcctgctggcacagctgaacgaaacagaagcggcctttgacgagttttgggcaaaacatcagcaaaagttggaacagtgcttacaactgcgccattttgaacaggggtttcgcgaggtcaaagccatccttgatgctgcctcccaaaaaattgcgaccttcaccgacatcgggaattccctggcccacgtcgaacatctgctcagggatctggcttcattcgaggagaagtctggtgtagcagtcgagagggccagagccctgagtctggatggcgaacagctgatcgggaacaaacactatgccgttgactccattcggccgaaatgtcaggaacttagacacctgtgcgatcagtttagcgccgaaatcgctaggcgtcgcggactgctcagcaagagcttggagctccaccggcggttggagacttccatgaaatggtgtgacgagggaatctacttactggcctctcaaccggtggacaagtgccagagccaggacggggctgaggccgcgctgcaggaaatcgaaaaattcctagagactggcgccgaaaataagatccaggagttaaacgccatttacaaggagtatgagtctattctgaaccaggatttgatggaacacgttagaaaggtgtttcagaagcaggcctccatggaagaggtgtttcatcgacggcaagcatctctgaagaagctcgcagcaagacagacacgccctgtgcagcccgtcgctcccaggcccgaggctctagctaaaagcccatgtcccagtcccgggatccgccgaggctctgaaaacagctcaagcgagggaggcgcactccggaggggcccatacaggagggcgaagagcgagatgtctgagagcaggcaaggccgcggctccgcaggagaggaggaagagtctctcgccattctccgaaggcacgtcatgtctgaactactcgatacagagagggcttacgtcgaagagctactctgtgtgctggaggggtacgctgcggagatggacaaccctctgatggcccatcttctcagtactggccttcataataagaaagatgtgttattcggcaacatggaagaaatttaccacttccacaacaggatcttcttgagggaactcgagaattacacagattgccctgaattggtaggcagatgcttccttgaaaggatggaggactttcaaatttacgagaaatactgtcagaataaaccaagatctgagtcactgtggcgccagtgctccgattgcccctttttccaggagtgtcagagaaaactggatcacaagctttctctcgacagctacctgttaaaaccagtgcagcgcatcacaaaataccagctgctgttgaaggagatgctgaagtacagtcgtaactgtgagggtgcagaggatctgcaagaagcactatccagcattctggggatcttaaaagcagtgaacgacagcatgcacctcattgcgattacgggatatgatggcaacctaggggatctgggtaaactgctgatgcaggggtccttttccgtgtggaccgatcataagcggggccacacgaaggtcaaggagttggccaggttcaagcccatgcaaagacatctgttcctgcatgaaaaggcggtcttgttttgcaaaaagcgggaagagaatggagaggggtacgaaaaggctccatcctattcttacaagcaatcactgaatatggccgccgttggaatcaccgaaaacgtcaaaggggacgccaagaaattcgagatctggtacaatgctagagaggaggtatatattgtgcaagctccgactcccgaaatcaaagccgcatgggttaatgaaatcagaaaagtgttgacttctcagcttcaggcatgcagagaggcgtctcagcatcgggcccttgagcaaagtcaaagtttgcctctgcctgcaccaacttcaacatccccatcgaggggaaatagtcgaaatatcaagaagctggaggaacgcaagaccgacccactgtccctggaaggctacgtatccagcgctccactgaccaagcccccagaaaagggtaagggatggagcaaaaccagtcactccttggaggcccctgaagatgatggtggatggtctagtgctgaagagcaaataaatagctcagacgcggaggaggacgggggcctcgggccaaagaaactggtgcccggaaaatataccgtggttgccgatcatgagaagggcgggcctgatgccctgcgcgtgagatccggagacgtcgtcgaactggtccaggagggggacgaagggttgtggtatgttcgtgatccaactacgggtaaagagggctgggtcccagcatcttccctctccgtgaggctcggacccagtggttcagcgcagtgcctaagcagttctgaatcatcgcccggcagtgccgtcctctctaatagcagctcctgtagcgagggggggcaggccccattctccgaccttcagggctag

SEQ ID NO: 123575 - DNA, 741 bp, Artificial Sequence
  Description of Artificial Sequence: Synthetic coding sequence
atgaggttttggctgcggacagaggagatggccttggaggaaatggtacagcgactcaatgctgtttcaaaacacaccgatgagatcatgcaccaagatattgtgcctctgtgtgctgcagacatccaggaccagctcaagaagcggtttgcatatctctcaggcggtaggggacaggacgggagccctgtgatcacctttccagattatcctgctttcagcgagatccctgacaaagaattccagaatgtcatgacctacctcacctctatacctagtctacaagatgctggcatcggttttatcctggtgattgatagaagacgggacaaatggacctccgtgaaggcaagtgtgcttcggattgccgcctcgttccctgccaacctccagctcgtattagtgttgcgtcccacaggcttcttccagaggacactgtccgacattgcatttaagtttaatcgtgacgatttcaaaatgaaggtgcctgtcattatgttgagttccgtgccagatctccacggctacatcgacaagtcccagctgacagaagacctgggtggaaccttagactattgtcactcacggtggctgtgccaacgaactgccattgagtctttcgccctgatggtgaagcaaacagcacaaatgttgcagtccttcggtacagagttggccgagactgagctcccaaatgacgtgcaatcaacatcctccgtgctgtgtgcgcacactgaatag

SEQ ID NO: 123576 - DNA, 3342 bp, Artificial Sequence
  Description of Artificial Sequence: Synthetic coding sequence
atgggggatgggaaggcagttcggatatctgtggcggaaatgaagagctactatctttattccgagtggtgtagctggctcctctccgttgcagaggatgaaatcatgcaccaggatattgtgccgctttgtgccgcagatatccaggatcaactgaaaaagaggttcgcgtacctgagtggaggcagaggtcaggacggttcacccgttatcactttccctgactaccctgccttcagcgagatccccgacaaggagttccagaacgtaatgacttacttgacctctatcccctccttgcaggacgctgggattggatttattctggtgattgaccgcaggagagataaatggacatccgtcaaggcttcagtcctgcgcatagccgcctctttccccgctaacctccagctggtgttggtgctcagacctactggatttttccagcggacactgtcagatatagcttttaaattcaatcgcgacgattttaagatgaaagtgcctgtcattatgctaagtagcgtccccgacctccacggctatattgacaagtcccagctaaccgaagacctgggtggaacacttgattactgtcacagcaggtggctttgccagcgcactgcaatagagtcattcgccctgatggttaaacagactgcccagatgttacagtccttcggcaccgaactcgccgagacagagctgcctaatgatgttcaatccacaagctcagtgttatgtgctcataccgagaagaaggataaagcaaaggaggacctgagactggccctcaaagagggacatagtgtgctcgagtcactgcgggaattgcaggccgagggcagtgaaccttccgtgaaccaagaccagctggataaccaggcaaccgtccagaggctgctggcccagctaaatgagacagaggctgccttcgacgaattctgggcaaaacatcagcaaaagttagagcaatgcttgcagctgcgacatttcgaacaaggatttagggaagtaaaagcaatactggatgccgcatctcagaaaattgcgacgttcacagatatcggaaattcgctggcccacgtggagcatcttttgagagacctggccagctttgaagaaaaatctggtgtggcggtggagcgtgccagagccctcagtttggacggtgagcagcttattggcaataagcactatgcagttgactccattaggccgaagtgtcaggaactgcgccatctatgcgatcagtttagcgcagagatcgcgcgtcggcgcggactgctgagcaaatctttggaactacaccgtaggctggagacatctatgaagtggtgcgatgaaggaatttacctgctggccagccaacctgttgataaatgtcagtcgcaggacggcgccgaagctgcacttcaggaaatcgagaagtttcttgagacaggcgctgagaacaaaatacaggaactaaatgctatctacaaagagtatgagtccattcttaatcaggacctgatggaacacgtgcgcaaagtattccagaaacaagcttccatggaggaagtgtttcaccggcgccaagcctccctgaagaagcttgcagctaggcaaactaggcctgtccagcccgtggccccacgtcccgaggctctggctaagtccccatgtcctagccctggtataaggcgaggcagcgagaacagcagctcggaggggggagcactccgtcgcggaccatatcgtagggctaagtccgaaatgagcgaatctcgccagggtagggggtctgcgggcgaagaagaagagtcccttgccatattgcgcaggcatgtgatgagcgaactgctggataccgagagggcatatgttgaggagctgctgtgcgtgctggagggatacgctgctgagatggataaccctctgatggcacatctactcagcaccggcctgcacaataaaaaggacgtgctgttcggaaatatggaggaaatataccacttccataatcgtatcttcttaagggagctggagaattatactgactgtcccgaactcgtcggacgctgcttcctggagcgaatggaggattttcagatctacgagaagtattgccaaaacaagccacggtcagaatctctgtggagacaatgttctgattgtccattttttcaagagtgccagcgcaagctggatcataaattaagcttagatagttatctgctgaagcccgtccagagaattacaaagtaccagctgctgttgaaggaaatgcttaaatatagtagaaattgtgagggagccgaggatctccaggaagctctctcctctatactgggaatcctgaaagcggtcaacgattcaatgcatttgatcgccattacagggtacgacgggaacctgggcgacctcggtaagctcctcatgcagggctctttcagcgtgtggaccgaccacaagcggggccacactaaggttaaggagctcgctaggttcaaaccaatgcaacgtcacctattccttcacgagaaggccgtcttgttttgtaaaaagcgcgaagaaaatggtgaggggtatgagaaagcaccatcgtactcctacaaacaatctcttaacatggctgccgttggaatcacagagaacgttaagggggatgcaaagaagttcgaaatctggtataacgctcgagaggaggtgtacatcgtgcaagcacccactcctgaaattaaagccgcctgggtgaacgagatccgcaaggtgctgacatctcaattgcaagcctgtcgcgaagcgtcacagcaccgcgccttggagcagtcacaatctctgccactgccagccccgacctctacaagcccctctcggggtaactcccgaaatatcaagaaattggaggagcggaagaccgacccactctcactggagggatatgtttcttctgccccactgaccaagccgcccgagaagggcaagggttggagcaagactagccattccctggaggctccggaagacgatggcggctggtctagtgccgaggagcagataaatagcagtgacgcagaagaggacggtggccttgggcccaaaaagctggtccctgggaagtacaccgtagtggccgaccatgagaaaggtggaccagatgccctccgcgtgagatctggagatgtcgtggaactcgtacaggagggagatgaaggcctatggtatgtgcgcgacccaaccactggcaaagaaggttgggtccctgcctctagcctaagcgtgagacttggtccatctggctctgcccagtgtctctcaagctcaggcaaagctcacgtaccacgcgcacatccatag

SEQ ID NO: 123577 - DNA, 2712 bp, Artificial Sequence
  Description of Artificial Sequence: Synthetic coding sequence
ttgaagatgcctgttatcatgctgagcagcgtaccagatctacatgggtatatcgacaaatcgcagctgactgaggacctaggaggtactctggattactgccatagcaggtggttgtgccagcggaccgccatagagtcctttgctcttatggtaaaacaaactgcccagatgctccaatcatttggcaccgagctcgccgagacagagctgcccaacgatgttcaatcaacctcatcagtactatgtgcccatacagagaagaaggacaaagccaaagaagaccttcggctcgctctgaaagaaggccactctgttctcgagtccctaagagagttgcaagccgaaggatcagaaccatctgtgaatcaggaccagttagacaatcaggcaactgttcaacgtctgctggctcagcttaatgaaaccgaagccgcatttgacgagttttgggctaagcaccagcaaaagctggaacaatgtctccaactgcggcatttcgagcagggcttcagagaagttaaagcgatactggacgccgcaagtcagaagattgctacttttaccgacatcggcaacagcctggcacatgtcgaacacctgctgagagacctggcgagctttgaggaaaaaagtggcgtggcggttgagcgagcacgggcactgtctctcgatggtgagcagctaattggcaataaacattacgctgtggactctattcgccctaagtgccaagagctacggcacctctgcgaccagttctcagctgaaatcgcgaggagacgcggactgctctctaaatctcttgaactccaccgtcgcctggagacttctatgaagtggtgtgacgaaggtatctacctcctggcatcgcagcccgtagacaagtgccagtcccaggatggggcggaagcagccttgcaggagatcgaaaaatttctggaaaccggggcagagaataaaatacaagagttgaacgctatctataaggagtacgaatctatactgaatcaggatctgatggaacacgtccgaaaggtgttccagaaacaggccagcatggaagaagtgttccacaggagacaagcaagtctcaagaagttagccgctcgtcagactcgacccgtgcagcctgtggcccccaggccggaggcgctggcgaagagcccatgccctagtccgggtatccgccgggggtcagagaacagttctagcgagggcggagctctacgcagaggcccttacaggagggccaagtctgagatgagcgaaagcaggcaaggacgcggtagcgctggtgaagaagaagagagcctcgctatccttcggcgccatgtgatgtcagagttattggataccgagcgcgcctatgtggaagagctgctctgcgtccttgaagggtatgccgccgaaatggacaacccacttatggcccacctacttagcacgggcctccataacaaaaaagatgtcttgtttgggaatatggaggaaatctaccatttccataaccgcatttttctccgggagcttgaaaactatacggattgtccagaactggttggccgctgcttcctcgaaaggatggaggacttccagatttacgaaaagtattgtcagaacaagccccggagcgaatccctgtggagacagtgttctgactgccccttcttccaggagtgtcaacgcaagttagatcacaaactgtccctcgactcatacctcctgaaacctgtacagaggattaccaagtaccagctccttctgaaagaaatgctaaaatattcccgtaactgtgagggtgccgaagaccttcaggaggccctctcctctattttaggtatcctcaaggcggtgaacgatagtatgcaccttatagccatcacagggtacgatggcaacctgggggacctcggcaaactcttaatgcaaggttcctttagcgtatggacagaccataagaggggacataccaaagtaaaggagctggcccgatttaaacccatgcagaggcacctctttctgcatgagaaggcagtgcttttctgcaagaagcgtgaagagaatggagaaggctacgaaaaagcaccttcatactcatataaacagtccctgaacatggccgccgtgggtattaccgagaatgtaaaaggagacgcaaagaagttcgaaatttggtataacgcaagggaagaggtctacattgttcaggccccaacaccagagatcaaggcagcctgggtgaatgagattagaaaagtcctgacgtcacagctccaggcttgtagggaagcttcccagcacagggctttagaacagtcacagagtctgcctctgccagcaccaacctcaacaagtccatctaggggaaatagccgaaacattaaaaagctggaggagcggaagacggaccctctgagtctcgagggctacgtctcgtccgcacccttgaccaagccacccgagaaaggtaagggatggtccaagacctctcactcactcgaggctccagaagatgacggcggctggagcagcgcagaggaacagattaacagcagcgatgccgaagaagacggtggccttggacctaagaagttggttccaggaaaatacaccgtcgtggctgatcatgaaaaaggcggtccagacgctttaagagtgagaagcggagatgtcgtcgaattggttcaggaaggtgatgaaggcctctag

SEQ ID NO: 123578 - DNA, 3414 bp, Artificial Sequence
  Description of Artificial Sequence: Synthetic coding sequence
atgtttgactgctggagatttatactgtgcaagcggccagggagtaattcttactcatcaccccagcgtcccaatgaagcaaaaaaagaggaaaccgaccaccagatagacgtcagcgacgtgatccgactggttcaggatacccccgaggccacggctatggccacagacgagatcatgcatcaggatattgtgcctttatgcgcagctgacattcaggatcaacttaagaagagattcgcgtaccttagtgggggccgcggtcaagatgggtcacctgtgatcacattccccgactatcccgcgttctcggaaattcctgacaaagagttccagaatgtgatgacgtatttaacttccatacccagcctccaagatgctggcattggcttcattctagtcattgacagaagacgggataagtggactagcgtgaaagccagcgtcttgcgcatcgccgcttcattccccgcgaacctgcagctagttcttgtccttcgtccaaccggctttttccagcggactctgagcgatattgctttcaagttcaaccgggatgatttcaaaatgaaagtccccgttatcatgctgtcgagtgtgcccgaccttcatggctacatcgacaagtctcagctgactgaagatcttggtgggaccctggattactgccactctcggtggctgtgccagcggaccgccattgaatcatttgccctcatggtgaagcagactgcccagatgttacagagttttgggacagagctcgcggagacggagcttccaaatgacgttcagtccacatcgagcgttctttgtgcacacaccgaaaagaaggacaaagccaaagaagacctacgcttggccttgaaagaaggtcactcggttttagagagtctgcgcgagctacaggcagagggttctgagcctagcgtgaatcaagatcagcttgataaccaggcaactgtgcagcgcctgctggctcagctaaatgaaacagaagcagcgtttgatgagttttgggccaaacaccagcagaagctggaacagtgcctccaactcagacactttgagcaaggatttcgagaagtgaaggcaatcttggatgccgcttcccagaagatcgcaacatttactgacattggtaacagtttggcacacgtggagcatctactgcgggatctggctagctttgaggagaaaagtggggtggccgtagagagagcccgtgcgctgagtctggacggcgagcagctaattgggaacaagcactacgccgtggattccattaggcccaagtgtcaagaactgaggcatttgtgtgatcagttctccgccgaaatcgctcgcaggcgcggcctactgtccaaaagcttagaactgcacaggcggctagagacttccatgaaatggtgcgacgagggcatctatttgctggcctcccaacctgtggataaatgtcagagccaggacggggctgaggccgccctgcaagagatcgagaaattcctggaaaccggcgccgaaaacaaaatccaggagttgaacgccatttataaggaatacgagagtattctgaaccaggatctgatggagcacgtccgaaaggtctttcagaaacaggccagcatggaagaggtgtttcatcgcagacaggcttcactgaaaaagctggccgctcggcagacgcgtccagtgcagcccgtcgccccccgaccagaagccctcgcgaaaagtccatgcccctcccctggaattaggagggggtccgaaaatagcagcagcgaaggcggagctctgcgtcggggcccatatcgacgagccaaatctgagatgagcgagtctaggcagggccggggtagcgcaggtgaagaggaagagtctctggctatccttcgccgacatgttatgtctgaactgctggacaccgagagggcctatgtggaggaactgctgtgcgtgcttgaagggtatgccgctgaaatggacaatccactgatggctcacttgctcagtaccgggctccacaataagaaggacgtgctcttcgggaacatggaggaaatctatcatttccataatagaatattccttagagagctcgaaaactacaccgattgccccgagctagtaggtcgatgcttcctcgaacgtatggaagactttcagatctacgaaaagtattgtcagaataagcctcgatcagagtccctctggcgtcaatgttctgattgtcctttttttcaggaatgccaaaggaagcttgaccacaaattgagcctggactcctacctcctcaagccagtacaaaggatcaccaaataccagctgctgctgaaagagatgcttaagtattccagaaattgtgaaggagctgaagatctgcaggaagcactctcttccattctcggaatcctaaaggccgtgaatgatagcatgcacctaatcgcgatcactgggtatgatgggaacctgggagaccttggtaaacttctgatgcagggctccttcagcgtgtggacggatcacaagagaggccatacaaaggtcaaggaactggcacggtttaagccaatgcaacgccacctgttcttgcacgagaaggccgtgttattttgtaaaaagcgcgaggagaacggggaaggatatgaaaaggccccctcgtactcatacaagcaatcgctgaacatggctgctgttggcatcacagagaacgtgaaaggtgacgcaaagaaatttgaaatatggtacaacgccagagaggaggtttacatcgtacaggcaccaacccccgaaatcaaggctgcctgggtaaatgagatcagaaaagtgttaacctctcaacttcaggcctgtcgggaagcttcacagcatcgggcacttgaacagagccaaagtctgccactgccagcccccacttcaacctcaccaagtcggggcaatagccgtaatattaaaaaattggaggagcggaagacggatcccctgagcctggagggctatgtgtcctccgcccccctgacaaaacctcctgagaagggcaagggttggtccaagacctcacacagcttagaggccccagaggatgacggaggatggtcatctgcagaggagcaaattaacagcagcgatgctgaagaggatggcgggctgggaccaaagaagttggtcccaggcaaatacaccgtggttgccgaccacgaaaaaggcggcccggatgcactgcgagttcgcagcggggacgtcgtggagctggtccaagaaggagacgaaggcctatggtatgttagggatccaaccaccggtaaggagggatgggtacccgccagttcccttagcgttaggctgggcccctccggctcagcccagtgcctcagctcatcaggaaaggcacacgtaccgcgcgcacacccttag

SEQ ID NO: 123579 - DNA, 3378 bp, Artificial Sequence
  Description of Artificial Sequence: Synthetic coding sequence
atgagattttggctccgcaccgaggagatggccctggaggagatggttcagcgcctgaatgctgtcagcaaacacactgatgaaatcatgcaccaggacattgtaccactgtgtgctgctgatattcaggaccaattaaaaaagagatttgcctacctgtctggcggccgcggccaagatgggagtcccgtcatcaccttcccggattacccagctttctctgaaatccctgacaaggaattccagaacgtaatgacctatctcacctcaatccccagcctgcaggatgcggggatcgggtttatccttgtgattgacaggcgcagagataagtggacttccgtgaaagcaagtgtgctaagaattgctgcttccttcccagcaaacctgcagctcgttctcgtgctcaggcccacggggttctttcagcggaccctgtcagatatagcatttaagttcaaccgagacgacttcaaaatgaaggtgcctgtgataatgctcagcagcgtgccagatcttcatggatacatcgataaatcacagcttaccgaagaccttggcggaaccctggactattgtcactcgagatggctttgtcagcgcactgctatcgagtcttttgccttgatggtaaaacaaacagctcaaatgctgcagtccttcggaactgaactcgccgaaacagaactcccaaatgacgtacaatccacaagcagcgttctgtgtgcgcacacagagaaaaaggataaagccaaagaggacctgcggctggccctcaaggaggggcattcagtcctggaaagcttacgtgaacttcaagctgagggaagcgaaccttctgtcaatcaggaccagcttgataatcaggccactgtacagcggctgttggcacagctcaatgaaaccgaagccgcgttcgatgagttctgggcgaaacatcaacagaaactagaacagtgtctgcagctacgacatttcgagcaggggtttcgcgaggtgaaagcaattttggacgccgcgtcccagaagatcgccacgttcaccgacattggcaattcattggcccacgtggagcatctgcttagggacttggctagcttcgaggaaaaaagtggcgtcgccgtagaacgtgcccgcgcactcagtcttgacggggaacagctcataggaaataagcactacgctgttgacagtatccggcctaagtgtcaggagctccggcatttgtgtgatcagttttctgccgaaatcgctaggcgccgaggcctgctctccaagagtttggaactgcacagacgactagagacttccatgaaatggtgtgacgaaggaatttacttgctcgcatcacagcccgtggacaaatgccagagccaagacggcgcagaggccgctcttcaagagattgagaaattcctggagactggtgctgaaaataagatccaggaacttaacgcaatttacaaggaatacgaatctatcctgaaccaggaccttatggaacatgtccggaaggtctttcaaaagcaggcgagcatggaggaagtcttccacaggaggcaagcctccctcaaaaaactcgctgccaggcaaaccaggccagtccagcccgtggcccctcgacccgaggctctggcaaaaagtccctgtccttcgcccggaattcgcagggggtcagagaattctagcagcgagggaggagccctgagacgtggtccttatcgaagggccaagagcgagatgtcagaatctagacaaggtcgaggctccgcgggagaagaggaagagtccctggccatccttcgccgccatgtgatgtcagagctcctcgatacagaaagagcgtacgtagaggaattgctgtgtgtgttggaaggatatgctgctgagatggacaatcccctcatggcccatttactctctactggattgcacaacaagaaggatgtgttattcgggaatatggaagaaatctatcatttccacaataggatctttttgcgggagcttgagaattatactgactgtcccgagctcgtgggcaggtgcttcctcgagagaatggaggacttccaaatttatgagaagtattgccaaaacaaaccaaggagtgagagtctgtggcgtcaatgtagcgactgccccttttttcaggaatgccagagaaagcttgaccataagctgtcacttgattcgtacctgctgaaacccgtgcagcgcataaccaaataccagcttctgcttaaggaaatgctaaagtactcccgcaattgcgaaggggccgaggacctgcaggaagccttatccagcattttggggatactgaaagcggttaacgactctatgcatctcattgcaattacgggttatgacggtaaccttggcgaccttgggaaacttctgatgcaagggagcttttctgtctggacagatcataagaggggacataccaaggtgaaggaactcgcgcgcttcaaacccatgcagaggcatctcttcctgcacgaaaaggccgttctcttttgcaaaaagcgcgaagaaaatggagagggctacgaaaaggcaccctcttattcctacaaacaaagccttaatatggctgccgttggcatcacagagaacgtgaagggggatgccaagaagtttgaaatatggtataatgccagagaggaagtctacattgtccaggcacctacccccgaaattaaagctgcctgggtaaacgagatccgaaaggtcctaacctctcagctgcaggcttgcagggaggcctctcagcatagggccctcgagcaaagccagtcactgccgctgcccgccccaacctcaacgagtcctagtcgcggaaatagtcgcaatataaagaagctcgaagaaaggaaaaccgaccccctgagtctggagggctacgtgtcttcagcccctttgactaagccaccagaaaaaggaaaaggttggagcaagacctcccattcactggaagcacccgaggatgacggaggatggtctagtgccgaggagcagatcaactcaagcgatgccgaggaagacggaggactgggaccaaaaaaattggtgccaggtaagtatacagtcgtggccgaccatgaaaagggggggccagacgctctgcgggtccgctccggcgacgtcgtggagcttgtccaggaaggagacgaaggcctttggtatgttcgtgatcctacaacgggcaaggaggggtgggtgccagcaagcagcctgtctgtcaggctcggtccgagcggtagtgctcagtgtctgtcttctagcgagtcatcccccggttctgctgtgctaagcaactcgagctcttgcagcgagggtggacaggccccattctccgatctccagggctag

SEQ ID NO: 123580 - DNA, 1713 bp, Artificial Sequence
  Description of Artificial Sequence: Synthetic coding sequence
atgagtagactggaagccaaaaaaccatctctgtgcaagtcagaacctctgaccacagaacgggtcaggacaaccctgtcagtactaaaacggatcgtcacatcctgctatggaccatccggacggttgaaacagctgcataatggctttggtggctacgtgtgtaccactagtcagtcgagtgccctgcttagccacctgctggttacacaccccattcttaagatacttaccgcctcaatccagaaccatgtgtccagctttagcgactgtggactgttcaccgccatactttgttgcaacctcattgagaatgtgcagcggctggggcttacaccgacaactgtgattcggctaaataagcatctgctttcactctgtatctcctacctgaaaagtgaaacctgtggttgccgcattcccgtagatttttctagcactcagatattgttgtgcctggttagatctatactgactagcaaacccgcctgtatgcttacaagaaaggagaccgagcatgtctccgctctgatactgcgtgccttccttctcacaatccccgaaaatgcagagggtcatattatcttgggcaagagcctcatcgtgccgctcaaaggccaaagagtgattgatagtactgtgctccccgggatcctcattgagatgtccgaggtccagctaatgcggctgttacccatcaaaaagagtactgctctgaaagtcgctttattctgcactaccttaagcggagacacctccgacactggtgagggcactgtcgtggtcagttatggtgtaagcctcgagaatgcagtgctagaccagctactgaatcttgggagacagctaattagcgaccatgtcgacctggtcctatgtcagaaggttattcatccctcactcaaacagtttctgaacatgcaccgtatcatcgctatcgaccgcattggtgttacgcttatggagccattgacgaagatgacaggcactcagcctataggtagcctcggctcaatctgcccgaatagctacggatctgtgaaggacgtctgtactgctaagttcggctccaagcacttctttcacctaattcctaacgaagctaccatctgctcgctcctcctttgcaatcgcaacgataccgcttgggacgaactgaagctgacttgtcaaacagcattgcatgtccttcagctgactctgaaagagccctgggcgctcttaggcggcgggtgcaccgagacccatctggccgcttacattcgccacaagacccataacgatccggagtccatcctaaaggacgatgaatgcacacagactgagctgcaattaatcgctgaagcattctgctctgccctggaaagcgtggttggctcgctggagcatgacggcggggagattttgactgacatgaaatacggccatctttggtcagtgcaagctgacagcccttgcgtcgcaaactggcccgatttgctcagtcagtgtgggtgcggcctatacaacagtcaggaggagctaaactggagcttcctccgttcaacaaggcggccatttgtgccacaatcctgcctaccccacgaggctgtgggctccgccagcaatctgacattggattgtctcaccgcaaagcttagtggcctgcaggttgctgtagaaaccgctaacctgattctagatctctcatatgtgatagaggacaaaaattag

SEQ ID NO: 123581 - DNA, 1713 bp, Artificial Sequence
  Description of Artificial Sequence: Synthetic coding sequence
atgtccagactcgaagcgaagaagccgagcctgtgcaaatccgaaccattgactaccgagcgagtgagaaccaccctcagcgtattaaagcgaatcgtgacctcttgctacggcccctccggccgtctcaagcagctacataacgggtttggcggatacgtgtgtaccacgtcccagagttctgcactgttaagccatttgctggtcacacatccaatcctgaagattctcacggccagcatccagaaccacgtgtcttcgttttctgactgcggcctcttcacagccattctttgctgtaaccttatagaaaacgttcagcgtttgggattgacacctaccactgtaatcagactgaacaagcacttgctgagcttatgcatctcatacctgaaatcagagacatgcggctgccgtattcctgtggactttagtagtacacaaatcctcttatgcctcgtacggtctatcctcacgtccaaacccgcctgcatgctgacgcgcaaggaaacggagcacgtgtctgcactgatcttgagagccttcctgctgaccattccagaaaacgcagagggacacattattctcggcaagagcctgatcgtacccctcaaggggcagcgagtcatcgatagtacagtgctccctggaatcctgatcgaaatgtctgaggtacagctgatgagactgctaccgattaagaaatccaccgcgctgaaggtcgcactattttgtacaacactcagcggcgatacgagcgacaccggagagggaaccgtggtcgtatcgtacggagtcagcttggaaaacgcagtgctcgaccagctgctgaatctgggcaggcaactcatctcagatcacgtggatttggttctatgtcagaaagtgattcaccctagccttaaacagtttttgaatatgcacagaataatcgccatcgaccggatcggggtcactttgatggagccactgacgaagatgaccggcacgcaacctatcggtagtctgggtagcatctgccccaattcctatggcagcgtgaaagacgtgtgtacggcgaagttcggaagcaagcacttttttcacctgatccctaatgaagctactatctgttccctgctcctctgtaaccgaaatgacactgcttgggacgaattgaagctgacctgccagactgctctgcacgtgctgcagctgaccttgaaagagccctgggccctcctgggtggcggctgtacggaaacccacctcgccgcctacatcagacacaagacacataacgatcctgagagtatactgaaggatgacgagtgcacccagaccgagctgcagctcattgctgaggccttctgctccgcacttgaatctgtagtgggctcactggaacacgatgggggcgaaatccttaccgatatgaagtacggacacctatggtcagttcaggccgattccccttgtgtggcgaattggccagacctcctaagccagtgcggctgcgggctgtacaattcacaggaggaactgaattggtctttccttcggtccacacgacggcccttcgttccgcaatcgtgcttaccccacgaggcagtaggttctgccagcaatctgactcttgattgcttgactgctaaactgtccgggctgcaggtggcggtggagacagctaacctgatcctcgacctgagttatgtcatcgaggataaaaattag

SEQ ID NO: 123582 - DNA, 2145 bp, Artificial Sequence
  Description of Artificial Sequence: Synthetic coding sequence
atgcctgttcggtttaaaggcctgtccgagtatcagcggaattttctgtggaaaaagagctacctgagcgagtcttgtaattctagtgtcggccggaaatacccatgggctggcttgcgaagtgaccagctggggatcaccaaggagccaagctttatcagcaaaaggagggtcccttaccatgacccacagatatccaaatcacttgaatggaacggagcaatctctgagagtaacgttgtggccagccccgagccggaagcgcccgagacccctaaaagtcaggaagctgagcagaaggacgtgacgcaagagagagtccattctctggaagccagtagggtgcctaaaagaacccggagccattcagccgatagccgagccgagggggcatctgacgtggagaataatgagggcgtcaccaatcacacccctgtgaatgaaaatgtggagctcgagcattcgaccaaagtactgtcagaaaatgtggataatgggctggataggttgttgcgtaagaaagccgggctgacggtggtgccgtcctataacgcccttaggaattcagagtaccaacggcaattcgtgtggaagacctcaaaagaaaccgcaccagcattcgcagcgaaccaggtttttcacaacaaatctcaatttgtgcccccatttaaaggtaattcagtaattcatgaaactgagtacaagaggaacttcaaaggcttatccccagtgaaggaaccaaagcttaggaacgatctcagggaaaatcggaacttagagacagtgtcccccgaacgtaagtctaataagattgatgacagattaaagctagaggccgagatggagctcaaagatctgcaccagcccaagcgtaagttaactccatggaaacaccaacgactcggaaaagttaactcggagtatagagctaaattcctgagccctgcccagtacctgtataaagcaggggcctggactcatgtgaaggggaatatgcccaatcaagtaaaagagctgagggagaaagctgaattctaccgtaagagagtacagggcacccacttttccagggatcatctgaatcagatcctaagcgactcaaactgctgctgggacgtgagtagcaccacctcaagcgagggtacagtttcatcaaatattcgggccctcgacctcgccggcgacccaactagtcacaaaacactacaaaagtgccccagtacagagccagaggagaagggcaatatcgtggaggaacagccccagaaaaacacaaccgagaagcttggggttagtgcacccacaatcccggtgcgcagaagactggcatgggacactgaaaatactagcgaggacgttcaaaaacagccaggcgaaaaggaggaggaggacgataatgaagaggaaggcgaccgcaagacaggcaaacaggccttcatgggcgagcaagaaaaactcgatgtgcgtgagaagagtaaagccgataaaatgaaagaagggtccgattccagcgtcagttctgagaaagggggtcgattgcctactccaaaactgcgggaactgggcggcatacaaagaacacatcacgaccttacaactccagccgttggtggcgccgtactggtcagtccgagcaaaatgaaacctccagctccggaacagaggaagaggatgactagccaagattgtctagagacctcaaaaaacgattttaccaagaaggaatcccgagcagtttccctgcttacatcacccgcggccggtatcaaaacagtcgatcctttacccctgagagaggattctgaggataacattcataaatttgccgaggctaccctgccagtcagcaagatccccaaatacccaacaaatccccccgggcaattacccagtccccctcacgtgcctagttactggcatccctcgaggaggatccagggcagtctgcgggatcccgaattccaacacaacgtggggaaggctcgaatgaacaaccttcagttgccacagcatgaagcctttaatgatgaagatgaagaccggctttcggagatcagcgcccgaagcgcagcctcttcccttcgcgcgtttcaaactctcgcacgcgctaagaaacgaaaagaaaacttttggggcaaaacctag

SEQ ID NO: 123583 - DNA, 210 bp, Artificial Sequence
  Description of Artificial Sequence: Synthetic coding sequence
atgcccgtgcgttttaaggggctctccgaataccagcgcaactttctatggaaaaaaagttatttgagcgagtcatgcaactcatctgttgggagaaagtatccctgggccggtctgcgctccgaccagctaggaaaccagggtcgttgtagaacaaaaatccagcacagcgacatcagcagcttactgatcttggtttgttctacatag

SEQ ID NO: 123584 - DNA, 669 bp, Artificial Sequence
  Description of Artificial Sequence: Synthetic coding sequence
atgcctgtccggttcaaggggctgtctgagtaccagagaaattttctgtggaagaaatcatatttatccgagtcttgcaacagctctgtggggcggaagtatccctgggccgggctgaggtcagatcagctggggattaccaaggaaccctctttcatttctaaaaggcgagtcccttatcatgacccccaaattagtaagagtctcgaatggaatggggctatctccgagtccaacgtcgtggccagccccgaacctgaagcgccggagactccaaaatcacaggaagcagagcagaaggacgtgacccaggagcgggtacacagtcttgaagcgagccgagtgcccaagcgaacacgatctcactccgcagacagcagagcggaaggggcgagcgatgtggaaaacaatgagggcgtcacaaaccacacacccgtaaacgagaatgttgagctcgaacactcgacaaaggtgctgtctgagaacgtcgataacggcgtcgggattttcaccgcatttctgttcaagtccattgagttttttatcggattcatcgtcatcagcgtaatactccacttcgttttccagaacttcccactgctttttagttgtcttatgtctatcaggatagtcgacaatcgcttgctgacactggtaattgtgaactag

SEQ ID NO: 123585 - DNA, 2040 bp, Artificial Sequence
  Description of Artificial Sequence: Synthetic coding sequence
atgccagtgcgcttcaagggcctttctgagtaccagaggaactttctgtggaagaaatcttacctgtcagaatcctgcaattcatcagtcgggagaaaatatccttgggccgggctgcgatcagatcagttaggcataaccaaggagcctagcttcatatcaaagcgacgcgtgccgtaccacgacccacaaatctctaagtcactggaatggaacggcgcaatctccgaaagtaacgtcgttgcaagtcctgagccggaggcccccgagacccccaagtcacaggaggccgaacagaaagacgttacccaggaacgggtgcactcattagaggcttccagagttcccaaaagaaccaggtcacactctgccgatagcagggctgaaggggcctcggatgtagagaacaacgagggtgtgaccaaccacaccccagtgaatgagaacgttgagttggaacatagtacaaaagtcctgtccgaaaacgtggacaacggcgtctttcataacaagagccagtttgtcccccctttcaagggcaatagcgtcatccacgagacagagtataagcgaaatttcaagggactgagcccagttaaagagcctaagctccgcaatgatttgcgagaaaatagaaatttggaaacggtgagtcctgagagaaaaagtaataaaatcgatgaccggctaaaactcgaggcagaaatggagctgaaagacctgcatcagcctaaacgaaagcttaccccatggaagcatcagaggctggggaaagttaactccgagtatcgcgcaaagttcctcagtcccgcacagtacctgtacaaggctggggcatggactcacgtgaaggggaatatgcccaaccaagggtcgctgaatgctatgtggtatgctgaggttaaggagctgagagagaaggctgagttctacaggaaacgcgtccagggcacgcatttcagtcgcgaccatctcaatcagatactgtcagactccaattgctgctgggatgtctcatcaactaccagttccgaaggcacagtctcaagtaacataagagccctggacctggccggcgacccgacttcgcataaaactcttcaaaagtgccccagcacggagccggaagagaaagggaacatagtggaagagcagccccagaaaaatacaaccgagaagctgggggtctcagcacctacgattcccgttcggaggagattggcctgggacacggaaaacacctccgaggacgtgcagaagcagccgggagagaaagaggaggaggacgacaatgaggaggaaggcgatagaaagaccggaaagcaagcattcatgggcgaacaggagaaactcgacgtgagggaaaaatccaaggccgacaaaatgaaggaagggtcggactcgagtgtctcatccgagaagggaggtcggctgccaactcccaaactccgcgaactgggtggtatccaaaggacccaccatgacctgacaaccccggcagtgggaggggccgtcctggtttcacctagtaagatgaaacctcctgccccagagcagaggaagagaatgactagccaggactgcctggaaactagcaagaatgattttacgaagaaggaatcccgtgcagtaagcctcctaacgtcaccggcagccggtatcaaaacagtggatcctctccctcttcgggaagactctgaagataacatccacaagtttgccgaggccaccctgccagtcagcaagattcctaaataccctaccaatcctccaggacagttgccctcacctccacatgtgccaagctattggcatccttcaaggaggatacaagggtccctgagggatcctgaattccaacataatgtcggtaaggctcggatgaacaatctacagttgcctcagcatgaggcttttaatgacgaggacgaggaccgcctgagcgagatttctgccagaagcgctgcctcctctctgcgagccttccagacccttgccagagcgaagaagcggaaggaaaatttctggggtaaaacctag

SEQ ID NO: 123586 - DNA, 2715 bp, Artificial Sequence
  Description of Artificial Sequence: Synthetic coding sequence
atggaccgctatctcctactggtgatctggggagagggcaagtttccaagcgcggcctcaagggaagcagagcatggccctgaggtgtctagcggggagggcacagagaatcaaccagatttcaccgccgcaaacgtgtatcacctgctgaaaagaagcatatccgcaagtatcaaccctgaggatagtacatttcctgcgtgttccgtgggggggatacctgggtccaagaagtggttttttgctgtgcaggccatttacggtttctatcagttttgctctagcgactggcaggaaatacatttcgacacagagaaggacaaaattgaagacgtcctccagacaaacattgaggagtgtcttggcgccgtagagtgttttgaggaggaagactcaaacagtagggaatcgttgtcactcgcagacctgtacgaagaagcagccgagaacttgcaccaactgagcgataagcttccagcccccggacgcgccatggtggatattatcttactgttgtcagataaggatccgcctaagttgaaagactacttacctaccgtcggcgcgctgaaacacctcagagaatggtatagcgcgaaaatcacaatagccggtaatcactgcgagattaactgtcagaaaatcgctgaatatcttagcgccaatgtcgtgtccctcgaggacctgaggaatgtcatcgacagtaaggagctatggaggggcaaaatccaaatttgggagcgcaagtttggattcgagatttcgttcccggagttttgcctgaagggtgttactctgaagaacttctccaccagtaacctaaatactgacttcttggcaaaaaaaatcatccccagcaaggacaaaaacattctacctaaggtgttccactattacggacctgcccttgaatttgtgcagatgattaagctgtccgacttgccgtcgtgttatatgtcagacatcgaatttgagcttggccttacaaactctactaaacagaactccgtgttgctcctggagcagattagctctctgtgcagtaaagttggagctctctttgtactgccctgcacaatctccaacatccttattcccccacccaaccaactcagttcacggaagtggaaggaatacatcgccaagaaacctaaaaccatctctgttccagacgtcgaggtcaagggtgagtgtagctcatattacctgcttcttcagggcaacggtaatcggagatgtaaggcaaccctaatccacagcgccaaccaaatcaacggaagcttcgccttgaacttgatacacggtaagatgaaaactaagactgaggaagccaaactctcctttccttttgatctgctgagccttcctcactttagtggcgagcagatcgttcagcgggagaaacaactggctaacgtgcaggttttggccctggaggagtgccttaagcgcaggaagttggccaagcaaccagagacagtctcagttgccgagctcaagagcctgctcgtattaacccgaaagcacttcctcgattattttgatgcggtaatccccaaaatgatcctgcggaaaatggacaagatcaagacgtttaatatactgaatgattttagccccgtggaacccaactcgtccagccttatggagactaatcccttagaatggcccgaacgccatgtgctgcaaaatctggagaccttcgaaaaaacgaaacagaagatgagaaccgggtcgctgcctcactcctccgaacaacttctgggacacaaggaaggtccgagagactctatcaccctcctggatgccaaggaactcctcaagtacttcacctcagatggacttccgattggcgatctgcagcccctcccaattcagaagggcgagaagacatttgtcctaacccctgagctgtcaccaggaaagctccaggtactcccatttgagaaggcatccgtgtgccattaccacggtatagaatattgcctagacgaccgaaaagccctggagcgggacgggggcttttctgagctgcagagtaggctgattcgctatgaaacccaaacaacctgcactagagagtccttccccgtgccaacagtcttaagcccactgccctccccagtggttagcagcgacccaggatcagtgcccgacggagaagtcctgcaaaatgagttgagaactgaagtgagccgacttaagaggcggtctaaggacctcaactgtttatacccccggaaaaggctagtcaagtctgaatcttctgaaagtttactctctcagacgaccggcaacagtaaccattaccatcaccatgtgaccagccggaagcctcaaaccgagaggtcattgcctgtcacttgcccactggttcctataccttcctgtgagaccccaaagcttgctacgaaaacgagctctgggcagaaatccatgcacgaaagcaaaacgagccgccagattaaagaaagtcggagtcagaaacacacacgcatacttaaggaagtcgtcactgagaccctgaaaaagcactctataactgagacacatgagtgctttacagcttgctcccagcggctgtttgagatatctaaattttacctaaaggacttgaagactagccgcggcctatttgaagagatgaaaaaaaccgctaataacaacgccgtgcaggttattgattgggtgctggaaaagacttccaagaaatag

SEQ ID NO: 123587 - DNA, 1374 bp, Artificial Sequence
  Description of Artificial Sequence: Synthetic coding sequence
tgaatggcggaaaccgtctggagcacagacactggcgaagccgtgtatcggtctcgcgaccccgtgaggaacttgaggctcagggtgcatctgcagcgtattacatcctccaacttcttacattaccagccagcagccgagctcggcaaggatttaatcgacctcgcgacatttagaccacagcccactgcctcggggcaccgaccagaggaggacgaagaggaggagattgttatcggatggcaggagaaattgttcagtcaatttgaagtggacctgtatcagaatgaaacagcctgtcagtcaccactcgactatcagtatcgtcaggagatcctgaaacttgagaatagtgggggcaagaagaatcggaggatcttcacatacacggattctgatcggtataccaacctagaagaacattgccaacgaatgactaccgccgctagtgaggttccatcctttctggtagagaggatggctaacgtgaggcggcgtaggcaagacagacggggaatggagggtggcattctcaaatctaggatcgtgacttgggagccctcagaggaattcgtaaggaataaccatgtaatcaacacgccactccaaaccatgcatatcatggccgatttaggaccatataagaagctgggatacaagaagtatgaacacgtgctctgcacactgaaggtggactctaatggcgttataactgtgaagcctgactttaccgggcttaaggggccctatcgaatcgagacagaaggcgagaagcaggaactgtggaaatatacaattgataacgtgagcccgcatgcccagcccgaggaggaagaacgagagcgccgcgtgttcaaggacctgtatggacggcataaggaatatctgtctagcctggtcggtactgactttgaaatgaccgtcccaggagcacttcgcctctttgtgaatggcgaggtggtgtctgcccaagggtatgaatatgataatctgtatgtccacttcttcgtagaactccccaccgcccattggagttctcctgcctttcaacagctctccggggtaacccagacatgtactacaaaatccctggcaatggataaggtggcacacttttcttatcccttcaccttcgaagctttttttctgcatgaggacgagtctagcgacgctctgcctgaatggccagtgctctactgtgaggtgctttctttggacttctggcagcgctaccgagtggagggctatggtgctgtcgttcttccagcaacaccaggcccttcttggaaccgtgcaccatttagaaaaggctgcggagtgtgttggacagtgtggaagggatctgcgtcgcgtgtgccattcaccatgtgttag

SEQ ID NO: 123588 - DNA, 1566 bp, Artificial Sequence
  Description of Artificial Sequence: Synthetic coding sequence
atggccgagactgtgtggagtaccgataccggggaggctgtatacaggtcccgagaccccgttcgtaaccttaggctcagagttcaccttcaaagaattaccagctcaaattttcttcactatcagcctgctgctgagctgggtaaggatttgatagacttagctaccttcagaccacaacccaccgccagcggccacagacccgaggaggatgaagaggaggaaatcgtgatcggttggcaggaaaagctctttagccagttcgaagttgacctgtaccagaacgagacagcttgtcaaagtccattagactatcagtaccgccaggaaatcctgaagttggagaactctgggggcaaaaaaaatcgtagaattttcacttatactgactcagatcgctatacaaatctggaagagcactgtcaacgcatgaccacagcagcttcagaggtgccaagctttctggttgagcggatggcgaacgtgaggcgaagacggcaggatagacgagggatggagggtggcattctgaagagccgcattgtgacatgggaaccatctgaggagtttgtgcggaacaaccatgtgattaacacgcctctacaaaccatgcatatcatggcagatcttgggccctacaagaagctcggatacaagaagtacgaacacgtgctgtgcactctgaaagtggactccaacggagtgattaccgtcaaaccggacttcaccggtttgaaaggtccctaccgaatcgagactgagggagaaaaacaggagctgtggaaatacaccatagataatgtcagcccacacgcccagccagaggaggaagagcgcgagcgccgagtctttaaggacctctacggcagacacaaggagtacctttcctcgctggtcgggaccgatttcgaaatgactgtgccgggtgccctccgcctttttgtcaatggtgaggtggtgtcagcccagggatacgaatatgacaatctctatgtgcattttttcgtggaattgcctacagcacactggtctagccctgctttccagcagctgagcggagtaacgcagacctgtaccaccaagtctttggccatggacaaagtggcgcacttctcttacccgtttaccttcgaagctttcttcctgcacgaggacgagagtagtgatgccctgccagaatggccagtgttgtactgtgaggttctgagcttggatttctggcaacgctaccgcgtggaggggtacggggcagtagtgctccccgctacccctggttcccatacactcacggtatccacctggcgccccgtggagctcggcactgtggcggaactgaggcgcttcttcattggcggatcccttgaattagaagacctatcttatgtcagaattccaggttcgttcaaggccctcttaagctcaagtaagaccaaggaagggcgtaaagtggacggggagcgagtgctgaatccgcagcctgtcagcctctccctattccctggtaagcctcactccaccgcttggggccttttacgcctaaggtacgaactgtttttatcgaaatag

SEQ ID NO: 123589 - DNA, 1680 bp, Artificial Sequence
  Description of Artificial Sequence: Synthetic coding sequence
atggcagaaaccgtttggtctaccgataccggagaagccgtgtacaggtccagggacccagtgaggaatctccgcctccgagtccacctacagcgcataacgtcctccaattttctacactaccaacctgcagctgaactggggaaagatctcattgacctagctaccttccgtcctcaaccaacagcctccggccatcgcccagaagaggatgaagaagaggaaattgttatcggatggcaagaaaagctattttctcaattcgaggtggacctttaccagaatgagaccgcgtgtcaaagccctctggattaccagtaccgacaagagatcctgaagctggagaacagcggaggaaaaaagaaccgtcggatctttacctatacagatagtgataggtacacgaacctggaggagcattgccagcgaatgactacggctgcatcagaggtgccctcctttctggttgaaagaatggcgaacgtgagaagaaggcgacaagaccggcgtgggatggaaggaggtatccttaaatcccggattgtgacttgggaaccatcagaagagttcgttcgtaataaccacgtgattaacacgcctctgcagactatgcacataatggccgatctgggaccatacaaaaaactcgggtacaagaaatatgagcatgtcctttgtactctgaaggtcgactcaaatggcgtgattactgtgaaacctgatttcactgggttaaaggggccttatcgcatagaaactgagggcgaaaagcaggagctgtggaaatatactatcgacaacgttagccctcatgcccagcctgaagaggaggagcgggagaggagagttttcaaagacctctatggaagacataaggaatatcttagttccctggtggggactgacttcgaaatgacggtccctggagccctgcgcctgtttgtgaatggcgaagtggtgagtgcccagggatacgagtatgataatctgtatgtgcatttcttcgtggagcttcctaccgcgcactggtcctcacctgcattccagcagctgagcggtgtcactcagacctgtactacaaagagtctggcgatggacaaggtggcacacttttcctacccattcacatttgaagccttctttctacacgaggacgagtcctctgacgccctccccgagtggcctgtgctgtactgcgaggtgctgtccctggatttttggcagcggtatagggtcgaaggctatggcgccgtcgttcttcccgccaccccgggctcgcacactttgaccgtgtccacatggagaccagttgaactgggcacagtcgccgaactgagaagattttttatcggcggctcccttgagttggaggatctgtcatatgtgaggatcccaggctcctttaaaggcgagagactgtctcgattcgggctgcgaaccgagacaaccggcaccgttacttttcggttgcattgcctgcagcagtcgcgggcattcatggagtctagctcccttcagaagaggatgcgcagcgtcttagatcggctggagggcttcagtcagcaatcctctatccacaatgtacttgaggcctttcgaagagcgcggcgacggatgcaggaggcacgtgagagcctgccacaagaccttgtttctccatctggtaccctggtgagctag

SEQ ID NO: 123590 - DNA, 1563 bp, Artificial Sequence
  Description of Artificial Sequence: Synthetic coding sequence
atggccgagactgtctggagtacagacacgggggaggccgtgtatcgctctagagatccggtgcggaatctccgccttcgtgtgcacttgcagcgcataacatcttcaaactttctccattatcaaccggctgccgaattgggtaaagacctcatcgacctggccacttttcgcccccagccaaccgcctccggtcacagacccgaggaagatgaagaggaagagattgtaatcggatggcaagagaaactgttctcccaatttgaggtggatctctatcagaacgaaacagcttgtcagtcacccttggattaccagtaccggcaagagatcctcaaactagagaattccggcgggaagaagaaccgcaggatctttacttatacagacagcgacaggtatactaatctcgaggaacattgtcaacgcatgacgaccgcagcatctgaggtaccatctttccttgttgaacgcatggccaatgttcgcaggaggcgacaggacagacggggtatggagggcgggatactgaagagtcggattgtgacttgggagccttctgaagagtttgtgaggaataatcacgtcattaatactcctttgcagactatgcatataatggcagacctgggaccctataaaaaactgggttataaaaagtacgaacacgtactttgtaccctgaaagtggactccaatggagtaatcaccgtcaagccagacttcacagggctgaagggaccatataggatagagactgagggcgaaaagcaggagttatggaaatacactattgataatgtatcccctcacgcccagccagaggaagaagaacgcgaacgccgggtattcaaggatctctacgggcggcataaagagtatttgtcctccctggtgggaactgactttgagatgaccgttccaggagcactgagactgttcgtgaacggcgaagtggtaagtgcccaagggtacgagtacgataatttgtacgtgcacttctttgtggaattaccaactgcacattggagttcaccagcattccagcagctgagcggggtgactcagacctgtactaccaagtccttggctatggataaggtcgcccacttttcttacccattcactttcgaggctttttttcttcacgaggacgaaagctccgatgcccttcccgagtggcccgtgctctattgcgaggtgctttccctggacttttggcaacgttaccgtgtggaaggctacggggcagtggtcctgcccgcaacaccaggatctcatacactgactgttagcacatggaggccagtcgagctgggcacagtggcagagctgaggagatttttcatcggaggatctctggaactggaagatctctcctatgttagaatccctggaagcttcaaagggttgtctagtagtaaaacgaaagagggtagaaaagtggacggagaaagagtactgaatcctcagccagttagcctgtccctttttcctggcaagccccacagtaccgcctggggcctgcttaggctgcggtacgaactgttcttgagcaaatag

SEQ ID NO: 123591 - DNA, 1650 bp, Artificial Sequence
  Description of Artificial Sequence: Synthetic coding sequence
atggccgtacccgtctctagctttgctcaacgtacccggtccaggttcagagtccatctgcagcggataactagtagtaatttcctgcactaccagccagcagccgaactgggcaaggatctgattgacttagcaaccttccgcccacagcctacagccagcggccacaggcctgaggaggatgaggaggaggaaatcgtcatcggttggcaagagaagctgttcagccagttcgaggtggacttataccagaacgaaaccgcttgccagagccctttagactaccagtacagacaggaaatcctcaaattggaaaactccggagggaagaaaaaccgcaggatctttacctatacagattccgatcggtatactaacctggaagaacattgccagaggatgactacggcagcttcagaggtgccgtccttcttagtggaacgcatggccaatgtgcggcgtaggagacaggatcggagggggatggaggggggcatactgaagtcccgaattgttacgtgggaaccaagcgaggagttcgtaaggaacaatcacgtcatcaatacccctttacagactatgcacattatggctgaccttgggccctataagaagctggggtacaaaaaatatgaacatgttctctgtaccttaaaggtggatagcaacggagtcatcacagttaaacccgattttactgggctgaagggcccgtatcgtattgagactgaaggggaaaaacaggagctgtggaagtacaccatcgacaatgtgagcccccacgcgcagccggaagaggaggaacgggagcgccgggtgtttaaagacctctatggacgtcacaaggaatacctaagcagcctcgtcggtactgactttgaaatgaccgtgccaggagcattgcgcttgtttgtgaacggcgaggtagtttccgcacaaggctacgagtatgacaacctgtatgttcacttcttcgtcgaactaccgacagctcactggtcttccccagcatttcagcagctttcaggagttactcagacatgcacaaccaaatctctggccatggacaaggtcgcccatttctcttatccctttacgttcgaggcctttttcctccatgaggatgaaagcagcgacgcgctgcctgagtggccagtactatactgcgaggtccttagtctggatttttggcagcggtacagagtggaaggctacggcgctgttgtactcccagccacacctggcagccacactttaacggtttctacctggaggcccgtcgagctcgggacggtcgcagagctcagaaggtttttcattggtggctctctggagttagaggatctctcctacgtgcgaattcccggatcttttaagggagagcggctgagtcgatttgggctgcgaacagagacgactggcaccgtgacatttagactgcattgtcttcagcagtctcgggcctttatggagagtagctccttgcagaagcggatgcgatccgtcctcgatcggctcgagggtttcagccagcaatctagcatccataatgtgctggaagccttcagacgcgctcgtcgaaggatgcaggaagcccgagagtctctcccacaggatctggtctccccatcagggacactcgtttcgtag

SEQ ID NO: 123592 - DNA, 1071 bp, Artificial Sequence
  Description of Artificial Sequence: Synthetic coding sequence
atgcatatcatggccgacctgggtccctataagaagttagggtataaaaagtatgaacacgtgctgtgtactctaaaagttgactctaacggggtgattacagttaaacccgacttcaccggccttaagggcccctatcggatcgagaccgaaggtgaaaagcaggaactctggaagtacaccatcgacaatgtaagcccccacgctcagcccgaagaagaagagcgggagcggagagttttcaaggacttgtacgggcggcacaaggagtaccttagtagtttagttggtacagacttcgagatgacagttcccggtgccctccgtctgtttgtcaatggagaggtggtatccgctcaggggtacgaatacgacaatctgtacgtacatttcttcgtggaactgcccactgcgcattggtctagcccggccttccagcagttaagtggggtaacccaaacatgtacaaccaagtctctagccatggacaaggtagcacacttctcttaccctttcacattcgaagcattcttcctgcacgaagatgagagtagtgatgccctccccgagtggccagtcctgtactgcgaagttttgagtctggacttctggcagcggtaccgcgtagaaggttacggcgctgtagtgctccccgccacccctgggtcacacacactgactgtgtctacttggagacccgttgaactcggcactgtggccgagttacgacgcttcttcatcggtggatcactcgagcttgaggatctgagttacgtgcgcatcccaggttcattcaaaggcgagcgcttatcccggttcgggcttagaacagaaacgacaggcacggtcacatttaggctgcactgtttgcagcagtcgagggcttttatggaaagtagctccttgcagaagcggatgcggtcagtgctcgaccggctcgagggcttctcacagcagagtagtattcacaatgtccttgaggcctttcggcgggcaagacgcagaatgcaagaagcccgggaaagcctccctcaagacctcgtgtccccctccggcacattggtttcctag

SEQ ID NO: 123593 - DNA, 4746 bp, Artificial Sequence
  Description of Artificial Sequence: Synthetic coding sequence
atgaaagcccagggtgagaccgaggaaagcgagaaactgtccaagatgtccagcctactggaacgactgcacgccaagttcaaccaaaacagaccttggtcagagacaatcaagctagttagacaagttatggagaaaagagtcgtcatgtcctccgggggccaccagcacctagtcagctgtctggaaacactgcaaaaggcacttaaggtgacttccttgccggcgatgaccgatcggttggaatctatcgctcgccagaacggcctgggatctcacctcagcgcgtccggtaccgagtgttatatcacttcagacatgttctacgtggaagtgcagctggacccagccggccaactttgcgatgttaaggtcgcacaccatggagagaatcctgtgtcctgcccagaactggttcagcaactgcgcgaaaaaaattttgacgaatttagtaagcatttgaagggcctagtgaacctttataacctgccgggcgataacaagctcaaaaccaagatgtacttagccctgcagagcctggagcaggatttaagcaaaatggccatcatgtactggaaggccactaatgccggaccattggacaagatcttgcacggttccgtagggtatctcacccccaggtcaggtgggcacctgatgaaccttaaatattatgtgagccctagtgatctgctcgacgacaagactgcgagtcctattattctgcacgagaataatgtctctcgcagtctgggaatgaacgcctccgtgaccatcgagggaacctcagctgtttataaactccccatcgcaccactgatcatgggatcacacccagtagataacaagtggacgccatccttttctagtatcacatcagccaatagtgttgatttacccgcctgcttcttccttaagtttcctcagcctattcccgttagtcgggccttcgtccaaaaattgcagaattgtaccggaatccccctctttgaaactcagcccacttatgctcccctttacgaactcattacccagtttgagctgagcaaggatccagatccaattccccttaaccataatatgagattctatgccgcactccctgggcagcaacactgctatttcctgaacaaggatgcacctttacccgatggaagatctttgcagggcactctggtgtctaagatcacctttcagcaccccggtagagtccccctgatcctgaacctgataagacaccaagtggcttacaatacgcttattggatcctgtgtgaagaggactattctgaaagaagattctccgggtctgttgcagtttgaagtgtgtcccctttccgaatctcgtttttcagtcagctttcaacacccagtgaatgattccctcgtgtgtgtggttatggatgtgcaggatagcacccatgtttcttgcaagctctataaaggcctgtctgatgccctaatttgtaccgatgactttattgccaaggtcgtgcagcgatgtatgagcatcccggtgacgatgagggccattaggaggaaagctgaaactatccaggcagataccccagctcttagcctgatcgccgagactgtggaagatatggttaagaagaacctgccgccagcctcctctccgggctacgggatgaccacaggcaacaaccccatgtctggaaccacaacacccaccaataccttccctggtgggccaattaccacattgttcaatatgtcaatgagtataaaggatcggcacgagagcgtcggccatggggaggacttttccaaggtgtcccagaacccaatcctgacctcactgctgcaaattaccggcaacggcggtagcactattggttcctcccccacccctccgcaccatacacctcctcccgtgtcctcaatggctggcaacacaaaaaaccaccctatgcttatgaatctgctcaaagacaatcctgcgcaggattttagtacactgtacggctccagtcccctggagcggcagaattcttcaagtggctccccacgcatggagatctgcagcggctctaacaagactaagaaaaaaaagagctcgaggctccccccagagaagcctaagcaccagaccgaagacgatttccagagagaactgttctcaatggatgtcgattcccagaatccaatcttcgacgttaatatgactgccgataccctggacaccccacacattactccggcccccagtcagtgcagtacccctcccacgacttacccacagccggtcccccatcctcagccctcgatccagagaatggtccggctgagcagttcagactctatcggacccgacgtgacagatatcctatctgatattgctgaggaagcctcaaagcttccatcaacctccgacgattgtcccgccatcggaactcctctcagagacagctccagcagtggccattcacagtcgacactgtttgattccgatgtctttcaaactaataataacgaaaatccttatacagacccagccgacttgatcgctgacgctgctggtagcccatccagcgactccccgacgaaccactttttccacgatggggtggatttcaatcccgacttactgaattcccagagtcagtccggtttcggtgaggagtactttgatgagtctagccaaagcggagataatgatgactttaagggctttgcctcgcaggccttgaacaccctgggagtgccaatgctaggtggtgacaatggagagacgaagttcaagggaaacaatcaggctgacaccgtggacttttccatcattagcgtcgctggtaaagctctggccccagccgacctgatggaacatcactctggtagccaaggacctctcttaacgactggtgacttagggaaggagaaaacacagaagagggtgaaggaaggaaacggcacttcaaattccacgttaagcggtcccgggctcgatagtaagcccggtaagcggagccggacaccatccaatgatggaaaatccaaggacaagcctcctaagaggaagaaagctgatacagaaggaaagtctccctctcattcatctagcaaccggccattcactccccctaccagcacaggggggtccaaatcccctggctccgccggacgctctcaaacacctcctggggtggccaccccaccaatcccaaagataactatacagatccctaaaggcactgtgatggttgggaagcctagcagccactctcaatatacatcatccgggtcagtctccagctctggttctaaaagccaccacagtcatagcagctcttccagcagcagcgcttcaacgagtgggaaaatgaaatcttctaagagcgaaggctcatccagctctaagttatcgagcagcatgtattcctcgcaaggtagtagtgggagttcacaatctaaaaatagctctcagtctggtggaaagcctggaagctctccaattaccaagcacggcctgtcctctggcagctcatctactaaaatgaagccacaggggaagccatcatcgctaatgaacccctctttgagcaagcccaatattagtcccagtcatagcagacctccggggggcagtgataagctcgcttcccctatgaagcctgtgcccggaacgccccctagctcgaaagccaaaagccccattagctctggaagcggcggtagccacatgagcggcacgtcaagctcctctggtatgaaaagcagcagcggtttggggagctctggctccttgagtcagaaaaccccaccttcgtccaattcatgtaccgcgtcatcaagcagtttctcctcaagtgggtcctccatgtcatcttcacagaaccagcacggctccagcaaaggaaagtcaccctctagaaataaaaaaccatctctaaccgctgtcattgacaaactgaaacatggggtcgtgaccagcggtcccggcggggaggacccgcttgacggccaaatgggcgttagcacaaactcaagctcccaccccatgagtagtaaacacaacatgtcggggggggagttccagggtaagagagaaaaatcggataaggataagtcaaaggtgagcacctctgggtcctccgtcgactcctctaaaaaaacgtcagaatcaaagaacgttggcagcacaggtgtggctaagatcatcatcagcaagcatgacggtggctcgccctcgattaaggccaaagtgaccttgcagaagcccggagagtcctctggagaagggctgcgtccccagatggctagttccaagaactacggtagtcccctcattagcggtagcacacctaagcatgaacggggtagcccttcccactccaagtctccggcctatactccacagaatctggattcagaatctgagagtgggagttctatagctgagaagagttaccagaactctccgtccagcgacgatggaattagacctcttcctgagtacagcaccgaaaaacataagaaacacaagaaagagaagaagaaggtgaaggacaaggatcgcgatagggacagggacaaagaccgggataaaaagaaaagccattctataaaaccagagtcgtggtccaagagtcccatttctagcgaccagtcactgtctatgacatcaaatacgatcctgtcagctgataggccaagcagactatctcctgactttatgatcggtgaagaggacgacgatctgatggacgtggcacttatcggaaactag

SEQ ID NO: 123594 - DNA, 1671 bp, Artificial Sequence
  Description of Artificial Sequence: Synthetic coding sequence
atgaaggcacagggggagacagaggagagcgagaaactatccaaaatgtcgagcctgctggaaagactgcacgccaagttcaaccagaaccggccttggtctgagaccataaagctcgtaagacaggtgatggagaaacgagtagtcatgagttccgggggacatcagcacctggtgagctgcttggaaactctgcagaaagctttgaaggtaacatcattgcctgccatgacagatcgccttgagtcgattgcacgccagaacggcctaggatcccatcttagtgcctctgggacggaatgttacatcacctccgacatgttttacgtggaggtgcagctggatcctgccggacagttgtgtgatgtaaaggtggcgcatcacggcgaaaaccctgttagttgtcccgagcttgtgcagcaactgcgggaaaagaattttgatgagttctccaaacacttgaaagggttagttaacctgtacaatcttcctggcgataacaagcttaaaacgaagatgtacttggcccttcagtccctggaacaagacctcagcaaaatggccatcatgtattggaaagccaccaacgctggcccactcgataaaatcttacacggaagtgtggggtaccttacccctagaagcggcgggcacctcatgaacctgaaatattatgtttcgccttctgatctcctagatgataaaactgcgtcacctatcatcctgcacgagaataatgtttcccggtccctaggtatgaacgcgagcgtcaccattgaggggacaagcgcagtctacaagctgcccatcgctcctctaattatgggctctcatccagtcgataataaatggaccccctctttcagcagtattacttcagccaatagcgtcgacctcccggcttgtttttttctgaagttcccacaaccgattcccgtgtctcgtgcgttcgtccagaagctgcaaaattgcactgggatcccactgtttgagacgcagcccacctacgcacctttatatgaactaatcacacagttcgagttgtccaaggatcctgaccccatacctctgaatcacaatatgaggttctacgctgctctgcccggtcagcaacattgctactttcttaataaggacgcccccctgccagacgggaggtctctgcagggaactctggtaagcaagatcacgttccagcatcctggaagagtgccattgatcctcaacttgattagacaccaggtggcctataatacactaatcgggtcatgcgttaaaaggactatcctcaaggaagacagccctggccttctgcaattcgaggtctgccccctctctgaatcccgattcagcgtgtcatttcagcaccctgtgaacgattctctcgtttgcgttgtgatggatgtccaagacagtacccatgtatcctgtaagttatacaagggattaagcgacgcgctgatctgcactgacgatttcattgcaaaggtagtccagaggtgtatgtcaatccctgtgacaatgagggcaatcagaaggaaagcggaaacgatacaggcggatactccagcgctgagtttgattgctgaaacagtggaggacatggtcaagaagaatctgccacctgccagcagtcccggaagcaaaaaccctgagttggggagcggctag

SEQ ID NO: 123595 - DNA, 408 bp, Artificial Sequence
  Description of Artificial Sequence: Synthetic coding sequence
atggcagaaaagtttgaccacctggaagagcatttagagaagtttgtggagaacatcaggcagctggggattattgtgagtgatttccagcccagcagccaagccggtttgaatcagaaactcaatttcattgtaacaggactccaggacatagacaagtgtagacagcaactccacgacatcacagtgcccctggaagtttttgagtacatcgaccaggggcgcaatccccagctttacacgaaggagtgccttgaacgggcattggctaaaaacgagcaagtaaagggaaagattgacaccatgaaaaaattcaagagtctgttgatccaagaactctctaaggtattccccgaggatatggcaaagtacaggtcaatccgaggagaagatcatccaccgtcgtag

SEQ ID NO: 123596 - DNA, 354 bp, Artificial Sequence
  Description of Artificial Sequence: Synthetic coding sequence
atggctacttattctctggctaatgagcggctgagggctttagaggatatcgagagggagattggcgcaatcctgcagaacgccggcacagtgattctcgagctctcgaaggagaagacaaacgaaagattgctggataggcaggccgccgcattcaccgctagtgtgcaacatgtcgaagcagagctatctgcccagataaggtacctgacccaagttgcaacaggtcaaccccacgagggaagttcctactcctcccggaaagattgccagatggctctgaagagggtagactatgctcggctcaagctgtcagacgtcgcccgtacgtgtgaacagatgcttgagaactag

SEQ ID NO: 123597 - DNA, 6543 bp, Artificial Sequence
  Description of Artificial Sequence: Synthetic coding sequence
atggctgcttttgggatattgagttacgaacaccgcccactaaagcggcccagactggggccaccagatgtgtacccgcaggatcccaagcagaaagaggacgagttaaccgccctcaatgtaaagcagggttttaataaccaacctgccgtctcaggggatgaacatggaagcgccaagaatgtctcatttaatccggccaagatttcctcaaacttttctagtattatagcagaaaaactaaggtgcaacacgctccctgacacaggacgaagaaaaccacaggtaaaccagaaagataatttttggctggtgaccgccagatctcagagcgctattaatacttggtttacagacctcgccggcaccaaacccctaacccaattggctaaaaaggttcctatcttcagcaagaaagaggaagtcttcggctacctcgcaaagtacaccgtgccagtgatgagggctgcctggcttatcaaaatgacttgcgcctattatgccgcaatcagtgagaccaaggtaaaaaagaggcatgttgatccttttatggagtggacacagatcatcacgaaatacctgtgggaacagctccagaaaatggctgagtattaccgcccagggccagccggcagtgggggctgcgggtctactattgggcccctcccccacgatgtggaagtggctattcggcagtgggattataccgaaaaactggcaatgttcatgttccaagacggcatgctcgatcgtcatgaattcttgacctgggtccttgagtgttttgaaaagatcagacctggggaggatgaattattaaaacttctgctgccactgcttctgagatactccggtgagtttgtgcagtcagcctacctgtcgcggcggcttgcatacttttgtacccgccggctggccttgcaacttgacggcgttagctctcactcttcccacgtcatcagcgctcaatcgacttctactctccccaccactccagcaccccagccccctactagctccacccctagcaccccctttagcgacctgttaatgtgtcctcagcatcggcctctggtgtttggtttaagttgcatcctgcagactatcctcctttgctgccccagcgcgctggtctggcattacagcctaactgactcccgcatcaaaacgggtagtcctctggaccacctgccaattgctccatccaaccttcccatgcctgagggcaattcagcctttacacaacaagtgagagccaaattgagagaaatcgagcagcagatcaaagaaagggggcaggctgtggaggttcgatggagttttgacaaatgccaagaggccacagctgggttcactattggcagggtgctgcatactctggaagtgcttgattcccacagcttcgagagatccgacttctcgaactcgcttgactcactctgtaaccgcatctttggcctggggccgagtaaagacggtcacgagatttctagtgatgacgacgcggtggtgtctctcctgtgtgaatgggcagtgagctgtaagcgcagcggacgacaccgcgcaatggtggtggctaaactgctggagaaacgccaggcggaaattgaggccgagcgctgcggagaatctgaggccgcagatgaaaagggcagcattgcttcagggtctctgagcgctccttccgcccccatcttccaggacgtgctgttacagtttcttgacacccaggctcctatgctgacagatcctcggtccgaatccgagagagtggaatttttcaatctggtcctgctattctgtgagctcatcagacacgatgtatttagccacaatatgtatacctgcacactcatctctagaggggatctggccttcggagcccctggacctaggcctccgtctccctttgacgatcctgccgacgaccccgagcacaaagaagctgaaggtagcagctcaagcaagctggaggatcccggcctgtctgaaagcatggatattgatccatcctcctctgtgctgtttgaggacatggaaaagcctgacttctctctctttagccccactatgccttgtgagggcaagggaagcccaagcccagagaaacctgacgtcgagaaggaagtcaaacccccacctaaggagaaaattgagggcacacttggggtcctttatgatcagcctcggcacgtgcaatacgcaacccacttccctatcccccaggaggagagttgttcacacgagtgcaatcagaggctggtggtcctatttggggtggggaaacagagggacgacgcgaggcacgccataaagaaaatcaccaaggacatcttgaaagtactgaaccgtaagggaaccgcagagaccgatcagctagctcccattgtcccactgaaccccggggacctgacattcctgggaggtgaggacggacagaaaaggcgacgaaatcggcccgaggccttccctactgccgaagacatctttgccaaatttcagcacctgtctcactacgaccagcatcaggtaacagctcaggtttctcgcaatgtgctggagcaaattacttcgtttgctttgggcatgagttaccacctgcccttggtccagcacgtgcaatttatctttgacctgatggagtactctttatcaatatccggcctcatcgactttgcaatccagctactgaacgagctgagcgtagtggaggccgagcttctgttgaagagcagcgatctcgtcgggtcctacaccacctccctgtgtctctgcatagtcgcagtgctgaggcattatcatgcctgcctgattttaaatcaggaccaaatggcacaggtcttcgagggattgtgtggtgtggtcaaacatggcatgaaccgttcagacgggtctagtgccgagagatgtattctggcctatctgtatgacctgtataccagttgttcacacctcaagaacaaattcggcgagctgttttccgacttttgttctaaggttaagaatactatctactgtaacgtcgaacctagcgaatcaaacatgcggtgggcccctgaatttatgatcgacactttggaaaatcctgctgcgcacacgtttacatatacgggcctgggtaagtcactctccgagaatcccgcgaaccggtatagtttcgtgtgtaacgccctgatgcacgtgtgcgtaggccaccacgatccagacagggtaaacgatatcgcaattttatgcgccgagctgaccggctactgtaaaagtctcagcgcggagtggctgggcgtcctgaaagccctttgctgtagctcaaataatgggacgtgcggctttaacgatctcctttgtaatgtcgatgtgagtgacctctcatttcacgacagtctagctacatttgtggccattctgattgcaaggcaatgtctgcttttggaggatctcattcggtgtgcggccatcccttccctgttgaacgccgcctgctcagaacaggattccgagccaggggcgcgcctcacatgccggatcctgctgcacctatttaagacgcctcagctcaacccctgtcagtccgatgggaataaacccacagtggggatcaggagctcttgcgaccggcacttactggctgcgtctcagaacaggattgtcgacggagccgtgttcgctgttctgaaggcagtgttcgtgcttggggatgcagaattaaagggcagtggcttcaccgtgaccggagggaccgaggaactgccagaagaggagggtgggggggggtctggcggtaggcgccagggcggaaggaacatctcagttgaaacggcttctctggatgtctatgccaagtacgttttacgatccatttgtcagcaggagtgggtgggagagcggtgtctgaagagcctgtgcgaggattccaacgacctccaagaccctgtgctgagcagtgcccaggctcagcgtctcatgcagctcatctgttaccctcaccgcttgctagataacgaggacggtgaaaacccccagcggcagcgcatcaaacgcatacttcagaaccttgatcagtggactatgaggcaatctagcctggagttgcaactcatgatcaaacaaacccccaacaacgagatgaattccctgctggagaacatcgccaaagcgactatcgaggtctttcagcagtccgctgagaccgggtcgtcaagcggatcaacagcctccaacatgcctagttcctcaaaaactaaacctgtattgtcctcgctggaaagatccggggtctggctggttgctcctcttatcgctaagctgccgacatccgtgcagggccacgtcttgaaggcagcgggtgaagagctagagaaagggcagcatctcggctcatcgtctcgaaaggaacgggatcgtcagaaacagaagtctatgtctctgctgtcccaacagcccttcctctcactggtgctgacctgtctgaagggccaagacgaacagagggagggcctgttgacatccctttactcacaggtgcaccaaattgtcaataactggcgggacgaccagtacttagacgattgcaagcctaaacagcttatgcatgaagccctgaagctgcgcctgaacttagtgggcggtatgttcgacaccgtccagcgtagcacgcaacaaaccacagaatgggccatgctcctgttggagattattatctccggtacggtcgatatgcaatcgaataatgagctatttactaccgttcttgatatgctaagcgttttaattaatggaaccctggccgccgacatgagctccatttctcaggggtctatggaagaaaacaaaagagcgtacatgaacctggctaagaagttgcagaaagagctgggtgagcgacaatctgatagtctagaaaaggtgagacagctgctacctctgccaaagcagactagggacgtaatcacttgtgagccgcaaggttcactcatcgataccaagggaaacaagattgccggtttcgacagtattttcaaaaaagagggcctccaggtgtcaacgaaacagaaaattagcccctgggacctctttgaaggtcttaagcctagcgcacctctctcttggggatggttcggtaccgtgcgtgtggaccgtcgggtggccagaggagaggagcaacagcgcctgctgctatatcacacccatcttagaccacgacccagagcttactacctggagcccctgccactccctcccgaggatgaagagcctcccgctccgaccctcttggagccagaaaaaaaggcgcctgagcctcctaaaactgacaagcccggcgctgctccaccaagcactgaagagcgcaagaagaaaagtaccaaaggcaaaaagagaagtcagccggccacaaagaccgaggattacggtatgggtccagggcgaagtggcccgtatggcgtcacagtgcctccagatctgctccaccacccgaatccaggctctatcacccatttgaactaccggcaaggttctatcgggttatatacacagaatcagcccttacccgccggaggacctagggtggacccttatagacctgtccgccttcctatgcagaagttgccaacaagacccacctaccccggtgtgctgcccaccaccatgaccggcgtaatgggactggaaccttcttcctataagaccagcgtctataggcaacagcagcctgcggtgcctcagggccagcgtcttcgccagcaactccaggccaaaattcaatcccagggaatgctagggcaaagtagcgtgcaccagatgacaccctctagctcatatgggctacagaccagccagggctacactccctacgtgtcacatgtgggcctccaacagcatacaggacccgccggtaccatggtgcctccctcatactctagccagccctaccagagtacacacccatctactaatcccacccttgtggatccaaccagacatctgcagcagcgccctagcggctacgtacatcagcaggctcccacgtatggtcacgggcttacgtctacacagaggtttagccaccaaaccctgcagcagacaccaatgataagcaccatgaccccgatgtctgcccagggggtccaggccggcgtcagatcaacggcaatcctgccggaacagcagcagcaacagcagcagcagcagcagcagcagcaacagcagcaacagcagcagcagcaacaacagcagcaacagtaccacattcggcaacagcagcaacaacaaatcctgcggcagcagcagcagcagcagcagcagcagcaacagcagcagcagcagcagcagcagcagcaacagcagcagcaacaacaacatcagcagcagcagcagcagcaggcggcaccgcctcaaccacaaccgcagtcacaacctcaattccagcggcaggggctccaacaaacccagcagcagcagcagactgctgcccttgtgcgccagttgcagcaacagctgtccaacacccaaccgcaaccatccaccaatatttttggcaggtactag

SEQ ID NO: 123598 - DNA, 6534 bp, Artificial Sequence
  Description of Artificial Sequence: Synthetic coding sequence
atggccgcattcggcatactctcctatgaacaccggcccctcaaaaggcctagactcggcccacctgatgtgtatcctcaggatcccaaacaaaaagaagacgagttgaccgccctgaacgtgaagcaggggttcaacaaccagccggcggtctctggggatgaacatggatccgctaagaatgtgagctttaatccggcaaagatctcttctaatttcagctcaattatcgccgaaaaactgagatgtaacaccctgccagatacaggccgaagaaagccccaggttaaccagaaggacaatttctggcttgtaactgctcgctctcagagcgcaatcaacacgtggtttaccgacttggctggaacaaagcccctgacccagctggccaagaaagtccctatcttcagcaaaaaggaggaagtgttcgggtatctggccaagtatacagtgcccgtgatgcgggccgcttggcttattaagatgacctgcgcctactatgctgccatctctgagaccaaggtgaagaagagacacgtagacccttttatggagtggacccaaatcatcactaagtatctgtgggagcagctgcagaagatggctgaatattatcgaccgggtcctgctggcagcggaggctgtggctcaacgatcggacctctgccccacgacgtggaagtcgccattagacagtgggattatacagaaaagctcgccatgttcatgtttcaggatggaatgttagaccgacatgagttcttgacttgggtgctggaatgctttgagaagattaggcccggcgaagatgagctgctaaagttgcttctcccactccttctgcgctactccggagagtttgtgcagtctgcatacctgtctcgcagacttgcttacttctgcacacgaaggttagccctccagttagacggtgtctccagtcattcctcccatgttatctccgcacaaagcacgtcaactttacctacaaccccagctccgcagccaccaaccagctccactccttcaacgcctttctccgatttgctcatgtgcccgcagcacaggcccctggtgtttggtttgtcatgtatcctccagacaatccttctctgctgtcccagtgccctggtgtggcactacagcctgaccgactcccgcatcaagaccggatcccctctcgatcacttgccaattgcaccctccaatttgccgatgccagaggggaacagcgctttcacacagcaggtgagagccaagctgcgcgagatagagcaacagattaaggaacgtggacaggccgtggaggtgcgatggagttttgacaaatgccaggaagcaaccgctgggttcactatagggcgtgtccttcacactttggaggtgctggactctcactctttcgaacgaagtgacttcagtaacagcttggattcactgtgcaataggatttttggactgggcccttctaaagatggccatgagatctccagcgacgacgatgcggtcgtgtcgctgctgtgtgaatgggctgttagttgtaagcgaagcggaaggcaccgcgcaatggtggtggcaaaactccttgaaaagaggcaggcagaaatcgaagccgaaagatgtggagaatctgaggccgcggacgagaagggaagcattgccagcggaagcctctctgccccctctgccccaatattccaggatgtcctgttgcagttcctcgacacccaggcaccaatgctgaccgaccctcgctcagagagcgagcgtgtggagttttttaatttagtgctgctgttctgcgagctgattcgccatgatgtgttttctcataacatgtacacatgtacattaatctcacggggcgatcttgcattcggggcacccggtcccaggcctccctctccatttgacgatcccgcggatgatccagaacataaggaagctgagggtagctcctcgtctaagctagaggaccccggcttgagcgagtccatggatatagatccttcctccagcgtgctgttcgaggatatggaaaaacctgacttttcccttttctcccccacaatgccttgtgagggcaaaggctcaccatctccggaaaaaccggacgtggaaaaggaagtgaaaccccctccgaaagagaaaatcgaaggaactctcggggtactgtacgaccaacctcgccatgttcagtacgcaacccattttcccatccctcaagaagagagttgcagtcacgagtgtaatcaaaggttagttgtccttttcggagtgggaaaacagagagatgacgccagacatgctattaagaaaattaccaaggatatcctgaaagtgctgaatcggaaggggactgctgagaccgaccagcttgcgcctattgttcccctgaatcctggtgacttgacttttttaggaggtgaggacggccagaaaagaaggcggaatcggccagaagcttttccgaccgctgaggacatttttgcgaagtttcagcacttaagccattacgatcagcaccaggtgaccgcgcaggtatctaggaacgtactggagcagatcacctccttcgcgctgggaatgtcataccatcttcccctagtccagcatgtgcaattcatctttgatctgatggaatattcacttagtataagtggactaatcgacttcgccatccagttgttgaacgagctgtcagtagtggaggccgagttgctgcttaaatctagtgatttagtcgggagctacaccacttccctgtgcctgtgcatcgtcgctgtgctaagacactaccacgcgtgtctgatcctgaaccaagatcaaatggctcaggtcttcgaaggcctgtgtggcgtagtgaaacatgggatgaaccgctcagatggctcctccgctgagcgctgtattctggcctatctgtatgatttgtatacctcttgtagccacctgaagaacaaattcggcgagttatttagcgatttttgtagtaaagtaaagaacaccatttactgcaacgtcgagcccagtgagtctaacatgcgatgggctcctgagttcatgattgacactctggagaatcccgcagcgcacactttcacctacactgggctgggcaagtccttatccgagaaccctgcgaacagatactctttcgtttgtaatgcactgatgcatgtgtgtgttggccatcatgatccggacagggtcaatgatattgctattttatgtgcagaattaacgggatattgcaaaagcctctcagcagagtggctcggcgtgttgaaagctctgtgttgctctagcaataacgggacttgcggattcaatgatcttctctgcaacgtcgacgtgagcgaccttagtttccatgattctctagccacattcgtggcaatcttaatcgctcgccagtgtctcttacttgaggatctgatcagatgtgcagcaatcccttcattactcaatgccgcgtgtagtgaacaggactccgagcccggcgcgagactcacttgcagaatcctattacatctgttcaagactccacagcttaacccttgtcagagcgatggcaacaagcctacagtggggatccggagtagctgcgatcgccatctgctggccgcttctcaaaacaggatcgtggatggtgccgtgttcgccgtcctaaaagcagtcttcgtgttgggcgatgcggagctgaagggatctggtttcacggtgactggagggaccgaggagctcccagaggaagagggtggcgggggcagcggaggacgtcgccaggggggacgcaatatatcggtagaaaccgctagcctggatgtctatgctaaatatgtgctgcgctctatttgccagcaggagtgggtcggcgaaaggtgtctgaagagcctgtgtgaggatagtaacgatctccaggatccagtcctgagctctgcccaggcccagagactgatgcagctgatatgttacccacatcggctgctcgacaacgaggatggagaaaatccccaaagacaaaggattaaaaggattctacagaacctggatcagtggactatgcgccagtcttctctcgagttacagttaatgatcaagcagacccccaacaacgaaatgaactcacttcttgaaaacattgctaaagccaccatcgaggtgttccaacaatctgcagagacagggtcaagcagtggatcaactgcctcaaacatgccctcatcatcaaagacaaaacctgtactcagtagtttggaaagatctggggtgtggctcgtggctcctttgattgccaaactgcccacatccgtacagggccacgtgctgaaggccgccggcgaggagctcgagaaggggcaacatttgggctcatcttcgaggaaggagcgggacagacagaaacagaaaagtatgtccttactcagccaacagcctttccttagcctggtattaacttgcctaaaaggccaggatgaacagcgcgagggactgctgactagcctttactcccaggtccaccagatcgtaaacaattggcgggacgatcagtatctggatgattgcaagcctaaacagctgatgcacgaagccttgaagctgaggctgaacttagtcgggggtatgttcgacacagtccagagaagtacacagcagacgaccgagtgggccatgctgctgctcgagatcattataagcgggacagtggatatgcagtctaacaatgaactgtttactaccgtcctggacatgctcagtgtgctgatcaatggtacactcgccgccgacatgtcatctatctctcaggggtcgatggaagaaaataaaagggcatatatgaacctggccaaaaaattacagaaggagctgggggaaaggcagtcggactccctcgaaaaggtgcggcagctattaccgctgcctaagcaaacgagagatgtgattacctgcgagccacagggttctctgattgacacaaagggcaacaagatcgcggggtttgacagcatttttaaaaaggaagggcttcaggtgtccacgaagcagaagatttcaccctgggatctgtttgaaggcttaaagccgagcgctccactgtcttggggttggttcggcactgttcgggtggaccgcagagtggctaggggcgaagaacagcaaaggctgttgctataccatactcacctgcgacctcggcccagagcgtactatttagaaccattacctctgcccccggaggacgaggagccaccagctcctaccctgctagaacctgagaagaaggctccggagcctccaaagactgataagccaggcgcagccccaccgtctacagaagaacgcaaaaagaaaagtaccaaaggaaaaaaaaggagccaaccagccacaaaaaccgaggactatgggatgggccccgggagatccgggccctacggcgttactgtccctcctgacttgctccaccacccaaatcccggctctattacacatctgaactaccgacaagggagcattggcctgtacacccagaaccagcctctgcccgccggtgggccccgagtggatccctatagacccgtcaggctgcccatgcagaaactgcctactcggcccacataccccggagtgttgccaaccacgatgaccggggttatgggcctggagccgagttcctataaaacttctgtgtatcgccaacaacagcccgctgtgccccaggggcagagactcaggcaacagctccaacagtcccagggcatgcttgggcaaagctctgtgcatcagatgacaccctcatcatcctatgggctccagacatcccaaggttacacgccttacgtcagccacgtgggacttcagcagcacacagggcctgctggtaccatggttcctccctcatactcatcacagccgtatcagagtacacatcctagcactaatccaactctggtggaccctacccgccatctccagcaacggcctagtggctacgtccaccaacaggcacctacttatggacatggactgacgtccacacaaagattctctcaccagaccctgcagcagactcctatgatcagtaccatgactcccatgtcagcacagggcgttcaagcgggggtgagatccaccgccatcctgcccgagcagcagcagcaacagcagcaacaacagcagcagcagcagcaacagcaacagcaacaacagcagcagcaacagcagcagtaccatatacgtcagcagcaacagcaacaaattttgagacagcagcagcagcaacagcagcagcagcagcaacagcagcagcagcagcagcagcagcagcagcagcagcagcaacaacatcagcagcagcaacagcaacaagccgcccccccccagccacagccacagtcacaaccgcagtttcagcgtcagggtctgcaacagactcagcaacagcagcagacagccgcactggtgcgtcagttacagcaacaactatccaatacccaaccccaaccatcaaccaacatattcggtagatattag

SEQ ID NO: 123599 - DNA, 6531 bp, Artificial Sequence
  Description of Artificial Sequence: Synthetic coding sequence
atggccgcgtttggaattttgagttatgaacacagacctctgaaaaggccaaggttgggccctccagatgtgtacccccaagatcccaagcagaaagaggatgaacttaccgcactgaatgtgaagcagggattcaataaccagcccgcagtaagcggggatgagcacggcagcgcaaaaaacgtttctttcaacccagccaaaatctcctctaacttttcctctatcatcgctgaaaagctccgctgtaacactttaccagataccgggcgtagaaagccacaggtaaaccaaaaggacaatttctggcttgttaccgctcgctcacagagtgccataaacacctggtttacagatctggcgggcaccaagccgttaacccagctggctaaaaaggttcccatcttttcaaaaaaggaagaagtctttggctaccttgcaaagtacacagttcctgtgatgcgtgccgcatggctaataaaaatgacctgtgcctactatgccgccattagcgagacaaaggtgaaaaaaagacatgttgaccccttcatggaatggacccagattatcacaaaatacctttgggagcagctgcagaaaatggcggagtattacagaccaggcccagcgggcagcggggggtgtgggagcacaattggcccattgccccatgacgtggaagttgccatacgacaatgggactataccgagaagctcgccatgtttatgttccaggatggtatgctcgaccggcacgaattcttgacttgggttctcgaatgcttcgaaaagattcgtcctggagaggacgagttgttaaagttgctcctccctcttctccttcgatattccggggaatttgtgcagtcagcttacctttcgcgaagattggcctacttttgcaccagaaggttggcactgcagctggacggggtcagctcacacagtagccacgtcataagcgcccagtcaacgtcaactctgcccaccacccccgccccgcaaccccctacctctagcacaccatctacccccttctctgacctgctgatgtgtccccagcatcggcctcttgtcttcggtctgtcttgcattcttcagaccattctcttgtgttgtccttcagctttagtctggcattacagcctcactgactcacggatcaagacaggctccccactggaccatctgcctattgcgccctccaacttgccaatgcccgagggcaacagtgcgtttactcagcaggtgagagcaaaattgcgggagatcgaacagcagattaaggagaggggccaggctgttgaggtgagatggagtttcgataagtgccaggaagcaacagccggtttcactattggacgcgtgttgcacacactcgaggtgctagacagccattcgtttgaaagatccgattttagcaatagcctggacagcctgtgcaatcggatattcggcttgggcccaagtaaggatggccatgaaattagcagtgatgatgatgcagttgtgtcactcttatgcgaatgggcagttagttgcaaaagatctgggcgccatcgagccatggtagtggccaagcttctcgaaaaaagacaggccgaaattgaggctgaaaggtgcggcgagagtgaggcagcagatgaaaaggggagcatcgccagcgggagcttatcagctccttccgccccaatttttcaggacgttctgctccagtttcttgatacccaggcccctatgctgaccgatcctaggtccgagtctgagcgcgtagaatttttcaacctcgtgttactgttttgcgaactgatacggcacgatgtattctcccacaatatgtatacatgcactctgatctcacggggcgacttggccttcggcgcacctggaccaaggcccccctccccttttgatgacccggcagacgaccccgaacacaaagaggcagaaggaagttccagcagcaagctggaggatccaggcttgagtgagtctatggacatagacccatcctcgtctgtgcttttcgaggacatggaaaaacctgacttttcattgttctctcccactatgccatgtgaaggcaagggtagtccttctcccgagaagcctgatgtggaaaaagaggttaaaccccctccaaaggagaagattgaaggtacccttggagtcctttacgatcagccacgccacgtgcagtatgctactcatttccctattccacaggaggaaagttgcagccatgagtgtaaccaacggcttgtcgtcctttttggcgtcggcaaacagcgagatgacgcacggcacgctatcaagaaaataacaaaggacattctgaaggttctaaataggaagggtactgccgagacagatcaactggccccaatagttccattgaatcccggagacctgacatttttgggaggcgaagacggccagaaacggcgtcgtaatagacctgaagcgtttcccaccgccgaggacatcttcgccaaattccagcacctgtcacattatgaccagcatcaagtgactgcccaggtctcccggaatgtgctagagcagatcacctcattcgctctgggcatgtcctaccatctaccgcttgtacagcacgtacagtttatatttgatctcatggaatactccctgagcatttcaggattgatcgattttgcaattcagctgttgaacgagctatcagtggtcgaggctgagctgttgcttaaatcttctgatctcgtggggtcctataccacgtcactgtgtctgtgcatcgtcgccgtactgcgtcactaccatgcctgcctgatcctgaaccaggatcagatggctcaggtgtttgaagggctgtgcggcgtcgtgaaacatgggatgaaccgctctgacggctcctcagctgagcgttgcatcctggcctacttatacgatctgtacacctcttgcagccatttaaaaaataagttcggggaactcttctctgatttttgttccaaggtgaaaaacaccatctattgcaatgttgagccttcggagtccaatatgagatgggcccctgaattcatgatagataccctggagaatccagccgcgcacacttttacctacaccggcctaggcaaaagcctcagtgagaatccagcaaaccggtatagcttcgtgtgcaacgccctcatgcacgtgtgcgtgggtcatcatgaccccgatcgggtgaatgacattgcaatactttgtgctgaactgactggctactgcaaatcgttgtctgccgaatggctgggggtcttgaaggccctttgctgttcatctaataatgggacatgcgggtttaatgatcttctgtgtaatgtagacgtgtccgacctgtcttttcacgattccctggctaccttcgtggcgatattgattgccagacaatgcctgctgttggaagacttaatccgctgcgccgccatcccttccctgctcaacgcagcctgttctgagcaggattcagagcctggtgcccggctgacctgtcggatcttgctgcacctgtttaaaactccacagcttaacccatgccaaagtgacggcaacaagccgacagtgggaatccgttcatcctgtgatagacacttactggccgcaagccagaatcgaatagtggacggggctgtctttgctgtactaaaggctgtttttgtcctgggcgacgccgaactgaagggcagcggattcacagtcacaggcggcactgaagagttaccagaggaggagggaggcgggggttccggtggacgacgccaaggcgggcggaacattagcgttgaaacagcctccctagatgtttacgcaaaatacgtgctgaggagtatttgtcaacaagagtgggttggggaaagatgcttgaagagtttatgcgaagacagtaatgacctccaagacccagtcctctcaagcgctcaggcccaacgcctgatgcagcttatttgctacccacatcgtctcttggataatgaggacggtgagaacccgcagcggcaaaggatcaaacgtattctccagaaccttgaccagtggacaatgcgacagtcatccctggagttgcagctcatgattaagcagaccccaaacaacgagatgaattcattgctggaaaacattgcgaaggccactattgaagttttccagcagagcgctgagaccgggtctagctccggctccactgctagcaacatgccatcttctagcaagacgaaacccgtgctcagctcactggaacgctccggagtatggcttgtggcccctttgattgccaaacttccaactagcgttcagggccatgtgctgaaggcggcgggcgaggaactcgagaaaggccaacacctcggcagcagctcccgtaaggaaagggacaggcaaaaacaaaagtctatgtctttgttgtctcaacagcccttcctgagtctggttctgacatgcctgaagggtcaggatgaacaaagagagggactgttaacatctttatactcccaggtccaccagatcgtgaataattggagggacgaccagtatttggatgactgtaagcccaagcagttaatgcacgaggcccttaagcttcgccttaatctggttggtggcatgttcgacacagtccagagaagcacccagcaaacaacagaatgggctatgctcctcttggagatcattattagcgggaccgtcgacatgcaaagcaacaatgagctgtttaccaccgtgctagacatgctgagtgtgctaattaacggaactctggccgcggacatgtcttctatttcccagggaagtatggaggagaataagcgcgcctatatgaacctggctaaaaagctgcagaaagaactgggcgagcgccaatccgatagcctggaaaaagtgcggcagcttcttccgcttcccaaacaaacaagagacgtgatcacatgtgagccccaggggagtcttatcgacaccaaggggaacaaaatcgcgggtttcgactccattttcaaaaaggaaggcctgcaggtgagcacaaagcagaaaatatctccctgggacttgtttgagggcctgaaaccgagcgctccgctgagttgggggtggtttggtaccgtccgggtggaccggcgagtagctaggggtgaggaacagcagcgacttctcctctaccacacacatttgagaccccggccccgagcctattacctcgaacctctgccactgcctcccgaagacgaggagcctcctgccccaaccctcctggaaccagagaaaaaagctccagaaccgcccaaaacagataagccaggcgccgcccctcctagtactgaagaacggaagaagaaaagcaccaaaggcaagaaaaggtcacaacccgcaaccaaaacagaggactacggtatgggccctggcagatccggcccctacggagtgacagtcccccccgatctgctgcatcatcccaatcccggatccattacccacctgaactataggcagggcagtatcggcctgtatacccagaaccaaccactccctgcaggaggacctcgggtggacccttatcgaccagtgcggctgcccatgcagaaactgccaacccgaccaacttatcccggggtgctgccaaccactatgaccggggtgatgggactagagccatcttcctataaaactagcgtgtatagacagcagcagcccgctgtgcctcagggccagcgccttcgacagcagctgcaatcacaaggaatgctcggccagagttctgtgcaccagatgacccccagtagttcctacggcctgcagacttcccaagggtataccccttatgtgagccatgtcggtctgcaacaacacactgggccggccggaaccatggtccccccgtcgtactcttctcagccataccagagcacacacccttctaccaatcctactttggtggatccaaccagacacctccagcagcggccctcaggctacgtgcatcaacaggcccctacttacgggcatggcctgacctcaacccaacgcttcagccatcagaccctccagcaaacaccgatgatctcaacgatgacacctatgtccgcacaaggggtgcaggccggtgttcgaagcaccgccatcctgcctgagcagcaacagcagcagcagcagcagcagcaacagcagcagcaacagcagcagcagcaacagcagcaacagcaacagcagtaccatattcgccaacagcagcagcaacagatcttaagacagcagcaacagcagcagcagcagcagcagcagcagcaacagcagcagcagcagcagcagcagcagcagcagcaacaacaccagcagcagcagcagcaacaagctgcaccccctcagccccagcctcagtcacaaccccagttccagcgacaaggactgcaacagacacaacagcagcagcagacggccgctctggtaagacaactgcaacagcagctgagtaatactcagccacagccttctacaaacatattcggaaggtattag

SEQ ID NO: 123600 - DNA, 393 bp, Artificial Sequence
  Description of Artificial Sequence: Synthetic coding sequence
tgaacacccaatcggcgcagaaagaagcagctcaatgccgctttccttccacaggatgaactgacagctctgaacgtgaagcagggcttcaacaaccagcccgcagtcagtggtgatgaacacgggtctgctaaaaatgtaagctttaaccctgccaagatttcctcaaacttctcatcgatcattgcagagaaactgagatgcaataccttgccagacaccggcaggcggaaaccacaggtaaatcagaaagacaatttctggttagtgactgcaagaagccagagcgctataaacacctggtttacagatctcgcgggcacaaagccccttactcaactggcgaagaaggtgcccatcttttctaaaaaggaagaggtgtttggctattag

SEQ ID NO: 123601 - DNA, 6384 bp, Artificial Sequence
  Description of Artificial Sequence: Synthetic coding sequence
gaggacgaactcacagccctaaacgtcaaacagggattcaataaccagccggcggtgtctggagatgaacacggttccgctaagaatgtcagttttaacccagccaagatcagctccaattttagtagcatcatagccgagaaactgcgttgcaataccctaccagacacaggacgccgtaagccacaggtgaatcaaaaggacaacttctggctggtgacagcacgatctcagagcgccatcaacacctggttcaccgacttagcaggcactaagccactcacacagctggcaaagaaagtgcctatcttctccaagaaagaggaggtctttggatatctagccaaatacacagtgcctgtgatgagagctgcatggttaatcaaaatgacttgtgcgtactatgcggcgatatccgaaacaaaggtgaaaaaacgccatgtcgatccgtttatggaatggactcagatcatcacgaagtatctgtgggagcagttgcagaagatggccgagtattacaggccagggcctgccggttcaggcggctgtggaagcactatcgggcccctgccccacgatgttgaggtggccatccggcagtgggattataccgaaaaattagccatgtttatgtttcaggacggcatgcttgacaggcacgagttcctaacctgggtactggagtgctttgagaagattagacccggcgaggatgagctgctgaagcttctgttgccgctgctgctccggtactcaggggaatttgtgcaaagtgcctacttatctcgcagactagcttacttttgcactcgccggcttgctcttcagctagacggtgtttcttctcactcgtctcacgttatctcggctcagagcacttcaacccttcctaccactcctgccccacagccccccacctccagtacgcctagcacccctttctccgatctcctcatgtgtccccagcacaggcctttggtgttcggcctgtcctgtattctgcagaccatattactgtgttgcccctcagcgttagtctggcactactccctgactgacagccgaatcaagactggctcacctttggatcatttgccaatcgccccaagcaacctacccatgccagaggggaatagcgcattcactcagcaggtcagggccaaattgcgagaaatcgaacagcagattaaagaaaggggccaggcagtggaagttaggtggagttttgataagtgtcaggaggcaacggccgggttcacgattgggcgggttctgcacacactggaggtgctggattctcatagtttcgaacgaagcgatttctccaacagtttggactccctctgcaatcgaatatttgggctcggtcccagtaaagacggccacgaaatctcatcagatgacgatgcagtcgttagcctcctctgcgaatgggcagttagctgcaaacgatccggccgccaccgagctatggttgtggcgaaattgctcgagaagaggcaggctgaaatcgaggcagagcgctgcggtgaatccgaagccgcagatgagaagggttcaattgcttcaggaagcctgagcgccccatcagccccaatatttcaggatgtgttgctccagttcctcgatactcaagctcctatgctcacggatcctcgctcagaatcagagagggtggagttttttaacctggtgctcctgttctgtgaacttattcgtcacgacgttttttcacataatatgtacacctgcactctaatttctcggggggaccttgcctttggcgcaccgggaccccggccaccctccccatttgatgatcctgcggatgatcctgagcataaggaggccgagggatcctcctccagcaagttggaggatccaggtctgagcgagtctatggacatcgatccgtcttcctctgttttgttcgaagacatggagaagccagacttttctctcttctcacccacgatgccttgcgagggcaaaggatcgccttcacccgagaagccagatgtggaaaaagaggtgaagccccccccaaaggaaaagatcgaagggaccctaggcgtgctatacgatcagccaaggcatgtgcagtacgccacacacttccccatcccacaagaggaatcttgctctcacgaatgcaaccaacggctagtcgtgctgtttggtgtggggaagcagagggacgatgcacgacacgcgatcaaaaaaataacaaaggatattctgaaggtgttgaatcggaaaggcacagccgagaccgaccagctcgcccccattgtgcccctcaaccctggagacctcactttcctgggtggcgaagacggtcagaagaggaggagaaataggcctgaagcgttcccaacagccgaagatatattcgccaagttccagcatctgtcgcactacgatcagcaccaagtcactgctcaggtctcacggaacgtactggagcagataacaagcttcgccctggggatgagttatcacctgcccttagtacagcatgtgcaatttatcttcgatctcatggagtatagcctgtcaatctctggccttatcgatttcgccatccaactactgaatgagttgtcagtggtcgaagccgagctcctcctcaagagttccgacctggtgggcagttatacgactagcttgtgcttgtgcatcgtggcggtcttaagacattatcacgcctgcctcattctgaaccaagatcaaatggcacaggtctttgagggtctatgtggagtggtgaagcatggaatgaatagatccgacgggtccagcgcagagagatgcattctggcttacttgtacgacctgtacacttcctgctcccatctaaaaaacaaatttggggaactgttctccgacttctgctccaaggtgaaaaacacaatctattgcaacgtggaaccaagcgagtctaatatgcggtgggcccccgaattcatgatagataccttggagaatccagccgcacatactttcacctacacaggattggggaaaagcttatccgagaatcctgccaacaggtactcattcgtatgcaatgccctgatgcacgtgtgcgtcggccaccacgacccggatcgggttaatgacatagcaatcctgtgcgctgagctcaccggttattgtaagagcctatccgccgaatggttaggggttcttaaggctttatgttgcagttctaacaatggaacctgtggcttcaatgacctgctctgtaatgtggatgtgtcggacctgtctttccacgactcactggcaactttcgtggccattctgatcgctagacagtgcctccttctggaggatcttatccgttgcgcggcaattccatccttgctcaacgccgcttgtagtgagcaggactctgaacccggtgcccggcttacgtgtagaattctgctccacttattcaaaaccccccagctaaacccctgtcaatccgatgggaataagcctaccgttgggattagaagcagctgtgacagacacctgcttgccgcgtcacagaatcgtattgtcgatggagcagtgtttgccgtcctcaaggcggtgttcgttctaggcgacgcagagctcaaaggatccgggtttactgtaaccgggggaaccgaagagttgcccgaagaagagggggggggcgggagcggaggccggcggcaggggggccgcaatatttccgtggaaacagccagcctggacgtgtatgccaagtacgtcctgaggagtatatgccagcaggaatgggtgggcgaacggtgcctgaagtcgctgtgtgaggattctaacgatcttcaagaccctgttctgagcagtgctcaggcccaaagattgatgcagttgatctgctacccccatagactactcgacaacgaggacggggaaaatcctcagaggcagaggattaaacggatcttgcagaatttggaccaatggactatgcgccagtcctcattagaacttcagctgatgatcaaacaaacacccaacaatgaaatgaacagcctcctcgagaacatagcaaaggccaccatcgaggtattccaacaaagcgccgaaacaggctcttcaagcggcagcaccgcgtcaaatatgccttcaagtagcaagacaaaacccgtcttgagttcccttgaacggtcgggcgtgtggctggtggcacctctcatcgctaaattaccaacatcagtgcagggccatgtgctcaaggcggccggggaagaactggagaaggggcaacacctcggctcatccagccggaaagagagggaccgccagaaacagaaaagtatgagcctgttgtcacagcagccgtttctctcactggttctaacatgcctgaaggggcaagatgagcaacgcgagggcttattaacaagcctatacagtcaggtacatcagatagtaaacaactggcgggatgatcaatatcttgatgattgtaaacccaagcagttaatgcatgaggctctgaaactccgccttaatcttgtaggaggtatgtttgacacagtccagagatccactcagcagactacagaatgggctatgctgttgctcgagatcatcatctcggggaccgttgacatgcagtcaaataatgagctgtttaccacagtgcttgatatgttatctgtgctgattaacggaacgctcgccgctgatatgtcctcaataagccagggatccatggaggagaataagcgtgcctacatgaatttggcaaagaaactgcagaaagagctgggtgagagacagtccgatagtcttgaaaaggtgcgtcagctgctgccactgcccaaacagactcgggatgtaattacatgcgagccacagggatctctcattgataccaaggggaataagatcgctggtttcgactcaatcttcaagaaagaagggctgcaagtgagtaccaagcagaaaatctcaccttgggatctcttcgaaggcctgaaaccttctgcccctctgagctgggggtggtttgggacagtcagagtggacaggagggttgcgcgtggggaggagcagcagaggctcctgctctaccatacacacctccgcccaagacccagggcttattacttagaaccgctccccctgcctcctgaagacgaggagccaccggctccaacactcctggagcctgagaaaaaggcccccgaacctcctaaaacagacaagcccggtgccgccccgccatctactgaagaacggaagaaaaaaagtactaaaggaaagaagagaagtcagcctgcaactaagacagaggattatgggatggggccaggccgcagcggtccctacggcgtaaccgtaccccccgatttgctacatcatcctaatcccgggtctattacgcatcttaattaccgtcagggctctatcggtctgtacacacagaatcaacccctgcctgccggaggccctagggtggatccctatagaccggtgcggctacctatgcaaaagttgcctacccgtcccacatatcctggggttctcccaacgacgatgacaggggtcatgggcctggagccctcctcatacaaaactagcgtgtaccggcagcaacagccggcggtgccccaaggccagaggctgcgccagcagctgcagcagagccagggtatgctcggacagtctagtgtgcaccagatgacaccaagtagtagctatggactgcagacgagccagctctcacctagctctcttcagggctacaccccctatgtctcccatgtcgggctacaacagcatactggccccgctgacccaacgagacacttgcagcagaggccatctgggtacgtgcaccagcaagcccctacctatggccacggactgacctcaacgcagcgcttctcgcatcaaaccctgcagcagacccccatgattagtacaatgacacctatgtcggcacagggcgtgcaggcaggcgtcaggtctaccgctattctgcccgagcaacagcagcagcagcagcagcagcagcagcaacagcaacagcagcaacagcagcagcagcagcaacaacaacagcagtaccacatcaggcagcaacaacagcagcaaattttgcgccagcagcagcagcagcagcagcagcagcagcaacagcagcagcagcagcagcagcagcagcagcagcagcagcagcagcaccaacagcagcagcagcagcaggcagcacccccccagccacaacctcagtcccaacctcagttccagcggcagggcctgcagcaaacccagcagcagcagcaaactgctgcgcttgttaggcagttgcagcaacaactgtcaaatacgcagccacaaccctccaccaacatatttggcaggtactag

SEQ ID NO: 123602 - DNA, 2778 bp, Artificial Sequence
  Description of Artificial Sequence: Synthetic coding sequence
ggaggtagcggtggccgaaggcagggcggaaggaacatctcggtcgaaaccgcaagtttagatgtgtacgccaagtacgttttgagaagcatttgccagcaggaatgggttggggagagatgcctaaaatcactctgtgaagattctaacgacctgcaggatccagtgctcagctccgcacaagcacagcgtcttatgcagctaatctgttatccacaccggctgctcgacaatgaggatggcgagaatcctcagcggcagaggatcaaaagaattctgcagaatctggatcagtggaccatgaggcagtcatcattagaactgcaacttatgatcaagcagacgcccaataatgaaatgaacagcttgctggagaacatcgctaaagccacaatcgaagttttccagcagagcgcagagacgggatccagttctggatcaaccgccagtaacatgccttcaagctccaaaacaaaacccgtattgtcctctttagaacgaagtggagtgtggctggttgcccccctaatcgccaaattgccaaccagcgttcagggccatgtgctcaaagctgccggcgaagagcttgaaaagggccagcatctgggatcctcatctaggaaagagagggatagacagaagcaaaaaagtatgagcctgctcagccagcagccattcctgagtctcgtgctgacctgtctcaagggtcaagatgagcaacgggagggcctgctgacatctctatactctcaggtgcaccagatcgttaataattggagagatgaccagtacctcgacgattgcaagcctaaacagctcatgcacgaggccctcaaattacggctcaatctcgtcggtggaatgtttgatacagtgcagaggtccacccagcaaacaactgaatgggccatgctgcttctagagattattatctcgggaactgtggacatgcagtccaacaacgaattatttacaacggtgctcgacatgctcagtgtcctaattaatggaactctcgcagctgacatgagcagcatatcccagggttcgatggaggaaaataaacgggcttatatgaatttggccaagaaactgcagaaggagctcggtgaaagacagtcagattctctcgaaaaagtgagacagctgctgcccctgcccaagcaaactagagacgttataacgtgtgagccccaagggtccttgatcgacacaaaaggcaacaaaattgctggattcgattccatcttcaaaaaagagggcttgcaggtgtcaacaaagcagaagattagcccgtgggatttgttcgaaggcttgaagccctcggccccactgtcgtgggggtggtttgggaccgtaagggtggacagacgggtcgcgagaggcgaagagcagcagcgacttctgttgtaccatacgcacctcagaccccggccccgggcatactatctcgaaccccttcctctaccacctgaggacgaggaaccacccgccccgactctcctcgaacccgagaagaaggctccagagcctccgaagacagataagcccggcgccgcaccccctagcactgaggagaggaagaaaaaatccacaaaaggcaagaaaaggtctcaacctgcgactaaaaccgaggactatgggatggggccaggcaggagtgggccctatggggttacagtgccgccggacctcctacatcaccccaatcccgggtcaatcacccacctgaactacagacaggggtccatcggattatatacccagaatcaaccactcccagcagggggccccagggtggatccttacagacccgttaggcttcctatgcagaagttacctactcgcccaacgtacccaggcgtgctgccaaccaccatgaccggagtaatggggctagagccttcttcctataagacgtctgtttaccggcaacagcaaccagcagttccccagggacagcggctccggcaacagctgcaggccaaaatccagagccaaggtatgctcggccagtcaagtgtgcaccagatgactccatcttcatcgtatgggctacagaccagccagggctataccccatacgtgtcccacgtcggacttcaacagcacacgggtccagccggtacaatggtaccgccttcttactcttctcagccatatcagagcacacaccctagtactaatcccacccttgttgatccaacaaggcatttgcagcagaggcctagcgggtatgtacatcaacaagccccgacctacgggcatgggctcacaagtacccagaggttctcccaccaaactctccagcagaccccaatgatcagcaccatgacacccatgtccgcccagggggtacaggccggggtacggtcaaccgctattctcccagaacagcagcagcagcagcaacaacagcagcaacagcagcaacaacagcagcagcaacagcagcagcagcagcaacagcaataccacataaggcagcagcaacagcagcagattctgcgacagcagcagcagcagcagcagcaacagcagcagcagcagcagcagcagcagcaacagcagcagcagcagcagcaacagcaccagcagcagcagcaacagcaggctgctcccccccagccacagcctcagtcacagccccagttccagcggcaggggctgcagcagacccagcagcagcagcagactgctgccttagtaagacagctacagcagcaactttctaatacccagccgcaaccatccactaatatcttcggaaggtattag

SEQ ID NO: 123603 - DNA, 756 bp, Artificial Sequence
  Description of Artificial Sequence: Synthetic coding sequence
taggagaggaaaaagaaatctacgaagggcaaaaagagatcgcagcctgcaactaagacagaagactacggaatgggccctgggaggtccggcccctacggagtcactgtgccgccagatctgctgcatcaccctaatcctggctccattactcacctgaactaccggcagggcagtataggcttgtatacgcagaaccagcccctacccgctggcggcccaagagttgatccttaccggcctgtgaggttgcctatgcagaagttacccactcgaccgacttatcccggggtgctccccaccacgatgaccggagtgatgggcttggagcctagcagctacaagacatctgtttacaggcagcaacaacccgcagtcccacagggtcagaggctgcggcagcagctccagcaatcccagggtatgcttggccagagcagtgtgcaccagatgaccccgtcatcaagttatggattgcagaccagtcagggttatacgccctacgtatcacatgtgggattgcaacagcatacagggcctgccgatccgacgcgtcacttacagcaacgaccaagtggctatgttcaccagcaggcacccacttacggacatggtctgaccagtacacagcgtttttctcaccagactctccagcagacaccaatgatctcaaccatgacgcccatgtcagcgcagggcgtgcaggccggcgtacgtagtacagcaattctcccggaacagcaacagcagcaatag

SEQ ID NO: 123604 - DNA, 6003 bp, Artificial Sequence
  Description of Artificial Sequence: Synthetic coding sequence
atggcggccttcgggatactgtcctacgagcatcggcctctgaaaaggccccgcttgggaccaccggatgtttacccccaggacccaaagcagaaggaagacgagctaaccgctctcaacgtcaagcagggatttaacaatcagccagcagtgagcggtgacgagcatggctcggccaaaaacgtttctttcaatcctgccaaaatatcatcaaacttcagcagtattatcgcagagaaacttagatgcaacacgcttccggataccggccggagaaagccgcaggtgaaccaaaaagacaacttttggttggtcacagcacgaagccagtctgccattaacacctggttcacggacctggcgggaactaagccacttacacagctggccaagaaagtacctatcttttctaagaaagaagaggtgtttggatatcttgctaagtacacagttcctgtgatgcgcgcagcttggttgatcaaaatgacgtgtgcctactacgccgctataagcgagacaaaggtgaagaagcgacatgttgatccctttatggagtggacccaaatcattacaaaatatttgtgggagcagcttcagaaaatggccgaatactatcgccccggcccagctggaagtggaggatgcggatctacgatcgggcctttgcctcatgacgtggaggtagctatacgtcagtgggattacacagaaaagcttgctatgtttatgttccaggatggcatgctcgacagacacgaatttcttacgtgggttttggaatgctttgaaaaaatccggccaggtgaggacgagctgcttaagctgctccttccactcctgctaaggtatagcggtgaattcgtgcagtcagcttacttaagcaggcggcttgcctatttttgtaccaggcggctggcgttgcagctggacggagttagcagccactcatctcacgtaatttccgctcaatcaacttctaccctgcctaccacccctgcaccccagccccctacatctagcacccccagcacccccttctctgatttgctaatgtgcccccagcatcgcccactcgtgtttggactgtcttgtattctgcaaacgatcctgctgtgttgtcccagcgcccttgtatggcactactcacttaccgactcccgaataaagaccggctcacccttggatcatctccccatcgctccctctaacctcccaatgccagagggaaattccgccttcactcagcaggtgagggcaaaactgcgcgagatagagcagcagataaaagagagggggcaggccgtagaagtccgatggagtttcgataaatgccaggaggcgactgccgggttcacaatcggtcgcgtgttgcacaccctggaggtgctcgacagtcactcattcgaacgaagtgacttctctaatagtcttgattccctgtgtaaccgaatatttgggttgggcccatcaaaggatggccacgagatcagctctgacgacgacgctgtggtttccttattatgcgagtgggcagtctcgtgtaaacgatccgggcgtcacagagcaatggtggtggcaaaacttctggaaaagagacaagctgagatcgaggccgagcgctgcggggaatccgaggctgccgatgaaaaaggtagtattgcctctggatcgctgagcgctcccagcgctcctatctttcaggacgtgctactccagtttctagacacgcaggcacccatgctgaccgacccacgcagtgaatcagaacgagtggagttcttcaatctcgtcctcctgttctgcgaactgattcgccacgacgtcttctcacacaatatgtatacttgtaccctgatttcaagaggcgatctggctttcggggccccggggccaagaccccctagcccattcgatgatccagccgacgatccggagcacaaggaggcggaagggtcaagcagtagcaaactggaggatcccggactgtcggaaagcatggatatcgacccatctagctcagtcttattcgaggacatggaaaagccggatttttcccttttctctccgacaatgccatgcgaaggcaaagggtcgccatctcccgagaagcctgacgtggagaaggaggtcaagcctccacccaaagaaaaaatcgagggtactttgggagtgttgtacgaccagccaagacatgtgcaatacgctacacacttccctattccacaggaagaatcttgtagccatgaatgtaatcaaaggctagtcgttctgtttggagtcggtaagcagcgagatgacgcacgacacgccattaagaagataaccaaagatattctcaaagtgctgaatcggaagggcacagctgagactgatcaattggctccaattgtcccgttgaacccaggcgatctgacctttctgggcggcgaggacgggcagaaacgacggcgaaacaggccagaagcattccccaccgctgaagacatttttgccaagttccagcatctaagccactatgatcaacaccaggtgactgcccaggtcagccgtaacgtgctggaacagatcacctccttcgcgctcgggatgagctaccacctgccattggtgcagcatgtccagtttatctttgacctcatggaatattcattgagcattagcgggctgattgatttcgccatccagctgctgaacgaacttagtgtggttgaggctgaacttcttctcaaatcctcagatctggttggcagttacaccactagtctgtgcctgtgtatcgtcgcggtgctgcgccactatcacgcatgtttaattttgaaccaagaccagatggcccaagtatttgagggcctgtgcggcgtcgtcaaacacgggatgaacaggagtgacggttcttctgctgaacggtgtatcctcgcgtacctgtacgatttgtatacctcatgtagccacctgaaaaataagttcggcgaactgttctccgatttttgtagtaaggtgaagaataccatctactgtaatgtggaaccgtctgaaagcaatatgaggtgggctccagagtttatgattgataccttagagaaccccgccgcccataccttcacctatacaggccttggcaagagtttgtctgagaatcctgccaaccgctattcattcgtctgcaatgcactgatgcacgtctgtgtgggtcatcatgatcccgacagagttaacgacatcgctattttatgtgcggagctgactgggtactgcaagagtctttctgccgaatggctgggtgttttgaaagccctgtgttgcagctccaacaacggcacctgcggctttaatgatctcctgtgtaacgtagacgtaagcgacctcagcttccacgactcgctggcaacttttgttgccattctcatagctagacagtgtcttctgcttgaggacctaatccgttgtgccgctataccctcattgctcaacgctgcctgcagcgagcaagatagcgagcctggagcccggcttacatgtagaatcctcttgcacctattcaagactccacagctgaatccctgccagtccgatggaaacaaaccaacagtgggaataagatcctcatgcgatcgccatttactcgccgctagccaaaacaggatagtggacggcgcagtgtttgccgtgttgaaggctgtgttcgtcctcggtgacgcagaactcaaaggctccgggttcaccgtgaccggaggaaccgaggaactaccagaggaggagggcggcggagggtctgggggccggaggcagggagggagaaatatctctgtcgagactgccagtcttgacgtgtacgcgaaatacgtcctgagaagcatctgccagcaggaatgggtcggagagcgctgcctcaagtccctgtgtgaagacagtaatgacctgcaagacccagtcctctctagcgcacaagcccaacgactcatgcagctgatctgctatccacatagactactcgataatgaagatggggagaatccccagcgacagcgcattaagcggatcctccagaatctggatcagtggactatgcgacaatcctctctggaattacagcttatgatcaagcaaaccccaaataacgagatgaattccctactggagaacatcgctaaggccacaatcgaggtgtttcaacagtcggctgagacgggatcgtcttctgggtcaaccgcatctaatatgcccagtagcagtaagacgaaaccggtgttatctagcctggagcgctctggagtctggctagtggcacccctcatagccaagctgcctacaagcgtgcagggacacgtgctgaaagccgcaggagaggagctcgagaaaggacagcatttgggctccagcagcaggaaagagcgcgatcggcaaaaacagaagtccatgtccttactctcacagcagcctttcctcagcctggtcctgacctgcctgaaagggcaggatgaacagcgcgagggactgttaacttcgctttatagccaagtacatcagatcgtaaacaattggagggatgatcaatacttggatgactgtaagccgaagcaactgatgcacgaggcgttaaagctgcggctgaatctcgttgggggcatgtttgatactgtacagcggtcaactcagcagacaaccgaatgggccatgctgctgctggagatcatcatttccgggaccgtagacatgcagtcaaacaatgagctgttcactacagtgctggacatgctaagcgtcctcatcaatggcactttagctgcagatatgagtagcatttcgcaaggctcaatggaggagaataagcgtgcatacatgaatctagcaaagaagctgcagaaggagctgggagagagacaatcggattcattagagaaggtccgccagctccttcctctgcctaagcagacacgggacgtgatcacgtgcgaacctcaaggtagccttattgatactaagggaaacaagatcgccggttttgactcgatctttaaaaaggagggactgcaggtgtccaccaagcagaaaatttcaccttgggacctatttgagggactgaagccatcggcccccctgagttggggatggttcggcaccgtacgtgtagacagaagggttgctcgcggagaggaacagcagaggctgctgctgtaccacactcacctgcgacctcgaccacgcgcttattacttggagcccctgccactgcctccagaagacgaagaaccacccgccccaaccctgctggagccagaaaagaaggctcccgagcctccaaaaactgataagcctggcgctgcacccccaagcactgaggaaagaaaaaaaaaaagcacgaaaggcaagaaaagaagtcagcccgctacaaagacagaggattacggtatgggtccagggagatccggaccatacggagttactgtcccccctgaccttctacaccatcccaaccctggcagcatcacacatcttaactaccggcagggatccatcggtttgtatacacagaaccagcctctgccagcagggggcccccgcgtcgatccttaccgtccagtcaggcttcccatgcagaagcttcccaccaggcctacctatcctggagtgctgcccacaacaatgacaggggttatgggactagagccaagctcttataagacttccgtctacagacagcaacaacctgctgtgccgcaagggcagaggctacgacaacagctgcagcagtcacagggaatgttgggacaatccagcgtgcatcagatgaccccctcttcatcatatggacttcagacttcacagggatatactccctacgtgagtcacgttggcctgcaacagcatacaggtccggcagatcccactcgacatctgcaacagagaccttccggctacgtgcaccagcaggccccaacctatggccacggcctgacgtctactcaatcttttcatacacgtcactgctcaaggcatccctag

SEQ ID NO: 123605 - DNA, 2271 bp, Artificial Sequence
  Description of Artificial Sequence: Synthetic coding sequence
atggcggcctttggccttctcagttacgagcaacgacccctgaagagacctcgtctgggtcctcctgacgtgtacccgcaggacccaaagcagaaggaagacgagctcaccgctgtgaatgtcaaacaggggttcaataatcagcccgcttttactggagatgagcatggctccgcaagaaacatcgtgatcaacccatccaagatcggcgcatacttcagcagtatcttagctgagaaactaaagcttaacacgtttcaggacaccggaaaaaagaagccacaggtgaatgcaaaagacaactattggctggtgactgccagatcccagtctgctatccactcctggtttagcgacctcgccggcaataaaccactctcaatacttgcaaaaaaggtgccaatcctgtccaagaaggaggacgtctttgcctacctggcgaagtacagtgtgccaatggttcgtgcgacatggttaatcaaaatgacatgtgcatattatagcgccatcagtgaagctaagatcaagaagagacaggctcccgatcccaatttagaatggactcagatttctactcgctatctgcgtgagcaactggccaaaattagtgacttctaccatatggcctcgtcaaccggagacggccccgtccccgtgccccctgaggtcgagcaagctatgaagcaatgggagtacaatgagaaactcgcttttcacatgttccaggagggcatgttggaaaagcatgaataccttacttggatactcgacgtacttgagaagatccgacctatggacgatgaccttttaaagctgctgctccctctgatgttacagtattccgacgagttcgttcaatcagcttatctgtctcgtcggctggcttacttttgcgcccgaaggctgagcttgttactctcagatagtccaaacctgctggctgctcatagtccccacatgatgattggcccgaataattctagcatcggagcacccagccctggtcctccaggtcccggtatgagcccagtgcagctggctttctcagattttctttcctgcgcccaacacgggcccctggtttatgggctatcgtgtatgctgcaaactgtgacgctttgttgtccttccgcccttgtctggaactactccacaaacgagaataaatctgctaatccgggtagccctcttgacctgcttcaggtggccccgagctccttgcccatgcccggcggcaatactgcctttaatcagcaggtgcgcgcccgcatatacgaggtggaacagcaaatcaagcagcgtgggcgggctgtggaggtgaggtggagctttgataagtgtcaagagagcacagcaggagtaaccatttcccgagtcctccacactctagaagtgctggaccggcactgttttgatagaaccgattccagtaattctatggagactttgtatcacaagatattttgggccaaccagaacaaggataaccaggaggtggcaccgaacgacgaggcagtcgtgactttgctgtgcgaatgggccgtgtcctgcaagcgttccgggaagcacagagcgatggccgtagcaaagctgctagagaagcgacaggccgaaatcgaggccgagagatgtggcgagtctgaggtgttggacgaaaaagagagtattagttccagctccttagccgggtctagccttccagtcttccagaacgtgctcctgagattccttgacacacaggcgccaagcctgtcagatcccaactcggagtgtgaaaaggtggaattcgtgaatctcgtgctcctgttttgtgaattcatacgccacgatgtgtttagtcacgatgcttatatgtgtacactgattagccggggcgatctaagtgtcaccgcttcgactagaccccgcagcccggtgggcgaaaacgcagacgagcactactctaaggatcacgatgtgaaaatggaggaacaatctatcatggcccatatggggatcgactctggtacgactaacatattcgatgaagttgataagtcggactttaagactgattttggttctgagttcccgattttctcccccatgcctggagagtcatgcgagaatgcaaatacatcgctgggccgaaggatgtcagttaactgcgagaagctagttaaacgcgagaaaccccgtgaattaatcttcccctccaattatgacctgctcaggcacctgcagtacgctacgcacttccccatccctctggtgagtcattgttttagctag

SEQ ID NO: 123606 - DNA, 2166 bp, Artificial Sequence
  Description of Artificial Sequence: Synthetic coding sequence
atggcggcctttggattgctcagctacgagcagaggcctttaaagcgcccacgtcttgggcccccagacgtgtatccccaggatcccaaacagaaggaggatgaactgaccgcagtaaatgtcaagcagggctttaataaccaacccgcatttaccggcgacgaacacggcagcgccagaaatatagttatcaaccccagcaaaatcggagcttacttctcctcaatactggccgagaagctgaaactgaacaccttccaggacacgggcaaaaagaagccacaggtgaacgccaaggacaactactggctcgtcaccgccaggagtcaaagcgcgatacatagctggttctcggaccttgccggcaataaacctttgtctatccttgcaaagaaggtgcccattctttccaagaaggaagacgtattcgcatacttggccaagtactcggtgcccatggttagagccacctggcttattaagatgacctgcgcctattactcggcgatttccgaggcaaaaattaagaagcggcaagctccggatcctaatctagagtggactcagatctctacgcgctacctgagggagcagttagccaagatttccgacttctaccacatggcgtcctctacaggggacggtccagtccccgtgccccctgaggtagaacaagccatgaagcaatgggagtacaatgaaaagctggcattccatatgttccaggagggcatgttagagaaacatgagtacctcacctggattctggatgtcttggaaaagatccgcccaatggatgatgatctcctgaagttgctattgccccttatgttgcaatacagcgatgagtttgtgcaatctgcctacctctcacgcaggctcgcctatttttgtgccaggcgactgtcccttctgctgtcagattcccctaacctgctggcagcccattcccctcacatgatgatcggacctaataacagttcaattggcgctcccagccccggtcctcccggtcccggtatgtcccccgtccagctggccttcagcgactttcttagttgcgctcagcacggtcccctggtgtacggtctgtcttgcatgttgcagaccgtgaccctctgctgcccgtctgcattagtctggaactattcaaccaatgaaaacaaatcagcgaaccccggatctcccctagaccttctgcaagtggcaccaagcagtcttcctatgccgggggggaatacagccttcaaccagcaggttagggccaggatctatgaagtcgagcaacaaattaagcagaggggaagagcagtggaggtgcgctggtcctttgataagtgccaggagagtaccgctggggtcactatcagccgcgtgcttcacaccctggaggtcctggacaggcattgctttgaccgaactgacagttcaaactctatggaaaccttataccataagatcttctgggcaaaccagaataaagacaaccaggaagtcgcccctaatgacgaggccgttgttactctgctgtgcgagtgggccgtgtcatgcaagcggtctggtaaacaccgcgcgatggccgtggctaaacttctggagaagcgccaagcggagatcgaggcagaaaggtgcggcgagtcggaggttctagatgaaaaggaatccatatcgtctagttccctcgccggttccagtctgcccgtctttcagaacgtgctgctcagattcctcgatactcaagcaccttcactctccgaccccaattctgaatgtgaaaaggttgagtttgttaacctcgtgttacttttctgtgagttcatcaggcatgatgtgttttcccacgacgcatacatgtgcacacttatttctagaggtgacttgagcgtaactgcgtctacaaggcccaggtcgcccgttggagaaaacgccgatgagcattatagcaaagaccatgatgtgaagatggaaattttctctcctatgccaggagaatcctgcgaaaatgctaatacaagcctgggccgcagaatgtccgtgaactgtgaaaagttggttaagcgagaaaagccgcgcgagttaatttttccgtccaactatgacctgctgagacacctgcagtatgccacccacttcccgatccctctggtgagccactgcttcagctag

SEQ ID NO: 123607 - DNA, 6438 bp, Artificial Sequence
  Description of Artificial Sequence: Synthetic coding sequence
atggctgcatttggattactgtcttacgaacagcggcccctgaagcgtcctagactgggacccccagatgtgtacccacaagacccgaagcaaaaggaggacgagctcactgcagtaaacgtcaagcagggctttaataaccaacctgcttttaccggcgatgagcacgggtcagcacggaatatcgttatcaacccctccaaaatcggcgcctatttcagcagtatcctcgccgagaaattaaaactgaataccttccaagatactgggaagaaaaagccacaggtcaatgctaaagacaactattggctcgtcaccgcccggagccagtctgctatccactcctggttttctgacttggcggggaataaacctctgtctatcctggcaaaaaaggtgcccattctgtcaaagaaagaagatgtgtttgcctatctggctaagtacagcgtgcctatggttcgcgccacttggctcatcaaaatgacttgcgcatactacagtgccatttctgaggcgaagatcaagaagagacaggcacccgacccaaatttggagtggactcaaatttccacacggtatctcagggagcagctggccaaaatctcagacttctatcacatggcgagctcaacaggagatggcccagtgcccgtgccacctgaggtggagcaggccatgaagcagtgggagtacaacgaaaagcttgcttttcatatgtttcaagagggaatgctcgagaagcatgagtacctgacatggatactcgacgttctagagaagatcaggcctatggatgatgacctcctgaaattgctgctcccgctgatgttgcaatactccgacgaattcgtgcagagtgcttacctgtcccgccgtctggcgtacttttgcgctagacgcctgtccctgcttctctccgattcaccaaaccttctagctgcccatagtccacacatgatgatcggtcctaataactcttctatcggagctcctagcccaggtccaccaggtcccgggatgagtcccgttcagctggcattctccgattttctgtcatgtgcccagcacggacccttggtctacggcctgtcatgtatgcttcagacagtcaccttgtgttgtcccagtgccctggtgtggaactattccacaaatgagaacaaaagcgccaatcccggctctccactggatctgttacaggtcgctccatcttctctacccatgcccggtgggaatactgcttttaaccaacaagtacgggcacgcatctacgaggtcgagcagcagatcaaacaaaggggacgcgctgtggaagtgcggtggtccttcgataaatgccaggaatccacagctggggtgacaatttcaagggtactgcacaccctcgaggtactggatcgacattgcttcgacaggacagactcatctaattccatggagacgctctatcataaaattttctgggcaaatcagaacaaggacaaccaagaagtggcccccaatgatgaggccgtggttactctgctctgcgagtgggcagtgtcctgcaagagatccggcaaacaccgggcgatggctgtggcgaaactgctcgaaaaacgccaggctgagatcgaggccgagaggtgcggagagtccgaggtgctagacgagaaagaatccatatcctcctctagccttgccggatcctcattaccggtctttcagaatgttctgttgagatttctggacactcaggctccctccctgtctgatccaaatagtgaatgtgagaaggttgagtttgtcaatttggtcctgttattctgtgaattcattagacacgatgtattcagccacgatgcttacatgtgtactctgattagtagaggggacctgtcggttacagcctctacccgtccaagaagccccgtgggcgagaacgccgacgagcactacagcaaggaccatgatgtgaagatggagatttttagccctatgcctggcgaaagttgtgagaatgccaacacctcgttggggagacgaatgagtgtaaattgcgaaaagctggtcaaaagagagaagccgagggagctgatcttcccctccaattacgacctgttgcgacatctgcagtacgcaacccacttcccaattccattggatgagtccagtagtcatgagtgcaatcaacgcactatcctgctttatggtgtgggcaaggaacgcgatgaagcaagacatcagctgaaaaaaatcaccaaagatatccttaagattctcaataaaaaatcaactacggagacgggcgtcggagacgaggggcagaaagcacgcaaaaacaagcaggagacttttcccactcttgagacagttttcacaaagctccaactgctctcatatttcgatcagcaccaggtgacgtcccaaatcagtaacaacgtgttggaacaaatcacaagcttcgcctcaggcacgagttatcacttaccactggctcatcacatccagctgatattcgacttaatggaaccagccctaaatatcaatggtttgatagacttcgctattcagttgttaaacgagctgtcagtcgtcgaggcagagttactgctgaagtcatcatccctggctggttcatacacaactggactatgcgtctgcatcgtcgccgttctgcggcggtaccacagttgtttgatcttgaatcctgatcagacagcccaggtcttcgaagggctgtgcggtgtggtgaaacacgtggtaaacccaagtgaatgctcttcccccgaacgatgcatcctggcttacttgtatgatctgtatgtgtcttgttcccatctgcgatcaaagtttggagatttatttagctccgcctgtagtaaggtgaagcaaactatttataacaacgtaatgcccgccaacagtaacctgcggtgggaccccgatttcatgatggatttcatagaaaatccgtccgccaggtctatcaattatagtatgttggggaaaatcctgtccgataacgccgccaaccgctacagctttgtttgcaatacgctgatgaatgtgtgcatgggtcaccaggatgcggggcgcatcaacgacatcgcaaatttcagctctgaattgaccgcatgttgcactgtgctcagttctgagtggctgggggtgctcaaggcactgtgttgctcatctaaccacgtctggggtttcaatgatgtcttatgtacagtcgacgtatctgatcttagttttcacgactctcttgctaccttcatagcgatccttatcgctcggcagtgtttttcattagaagacgttgtgcagcacgtggcactgccaagtctcctggccgcagcgtgcggagacgccgacgcagagccaggcgctcgaatgacatgtcgactgctgctccaccttttcagggcgccccaggcatgctttctgccccaggcgacaggaaagcctttcccaggcataagaagcagctgcgatcggcacctgttagcggcagcacataacagtatcgaagtgggggcagtcttcgcagttctaaaagcgatcatgatgctgggggatgctaagatcggtaataattccgtgtcatctctgaaaaacgacgactttactatgagaggcctgagatgcgacggcaacgcagacgatatttggactgccagccagaatcctaagagctgcgggaaaagcatctcaattgagaccgcaaatcttcgcgagtatgcaaggtacgtcctgcgcacaatatgccagcaggagtgggttggcgagcactgcctcaaagagccggagagactttgtacagataaagagcttatcctggatcccgttttgtccaatatgcaagcccagaaactcctgcagctgatctgttacccacacggcattaaagaatgtacagaaggtgataacctgcaaagacagcatattaaacgcattctgcagaacttggagcaatggacattacgacagagctggctggaactgcagttgatgataaaacagtgtctgaaggatcccgggagcggttctgttgctgaaatgaacaatctcctggataacatcgccaaggctaccatcgaggtattccagcaatctgcagacctgaacaacagcagcaacagcgggatgtcactcttcaatcctaactcaattggaagcgccgacacttcctctacccgacaaaacggcattaagacattcctgagttcctctgaacgtcgaggagtctggctggtggcccccttgatagctagactgccaacatctgtacaaggccgggtcctaaaagccgcaggcgaagaactggaaaaagggcagcacttaggatctagctcaaagaaagagcgcgaccggcaaaagcagaagagcatgtccctgctctcccagcaaccgttcctgtccttggtcctaacgtgcctgaagggacaggatgaacaaagggaggggcttctgaccagtcttcagaatcaggtgaaccaaatccttagcaactggagagaagaaaggtatcaggatgacattaaggcacgtcagatgatgcacgaagccctgcagctccggcttaatttggtggggggcatgttcgacactgtgcagagaagtacacaatggactacggattgggctctcttgctcctccagatcataacaagcggaacagttgacatgcacaccaacaacgagctgttcacaacagtgctggatatgttgggagtgctgatcaacggcaccctcgcctcagacctctctaacgcttcccccggaggaagtgaggaaaacaagcgcgcttatatgaacctcgtgaaaaagctgaaaaaagaactcggtgacaaacgcagcgaatccattgacaaggtgagacagctcctccccctccctaagcagacctgcgacgtaatcacttgtgagcctatgggctctctgattgacaccaagggaaataagatcgctggttttgatagtattgacaagaaacaggggctgcaggtatcaactaaacagaaggtgtccccgtgggatctttttgaggggcagaagaaccctgcacctctcagctgggcatggttcgggacagttcgcgtcgaccggcgggtgattaaatatgaggagcagcaccacttactactctaccacactcatcccatgcctaaacctagaagttactacctgcagccacttccactgcctcccgaggaagaagaagaggagcctacttccccagtttcacaggagcccgagaggaagtctgccgagctctccgatcaggggaagactacaacggatgaagaaaagaagactaagggccgcaaaaggaagaccaaatcatcctcaagggtagatgagtacccccagagcaacatctaccgggtccctccgaattactctccaatatccagccagatgatgcaccacccacagtccaccctttggggatataatctggtgggtcaacctcagcaacctggcttttttttgcaaaaccagagcctaacccccggaggatctagactagatcctgctggaagcttcgttcccactaacacgaaacaagccctgagcaacatgctacaacggagatccggggccatgatgcagccaccttccctccatgccattacatcacaacagcagttgatccagatgaagttgcttcaacagcagcagcaacagaggctgttacgccaggcccagacacgcccctttcagcagggccagcccggcgaccaggccgcactctttgcggctcaggcacgaccatcacctcagctgcctcagtacccaggtctgcaacaggcacagacaatgcctcaagggtatacgatgtatggtactcagatgcctctgcagcaaacaagccaacagcaggctgggtccgtcgtcctgtccccttcgtacaacagtcgcgcctatcccgcggcccatagcaatccggtgctgatggagcgactgaggcaaattcagcagcagccgagtggctacgtccagcagcaggcctccccctatttgcagcctttaaccggttcacagaggctcaatcatcaagccttgcagcagtctcccctggttggtggaggcatcgatgccgttttgaccagtgcacatcctaatcttccttccgtcccactcccacaggacccaatgcggccacggcagccccaggtgagacagcagcagcgcttgttgcaaatgcagcaaccgcagcaaccgcagccccagcagcccccccagccccaacaatccagccagtcacagagccagacccttggactacaggctatgcagcctcagcagcccttgttcccaagacagggtcttcaacaaacacagcagcagcagcagactgccgcccttgtgagacagttgcaaaagcagctgtcatccaaccagccgcagcaaggggtgaccccttatggacatccgtcgcatttttag

SEQ ID NO: 123608 - DNA, 6522 bp, Artificial Sequence
  Description of Artificial Sequence: Synthetic coding sequence
atgtccgcttctttcgtccctaatggtgcaagcttagaagactgccattgtaatctgttctgtctcgccgacctgaccggaattaaatggaagaagtacgtttggcagggcccgacctcagctccgatacttttccctgtcacagaggaggatcccatcctctccagcttcagtaggtgtttgaaggccgatgtgctgggggtatggcggagagatcagcgcccaggaagaagagaactgtggattttttggtggggcgaagaccccgtgctgctcactctgtttaccatgacatatcagaagaaaaaaatggaatgcgggaggatggactttcctatgaatgccgtactgtgctttcaagctgtacacaacctgctcgaaagatgcttgatgaaccgtaacttcgtgcggatcggaaaatggttcgtaaagccctacgagaaagatgagaaacccatcaataagtctgagcatctgagctgttcatttaccttcttcctgcatggggattccaacgtgtgtaccagcgttgagatcaatcagcatcagccagtctacttgctgtccgaagagcacatcaccctagctcagcagagtaactctcccttccaggttatactgtgtccatttggcctcaatggcacgctgaccggccaggctttcaagatgagtgactcagcaaccaaaaagctgattggcgaatggaaacagttttatcctatctcctgctgcctgaaggagatgagcgaagagaagcaggaagatatggactgggaggatgacagcctcgccgcagtggaggtgcttgtcgccggggtcagaatgatttaccccgcatgcttcgtcttagttccccagtcagatattccgaccccctcaccagttggcagtactcattgtagcagcagctgtctgggcgtacaccaagtgccggctagtactagagaccctgctatgtcatctgttacactgacccctccaacttctcccgaagaggttcagactgtcgacccccaaagcgtgcagaaatgggtaaagttctcttccgtgtccgatggtttcaattcggatagtaccagccatcatggcgggaagattcccaggaagctcgccaaccatgtcgtggacagggtttggcaagagtgcaatatgaatcgtgctcagaacaaaaggaagtattccgcttcttcaggcggtctgtgcgaggaagccaccgctgcgaaagtggccagctgggactttgtagaggctactcagcgtaccaactgtagttgcctccgacataaaaatctgaagtcacgaaacgctggccaacaggggcaagcaccaagcctgggtcagcaacagcaaatcctacccaaacataagacaaatgagaaacaggagaagtcagaaaagccccaaaaacggccactgactccctttcaccatagggtgtcagtaagcgacgacgtgggcatggatgccgacagcgcatcccagcgactggtgatctctgcaccagactctcaagtgcggttctcaaatattaggaccaatgacgttgctaaaacccctcaaatgcacggcaccgagatggcaaatagtccccaaccacctcctttgagtccccacccatgtgatgtcgtggatgagggagtaacaaaaaccccatccactccccagagtcagcacttttatcagatgccaactccagaccctctggtgccctcgaagcctatggaagaccggatcgactctctgagccagtcgtttccacctcaataccaggaagctgtcgaacccacagtttacgtgggaacagctgtcaatcttgaggaggatgaggctaacatcgcatggaagtattacaagttcccgaagaagaaggatgtggaatttctgcctccccaactgcctagcgacaagtttaaggatgatcccgttggaccgttcgggcaagaatccgtaactagtgtgacagagctgatggtccagtgcaagaagccgctgaaagtgtctgatgagctggtgcaacagtatcagattaaaaaccagtgtctgtcggccatcgcgtcagacgcggagcaggagcccaaaatcgacccatatgccttcgtggaaggtgatgaagagttcttatttccagacaaaaaagacagacagaattctgaacgggaagccggcaaaaagcataaggtggaagacggcactagcagcgtcacagtcttgagccacgaggaggacgccatgtctctcttctccccctcaatcaagcaagatgcacctagacccacctcacacgcgaggcctccttctacctctttgatatatgatagtgaccttgccgtgagctatactgacttggataacctctttaattcagacgaagacgagttaacgcccggatccaagaagtccgctaacggcagcgacgataaagccagctgtaaagaaagcaagacaggcaatctggaccccctgagttgtatctctactgccgatctccataagatgtatcccacaccaccttccctggaacagcacattatgggtttctcaccaatgaatatgaataataaggagtatggcagcatggacacaaccccaggtggcacagtgctggaggggaatagtagctccataggagctcagttcaagattgaagtagatgaaggattttgtagccccaaaccctcagagatcaaagacttctcttacgtgtataaacctgagaactgccaaatcttagtggggtgttctatgttcgccccactcaagacccttccaagccaatacctgcccccaatcaaactgcctgaggaatgcatctaccgccagtcttggacagtaggcaaactcgagctactgagttcaggcccatccatgccctttataaaggagggggatggatcaaacatggaccaggagtacgggaccgcctatacaccacagacacacaccagttttggaatgccccctagtagcgctcctcccagtaactccggagcggggatcttaccttctccctcgaccccacgtttccctacacctaggacccccagaacgccacgaacgccacggggtgcagggggcccagcttccgcccaaggatccgtgaagtacgaaaactcagacttgtattccccagcatccaccccctccacgtgccgtcctctgaacagcgtggagccggctacagtaccctccatccccgaagcccacagcttatatgtgaacctgatcctttctgagagcgtgatgaacctcttcaaggactgtaactttgacagttgttgtatttgcgtgtgcaatatgaacataaaaggagctgacgtgggcgtgtacatccccgaccctacacaagaggcccagtacagatgcacatgcgggttctccgcagttatgaatcgaaagtttggaaacaactccgggctgttcctcgaggacgagctggacataattggccgcaatactgattgcggaaaagaggccgagaagaggttcgaggcactgagagctacatccgccgagcacgtgaatgggggccttaaggaaagtgaaaagctctctgatgatctgatactgttgctacaagaccagtgcacgaatctcttcagtcctttcggagccgccgatcaggatccattccctaaatcaggggttatcagcaactgggtacgcgtggaagagagagattgctgtaatgattgttaccttgccctggagcacgggcggcagttcatggataacatgagcgggggtaaggtggatgaagcgctggtcaagtcttcctgtttacatccatggagcaaacggaatgatgtcagtatgcagtgctcccaagatatcctgaggatgcttttgagtctccagcccgtattgcaggatgcaatccagaaaaaacgcaccgttcggccctggggggtgcagggcccactgacatggcagcagttccacaaaatggctggaagaggctcttatggaacagacgaatcccccgaaccgctccccatcccaacattcctgcttggctatgattatgattatctggtgctcagcccgttcgcgttgccatattgggaaaggttaatgctggagccatatgggagccagcgggacattgcttacgtggtgctgtgccccgagaacgaggcgctccttaacggggccaaaagcttttttagagacctcacagcgatctatgaaagctgcagactgggtcagcatagaccggtgtcccggctgctgacggacggcattatgagggtgggttctactgcatccaagaagctgtctgaaaaactcgtggcagagtggtttagccaggcagcagatggcaacaacgaagccttctctaagcttaagctttacgcacaggtctgcaggtatgatcttggcccctacttggcgtcactaccgctcgatagctcactcctaagtcagcccaatcttgtcgcaccaacaagtcagagcctgattactccgccacagatgactaatactggcaatgccaacacgcccagtgcaactttggcttctgctgcctctagcaccatgaccgtcacaagcggtgtggccattagcactagcgtcgcgaccgccaattcaacattgactactgccagtacatcctcgtcaagctcctcaaatctcaattccggcgtctctagtaataagttacccagcttcccccctttcggctccatgaattccaacgccgcaggatcaatgtcaacccaagctaatactgtccagtccggccagctcggtggacagcagacatctgccttacagacagccggcattagtggagagtctagctccttaccaactcagccacacccagatgtgtccgagagcaccatggatagggacaaggttgggatccccacagacggtgacagccatgcggtgacataccccccggcgatagttgtttacattatcgacccttttacatatgaaaacactgacgagtccacgaattcctctagtgtgtggacgctgggactcctcagatgttttttagaaatggtgcaaactctaccaccacacattaaatccactgttagcgtccagatcataccgtgccagtatcttttgcagccagtgaagcatgaagatagggaaatctatccgcaacatctgaagagccttgcattctccgccttcacccaatgtaggcgccctttgcctacatctacaaacgttaaaacccttaccgggttcggacccggattggccatggaaacagccctccgttctcccgacagacctgagtgcatccggctgtatgctcccccctttattctcgcacccgtcaaggacaaacagactgaactgggagagacctttggggaagctgggcaaaagtataatgtcctgtttgttggctattgtttgtctcatgatcagcgctggattttagctagctgcacagacttgtacggcgagttactggagacatgcatcatcaacattgacgtgcccaacagagctagaaggaagaagtcatccgctcgaaaattcggcctacaaaaactgtgggaatggtgtctaggcctggtccagatgtcgtctctaccctggagagtggtcattgggcggctcggtcgcatcgggcatggcgaactcaaggactggtcgtgtctcttgagtagacggaacctgcagtccctgagtaaacgccttaaggatatgtgtaggatgtgcggcatcagcgccgcggactctccaagtatattgagcgcttgcctcgtagctatggagccacagggcagttttgttattatgcccgattctgtctcaactggatctgtctttggcaggtcgacgaccttgaatatgcagacctcccagctgaacaccccccaggatacttcctgtactcatatcttagtgtttcctacttcagcatcggtacaggtggcatctgctacctacaccaccgaaaatctcgacctggcgttcaaccccaacaatgatggtgctgatgggatgggcatcttcgacctcctcgacaccggagatgacctcgatcctgacatcatcaatatactccctgcgtctccaaccggcagccccgtccacagtccaggctcccactatccgcatggaggtgatgccggaaaagggcagtccaccgaccgtctcctgtctaccgagcctcatgaagaggtgccgaacatattacagcagcctcttgctttggggtatttcgtcagcacagctaaagccggccccctgcccgattggttctggtctgcatgcccacaggcccagtaccagtgtccattattcctcaaagcctccctacacttgcacgttccgtcggtgcagtcagacgaactactacattcaaaacactcacacccgttggactctaaccagacctccgatgtgctgcggtttgtcctcgaacagtataatgctttatcttggcttacttgtgatcccgctacccaggatcggcgctcatgtttacctatacacttcgtcgtgctgaaccagttgtacaattttatcatgaatatgctgtag

SEQ ID NO: 123609 - DNA, 6525 bp, Artificial Sequence
  Description of Artificial Sequence: Synthetic coding sequence
atgtcggcctccttcgttcctaatggggctagcttggaggattgccactgcaatcttttttgtttggccgacctgacagggatcaaatggaagaagtatgtgtggcagggtccaacctccgctcctattctgtttccagtgaccgaggaggaccctattctgagctcgttttctaggtgtctgaaggctgacgtgctgggcgtgtggagaagagaccaacgtccaggacggagagagctgtggatcttttggtggggagaggatccaagcttcgccgatctgatacaccacgacctgtccgaggaagaagacggtgtgtgggagaacggactatcctacgaatgccggactttgctgttcaaggcagtgcacaatttactcgaacggtgcctcatgaaccgaaatttcgtacgcatcggaaagtggttcgtcaagccttacgaaaaggatgagaagccaattaataaaagcgagcacctgagttgctctttcacgttcttcttacatggtgacagtaacgtttgcaccagcgtggagattaaccagcaccagccagtttatcttttgagcgaggaacacattacgctggctcagcagagtaactccccctttcaggtgattctgtgccctttcggtctcaatggcactctgacaggccaggctttcaagatgtccgactccgcgactaaaaagcttatcggagagtggaaacagttttatcctatttcttgctgcctcaaggagatgtctgaggagaagcaagaagacatggactgggaggatgacagtctcgcagccgtggaggtgctcgtggccggcgtgaggatgatttacccggcttgtttcgtcctggtgccccagtcggatataccgacaccttctccagttggttctacacactgctcgagcagctgtctcggagtgcaccaagtgcccgcgtccacccgggatcctgccatgtccagtgtcactcttacacctcccaccagccctgaggaggtccagacagtggatccccagtccgtgcagaaatgggtaaagttcagtagcgtgagtgacggatttaattctgactcaacctcgcatcacggcggcaagatacctagaaagcttgcaaatcacgttgtcgatagggtgtggcaagaatgcaacatgaacagggcacagaataaacgcaagtactccgcaagcagcggtggcctgtgcgaggaagccaccgccgcaaaagtggcaagttgggatttcgtggaagccacacagcgaaccaattgttcatgtctccggcacaagaaccttaaatcccgtaacgccggtcagcaaggccaggctccctctctggggcaacagcagcagattctgccaaagcacaagacaaatgaaaaacaagagaagagcgagaaaccccagaagcgaccactgacaccattccaccatagagtcagcgtcagtgacgatgtcgggatggatgctgactctgccagccaacggttagtaatctcagccccagacagccaagtgagattttctaacatcagaacgaacgatgttgcgaagacacctcaaatgcatggcaccgagatggccaatagccctcagcccccaccgctcagcccccatccctgtgacgtggtagatgagggagtaaccaaaaccccctcgacgccccagagccagcacttctatcagatgcccactcctgatcccctagttccctctaagcccatggaggataggatcgacagtctaagtcagtctttcccacctcagtaccaagaagccgtggaacctaccgtgtacgtaggcactgccgtcaatctggaggaggatgaagctaacatagcctggaaatattacaaatttccgaagaagaaagatgttgaatttctgcctccccaactgcctagcgacaagttcaaagatgaccctgtgggcccattcgggcaagaaagcgtgacctccgtaactgaactcatggtgcagtgcaaaaaaccactgaaggttagcgacgagctcgtacaacagtatcagattaagaatcaatgtctgagtgcgatagcgtctgacgctgaacaggaacccaagatcgatccttatgcctttgtagaaggcgacgaggaatttctgtttcccgataagaaggaccgccagaattccgagagggaggctggtaagaaacataaagttgaggacggtaccagcagtgtcaccgtcctctcgcatgaggaagatgctatgtccctgtttagtccgtcaattaagcaggacgccccacgccctactagtcacgcgcggccccccagcacatctctgatatatgactctgatctcgctgtgagttacacggaccttgacaacctgttcaactccgacgaagatgaactgacccccgggagtaaaaagtccgccaatgggagtgacgacaaggcctcctgtaaggaatctaaaaccggcaacctggatcccctctcctgtatttccaccgcagacttacataaaatgtacccgaccccaccctctctggagcagcacatcatgggcttttccccaatgaacatgaataataaggagtatggcagtatggatactacacctgggggcacagtgctcgaagggaattccagtagcataggagcccaatttaaaatcgaagtagacgaaggcttctgttccccaaagccttccgaaattaaagacttctcttatgtctacaaaccagagaactgtcagattttagtgggctgctccatgttcgcaccactcaagactttaccatcacaatacctgcctccaatcaaattgcctgaggaatgcatctatcgccagtcctggaccgtgggcaaactcgaactgctgtcgtccgggccctccatgcccttcattaaggagggtgatggatcgaatatggatcaggagtacgggaccgcgtatacccctcagacccatacctcgttcggcatgccgcccagtagtgcaccaccgtccaactccggcgccggtatactgcctagtccctctacacctagattcccaacgcctcgcacaccacgcaccccacgcactcctcgcggagccggaggccctgcatccgcccaggggtcagtcaaatatgagaactccgacctgtatagccccgcttccaccccatctacgtgcagacccttgaattccgtcgagcccgcaacggtccctagcattccagaggcccactcactctacgtaaacctgatcttaagtgagagcgtaatgaacctgttcaaagattgcaactttgatagttgctgtatttgtgtgtgcaacatgaacatcaaaggagctgacgtgggtgtctacataccagatccaactcaggaggcccagtaccgctgcacatgcggattctctgccgtgatgaacaggaaattcggcaataacagcggcttgttcctcgaagatgagctggacatcattgggcgtaacaccgactgtggaaaagaggcagaaaagcgtttcgaagcactaagagctacatcagccgaacatgtcaatggcggtctgaaagaatccgagaagctcagtgacgatctgatcctgctgcttcaggatcagtgcaccaacctcttcagcccctttggagcagccgatcaggatccattccctaagtcgggtgttatcagcaattgggtgcgagtggaagagcgtgactgttgtaacgattgctacttggccctcgaacacggcagacagttcatggataatatgtcgggcggaaaggtcgacgaagcactcgtaaagtctagctgcctgcacccttggagcaagagaaacgatgtttccatgcagtgctcccaggacatccttagaatgctcttatcactgcagccagtgctgcaagatgctattcagaaaaagcggacagtcagaccatggggtgtccaggggcctctcacctggcagcagtttcacaagatggcggggcgggggagctatgggacggatgaatctccagaacccctgcccatcccgacattccttttgggatatgattacgattatctcgttttatcgccctttgccctgccctattgggagagactcatgctcgaaccctatggatcccagcgcgatatagcatacgttgtcctgtgtcccgagaatgaggccctgcttaacggggccaagtccttcttccgcgatctgaccgccatttacgagtcttgtaggctcggccagcacagaccagtgtccagactgctcaccgacgggattatgcgcgttggaagcacggcaagcaaaaagttgagcgaaaaactggttgcagagtggttctcgcaagccgccgatggtaacaatgaggcattctccaaactcaagctctacgcccaggtatgccgctacgatttaggaccgtatttagccagccttcccctggactcctcgctcctttcccaaccaaatctggtcgcccctacgtctcagtcccttattactccacctcagatgaccaacacaggcaatgccaatacaccctccgccactttagcatccgcggctagcagtacaatgaccgttaccagcggcgtcgccatcagtacttctgtggcaacagctaacagcaccctaacgaccgcaagcacatcaagttcctcgagctcaaaccttaattctggagtgtcttcaaacaagctaccgtcatttcctccgttcggtagcatgaattctaatgccgccggttctatgtcaactcaggcgaataccgtccagtcaggtcaactcggaggacagcaaacatctgcactccagaccgcaggcatctcgggagagtccagttcactcccgacccagccgcaccccgatgttagtgagagcacaatggaccgcgataaagtcggcattccaactgacggagatagtcacgcagttacctatccaccagccattgtcgtgtacattatcgatccattcacctacgagaataccgatgaaagcacaaatagttcaagtgtgtggactctgggcctcctcagatgtttcttagaaatggtccagacattgcctcctcatatcaaatctactgtttcagttcagattattccgtgtcagtaccttcttcaacctgtcaaacacgaggaccgagagatctacccccagcacttgaagagcctggcattttcagcctttacccagtgtcggcggccacttcctaccagcacaaacgtgaagacactgactgggttcggccctggcctggctatggaaaccgcactgcgatcccccgataggccagaatgcatccggctgtatgcgccccccttcatcctggcaccggtgaaggacaagcaaaccgagctgggtgaaacctttggagaagctggccagaaatacaacgtgctgttcgtcggctactgcctttctcatgaccagcgctggatcctcgctagttgcacggatctgtacggtgagctgttagagacctgcatcatcaatatcgatgttccaaaccgggcacgtcgcaagaaaagcagcgcacgcaaatttgggctgcagaagttgtgggaatggtgcctgggcctggtccagatgtcttccctgccttggcgtgttgtgattggacggctgggtcgcataggacacggggagctgaaggactggtcatgtctgctgtcacgaagaaacttgcaatccttgtctaaacggttgaaagacatgtgcagaatgtgtggaatctctgccgccgactcccccagcatcctctctgcttgtctagttgccatggagccccagggctcattcgtaataatgccggacagtgtgagtactggctctgtcttcggcaggagtactactctcaatatgcagacctcacaactgaataccccacaggacactagctgcactcatattcttgtgttccccacctcagcttcagtccaggtggcttctgcaacatacactactgagaatttggacctggcctttaaccctaacaatgacggagccgacggcatgggaatctttgacctcctggacaccggcgacgacctcgacccagacatcattaatatactgcccgcatcacccactggaagcccagtccatagccccgggagccactacccacatgggggcgatgctggaaaaggccagagcacagacaggttactgtcaacggagcctcacgaggaggtgccaaacattctgcagcagcctctcgccttaggatactttgtttctactgcgaaagctggcccgctaccagattggttctggtctgcttgcccacaggcacaataccagtgtccactgtttttaaaggctagcctccacctccatgtgccttccgtgcaatccgatgaactgcttcacagtaagcattcccacccactcgactccaatcagacaagcgacgtactgagatttgtgcttgaacaatacaatgcccttagttggctgacctgcgacccagcaacacaggacaggcgtagttgcctgcccatccacttcgttgtcctgaaccagctgtataactttattatgaacatgctgtag

SEQ ID NO: 123610 - DNA, 6633 bp, Artificial Sequence
  Description of Artificial Sequence: Synthetic coding sequence
atgaccgccgctgccaactgggtggctaacggagcatcccttgaggattgtcatagcaatctgtttagccttgccgagcttacgggaataaaatggcgacgatataatttcgggggacatggagactgtgggccaatcataagcgccccggcccaagatgatccaatcctcttgagctttattcgttgccttcaggccaacctgctgtgcgtgtggcggcgggatgtaaagcccgattgtaaagaactgtggattttctggtggggcgatgagcctaacctggttggtgtcatccaccacgaattgcaagtagttgaggaagggctttgggaaaacggtttgtcttatgaatgcagaacactgttattcaaagcaatacataatctcttggagcgctgccttatggacaaaaactttgtccgtataggaaaatggttcgtgcggccttatgagaaggacgagaaacccgttaacaagtctgaacacctgtcctgtgcttttactttctttctgcacggagaaagcaatgtatgtacaagcgtggagatcgcgcaacatcaacccatttacttgattaacgaggaacatattcacatggctcagagctccccagccccatttcaggtcctcgtgagcccttatggcttgaatggtacattgactgggcaggcttacaaaatgtctgaccctgccacccggaaactcatcgaggagtggcaatatttttatcctatggtccttaaaaaaaaggaagaatccaaggaagaggatgagcttggttatgatgacgacttcccagttgccgtggaagtgatcgtaggcggcgttaggatggtctatccctccgccttcgtgcttatatctcagaacgatatcccggtccctcagagcgtggcatcagccggcggccatattgctgtgggtcagcagggtctgggcagtgtgaaagaccctagcaattgtggtatgccactgaccccacctactagccctgaacaagctatactgggcgagagtggcgggatgcagtctgctgccagccatctagtgtcgcaggacggcggcatgatcactatgcattcgcccaagagaagcgggaagatcccacccaaactgcacaaccacatggtccaccgagtgtggaaggaatgtatcctcaataggacacaatccaagcggtcgcagatgagtacccccaccctggaagaagagcccgcctctaatccggccacctgggactttgtcgaccccactcagcgggtcagctgctcatgtagcagacacaagctgctgaaaaggtgcgccgtgggaccaaatagaccgcctacagtgagccaacctgggttctccgcaggaccatcatctagttcatccttgccaccacctgcctcttcaaagcacaagactgccgagcgccaggagaaaggggataagctgcagaaacggcccttgattccttttcatcatagaccgagtgttgcagaagagctatgtatggagcaggataccccgggccagaaacttggcttagccggaatcgattcaagtctcgaggtgtccagttctcgcaagtatgataagcaaatggccgtgccctcccggaatacaagtaagcagatgaatctgaacccgatggactccccccactcacccatctcccccctgcccccaactcttagcccacagccgcgggggcaggagaccgagtcccttgaccccccaagtgtccccgtgaatccggcattatacggcaatggactggaactccagcagctcagtacactcgacgaccggacagtgctcgttggtcagcggctgccactgatggcagaagtcagcgagacagcactgtactgcggcatcagaccatccaaccctgaatccagtgagaagtggtggcactcctatcgactgccacccagcgatgacgccgagttccgccccccagaactacagggagaaaggtgtgatgccaagatggaggtgaacagtgagtctacagccttgcagcgccttctggctcagcccaacaaaagattcaaaatctggcaggataagcagcctcagctgcagccattgcattttctcgatcccttgcctctaagccagcagcccggtgatagcctcggggaggtcaatgacccgtacacattcgaggacggggacattaagtatatctttacggcaaacaaaaagtgtaagcagggaacagaaaaagactcactgaagaagaacaaatccgaggacgggttcggcacaaaagacgtaactacccccggccattctacacctgtgccagatggcaagaacgccatgagcattttctctagcgcgacgaaaacagacgtgagacaggacaatgctgcagggcgcgcaggcagcagtagtctgactcaagtcacggacttggctccttccctgcacgatctggacaacatctttgacaacagcgacgacgacgagcttggggcggtctcaccggcactacgatctagtaaaatgcccgccgttgggactgaggatcgtcccctcgggaaggacggcagagctgccgtcccgtacccccccaccgtggctgacctgcaacggatgttcccaacacccccttcactggaacaacatcctgccttctcgcctgtaatgaactataaggatggaatctcctccgagactgttaccgccctgggcatgatggaaagtccaatggtgagcatggtgtcaacacagctgacagagttcaagatggaagttgaggatggtctggggagccccaagcctgaggaaattaaagacttttcctacgttcacaaggtgccatctttccagccctttgtggggagtagcatgtttgccccccttaagatgcttccctcgcactgtcttctgcccctgaagatcccagacgcctgtctcttccgaccttcctgggcaatcccccctaagatcgaacagctccccatgcctccggcggccactttcatcagggatggctacaacaatgtcccatccgtcggaagcttagccgatcctgactacttaaatactcctcaaatgaacacaccagtgactctgaatagcgcggccccggcctctaactctggcgccggggtgctgcctagccctgctacaccgaggttctcggtcccaactcctagaacaccccgtactccccgcacaccccgcggcggtggaaccgcctccggacagggaagtgtaaaatacgattcgaccgatcagggatccccagcttcaactccatctacgacaaggcctctcaacagcgtcgaacctgctaccatgcagcccattccagaagctcactcactttatgttacactgattctcagcgacagtgtcatgaatatttttaaggaccgcaatttcgactcatgctgcatctgtgcttgtaacatgaatattaaaggggcagatgtgggcttgtatatcccagattccagtaatgaggaccagtacagatgtacctgcggcttctccgccataatgaaccggaaactaggatacaattcgggactgttcctggaagacgagctggatatcttcgggaaaaactctgacatcggacaggccgctgagaggaggctaatgatgtgccagtctacattccttcctcaagtcgaggggacaaaaaagcctcaggagcctcccatcagcctgcttctcttgcttcagaatcaacacacacagccgtttgcatctctgaactttctagattatatcagctcgaataatcgacagacgttgccatgtgtgtcatggagctatgaccgggtgcaggcggacaacaatgattattggacggagtgcttcaacgccctggaacagggcaggcaatatgtcgacaatcctaccggtggaaaggtggatgaagccctcgtgcgatctgccaccgtacacagttggccccatagcaatgtgctggacatttccatgctgagctcacaggacgtcgtgaggatgctgttgagcctccagcctttcctgcaggacgcgattcagaaaaagaggactgggcgaacgtgggaaaatatacagcatgtccagggcccgttgacatggcaacaatttcataagatggccggaagggggacgtatggctcagaggagtctcccgagcctctgccaattcccaccttactggtcggctatgacaaggacttcctcaccatctcccctttttccttaccattctgggaaagactcctattagatccgtacggtggtcacagggacgtggcatatattgtggtttgccccgagaatgaagcacttctggagggggcaaaaacttttttcagagatttgtccgcggtgtacgaaatgtgcagattgggccaacataaaccaatctgcaaggttctcagggacggcattatgcgagtcggtaagaccgtagcccaaaagctcaccgatgagctggtgagcgagtggttcaatcaaccatggtcaggggaagagaatgacaaccacagcaggctcaagctatatgcccaggtctgccgacaccatctggccccctacttggccacactgcagctggacagctccctcttgatcccaccgaaatatcagacaccaccagccgcggcacagggccaagctacacccggtaatgccggcccactggcacccaacggcagtgcagcccctcccgcgggcagcgcattcaatcccacctctaatagtagcagtaccaacccagccgcaagttcctcagccagcggctcttcagtgccgcctgtgtcttctagcgcttcagcacctggcattagccaaatcagcaccacttcgagcagtggattttctggttcggtgggtggccagaatccctcaactggggggattagtgccgatcggacacagggcaatatcggatgtgggggcgacactgacccaggccagagttcatcccagccctcgcaagatggacaagagtctgtgaccgagcgcgaaagaatagggatccctacggagcccgatagtgccgattcacatgcccacccccctgcagtcgtaatctatatggtggacccctttacctatgccgcggaagaagatagcactagcggaaacttctggcttctgtccctgatgcggtgctatacggagatgctcgataacctcccagaacacatgcgcaacagctttatattgcagatcgtgccttgtcagtacatgctgcaaaccatgaaagacgaacaggttttctatattcagtacttaaaatcaatggcatttagcgtttactgccagtgtcgccgaccacttcctacccagatacatatcaagtccctgaccggttttggacccgccgcttctattgagatgaccctaaagaaccccgaaagaccaagcccaattcaactgtactccccaccctttatcctggcccccatcaaagataaacaaacggaactcggcgagaccttcggagaggcttctcaaaaatacaacgtgctgtttgtaggatactgtctgtcccacgatcagagatggctgctggcttcctgcacggacttgcatggtgagctattggagacctgcgtggtaaacatcgccctgcccaataggagtcggcgttctaaggtgtccgcgcggaaaatcgggctgcagaaattgtgggagtggtgcataggcatcgttcagatgacgtctcttccttggcgcgtagttatcggacggctcgggaggctggggcacggcgagttgaaggactggtccattttattgggagaatgctcattacagacgatatcaaaaaaactgaaagacgtgtgtcggatgtgcggcatatctgcagctgattcaccatctatcctttcggcctgcctggttgcaatggaaccacaaggaagctttgtggtcatgcccgatgctgtgaccatgggcagcgtctttggccggagcacagccctgaacatgcagtccagccagctgaacaccccccaggacgcctcctgcacgcatatcttggtatttcctacttcaagcaccatccaggtggcccccgctaactatcctaacgaggatggattttcacccaacaatgatgatatgttcgtcgacctcccttttcccgacgacatggacaatgacattggaattcttatgaccggcaatttgcacagctcacccaacagtagcccagtaccctcacctggatcgccatccgggatcggcgtcggctcacatttccagcattccaggagtcagggagagcgtttactgtcccgggaagctcctgaggagctgaagcagcagcccctagctttaggctattttgtttccactgctaaggcggaaaatttgccacaatggttttggtcaagttgcccccaggctcagaaccagtgccccttgtttctgaaggcttccctccaccaccatatatctgtcgcccagaccgacgagcttctcccagctagaaattcacagcgcgtgcctcatcccctggattccaagactacaagtgacgtgctgcgtttcgtcctggaacagtataatgctctcagttggctcacctgtaatccagctacccaggacagaaccagctgcctacctgtgcatttcgtcgtgctgacccagctttacaacgcaatcatgaatatcttgtag

SEQ ID NO: 123611 - DNA, 4365 bp, Artificial Sequence
  Description of Artificial Sequence: Synthetic coding sequence
atggctcccgtgcaacttgagaaccatcaactcgtgccacccgggggtggtggtggcgggtctggaggtccacctagtgcacccgctccccccccacctggtgccgcagtggcggctgccgccgctgccgcagcatcaccgggttacaggctgtccactctcattgagtttctgctgcatagggcttactcagaattgatggtactgacggatctgctccctagaaagtccgacgtggagagaaaaattgagattgtgcaatttgcaagcaggactcgtcaactgtttgtacggctgctcgccctggttaagtgggccaacaatgcaggcaaggttgagaaatgcgctatgatatccagtttcttggatcaacaggcaatactgtttgtcgacaccgcggatcgtctggcatccctcgcaagggacgccctggtgcatgcacgcctgccctcattcgctatcccgtacgcaatagatgtactgaccactgggagttatccgcggcttcccacttgtatacgcgacaagattatccctccagacccgatcaccaaaatcgaaaagcaggctacactgcatcagctgaaccagatactacgacatcggctggtgacaactgatcttccacctcagctcgcaaacttgacagtggccaatggacgcgtgaaattcagggttgagggcgagtttgaggcgacccttaccgtcatgggagatgaccccgatgtgccatggagattgctgaaattagagatacttgtagaggacaaggagacaggagacgggcgagccctggtccactctatgcaaatcagtttcatccaccagcttgtccagtctcgactgttcgctgatgaaaaaccattgcaggacatgtacaactgcctccatagcttctgtttatccctgcagttagaagtattgcactcacagacattaatgttaattagggagcgttggggtgacttagtgcaggtagaacgttatcacgctggtaagtgtctctccctgtctgtttggaatcagcaggtcctaggcaggaaaactggtactgcttccgttcataaggtaaccatcaagatagatgagaacgatgtgtctaaacctctccagatatttcacgatcccccactgccagccagtgactctaagcttgtggaaagagctatgaagattgaccacctctctatagagaagttgttgattgacagtgtgcacgctcgggcacaccagaaattacaggagttgaaagctatattgcgagggttcaacgccaacgaaaacagcagcatcgagactgctctgccagctcttgttgtgcctatcctcgaaccatgcggcaattctgagtgtcttcacatatttgtggatctgcacagcggcatgtttcagctcatgttgtatgggttagatcaagcgacactcgatgatatggagaaatccgtgaacgatgacatgaagagaatcatcccttggatccagcagctgaagttttggttaggccagcagcgctgtaaacagagcattaagcacttacccacaatctcgtctgaaaccttgcagctcagtaattacagcacgcaccctataggaaacctctccaaaaacaagttgttcatcaaactgacccgactgccccagtactacatagtcgtagagatgctcgaagttccaaataagccaacgcaactctcttacaagtactacttcatgtctgtgaatgccgcggaccgcgaagatagcccagcaatggcgctcctgctccagcaatttaaagaaaatatccaggatctcgtatttaggaccaagactggaaaacagacccgaacaaatgccaagagaaagctgtctgacgacccatgcccggttgaatccaagaaaaccaagagggcaggtgaaatgtgtgctttcaataaagtcttggcacactttgtcgcgatgtgtgacacaaacatgccctttgttgggctgagactggagctgtccaatctagaaattccgcatcagggggtgcaggtagagggagacggtttttctcacgcaatccgcctgctcaaaattcctccctgtaagggtatcacagaggagacgcagaaggccctcgaccggagtcttctagactgtacgttcaggttgcaaggtcgcaacaataggacatgggtagctgagcttgtctttgctaattgtcctctgaacggcacatctactagagagcaagggccttcccggcatgtttatctcacctacgagaatctactgtctgaaccggtgggtggccgaaaggtggtggaaatgttcctgaacgactggaactccattgctaggctgtatgagtgcgtgctggagtttgcaaggtccctgccagatatccccgcacacctcaacatcttttccgaggtgcgtgtctacaactatagaaagctgatcctttgctatgggacgacgaaggggagctccatctccattcagtggaatagcatacaccagaaatttcacattagtctcggcacagtcggaccgaattctggctgtagcaactgccataatacaattctgcaccagctgcaggaaatgttcaataagacccctaatgtggtacagttattgcaggtgctcttcgacacacaagccccccttaacgctatcaataagctgcccaccgttcctatgctaggactgacacaaaggacaaacacagcctaccagtgtttctccatcttgcctcagtcaagtacacatatcagattagcttttaggaacatgtactgtatagatatctactgcaggtccagaggggtggttgctataagagatggtgcttactctctgttcgataactccaagctggtggagggtttctatccagcccctggccttaaaacattcctcaatatgttcgtagatagtaaccaggacgcaaggaggaggtcggtgaacgaggacgacaaccccccgagtcccattgggggcgatatgatggactctctgatttctcaacttcagccccctccgcagcagcagcccttcccgaaacagcctggcacatcgggcgcgtaccccctcaccagcccccccacatcttaccattctactgtcaatcagagcccttctatgatgcacacccagtccccagggaatctccatgcagcgtcttctccttcaggcgcacttcgcgctccttcgcccgccagtttcgttcctacgccaccaccatcttcccacggcataagcattggtcccggagccagctttgcctccccacatggtactctcgatcctagcagcccctataccatggtctccccttcaggaagagccggaaattggcccggctcccctcaggtatctggaccctctccggcagccaggatgccaggtatgagccccgccaacccatctttgcactcaccagtgccggacgcttctcacagtcctcgagcaggtacatcttcacagactatgccaaccaacatgcctccacctaggaaactgccgcaaagatcctgggccgcaagcataccaaccatcttgactcatagcgccctgaatatcctcttactgcccagcccgactccaggccttgtccctgggttagctggttcttacctgtgttccccccttgagaggttcctggggagcgttatcatgcggcggcatctgcagaggattatccagcaggagactctgcagctgattaatagcaacgaaccgggagtgattatgttcaaaacagacgcactgaagtgccgcgttgcactctcccccaagaccaatcagacccttcagcttaaggttacccctgagaacgcaggacagtggaagcccgatgagttgcaggtattagagaagtttttcgaaacacgggtggcaggaccccccttcaaggccaataccctgatagcatttacaaaactgctaggcgccccgacccacatcctgcgggattgtgtgcatatcatgaagctcgagttgtttcctgatcaggccacacaactcaaatggaatgtgcagttctgcctcacaatcccgccctctgccccccctattgctccccccgggacacctgccgtggtactgaaaagcaagatgctgtttttcttgcagctaactcagaagaccagtgtccccccacaggaaccagtgagcattatagtgccaattatttacgacatggcatccggaaccacgcaacaggccgacatcccaaggcaacagaactcatccgtcgccgctcccatgatggtgtccaatatactcaagcggttcgcagagatgaatccgcctaggcagggcgagtgcaccatcttcgcagcagtgcgtgacttgatggccaaccttaccctgcctcccggcggtcgcccctag

SEQ ID NO: 123612 - DNA, 468 bp, Artificial Sequence
  Description of Artificial Sequence: Synthetic coding sequence
gtggcggggccacctttcaaagcgaacacattgattgcgttcacgaagcttcttggggcccccacccatattctccgggattgtgtacacatcatgaagctggagcttttcccagaccaggcaacccagctcaaatggaacgtccagttctgccttactatacctccaagcgcacccccaatcgccccacccggaactcctgccgttgtgttaaagtcaaaaatgctgttttttctgcagctcacacagaaaacatccgtaccaccccaggagcccgtgtctattatagtaccaatcatttacgatatggcgtccggtacgacccagcaggcagatatacctaggcagcagaattcatctgtcgcagcccccatgatggtgagcaatattctgaaacgcttcgcggaaatgaaccccccgcgacagggctcaatcaagggcaccggatgcccgagtgatttcctctag

SEQ ID NO: 123613 - DNA, 996 bp, Artificial Sequence
  Description of Artificial Sequence: Synthetic coding sequence
ccctcaggtcgggccggtaattggccgggatccccacaggtgagcggccccagtccagccgcccgtatgccgggtatgtccccagccaacccaagtctgcactcccccgtccccgacgctagccactctcctcgggccgggacaagctcacagacaatgccaaccaatatgccacctccccggaaactccctcagaggagctgggcagcgtcaatacccacaatcttgacacacagcgcattgaacattctcctcctgccttcgccaacccccggccttgtgccagggctggccggaagctatctgtgcagccccctggaacgtttcctgggctccgtgatcatgaggcgacatctccagcggatcatccagcaagagacactccagctgatcaattccaatgagcccggggtaatcatgtttaagactgatgccctcaagtgccgcgtggccctgagcccaaaaaccaaccaaactctgcagctgaaagtgactccagagaacgccggacagtggaaaccagatgaactgcaggtcctagaaaaattcttcgaaacacgagtggccggccccccctttaaggcaaatacgctgatcgcctttaccaagttactcggggcgccaacccatatactgcgtgattgcgtgcacatcatgaaactcgaactcttcccagaccaggccacgcaactgaaatggaacgtgcagttttgccttactatccctccatccgcccctccgatcgctcctccagggacccccgctgttgtgctaaagagcaagatgctgttttttctgcagttgacccagaaaacctccgtaccccctcaagagcctgtcagtattatcgtccctatcatctatgacatggcctccggaactacccagcaggcagacattccccggcagcagaactcgtccgtggcagcccctatgatggtcagcaatattctgaagcggttcgccgagatgaatcccccgaggcaggggacatag

SEQ ID NO: 123614 - DNA, 2367 bp, Artificial Sequence
  Description of Artificial Sequence: Synthetic coding sequence
atggatgtgagcggtcaggagacagattggagatccaccgcattcaggcaaaagctagtttctcagatcgaggacgcaatgcgcaaggccggcgttgcccacagcaagtcctctaaagacatggagtcacatgtgtttttgaaggccaagacaagagacgagtatttatccctggtcgccaggcttatcatccacttccgcgatatccataataagaaatctcaggcttctgttagtgaccctatgaacgctctacagagcttgaccggggggccagctgcaggcgccgccgggattggaatgccacctcgaggccccgggcagtctcttggtggtatgggttcactaggggcgatgggacaaccaatgtccctttctggtcagccacccccaggaactagtggaatggctcctcattctatggcggtcgtatccaccgcaacccctcagacgcagcttcagttacaacaagtggctctgcaacagcagcagcagcaacaacagtttcagcaacaacagcaggccgcgcttcaacagcagcagcaacagcagcaacagcaacagttccaggctcagcagtctgcgatgcagcagcagttccaagccgttgtacagcagcagcagcagttacaacagcagcagcagcaacaacagcaccttataaaactccaccatcagaatcagcaacagatccagcagcagcaacaacagctgcagaggattgctcaactccagctccagcagcagcagcaacaacagcagcagcagcagcagcagcagcaacaggcactccaagcacaaccacctatccagcaaccgcctatgcagcagccccagccaccccccagccaagcattgccgcagcagctgcagcagatgcaccatacccaacaccaccaacctcctcctcaaccgcagcaacctcccgtcgcacagaaccaaccttcacagttgcccccgcaatctcagactcagcctctcgtgagtcaggctcaagcattgcccggccagatgctgtacactcagcccccccttaaattcgtgcgcgctcccatggtggtccagcaaccaccggtgcagccacaagtgcagcaacagcagaccgcggtgcagactgctcaagccgctcagatggttgcaccgggcgtgcagatgattacagaggcactcgcccagggtggcatgcacatacgagcccggtttccccccacaactgctgtttcagcaataccttctagctccatacctctggggaggcagcctatggcccaggtcagccagtcgtccctgcctatgctcagtagtcctagccctggccagcaggtgcagacccctcagtccatgccaccacccccacagccttccccacagccagggcagcccagctcacagcctaatagtaacgtcagttcagggcccgcgccttccccttcgtcctttctgccctcgcctagtccacagccatcacaatcaccagtgaccgccaggaccccccagaacttctccgtgccctctccggggcctctgaacacaccagtgaacccgtcatctgtcatgtcgcctgctggctctagtcaggccgaggagcagcagtatttggataaactgaaacaactttccaagtatatcgagcccctaagaaggatgatcaacaagattgacaagaacgaagaccggaagaaggatctaagcaagatgaaaagcttactcgacatactgacggaccccagtaagcggtgccccctgaagactctccagaaatgcgaaattgcactagagaagctgaagaatgacatggcggtccccactcctcctcctccccctgtgccccccaccaaacagcagtatctgtgtcagcctctgctcgatgccgtgctcgcaaatattaggtctcctgtgttcaatcactccctgtaccggacattcgtccccgctatgacagcaatccatggccctcccatcacagcgcctgttgtgtgcactcggaaaaggcgactggaggacgatgaaagacagagcatcccttctgtcctccagggggaagtagctaggctggaccccaagtttctggtcaaccttgatcccagccattgctccaacaatgggaccgtacacctgatttgtaaactggatgacaaggatcttcctagtgtgccgcccctcgagctgagcgtgcccgcagactatcctgcacaatcccctttatggattgaccgtcagtggcaatatgatgccaaccctttcttgcagtccgtccacagatgtatgacaagcaggcttttgcagctacctgataaacacagtgtgactgcgttgcttaatacatgggcccagagcgtgcatcaggcctgcctgtctgcggcttag

SEQ ID NO: 123615 - DNA, 2247 bp, Artificial Sequence
  Description of Artificial Sequence: Synthetic coding sequence
atggacgttagcggacaggagactgactggcggagcaccgctttccgacagaaactcgttagtcaaattgaggacgccatgcgcaaggccggtgtggctcactccaaaagtagtaaggatatggagtctcacgtctttttgaaggccaagacacgggatgaatatctgtcactggtcgccagactgattatccactttagggatatccacaacaaaaaatcccaggcctccgtgagtgatcctatgaatgccctccagagcctcacgggaggccccgccgctggtgctgccgggattggcatgcccccaagaggccccgggcaaagcttggggggaatggggtccctcggagccatgggccagcctatgtctctgagcggacagccccccccagggacgtccggcatggccccccactctatggcagttgtgtccaccgccacaccccagacacaattacagctccagcaagtggccctccagcagcagcagcagcagcagcagtttcagcagcagcaacaagccgcgttacaacaacaacagcaacagcagcagcagcagcaattccaggcacagcagagtgcgatgcaacagcaattccaggccgtggtgcaacagcagcagcagcttcagcagcagcagcaacagcagcagcatttaatcaaattgcaccaccagaatcagcagcagattcagcagcagcagcaacagctccaaaggattgcacaactgcagttacaacagcagcaacagcagcagcaacaacaacaacagcaacaacagcaggctctgcaggcccagcccccaatccagcagccccccatgcagcagccgcagccaccccccagccaagctctcccgcagcaactccagcagatgcaccacactcagcaccatcagccccccccccagcctcagcagcctcctgttgctcagaaccaacccagccagctccctccacagtcgcagactcaacccttggtttctcaggctcaagccctccctgggcaaatgttgtatacacagcccccactcaaatttgtgcgagctcctatggtggtccaacagcctcccgtgcagccccaggtgcagcagcagcaaacagcagttcagacagctcaggctgcgcaaatggttgcacccggagtccaggtctcccagtcaagcctaccaatgttaagttcaccgagcccagggcaacaggttcaaaccccacaatccatgccgccacctccccagccctcgcctcaacccggtcagcccagctcccagccaaactcaaacgtgtcatccgggccagccccctccccctcttctttcctgcccagcccctcccctcaaccttctcagtccccagtgacggctcgtactccgcagaacttttccgtgccttcgcctggacctttgaatacccctgtcaacccatctagcgtgatgtcccctgcagggagcagccaagccgaggagcaacagtacctcgataaactgaaacagctcagtaaatacatagaaccactgcggcgtatgataaataagattgacaagaatgaagatcgcaagaaagacctctctaagatgaagagtctcctggatatcctcaccgatccaagtaagagatgtccgttgaagactctgcaaaagtgcgagattgccctagagaagctcaaaaatgacatggccgtgcctacccccccaccgcccccagtgccaccaaccaagcaacagtacctgtgtcagccgctacttgatgcggtgctggccaacattagatcaccagtattcaaccatagtttgtaccgcaccttcgttccagcaatgacggctatccacgggccccctatcacagctccagtggtgtgcacccgcaagaggcgcctggaagatgacgaaaggcaaagcataccttcagtgcttcagggagaagtggcaagattggatcctaagttccttgtaaacctagacccttcacactgttccaataatggtacagtgcatttgatttgcaaactggatgacaaagaccttccaagtgtaccgcccctggagctcagtgtgcccgctgattaccctgctcagagcccgctgtggattgataggcagtggcaatatgacgcaaatcctttcctgcaatcagtgcaccggtgcatgacctcgcgtctcttacagctgcccgacaaacacagcgttaccgccctcctgaacacatgggcccagtccgtgcatcaagcatgtttgagtgctgcatag

SEQ ID NO: 123616 - DNA, 2034 bp, Artificial Sequence
  Description of Artificial Sequence: Synthetic coding sequence
atggacgtctcgggccaggaaactgactggcgctccaccgcttttaggcagaaattagtatctcaaattgaggatgccatgaggaaggccggggtggcacactccaagtcttctaaggatatggagagccacgtctttttgaaggcaaagaccagggacgaatacctttctctcgttgcccgcctgatcattcactttcgggacattcacaataagaaatctcaagcaagcgtgtccgcccaactccaacttcaacaggtagcgctccagcaacaacaacagcaacaacagttccaacaacagcaacaagccgccctccagcagcaacagcagcagcagcagcagcaacaattccaagcccagcagtccgctatgcaacagcaatttcaggccgttgtccaacagcagcagcaactgcaacaacagcagcagcagcaacagcatttgattaagctgcaccaccaaaatcagcagcagattcagcagcagcagcaacaactgcagcgaattgcccagctgcagttacagcaacagcagcagcagcaacagcagcagcaacaacaacagcagcaagcgttacaggcacaaccgccgatacagcaaccgcctatgcagcaaccacagccacccccgtcgcaggcactgccccagcagctgcagcagatgcaccatactcagcatcaccagcctccccctcagcctcagcagcccccagtagcccaaaatcagccttctcagctaccaccgcaaagccagacgcaaccactagttagccaggcccaggctctgcccggccagatgctgtacacccagccacccctgaaattcgtcagagccccgatggtggttcagcagccgccagtgcagccccaggtccagcaacagcagactgcggttcagaccgcccaagccgcacagatggtggcgccaggtgtccaagtctctcagtcttctctcccaatgctcagttccccttctcccgggcagcaggtgcagacccctcagtcgatgcctccacctccacagccctctcctcagccaggccagccatcctcccaaccaaatagtaatgttagctcagggcctgccccctctccttcgtccttcctgccctctccatcccctcagccctctcagagtccagtaaccgctcgcacccctcagaacttctccgtgccctcccctggccccctgaacaccccagtcaatccatccagtgtaatgagcccagcaggtagctcccaagctgaggagcagcagtacctggataagcttaagcaactcagcaagtatatcgaaccgttgcgcaggatgataaataagatcgataaaaatgaagacagaaaaaaagatttgtctaagatgaagagtctgctggacattctgaccgaccccagtaaacgatgccctctcaaaacactgcagaaatgcgaaatcgcgctggagaaactgaagaacgatatggcggtgcctacgccaccaccaccacccgttcctcctacaaagcagcaatatctctgccagcctttgttggacgcagtgctggctaatattcgctcacccgtgttcaaccatagtttatatcgaacttttgtgccagctatgaccgcaatccacggtcctcctattaccgcaccagttgtatgcacccggaagagaaggttggaagacgacgagcgccaaagcatcccgtctgtgttgcagggggaagtggcaagactagacccaaaatttctggtaaatctagatccaagtcactgctccaataacggcacagtacacctgatctgcaagcttgatgacaaagacctgcccagcgtcccacccttggagctaagcgtgccggctgattaccccgcccaatctcctctctggatagaccgccagtggcagtacgatgcaaatcctttcctccagagcgtccatcggtgtatgacctctaggctcctccagttgcccgacaaacatagtgttactgctcttctcaatacttgggcccagtccgtacatcaagcatgtctatctgccgcatag

SEQ ID NO: 123617 - DNA, 2169 bp, Artificial Sequence
  Description of Artificial Sequence: Synthetic coding sequence
atgaggaaagcaggagtcgctcattctaagtcaagtaaggatatggagtcccacgttttcctgaaagcgaagactagggatgaatacctcagtttggtggctcgactaatcatccattttagagatatccacaacaaaaagagccaggcgtcagtctcggatccaatgaatgcactgcagtcactgactgggggccccgccgcgggcgccgccggaatcggaatgccaccccgtgggcctggccaatcattgggaggcatgggtagcttgggtgccatgggccagcctatgtctcttagcggtcagccacctccaggtactagcgggatggcgccccattctatggccgttgttagcaccgctaccccccagacccagcttcaacttcagcaggttgctctacaacagcagcagcaacagcagcagttccagcaacagcagcaggccgcccttcagcagcaacagcagcaacaacagcagcaacagttccaggctcaacaatctgccatgcagcagcagtttcaggcagtggtgcagcaacagcagcaacttcagcaacagcaacagcagcagcagcaccttatcaagctgcatcatcagaatcagcaacaaattcagcaacagcagcaacagcttcaacggatcgcgcagttgcagttgcagcagcagcaacagcagcaacagcagcaacaacaacagcaacagcaagccctgcaggctcaacccccaattcagcaaccccccatgcaacagccgcagccgcccccgtcccaagcccttccacaacagctccagcaaatgcaccacacacagcaccatcagccccccccacagccccaacagcctcccgtcgcccagaaccagccctcacaacttcctcctcagagccaaacccagccattggtgtcccaagcccaagcactgccagggcagatgctgtacacccaacccccgttgaaattcgtacgcgcacctatggtggtccagcagccaccagtgcaacctcaggtgcagcagcagcagaccgccgtgcagacagcccaggctgctcagatggttgcccccggagtacaggtcagtcagtcatctctccctatgttgtcttcacccagtccgggtcagcaggtccagacgcctcagtccatgccccccccgccacagccctccccacaacctggacagccatcctcacaaccaaactctaacgtctcgtccgggccagcccctagtccgtcatctttcctcccttctccctcccctcagccttcacagagccctgtcaccgctcgtactccccaaaacttttccgtcccctctccagggccccttaatacccccgttaacccttcttctgtgatgtcccccgcaggtagtagccaggcagaggagcagcagtacctggataagcttaagcagctgtccaaatatattgaacctctgaggcgaatgattaataagatcgataaaaatgaggataggaagaaagacctgtcgaaaatgaaatctctacttgacatcctgacggacccttctaagcggtgtccactgaaaactcttcagaagtgcgagattgctttagaaaagctgaagaatgatatggctgtccccacgcctcctccgccccccgttcccccaacaaagcagcagtatctgtgtcagcccttacttgatgctgtcttggcaaacatacggtctccggtgttcaatcacagcctatatcgtacatttgtgccagcaatgaccgcaattcacggtccgcctatcacagcgcccgtcgtatgtactagaaaaagaagacttgaagacgacgagcggcagtcgattccttctgttttgcagggtgaggtcgcacgcctggatccgaagtttttggtcaatctggatccaagtcattgttctaataacggtacggtgcacttgatctgcaaattggatgataaagatctcccatcagtacccccactggagctgtctgttcccgcagattatccagcccagtctcccctgtggatcgacagacagtggcaatatgatgctaacccttttctgcagtcagttcaccgctgtatgacctctagactgctacagctgccagacaagcactctgtgaccgcattgctcaacacatgggctcagagtgttcatcaggcctgtctcagcgcagcctag

SEQ ID NO: 123618 - DNA, 1914 bp, Artificial Sequence
  Description of Artificial Sequence: Synthetic coding sequence
atggagtcacacgtgttcctgaaagcaaaaacaagagacgagtacctgtctttggtcgcccgacttattatacactttcgcgacatccacaacaagaagtcccaagctagcgtttcagcccaattgcaacttcaacaagtcgccctgcagcaacaacaacagcagcagcagttccagcaacagcagcaggccgccctgcagcaacaacagcagcagcagcagcagcagcaatttcaggcacagcagagtgccatgcagcagcagtttcaggccgtggttcaacaacaacagcagcttcagcagcagcagcaacaacagcagcacctgatcaaactccaccaccagaatcaacagcagattcagcagcagcaacagcagctccagagaattgctcaattgcagctacaacaacaacagcagcaacagcagcagcagcagcagcaacaacagcaagcattgcaagcccagcccccaatccagcaacctccaatgcagcagccccagccacctccctcccaggcgctgcctcagcagctgcagcagatgcaccacacccagcatcatcagccgccaccccagccacagcagcctcctgtggcacagaaccagccttcccagctccctcctcagtctcagacgcagccactggtgtcccaggctcaggccttgcccgggcagatgctgtacacccagccccccctaaagtttgtgagagctccgatggtggtgcaacagccccccgttcaacctcaggtgcagcagcagcaaacagctgtacagacggcccaggctgcccagatggttgcccccggtgtccaggtgtctcagtctagcctgcccatgttatcctcccccagccccggacaacaagtgcaaaccccacagagcatgcctcctccgccccagccctccccccaacctggacagcccagctctcagcctaattcaaatgtgagcagcgggcccgcacctagccccagtagtttcctgcctagccccagcccccaaccatctcaaagcccagtgactgctcggacaccgcagaacttcagtgtaccttcaccgggccccctgaatacacctgtcaaccccagctcagtgatgtctcctgctgggagttctcaagctgaggagcagcagtacctggacaagttgaagcagctatctaagtatattgagcctttgaggcgaatgatcaacaagatcgacaaaaacgaagaccggaagaaggatttatctaaaatgaagtccctgttggatattctgacagacccctccaagaggtgccccttgaagactctgcagaagtgcgagatcgctctcgagaagctgaagaacgatatggcggttccaaccccccccccccctcctgtccctcctacaaagcaacagtacctgtgccaacctcttctcgacgcggttttagcaaacatccggtcaccagtgttcaatcattccctttaccgtacttttgttccagcaatgaccgccattcacggcccccccataaccgcacccgtggtgtgtacaaggaaacggagactggaagacgacgaacggcagagtattccaagtgtgctgcagggagaagttgcaaggctggacccgaaatttttagttaatcttgacccatcccattgcagtaacaatgggaccgtccacctcatctgcaaactggatgataaggacttgccctccgttccacctttagaactttccgttccagcagattatccagcccagagtcctctgtggatcgaccgtcagtggcaatatgacgccaacccatttctgcaatcagtgcataggtgtatgacatcaaggctcctccagttaccagataagcacagcgttactgccttgctgaacacatgggctcaatctgtgcaccaggcctgtctgtcggcagcctag

SEQ ID NO: 123619 - DNA, 2169 bp, Artificial Sequence
  Description of Artificial Sequence: Synthetic coding sequence
atgcgaaaagctggggtcgcccatagcaaatcttccaaagatatggagtctcacgtcttcctgaaggctaagaccagggatgagtatctcagcctggttgcccggcttattatccactttagagatattcacaacaaaaagtcacaggcatccgtctctgaccccatgaatgctctccagagcctgaccgggggccccgccgccggcgcagcaggcatagggatgcctcccaggggccctggccagtccctgggtggcatgggcagcctgggcgccatggggcaacctatgtctttgagcggccagcccccacccggaacaagcggtatggccccacactcaatggccgtagtgagcacggctaccccccagactcaactgcagctgcagcaagtggccctgcagcaacaacagcagcagcagcagtttcagcagcaacagcaggccgctttacagcaacagcaacagcagcagcaacagcagcagttccaagcccagcaatccgccatgcagcaacagttccaggcagtcgtacagcagcagcaacagcttcaacagcagcagcagcagcagcaacatctgataaaattgcaccaccagaaccagcaacaaatccaacaacaacagcagcaactgcagcggatcgcacagttgcagctccaacagcagcagcagcagcagcagcagcagcagcagcagcaacagcaagctttgcaggcccagccaccgattcagcagcctcctatgcagcagcctcaaccaccaccatcacaggcccttcctcaacaattgcaacagatgcatcacacccaacaccaccaaccccctccgcagccccagcagcctcctgtcgcacagaaccaaccgtcacagctgcctcctcagagccagacccagcctttggtgtctcaggctcaggctctacccgggcagatgctttacacccaacccccactgaaattcgtgagagctccgatggtggtacagcagcccccggttcagcctcaagtacagcagcagcagacagccgttcagaccgctcaggccgcccagatggtggccccgggtgttcaggtcagtcagtcttccctccctatgctcagctctccctcgcccggccagcaggtgcagacaccccagtccatgcctcctccccctcagccatcgccccagcccggtcagccaagcagccagcctaattctaacgtctcctctggacctgctccttcccctagtagttttctaccaagtccttcaccccagccttcacagtcgcctgtcacggccagaacaccccagaacttttccgttccatcccccggacccctgaacacgcccgtgaaccctagttccgtaatgtctcccgccggctcgagtcaagctgaagagcagcagtacttggataagctcaaacagctcagcaaatatatcgaacctctgcgaagaatgattaacaaaatagataaaaacgaagaccgcaaaaaagacttgtctaaaatgaagtcactgctggatattctcactgacccaagtaagcgatgtccacttaagacactccagaagtgtgagatcgcattagaaaagctgaaaaatgatatggctgtgccgacccctcctccgccaccagtccctcctaccaagcaacagtacctgtgtcagccgcttctcgatgccgtgttggcaaacatcaggtctcctgtgtttaaccacagcctctaccgcactttcgtgcctgccatgacagctatccacggcccccctataactgcccctgtggtgtgcacaagaaaacgacgcctggaagatgacgagcggcaaagcatcccgtcagtcctgcagggcgaggtcgcccgtttggaccccaaatttctggtaaatctggacccatctcattgcagtaacaacggaaccgtgcaccttatctgtaaactcgatgacaaggacctcccatctgttcctccattggaactcagcgtccctgctgactatcccgcccaaagtccgctgtggatagacagacaatggcagtacgatgccaatccctttctgcagagcgtccatagatgcatgaccagcaggctcctgcaactccctgataaacactcagtgacagcattactcaatacgtgggcgcagagcgtccaccaagcttgcctttctgcagcctag

SEQ ID NO: 123620 - DNA, 2157 bp, Artificial Sequence
  Description of Artificial Sequence: Synthetic coding sequence
atgcgcaaagcaggagttgcccattccaagagtagcaaagacatggagagtcacgtgttcttaaaggcaaagaccagggacgaatatttgagcttagtggcacggctgatcatacattttagggatatccataacaaaaagtcccaggcttctgtgtctgaccctatgaatgccttacaaagcctgacaggagggcctgctgccggcgctgccggaataggtatgccacccaggggccctggacagtcccttggtggtatgggatcgttaggcgccatgggtcagcccatgtcgctgtccggccagcctcctccgggcactagcgggatggctccacactctatggctgtggtctccacagctactcctcaaacccaacttcagctgcagcaggtagctctgcagcagcagcagcagcaacagcagttccaacaacagcagcaggcagctctgcagcaacagcagcagcaacaacagcagcaacagtttcaggctcagcagtccgctatgcagcagcagttccaggcagtggtgcagcagcagcagcagctccagcagcagcagcagcagcagcagcacctcattaagctccatcaccagaaccagcagcagcagcagcagcaagccctacaggcacaacccccaattcaacagcctcccatgcaacagccccagccacctccatctcaggccctaccgcagcaactgcaacagatgcaccacacacaacaccaccagcctcctccccagccccagcaaccacccgtggcgcagaaccagcccagccagctgccaccccagagccaaacccagcccctggtgtctcaggcacaagccctccctggacagatgttatatacgcaaccaccactgaaattcgtgagagcccctatggtcgttcagcagccacctgtccagcctcaagtccagcaacagcagacagccgtccagactgcccaggcggcccagatggtagctccgggcgtccagatgatcacggaagcactagctcagggaggcatgcacattcgagctagattcccccccaccacagctgtctccgcaattccttcttcaagtataccattgggcaggcagcccatggcacaacaggtgcagactcctcaatctatgcctcccccccctcagccctccccccagcctggtcaaccttctagccagcctaattcaaacgtctcctccgggcctgctccatcaccctcatcctttttgcccagccccagcccacagccatcacagtcaccagtcaccgccagaacaccccagaatttcagcgttccatcccccggaccgctgaatacacctgtgaatccttcttctgtgatgagtcccgctgggtcatctcaggccgaagaacaacagtatcttgataaactaaagcagcttagcaagtacattgagcccctacgccgaatgatcaataagatagataaaaatgaggacagaaagaaggatctgagtaagatgaagagtctgttggatatcctaactgatccaagcaaaaggtgtccccttaaaacactgcaaaaatgtgaaatagctctggaaaagttgaaaaatgatatggccgtgccaacacctcccccccctcccgtcccaccaacaaaacaacagtacctgtgtcagcccttgctggacgccgtacttgccaacatccgttctcccgtgtttaatcactcgctctaccgcacgtttgtccccgccatgaccgcgatccatggcccacccatcacagctcccgtggtgtgcaccaggaagcgtagactcgaggatgacgaacgtcaaagcatcccctccgtactgcaaggcgaggttgcccgcctcgaccccaagttcctggtaaatctggacccaagtcactgcagcaacaatgggacggttcatctaatttgcaaactggatgataaggacctgccatccgtcccccccttggagttatcagtacctgccgattaccctgctcagagccctttgtggatagataggcagtggcagtacgatgctaacccatttttacagtctgtgcacaggtgcatgacaagccgccttcttcagctgcctgacaaacacagcgtgacagccctcttgaacacctgggcccagtctgtgcaccaggcatgtctgtctgccgcttag

SEQ ID NO: 123621 - DNA, 570 bp, Artificial Sequence
  Description of Artificial Sequence: Synthetic coding sequence
atgcagcagcagttccaggccgtcgtgcaacagcagcaacaactacagcagcagcagcagcaacagcaacacctcattaagctgcaccatcagaaccaacagcagattcagcagcaacagcagcagcttcagcgaattgctcaacttcagctgcaacagcagcagcaacagcaacagcaacaacagcagcagcaacagcaggcgcttcaagcccaaccacctattcagcagcccccaatgcagcagccccaaccccccccaagtcaagccttaccccagcaactgcagcaaatgcatcacactcagcaccatcagccacctccacagcctcagcagccaccagtcgcacagaaccagccatcccagttgcctccccaaagccagactcaacctcttgtttcccaagcccaggctctgcctggccagatgttgtacacccaacctcccctcaaatttgttagggctcccatggtggttcagcagccacctgtacagcctcaagtgcaacagcagcagactgcggtacagaccgcccaggctgctcagatggtggcaccgggagtgcagtag

SEQ ID NO: 123622 - DNA, 1956 bp, Artificial Sequence
  Description of Artificial Sequence: Synthetic coding sequence
atgagcggggttagagcagtgcgcataagtatcgagtccgcatgtgagaaacaagtacatgaggttggactggacggcaccgagacctatctgccaccgctcagtatgtcacagaacctggcacgactagctcagcggatcgatttttcccagggcagcgggtctgaggaagaagaagccgccggcactgagggcgacgcccaggagtggcctggcgcgggcagctcagctgaccaggacgatgaagagggcgtggtaaaatttcagccttccttgtggccatgggatagcgttcggaacaatttgcgcagcgcactgaccgagatgtgtgtgctgtatgacgtgctgagtatagtccgtgataaaaaatttatgactttagaccccgtatctcaggatgctctgccaccgaaacagaatccacagacccttcagttgatctcgaagaagaaaagtctggcgggcgcggcacagatattgctgaaaggagctgagagactgactaagagtgttacagaaaatcaggagaataaactgcagcgggacttcaattccgaactcctgcggctgcgacagcactggaaactgcggaaagtaggtgataaaattctgggggatctctcctaccggtcagcagggtccttgtttccccaccatgggaccttcgaagtgatcaagaacacagacttggatcttgataagaagatcccagaggactattgtccccttgacgtacaaatcccctctgacctcgaagggagcgcgtatatcaaagttagcattcagaagcaggctccagacattggtgacctgggaacagtaaatctgtttaaaaggcctttgcctaagagcaagccaggttccccccattggcagacaaagttggaagcagcacaaaatgttttgctatgtaaggagatcttcgcccagctcagtcgcgaggcggtccagatcaagtcacaagtcccgcatattgtagtgaaaaaccagatcatttcacaacctttcccttctcttcagctgagtatctcactgtgccatagcagcaacgataagaaatctcagaaatttgcgaccgaaaagcaatgccccgaggaccatctttatgtgttggaacataacctgcacctcctcataagagagtttcacaagcagacattatcgagcatcatgatgcctcaccctgcctccgctccctttggtcataagagaatgcggttgtccggcccacaggccttcgataaaaatgaaattaacagcctccaatcaagcgaaggccttttagagaagatcataaagcaggctaaacacatattcctccggagccgtgccgccgccactatcgactctctggcgagcaggattgaagatccacaaatccaagcccactggagtaacattaacgatgtgtacgaaagtagcgtaaaggtcttgataactagccagggctatgaacagatatgcaaatccatccaactgcagctcaatattggggtggagcagatccgcgtggttcaccgggacggcagggtgattaccctgagctatcaagagcaggagcttcaggacttcctgctgagccagatgtctcagcatcaggtgcatgccgtccaacaacttgccaaggtcatgggctggcaagtcttatcctttagtaaccatgttggactgggcccaattgagtctatagggaacgctagtgcgattactgtagcttctccctctggcgattatgctattagcgtccgaaatgggccagaatcgggaagcaaaattatggtgcagttcccacggaatcagtgcaaagacctgccaaaatcagacgtattgcaagacaacaaatggtcccatttaagagggcccttcaaggaagtgcagtggaataagatggagggtagaaattttgtctataagatggagttactcatgtcagccttgtctccatgcctcttgtag

SEQ ID NO: 123623 - DNA, 1866 bp, Artificial Sequence
  Description of Artificial Sequence: Synthetic coding sequence
atgtccggcgtccgggcagtgagaatcagcattgagagcgcctgtgagaagcaggtccatgaggtcggactggacgggaccgagacttatctccctcccttatcaatgtcacaggaatggccgggtgccggcagctctgctgaccaggacgacgaggaaggagtagtgaaatttcagccctccctgtggccatgggattcagtaagaaataatctgcggtccgccctgacggagatgtgtgtgctttatgatgtcctctcaatcgttcgcgataaaaagttcatgactcttgacccagtgagccaggacgctttgcccccaaagcagaacccccagacccttcaactgatctccaaaaagaaatccctcgctggggcggcgcagatactcctgaaaggcgctgagaggctgacaaagtccgtaactgaaaaccaggaaaataagctccagagagacttcaatagcgaactgttaaggcttagacaacactggaaattgcgaaaggttggagataaaatcctgggcgacctgtcataccgtagcgcaggatccttgtttccacaccatggtactttcgaagttataaagaatacagatttagaccttgacaaaaaaatccccgaggactattgccccctagatgtccaaattccttctgacctcgagggatctgcttatatcaaggtcagcatccagaagcaggctccggacatcggtgatctgggaaccgtgaatctgtttaagcggccgctgccaaagagcaagccaggctcgccacactggcagacaaagcttgaagcagcacagaacgtgttgctttgtaaagagattttcgctcagcttagcagggaagcggtgcagatcaagtcccaagtacctcatatcgtggtgaagaaccagatcatctcccaaccttttccgagtctccagttgtctatatctctatgtcacagtagcaatgacaagaagtcacaaaagtttgcaaccgagaagcaatgccctgaggaccatctgtacgttcttgagcacaatctgcacctgctcatcagagagttccacaaacagactctgtctagcatcatgatgcctcacccagcatccgcacctttcgggcacaaacgcatgaggttgagcgggccacaggcatttgacaagaacgaaataaattcgctgcagagcagtgaaggcttgctagagaagatcataaaacaagcaaagcacatattcctgcggtcccgtgctgcggccactattgactcattggccagccgaatcgaagatcctcagatccaggcccattggtcgaacataaatgatgtgtacgaatcttccgttaaagtcctcatcacgagccagggctacgagcagatttgtaagtccattcagttgcagctgaatatcggcgtcgaacaaatcagggttgtgcatagagatggtagggtcattactttatcctatcaagagcaagaactgcaggactttctcttgtcccagatgtcacagcatcaagtgcacgcagtgcagcaactcgctaaagtgatggggtggcaggttctttcgttcagtaatcacgtgggactaggcccgatcgaatccatcgggaacgcttcagcgatcaccgttgcgagcccctcgggggattacgctatctcagtgaggaacggccccgagagtggttcaaaaatcatggtgcagttcccgcgcaatcagtgcaaagatcttcctaagtctgatgtgttgcaggacaacaagtggtcccatctgcgggggcctttcaaggaggtgcagtggaataagatggagggcagaaacttcgtgtataagatggaattgctgatgtcagcattgtccccctgccttctctag

SEQ ID NO: 123624 - DNA, 438 bp, Artificial Sequence
  Description of Artificial Sequence: Synthetic coding sequence
atgagcggagtccgcgccgtccgcattagcattgaatccgcctgcgagaagcaagttcatgaagtggggctggatggtaccgagacctaccttcctcccttgtctatgtctcagaatctagccaggctcgcacaacgtattgacttcagccagggatccggaagcgaggaggaggaagctgcgggcaccgaaggcgacgcacaagaatggccgggagccggatcctccgccgaccaagacgatgaggagggggtggtgaagttccaaccatcactctggccttgggacagcgtacgcaacaacctccgatcagccttaaccgagatgtgtgtactgtacgacgttctgtctatcgtgagggataagaagtttatgaccctcgaccctgtttcacaagatgcactcccaccgaagcaggtctttgtcgactttaactag

SEQ ID NO: 123625 - DNA, 627 bp, Artificial Sequence
  Description of Artificial Sequence: Synthetic coding sequence
atggaagctccccctgttaccatgatgccagtgaccggcggcacaatcaacatgatggagtacctgctccagggaagcgttttggaccattctcttgagagcctgatccatcgactcagaggactgtgcgataatatggaaccagagacttttctggaccatgaaatggtgtttctgctgaagggacaacaagcatcaccatttgtactgagggctagaaggagcatggatcgtgcaggggctccctggcacctacggtacctggggcagcccgaaatgggagataagaatagacacgcccttgtgcgaaattgtgtggacattgcaacatctgagaatctcaccgatttccttatggagatgggctttcggatggatcatgagttcgtcgctaaagggcatctgttcaggaagggcatcatgaagatcatggtgtacaaaatctttcgaatcctggtgcccggcaatacagattccaccgaggcgttgtcactttcctacctagtggaattgtccgtggtagcaccagcgggccaggatatggtgtcagacgatatgaaaaactttgcggagcagcttaaacccttggtgcatcttgaaaaaattgacccaaaaaggctgatgtag

SEQ ID NO: 123626 - DNA, 627 bp, Artificial Sequence
  Description of Artificial Sequence: Synthetic coding sequence
atggaggctccgccagtcacaatgatgcccgtgaccgggggcacgattaacatgatggaatacctcttgcaaggaagcgtcctggaccacagtcttgaatcactgatccatagacttcgtggcctctgtgacaacatggagcccgagacatttcttgaccacgagatggtgtttctcctgaaaggccagcaagcctctccattcgtactaagagctagacgttcgatggaccgggctggcgcgccatggcacttaagatacctgggtcagcctgaaatgggcgataaaaatcgacacgcactggtccgaaactgtgtcgatattgccacaagcgagaacctcaccgattttctcatggaaatgggatttagaatggatcacgagtttgtggctaaaggccatctattcaggaaaggcataatgaagatcatggtgtacaagatcttccggatcttagtgcccgggaacacggacagcaccgaagctctgagcctgtcctacctggtggaattgtctgtcgtcgctccagctggacaggatatggtatccgacgatatgaagaactttgccgaacaattgaagcccctggtccatttggagaaaattgatccaaagagactgatgtag

SEQ ID NO: 123627 - DNA, 585 bp, Artificial Sequence
  Description of Artificial Sequence: Synthetic coding sequence
atggagaacttcaccgctcttttcggcgctcaggccgatcctccacctccacctactgccctggggtttggccctgggaagccccccccacccccccccccacccgcaggaggcgggccgggtactgcccccccacccacagcagcaaccgcccctcccggcgccgataaatccggcgccggatgcggccccttctaccttatgcgtgagttaccgggatctactgaactgaccggctctactaatctgataacacattataatcttgaacaggcctacaacaagttctgtgggaagaaagtgaaagaaaaactaagtaactttctgcccgatctgccgggaatgatcgacctgccaggatcacatgataattctagcctccggtccctgatagaaaagccgcccattctgtcttcttcttttaatcctataacaggcaccatgctggccgggtttcggctgcataccggtcccctgccagagcagtgccggctgatgcatattcaacctcccaagaaaaagaacaaacacaagcataaacagagcagaacacaggaccccgttcctcccgggaagccaagctag

SEQ ID NO: 123628 - DNA, 735 bp, Artificial Sequence
  Description of Artificial Sequence: Synthetic coding sequence
atggagaatttcacggccctgttcggcgcgcaggcagaccccccaccccctcctactgccttaggtttcgggcctggcaaacctccaccaccgccccccccacccgctggcggtgggccaggcacagcgcctccacctactgccgccacggccccaccgggtgcagacaagtctggagctgggtgtggccccttctacctaatgagagagctgcccggtagtacagagctaaccggttcaaccaatctgatcacacattacaacctagaacaggcttataacaagttttgtggaaagaaagtgaaagagaagcttagtaacttcttgcctgatctgcccggcatgattgatttacctggctctcacgataattcttccctaaggtctctaatagagaagccgccaattctttcatcaagtttcaaccctattactggaactatgctcgctggatttagactacacaccggaccactcccggagcagtgcaggttaatgcatatacagcccccgaaaaagaaaaacaaacacaagcacaaacagagcagaacgcaagatccagtgcctccagaaacaccctctgattcagaccataagaaaaaaaaaaagaaaaaggaggaggaccccgagaggaaaagaaaaaaaaaggaaaagaaaaaaaagaagaaccggcactccccagaccatcctgggatgggaagtagtcaggcatcatccagctctagcctgcggtag

SEQ ID NO: 123629 - DNA, 639 bp, Artificial Sequence
  Description of Artificial Sequence: Synthetic coding sequence
atgggagtgacatgtgtgagccagatgcctgtggctgaaggcaagagcgtccagcagacagttgagcttctgactcggaaactggagatgttaggagccgagaaacaaggcactttttgtgtggactgtgagacctatcatacggccgcctctacccttgggtctcaaggacagaccgggaaattgatgtatgttatgcacaactctgaatacccactctcctgctttgccttgttcgagaacggtccatgcctgatagcagacactaactttgacgtccttatggtgaaactgaagggcttttttcagtccgccaaggcttcgaagattgaaacaagggggacgcgataccaatactgtgactttttagtcaaggtggggacggtcaccatggggccaagtgcccgcggcattagcgtagaagtggagtacggtccatgcgtggtggcctccgactgttggtccttgctcctggagttccttcagtcattcttagggagccacacccccggtgcccctgctgtgttcgggaatcgccacgacgctgtttacggcccagcggatacgatggtgcagtacatggagctgttcaacaagattcggaagcaacagcaggtgcctgttgctggaatcagatag

SEQ ID NO: 123630 - DNA, 423 bp, Artificial Sequence
  Description of Artificial Sequence: Synthetic coding sequence
atgcccgtagccgagggcaagagcgtgcaacagaccgtcgagttactgactcgcaaactcgagatgctcggcgcagagaagcagggaacattttgcgttgactgcgaaacctatcacactgcagcctcaacactggggtcccagggccagacaggcaaactgatgtacgtgatgcataatagtgagtatccgctgtcttgctttgccttgtttgagaatggtccttgcctgatcgcagacactaacttcgatgtgctcatggttaaattaaaagggttttttcagtccgccaaagccagtaaaattgagacacgggggactcgataccaatactgtgacttcctggtcaaggtggggacggtcacgatggggccctccgcacgcgggatatccgtggaagtagagtacggcccctgtgtatag

SEQ ID NO: 123631 - DNA, 438 bp, Artificial Sequence
  Description of Artificial Sequence: Synthetic coding sequence
atgggtgtgacatgcgtgtctcagatgcctgtggctgagggcaagagcgtgcaacagacggtagaactcctaacaagaaagctggaaatgttaggcgcagaaaaacaaggcaccttttgtgtcgactgtgaaacctaccacacagcagctagtaccctaggaagccagggtcaaaccgggaagctgatgtatgtaatgcataattcagaatatcccctgagctgtttcgccctttttgagaatggcccctgtctcatcgcagacaccaactttgacgtactgatggtgaagctgaaaggtttttttcagtcagcgaaggcgtccaagattgagacaaggggtactaggtaccaatattgtgacttccttgtcaaggttggcactgtaaccatggggccctcagcacggggcatttccgtggaggtacgaccctggtag

SEQ ID NO: 123632 - DNA, 372 bp, Artificial Sequence
  Description of Artificial Sequence: Synthetic coding sequence
atgggcgtgacgtgtgtaagtcagatgcctgttgccgaggggaagtcagtccagcagaccgtggaactcctcactaggaagctcgagatgctgggtgcagagaagcaggggactttttgcgtcgattgtgaaacatatcataccgctgcaagcaccctgggatctcaagggcagacgggtaaactgatgtacgtgatgcataattcagagtaccccctctcctgttttgcgctgtttgaaaacgggccctgccttatagccgacaccaactttgatgtactgatggtcaagctgaaaggattctttcagtccgctaaagcatccaaaatcgagactagggggactaggtggtcaatggccccagtctggtag

SEQ ID NO: 123633 - DNA, 435 bp, Artificial Sequence
  Description of Artificial Sequence: Synthetic coding sequence
atggctgatagactgacccagctgcaagatgccgtgaactccctcgctgaccagttttgtaatgctattggcgtgttgcagcagtgcggtcccccggcctcgtttaacaacatacaaactgccatcaataaagaccagccggccaacccaaccgaggaatatgcacaattgttcgcggctctgatcgcaagaacggccaaggacatagacgtgctgatcgattcgctgccttctgaagagagtacggccgcgctccaggccgcgagcctatacaagctggaagaagaaaaccacgaagccgctacctgtctggaagatgttgtgtaccgcggggacatgcttctggaaaaaatccagtccgccctggcggatatcgctcagtcccagttgaaaaccaggagcggcacacattctcagtctctcccagacagctag

SEQ ID NO: 123634 - DNA, 4098 bp, Artificial Sequence
  Description of Artificial Sequence: Synthetic coding sequence
atggagacacagctgcaatccatctttgaggaagtggtgaagacagaggttatagaagaggcatttcccggcatgtttatggacactcctgaagacgagaagactaagctaataagctgtttgggggccttccgccaattctggggcgggctgagtcaggaatcccatgaacagtgcattcaatggattgtcaaatttattcacggccaacacagccctaagagaatcagcttcctgtacgactgtttggccatggccgtggagaccggtctgctgcctcctcgactagtatgtgagagcctcatcaactctgataccctcgaatgggagagaactcagctctgggcccttacgttcaagctagtgcggaagattatcggaggcgttgattacaaaggagttagggacctactgaaagtcatcctagagaagatcctgaccatccctaatactgtgtcctcagctgtggtgcagcagttgcttgccgctagggaggtcattgcatatatcctggagcgcaacgcctgtttattgccagcctacttcgccgtgactgagatcagaaagctctacccggaggggaaactaccacactggcttctcgggaatttggtcagtgacttcgtggacaccttcagacctactgcacgcattaactccatatgcggcaggtgttccctcctgcccgtagtgaacaacagcggagccatctgcaattcatggaagctagaccctgctaccctgaggttccctcttaagggcctcctgccatatgacaaggacctcttcgagccccaaacggcgctgctgagatacgtcctagagcagccttactcccgggacatggtgtgtaacatgctgggcctaaacaaacagaccctgaacatcgcccagcacaaacagcggtgccctgtgctggaagaccagctggtcgacctggtggtatacgccatggagcggtcagaaacagaggagaagtttgacgatggaggcactagccagctgctgtggcagcacctaagcagtcaactaatattctttgtactgttccagtttgctagttttccccatatggtgctcagccttcatcagaagctcgcgggcagaggactcattaaaggaagagatcacttaatgtgggttctgctccagttcatctccggctccatacaaaaaaacgccctggccgactttctgcccgtgatgaaattattcgatctcctgtacccagagaaagagtatatacccgttcccgacattaacaaacctcagagcacacatgcattcgctatgacgtgcatctggatacacctcaaccggaaagctcagaatgacaattctaaattacagatacccattccacactctctccgcctgcaccacgaatttctgcaacagagcttgcgcaataaaagtttacagatgaatgactacaagattgcccttctgtgtaacgcgtattctaccaactcggagtgctttaccctgcccatgggtgccctggtggagaccatttatgggaatggtatcatgaggatcccgctcccagggacaaactgcatggcatcaggaagtatcactccgctccctatgaacttgcttgattctctgactgtgcatgcgaagatgtcactcatccatagtattgcaacgagggtcattaagcttgcccatgccaagtcaagcgtggccctggccccagcacttgtcgaaacctactcacgactactggtatacatggaaatcgaaagcctcgggatcaagggattcatcagtcagctgctgcctacagtgttcaaatcccatgcctggggaattttgcataccctccttgagatgttttcctaccgaatgcatcatatccagccacactaccgcgtgcaactgctttcccacctccacactctcgccgcagtggcgcagaccaatcagaatcagctgcacctgtgtgtggagtcaacagcactgcgcctgattactgccctcggatctagcgaagtgcagccccagttcacgaggttcctgtctgacccaaagacggtgttgtcagctgaatccgaggaactgaacagagccttaatcctgactctggctcgtgcaacgcacgttacagatttttttactggatcggatagtatccagggtacgtggtgcaaagatatcctccagacaatcatgtctttcactccacataactgggcctcacacacattgtcgtgcttccccgggcccctccaggctttcttcaagcagaataatgttccacaagaaagcagatttaacctgaaaaagaatgttgaggaggaatataggaaatggaagagtatgtccaacgagaatgatattataacccatttctccatgcaaggatcaccccccctgtttctttgcctgttatggaagatgctgctggagacagaccacattaatcagatcggctaccgtgtgcttgagagaattggcgctagagctttggttgcccacgtcagaactttcgcggactttcttgtctatgagttttcaacatctgctgggggacagcagcttaacaagtgtattgagatactgaatgacatggtctggaaatataatatcgtaaccttggacagactcatactttgtttggcgatgcggtcgcatgaaggaaacgaagcccaagtgtgttatttcattattcagcttctattactaaaacctaatgatttccggaacagggtaagcgacttcgttaaggagaattctccggagcattggcttcagaacgattggcatactaagcatatgaattaccacaagaagtacccagagaaactctattttgaaggactggccgagcaggtggatccccctgtgcaaattcagtccccatatctgcccatctacttcgggaatgtgtgccttcgcttccttccagtttttgatattgtgattcacagatttctcgagttattacctgtttctaaaagcctcgagaccctgctggaccatctgggtggactgtacaagtttcatgaccgccctgtcacttatctttacaataccctccactattatgagatgcatctgcgcgaccgggcattcctcaaacgaaaattagtacacgcaattattgggtccctgaaggacaaccgccctcaaggctggtgcctcagtgacacatatttgaaatgcgctatgaacgcgcgggaggagaatccgtgggtgcccgacgatacatactactgcaggctcattggcagactggtagataccatggcaggtaaatcacccggaccatttccaaattgcgactggcggtttaacgaattcccaaaccccgcggctcacgcactccacgtgacctgcgtcgagctcatggcgttggcagtatcgggtaaggaggtcgggaacgccctgttgaacgtggtgctcaaatcccaaccattagtacccagagagaacataacagcctggatgaacgctattggactgatcataactgctctcccagaaccatactggatcgttcttcatgatcgaatcgtttcagttattagctcaccttcactgacctccgagaccgagtgggttggatacccttttcgactctttgatttcacggcctgtcaccagtcttactcggagatgagttgctcttatacgctcgccctggcccatgcagtgtggcaccactccagtataggccagttatcattgatcccaaagtttcttacggaagtgctgctgcctattgtcaagacagagtttcaattactgtacgtgtatcacctcgtcggtccattcctccagcgtttccagcaggagcgcacccgctgcatgatcgaaattggcgtcgccttctacgacatgctgctgaacgtggaccagtgcagtacccatttgaactatatggatcccatctgcgacttcctctaccacatgaaatacatgttcacaggagactctgtgaaagagcaggtagagaaaattatctgtaacctcaaacctgccctcaaactgcgcctgcgattcattactcatatttcaaagatggaacccgccgccgtgcctcctcaggctatgaacagcggttcacccgccccacagtccaaccagtag

SEQ ID NO: 123635 - DNA, 2661 bp, Artificial Sequence
  Description of Artificial Sequence: Synthetic coding sequence
atggaaactcaactgcagtcaattttcgaagaggtggtgaaaacagaggtgatcgaagaggcttttccaggcatgttcatggacaccccagaggacgagaaaaccaagctcatttcatgcctgggcgcctttcggcagttttggggcggcctgtcgcaagagagccacgaacaatgtattcaatggatcgtgaaatttatccacggccagcactctcctaaacgcattagtttcctctatgattgcttagcaatggcagtcgagaccggtctgctgccccccaggttggtgtgtgaaagtttaatcaattccgatacgctggaatgggagcggacacagctgtgggcgcttacatttaagctcgtgcggaagatcatcggcggagttgattataaaggcgtacgggatctcctcaaggtcatcctagaaaaaattctcacgattccaaacacagtttcttccgctgttgtgcagcaacttctcgcagccagagaagtgattgcatacatcctagaaaggaacgcttgtctgttgcccgcttatttcgccgtaaccgagataaggaagctttacccagaaggcaaactaccacactggttgctgggaaacttggtgagcgattttgttgataccttcagacctacggctaggataaactcgatctgtggcagatgctccttgcttcctgtggttaacaactctggggctatctgtaactcctggaaactcgatcccgccacccttcgcttccccctcaagggtttgctcccttacgacaaggacctctttgagccccaaaccgccctgctgaggtacgtgctggagcaaccctactctcgcgatatggtatgcaatatgctcgggcttaataagcagactttaaatatagcgcaacacaagcagagatgccctgtgctagaagaccaattagttgacctcgtagtttacgccatggagcggtcagagacggaggagaaatttgacgatggtggcactagtcagctactatggcagcacctttcctctcagttgatattttttgtcctttttcagtttgccagtttccctcacatggtactcagcctccatcagaagctggcggggcgcggcttaattaaaggccgtgaccacctgatgtgggtgcttcttcagtttatctccggctccattcaaaagaacgcactcgcagattttctgcctgttatgaagctgtttgacctgctgtaccccgaaaaagagtacattcctgtgccggacattaacaagccacaaagcacccacgcatttgctatgacatgcatttggatccacctgaacaggaaggcccagaatgataactccaagctccaaataccgattccacattccttgagacttcaccatgagttcttgcaacagagcctgcgcaataaatccctgcagatgaacgactataagattgctctcctgtgtaatgcctattccaccaatagcgagtgcttcacactgcctatgggtgccttggtagaaacaatctacggaaatggcataatgcggatcccgctgcctggaactaactgtatggctagtggctctatcacgccactccctatgaacctgctagacagcctgactgtgcatgccaagatgtccctcatccattcaatcgccacccgtgttatcaagctcgctcacgctaagtcgagcgtggccctggctcctgccctcgtcgagacctactctaggctgctggtttatatggagattgaatccctgggaatcaaagggtttatctctcagctactccctacagtgtttaagtcccatgcatggggaattctgcacacacttctagagatgttttcgtataggatgcaccatatacagcctcattacagagtacaactgctgtcacatctccacaccctggccgctgttgcacaaacgaatcagaaccagctgcatctgtgtgtcgaatctactgccctcagattaatcacagcactgggaagttccgaggtgcagcctcagttcacacggttcctctccgatccaaagactgtcctgagcgccgagtccgaagagctgaatcgggccctgatcctaaccctcgccagagcaacccacgtgaccgactttttcaccggcagcgattcaatccagggtacatggtgtaaggacatactgcaaaccatcatgtcctttacaccgcataactgggcttcacacacattgtcgtgctttccagggccgttacaggctttcttcaaacagaataacgttccacaggagtctcggttcaacctaaaaaaaaatgttgaggaggagtataggaagtggaagagtatgagcaatgaaaatgacataataacacatttcagtatgcaaggcagtcctcccctttttctgtgcctcctctggaaaatgctgctcgaaacggatcatattaaccagatcggatatcgagtgctggagagaatcggtgcgcgcgccctggtcgcccacgtgcgcactttcgctgacttcctcgtctatgagttcagcacgtccgctggaggacaacaactcaataagtgcattgagatactcaatgacatggtctggaagtacaacattgtcacccttgatcgccttatcctgtgtctcgtgcgaatcaataccttcttgagcctcttttcttag

SEQ ID NO: 123636 - DNA, 4125 bp, Artificial Sequence
  Description of Artificial Sequence: Synthetic coding sequence
atggagactcagctgcagagcattttcgaggaagtcgtgaagaccgaagtcatcgaggaagccttcccgggcatgttcatggatacccccgaggatgaaaagaccaagttgatttcttgcctcggggctttccgccagttttggggaggcctttcccaagaatcccacgagcaatgtatccagtggatagtcaagttcatccacggtcaacactctcctaagaggattagtttcctttacgattgcctggctatggccgtcgaaaccggactcctaccgccacgcctggtctgtgaatctctcatcaacagcgatactctggagtgggagagaacccaactctgggccctcactttcaaactagtgcggaaaataataggaggcgtcgattacaagggtgtgcgggaccttcttaaggtgatcctggagaaaattctaaccatcccgaatacagtatcatcagctgtggtccaacagctattagccgcccgcgaagtaatcgcgtacatcctggaacgtaacgcctgcctgcttcccgcctattttgccgttaccgagatccgaaagttgtatcccgaagggaaacttccccattggctgttgggtaacctggtgtcagacttcgtagataccttccggcctaccgcgcgcatcaattccatctgcgggcggtgctctctcctgcccgtcgtgaacaatagtggcgcaatctgcaattcctggaagctcgacccagcaacactgcgtttccccctgaaagggcttctcccgtacgacaaggaccttttcgaacctcagacagcgctactgaggtatgttttggaacagccttattcccgagatatggtgtgcaatatgctcggactgaataaacagactctcaacatcgctcaacataagcaaagatgtccagtactagaagatcagttggtagacttggtcgtgtacgccatggaaaggagtgagacagaagagaagtttgatgatggtggtacgagtcagctgctgtggcaacatctctcctcacagctgatcttcttcgtgctcttccaatttgccagctttcctcacatggtgcttagtctgcaccagaagctggccggacggggactgatcaagggcagagatcacttgatgtgggttctccttcaattcataagcggcagcatacaaaaaaatgcactcgctgacttcttgccagtgatgaagctattcgatctgctgtatcccgaaaaggaatacatcccggtgcctgacataaataaaccccaatccactcatgcattcgcaatgacctgcatttggattcacctgaatcgaaaagcccagaacgacaattcgaagcttcagattcccattccccacagtttgaggctgcaccacgagtttcttcagcaaagcctgcgcaacaagtccttgcagatgaacgattataagatagcactgctctgtaacgcgtattccacaaactccgagtgtttcactctgcctatgggagcacttgtggagacgatctacggcaatggcattatgaggatcccgctgcctggcaccaactgcatggcctctggctctatcactccactcccgatgaacctccttgatagcctgaccgtccatgcaaagatgtccctaatccactccatcgcgacgagagtgataaaattagcccacgctaagtcctcggtggccctggctcctgccctcgttgaaacttacagtaggctgcttgtgtacatggagattgaaagtctcggcatcaagggcttcatcagccagctgcttcccaccgtttttaagtcacacgcttggggcatccttcatacactgctcgaaatgttctcctaccggatgcatcacatccagcctcactacagggttcagctactctctcacctgcacaccctggccgctgttgcacaaaccaatcagaatcagctacacttgtgtgttgagtcaaccgcgctacgcctgatcactgctttgggctcttccgaggtgcagccacagttcacacgattcttgagtgaccccaagacggtgttgtcagcagagagtgaggagcttaatcgtgcgctcatcctgaccctagctagagccacgcacgttacagacttttttaccggatctgactccattcagggaacgtggtgtaaagacatactccagacgattatgtcctttaccccacacaactgggcctcccatacactgagttgttttcctggacctctacaggctttcttcaaacagaataacgtgccacaggagtcccggttcaacctgaagaaaaacgtggaggaagaatataggaagtggaaaagcatgagcaacgaaaacgacataatcacccatttttccatgcaaggcagtcctccactcttcctttgtctgctttggaaaatgctgcttgagacggaccacattaatcaaatcggataccgagtactggagaggattggcgcgcgcgccctggtcgcccacgtgcggactttcgccgactttctggtctatgagttctccacttccgcaggaggtcagcaactcaacaagtgcattgagatccttaatgacatggtgtggaagtacaatatcgtgacgctcgaccgcctcattctctgcctggccatgaggtctcacgaaggcaatgaagcccaggtgtgctattttataattcagcttctgcttttgaaaccaaatgacttcaggaaccgcgtatcagacttcgttaaagaaaattctccagagcactggctccagaatgattggcatactaagcacatgaattaccacaagaaatacccggagaaattatacttcgaaggattggctgagcaggtggatccgccagtgcagatccagtccccatacctcccgatttactttggtaacgtttgcctaagatttctgccagtgtttgacatcgtgatccatcgctttctggaactattgccagtgagcaaatctctcgagacacttctagaccatttgggtggcctttataagttccacgaccgaccggtgacctatctgtacaacacactgcattattatgaaatgcatctgagagaccgcgccttcctgaaaaggaagctggtgcacgccatcattggcagccttaaggataacagacctcaaggctggtgtctaagcgacacgtatttgaagtgtgccatgaatgccagggaggagaatccctgggtgcccgacgacacgtactactgtcggctaataggcaggttggtcgacactatggctgggaagagtcctggccccttccccaactgtgactggaggttcaacgaatttcccaaccctgcagctcatgccctgcatgtgacctgtgtggagctgatggcactcgccgtgtcaggtaaagaggtgggcaacgctcttcttaacgtggtgctgaagtcccagcctctcgtccctcgagaaaacatcacggcctggatgaacgccattggcctgatcattacagctttgccagaaccatactggattgtgctgcacgataggatcgtctccgtgatatcttccccaagcttaacgtcagaaacagagtgggtaggttaccctttccggctatttgattttacagcgtgccaccagtcatactctgagatgtcttgtagctatactctcgccctggcccatgccgtttggcaccactcaagtatcggtcagctgagtttgatccccaaatttcttaccgaggtgttactccctattgttaaaactgagtttcagttgttatacgtttaccatttggtaggaccctttctgcagcgatttcaacaggaacgaacacgttgcatgatcgagattggggtcgcgttttacgatatgctcctcaatgtagatcagtgctctacccatttgaactatatggatcccatttgtgacttcctgtaccacatgaaatatatgttcaccggggactcggtgaaggagcaggtgaagaagataatctgcaacctaaagcccgcccttaaactccgactgcggtttattacacacataagtaagatggagcccgcggccgtgcccccacaggctatgaactccgggtcaccagcgcctcagtctaatcaggttcccgtatcattacctgtgactcagtag

SEQ ID NO: 123637 - DNA, 4095 bp, Artificial Sequence
  Description of Artificial Sequence: Synthetic coding sequence
atggaaacacaactgcaaagcatcttcgaggaagtggtaaaaacagaagtaatcgaagaggcttttcccggcatgttcatggacactccagaagacgaaaaaaccaagctgatctcttgcctgggagccttccggcaattttggggtggcctctcacaggagagtcatgagcagtgtatccagtggatcgtgaagttcatccacggacagcattccccaaaaagaatcagctttctgtatgattgtctggctatggctgttgagaccgggctgttgcctccacgcctggtatgcgaatccctaattaactccgataccttggagtgggaacgcacccagctgtgggccttaactttcaaactcgtccggaaaatcattggcggagtggattataaaggggttagggacctgttgaaggtaattctggagaagatccttactatccccaacaccgtgtcatcagcggtggtgcaacagctgctggctgcaagagaggttatagcctacattctggagagaaacgcatgtcttctccccgcctacttcgctgtcactgagatccgaaaactctaccccgaggggaagcttccacattggctgttggggaatctggtgagcgatttcgtggacacctttcgacctactgcccgaatcaatagtatctgcggcaggtgttcactgctccccgtggtgaataatagcggagcaatatgcaattcatggaaactcgatcctgcgactcttcgatttcccctgaaggggctgctgccctacgacaaagatttgttcgaaccacagacagctctgctccgttacgtgctggagcagccgtactctagggacatggtctgtaatatgctgggactgaacaagcagcacaagcaacggtgtccagttctggaagatcagctggtcgacctggttgtgtacgcaatggagaggagtgagaccgaggagaagtttgatgatggtggaacctcccagctcctatggcaacatcttagctcacaactgatattttttgttttgtttcagttcgccagttttccacatatggttttatcgcttcaccagaagctggccggcagagggctaataaaaggaagggaccatttgatgtgggtgcttctgcagtttatcagcggatctatccagaaaaacgctctggccgatttcctgcctgtaatgaaactgttcgatctcttataccctgagaaagagtatatccctgtgcccgatattaacaagccgcagagtacccacgcatttgctatgacgtgtatatggatccacctgaaccggaaggcacagaatgataactctaagctgcaaatccccatcccgcactcgttgcgattgcatcatgagttcctacagcagtcactgagaaataagagcttacagatgaacgactacaaaattgccctgctgtgcaacgcttatagcacaaacagcgagtgttttacgctgcctatgggggccctcgtagagacaatctatggcaatggtattatgaggatcccattacctggcacaaattgcatggccagtggctctattactccactccctatgaacctcctcgattctctgactgtccatgccaaaatgagcctgattcatagcatagctacaagggttataaaattggctcacgcaaaaagctccgtggccctcgcgcctgctctggtagaaacttactcccggctccttgtgtacatggagattgaatccctcgggattaaggggtttatctcacagctgcttccgaccgtgttcaagagccacgcttggggaatcttgcataccttgctagaaatgttctcttaccgtatgcaccatatccaaccccattaccgagtccagctcctctcgcacttacacactctggcagctgttgcccagacgaatcaaaatcagcttcacctctgcgtggaaagtactgccttacggctgatcacagccttaggatctagcgaggtgcagccccagttcacacgatttctaagcgacccaaaaaccgtattgtctgcagagagtgaagaactgaatagagccctgattctgacattagcacgagctactcatgtgaccgacttcttcacgggttccgactccatccagggtacctggtgcaaggacatcctccagactattatgtcattcacaccgcacaactgggcctcccacacgctgagctgtttccctggacccttgcaggcattttttaagcagaataacgtaccccaggagtcccgcttcaaccttaaaaagaatgtggaggaggaatacaggaagtggaaatccatgagtaatgagaacgacattatcacccatttttcaatgcagggcagcccaccactattcctctgtctcttatggaaaatgctccttgaaacggatcacatcaatcaaattggctaccgggttttggagcgaataggagctcgcgctctcgtcgctcacgtcaggaccttcgcagactttctggtgtatgaattttcaactagcgcaggcggacagcagctgaataaatgcatagagatcctgaatgacatggtctggaagtacaacatcgtaacactagaccgacttattttgtgcctggccatgaggagtcacgaagggaacgaggcccaggtctgctacttcatcattcagttacttctgctgaagcctaacgactttaggaaccgggtttcagacttcgttaaagaaaacagcccagaacattggttgcagaatgactggcacacaaagcatatgaactaccacaaaaagtaccctgaaaaattatacttcgaaggcctcgctgaacaggtcgacccacctgtccagattcaatcaccgtacttgcctatctattttggtaatgtttgtttgcgcttcttgcccgtctttgatattgtgatccatagatttctggagttactccccgtatcaaaaagtttggagaccctgctcgaccacctgggagggctctataaattccacgatcgacccgtgacttatttgtacaataccttgcattattacgaaatgcaccttcgagatagagcctttctgaagagaaagcttgtgcacgcaataatcgggtccctgaaagacaatagaccccagggatggtgtctgtctgacacatacctcaagtgtgcgatgaacgccagggaggagaatccatgggtccctgatgatacttattattgccggctaatcgggagactggtggatacaatggccggaaagtctcctggacccttcccgaactgcgattggaggttcaacgaattcccgaacccagctgctcatgcactgcatgtgacttgcgttgagctgatggcattggccgtttcaggaaaggaggtgggaaacgctctcctaaatgtggtcctgaagagccagcccctagtacctcgcgaaaatatcacagcttggatgaatgcaatcggattaattatcaccgcactccccgagccttattggatcgtgctccatgatagaattgtcagtgtgatcagcagtccatctttaacgagcgagacagaatgggtcggctacccttttagactcttcgattttacagcatgccatcagtcctattcggaaatgtcctgttcctacacattagctttggcacacgccgtatggcatcatagtagtatcggccagctgtctctgatccccaaatttctgaccgaagtgctgctgcctatcgtaaaaactgaattccagctgttgtacgtctatcacctggtaggacccttcctgcaacgcttccagcaggaacgaactcggtgcatgatcgagatcggcgttgcattttatgatatgcttttaaacgtagaccagtgttccacccacctaaattatatggacccaatatgtgattttctgtaccacatgaagtacatgttcacgggggattctgttaaagagcaggtagaaaagattatttgcaacctgaagcctgcactaaagctgcggctccgtttcatcacacacatctcgaaaatggagccagctgccgtgcctccacaagccatgaattccggctcccctgcaccacaaagcaaccaggtggatacactcacctag

SEQ ID NO: 123638 - DNA, 4107 bp, Artificial Sequence
  Description of Artificial Sequence: Synthetic coding sequence
atggaaactcagctgcagagcatcttcgaggaagttgtcaaaactgaggtgatagaggaggcttttcctgggatgtttatggataccccagaggacgaaaaaaccaaactgatctcctgtctgggtgccttccggcagttttgggggggtctgtctcaggaatcccacgaacagtgcattcagtggattgttaaattcattcacggccaacacagtccgaaacgcatctcctttttatacgactgccttgctatggccgtggagacaggactcctgccgcctagacttgtgtgcgagagcttgataaacagcgacactctggagtgggaacggacacaactgtgggcgttaacatttaagctggtccggaagatcatcggcggggtggactacaagggagtgagggacttactgaaggtgatcctggaaaagattctgaccattcctaacacagtgagtagcgccgttgtgcagcagctgctggcggcccgggaagtcattgcctatattctggagcggaacgcctgcctcctgcctgcctacttcgcagtgactgagataaggaagctgtaccctgaagggaaattaccacactggcttctcgggaacttggtatccgactttgttgacacgttccgaccaacggcacggattaattctatctgtgggagatgctctctattgcctgtagtcaataactctggtgccatctgtaatagctggaaactggatcctgccactctaaggttccccctaaaaggcttgctgccgtatgataaggatttattcgagcctcaaactgcacttttacgctatgtcctggaacagccctacagtcgggatatggtgtgcaatatgctgggcctgaataagcagcataagcagaggtgccctgtcctagaggaccagctggtggaccttgttgtgtatgctatggaaagaagcgaaacggaggagaagtttgatgatggcggcacgtcccagttactgtggcagcacctgtccagccaattaattttttttgtgctgttccagtttgcctcatttccccatatggtgcttagtctccatcaaaagctggctggaagaggtctaatcaagggacgcgaccacctaatgtgggtcctgcttcaatttatctctggctcaatccagaaaaacgccctagccgatttcctcccagtcatgaaactgtttgatttgttgtatcccgagaaagaatacatccctgtacccgatatcaacaagccacaatccacccacgcctttgcgatgacctgcatctggatccacctgaatcgaaaagcacaaaatgacaactccaaactgcagatccctattccgcacagtctcagactgcaccacgaattcttgcaacagagcctgcgcaataagtctctgcagatgaacgattacaagatcgcattgttgtgcaacgcatactcaaccaattcggagtgtttcacactgcccatgggagcattggtcgagacaatatacggaaacggaattatgagaattcccttgcccggaaccaattgcatggcctctggaagtatcactcccctgccaatgaacctcctggacagtcttacagtgcacgctaagatgtccctcattcatagtatcgcaacccgggtcattaagctggcccacgcaaagtctagtgtcgctctcgctcctgcacttgtggagacttattcccgactgctcgtgtacatggagatcgagagtcttgggattaaaggcttcatctctcagctgcttcccacagtgttcaagagccatgcctggggaatactgcataccttgctggagatgttttcttaccgaatgcatcatattcaacctcattacagggtccagttgttatctcacctacatactctggctgccgtcgcccagaccaaccagaaccagctgcacctgtgtgtcgagtcaaccgcccttaggctgattactgccctcggctcatccgaggtgcagccccaatttactaggttcctttccgaccccaagactgtgctgtccgccgaatcagaagagctgaatcgagctctcatcctgactttggcccgggccacgcacgtaaccgacttcttcaccggtagcgattcaatccaggggacatggtgcaaggacatattgcagaccatcatgagtttcacaccgcataactgggcttcgcacactcttagttgtttcccaggtccacttcaagctttcttcaagcaaaataatgtgcctcaggagtccagatttaacctcaaaaaaaacgttgaagaagaatacagaaagtggaagagcatgtctaatgaaaacgatatcattacccacttctcaatgcagggcagcccacctctatttctctgccttctgtggaaaatgctgctggaaaccgaccatataaaccagattggctaccgagtcctcgaacggattggcgctcgggctctggtcgcacatgtgcgcacttttgccgacttcctcgtctatgagttttcaacgagtgccggcgggcagcaactgaataaatgcatcgagatccttaacgacatggtgtggaagtacaacatagtgacattggataggctcatcctgtgtctggctatgaggagccacgagggcaatgaggcacaggtctgttattttattatccagctcctgttgctgaaaccaaacgactttaggaatcgggtgagtgacttcgtgaaagagaactcaccagagcactggctgcagaatgactggcatacaaagcacatgaattaccacaaaaagtatcccgaaaagttgtattttgagggcctggctgagcaggtcgatcctccagtgcagatacagagcccatatctgcctatctacttcggcaacgtttgcctgcgatttctgcctgttttcgatattgtgatacacaggttcctggaattactgcccgttagcaaatccctggagacccttctcgatcatctcggaggcctgtataagtttcatgacagaccagttacctacctgtacaataccctacactattatgagatgcatttgcgggaccgggcatttttgaaaaggaagctggtgcatgcaattataggcagtttgaaagataataggccccaggggtggtgcttgtccgatacctacctgaagtgcgccatgaatgctcgtgaagagaatccttgggtcccggacgatacgtattactgccgtctgataggcaggttggtcgacaccatggccgggaaatctcccggcccgttcccaaattgtgactggcggttcaacgaatttccaaatcccgccgcccacgctttacacgttacctgcgtggagctgatggccctcgcggtaagcggcaaggaagtcggtaacgcactcctaaatgtcgtacttaaatctcagccccttgttcccagagaaaacatcactgcatggatgaatgccatcggtttgattatcaccgccctgcctgagccatattggatagttctgcatgaccgcattgtgtctgttataagtagtccctccctgacaagtgaaactgaatgggtgggctacccctttaggctgtttgattttaccgcatgtcaccagagctactctgagatgagctgctcctataccctagctctggcccacgcagtgtggcaccactctagcatagggcagctctcactgatccccaaatttctaacggaagtgctcctgcctatcgtgaaaaccgagttccagctgctgtatgtctatcacctcgtggggccttttctccagagattccagcaggagcgaactaggtgcatgattgagatcggagtggccttctacgatatgcttcttaacgtggaccagtgcagtacccacctaaattacatggacccaatttgtgattttctgtaccacatgaaatacatgttcacaggagatagtgtcaaagaacaggtggagaagataatttgcaatctgaagcccgcactgaagctgagactcagattcattactcatatctccaagatggagcccgctgcggtccccccacaggctatgaattcaggttctcctgcccctcagtccaatcaggtccccgtgtcactgcccgtgacacagtag

SEQ ID NO: 123639 - DNA, 4125 bp, Artificial Sequence
  Description of Artificial Sequence: Synthetic coding sequence
atggagacacagttgcagtcaatctttgaagaggttgttaagactgaggtgatcgaagaagccttcccaggtatgtttatggatacccccgaagatgaaaagactaagctcattagttgcttaggggcttttaggcagttttggggcggactgtcccaggaaagccatgaacagtgcatccagtggatcgttaagtttatacacgggcagcattctccaaagcgcatctccttcctctacgactgccttgccatggcagtcgaaaccgggcttcttccaccccgactcgtgtgcgagagcttaattaatagtgacaccctagaatgggagcggacacagctctgggccctgactttcaaactggtcaggaaaattatcggaggcgttgattacaaaggcgtaagggacctgctcaaggtcatcttggaaaaaattctgaccatacccaatactgtgtcctctgctgtggtgcagcagcttcttgccgcccgggaagtgatagcttacatcctcgagcgaaatgcttgcctcctgccagcatacttcgccgttaccgagataagaaagctgtaccctgagggaaagcttccccactggttactgggtaacctggtgtccgatttcgtggatacgtttagacccaccgcaaggattaactccatctgtgggcgatgctcacttcttcccgtggtgaacaactctggggctatatgcaacagttggaaacttgacccagctacccttagattccccctgaaaggcctgctcccctacgacaaagacctgttcgaacctcaaactgccctactgaggtacgtgttggaacagccttattctcgcgacatggtctgcaacatgctgggcctgaacaaacagttgattagtgctctgcagcataagcagcgctgccctgtgctggaggaccagctggtcgatctggttgtgtacgcaatggaacgcagtgagacagaggagaagttcgatgatggcgggacaagccaactcctgtggcagcatctatcctcccagctgatttttttcgtgttattccagtttgcatccttccctcatatggtgctatcactgcaccagaagttggcgggacggggactgataaaaggtagggatcacctgatgtgggtgttgttgcagtttatcagcgggtcaatccagaagaatgcgctcgcagatttcttgccggtcatgaagctgttcgatttattgtacccagaaaaggagtacataccggtgccggacatcaataagccccaaagcacacacgcttttgcaatgacatgtatatggatccatcttaaccggaaagcccagaacgacaactctaagctgcagattccaataccacacagccttaggctgcatcacgaattcctgcagcagtctctgcgaaataagagtttgcagatgaatgactacaagatcgccctgctctgtaacgcctatagcaccaactctgagtgcttcactctgccaatgggcgccttagttgaaaccatttacggtaatgggatcatgagaatcccgcttcccggcaccaactgtatggccagcggatccattactcccctgccaatgaatctgttggactcactgacagtccacgccaagatgagtctcatccattcaatcgccaccagagtgattaagctcgcccacgctaagtctagcgtcgcactggcgcctgcccttgtagaaacttactcaaggcttctggtgtatatggagattgaatccctcggaatcaaggggttcattagccagctgctgccaaccgtattcaagagccacgcatggggaatccttcatactctcctcgaaatgttttcttatagaatgcaccacatacaaccgcactatcgcgttcagctcctgtcacatctccacacccttgcagcagtagcccagaccaatcagaatcaactccacctgtgtgttgagtctaccgcactgcggctgatcacagccttgggcagcagcgaggtgcaacctcagtttacgcggtttctgagcgaccctaagactgttctcagcgccgaaagcgaggagctcaacagggccctgattcttactttggctcgggcaacccacgtcactgacttctttacaggaagcgatagtatccagggcacatggtgcaaagatatcctgcagaccatcatgtctttcaccccccacaattgggcgagccatacactttcctgtttcccaggccccctccaggctttttttaaacagaacaacgtgccgcaggagagtcgctttaatcttaagaaaaatgtggaagaggagtaccggaagtggaagagtatgtccaacgaaaatgatatcattacccacttctctatgcagggatcaccaccattgttcctctgtctgctgtggaaaatgctcctcgagactgaccacatcaatcaaataggttacagagtgctggagcgcattggtgctagagccctcgtggctcatgtgaggaccttcgctgatttcctggtttatgagttctccacttcagccgggggacagcagctcaataaatgcatcgaaatcctgaacgacatggtgtggaagtacaatatagtgacactcgacaggctgatcctgtgtcttgccatgaggtcacatgaaggaaatgaggcccaggtctgttattttataatccagcttctgttgctgaagccaaacgatttcaggaacagggttagcgatttcgtgaaggagaactcacccgaacattggctgcagaacgattggcatactaaacatatgaattatcataaaaagtatcctgaaaagctgtacttcgagggattagccgaacaggtggaccccccagtgcagatacagagcccttatctccctatttattttggaaatgtttgcttgcgattcctacccgtctttgacatcgtgattcaccgcttcctagagctgctaccagtatccaaaagcttggagacactactggatcacctgggaggactgtacaagttccacgatcggcccgtgacgtacttatacaatactttacactactacgagatgcatctcagagatagagcgttcttaaagaggaagctggtgcacgcaatcatagggagccttaaagataaccgaccacagggatggtgtctgtcagacacctatctgaaatgtgcgatgaatgctcgcgaggaaaatccttgggtccccgacgatacttactactgccgactcatagggagattagttgatacgatggcgggtaagagtccgggtccgtttcctaactgcgactggcggtttaatgaattccctaatccagcagctcatgctttacatgtcacgtgtgtagaactgatggcactagccgtgtctggcaaagaagtgggcaatgctttgctcaatgtcgtacttaaatcccagccactagtgccacgggagaatatcaccgcatggatgaatgcaatcggcctaatcataacagctctgcctgaaccttactggatagttttgcatgatcgtatagtaagcgtgatcagctccccatcgctaacaagcgaaacagaatgggtggggtatccttttcgactgttcgattttaccgcatgtcatcagtcctactctgaaatgtcctgctcttacaccctggccctcgcacatgctgtctggcatcattcttcaatcggtcagctctcactgattcctaaattcctgaccgaagtccttctgcctatcgtcaagactgaattccagctgctctatgtatatcatctggttggcccttttctccagcgcttccaacaagaaaggacacgatgtatgatcgagatcggcgtcgctttctacgacatgcttctcaatgtggaccaatgctccactcatctgaattacatggacccaatctgtgattttctctatcatatgaaatacatgttcacaggagactcagtgaaggagcaagtggagaaaataatctgcaatcttaaacccgctctgaagcttagactgcgttttatcactcatatcagcaagatggagcccgccgccgtgccacctcaggccatgaattccggaagccctgccccccagagcaatcaggtgcctgtctcactgccagtgacgcagtag

SEQ ID NO: 123640 - DNA, 114 bp, Artificial Sequence
  Description of Artificial Sequence: Synthetic coding sequence
atggaaactcagctacagtccatcttcgaggaggtcgtcaaaactgaggtaattgaggaggcttttcctggaatgtttatggatacgcctgaggatgaaaagagctcaaaatag

SEQ ID NO: 123641 - DNA, 132 bp, Artificial Sequence
  Description of Artificial Sequence: Synthetic coding sequence
atggagacccaattgcagagcattttcgaagaagttgtgaagaccgaagtaattgaggaggcattccctggaatgtttatggacacccccgaggatgagaaaacaaaattattcatggaaatggagctgtag

SEQ ID NO: 123642 - DNA, 1428 bp, Artificial Sequence
  Description of Artificial Sequence: Synthetic coding sequence
atggagactcagttgcaatctatctttgaggaagtagtaaagaccgaggtcatcgaggaggcttttcccggaatgttcatggatacccccgaggacgagaagaccaagttaatcagctgcctcggcgccttccgccaattctggggtggtttgtctcaggaatctcatgagcaatgtattcagtggatagtcaaattcattcacggccagcactctccaaagaggatttcgtttctgtatgactgcttagcaatggctgtggagaccggactgctccccccacgcctggtgtgcgagtcactgattaatagcgatacactagagtgggaacggactcagttgtgggccctgaccttcaagcttgtacgcaaaatcataggcggagtcgactacaagggggtgcgcgaccttctcaaagtgatcctggaaaagatcttgactattcccaatacagtgtcttcagctgtggtgcagcagctgcttgcagcacgcgaggttattgcgtacatcctcgagagaaacgcttgtctgttacctgcatacttcgccgtgaccgagataagaaaactgtacccagaaggcaagctgccgcattggctcctcggcaacttggtgtcggactttgtggatacatttcgccccacagccaggataaatagtatctgtggcaggtgcagcctgcttcccgtggtgaacaacagcggggcaatttgtaacagctggaagctggatcccgccacccttcgtttcccacttaaggggttgttgccatatgacaaggacttgtttgaacctcaaactgctctccttaggtatgttctcgagcagccttattctagggatatggtttgcaatatgctggggctgaacaagcagcacaaacagagatgcccggtgcttgaagaccagctggtggatctagttgtgtatgctatggagcgtagcgaaaccgaggaaaaatttgatgatggcggcacaagtcaacttctatggcaacacctttcatcacagctgatttttttcgtgctgtttcaattcgcttcattccctcacatggtactatcactccaccaaaagttggcaggcaggggactgattaaaggacgggatcacctgatgtgggttcttctgcagttcattagtgggagcattcagaaaaatgcccttgccgattttttgcctgttatgaagctgtttgatttattataccccgagaaggagtacatcccagtcccagatattaacaagccccaaagtactcatgcctttgcaatgacatgtatatggatccaccttaatcgaaaggcccaaaatgacaatagtaagctgcagataccgatccctcacagtctgagactgcaccatgaatcagcgtttgcgaactgtttccagatcacctgtatgggcgacttgactcacactccatag

SEQ ID NO: 123643 - DNA, 429 bp, Artificial Sequence
  Description of Artificial Sequence: Synthetic coding sequence
atgcatcatattcagcctcactaccgcgtgcagttactgtcccacctgcatacccttgccgccgtggcccagaccaatcaaaaccagcttcacctctgcgtggagagtactgcattgcggctgattacagcattgggctcctccgaggtgcagcctcagtttacgaggttcctgagcgaccccaagacagtactctcagccgagtccgaggaactcaacagggcactcattcttaccctggcgcgcgctactcacgtgacagacttcttcaccgggtccgacagcatccagggtacatggtgcaaggacatcttgcagactatcatgtccttcactcctcataattgggcaagtcacaccctctcgtgcttccccggcccactacagacactcctgattttgggagagctggctctccgcaagacttag

SEQ ID NO: 123644 - DNA, 2661 bp, Artificial Sequence
  Description of Artificial Sequence: Synthetic coding sequence
atggaaacacagctgcagtctatctttgaagaggtcgtgaagacggaagtgatcgaggaggctttcccaggcatgttcatggatacaccagaggacgaaaaaaccaagttaatttcatgtttaggcgcatttcggcaattctggggtggactctcgcaggaaagccacgagcagtgtatccaatggatcgtgaagtttattcatggccaacattccccaaaacggatcagtttcctttacgactgcctggctatggccgtagagactggattgcttccgcctcgccttgtgtgtgaatcactgatcaactccgacaccctcgagtgggaacggactcagctgtgggctctgactttcaagctcgtccgcaaaatcatcgggggtgtcgactacaagggagtgcgagacctgctgaaggtcattttggagaaaatcttgacaatccctaacaccgtcagcagcgcggtggtccagcaactgctggctgcaagagaagtcatcgcctacatcctcgagcgcaacgcatgcctcttaccagcgtacttcgccgttaccgagattagaaagctgtaccccgagggaaagctgccccactggttgctggggaaccttgtatcagacttcgtggacactttccggccaacagcccgaatcaactctatctgtggaaggtgctctctccttccggtggtcaacaattctggggcaatctgtaatagctggaaattagatcctgcaacgctcaggttccctctgaagggattgctgccatacgataaggacttgtttgagccccagaccgcattgctgcgctacgtgttggagcagccctatagcagagacatggtatgtaatatgctggggttgaataagcaggtccttaaaatttttaagcacaagcagcgctgtcctgtgctcgaggaccagctcgtggatctcgtggtttatgccatggagcgctctgagacagaggagaagttcgatgatggagggacttctcaactcttatggcagcatctgtcctcacagctcattttcttcgtgctctttcagtttgcttcctttccccatatggtgcttagcttacatcaaaagctggcgggtagggggttaatcaagggccgcgaccatcttatgtgggtgttgcttcagtttatcagtgggtccatccagaagaacgctcttgcagactttctgcctgtcatgaagctcttcgacctgctctacccggagaaggagtatattcccgtgccagacataaataagccccagtctacccatgcctttgcaatgacatgcatatggatccacctgaatcgtaaggctcagaatgacaacagtaagcttcagatcccaatcccccatagcctccggttgcaccacgagttcctgcagcagtctctcaggaacaaaagccttcagatgaatgattataagattgctctcctttgtaacgcttacagcaccaacagcgagtgttttactctcccgatgggagctctggtcgaaacaatatatgggaatggcatcatgagaatcccactccccggcaccaactgcatggcctccgggtctatcactcccctccctatgaatttgctggactcacttaccgtgcatgctaaaatgtccctgattcacagtattgcaactagggtaattaagttggcccacgctaaatccagtgtcgccctcgcacccgccctagtagagacctacagccggcttctggtgtacatggagatcgaatcccttggaattaaaggatttatatcccagctgctgccgactgtgttcaaaagccacgcatgggggatccttcacacactgcttgagatgttcagttaccgaatgcatcatatccagccccattaccgggtccaactgctgagtcacctgcatactctggcggcagtggctcagaccaaccagaaccaactgcatctgtgtgtggaaagcactgcccttcgcctgattacagccctgggctcatcagaggttcagcctcagttcacgcgcttcttgtcggatcctaaaaccgtactgtccgcagaatcggaagagttaaacagagccctgatcctcactttggctagagcaacccacgtaaccgatttttttaccggaagcgattcgatacaggggacctggtgcaaggacattctgcagactatcatgagctttacgcctcacaactgggcgagtcacacgctctcatgtttcccagggccgctacaagccttttttaagcaaaataacgtgccgcaggaatccagattcaaccttaaaaagaatgtcgaagaagagtatcgaaaatggaagtcaatgtcgaatgaaaacgatattatcacgcacttctccatgcaggggagcccaccactgtttctctgtcttctctggaaaatgcttctcgagaccgaccatataaaccaaatcggttaccgggtgctcgagcggataggggcgagagctctcgttgcgcatgttagaacatttgccgattttctagtctatgaattttcgacatccgctgggggccagcagctgaataagtgcatagaaattttgaatgacatggtctggaaatacaatatagttacactggatagacttatcctttgcctagtgaggattaacacttttctgtcactttttagctag

SEQ ID NO: 123645 - DNA, 3030 bp, Artificial Sequence
  Description of Artificial Sequence: Synthetic coding sequence
atggagcgatccgagactgaggagaaatttgacgacgggggtaccagtcagctgctctggcagcatctgagcagtcaattgatctttttcgtattgtttcaatttgccagctttccccatatggtcctgagccttcatcagaagtacattccagtccccgatattaataagccacagagcacacacgctttcgctatgacttgtatctggattcatttgaaccgaaaagcccagaacgataactcaaagctgcaaattccaattccccactctctgaggcttcatcatgaatttctgcagcaaagccttaggaataaatccctgcagatgaacgactataaaatagcgttgttatgcaatgcttattccacaaattcagagtgttttacgctgcctatgggcgcactggtggagaccatatatggtaatggtattatgaggattcccttgcccggcaccaattgcatggcgtccgggtcaatcactccactcccgatgaatcttctcgacagcctaacggtgcacgccaagatgtccctcatacactctatagccacaagggtcatcaagcttgcccatgccaagagttctgtggcattagccccagctctagttgaaacctacagtcggttgctcgtgtacatggagattgagtcccttggcattaagggattcatcagtcagctcctgcccaccgtcttcaagtcgcatgcttggggaatactacataccctgctggagatgttctcttacaggatgcatcatattcagccccattaccgggtgcaactccttagccatctgcatacactggcagcagtggcccagacaaaccagaatcagctgcacctgtgcgtggagtcaactgccctcaggctcataacagctttagggagctcagaggtacagccgcaattcacccgctttctgtctgacccgaagacagtgctgtccgctgagtcagaggaactgaatcgagccctgatactcacactcgcccgggccacacatgtgaccgacttcttcactggctccgatagcatccaggggacatggtgtaaagacatccttcagactattatgtcttttacacctcataactgggcctcacatacactgagctgcttcccgggtccgttgcaagcattctttaaacagaacaacgttcctcaggaaagccggttcaacttgaaaaagaatgtcgaggaggagtatagaaaatggaagtctatgtctaacgagaacgatattattactcatttctctatgcaggggtcccctccgctgttcctgtgtcttctgtggaagatgctgctggaaaccgaccacattaaccagatcggataccgggtcctcgagaggatcggcgccagagccctcgtggcccatgtacgaacctttgcagactttctggtatacgagttctctacctcagctggcgggcagcagctaaacaaatgtattgaaattctcaatgacatggtgtggaagtataacattgtgaccctagataggctgatcttgtgcctggctatgcgctcccatgagggcaatgaagcccaagtatgctatttcataatccaactgctactgctgaaaccaaacgattttcggaaccgagtcagcgacttcgttaaagagaattctcctgagcactggctgcaaaatgactggcataccaaacacatgaattatcataagaagtatccagaaaaattgtattttgagggcctggccgagcaagtggaccccccagtccagattcagagtccgtatttgcccatttattttggtaacgtgtgcctgagatttctgcccgtgtttgacatcgtgattcatcggttcttagaactgcttccagtgtcaaagagcctcgaaacgcttttagatcacctaggcggtctctataagttccatgatcggcccgtgacttatctatacaacacacttcattactacgaaatgcatctccgcgaccgcgcattcctgaagagaaaactggtacatgcaattattggaagcctgaaggataaccgacctcagggttggtgtctctcagacacctacctgaaatgcgccatgaatgcgcgagaagagaacccctgggtgcccgacgatacctactactgtcgtctgataggacgattagtggacactatggccggtaagagccccggtcctttcccaaattgcgattggagattcaatgagtttcctaatcctgctgcccacgccctgcacgttacttgtgtggagctgatggccctagctgttagcgggaaagaggtcgggaacgccctcctgaacgttgtgctgaagtctcagccactggtgccccgggagaacataactgcttggatgaacgctattggcctcatcattaccgcactcccagaaccatattggatcgtgctgcacgaccgtattgtgtctgtaataagctccccttccttgaccagcgagacagagtgggtcggatatccgtttagattatttgactttaccgcctgtcaccaatcatactctgagatgagttgttcctacacgctggccctggcacatgccgtgtggcaccacagctcgatcggacaactgagcctcattccaaagtttttaactgaggtgctcttaccaatcgtcaagacagaatttcagctgctttacgtgtatcatctggtggggccttttctccaacgattccaacaagagaggactagatgtatgattgagataggagttgcattctacgacatgttactgaacgtggaccagtgttctacccatctcaattacatggacccgatctgtgactttctgtaccacatgaaatacatgtttacaggggactctgtcaaagagcaagttgaaaagatcatatgcaacctcaaacctgccctgaaacttagactgcgcttcattactcacatttccaagatggagccagctgccgtgccaccccaggcaatgaactccggatcgcctgccccacaaagtaatcaggtgcccgtctcactgccagtaacacaatag

SEQ ID NO: 123646 - DNA, 2970 bp, Artificial Sequence
  Description of Artificial Sequence: Synthetic coding sequence
atgaaagtggtgaatctgaagcaagctatcctccaggcgtggaaggagaggtggtctgattatcagtgggctatcaacatgaagaaattctttcctaagggcgccacatgggacatccttaatctcgccgacgccctactagaacaggcaatgattgggcctagccccaatcccctcatccttagttacctcaaatacgctatttcaagtcagatggtgtcctactcctccgttcttacagccatttccaagttcgacgatttttctagagacctgtgcgttcaagctcttctggacattatggacatgttttgtgatagactgtcctgtcacggaaaggccgaagagtgtattgggctgtgcagggccctgttgtcagcattgcactggcttctgcgctgtactgccgcgagcgccgagagactcagggagggcttggaggctgggacaccagccgctggagaaaagcagctcgcgatgtgtttgcaaaggctcgagaagaccctgagctcaacaaaaaatagagccttactgcacatcgctaaattggaggaagctagcagctggacagcaatagagcacagcttactcaagctcggtgagatactggccaatctgtccaatccgcaattacgaagccaggccgagcagtgcggcacgctgatacgtagcatccccaccatgctatcagtgcacgctgaacagatgcataagacaggatttccaaccgttcacgctgtgattctgttggaaggcaccatgaatctcaccggagagacccaaagtctggtggagcaactgacgatggtaaagaggatgcagcatatccccacaccgctcttcgtgctggaaatttggaaggcatgcttcgttggacttattgaaagcccagaaggcacagaggagcttaagtggacagccttcacatttcttaaaattccgcaggtgttggtgaagctcaaaaaatattctcatggggacaaggactttacagaggacgttaactgtgcattcgaattcctactcaagctgaccccattactggacaaggccgaccagcgttgcaactgtgactgcactaatttcttgctccaggagtgcggaaagcagggacttttgagtgaggccagcgtcaacaatctgatggccaaacgcaaggccgatcgcgagcacgcccctcagcagaaatctggagaaaacgcaaacatacagcccaatatccagctgattctgagagcggagcctaccgttaccaatatcctcaaaactatggacgccgaccatagcaaatctccagaaggactcctcggggtcttagggcacatgcttagcggaaagagtttggatctactgcttgccgcagccgcagctaccggaaaactgaagagttttgctcggaaattcattaacctgaatgaatttactacctatggcagcgaggagtccaccaagccagcttccgtgagggcactgctgttcgacatcagtttcctgatgctgtgtcatgtggctcagacctatggttcagaagtaatcctctccgaaagccggacaggagccgaagtgccattcttcgagacatggatgcaaacatgcatgccggaagaaggcaaaatcctgaatcctgatcacccatgctttaggccggactctacaaaggtggaatccctggtcgccctcctgaacaatagctctgagatgaaattagtccagatgaagtggcacgaggcatgccttagcatttccgccgccattctggagatcctgaacgcttgggagaacggagtgcttgcattcgaatctatccagaagatcaccgacaacattaaggggaaagtgtgctcactcgccgtttgtgccgtggcctggctggtagctcacgtgagaatgctggggcttgatgagagggagaaaagcctccagatgatacgacagctcgcaggtccactgtttagtgagaatacgctccaattttacaatgagcgcgtagtgattatgaattcaattttagaaaggatgtgcgctgacgttcttcagcagacggctactcagatcaagttcccgtctacaggcgtcgacactatgccatactggaatcttctcccacctaagagacccatcaaagaagtcctgacggatatctttgctaaggtgcttgaaaagggttgggtcgatagccgctccatacacatcttcgacaccttgctgcacatgggaggggtgtattggttttgcaataaccttatcaaggagttactgaaggaaactcgcaaggaacatacattacgcgcggtggaacttctctacagcatattttgcctggacatgcagcaggtaacactggtgctcctaggacatatcctgcccggactgctgacggattcttcgaagtggcacagtctgatggacccccccggtacggctctggccaaactcgccgtttggtgcgctcttagctcgtattcctctcacaagggccaggcaagcactagacagaaaaaacgacaccgcgaggatattgaggattacatcagtctctttccgctcgacgacgtgcaacccagtaaactaatgcggctgctgtccagcaatgaggacgatgcgaacatactgagctcaccgactgatcggtcgatgtcttcctctttgtccgcttcccagctccacaccgttaatatgcgggatcccctgaaccgtgtgttggctaatctcttcctcctcatctcatctattctggggtcacggaccgctgggcctcatacccagttcgtacagtggtttatggaggaatgcgtggactgtctcgaacaaggcgggcgagggtccgttctgcagtttatgcccttcaccaccgtgtcagagttggtcaaggtcagtgctatgtcatctccaaaggtagtcctggcaattacagatctgagtctcccccttgggcgccaagttgcagccaaagcgatagctgccctctag

SEQ ID NO: 123647 - DNA, 2970 bp, Artificial Sequence
  Description of Artificial Sequence: Synthetic coding sequence
atgaaggtggttaacctgaagcaagccattttgcaggcctggaaggagcgctggagcgactatcagtgggccatcaatatgaagaagttcttcccaaagggcgctacatgggacatcctcaatctggccgacgcacttctggagcaggcaatgatcggcccttctccaaaccctctgatcctctcctatcttaaatatgctatctctagccagatggtctcctattcatctgtcttgaccgccatttctaagttcgatgacttcagtagagacctctgcgtgcaggcgctcctagatattatggacatgttttgtgatcgtctatcctgtcacggcaaggctgaggagtgtattgggctgtgccgcgctttgctgagtgctctccattggcttcttcgctgcaccgctgcctcagcagagcggttgagagagggcctggaggcaggaacacctgccgcaggagaaaaacagctcgccatgtgtttgcagaggctggagaaaacccttagcagtacaaaaaatagggcacttctccatatcgcaaaactcgaggaagcttcctcttggaccgccatcgagcacagcttacttaagctcggtgagattctcgccaatctctccaacccacagctccggtctcaggctgaacagtgtgggactctcataaggtctattcccaccatgctgagcgtccatgctgagcagatgcataagacgggttttcccaccgttcacgcggttattcttctcgaagggactatgaacctcacaggagagacccagtctcttgtggagcaattgacaatggttaaaaggatgcaacacatcccaacccccctctttgttctagaaatttggaaggcttgcttcgtcggacttattgagagcccagaaggaactgaagaactgaaatggacagcctttactttcttgaagattccccaggtgttagtcaagctaaagaaatattcacatggcgacaaggacttcacagaagacgtcaactgtgcattcgaatttctcctcaaattgacccccctcctcgataaggccgatcaacgctgcaactgtgactgtactaactttctcctccaggagtgcggcaaacaaggactcctcagcgaggctagcgttaacaatctcatggccaagagaaaagcagacagggaacatgccccacagcaaaagtccggcgagaacgctaacatccagccgaacatccagctgatcctgagagctgaaccaaccgtgaccaacattttgaagactatggatgccgaccatagcaaaagtcccgaggggctgctgggagtattgggtcacatgctgtctggcaaatcactggatctgctactggcagcggctgctgcgacagggaaactgaagtcatttgcgaggaagttcatcaatctgaatgagtttacgacttatggttccgaggaaagcactaaacccgcatccgtgcgcgccctcctctttgatatctccttcctcatgctgtgccacgtcgctcagacgtatggatccgaagtcattctcagcgaatctcgcactggcgctgaagtgccttttttcgagacctggatgcagacttgtatgccagaggagggcaaaatactcaaccctgatcacccatgtttcagacctgactctaccaaagtcgagtctctagtggctctgctcaataactcaagtgagatgaagctggtgcagatgaagtggcacgaagcttgcttgagcatcagcgcagcaatcttggaaatcctgaatgcctgggaaaatggtgtgcttgctttcgaaagcattcagaagatcaccgacaatatcaagggaaaggtctgttcgctggccgtctgcgctgtggcatggctggtcgcacatgtgaggatgctcggcctggacgagcgggaaaagtcactacaaatgatcaggcaactggctgggccactcttttctgaaaacacccttcagttttacaacgagcgcgtggtgattatgaacagcatcctcgagcggatgtgcgccgacgttctccagcagacggctacccaaattaagttcccaagcacaggggtcgacactatgccctactggaacttgctacctcccaaacggcccatcaaagaggtgctcaccgacatttttgctaaagtactcgaaaaggggtgggtcgattcgcgctctattcacattttcgacaccttgctccacatgggtggagtttattggttctgcaacaacctgatcaaggagctgcttaaggagacacggaaagagcacaccctccgcgccgtggaactgctctatagcatcttttgcttggatatgcagcaggtgacgctggtgttgctcggccatatcctaccggggctcctcactgatagcagcaaatggcactctttaatggatcccccagggacagcattggcaaagcttgccgtatggtgcgctcttagtagctactcttcacacaagggacaggcctcaactagacaaaaaaagcggcaccgggaggatatcgaagactacattagcctctttccccttgatgacgtccaaccaagcaaactgatgcgcctcctaagttctaacgaagatgacgccaatatcctgtcctcccccactgatcggtctatgagcagctctttaagtgctagtcagctgcatactgtgaacatgcgggaccctttaaatagggtgttggcaaacttgttcttactgattagcagcatactgggctcccgaacagccggaccacacacccagttcgtgcagtggtttatggaggaatgcgttgactgtctagagcaaggaggtaggggctcggtgcttcagtttatgccctttaccacggtgtcggagctggttaaggtcagcgccatgtccagcccaaaggtggtgcttgccattaccgacttgtctctgccgctggggcggcaggttgctgctaaggccatcgccgccctctag

SEQ ID NO: 123648 - DNA, 2931 bp, Artificial Sequence
  Description of Artificial Sequence: Synthetic coding sequence
atgaaggtggtgaatcttaaacaggccatcctgcaggcctggaaagaaagatggagtgactaccaatgggccattaatatgaagaagttctttccgaagggggcaacatgggatatcttgaatttggccgatgcgctcctggagcaagccatgatcgggcctagtcctaatcctttgattttatcttatcttaaatacgctattagtagtcagtttgatgactttagcagggatctctgcgtgcaggccctgctcgatattatggatatgttttgcgaccgcctgtcctgccatgggaaagcggaagagtgtattggactttgccgggctctcttgagcgcccttcattggctccttcgatgcactgccgcatctgctgaaagacttcgcgaaggtctcgaggcaggtactccagcggctggagaaaaacagttggcaatgtgtcttcagcgcctggagaagaccctctcatccacaaaaaacagggctctactccatatcgccaagttggaggaagcatcatcttggacagccattgagcactcactgcttaagcttggtgagattctggccaatctgtctaacccacagcttaggtcccaggccgaacagtgcggaaccctgatcagatcgattcccacaatgctgtcagtccacgccgagcagatgcacaagacaggctttcctacagtacacgctgtgatactgttggagggcactatgaacctgacaggagaaacgcaaagccttgtagaacagttgacgatggtaaagagaatgcagcatattccgacacccctgttcgtgctcgaaatctggaaggcctgtttcgtcgggctcatcgagtcccctgagggtacagaagagcttaaatggaccgcgtttacatttttgaagatcccacaggtgcttgttaagctcaagaaatacagccacggggataaggactttaccgaggatgtcaattgcgcgtttgaatttctcttgaagctaaccccgctgctggataaggccgatcagagatgtaattgcgactgcacaaactttctccttcaggaatgcggtaaacaggggcttctatcagaggcatccgtaaataatttaatggctaagaggaaggcggatagggaacacgctcctcagcagaagtccggggaaaatgccaatatccaaccgaacattcagctgatccttcgggccgaaccaactgtaacaaacattcttaagaccatggatgccgaccactcaaaaagtcctgaagggcttctcggagttctcgggcacatgctgagcgggaaatctttagatcttctgctcgccgctgccgccgcaaccggcaaactgaagtccttcgccaggaaattcatcaacctgaacgagtttaccacatacggttccgaggagagcacaaaacccgccagcgtcagggccttgctgtttgacatttcctttctgatgctgtgccatgtggctcagacctacggctcagaggttatcttaagtgagagccggacaggggccgaagtgccattcttcgaaacatggatgcaaacatgcatgccagaagaaggcaaaatcctgaacccagaccatccctgtttccgccccgattccactaaggtcgagtcacttgttgcattgctcaacaactcgtctgagatgaagttggtccagatgaagtggcatgaggcatgcctgagcatcagtgctgcgatcctggagattcttaatgcttgggaaaatggtgtgctggcttttgagtcaattcagaaaattaccgacaacatcaagggaaaagtgtgttcgcttgccgtgtgcgcggtggcgtggctggtagcacacgtcagaatgctgggcctggatgaacgagaaaagagcctgcaaatgattagacagctggcaggaccactatttagtgagaacacacttcagttctataacgagcgcgtcgtcatcatgaactctatattggagcgcatgtgtgcagacgttcttcagcagacggcaacccaaatcaagtttccatcaacgggggtagatacgatgccctactggaatctgctcccccctaagagaccgatcaaagaggttctgaccgacatctttgcaaaggtattagagaagggctgggttgacagccggagtatccacatttttgatacccttctgcatatgggcggagtgtactggttctgcaataacctgataaaggagttgcttaaggagacccggaaagaacacaccctgagggctgttgaattgttgtactccatcttttgtctagacatgcaacaagtgacactcgtgcttcttggacatatcctccccgggctactgacagatagttccaagtggcattcactcatggaccccccgggaactgccctggcgaaactggccgtgtggtgcgctctttctagttattcttcccacaaggggcaggccagcacccggcagaaaaagaggcatagagaggatatcgaagattacatctctctgttccccctagacgacgtgcagccctctaaactaatgcgcctgttatcctcgaacgaggacgacgctaatattctctcatctccgaccgatcgctctatgagctcttctctgtcggcctctcagctgcatacagtaaatatgcgagacccgctgaaccgagtgttggcaaacctgttcctgctcatcagctccatcctcggttctcgcaccgccggcccacatacacagttcgtccaatggtttatggaagagtgcgtcgactgcctggagcagggcggaaggggctcggttctgcaatttatgccatttactactgtgagtgagctggtaaaggtttcagccatgtccagtcctaaggtggtgctggccattaccgacctttcactgccccttgggcgacaggtggccgcgaaggctattgcagcgctttag

SEQ ID NO: 123649 - DNA, 2970 bp, Artificial Sequence
  Description of Artificial Sequence: Synthetic coding sequence
atgaaggtcgtgaacctcaaacaggctatcctgcaggcttggaaagaacgttggagtgattatcaatgggccattaatatgaagaaattctttccaaagggggccacttgggatatcctgaacctggccgatgctcttctggagcaggctatgatcggaccgtcaccaaaccctctcatcctctcttacctgaagtacgcaatcagcagccagatggtgtcatattcttcagtcctgaccgccatcagcaagttcgatgatttttccagggatctttgtgtccaggctttgctagatatcatggacatgttctgtgatcgactcagctgccacggcaaagccgaagagtgcatagggctctgtagggctctgctctctgccttgcattggctacttagatgtaccgctgcaagcgcggaacggcttcgggagggcctggaagccggcacccccgctgctggggagaaacagctcgcgatgtgtttgcaaaggttggaaaagacattgagtagcaccaaaaatcgagcgctacttcatatcgctaaactggaagaggcctctagctggacagccatcgaacatagcctgctcaagctgggcgagattcttgcaaatctgtcaaacccccagctccgtagccaggccgaacagtgcggaacactgataagatccattcctactatgcttagcgtgcatgcggagcagatgcataaaactggctttcccacagtacatgccgtgatcctgctggaagggacgatgaaccttacaggggagacgcaatcccttgtggaacagctgaccatggtcaagcgaatgcagcatatacctactccactgtttgtccttgagatatggaaagcgtgctttgtaggtctgattgagtcccctgagggcactgaggagctgaagtggaccgcattcactttcctgaaaataccacaagtattggttaagctgaagaagtacagccatggcgataaggactttacagaggacgtgaattgtgcgttcgagtttcttctgaaactgaccccactcctggacaaagcggaccaacgatgcaattgcgattgtactaatttcctcctgcaggaatgcggcaagcaaggcctactgagtgaagcttccgtcaataacctgatggccaagcggaaagcggacagagagcatgctccccagcagaagagcggggaaaacgcgaacatccagcccaatatccaactcatcctgagagctgagccaacggttactaacattctgaaaaccatggacgccgatcattcaaaatcgcccgaaggcttgctgggagtgttaggacacatgctgagcggtaagagcttggatttgctgctcgctgcagcagccgctaccggaaaactgaagtcatttgcgcgcaagtttatcaacctcaacgaatttacaacctacggctctgaggagtctactaagccagcaagcgtccgagcgttgttattcgatatctcttttctgatgctgtgccacgttgcgcagacctatggtagcgaggtaattctgagcgaaagcagaaccggggccgaggttccatttttcgaaacttggatgcagacatgtatgcctgaggaaggaaagattctgaatccggatcacccctgctttagacctgacagcacaaaagtggagagcctggtcgccttactgaataattcaagtgagatgaagttggtgcaaatgaaatggcatgaagcttgccttagcatcagtgccgctatactggaaattctgaacgcttgggagaatggagtcctggcctttgaatcaatccagaagatcacggataacatcaaagggaaagtctgtagccttgctgtgtgcgccgttgcttggctcgtggctcatgtcagaatgttgggcttagatgagcgggaaaagtccctacaaatgatacggcagctagccggaccactgttctccgagaatacactgcagttctacaatgagagggtcgtgatcatgaacagtatactcgagcgtatgtgcgcggatgtcctgcaacagaccgcaacgcaaatcaaattccccagcactggggtggatacaatgccatactggaacttactgccccccaagcgccctattaaagaggttctgacagacatcttcgcaaaggtcctcgagaaaggctgggtcgacagtcgatcaatccatatctttgacactttacttcacatgggaggagtgtattggttctgtaacaatctcataaaagagctgctgaaggagacgcgcaaagagcacacacttcgcgcggttgagctcctttactcaatattctgcctggacatgcaacaggtaacacttgtcctgctcgggcatatactgccaggactgcttacagactccagcaaatggcacagcctcatggatcccccgggcaccgcactagccaagttagctgtctggtgcgctctgagctcatattcgtcacataagggccaggcgtcaaccagacagaagaagaggcacagggaagatattgaggactatataagtctgtttcctctggacgatgttcaaccctctaagctgatgagactgctgtcctctaatgaagatgatgcaaacatcctgtcctccccaaccgaccgctcaatgtcctctagtctgtcagcttcccagctacatactgtaaatatgcgtgatcctctcaatagggtgttggccaacctctttttgctcatcagtagcatcctgggtagtcgcacagccggaccacatacacagtttgtgcaatggtttatggaggagtgcgttgactgcctcgaacagggcggccgcggttccgttttgcagttcatgccctttactaccgtgtccgaactggttaaggtgagtgccatgtctagccctaaagtcgtcctagccatcactgacctctctctacccctgggacgacaggtggctgctaaagccattgctgctctgtag

SEQ ID NO: 123650 - DNA, 864 bp, Artificial Sequence
  Description of Artificial Sequence: Synthetic coding sequence
taaaacctcataaaagagcttctcaaggagacaagaaaggagcacacactccgcgctgtcgagttactatatagcatattttgtctggacatgcagcaggtaactttggtgcttctgggccacatcttgcccggactcttaaccgattcttctaagtggcactccctcatggacccgcctggcactgcgctggctaaattagcggtttggtgcgctcttagcagttactcttcccacaaaggtcaggctagcacccgccagaagaagaggcaccgcgaagatattgaggactacatatcactgttcccactggacgatgttcagccgagcaaactgatgcgactcctcagctccaacgaagatgacgctaatatcctgtcatcacctaggtccagtctcggctctccttgtactagttatctccgatgggtaaaagtcggactaggccaccccagaggtgcccctctgctacattcggcggggtgctttcctgctctgcacttgctgagacccactgcggacagaagcatgagtagtagtctcagtgcaagccagttacacaccgtcaacatgcgtgatccactgaatcgcgttctggctaatcttttcttgctaatttcttcaatccttgggagtcgaaccgcagggccccatactcagtttgtccagtggtttatggaggagtgcgtggattgtctggagcagggcggtaggggctccgtgctgcagtttatgccattcaccaccgtctctgagctcgtgaaggtgtcagctatgagctcgcccaaggtcgtgctcgccatcacagatctcagcttaccgctcggtagacaggtggcggcaaaggcaatagccgcgctgtag

SEQ ID NO: 123651 - DNA, 906 bp, Artificial Sequence
  Description of Artificial Sequence: Synthetic coding sequence
atgaaggtggtaaacctcaagcaggccattctgcaggcctggaaggagagatggagtgactatcagtgggcaattaacatgaaaaaattctttccaaagggcgccacctgggatatcttaaacctggccgacgcccttttggagcaggctatgatcggaccctcgccgaatccgctgattctgtcttatctgaagtacgcaatctcctcccagatggtgtcatattcatcagttctaactgccatctccaaatttgatgatttctcccgggacctctgtgtgcaggctctgctcgatattatggacatgttttgtgaccgtttgtcatgtcacgggaaggcagaggagtgtataggcctgtgtcgggcactcctgagcgccctgcactggctgctgcggtgtacagctgcctccgctgagcggctccgagagggcctggaggcaggaacacctgccgcaggagaaaagcaactggccatgtgcttgcaaaggctcgagaaaacactgtcttccaccaagaatcgagccctgctgcatatagcaaagctcgaggaggcttcccttcacacctcacagggcctcggtcaggggggaacccgcgccaaccagcccaccgcatcgtggacagccatcgaacactccctcctgaaactgggtgagattctggcaaatctctcaaaccctcagctgaggagtcaagcagaacagtgcgggaccctgatacgcagcatcccgacaatgctatctgtgcacgctgaacagatgcataagaccggcttccctactgtacacgctgtgattttactggaaggcaccatgaacctgactggggagactcaatctttggttgagcagctcacgatggtgaagcgaatgcaacacatccccactccgctgtttgtgtag

SEQ ID NO: 123652 - DNA, 2700 bp, Artificial Sequence
  Description of Artificial Sequence: Synthetic coding sequence
atgccattggtgcctcgctggtgccctactcttctgtcttctcaaccgtcagtatcctgccacggcaaggctgaagagtgtataggtttgtgccgtgctctgttatctgccctccactggctcctgcgttgtacagccgccagtgccgaaaggttgcgggagggcttagaggccgggacaccagccgcaggcgagaaacagctggccatgtgcctgcagcgactcgaaaagacactatcctctacaaaaaacagagccttgctgcatatcgctaagctcgaagaagcctcctcctggacagcaatcgaacactcattgctgaaattgggggagatcctcgctaatctctctaacccgcaactgagaagtcaagccgaacagtgcggcaccttgattagaagtattcccaccatgctgtccgttcatgccgagcaaatgcacaaaacaggctttcccactgtacacgcagttatccttctcgaagggaccatgaacctcacaggcgagacccagtcattggtcgaacagctgacaatggtcaaacggatgcagcacatccccactcctttgtttgtgctggagatctggaaggcctgtttcgttggcctgattgaatcccctgagggtaccgaggaactgaagtggaccgccttcacatttttgaaaattccccaagtgctcgtcaagctgaagaaatactctcacggtgacaaggacttcactgaggacgttaattgcgcgtttgaattccttctaaaactcacccctctcctcgataaggctgatcagagatgcaactgtgattgcaccaacttcctgctgcaggagtgcggcaaacagggcctgctgtctgaggcctctgttaataatctcatggccaagagaaaagccgacagggaacacgctcctcagcagaagagtggggagaatgcaaacatacaaccaaacatccagctgatcctgagagcagagcctacggtgactaatattttaaagaccatggacgctgatcacagtaagtcccccgaagggttgttaggcgtcctcggccatatgctgagtgggaagtccttggacctgctgctggccgccgcggcagcaacgggaaagctaaagagctttgctagaaagttcattaacttgaacgagtttacgacctacgggtctgaggagagcaccaagcctgccagcgttagagcactcctgtttgatatctcttttcttatgctttgccacgtggctcagacatacggatccgaggttattctctccgaaagcaggaccggcgcagaggttcccttttttgaaacctggatgcaaacatgcatgccggaagaggggaaaattttgaaccccgatcacccttgcttcaggcctgactccaccaaggtcgagagccttgtggccctacttaacaattcctctgaaatgaaattggttcagatgaaatggcatgaggcctgcctgtccatttccgctgcgattcttgaaatcctcaacgcttgggagaatggagtcctggccttcgaatcaattcagaaaatcaccgataatatcaagggtaaggtttgcagtctggccgtgtgtgcagtcgcctggctggtcgcgcacgtacggatgttaggacttgacgaacgggagaaaagtctacagatgatcaggcagcttgctgggcccctattctccgaaaacactttgcagttttataatgagcgggtggtcatcatgaatagtattctagaacggatgtgcgccgacgtgctgcagcagaccgccacccaaataaagttcccaagcacaggcgtggataccatgccgtattggaatctactgccacctaagcggcccataaaggaggttcttacagacatttttgccaaggttctcgagaagggttgggtagattcccgttccatacatatttttgatactctgctacatatggggggagtatactggttctgcaataaccttatcaaagaactgctgaaagagacccgtaaggagcacacactgagagcagtggagctactgtatagtattttctgtttagacatgcagcaggtaactttagttctcctcggccatatcctgcccgggttgcttaccgattcctctaaatggcactcgctcatggacccccccgggactgcattagcaaagctggccgtgtggtgcgctctctcctcatacagttcccacaaggggcaagccagtactcggcagaagaagcggcatcgcgaggatattgaggactacattagcctgtttccattggatgatgtacagcccagtaagctgatgaggcttctgtcatctaacgaggacgacgctaatattctcagctctcccaccgatcggtcaatgagctcgagcttgtctgcatctcagctgcacaccgttaacatgcgcgaccctctgaatcgtgttctggctaacctcttcttgcttattagcagcattctcggtagtcgtacggcggggccgcacacgcagttcgtgcaatggttcatggaggagtgtgtggattgcctcgagcaaggggggcgtggttccgtgcttcaattcatgccgttcactactgtgtcagagctggtcaaggtgtcagcaatgtcctctcctaaagtcgtgctggcgattacggacctgagcctgcccctggggaggcaggtggccgcgaaagccatcgcagcattatag

SEQ ID NO: 123653 - DNA, 756 bp, Artificial Sequence
  Description of Artificial Sequence: Synthetic coding sequence
atgaagaagttcttcccaaaaggcgccacgtgggacattctgaacctggcggacgctttattggaacaggccatgattggtccgagccctaacccactcattctatcctatttgaagtacgccattagtagtcagatggtgtcttatagttcggtccttactgccatcatggagattctgaatgcgtgggaaaacggagtcctcgcgttcgaatccattcagaaaattaccgataatattaaaggaaaagtctgttccctggccgtttgcgcagtggcctggttagtagcccacgtgagaatgctgggtctagacgagcgtgagaagtccctgcagatgatacggcaactggctggaccattattctctgagaatactcttcagttttacaacgaacgggtagttattatgaactctatcttggaacgaatgtgcgccgacgtgctgcagcaaaccgccactcagatcaagttcccttccactggggtggataccatgccttattggaatctgctacctcccaaacgccccatcaaggaggttttaaccgacatttttgccaaggttttggagaaaggttgggtggactctcgaagcatccacatcttcgatactttattgcacatgggaggagtttactggttttgcaataatctcattaaggagctgctgaaagagactcggaaggaacacacgttgagagctgttgagctgttgtattctatcttttgcctcgatatgcagcaagtcacctag

SEQ ID NO: 123654 - DNA, 2466 bp, Artificial Sequence
  Description of Artificial Sequence: Synthetic coding sequence
atgatcggaccctcacccaaccctttgattttgagctatttgaagtatgctatctcatctcagatggtgtcatactcttctgtgctcacggctatcagcaaatttgatgatttctcacgcgacttatgcgtgcaggcattgttggacataatggatatgttctgcgatcgactttcgtgccatggaaaggcggaagagtgcatcggactctgtcgagccctgcttagcgctttgcactggcttctgagatgcactgccgcctcggcagaaaggcttcgagagggactggaggcaggaacccctgcagccggtgaaaagcagctggcgatgtgcctccagcgcttggagaaaaccctgagcagtacaaaaaatcgtgctctgttacacatcgctaaattggaagaggcaagcagctggaccgctatcgaacacagccttcttaagctcggagagatcctcgctaatctgtcaaacccccaacttcgctcccaggctgagcagtgtggaaccctcatccgttcaatcccaacaatgttatccgtgcatgcagagcagatgcataagactggattccctactgttcacgcagtcatacttctggagggaactatgaatcttaccggagagacccaatccctggtcgagcagttgactatggtgaagcgcatgcagcatatccctacgccactctttgtgctggaaatatggaaagcctgttttgtggggctgatcgaatcccccgaaggaactgaagagctcaagtggacagcctttacattcctcaagatccctcaagtgctggttaaactcaagaaatattcgcatggcgacaaagatttcacggaagacgtaaactgtgcctttgaatttttactgaagttgactccactactggataaggctgatcagcggtgcaattgcgactgtactaactttttgctacaggaatgtggaaagcaaggccttttaagcgaggcctcagtaaacaacctgatggctaagaggaaggcagatcgggagcatgcaccccagcagaagagcggtgaaaacgcgaacatccagccaaacattcaactcatcctgcgcgctgagcccactgttaccaacattcttaagactatggacgctgaccattcaaagagccccgaaggccttctcggggtgctggggcacatgctcagtggcaaatccctggacctgctacttgccgctgccgccgctaccgggaaactgaagtcgttcgctcgcaagtttataaacctaaacgaatttactacctatggcagcgaggagtcaacaaaacccgccagcgtgcgcgccctactatttgatatttcgtttctgatgctgtgccacgtcgctcagacgtatggctctgaagtaatactttctgagtcacgcaccggcgcggaggtcccctttttcgagacctggatgcagacgtgcatgcctgaggagggcaagattttaaaccccgaccacccttgttttcgacctgattccactaaggttgaatcactcgtcgccttattaaataacagttcagaaatgaagctggtgcagatgaaatggcatgaggcttgtctttccatctctgctgccattctcgaaattctcaacgcttgggagaacggcgtgctagcctttgaaagcattcagaaaatcacggataacataaaaggtaaagtgtgttctctcgcagtctgcgcagtggcctggttggtggcgcatgtcagaatgcttggtctggacgagagagaaaaaagtctacaaatgatccgacagcttgcagggccactcttcagcgaaaatactctgcagttctataacgaacgcgtcgtcataatgaactccatcctagaaaggatgtgtgccgacgtgctgcagcaaactgcaacacagatcaaatttccctccactggagtggatacaatgccgtattggaaccttctccctccaaagcgccctatcaaagaggttttgaccgacatctttgcaaaagttttagaaaaaggctgggttgattctcggagtatccacatctttgatactttactgcacatggggggcgtgtactggttctgtaacaaccttattaaggaactgttaaaggagacacgcaaggaacatactctcagagcggttgaactcctctactccatcttttgccttgatatgcaacaggttacactggtcttgctggggcacattctgccagggctgcttacggattcgtcaaaatggcatagtctcatggaccccccagggaccgccctggctaaattggccgtttggtgcgctctgagctcctacagtagtcacaagggacaggcctcgactagacaaaagaagcgccaccgcgaggatattgaagactacatctcccctaaagtcgtcctggccataacagacctaagcctccctcttgggcgtcaggtcgccgccaaggcgatcgctgctctgtag

SEQ ID NO: 123655 - DNA, 1026 bp, Artificial Sequence
  Description of Artificial Sequence: Synthetic coding sequence
atgaagaagttctttccaaagggggccacctgggatatcctgaacctggccgatgctcttctcgaacaggccatgatcggcccgtcgcccaatcccctgatactatcttaccttaagtacgccatctctagtcaaatggtgagttattccagcgtcttaaccgctatttctaaatttgacgactttagccgagacttatgcgtgcaggcacttctggacataatggatatgttctgtgacagactgagttgtcacgggaaagctgaagaatgtattggactgtgcagagcgctcctgtctgctttgcattggctcttgcggtgtaccgcagccagtgcggagcgcttgagggaagggctggaagccggaacgccggctgccggggaaaagcaattagccatgtgcctgcagcgcttggaaaagacactctccagcacgaagaatagagctctgctccacattgccaagctggaagaagcaagtagttggaccgcgatagaacactcactgctgaagttaggggagattcttgccaacctgtccaatccccaactccggtcccaggccgagcaatgcgggactttaatcagaagtattccaaccatgctgtcggtgcacgcagaacagatgcataagaccggcttcccaacagtgcatgccgtgattctcctggaaggaactatgaatctcaccggagaaacccagtcgttggtcgaacagcagacggcaacccaaattaagtttccctcaaccggtgtcgacactatgccttactggaacctgcttcctcccaaaaggcctattaaagaagtcctgacagacatttttgccaaggtgctggaaaagggatgggtcgactccaggtcaatacatatattcgataccttattacacatgggcggcgtctattggttctgtaataacctcatcaaagaactcctcaaagagactagaaaagagcataccctcagggccgttgagctgctctactccatattctgtctggatatgcagcaggttacctag

SEQ ID NO: 123656 - DNA, 2796 bp, Artificial Sequence
  Description of Artificial Sequence: Synthetic coding sequence
atgaaagtggtaaatctgaagcaggcgattctccaggcttggaaagagagatggagtgattatcagtgggcaatcaatatgaaaaaattctttcccaagggtgccacctgggatattcttaatctcgcagatgccttgctggagcaggccatgattgggccgagccctaaccccttgatcctgagctatctgaaatatgccatctcgtcccagatggtatcctattcctctgtgctgacagcaattatgtgtctacaaaggttagaaaagaccctttcctcaaccaaaaatcgggccctgttgcacattgcaaaacttgaagaagcatcattgcataccagtcagggattaggacagggggggacgcgcgcgaaccagcctactgcatcgtggaccgcgatcgaacattcactcctcaagctaggagagatcctcgcaaacttgagtaacccccaactccgctcacaggcagagcaatgcggaaccctaattcgctcaatcccaacaatgctgtccgtccacgccgaacagatgcacaaaacaggatttcctactgtacacgcggtcattctgctcgagggtactatgaacctgaccggagagacccagtctctcgtcgagcagctaaccatggtaaagagaatgcagcacatccccaccccgcttttcgtcctcgaaatttggaaggcatgctttgtcggcctgatagagagtcccgagggcacggaggagcttaagtggaccgccttcacatttctgaagattcctcaggttctcgtcaagctcaagaagtattcccatggcgataaggacttcactgaagatgtcaattgtgcattcgaattcctgctgaaactgacgcctctgctggacaaggctgatcagcgctgtaactgcgactgtacgaattttttactgcaagaatgtgggaagcaggggctcttatccgaagcgagtgtgaataacctgatggctaagaggaaggcagaccgggaacacgccccacagcagaagtcaggcgagaatgcaaacatccagcctaatatccagctgattctgcgagcggagccaaccgttaccaatatactaaaaacgatggatgccgatcacagtaagtcacccgaaggtctcctcggcgtcctgggccacatgctgagcgggaaaagcttggacctgctactagcggccgccgcggcaaccgggaaattgaaatccttcgctaggaagtttataaacctcaatgagttcactacatatggctctgaggaaagtacgaagccggcttctgtgcgagccctgctctttgatatcagcttcctgatgctgtgtcacgtggctcagacttacggctcggaagtgatcttaagcgaatcacgaaccggagcagaggtgcctttcttcgaaacatggatgcaaacttgtatgcctgaagagggcaaaatactcaaccctgaccacccttgttttcggccggatagcacgaaagtggaaagccttgtggccctactgaacaactcttctgagatgaagttagtacagatgaagtggcatgaggcctgtttatctattagcgccgctatactggagatacttaacgcctgggagaatggggtactggccttcgagtccattcaaaagattaccgataacattaaaggaaaggtctgctcactggccgtatgcgcagtggcgtggttagtcgcacatgttaggatgctgggcctcgatgagagagagaaaagtctacaaatgattaggcagttggccgggcctctctttagcgaaaacactctgcagttttacaacgagagggtcgtgatcatgaactccatactcgagagaatgtgtgccgacgtgctgcaacagacggccactcaaatcaaatttccttccacgggggtggatactatgccttattggaatctcttacccccgaaacggcctattaaggaggtgctgactgatattttcgcaaaagtactagaaaagggatgggtggatagccgatccattcatatattcgacacgttacttcacatgggaggcgtgtattggttctgtaacaacctaatcaaggaattactgaaggagacaagaaaagagcacactctgcgcgctgttgagctgctttattctattttctgtctggacatgcagcaagtcacgcttgtactgttgggacacatattgcccggattgcttactgactcgtccaaatggcatagcctaatggaccctcctgggacagctctcgcaaaactggctgtatggtgtgccttgagcagttactcttctcacaagggacaagcaagcacacgccaaaaaaagcgtcaccgggaggacatcgaggactacatttctttgtttccgttagacgacgtccagcccagtaagcttatgcgtctgctcagtagcaatgaggacgatgccaacatcctgagcagcccaacagatcggtccatgtcctcttccctctccgcctcacaactccacaccgtgaacatgcgagacccgttgaacagggtgttggccaatctcttcttactaatatccagtattctaggctctagaaccgccgggccccatacgcaatttgtacagtggtttatggaagaatgtgtggattgtctcgaacagggggggagagggtctgtgctccagtttatgccattcactactgttagcgaattggttaaagttagcgctatgagttcccccaaagtcgtccttgccatcactgacctgtccctgcctctgggaaggcaagtggctgccaaggccatcgcggccctctag

SEQ ID NO: 123657 - DNA, 444 bp, Artificial Sequence
  Description of Artificial Sequence: Synthetic coding sequence
atgaaaaagttctttccaaaaggagcgacatgggatatactgaacctcgcggatgcattactcgagcaggcaatgattgggccaagtcctaatccattgatcctgtcttacctgaaatacgcaataagctcacagatggtgtcttactccagtgtgctaaccgccatctctaagttcgacgactttagccgcgacttgtgtgtccaggcattgctggatattatggacatgttttgcgatcggttatcatgtcatggaaaagctgaagagtgtatcgggctgtgtagggcactcctcagcgcacttcacttcatgccctttaccaccgtttccgagctggtgaaggtgagcgctatgtcaagtcccaaggtcgtgcttgccatcacagatctgtccctaccccttgggcgtcaggtagccgctaaagccatagcagcgctctag

SEQ ID NO: 123658 - DNA, 921 bp, Artificial Sequence
  Description of Artificial Sequence: Synthetic coding sequence
atgaagaagttctttccgaagggtgctacatgggatatactaaacttggcagacgctctgcttgagcaggcgatgataggaccctcccccaacccgctgatcctgtcctacttaaaatatgctataagtagccagatggttagttattcgagtgtgctgactgcaatctctaaattcgacgatttctccagggatttgtgcgtgcaggccttgcttgatatcatggatatgttctgcgatcgcctttcttgccacgggaaggctgaagaatgcatcggactgtgccgtgccctgctgtcagccctgcactggctccttagatgtactgccgccagtgccgagcgcctgcgcgaaggccttgaagccggaacacctgcggccggagagaagcagctggccatgtgtctgcagaggctggagaagacacttagtagcaccaagaaccgagcattactgcacattgctaagctcgaagaagcttcttcttggactgcgatcgagcactcgcttttgaagctgggcgagatcctggctaacctgtccaacccgcagctgcgctctcaggctgagcagtgcgggacgctgatacgctcaattcccaccatgctgtctgtgcacgcggagcagatgcataagacaggctttccgactgtccacgccgtgatattgctcgagggaacgatgaatctgactggagaaacacagtctctggtcgagcagctgactatggtgaagcgaatgcagcatatccccactcctcttttcggccgtggctctgtgctgcagtttatgccctttacgacagtcagtgaacttgtaaaggtctcagccatgagctctccaaaagtagtactcgccattactgacctgtccctgccactcggcagacaggtagccgcaaaggccattgccgccctgtag

SEQ ID NO: 123659 - DNA, 2244 bp, Artificial Sequence
  Description of Artificial Sequence: Synthetic coding sequence
atggtgccaggatcggaaggtcctgctagagctggcagcgtcgttgccgacgtggtgttcgtgattgagggcacagccaacctcgggccatatttcgagggcctcaggaagcactatctattacctgctatagagtacttcaatgggggcccgcccgcagagaccgattttggcggggattatggtgggacgcaatacagcttggttgtgttcaatactgttgattgcgcaccagagagctatgtgcaatgccatgccccgacttcatccgcatacgaattcgtgacttggttggatggaattaaattcatgggcggcggcggggagtcttgcagtctgatcgctgaaggtttaagtactgctttacagctcttcgacgacttcaaaaagatgcgcgaacagataggccagactcaccgcgtctgtcttctgatatgcaactcacctccgtacctgctacccgccgtggagtctaccacctattctggatgcactacggaaaacttggtgcagcaaatcggtgagcgaggtatccacttctccattgtgtcaccgcggaaactccccgccttaaggctcctcttcgaaaaggccgcacctccggcactgcttgaacctttgcagccccccaccgatgtgagtcaagatcctagacacatggtccttgtgagagggctggtcctgcctgtgggaggaggttcagcgcccggccctctgcagtctaaacaaccagtccccctgcctccggctgctcctagcggcgcaacactcagtgctgccccacagcaacccttgcctcccgtgccccctcaataccaggtgccaggcaatctctccgccgcccaagtggcggcacaaaacgcagtcgaggccgctaaaaatcagaaggcaggcctcgggccccgattttcccctatcacacctttacaacaagctgcccctggcgttggaccacctttctctcaagctcctgccccacagctaccacccggcccgccaggcgctcctaagcctccccctgcttcgcaacccagccttgttagtacggtggcccctggcagcggcctggctcctaccgcccagcccggagctccgtccatggccggcaccgtggctcccggaggggtatctgggccatccccggcacagttgggagcgcccgcccttggaggtcaacagagtgtatcaaacaaactgctagcatggagcggcgtgcttgagtggcaggagaagccgaagccagcttctgttgatgccaatacaaagctgacacgttctttgccctgccaggtgtacgttaaccacggtgagaatctgaaaaccgaacagtggccccagaagctgataatgcagctgattccccagcaactgctgaccacacttggcccactgtttcggaactcaagaatggtccagtttcatttcaccaacaaagacctggagtctcttaaaggattatatagaatcatggggaatgggttcgctggatgcgttcactttccacatacagctccctgcgaggtgcgagtgctcatgcttctgtacagcagcaaaaaaaaaatcttcatgggcctgattccatatgatcagagtggctttgttaatgggatcagacaagttatcaccaatcacaagcaggtgcagcagcagaaactggagcaacaacagagaggaatggggggtcagcaagccccaccgggactgggaccaatattggaggaccaggccagaccaagtcaaaatttactccaactgaggcccccccagccacagcctcagggcactgtaggcgcctcaggcgcaacaggccagcctcagcctcaagggactgcccagccgcctccaggggcccctcaggggccccctggggctgccagtgggccacctccccctggacccatactgcggcctcagaaccccggtgccaaccctcaactgaggtcccttctattgaatccccccccgccacagactggtgtaccaccaccgcaagccagtctgcaccaccttcagcctccaggagccccagcactacttccccctccccaccagggcctgggccagccacagctggggcctcccttgctgcaccctccaccagcccagagctggcccgcccaactcccaccaagggctcctctgccaggtcaaatgctcctgtcaggaggtcccaggggccctgtcccccagcccggtctgcagccatccgtgatggaagatgatattctcatggacctgatatag

SEQ ID NO: 123660 - DNA, 2268 bp, Artificial Sequence
  Description of Artificial Sequence: Synthetic coding sequence
atggtccctggctccgagggccctgcgagggcgggttctgttgtggccgatgtagtgtttgtgattgaaggaaccgcaaacctaggcccttattttgaaggactgagaaaacattatcttcttcccgcaatagagtactttaacgggggcccccccgccgagactgacttcgggggggattatggcggcacccaatacagcttagtggtgttcaacacagtcgattgtgctcccgagagttatgttcagtgtcacgcccccacttcttccgcatacgagttcgtcacatggctcgacggcatcaaattcatggggggagggggcgaatcctgcagcttgatcgccgaggggcttagcacagcactgcagcttttcgacgattttaagaaaatgcgagaacagataggccagactcatagagtctgcctgctcatatgcaactcacccccatatttgttgcccgcggtcgaatctaccacttactcaggctgcaccacagagaatttagtccagcagataggcgaaagaggcatccacttctccatcgtttctcctaggaagctgcctgccttacgcctgcttttcgaaaaagcagcccctcctgctttacttgagccactgcagccccccaccgacgtgtcacaggaccccaggcacatggtgctggtgcggggcctcgtgctgcccgtcggcggcgggagcgccccaggccctctgcagagtaagcaacctgtacccttaccaccagccgccccaagtggtgcaacactatcagcggctccccagcagccactgcccccagtcccccctcagtatcaggtgcccggcaacctgagcgccgcacaagttgcagcccagaatgccgtagaagccgccaaaaaccaaaaagccggtctaggtcctaggttcagtccaatcactccccttcagcaagccgcccccggcgtgggcccgccctttagccaagccccagccccccagctacctcccggtccacccggagcccctaaaccaccaccagcctcgcaaccctccctcgtgagtaccgtggcccccgggtcagggctcgcgccaactgcccagcccggcgcaccatctatggcaggaacagttgctcccggcggagtgagtggccccagtcccgcccagctgggtgctccagccctcggcggccagcaatccgtgagcaataagttgctcgcttggtcaggagtccttgagtggcaggagaagccaaaacctgccagcgttgacgccaatacaaagctgacccgctcgctcccctgccaggtgtacgtgaatcacggggaaaatctaaaaactgagcaatggccccagaagttgataatgcaactgattcctcagcagctgttgaccaccctcggaccactgtttaggaattctcggatggtccagttccatttcactaacaaggacctggaaagcctgaaaggcctgtatagaattatgggaaacggcttcgccggctgcgtccacttcccacacacagccccctgtgaagttcgggtgctcatgctgctgtacagcagcaagaaaaaaattttcatgggcctcataccttatgatcagtccggtttcgtgaacggtattcgacaggtcatcacaaatcacaaacaggtccagcagcaaaaactcgaacagcaacaacgggggatgggaggacagcaggccccccccggactgggacccatcctggaggaccaggccaggccatctcagaatctcctgcagctcagacctccccaaccccagccacagggaacggtgggcgcctcgggcgctaccggccagcctcaaccacagggcacagcgcagccccccccgggagccccccagggcccccccggcgcggcatctggcccgccccccccagggcctatcctgaggcctcagaatcccggtgcaaatccacagctcagatccctcttgctcaatcctcctccccctcagactggagtgcctcctccacaggctagtctccatcatcacctgccaagccctggtcctcacaacttcccactcgggcttcactgtcaagtgagaggccctggggggggtcagcgatctggcctttctgttccggcggcccccggcctggagcatcaggacagagtgctcctgggcagtaaagacattgggtccaagaacgaaggctcccccatccgggcatgttcaccagcctcctggagaacgacttctagctggatttcctctgagtcaccaactcccaacaaggtcccgttttag

SEQ ID NO: 123661 - DNA, 2349 bp, Artificial Sequence
  Description of Artificial Sequence: Synthetic coding sequence
atggtaccaggaagcgagggccctgccagagcaggttcagtcgtcgccgatgtggttttcgtgatcgaaggcacagccaacttaggaccatacttcgaggggctgcggaagcattaccttctccctgcaatcgagtatttcaacggcggccctcccgctgagactgatttcggtggagattatggcggcacgcagtacagcctagtggttttcaacacagttgactgtgctcctgagagctatgttcaatgccacgcaccaacttcctctgcatacgagtttgtgacctggctcgacggcataaaattcatggggggcggaggcgagtcttgcagcctgattgcagaggggctcagcacggcacttcagttgttcgatgacttcaagaaaatgagagagcagatcggccagactcacagggtctgtctgctaatttgtaattcccccccttaccttctacctgcggttgagtctacaacctactccggatgcaccacagagaacctcgtccagcagatcggggagagaggtatccattttagcatcgtgagccctcggaaattgccagccctgcggctcctgttcgagaaagcggccccacctgccctgcttgagccactccagcccccaaccgatgtatcccaggatccaaggcatatggtgctggtgcggggtctcgtcttgccagtcggcgggggctccgcccctgggcccttgcagagcaagcagcccgtccctctgccacctgcagcaccttcaggcgcgaccctcagtgctgctccccaacaacctctgcctcccgtgccacctcagtaccaggtgccagggaatctgtctgccgcacaggtggccgctcaaaacgctgtcgaagcagccaaaaatcagaaggccggactaggacccaggtttagcccaatcacccccttgcagcaggccgccccaggagtgggaccacctttcagtcaagcacctgcacctcagcttcctccagggcctccaggagctcctaagccgcctcctgcatcccaacccagccttgtctccacagtagcaccaggctctggcctcgccccgactgcgcagccaggggcccctagcatggcaggcactgtcgcaccagggggggtcagcggaccttctccagcccagctgggcgcacctgctctgggaggacaacagtccgtgagcaacaagttgctggcttggagcggcgtgttggagtggcaggaaaaacctaaacccgccagcgtcgacgcaaataccaaactcacccgtagtttaccttgtcaagtctacgttaaccacggcgaaaatcttaaaaccgaacagtggccacagaagctgatcatgcagttaattcctcaacaactgctgactacccttggacctctctttcggaactcacggatggtgcaatttcactttaccaacaaggaccttgagtcactcaagggtctgtacaggattatgggaaatggattcgccggttgcgtacacttccctcacactgccccttgtgaagttagggtgttgatgcttttatacagcagtaaaaagaaaatatttatggggttgatcccttacgatcagtccggattcgtcaatggcatccgccaagtgatcacaaaccacaaacaggttcagcagcagaagctggagcagcagcagcggggaatgggagggcagcaagcgccccccgggctgggccccattctcgaagaccaggcaagaccgagccaaaaccttctgcagctgagacctccccaaccccaaccccagggcaccgtgggcgcttctggcgcgactggccaaccacaaccgcaaggcacagcacagcctcctccgggcgctcctcagggtcctcccggggcggccagcggtcctcctccccctggaccaatcttgaggcctcagaatccgggggctaatcctcagttgagatccctgctactcaatcccccccccccgcaaacaggcgtccccccaccccaggctagcctgcaccatctgcaacctccaggagccccggcactgctgccccctcctcaccagggacttggccagcctcaattggggccacccctcctccatccaccacccgctcagagctggccagctcagttgcctccccgggctccgctcccagcagcgaaacggaaacgagaaggagagggaagagttttcagggagaagtgggagcgggcctatttctttgtagaagttaaatcaatgccgatgtgcttgatctgcaagcagattgtgagtgtgcttaaagaatacaacctgaagcgccactacgaatccaagcattcaaagtcttacgatcagtatacagaacaaacgcgatag

SEQ ID NO: 123662 - DNA, 1449 bp, Artificial Sequence
  Description of Artificial Sequence: Synthetic coding sequence
atggtgcctggatctgaagggcctgcgcgtgcagggtccgtcgtagcagatgtagtgttcgtgatagaaggtactgctaaccttgggccatactttgaggggctcaggaaacactacctgttaccggccatagaatattttaatggcggccctccagcccctttctctcaggcccccgcccctcagttacctcccggaccacccggagctcccaaacccccacctgccagtcagccatccctggtctctactgtcgcacccggatctgggctcgccccgacagcccagccaggagctccttcaatggctgggacagtggcccctgggggggtgtccgggcccagtcccgctcagctgggcgcacctgccctggggggccaacaatccgttagcaataagctgttggcatggtcaggggtccttgaatggcaagaaaagccaaaacccgcatccgtggacgcaaacaccaagctaacccgcagcctgccgtgtcaggtttacgtcaaccatggggagaatctgaagaccgagcaatggccccagaaactcattatgcagttgatcccacaacagctgctaacaacactggggcctctttttcggaactctcgtatggtgcaattccatttcacaaacaaagatctggagtctctcaagggcctgtatagaatcatgggtaatggattcgctggatgcgtgcattttccacacacagccccatgtgaggttcgggtcttaatgctgctgtacagctctaagaaaaagatctttatgggcctgattccatatgaccagtctggctttgttaatggcatcagacaggtaatcactaatcacaagcaggtgcagcagcaaaaacttgagcagcagcagcgggggatgggtggtcagcaggctccgccaggtctgggcccgattctcgaggaccaggcacggccgtcccagaatctcttgcagctccgaccgcctcaacctcagccacaaggtacggtgggcgcaagcggagccaccggccagcctcagccccaaggcaccgcacagcctcctcccggggcccctcaaggaccccccggggcagcaagcggccccccccctccgggacctattctgcggccacaaaatccaggggctaatccccagctgcgcagccttcttctgaaccctcctccacctcagacaggcgtccctccgccacaagcatcactgcaccatctccagcccccgggcgccccagccttactcccaccaccccatcaggggcttggccagccccagctggggccgcctcttttgcatcctccacccgctcaatcatggccagcgcagttgccaccacgggcgcccctgcccggtcagatgttgttatcaggcgggccacgtggccccgttccacagcctgggttgcagccatctgtcatggaagacgatatattgatggacctgatctag

SEQ ID NO: 123663 - DNA, 2385 bp, Artificial Sequence
  Description of Artificial Sequence: Synthetic coding sequence
atggtgcccggctcagagggtcctgcgcgggctggatctgtggttgccgacgtggttttcgtaatcgagggtaccgccaacctcggcccttacttcgaaggcctacgaaaacattatttactccctgccatcgagtacttcaacggtggcccgcctgcagaaaccgacttcggcggggactacggcggaacccagtattctctcgtggttttcaatacagttgactgcgcgccggaaagctatgtgcaatgtcacgccccaaccagttctgcatacgaatttgtcacttggctggacggaattaagttcatggggggaggtggtgagtcctgtagccttattgcagaaggccttagcacagccctgcagcttttcgacgattttaaaaaaatgcgggaacagataggccagacccacagggtttgtcttctgatctgtaacagtccaccttacctcctgccagctgtggagtcaacgacatattccgggtgcactaccgagaatcttgtccagcaaatcggcgagaggggcattcatttttccatagtgtcaccccgtaaactgcctgcactgagactgttgttcgagaaggctgccccccccgctctgctggagcctttgcaacccccaacggatgtttctcaagaccctagacacatggtactggtgcggggccttgtgctcccagtgggggggggatcagcccccggtcccctgcaatcaaagcaaccagtccctctgcctcccgccgcccctagcggggctacactgtccgccgcccctcagcagccactcccccccgtgcccccacaatatcaggttcctggaaatctctccgcagctcaagtggccgctcagaatgcagtggaggcggcgaagaaccagaaagcgggcctcggaccgcggttcagtccaatcactccactgcagcaggctgctccaggagtcggccccccattctcccaggccccggcgccccagctccccccaggacccccaggcgccccgaagccccctccagcttcacaacctagcctggtctctactgtcgctcccggttcaggactggcgccaactgcccaaccaggtgcgccatccatggccggcaccgtcgccccaggcggggtcagcggcccatcacctgcacaactaggcgcacctgctcttggcgggcagcagagcgtatctaataagctgctggcttggagcggcgtcctggagtggcaggaaaaaccaaaacccgcctccgtggatgccaacaccaaactgacacggtctctcccttgtcaggtttatgttaaccacggtgagaatttgaaaaccgaacagtggccacagaagctcattatgcagctgattcctcagcaattgttaactaccctcgggcctttgttccggaactctcgaatggttcaatttcacttcactaataaagacctggagagtctgaagggtttgtatcggattatgggcaacggattcgccggttgcgttcacttcccccacaccgccccatgtgaggtgagagtcctgatgctgctgtacagtagtaagaagaaaatatttatgggattgattccctatgatcagagtggatttgtaaatggcatacggcaagtaattacaaatcataaacaggttcagcagcagaagctggagcagcagcagcggggcatgggcggccagcaagcgcctcccggcctgggacctatcttggaggaccaagctcgacctagccagaacctgctccagctgcgtcccccacaacctcagccccaggggaccgtgggggcttcaggggcaaccggccagccccagccacaggggaccgcacagcctcctccaggggccccccagggcccccccggggctgctagtggacccccaccccctggtcccattctgaggccacagaatccaggcgcaaaccctcaattgaggagcctgctgctcaatcctccacctcctcagacgggggttccaccaccacaggcctccctccaccatctgcagccccccggtgctcctgcactgctgcccccaccccaccagggactcggccagccacagcttgggccccctctactgcatccgccccctgacggggcgcgccggtctgacgcggcagagcgagggagcccaggaccaggtcgcagccctcagtcccctccactgccccttgggtttcctgtgcgccagcgggtcaccgcattccatgtgagcattaccagtgggaagaccaaagagcgtaggagggggccgtgcgtgagcagaaagatgggggcaagtctgtttctctgtggctccgaagaacatgcttacgtgttcaacatgcagacaaacagagtctgtgtagagcgaatacaacccgagacccccctttag

SEQ ID NO: 123664 - DNA, 2175 bp, Artificial Sequence
  Description of Artificial Sequence: Synthetic coding sequence
atggttcccggttccgaagggcccgctcgagctggctcagtagtggctgatgtcgtgtttgtcatcgagggtacagccaatcttggaccatattttgaggggttgaggaaacattatctgttaccagccattgaatattttaatggcggcccccccgctgagacagacttcgggggagattacggcggcacacagtacagcctggtggtcttcaacactgtagattgcgccccggagagctacgtccagtgccacgccccaacttcatcagcttacgaattcgtgacatggctggatgggattaagttcatgggagggggcggagagagctgtagcttaatcgcggaagggctctctacggccctgcagctgtttgacgattttaagaaaatgagagaacagattgggcagacccatagagtctgtctcctgatctgcaactcccctccgtatctgctgcccgctgtggagtcaacgacctactctggttgtactacagagaatctcgtgcagcagattggcgaacggggcatccatttctccattgtctctccccgaaaattacctgccttacgcctcctgttcgaaaaggccgctcctccggcactgttggagccactccagcccccgacggacgtaagtcaggatccccggcacatggttctcgtcagagggctggtgctccccgtgggcggaggtagcgcaccaggacctcttcagagcaagcagcccgtaccattaccacccgctgccccctcaggcgctacgttatccgccgctccacagcagcctctcccccccgtcccgccacaataccaagtaccaggcaatctcagcgccgcccaggtcgccgcacagaatgctgtcgaagctgccaagaaccaaaaagcaggcctcgggccacggttctccccaatcacgcccttgcaacaggccgccccaggagtcgggcctcctttctcgcaggcacctgcgcctcagctgcctccagggcccccgggtgctccaaagccgccccccgccagtcagccttctttggtgagcaccgtggcccccggtagcggcttggctccaacagcgcagcccggagcccctagtatggccgggacggtagctcccggtggtgtcagcggtcctagtcccgcacagcttggcgccccggccctgggaggccagcaatctgtatccaacaaactcttggcctggtccggagttctggaatggcaagagaaaccaaaacctgctagtgtcgatgccaataccaagttaactagatccctcccctgccaagtgtatgtaaatcacggtgaaaacttaaagactgagcagtggcctcagaagctaattatgcagctgatcccacagcagctcctgaccacactcggccctctttttagaaatagtcggatggtccagttccactttaccaacaaggacttggagagtctgaaaggcctctaccgaataatgggaaacgggtttgctggatgcgtgcatttccctcatacagctccatgcgaggtgcgggtccttatgctcctgtactcatccaagaaaaaaattttcatggggctgattccatacgatcagtcaggattcgtaaatggaattagacaggtaatcacaaatcacaagcaggtacaacagcagaagctggaacagcagcagagaggaatgggaggtcagcaagctcctcctgggctcggacctatcttagaggaccaggccagacccagccagaatcttttacaactccgacctccccagcctcagcctcccccaggcgcgcctcagggcccacccggcgccgccagcggaccgccccctccagggccaattctgcggcctcagaaccccggtgccaaccctcaactgcgcagcctgctactgaatccacctccgccacagaccggcgttccgcctccccaggcgtcactgcatcatcttcagccaccaggggccccggccctgcttcctcccccccaccagggtttagggcaaccccagctgggccctcccctgctacacccccctccagcacaatcctggcctgctcagctgccacctcgcgccccgttgcctggaaagggcactagagggagggccgaagtatggactgagtgtccaagcagttcatgggccagggcaccacgtccatccgccccaggcaaatag

SEQ ID NO: 123665 - DNA, 753 bp, Artificial Sequence
  Description of Artificial Sequence: Synthetic coding sequence
atgcttctgtactcttctaagaaaaagatcttcatgggactgataccctacgatcagagcggctttgttaacggaatccgccaggtcatcacgaatcacaaacaagtgcagcagcagaagttagaacagcagcagcgcggcatggggggccagcaagccccccctggcctggggcccatcctggaagaccaggccaggccatcacagaacctcttgcagctgcggccccctcagcctcagccccaggggacggtcggtgcctccggggccaccggacagccacagccccagggcacggcgcaaccgcctcctggtgcgccccaggggcccccaggagctgccagtgggcccccccctcccggaccaattttcggaccacggacactaggccctaccttatcttgtgaagcaagttcttccactcatcaccgacgccggctgggttgcccccaccccagacccccctccaccacatcttcacaccaggggcttctgagatgttgcctccgcaggcagggactcggtcagcctcagctgggtcctcactcatgcatacatcacctgccttcacctggacctcacaattttccactcggacttcattgccaggtgcggggccctggcggaggtcagcgctctggactgtccgtccccgcagctcccgggctagagcatcaggacagggttctactgggaagcaaggacatcgggagcaagaacgaaggctccccgatggccttcgccgagttgtag

SEQ ID NO: 123666 - DNA, 1605 bp, Artificial Sequence
  Description of Artificial Sequence: Synthetic coding sequence
atggtccccgggtcagagggaccagcacgagctggttccgttgtcgctgatgtcgtgtttgttattgaaggaacggccaacctgggtccctatttcgaggggcttagaaagcactacctcttgcctgctattgaatatttcaacggagggccccctgccgaaacagactttggtggtgacgttccaggaaatctttcagcagcacaggttgctgctcaaaacgctgtcgaggctgcgaaaaatcaaaaggctggactgggtccacgattcagccctatcacccccctccagcaagcagcccccggcgtcggccccccattctctcaggcccccgccccacagttgcctccaggtcctcctggggccccaaagccacccccagctagccagccatctcttgtttcaacagttgctcctggcagtggtctggcaccaaccgcccagcctggagctccctcgatggccgggacagtcgcccccggcggagtgtcaggaccgtcccccgcacagcttggtgctcccgccttggggggacagcagtctgtgtcaaacaagttactggcttggagcggagtgttggagtggcaggagaagcccaaacctgcttcggtggacgccaatactaagctgaccagatcactaccctgccaggtttacgtgaatcacggagagaatctgaaaacagagcaatggccacagaagctcattatgcagctcatcccccagcagttgcttactacgcttggccctctgttccgcaactctaggatggtgcagttccattttaccaacaaggatctagaatctctcaaaggtctttacagaattatgggaaacgggttcgctggatgcgttcactttcctcacacagctccgtgcgaggtccgagtgctcatgctgctttatagcagtaaaaaaaagatcttcatggggttgattccttatgaccagagcggtttcgtgaacggcattaggcaggtgatcacaaaccataaacaggtgcaacaacagaagctggagcaacagcaacgcgggatggggggtcagcaagccccaccgggtctggggcctatccttgaggaccaggcacgcccaagccagaaccttctgcagttacgaccaccacagcctcagcctcagggaaccgttggcgcaagtggtgccacagggcagccacagccccaaggcacggcgcagcccccacctggagccccccaaggaccacccggtgcagcttccgggccgccaccgcctgggcctattttaaggcctcagaaccctggcgccaacccccagctccggtcactgctgctgaatcctccacctccgcagactggggtgcccccaccgcaggcttcgctccatcacttgcagccaccgggcgcaccagccctgctccctcccccccatcaagggctgggacagcctcagctagggcctcccctgctgcaccctccccctgcccaatcctggcccgctcagcttccgccgagagcaccattgcccggacagatgctgctgagtggagggccccgcggcccggtccctcagcctggcttgcagccctctgtaatggaggacgacattctgatggacctaatttag

SEQ ID NO: 123667 - DNA, 1194 bp, Artificial Sequence
  Description of Artificial Sequence: Synthetic coding sequence
atggtgcccggctccgaaggccccgctcgcgctggctcagtcgtggcagacgtggtattcgtgatagaaggcaccgcaaatctcggcccttacttcgagggcctgagaaagcattatctgctaccagccatcgaatattttaatggaggcccccctgccgaaaccgatttcggcggcgattatggtgggactcagtatagcctcgttgtgttcaatacagtggactgtgcccccgagtcatacgtccagtgccatgcccctaccagtagtgcgtatgagttcgtcacgtggctggacggaataaagtttatggggggtgggggggaatcatgttccctgattgccgaaggcctttctacagctctgcagctttttgacgattttaaaaagatgcgtgaacaaatcggacagacacacagagtgtgcctcctgatctgcaacagccccccatacctgctccccgcggtcgaaagcacaacctactctggttgtacaacagagaacttggtccagcagattggtgagcggggaatccacttcagcatcgtaagtccacggaagctgccagctctgagacttctcttcgagaaagctgctccgcccgctttgttggaacccctgcaaccccccactgatgtgtcacaagatccgaggcatatggtcctcgtgagagggttagtgctgcccgtgggaggtggttcggcaccagggcccctccagtccaaacagccagtccctcttcccccggcggccccatctggagccacactgagcgctgctccccagcagccgttgccgcctgtgccaccccaatatcaggtgccaggcaacttgagcgctgcacaggtagccgcccagaacgcggttgaagctgccaaaaaccagaaggcgggtcttggcccacggttcagccccatcacccctctacagcaagcagcacccggggtgggacctccgttcagtcaggcgcctgccccagctttgctccccccccctcaccagggattgggccaaccccaactcgggcctcccctgcttcaccctcctccagcccagagctggccagctcagcttcccccccgagctcctttgcccgggcagatgctgctctctggcggccccagagggcccgttccacaacctggactccaaccgtcggtgatggaagatgacatcctaatggacctcatatag

SEQ ID NO: 123668 - DNA, 780 bp, Artificial Sequence
  Description of Artificial Sequence: Synthetic coding sequence
atggtccccggctctgagggacccgcacgcgcaggcagtgttgtggccgatgtagtcttcgtgattgagggtacagccaacttgggcccctacttcgaaggcctgcgtaagcactatttgttgcccgcaatagaatacttcaatggtggtccaccagctgaaaccgacttcggcggagactacggtggtactcagtactcactcgtcgtctttaacacggtcgattgcgcgcccgagtcctacgtacagtgccatgctcctacttcttcagcctatgaattcgtgacctggctcgatgggatcaagtttatgggcggcggaggagagagttgttctctgattgctgaggggctttcaactgcgctgcaactctttgacgattttaaaaagatgcgtgaacagattggacaaacccatcgcgtgtgcctgctcatctgcaactctccaccctatctcctccccgccgtcgaatccacgacatattccggctgtaccacagagaatttggtgcagcagataggcgagcgcgggatccacttctccattgtgagcccccggaagttgcccgcgctccgtctgcttttcgagaaggcagctccaggcctcgccggcgcagccgccgcaagcgatcgatgcgagccaggcccggaagcccacggcgccggcagcggcacgagagccgcctgttggggatggctgtctccgaggcctccccccgtgaaagcagcatcacctcccgctagcaggcgaaccctgcgatgtcaggtgcgttgttgctag

SEQ ID NO: 123669 - DNA, 1803 bp, Artificial Sequence
  Description of Artificial Sequence: Synthetic coding sequence
atgaccgcagctcctgcctctccccaacagataagagatagactgctgcaagccattgacccccagtcgaacattcgcaacatggtggcagtgctggaggtgatctcctcactggagaagtatcccattactaaagaggcactggaggagacgcgacttggaaaactgatcaacgacgtgagaaaaaagacaaagaacgaggaacttgcaaaaagagctaaaaaactgcttcgctcgtggcagaaactgatcgaacctgcccatcagcacgaggccgccctgcggggactagcaggtgccaccgggagtgctaacggtggtgctcataactgccgacccgaagtgggggccgctggaccaccgagatctatccatgatctgaaatctcgcaatgacctgcaacgcctgcccggccagaggcttgaccgcctcggatctagaaaacgcagaggcgaccagcgagatctgggacaccctggcccgcctcccaaagtatccaaagctagccatgatcctctagtcccaaactcatcccctcttcctactaacggcattagtggctctcccgagtccttcgccagctcattggacgggtcgggccacgccgggccagaaggaagcaggctcgaacgggacgaaaacgataagcacagcggaaaaatccctgtcaatgctgtgcgtccccataccagcagcccaggcctggggaagccaccagggccctgcctccagccaaaagccagcgtcttgcagcagctagacagggtagatgagacacccgggcccccacatcctaagggtcccccaaggtgctcgttcagccctcgtaactccaggcacgagggctcttttgcccgtcaacagagtctctatgctcccaaaggcagcgtcccctcaccctcacctagaccccaggcactcgatgctacccaggtaccgagtcccctgcctctggcccaaccaagcacgccacccgttcggcgcctagaactactgcctagtgccgaaagcccagtttgttggcttgagcagcctgagtcacatcagcgcctcgccggtcccgggtgcaaggcaggcttgagccctgcagaaccgctgctgagtcgagcaggattttcccctgactcttctaaggccgacagtgacgccgccagctcaggtgggagtgacagcaaaaaaaagaagaggtatcggccgagagattataccgtaaatctggacggacaggtggctgaggcaggcgtaaagcccgtgcggcttaaagagagaaagcttacctttgatcccatgaccagacagattaaaccccttacgcaaaaagaacctgtcagggcagactcaccagtacatatggagcagcaatcgcgcaccgaattggacaaacaggaagccaaagcatctctgcaatctccctttgagcagacaaattggaaagagctctcccgcaacgagattattcagtcttatctgtcccgccaatccagtctcctttctagttccggtgcccagactcctggggcacatcatttcatgtccgagtacctcaaacaggaagaaagtacgcgtcagggagctcgccagctgcacgtgcttgtgccacagtcccccccgacagatctaccagggctgacccgggaagtaacccaggacgacttagaccggattcaggccagtcaatggcccggcgtgaatgggtgtcaggatacccaaggaaactggtacgactggacccaatgcatctctctagacccacacggcgacgacggtaggctcaatatcctgccgtatgtgtgcctcgattag

SEQ ID NO: 123670 - DNA, 282 bp, Artificial Sequence
  Description of Artificial Sequence: Synthetic coding sequence
atgacagccgctcccgcttctccccagcagatcagagaccggctgctccaggctatcgatccacagtctaacattagaaatatggtagcagtgctcgaagtgatctcctcgctggagaaatatcctataactaaagaggcactggaagaaactcgcctcggtaagctcattaacgatgtgaggaagaaaactaaaaatgaggaactggccaaaagagctaagaagttgctgcccgggtggcagtgggcgtgcagaccccgcggtcagccacctggggcctag

SEQ ID NO: 123671 - DNA, 936 bp, Artificial Sequence
  Description of Artificial Sequence: Synthetic coding sequence
atggcagatgttattaatgtctcagtgaatttggaagcattcagccaagccataagcgcgattcaggcactgagatccagcgtgtcacgcgtcttcgattgtcttaaagatggcatgcggaacaaagagacattggaaggacgcgagaaagcctttattgcccattttcaggataacctgcactcggtcaatcgggaccttaatgagctggaacgactgagcaacctcgtcgggaaaccatctgaaaaccaccctttacacaattcaggccttctctctctggatcctgtgcaggataaaacgcccctgtatagccagctgctgcaggcttacaagtggagcaataagttacaatatcacgcaggtctggcttccggcctccttaaccagcagagcctgaaacgctcggcaaaccaaatgggggtcagtgccaagaggagacctaaggcccagcccactacattagtgctgcctcctcagtacgtggacgatgtgatcagcaggatcgaccggatgtttccagagatgagcatccacctcagccgcccaaacgggacctccgcaatgctgctggtcacattaggcaaggtcctcaaggtcatcgttgtgatgaggtccctcttcatcgatcgcacaatcgtgaagggctacaatgaaaatgtctacacagaggacggtaagttggacatatggtccaagtccaactatcaggtgtttcaaaaggtcacagatcatgctaccaccgccctgctccactaccaactcccgcagatgcctgacgtcgtggtcagatccttcatgacttggctgaggagctatattaaactgttccaggctccttgccaaagatgcggtaagttccttcaggatggcttgccccccacatggcgggacttcaggacactggaggcgtttcatgacacatgcaggcagtag

SEQ ID NO: 123672 - DNA, 714 bp, Artificial Sequence
  Description of Artificial Sequence: Synthetic coding sequence
atgcgcaacaaagagacacttgagggccgcgagaaggcctttatcgctcactttcaagacaacctgcatagcgtaaatagagacctgaacgagcttgaacggctgagcaacttagtagggaaaccatcggagaatcaccctctgcataatagtgggcttcttagtctggacccagtccaggataagacccctctgtactcgcagctgctgcaggcctataagtggtcgaataagctccagtatcacgccggcctggcttctggcttgctcaatcagcagagtcttaaacggtcggccaaccaaatgggtgtaagcgctaagcgccgcccaaaggctcagcccactacgctagtgttgccaccgcagtacgtggacgacgtgatttccaggatcgataggatgttccctgagatgagtatccatttgagtagaccaaatggcacatcagccatgctgctgctggacatatggtcaaagagtaactaccaggtctttcagaaggtgacagatcacgcgactaccgcactgctgcattatcagctacctcagatgcccgacgtggtggttcgcagcttcatgacctggcttaggtcatatatcaaactgttccaggccccctgtcagaggtgcggaaagttcttgcaagatggtctcccccctacctggagggatttccggacattagaagcgttccacgacacctgcaggcaatag

SEQ ID NO: 123673 - DNA, 828 bp, Artificial Sequence
  Description of Artificial Sequence: Synthetic coding sequence
atggccgatgtaattaacgtcagcgtaaacctggaagcttttagtcaagccatttcggcaattcaagccctgcggagttctgtcagtcgagtttttgattgcctgaaagatggaatgcgaaacaaggagacccttgaaggcagggaaaaggccttcatcgctcactttcaagacaacctccactctgtcaatcgggatttaaatgaactggagcggctgagcaacctagtgggtaaaccatcagaaaaccatcccctccataacagtgggttgctgtctcttgacccagtccaggacaagacccctctctactcccagctgttgcaggcctacaaatggtccaacaagctgcagtatcacgccgggctggcctctggtctgctcaatcagcagtccctaaaacgctctgccaatcagatgggggtatcagctaaacggcgccctaaggcccaaccgaccacactggtgctcccaccccagtacgtggacgacgtgattagccggatcgacagaatgttcccagaaatgtcaatccacttatccaggccgaacggcacctccgccatgctgctgcttgacatctggagcaaatcaaactatcaggttttccagaaggtgacagaccatgcaaccaccgcactattgcactatcagctgcctcagatgcccgatgtggtggtccgctcctttatgacctggttgcggtcttacattaaactcttccaagctccgtgccaacggtgcggcaaatttcttcaggatggtctgccaccgacttggagggacttcaggacactagaggctttccacgacacatgtcgtcagtag

SEQ ID NO: 123674 - DNA, 666 bp, Artificial Sequence
  Description of Artificial Sequence: Synthetic coding sequence
atgctcaagtctaatggcgaaaggcggtcgaggaacgctctccctgctgtgtacgcaagaaaaatggctgcctcccagcagcaggccagcgcggcctctagtgccgcaggcgtttccggcccgtcatctgccggcggacccgggcctcaacagcagccccaaccacccgcacaactcgttggcccagctcagtccggcctactccaacagcagcagcaggatttcgatcccgtccaacgttacaagatgctcattccacagttaaaagaatctctgcagaccttgatgaaggttgcggcccagaatctcattcagaacaccaatatagacaacgggcagaagagttccgatggacccattcagcgcttcgacaaatgcctcgaagagttctacgccctatgtgaccagcttgagctttgccttcggctggcgcacgagtgcctttcgcagagctgtgattctgcaaagcacagtcctactctggtcccaacagcaaccaagcccgacgctgtgcagccagacagtttaccatacccccaatacttagctgtaattaaggcccagattagctgtgcaaaggacatacacactgcgcttctggattgtgctaacaaggtgactggaaagacccctgctccgcccgctgggcccgggggtaccctctag

SEQ ID NO: 123675 - DNA, 420 bp, Artificial Sequence
  Description of Artificial Sequence: Synthetic coding sequence
atgctgatccctcaacttaaggaaagtcttcagaccctcatgaaggttgccgcgcaaaatctgatccagaatactaacatcgataacggacagaaatcttctgacgggcctattcaacgcttcgacaaatgtctggaggaattttatgccctttgtgatcagttagaactctgtctgcggttggcgcatgaatgtctctcccagagttgcgacagcgctaaacactctcccaccctggtcccaaccgccacgaagcctgacgcagtccagcccgactcattaccctacccacaatacctggccgtgatcaaggcgcagatttcctgcgcgaaagatatccatactgcccttctggactgtgctaacaaagtgaccgggaaaacgccagctcctcctgctggccccgggggaaccctgtag

SEQ ID NO: 123676 - DNA, 537 bp, Artificial Sequence
  Description of Artificial Sequence: Synthetic coding sequence
atgagtacgcctcccttagcagccagcggcatggcacccggacctttcgcagggccccaggctcagcaggccgcaagggaggtgaatactgcatccctgtgtagaatcggacaggagaccgtgcaggatatcgtctatcgtaccatggagatcttccaattgttgcggaatatgcagcttcctaacggggttacctaccataccggcacctatcaggatagactgacgaagttacaggacaatttgcgccagctgagtgtgctattccgcaaactccgtctggtttacgacaagtgcaacgagaattgcggaggtatggatcccatccctgtagaacagctaatcccatatgtggaggaggatggaagcaaaaatgacgatagggcgggtcctcctagattcgctagtgaggagaggcgggaaatcgcagaggtgaacaagaagctgaagcagaaaaaccagcaactaaagcagatcatggaccagctgagaaacctaatctgggacattaatgccatgcttgccatgcggaattag

SEQ ID NO: 123677 - DNA, 813 bp, Artificial Sequence
  Description of Artificial Sequence: Synthetic coding sequence
atggccgcttcctcttctggggagaaagaaaaggagagacttggcggggggctcggcgttgccggcgggaattcaactcgcgaacgcttgttaagtgcactggaagatctagaggtcctgagtagggaactgatcgagatgctcgcaatctccagaaaccagaagctcctccaggctggagaggagaaccaagtacttgaattgctgatccatcgggacggcgagttccaagaactgatgaagctcgcgctcaaccagggaaaaatacatcatgaaatgcaggtcctagagaaggaagtggagaagcgagactcagacatccaacagctgcagaagcagttgaaggaagctgagcagattctcgccactgccgtgtatcaggccaaggagaaactgaagagcatagaaaaagcacgaaagggagccatctcatcagaggaaatcataaaatacgcccatcgcatttcggcgagtaatgccgtgtgtgctccactgacgtgggtgccgggcgatcctcgcagaccgtacccaacagaccttgagatgaggagtggactgctgggtcagatgaacaatccttcgacaaacggcgtaaatggccatctccccggcgatgctctggctgctgggcgactgcccgacgtgctagcgccacagtatccctggcagtcaaatgacatgtccatgaatatgctgccccccaaccatagcagcgacttcctactcgagccacctgggcacaacaaagagaatgaagacgatgtggagattatgagtacagatagctcctcctcgtcatctgaatccgactag

SEQ ID NO: 123678 - DNA, 675 bp, Artificial Sequence
  Description of Artificial Sequence: Synthetic coding sequence
atgctcgcaattagccgaaatcagaaattgctccaggctggagaggagaatcaggtcctggaactactaatccatcgagacggagaattccaggagctcatgaagttagccttaaaccagggcaagatccaccacgagatgcaggtgctggagaaggaagtcgagaagagggacagtgatattcagcaattgcagaagcagttgaaggaggccgagcagattttagccacagcagtctatcaagcgaaggagaaactgaaatccatcgagaaagccagaaagggagccatctcatctgaagagatcatcaaatacgctcatcgcataagcgcaagtaatgccgtgtgcgcccctctgacctgggtccccggggaccccaggcgtccctacccgacagacttggaaatgaggtcgggcctgctggggcaaatgaataatccgtccacaaatggagtcaatggccacctcccaggcgatgcactggcagccggccggttaccggatgtgctggctccccagtacccatggcagagcaacgatatgtcgatgaacatgctgccacctaatcacagctccgactttttgctggaacctccaggacataacaaggagaacgaggatgacgtcgaaatcatgtcgacggactcatctagttcttcttctgagagcgactag

SEQ ID NO: 123679 - DNA, 747 bp, Artificial Sequence
  Description of Artificial Sequence: Synthetic coding sequence
atgaaactgctatggtggtgcgactggttgcccgagaggtcccacgtcttcacgcaacgggagctcatcgagatgttggccattagcagaaatcaaaaactactgcaggccggtgaagagaatcaggtgctagagctgctcattcatcgcgacggtgagttccaagagctcatgaagctcgcactcaaccagggtaagatccaccacgaaatgcaggtgctggagaaggaggtggagaaacgtgattctgacattcagcaattgcagaagcagctgaaggaggccgagcagatcctggctaccgccgtatatcaggctaaggagaaacttaagtcgatagagaaggctcgaaagggtgctatttcttccgaggagattattaagtacgcccaccgtatttccgccagcaacgctgtttgcgctcctttgacctgggtgcccggtgacccacgacggccctacccaaccgatcttgaaatgagatcaggcctgcttgggcagatgaacaatccttcgacaaacggggtgaatggacatctacctggagatgcactggctgcgggccgcctcccagatgtcctggctccacaatatccctggcagtctaacgacatgagtatgaacatgctaccccccaatcactcctccgattttctactagagccacccggccacaataaggagaatgaggatgacgtggaaattatgagcaccgactcaagttcctcgtccagtgagagcgattag

SEQ ID NO: 123680 - DNA, 717 bp, Artificial Sequence
  Description of Artificial Sequence: Synthetic coding sequence
atgaagttgctgtggtggtgtgattggctgccagaacgctcacatgttttcacccagcgggaattgatcgagatgttggccatctcccgtaatcagaaactgttgcaggctggtgaggagaatcaggtcctggaactgctgatacatagggatggggagttccaagagcttatgaaactggcactgaaccaaggaaagattcatcatgagatgcaggttttagaaaaagaggtcgaaaaacgtgacagcgacatccagcagctgcagaagcaactgaaggaagcggaacagatcctggccactgccgtgtaccaggcaaaggagaagcttaaaagtatcgagaaagcgaggaagggcgccatatctagcgaagaaatcattaaatacgcccacaggatctcagcgtctaatgccgtgtgcgcgcccttgacttgggtgcccggagatcctcgtaggccgtacccgacagatttggagatgcggtctggattactgggccagatgaataatccatccacaaacggcgtcaacggtcatctgccaggtgatgcattggccgctgggagattaccggatgtgctcgcaccgcagtacccttggcagagtaatgacatgtctatgaatatgttaccacccaaccactcgtctgactttttgttggagcccccagggcataataaagaaaacgaagacgacgtagagatcatgagcacatag

SEQ ID NO: 123681 - DNA, 702 bp, Artificial Sequence
  Description of Artificial Sequence: Synthetic coding sequence
atgggtgaaccacagcaagttagcgcgctcccacctcctccaatgcagtatataaaagaatacacagacgagaatattcaggaaggcttggcccccaagccaccaccccctattaaggatagctatatgatgttcggcaaccaattccagtgcgacgacctcataataagaccattggagtctcaaggcatcgagaggctacacccaatgcaattcgatcacaagaaagagcttaggaagctgaatatgtctatactgataaactttcttgatctattagatatcctaatcaggtccccaggctctattaaaagggaggagaaactggaggatctgaagctcctttttgttcacgttcaccatctgattaacgagtataggccccaccaagcccgagagacactccgagtcatgatggaggtccagaagagacagcgactagagactgccgaaagattccagaagcatctggaacgggttatcgaaatgattcagaactgccttgcatcgctgccagacgacctcccccactccgaagccggcatgcgtgtgaagacggagccgatggatgcagacgactcgaataactgcacaggtcagaacgagcatcagagggaaaactccggacaccggcgggatcagattatcgagaaagacgcagcactctgtgtcctgatagacgaaatgaatgagcgaccttag

SEQ ID NO: 123682 - DNA, 702 bp, Artificial Sequence
  Description of Artificial Sequence: Synthetic coding sequence
atgggagaaccccagcaggtatctgccctcccacccccgccaatgcaatacattaaagagtatacagatgagaacatacaggagggtctggctcccaagcccccgcctccgatcaaagattcatacatgatgttcggtaaccagttccagtgcgatgatttgatcatcaggccacttgagtcacaggggatcgagcggctgcaccccatgcagtttgatcacaagaaagagctgcggaagttaaatatgagcattctgatcaacttcctggacctattggacattttaatccgctcaccaggaagtattaaacgcgaagagaaactggaggatctgaagctccttttcgtacatgtgcatcacctcatcaacgagtatcgaccccaccaggccagagagaccctgcgcgtaatgatggaagtgcagaagaggcaaaggttggagaccgctgaacgtttccagaagcatctagagagagtgattgaaatgatccaaaactgtctggctagcctgcctgacgacctaccacattctgaggccgggatgagggttaagactgaacctatggacgccgatgactcgaataactgtacaggacaaaacgaacatcagagagaaaatagcgggcatcgcagagatcagataatcgaaaaggatgcagcactctgcgtcctcattgatgagatgaacgaacgtccctag

SEQ ID NO: 123683 - DNA, 588 bp, Artificial Sequence
  Description of Artificial Sequence: Synthetic coding sequence
atgggggagccacagcaggtgtctgcgttgccacctcctccaatgcagtacattaaggagtacacagacgagaatatccaggaagggctggcacctaaacctccaccacccattaaggatagctatatgatgttcgggaatcaattccagtgcgacgatctgattattcgccctctggaatcccagggcatcgaaagactgcatcccatgcagttcgatcacaagaaggaactccgaaaactaaacatgtccatactgatcaatttcctggacttactggatatcctgatccgtagtccaggtagcattaaaagagaggagaaacttgaggatctcaaacttctctttgtgcacgtgcatcatctgattaacgagtaccgccctcatcaagctagggagaccctccgggtgatgatggaggtccagaagagacaaaggttagaaactgccgagcggtttcagaaacacctggagagagtcatcgagatgattcaaaactgtctcgcgagtcttcccgatgatctgcctcactcagaagcgggcatgcgagtcaagactgagcccatggatgctgatgatagcaactag

SEQ ID NO: 123684 - DNA, 441 bp, Artificial Sequence
  Description of Artificial Sequence: Synthetic coding sequence
atggcgagtgccggggttgccgcaggccggcaggcagaagacgttctaccaccaacaagtgatcaaccgttgcctgatacaaagcccctcccacctcctcagcctccccccgtcccggctccccaaccccaacagtcacctgctcctagacctcagagcccagctagagcccgggaggaggagaactactcatttctgccattggtccacaacataattaagtgtatggacaaagactcccccgaggtacaccaggatttgaatgccttaaagtcgaaattccaggaaatgagaaagctgatctctaccatgccgggcatccatttatcaccagaacagcaacagcagcaactacaaagtcttcgagaacaggttagaactaagaacgaattactgcagaagtacaagtccctgtgcatgttcgaaatacccaaagaatag

SEQ ID NO: 123685 - DNA, 894 bp, Artificial Sequence
  Description of Artificial Sequence: Synthetic coding sequence
atgagcaatagggtagtgtgtagagaggctagccacgccggctcgtggtatactgctagtgggccacaacttaacgctcagttggaaggatggctgagccaggtacagtcgacaaaacggcccgcgagagccattatcgcaccccacgcagggtatacgtactgtggtagttgtgctgctcacgcatataaacaagtcgacccttcaatcacgcggaggatttttatcctgggtccgtcacatcacgtacctctgagcagatgtgcactgtctagcgttgatatttataggacgcctctgtacgatctgcgaatcgaccagaagatctacggcgagctgtggaagaccggaatgtttgagaggatgagcctgcaaacagacgaggacgaacacagcattgaaatgcacctaccttacaccgctaaggccatggagagccacaaagacgaattcacgataatccccgtacttgtcggggcgctaagtgagtccaaggaacaggagttcggaaagctgttcagtaagtacttagcagacccttctaatctcttcgttgtgtcctctgacttctgccactggggccagagattccgctatagttattacgacgagagtcaaggggagatctatagaagcattgaacacctggacaagatgggaatgtccatcattgaacagttggacccagtgagtttctccaactacctgaaaaagtatcataataccatttgtggacggcatccgatcggggtgcttcttaacgccatcaccgagctgcagaagaacggcatgaacatgagtttctcttttctgaactacgctcagtcgtcccagtgccgtaattggcaggatagtagcgtgtcatatgccgccggcgcgttaaccgttcactag

SEQ ID NO: 123686 - DNA, 903 bp, Artificial Sequence
  Description of Artificial Sequence: Synthetic coding sequence
atgcccctctggcgagctgataaatgccaggatgtccagtcagcctcgtggaggccaaggcgcgccgacgggccacagcttaacgcccagctagaaggctggctgagccaggttcaatcaaccaagcggccggctcgggccatcatcgcaccccatgccgggtacacctactgcggcagctgtgccgcacacgcatacaaacaggtcgacccaagtataactagacgcattttcatcctgggaccatcacaccatgttcccctgtcaagatgtgccctttcctcagtggatatctaccgaacaccactgtatgatctccggatcgatcagaagatctacggcgagctttggaagacgggtatgtttgaaagaatgtcacttcagaccgatgaggacgagcatagcatcgagatgcacctcccctatacagccaaagcaatggaatcccataaagatgaatttacgatcattcctgttctggtgggcgcgctgagtgagtctaaggaacaggaattcgggaagctgttctcgaaatacctggctgaccccagcaacctcttcgtggtgtcttccgatttttgtcactggggtcaaaggtttcggtattcctactacgatgaaagccaaggcgaaatataccgatcgattgagcacctggataagatgggtatgtctatcattgaacaactggatcccgtatccttctccaactacctaaaaaagtatcacaatactatctgtggccgccatcccattggggtcctccttaacgctatcactgaactgcaaaagaacggaatgaatatgtcattctctttcttaaactatgcgcagagcagccaatgtcgcaactggcaggattcttctgtgagctatgctgccggggccctgactgtgcactag

SEQ ID NO: 123687 - DNA, 894 bp, Artificial Sequence
  Description of Artificial Sequence: Synthetic coding sequence
atgtctaaccgagtcgtctgtagagaggcgtctcacgctgggagttggtacaccgcgagcggcccacagctgaacgcacagcttgaggggtggctgagtcaggtgcagtccacgaaacgccccgcgcgcgcgatcatcgccccacacgctggctacacttattgcgggtcatgtgcggcacatgcatacaaacaggtagatccgagcatcacaagacggattttcatcctcggcccttctcaccatgtcccactgtcacggtgtgccctctcctcagtcgacatctacaggaccccgctgtacgatctgcggattgatcagaagatatacggggagctgtggaagaccggcatgttcgagcgaatgtctcttcagaccgacgaggacgagcacagcatcgagatgcatctgccatacacagccaaagcaatggaatcccacaaggacgagtttaccattatccccgtgctggttggcgcactctcggaaagtaaggaacaggaattcggcaaactgttctccaaatatctcgcagatccttcaaacctgttcgtcgtgtcatccgatttttgccactggggccagagatttcgctatagctattacgacgagagccagggagaaatctaccggagcattgagcatctggataagatgggtatgagcatcattgagcagctcgaccccgtgtccttctcgaactacctcaagaaataccacaatactatctgtggccggcatcctatcggagtgttgctaaatgccattaccgagctccagaagaacggaatgaacatgtcgttttctttcttgaactatgcacagtcgtcccaatgtaggaactggcaggatagctccgtgagctatgccgcaggggcacttaccgtccactag

SEQ ID NO: 123688 - DNA, 825 bp, Artificial Sequence
  Description of Artificial Sequence: Synthetic coding sequence
atgtccaatcgcgtggtgtgtcgggaagctagccatgcaggctcctggtataccgccagcgggccccagctcaacgcgcaattggaaggctggctgtcacaagtgcagtctaccaagagaccagcacgtgcaattatcgcccctagacgaattttcattctcggccctagccatcatgtaccgcttagtagatgcgcgctctcctccgtcgatatttaccgcacccctctttacgatctccgaatcgatcagaagatctatggcgagctgtggaaaactggcatgtttgagaggatgtcactgcagaccgacgaagatgagcactccattgagatgcatctgccttatacagcgaaggccatggagagtcataaggacgagtttaccattatccctgttctcgttggagccttgtcagagagcaaggaacaggaatttggcaagctgtttagcaaatacttggctgaccccagcaatttatttgtggtgagttccgatttttgccactggggccagcgattccgttacagttattatgacgaaagccagggcgagatctaccggagtattgagcaccttgacaagatggggatgtctattatcgaacagctcgaccccgtgtcctttagtaactatctgaagaaataccataatacaatttgcggacggcacccaattggagtgctcttgaatgcgataacagagctgcaaaagaatggaatgaacatgagctttagcttccttaattacgcacagtcctcccagtgtaggaattggcaggactcatccgtcagctatgcagctggtgctctgacagttcactag

SEQ ID NO: 123689 - DNA, 63 bp, Artificial Sequence
  Description of Artificial Sequence: Synthetic coding sequence
atgtccaatcgggtagtgtgcagggaagcaagccacgccgggagctggtacactgcgtcttag

SEQ ID NO: 123690 - DNA, 5478 bp, Artificial Sequence
  Description of Artificial Sequence: Synthetic coding sequence
atggaagacacccaggccatcgattgggacgtggaggaagaggaagagacggagcagtcaagcgagtcactgagatgcaatgtcgagcccgttggacggttgcacatcttttcaggagcacatggaccagagaaggactttcctttacatcttggcaagaatgttgtcggccgtatgcccgattgctcggtcgcgctgccgttcccaagcatttcgaagcaacatgccgaaatagagattctggcttgggacaaggctcctatcttgagggactgtggatctctgaatggtactcaaattctccgccccccgaaagtcctgagccccggtgtatcccaccgcctgcgagatcaggaactgatattatttgccgacctcttgtgccagtaccatagactggacgtcagcttaccttttgtctctaggggccccctgactgtagaagagacgccaagagttcagggtgaaacacagccacagcgtctgttgctggcggaagacagcgaggaggaagtggatttcctgagcgagcggcgaatggtgaaaaagtcacggactacaagttcttcagttatagtcccagagtctgatgaagaggggcatagtcctgtactaggtggactcggacccccttttgccttcaatttaaacagtgacaccgacgtcgaagagggtcagcagcctgcaactgaagaggcgagctcggcggcaaggagaggggccactgtagaggctaaacagtcagaggcggaagtggtgactgagattcagttggagaaggaccaacccttggttaaggagagagacaacgataccaaggttaagcgaggagctggcaacggtgtggtgcctgcaggcgtcatcttggaacggtctcagcccccaggtgaggactctgacactgatgtcgacgacgacagtcgccctcccgggcgacccgctgaggtccaccttgaacgggcccagccattcgggttcatcgattcagatactgatgcagaagaagagcggatacccgctacccctgttgttattcctatgaaaaagcgcaagattttccatggagtgggcacgagaggccccggcgcacctgggctggcacacctacaggagtcacaggcagggtcagacacggatgtagaggagggtaaggctcctcaggcagtgcccctggagaagagccaagcatctatggtgattaacagcgacactgatgacgaagaggaggtctcagccgcattgacactggctcacctcaaagagagtcagccagctatctggaatagagatgccgaggaggatatgccccagcgcgtggtcctgctccagcgctcccagaccacgaccgagcgtgattcggataccgacgtcgaggaagaggagctacctgttgaaaatcgcgaggccgttctgaaagaccacaccaaaataagggcgcttgttcgggcacactcagaaaaggaccagccccccttcggagacagcgacgactccgttgaggccgataaatcatcacccggaatccacctggagcggagccaggcctccactacggtagatatcaacacccaggtggaaaaagaggtccctcctggcagcgcaatcatccacattaaaaaacatcaggtcagcgttgaaggcacaaaccagacagacgtgaaggctgtcggtggccccgctaaactcctagttgtgagtttagaagaggcttggcccctccatggtgactgcgaaacagatgccgaagagggcacatctctcacagcttcagtcgtggctgatgtgaggaagagtcagttgcccgcagagggggatgctggagcagaatgggccgcagccgtcttgaaacaggagcgggctcatgaggtaggcgcccagggaggtcctcctgtcgcgcaggttgagcaagacctccccatcagcagggagaatcttactgacttagtcgtggacactgacactttaggcgagtctacccaaccacagagggagggcgctcaggttccaaccgggcgggaaagagagcaacatgtgggaggtaccaaggattctgaggataactacggggactctgaggatctcgatctccaggctacccagtgtttcttagagaatcaaggcttggaggctgtgcagagtatggaagacgagcccacacaagcattcatgctgaccccgccgcaggaactcgggcctagtcactgcagcttccagacaactggcttactaaactgtaagatgccgcctgctgaaaaggcttcacgcatcagagctgccgaaaaagtttccaggggtgatcaggaatctcctgacgcctgtcttccacctaccgtgccagaggcccccgcgcctcctcagaaacctttaaattcccaatctcagaaacatttggccccaccaccgcttctgagtcctctgctgccctcaatcaaacctacggttcgcaagactagacaggacggcagtcaggaagcaccagaagccccattgtctagtgaactggagccctttcatcccaagcccaaaatcaggactcgcaaatccagtaggatgacaccctttccagccacttccgccgcccccgaacctcatccttctacaagcaccgcgcagcctgtgactcctaagcctacctcacaggctaccaggtcgaggacgaaccggagcagcgttaaaacacccgagccagtggtgcccaccgcgcctgaattgcagcccagcacctctacagatcagcccgtcacttcggaacccaccagtcaagtcacccgcggtcggaagtcccggagctctgttaagaccccagagacagtggtcccaaccgctcttgagctacagccgtctacgtcaacagatcgccccgtcacatctgagcccacctcacaggccacacgaggacggaagaataggagtagcgtgaagacacccgagcccgttgtccccaccgcgcctgagctccagcccagcacatccacagaccaacccgtgactagcgagccgacgtatcaggccaccagagggcgcaagaaccgtagttccgtgaagacaccagagcccgtggttcccactgcacctgaactgcgcccctcgacttccactgataggcccgttaccccaaagcccacgagccggacaaccagaagtcgaacaaatatgtcttcagtcaagaccccggagactgtggtcccaactgcccccgaactccagattagcacatctaccgaccagccagttaccccaaagccaacaagtcggaccactagaagcaggaccaacatgtctagcgttaagaatccagagtccaccgtgccgattgcccccgaactgcccccatctacctctacggagcagcccgtgacacctgaacctactagccgcgctactcggggcagaaagaatcgatcaagcggcaaaacgcctgaaaccctggtgcctacagcccccaagctggagcctagtacatctactgaccagccggtcaccccagaacctacctcccaagccacgcgtgggagaaccaataggtcctccgtcaagacacctgaaactgtggtgcctaccgctcccgagctccagccatctacctctactgaccagcctgtaactccagagcctaccagtcaggccactaggggcaggactgatcgatcttcagtcaagacacctgaaacggtagtgcctacagcccccgagttgcaggcgtccgccagcacagatcagcctgtgacctcagagcctacaagtcgcactacccgcggccggaagaatcgttcctctgtcaaaactcccgagactgtcgtacccgccgcccccgaattacagccctctaccagcactgaccagccagtgacgcctgaaccaacttcacgtgccactcggggtcggaccaacaggagctctgttaaaacaccagagtccattgtgcctattgcccctgaactgcagcctagtaccagtcgcaaccagctggtgacccccgaaccaaccagtcgcgccaccagatgtcgcacaaaccgaagctctgtcaagacccctgagcccgtcgtgcctactgcccctgagcctcacccgacaacaagcacagatcagcccgtgacccctaaactgacttcaagggccactcgccgaaagacgaataggtcttccgtgaagactccaaagcctgtggaaccagctgcaagtgacctcgaaccatttactcccacggaccagtctgttactcctgaggccattgcccagggtggtcagtctaagactcttcgaagcagcacggtcagggctatgcctgtgccaaccacaccagagttccagagccctgtgactacggatcagcccatctcaccagaaccgattacgcagccctcctgtattaagaggcaaagggctgccgggaatcccggttcactggctgcgccaatagaccataagccgtgtagcgcacccctggagcccaaatcacaggcatcgcgtaaccagagatggggcgctgtcagggcagccgaaagtttgaccgccattccagagcctgcgagcccacagctgctagaaacgcccatccatgcttctcagatccagaaagttgaaccagcaggccggagccgctttactccggaactccagccaaaggcctcccagagcaggaagcggagtcttgcaaccatggactctcctccccatcaaaagcagccgcagaggggagaagtatcacaaaaaaccgtcattatcaaggaagaagaggaggacacggcagagaaacccgggaaggaggaagacgtggttaccccaaagccagggaagcggaaaagggaccaggctgaggaagagccaaaccgaattcctagtagaagcctccgccggacaaaactgaatcaggaatccactgcccctaaggtgcttttcaccggagtagtggacgctaggggggagagagcagtattggcccttggtggttcactggccggcagtgcagccgaagcctctcacttggtcaccgataggatcaggcgaactgtcaagttcctttgcgctcttggccggggcattccaatcctatcccttgattggctccatcagtctcgaaaggccggcttttttctccctcctgacgagtacgtggtgaccgacccagaacaggagaaaaattttggtttctccctgcaggatgccctgagccgggcccgtgagcgccgtctgctggagggatatgagatatatgtgacacccggagtccagcccccgcctccacagatgggcgagattatcagttgctgcggcggaacttacctgccttctatgccaagatcttataagccacagagagtggtgattacctgtcctcaagactttcctcattgttccatcccattgcgggtggggcttcctctcttgagccctgaattccttctgactggcgtgctcaaacaggaggccaagcccgaggcctttgtcctgtcccctcttgagatgagctctacgtag

SEQ ID NO: 123691 - DNA, 6270 bp, Artificial Sequence
  Description of Artificial Sequence: Synthetic coding sequence
atggaggatacacaggcaatcgactgggacgttgaagaggaagaagagacggagcagtcttcggaaagtctcaggtgtaacgtcgaaccagtgggccgtttgcatattttttctggtgctcacggacctgagaaggacttccccctgcatctcggcaagaacgtggtcgggcgcatgcctgattgttcagttgcgcttccttttcccagcattagtaagcagcacgccgagatcgagatcttggcttgggataaggctcccattctccgggattgcgggtccctgaatggaacccagattttgagaccccctaaggtcctgtcacctggggtgagccatcggttgcgtgatcaggaactgatcttattcgctgatctcctgtgccagtaccacaggctggacgtatcccttcccttcgtgtcccgtggacctcttacagtggaagagactccccgcgtacaaggcgaaacccagcctcagcggcttctgttggctgaggattccgaggaggaagttgatttcctgagtgagcggaggatggtaaagaaatcaaggaccaccagttcttccgtgatagtgccagagtccgacgaagaaggtcattccccagtcctgggaggtctgggtccgccttttgcattcaacctgaacagcgatacagatgtcgaggagggacagcagcccgccactgaagaggccagctccgctgccagacgtggagctacggtagaagccaagcaatcagaagctgaagttgtcacagagatacagctcgaaaaagaccagcccctggtgaaggagagagataatgacacgaaggtcaagcgcggggcaggaaacggcgttgtgccagctggagtgatacttgagcgaagccagcctcccggagaggacagtgatactgacgtcgacgatgatagccgcccccccgggcggccagctgaggtgcatttggaacgcgctcagccctttggattcatcgattctgatacagacgctgaagaagagagaatccccgctactccagttgtgatccccatgaagaagcggaagatctttcacggcgtaggaacacggggccccggcgcccctggattggcgcatctgcaggagtcccaagccggcagcgatacagacgtggaagagggcaaagctcctcaggcagtacctctagaaaaatcccaggcctccatggtgatcaattcagatacagacgatgaagaggaggttagtgcagctctgaccctggcccatctgaaagaaagccaacctgccatttggaacagagacgctgaggaggatatgccgcaacgtgtcgtgctgctgcaaagaagtcagactaccacggagcgggatagcgataccgacgtagaggaggaagagctgccagtggagaacagagaagcagtgctcaaggaccacacaaagatcagggccttagttcgcgcccactcagagaaagatcagccaccctttggtgattcagatgattccgtggaagccgacaagtcttcgcctggcattcatttggaaaggagtcaagcaagtaccaccgtagatatcaatactcaggttgaaaaggaagtcccccccggcagtgcaatcattcacatcaagaaacatcaggtgtcagtggagggtactaaccagaccgatgtgaaagccgtgggagggcccgcaaaactcctggtggtctccttagaggaggcctggccacttcacggcgactgtgagaccgacgcagaggagggcacctccctcacagccagcgtggtcgcagatgtgcggaaatcacagctgcccgccgaaggggacgcaggagccgaatgggccgcggcagtgctgaagcaggaaagagcccacgaggtgggagcacagggcggtccacctgtggcacaggttgaacaggacctgccaatctctagagaaaacctgaccgacctggtcgtggatacagacactctgggtgagagcacccagccccagcgggaaggagcacaggtccctacaggcagagagcgagaacaacacgtgggcggaacaaaggactctgaggacaactatggcgactctgaagatctggacttgcaggctactcagtgctttctggagaaccagggattagaggcggtgcagtcaatggaggatgagcccactcaggcatttatgcttacacccccgcaggagttgggccccagccactgcagttttcagaccacaggaaccttggacgagccttgggaggtacttgccactcagcctttttgtcttcgtgaaagtgaagattctgagacccagcctttcgacactcatttagaggcttacgggccctgtctctccccaccaagagctattccaggcgatcaacaccctgaatctcccgttcacacggagcctatgggcatccagggaagaggccggcaaacggtcgacaaggtgatgggaattcccaaagaaaccgcagagagggtcggaccagagaggggtccgttggagcgagagacagagaagctgctcccggagagacagactgacgtgactggggaggaagagcttacaaagggaaagcaagatagagaacagaagcaactcctggcacgggacacacagcgccaggagtctgacaagaacggtgagagcgcatcacccgagagggatagggagagtttgaaggtggaaatcgagacatcagaagagatacaggagaaacaggtccagaagcagacgctgcccagcaaggccttcgaaagagaggttgagaggcccgtggctaatcgggagtgtgatccggcagaacttgaagaaaaagtccctaaagtcatcctcgagcgtgacactcagaggggtgaacctgaaggaggttctcaggatcagaaaggacaggcatcgtctccaacgccagaacccggagtgggggccggagacttaccggggcctaccagcgcgcccgtaccaagtgggagccaaagcggtggcaggggatctcccgtgtcaccaaggcggcatcagaagggactgctcaattgcaagatgcctccagctgaaaaagcctcacgcattcgggcagcagagaaagtgtcacgtggcgatcaggagagccctgacgcctgtctgcccccgacagtccctgaggcccccgcaccacctcagaagccactcaatagccagagtcagaagcatctggcccctcctcctctgctgagccctctgcttccatcaattaagccaactgtgcgcaagacccggcaggatgggtcccaggaagccccagaagccccgctgagctcagagctggagccattccacccaaagcccaagataagaacccgcaagtcgtctaggatgacaccgttcccggccacttcagcagctccagagccccacccatccaccagcactgcccagccagtcacacctaaacccacctcccaggccacacgctcccgcacaaatcgaagttcagtgaagacacctgagcccgtggtccctactgcccctgagttacaaccaagcacctctactgatcagcctgtgacctccgagccgacctcacaagtcacccgcggtaggaagtccagatctagtgtgaagacgcccgaaactgtggttccaacggccctggagttgcaaccttctactagtacagatagacctgtgacaagtgagcctacaagccaggcaacgagaggtaggaagaacaggtcttctgtcaaaacaccagaacccgtggtgcccaccgctcccgagcttcagcccagtacttcgaccgaccaacctgtcacatcagaacctacctatcaggccacaagaggacggaaaaatcgatcctccgtcaagactccggaacccgtggtgcctaccgcccctgaactgcggccttcaacaagcaccgaccgcccagttacaccgaaacctacctcccggactacgcgaagtagaacaaacatgtccagcgtgaagactcctgagaccgtggtgccaacagctcccgagctgcagatttctacaagtaccgaccagcctgtgacgccaaagccgaccagcaggaccacacggagccggacaaatatgtcgagcgttaaaaatcctgaatcaacggtgcccattgctcctgaactgccaccaagtacaagcaccgagcaacccgtcacaccagagccaacaagccgcgcgaccagggggcggaagaataggtcatcgggcaagactccagagactctcgtgcccacagccccaaagctcgagccaagtacaagcacagaccagccggtgacccccgagcctacatcccaggcaacacgaggccgaactaatcgctcgtccgtgaaaacgccagaaacagtggttccaaccgcccccgagcttcaacctagcacctcaacagatcaacctgtgacaccagagcctacgtcccaggccactcgagggcgcaccgaccgaagcagcgtgaagacgccggaaactgttgtccccacagccccagagctgcaggccagtgccagtaccgaccagccagtaacctcagagcccactagcagaactacgcgagggcgtaaaaaccggagtagcgtcaagactcctgagaccgtcgttcccgctgcccccgagctgcaaccctccacgtccactgatcaacccgttacgcccgagcctacatcccgcgcaactcgtgggcgcacaaataggtcaagcgttaagacaccggagtcgatagtgccgatagcccctgagctgcaaccttccacatcgagaaatcaactagtaaccccagaacccacctcaagggccacacggtgccgtaccaaccgctccagcgtgaaaactcctgaacccgtagtgcccactgctcccgaacctcatccaaccacatcaacggatcagcccgtgaccccaaagttaacctctcgggccacccggcgtaagacaaacagatcttccgtgaagacacctaaacctgtcgagcctgccgcctctgacctggagccgtttactcctaccgaccaatcagttactccagaggccatcgctcaggggggccagtctaagacacttaggtccagtaccgtgcgcgccatgccagtccccactacaccagaatttcagagcccggttaccaccgatcagcctatatcacccgagccgataacccagcccagctgtataaaacgccagcgcgccgcaggtaaccccggtagtctggccgcacccattgaccacaagccgtgctcggccccactggaacctaagtctcaggcttccaggaatcagaggtggggcgctgtgagagcagctgagagtctgacagctatccccgaacctgcctcaccacagctgctcgagaccccaatacacgccagccaaattcagaaggtcgaaccagctgggcgctccaggttcacgccggaactgcagcctaaggccagccagtcaagaaagcgctctctggcgaccatggactctcctcctcatcagaagcagccccagcgaggtgaagtgagtcagaaaaccgtcatcattaaagaggaggaggaggacaccgccgagaagcccggaaaggaagaggacgttgtcacccctaaacccggaaaacgaaagagggaccaggctgaagaagagccaaacaggatcccttcgcgaagcttgcggcgcaccaagctgaaccaggagtcaacggctccaaaagtcctgttcactggcgtggttgacgctaggggagaacgcgcagtcctggctttggggggtagcctggccggttccgctgctgaggcctcccacctggttactgatcgcatccggcgaaccgtgaagtttctctgtgcgttaggtcggggtataccgatcttaagcctggactggctgcaccaaagtcgtaaagccggtttcttcctaccgcccgatgagtacgtggtgactgatccagagcaggagaagaatttcggcttttccctgcaagatgctttgtcgcgagccagagagcgtcgcctgctggagggctacgagatttacgtcacacccggggtgcaacctccgcctcctcagatgggcgagattatctcctgttgtggaggcacatatctcccctccatgccaagatcatataagccccagcgagtggtgatcacatgtcctcaggatttcccacattgctctatccctctcagggtgggtttacctctgttgagtcctgagttccttttgacaggggtcttgaagcaggaggcaaaacctgaggccttcgtgctgtcccctctcgaaatgtcttctacctag

SEQ ID NO: 123692 - DNA, 489 bp, Artificial Sequence
  Description of Artificial Sequence: Synthetic coding sequence
atggaagacacccaggctatcgattgggacgtggaagaagaggaggagacagagcaatcttctgaaagcctgcgttgtaatgtcgagcccgtgggacggttacacatcttttccggggcgcacggaccagagaaggattttcccttgcacttaggcaagaatgtggtgggaaggatgccagactgctctgtggcattaccattcccctcaatctcaaaacagcacgcagaaatcgaaattctcgcttgggataaggcaccgatactgagggattgcgggagtctgaacggtacgcagatcctgcgaccacctaaggttcttagcccgggagttagtcaccggttaagggaccaggagttgattctgttcgctgacctgctgtgccagtatcaccggcttgatgtatccctgccctttgtctctcgaggcccgcttacagtggaggagactccacgggtccagggcgagactcaaccccagcgactctag

SEQ ID NO: 123693 - DNA, 342 bp, Artificial Sequence
  Description of Artificial Sequence: Synthetic coding sequence
atggaagatacccaggcgattgattgggacgtggaggaggaagaggaaacagaacagtcctctgagtcccttcgatgcaacgtggagccggtggggaggctgcacatattctctggagcgcacggtcctgagaaagacttcccactacatttggggaagaatgtggtggggaggatgcccgattgcagcgtagcccttccattcccttccatctcaaaacaacacgccgaaatcgaaatcctggcctgggacaaggccccgattttgagggactgcgggtctctgaacggcactcagatcctgagaccgcccaaagttctgagtccaggggtgtctcactag

SEQ ID NO: 123694 - DNA, 384 bp, Artificial Sequence
  Description of Artificial Sequence: Synthetic coding sequence
atggaggacactcaggctatcgactgggatgtcgaagaggaagaggagacagagcaatcctccgagtcccttcgctgtaatgtggagccggtgggccggcttcacatcttttctggggcccatggaccggaaaaggacttccccctccatctcggaaagaacgttgtcgggagaatgccagactgcagcgtagctctcccattccccagtatttctaaacagcacgctgagatcgaaatccttgcctgggacaaggctcccatattaagagattgcggtagtctcaatggaacccaaatcctcaggcctcctaaagtcttaagccctggagtgtcccaccgccttagggatcaggagctgatcctgtttgcagatctactgtag

SEQ ID NO: 123695 - DNA, 489 bp, Artificial Sequence
  Description of Artificial Sequence: Synthetic coding sequence
atggaggacactcaggcgatcgactgggatgtcgaggaagaggaggaaacagagcagtcaagcgaatcactacgttgcaatgtggagccagtgggcaggctgcatatcttcagcggcgctcacggtcccgaaaaggattttccactacatttgggaaaaaatgtcgtcggccggatgcctgattgctccgtagctttgcccttcccaagcataagtaaacaacacgccgagatcgaaatactggcctgggacaaggcgccaatactgcgggactgtgggagcctcaacggcacacagatcttaaggcctcccaaagtacttagcccgggggtttcccacagactccgcgaccaggagctgatcttgtttgccgacctactgtgccagtaccacaggctcgatgtgtcccttcctttcgtcagcagagggcccctgactgtggaggaaacacctcgagttcaaggcgagactcagcctcagagactgtag

SEQ ID NO: 123696 - DNA, 921 bp, Artificial Sequence
  Description of Artificial Sequence: Synthetic coding sequence
tagcatgtgggggggaccaaggacagcgaggacaattacggagatagcgaggatctagatctgcaggctacacagtgttttctcgaaaatcaaggcctcgaggcggtgcagtctatggaagacgagcctacccaggcttttatgcttaccccgcctcaagagctaggaccctcccattgttccttccagaccacagggcttttgaattgcaagatgccgccagctgagaaagctagccgaattcgggccgccgaaaaagtgtcgaggggagaccaggagagtcctgatgcgtgtctgccccctaccgtgccagaggccccagccccccctcagaaacccttgaattcccagtctcagaaacatttagcaccaccccctttgctgtctccccttcttcctagcatcaaacctaccgtcagaaagaccaggcaggacggtagtcaggaggcccctgaagccccgctgagttcagagctcgaacctttccaccccaaaccaaaaatacgtactcggaaatccagccgtatgaccccattccccgccacgtcagctgcccctgaacctcaccccagtacatccacagcacagcccgtgaccccgaaacccacatcccaagccacaaggtccagaacaaatagaagttctgtgaaaaccccagaacccgtagtgccaaccgcaccggagttgcagcccagcacaagcaccgaccaacctgtgacctccgagcccacctcccaggttacacggggccgcaagagcagatcctcagtgaagacccccgagactgtagtgcccacggccctggagctgcagccgtctacctcaacagatcgcccagtgacttccgagcctaccagccaggccacaagaggtaggaaaaaccgttcatcggtaaagacgcccgaaccggtggtaccctag

SEQ ID NO: 123697 - DNA, 384 bp, Artificial Sequence
  Description of Artificial Sequence: Synthetic coding sequence
atggaagacacccaagccatcgactgggacgtagaagaggaggaggagactgagcagagctctgagtccctgagatgtaatgttgagcccgtgggccggcttcatattttcagtggtgctcacgggcctgaaaaagatttcccactgcaccttggtaaaaatgtcgtgggccgaatgcctgattgttctgtagccctgccgttcccaagcatttcgaagcagcacgctgaaatagaaatacttgcctgggacaaagccccaatcctgcgagactgcggctccctgaatgggacccagattcttcgccctcccaaggtcttaagcccaggtgtttctcataggcttagggaccaagaactcattctgtttgcagacctattatag

SEQ ID NO: 123698 - DNA, 921 bp, Artificial Sequence
  Description of Artificial Sequence: Synthetic coding sequence
tgacacgtcggtgggactaaagatagtgaagacaactatggagacagcgaggaccttgacctccaggctacccaatgctttctagaaaatcagggcctagaggctgtgcagtcaatggaagatgaaccaacccaggcctttatgctcactccaccccaagagctgggtcccagccactgttccttccagacaactggactcctcaactgtaaaatgcctcctgccgagaaggcctctcggatccgcgcagcagaaaaggtctctcgcggcgaccaagagtctccagatgcttgtttacccccaaccgtcccagaagcccctgcccccccccagaaaccgctgaacagtcaatctcagaagcacttggctccacctccattactttcccctctgttgcctagcatcaaacctaccgtgaggaaaaccagacaggatggttcccaggaggctcccgaggcacctttgtcttctgagctggaaccgttccaccccaaacctaaaattcgaaccagaaagagcagccgtatgaccccctttcccgcaacttctgccgcccccgaacctcatccatctacttccacggcccagcccgtcacccccaaacccacgtctcaagcaacccgctctcgcaccaaccgcagctccgtgaaaacgcccgagcctgtggtgcctactgctcctgagttacaaccttctacctcaaccgaccaaccagtaacatcagagcctacgagccaggtgaccagaggaagaaaatctagatcaagcgtgaaaactcctgagactgtggtccccactgctctggaactgcaaccctccacatctacagatcggccagtaacctcagagccaacttcacaagccaccagaggccgcaaaaatcgctcatcggtcaagactcctgagccagtggttccctag

SEQ ID NO: 123699 - DNA, 921 bp, Artificial Sequence
  Description of Artificial Sequence: Synthetic coding sequence
taacatgtagggggcaccaaggactccgaggacaactatggagattctgaggatttagatctgcaggccacccagtgttttctggagaaccagggcctagaagcagtccagtcaatggaggacgagccaacacaggcgtttatgctcactccaccccaggagctgggaccttcacattgtagcttccaaactacgggactgctcaactgtaagatgccccctgcggaaaaggcatcccgaatcagagctgcagaaaaagtgagtaggggcgatcaggagagcccagacgcctgtcttcctcctacagttccagaagccccagcccctccccaaaagccactcaattctcagtcgcaaaaacacctggcgccaccaccactgctttccccattgctgccatccatcaaaccaactgtgcggaagaccagacaggacggttcacaggaagccccagaggcaccactcagcagtgagctggaaccatttcatcctaaaccgaaaattcggacacggaaatcaagcagaatgacaccgttcccggcaacctctgccgcccccgaacctcatccaagcacatccaccgcccaacctgtaacacccaagccgacctctcaggcaacacgctctcgcacaaaccgatcaagtgttaaaacccctgagcccgtggtacccactgctccagagctgcagccctccacatcgacagatcaacccgtgactagtgaacctacctcacaagtgactcgaggtcggaagagccggtcctccgtgaaaacccctgaaacagtcgttccaactgccctggaacttcagccaagcactagcacagaccgacctgtcactagcgagcccacgtcacaggctactagaggcaggaaaaaccgatcgtccgtcaaaacaccagagccagttgtgccatag

SEQ ID NO: 123700 - DNA, 6270 bp, Artificial Sequence
  Description of Artificial Sequence: Synthetic coding sequence
atggaggacacacaggcaattgattgggacgtggaagaagaagaagagaccgagcagtcctccgagtcacttcggtgtaacgtagaaccggttggtaggcttcacatattctctggcgcccacggtccggaaaaagattttccattgcacttgggtaagaacgtcgtgggaagaatgccagactgctcagtggctctgccttttccgagcatatcaaagcagcatgccgaaattgagatactggcgtgggacaaggcccccatcttaagagactgcggctccctgaacggcactcagatcctgcggcctccgaaggtgctgagtcctggagtgtctcatcgccttcgggaccaggaactgatactattcgccgacctcctgtgccagtaccataggttggacgtgagtctgccttttgtttcccggggtcccctgactgttgaggagactcctcgcgtgcaaggcgaaacccagccccaacgcttattacttgcggaggatagtgaagaggaagtggatttcctgtctgaaaggagaatggtgaaaaagtctcgaactacctcttcatctgtgatcgtacccgaaagtgacgaagagggtcactctcctgttcttggtgggttggggcccccctttgcatttaatctgaactcagatactgacgtggaagagggacaacagcccgccaccgaagaagcttccagtgccgctagacggggagcaactgtcgaggcaaagcaaagtgaagccgaagttgtcacggaaattcaactggagaaagatcagcctctggtgaaggaacgggataatgacacgaaagtgaagcgtggggcaggcaatggcgtggtgcctgctggcgttatacttgagcggagccagcctccgggagaggactccgacacagacgtcgacgatgacagcagaccgccaggacggccagcagaggtacacctcgagagggcgcagccatttgggttcatagattctgacactgatgcggaggaagagcggatccccgcaacaccagtggtgatccccatgaagaagcggaagatattccacggagtggggactaggggccccggtgctcctggcttggcacacttgcaggagagccaggccggcagtgatacggatgtggaggaaggaaaagcaccccaggccgtgcctcttgagaagtcccaggctagcatggtgattaactctgataccgacgacgaggaggaagtctccgccgctctaacccttgctcacctgaaagaatctcaacctgccatctggaatcgcgacgctgaagaggatatgccacagcgcgtggtgctccttcagagaagtcagacgactacagagagggacagtgataccgatgtagaggaagaagagctccccgtagagaatagagaagccgtcctgaaggatcacaccaagatccgagccctggttagggctcatagcgagaaagatcagcctccctttggtgattctgacgacagcgtcgaagcagacaagagcagccccggcatccatttggaacgctctcaggcttcaaccaccgtggacatcaacacccaggtcgaaaaagaggttccgcctgggagtgcaatcattcatattaagaagcatcaggtatcagtcgaagggacaaaccagacggatgtgaaagctgtgggcggccctgctaaactattggtggtaagcctggaagaagcctggccgctccacggcgactgtgaaactgatgcggaggagggcacctcgctcactgcatctgtggtcgcagatgtgaggaagagccagttgccggcggagggagatgccggagccgagtgggcagcagccgtcttgaagcaggaacgcgcccatgaagtaggggcccagggagggcctccggtcgctcaagtggaacaagacctgccaatttcccgagagaatttgactgatctggtggtggataccgacacactgggagaatccacacaaccccagagagagggcgctcaagtgcccactggcagggaacgggagcaacacgttggcggaaccaaagactcggaggacaattacggggattccgaggacctggacctccaggctacccagtgttttctggagaatcagggtctggaagccgtccaatccatggaagatgagcctacacaagcgtttatgctcactccccctcaggagctgggccccagccactgtagtttccagacaaccgggacattggatgaaccatgggaggtgcttgccactcagccattttgcctgagggagagcgaagactccgaaacccagccctttgacacccacctggaggcatatggcccctgtctatccccacctcgtgccattccgggtgatcagcacccagagagtcccgtacatactgagcccatgggaatccagggcagaggccgtcagacagtggataaggtgatgggcattccgaaggagactgccgaacgtgtaggtcccgaacgaggcccgctcgaacgcgagactgagaaactgctgcctgagcgtcagacagacgtaacgggtgaggaagagctgactaaggggaaacaggaccgagagcagaagcagttactggcgcgggacactcaaaggcaggaatccgacaaaaatggagagagcgcatcccccgaacgggatagagagagcttgaaggtagagatcgagacatcggaggagatccaggaaaaacaggtgcaaaagcagactctcccaagcaaagctttcgaacgcgaagtcgagaggcccgtggccaacagggaatgtgatcctgctgagctggaggaaaaagtgcctaaagtgatcctcgaacgggacacccaaagaggtgagcccgagggaggctctcaggatcagaaagggcaggcgtcctcccctacccccgaaccaggggtcggagccggcgacttgccaggtccaacgtccgcccctgtgccttcaggatcgcagagtggtggcagaggctctcccgtgagcccaagaagacatcagaaaggcctactgaattgcaaaatgcccccggccgagaaggcgtcccggatcagagcagccgagaaggtgagccgcggagatcaggagtcacccgatgcctgcctgccacccacagtcccagaggcccctgctcccccacagaagcccctcaacagccagagccagaaacatttagcacccccccctctgctcagtccattgcttccgagcatcaagccaaccgttaggaagacccgacaggacggcagtcaggaggcgccggaggccccactctctagcgagctcgagccctttcatcccaagccaaaaataaggacacggaagagctctcggatgacaccctttcccgcgacttccgcggccccagaaccacacccaagcaccagcactgcacagcccgtgacccccaagccaacttcccaggcaactaggagccggactaaccggtctagcgtgaagacccccgaacccgtggtccctactgcacctgaattgcagccgagtacatcaaccgaccagcctgtgaccagcgagcctacctctcaggtaaccagaggaaggaaatctcgcagttcagtcaagactcctgagaccgtagtgcccaccgcccttgaactgcaaccttcaacctcaacagatagaccagtcacaagtgaacccacaagtcaggcgaccaggggtaggaaaaaccgttcatcagtgaaaacacctgagccggtggtccctacagcacccgaactccagccgagcaccagtaccgatcagcccgtgacaagcgagccgacctatcaggctacgaggggccgcaagaatcgatcgagtgtaaaaacgccagaacccgtggttcccactgcccccgagcttagaccatctacaagcaccgaccggcctgtgacacccaaaccaacttcaaggacaacacggtcacggaccaatatgtccagcgtgaagacacctgaaacagttgtgcctacggctccagagctgcagattagcacatcgacagatcagcctgtcacccccaaacccacctctcgcacgacacgatcaagaaccaacatgagttccgtaaaaaatccggagagtacagttccaattgcccctgaacttcctccctcgacaagcactgaacagcctgtgacacctgaacccacttcacgcgcaacccggggccggaaaaaccggtctagtgggaagacacccgagaccctggtccccactgctcctaagctggaaccgtcaactagcaccgaccaacccgtgacgccagagccaactagtcaggcaacaagaggacggaccaacagatcgagcgttaagacccctgagacagtagttcctaccgcacctgagctgcagccttccacttctaccgatcagcccgttacgcccgagccaacctcacaggctacccgggggagaacagatagatctagcgtgaagacgcccgaaaccgtcgtgccaacagccccggagttgcaagcttcggctagtacagatcagcctgtgacgtccgaaccaacttccaggaccactcgggggagaaagaaccggtcgtcagttaaaacaccagagaccgtagttccagctgcccccgagttacagcccagtacatccaccgatcaaccagtgacccctgagcccacaagtagggccacccggggacgaaccaataggagtagcgtgaagacccctgaatcgattgtgcccattgccccagagctgcagccctctaccagcagaaatcaacttgtgacccctgagcccactagccgcgcaaccagatgcaggaccaaccggagtagtgtcaaaaccccagaacccgtcgtgccgaccgctcccgagccccatcctaccacctctaccgaccagccggtgacccctaaactcacaagcagggccacccgccgcaaaaccaataggagttcagttaaaacccctaagcccgtggaaccagcagcaagtgatctcgaacctttcacacctactgaccagagcgtgacccctgaagctattgcgcaggggggccaaagcaaaaccctcaggtcttccacagtccgtgccatgcctgtgccgactacccctgaatttcagagtcctgttactacagatcaacccatcagcccggaacctatcactcagcccagctgcatcaagcggcaacgcgcagctggaaaccctggcagcctggcagcgcctatcgatcacaagccttgcagtgcaccactggagccgaaatcacaagcgagtaggaaccagcgctggggggctgttcgtgcggcagagtccctcacagctatcccggaaccagcttctccccagctgctcgaaacacctattcacgcctcacagattcaaaaggtcgaacccgccggcaggtcacggttcaccccggaacttcagccaaaggccagccagtccaggaagagatctctggcaacgatggacagcccccctcatcagaagcagcctcagcggggagaagttagccaaaaaaccgtcattatcaaggaggaggaagaagacacggcagaaaaaccagggaaggaggaagacgtggtaacccctaagcctgggaaacggaagcgagatcaggcggaggaagaaccaaaccggataccctccagatccttgcggcggactaagcttaaccaggaatcaactgcccctaaggtgctgtttactggagttgtcgacgcaagaggggaaagggcagtcctcgccctcggcggcagcctcgcagggagtgctgccgaggcatcacacttagtcacagataggatcagacgtaccgtgaaattcctctgtgctctggggcgtggaatccccatactatccctggattggctgcatcagagtaggaaggccggatttttcctgcctcccgatgagtacgtggtgactgacccagagcaagaaaagaacttcggcttcagcttacaggacgctctcagcagagctagggaacggcgtctgttggagggatacgagatttatgtgaccccaggcgttcagccgcctcccccccagatgggcgaaatcatcagctgctgcggtgggacctacctgccaagcatgccaagatcctataagccccagcgcgtcgttatcacgtgtccccaggattttccccattgcagcatcccccttagagtagggctgccacttttgtccccagaatttttgttaaccggggtgttgaagcaagaagcgaaacccgaagcctttgtgctaagtcccctcgaaatgtccagtacctag

SEQ ID NO: 123701 - DNA, 6270 bp, Artificial Sequence
  Description of Artificial Sequence: Synthetic coding sequence
atggaggatacacaggccatagactgggacgtagaggaagaggaggagacggaacagtctagcgaaagcctccggtgcaatgtcgagccagttggccggctgcacatttttagtggagcacatgggccggagaaagactttcctcttcacctgggaaagaatgttgttgggaggatgccagattgtagtgtggcgctgcctttcccctcgatctctaagcaacacgctgagatagagatcctcgcctgggacaaagcccccattttaagggattgtggctctctcaatggcacgcaaatcctcaggccccctaaagtgctgagcccgggtgtgagtcatcgtttgcgtgatcaggagctgattctttttgccgatcttctctgtcaataccatcgcctcgacgtgagtttaccattcgtttcaagaggccccttgaccgtggaagagactccaagggttcagggggagacacagcctcagcggctcctgcttgccgaggactctgaagaagaagtggacttcttatccgaacgacggatggtcaagaagtcccggactacttctagtagcgtcatcgtgcccgagtccgatgaggaggggcattcccccgtccttggtgggctcggtccgcctttcgctttcaacctcaactcagatacagatgttgaggaagggcagcagccagctacagaggaggcgtcttccgcggcgcgcagaggcgccactgtcgaggccaaacagtccgaagctgaagtagtgacagagattcaactggagaaggaccaaccactggttaaggagagagacaatgacacaaaggttaagcgaggggcaggtaatggcgtcgtcccagccggggtgattctcgaacggagtcagcctccaggcgaggactctgacactgatgtggatgacgatagccggcctccaggacgacctgcagaagtgcacctggagcgggcacagccattcggctttatagattctgacaccgacgcagaggaggagagaatccccgctacacctgtggtgatacctatgaagaaacgcaagatatttcacggtgttggcaccaggggccctggcgctcctggcctcgcccacttgcaagaaagtcaggctgggtccgacaccgacgtggaagaaggcaaggcgcctcaggcagtgcctctggagaagtctcaagcatctatggtaatcaatagcgatactgacgacgaggaggaagtctctgccgccctcactctcgcccaccttaaagaatctcagccagcaatatggaaccgagacgctgaagaggatatgcctcaacgggtcgtgcttctgcagcgctctcaaaccaccactgaacgcgacagcgacacagacgtggaagaagaagagctgcccgttgaaaatagagaggccgtgcttaaagaccacacaaagatacgcgctcttgttagagcacactccgaaaaggatcaacctccattcggggactctgatgactccgtcgaggctgacaaatccagtcctggcatacatttagagcggtcccaagcctctacaacagtagacataaacacccaggtggagaaggaggtccccccaggaagtgccattatccatattaagaaacaccaagtgagcgtggaaggcactaaccagacagatgtaaaggctgttggggggcccgccaagttacttgtagtgtcccttgaggaggcatggcccctccatggggattgcgaaaccgatgcagaggagggcactagcctgacagctagcgtagtcgcagacgtccgcaagagccagttgccagcggagggtgatgccggagccgaatgggcggcagctgtactcaagcaagagcgagcccatgaggttggcgctcaggggggcccccccgtggcccaggtggaacaggatctaccaataagccgagagaacctgaccgatttggttgttgatacagacactctgggcgaatctacccagccgcagcgggagggcgctcaggtgcccaccggtagggaacgagagcaacacgttgggggcacaaaagactccgaggataactacggggattccgaggatttagatctgcaggcaacgcagtgctttctggaaaaccagggtctcgaagcggtgcaatctatggaggatgagcctactcaagccttcatgctgactccaccccaagaactaggtccatcacactgctcctttcaaacaaccggtacacttgacgaaccttgggaagtactggcaactcagcctttctgcctccgggagtccgaggatagcgagacccagccattcgacacacacctggaagcctacggaccctgcctgtcaccccccagagcaatcccaggcgaccagcatcccgaaagtcctgtgcatacagagccaatgggaatacaggggagaggacgtcagacggtcgacaaagtcatgggcatccccaaagagaccgccgaacgggtgggccccgagcggggcccactggagcgtgaaactgagaaactcctgccggagcggcagaccgacgtcaccggtgaggaggaactcacaaaagggaaacaggatagggaacagaaacaactgctcgctagggacacccagaggcaggagtcggataagaacggcgagagtgccagccccgaacgagaccgagaatccttaaaggtggaaattgagacaagtgaagaaattcaggagaaacaagtgcagaagcagacactgccgtccaaagccttcgagagggaagttgagaggcccgtggccaatcgcgagtgtgatccggcagagctggaggaaaaagtccccaaggtaatcctcgagcgtgacacccaacggggcgagccagaggggggttcccaagaccagaagggtcaagcctcttctccaacacctgagcccggggtcggagccggagacctgcccgggccaacttcagctcctgtacccagcggaagtcagtctggcgggcggggaagccctgtgagcccgcgccgtcaccaaaaagggctcctgaattgcaagatgccacctgctgaaaaagcctctagaatccgggcagccgaaaaggtgagtagaggagaccaggagtctcccgatgcctgcctcccaccaactgttccagaagcaccagcccccccacaaaagccccttaactcccagagtcagaaacacttggctccacccccactgctgtctcccctgcttccatcaatcaaacccactgtgcgtaagacgaggcaggatggatcacaagaagctcccgaggcaccactgtcgtcagaactggagcctttccaccctaagcccaaaattcgaacacgcaagagcagcagaatgacaccatttcctgccacgtccgccgcacccgaaccacacccctcgacctcaactgcccaaccagtcacaccaaagcctacctcccaggctacacgcagccgcactaatcgatccagcgtgaagacccctgaacctgtggtgccaactgcgcccgagcttcagccaagcacaagcaccgaccagcccgtcacttctgagccgacttcgcaggtaacgcgcggtagaaaatctagaagttcagtcaagacccccgaaacagtcgtgccaacagccctggagctgcagccttctacttccacagacagacccgtgacttccgagccgacatcccaagcgaccagagggcgcaagaaccgcagtagtgtgaagactcccgagcctgtggtgcctaccgcacccgagctgcagccttctacttccaccgatcagcccgtaaccagcgagcctacttatcaagccacccggggccggaaaaatcgttccagcgtcaagacccccgaaccagtggttcctaccgcaccggaactgagacctagcacgagcactgatcggcctgttacacctaagcccacttcccgtaccaccaggtcacggaccaacatgtcgtccgtcaaaacccctgagacagtggtgcccacagcccctgaactgcaaatcagcacctctacagaccagcccgtgacccctaagcccactagccgtacaacaaggtcaagaacaaatatgtcgtcagttaagaaccccgagtcaacagtgcccattgcccctgaattgccccccagcaccagcactgagcagccagtaacccccgagcctaccagtagagccactagagggcggaagaataggagcagcggcaagactcccgagacattagtgcctaccgcccctaagctcgaaccttcaaccagtacagaccagcccgtcaccccagagcctacatcgcaggcaacaaggggaaggaccaatcgtagctcagtgaagaccccggaaaccgtggtcccgaccgcccccgaactacaaccctcaacgtccaccgatcagccggtgacacccgagcccacatctcaggccaccagaggccggaccgatcggtccagtgtaaagaccccagagacagtggtgcccaccgccccagaactgcaggcctcagctagtacagatcagcctgtcacatctgagccaacaagccggacaactcggggccgcaagaatcgtagctccgtgaaaacccctgaaacagtcgtgccggcagcccccgaacttcagcctagcactagtaccgaccaacctgtcacaccagaacccacaagtagagcgacccgggggaggacaaaccgctccagcgtcaagacacccgagagcattgtgcccattgcacccgagcttcagcctagtaccagcaggaatcaactcgttaccccggagcctacttcacgtgccacccgctgcaggaccaaccggagttcagtcaaaacgcccgagccagtggttcctaccgccccggagccccatcccactacaagtaccgaccagcctgtcacccccaagctaacctcacgtgcgactaggaggaagaccaacaggagtagcgtgaagacacctaaaccagttgaacccgccgcctcagacctggaacctttcacacccaccgaccagagcgtcacgcccgaagcaattgctcagggtgggcagagcaaaaccctgaggagcagcaccgtgagggcaatgccggtgcctacaactcctgagttccagagtcctgtaactacagatcagcctatcagcccagaaccaataacccaacccagctgcataaagaggcagcgggcagcaggtaatcctgggtctctggccgctccaattgatcacaaaccctgcagtgctcctcttgagccaaaaagccaagcaagcaggaaccagagatggggagccgttcgagccgcggagtctctgaccgccatccctgagcctgcatcaccacagttgcttgaaacccccatccacgcgtcccagatccagaaagtggaacctgccggccgttcccgattcacgccagaactgcagcccaaagctagtcaatctaggaaacggtcactggcaacaatggacagcccaccccaccagaagcagccccagagaggcgaggtaagccaaaagaccgttattattaaagaagaggaggaggatactgccgaaaagcccgggaaggaagaagatgtcgttactccaaagcctgggaaacggaaaagagaccaggctgaggaagagcccaatagaatcccctcccgctcccttcgccgcactaagctgaaccaggagtcgacagcaccaaaagtactcttcactggcgtggtggatgctagaggcgagcgcgcggtcctggctctgggtgggtcattagcgggctcagccgccgaagcgtcacatttagttaccgacagaatcaggaggacagtgaagttcttatgtgctctcggacgcggaatcccgattctttctctggactggctgcaccagtcccgtaaggctggatttttcctgcccccagatgagtacgtcgtgactgaccccgagcaggagaagaactttggtttctccctccaggatgctttgagccgcgctcgggagcgcagactgttggaaggatacgaaatatacgtaactcccggcgtgcagcctccccctcctcaaatgggcgagattatttcctgctgcgggggaacctacctcccttccatgccgaggagctacaaaccacaaagggtggtcattacttgcccgcaggatttcccgcactgttccattccccttcgagttggactgccgctcttatccccggagttcttgttgacgggagttttaaagcaggaagccaaacctgaagctttcgtgctctccccactggagatgtcaagcacctag

SEQ ID NO: 123702 - DNA, 4968 bp, Artificial Sequence
  Description of Artificial Sequence: Synthetic coding sequence
atgtatcatagactcgatgtgagtcttccctttgtctcaaggggaccgttaaccgtagaggagacccctcgagttcagggggagacacaaccccagcgtctgctcttggcagaggacagcgaggaggaggtggactttttgtcggaacgtaggatggtgaagaagagcagaacaacatcatctagcgtcattgtccctgaaagcgatgaggagggccattcacctgtgttaggcggcttgggtccacccttcgctttcaaccttaacagcgacacagatgttgaagagggacaacaaccagcaacggaagaggcgtcttccgcggcacggcgaggagccacggttgaggcaaagcagtccgaagccgaagtcgttactgagattcagctggaaaaagaccagcccttggttaaggagcgagataatgataccaaagtcaaaagaggcgccgggaatggggtggttccggcgggagttattctcgaaagatctcagccacctggggaagattccgatactgacgtggatgatgatagtcgtccaccaggtcgtccggccgaagtgcaccttgagcgcgcacaaccttttggtttcatcgacagcgacaccgatgccgaggaggaaagaatccccgctactcccgtggtgattcctatgaaaaagagaaagatttttcacggcgttggcacccgcgggccgggggcaccaggactggctcatctgcaggagtcgcaggccggttctgatacggacgtggaagaaggaaaggcgccacaggccgttccccttgaaaagtctcaggcatccatggtgatcaattccgataccgatgacgaggaagaggttagtgctgctctgacgcttgcacaccttaaagagagccagccagcaatttggaaccgggatgctgaggaggatatgccccagagggtggttcttttgcaacgatcacagacgacaacggagagagactctgacaccgacgtcgaagaggaggaactccccgtcgagaatcgggaagccgtgctgaaagaccacactaaaatacgcgctctggtgagagcccactctgaaaaggaccaacccccattcggggactctgacgatagcgttgaggccgacaaaagttcccccggcattcatctggaacgctctcaggcaagtaccaccgtggacatcaacacgcaggtcgaaaaagaggtacctccaggatctgcaattatacatatcaaaaagcaccaggtttcggtcgagggcaccaaccagacggacgtgaaggcagttggggggcccgctaagctccttgtggtatcactggaagaagcttggccgcttcatggcgactgcgagacagacgctgaggaagggacatctctgactgcatctgtggtcgctgatgtgcgaaagagccaactccctgctgagggagacgccggtgctgaatgggccgctgccgtgctgaaacaggagagagcccacgaagtgggcgcccaaggcggccctcccgtagcccaggttgaacaggacctgcccatctcaagagaaaacctgacggaccttgtggtggacaccgatactctgggggaatcaactcagccgcagagagagggcgctcaggtgcctactggcagggaacgagagcagcatgtaggggggactaaggatagcgaggataactacggcgattctgaagacttggatctccaggccacgcaatgttttttagaaaatcaggggctggaagtgcagtctatggaagatgaaccaacccaggctttcatgctgacaccaccacaagagcttggcccaagtcattgctccttccagaccaccggactgctgaattgcaagatgccccccgcggagaaagcctcacgaattcgtgcggctgaaaaagtgtctcgcggggaccaagagagtccagacgcttgtctgcctccaaccgtgcccgaggctccagccccccctcagaagcctctgaactcccaaagccagaagcacctggctcccccccctttgctgtcccccctcctacccagcatcaaacctaccgttcggaagacccgccaggacggcagccaggaggcaccagaagcacctctgtcttctgaactcgaaccattccatcccaaacctaagataaggactcgcaaatcgtcgaggatgaccccgtttccagctacatctgctgctcctgagcctcacccctccacttcgaccgcgcagcccgtcactcccaaacctactagccaggcgacaagatcgcgcactaaccgcagctcggtgaagacaccagaaccagtggtacctaccgcacctgaattgcagccctctacgtctactgaccagcccgtgaccagtgagcctacttctcaggttacccggggaaggaagagtcgcagtagcgtcaaaacacctgaaacggtggtacctacggccctggaactccaaccaagtacctccaccgatcgacccgtgacctccgaacccacgtcgcaggccaccagaggtcggaaaaatagatcttcggttaagactccagagcccgtcgttccaaccgcccctgaactgcaaccaagcacctccaccgatcagcccgttacaagtgaacctacttaccaagctacccgaggacgaaaaaataggtctagtgttaagacacccgaacctgtggtccctacagcccccgagctgagaccttctacatctaccgatcgccctgtaactccaaagccaacgtcaagaacaacccgctcgcgcacaaacatgagtagtgttaagaatcctgagtccaccgtccctatagctcccgaactgcctcctagcacctcaacagaacaacctgttaccccggagccaacatctcgcgccacccggggccgcaagaaccgcagctccgggaagactcccgagactctggtccccactgcccctaaactggaaccatcaaccagtactgatcagcccgtaacacccgaacccacgagccaggctactcgcgggcggaccaaccggtccagcgtcaagaccccagagaccgtggtcccaacagctccagaactgcagccttcaaccagcaccgatcaacctgtgacccctgaaccaacctcacaggctaccagagggcgcaccgatcgatccagtgtgaagacacccgagaccgtagtgcccaccgccccagagttgcaggcaagtgcttctacagatcagccagtgacaagcgagcccaccagccgaacaacaagggggagaaagaaccgatcttccgtgaaaactcctgagactgtggtcccagcagctcccgagttgcagccctccacatcaacagaccagcctgtgacccccgaacctaccagtcgtgcgactcgaggaaggaccaatcggagctccgtcaagacgcccgaaagcattgtcccaatcgctcccgagctgcaaccctctacaagtcggaatcagcttgtcacacctgagcctacttcacgcgccacccgctgtcgcaccaaccgttcgagcgtgaaaactccggagcctgtagtgcccacagccccagagcctcatccaacaacttcgaccgatcagcctgtgacccccaagctcacctccagggctactcggagaaaaaccaaccggtcctctgtaaaaacccccaagcccgttgagcctgcagccagcgacttggagccattcactcctacggaccagtcagtgacaccggaggcaatcgcccaaggcggtcagagtaagacactgaggagttctactgtgagagccatgccggtgcctacaacccctgagtttcaatccccggtcaccacagaccaaccaatatctcccgaacccattacacaaccgagctgtattaagcgccaaagagcagcagggaatccaggtagcctcgctgctccaattgaccataaaccttgcagtgcacctctcgaaccaaagtcacaggcatccagaaatcagaggtggggcgccgtgcgagctgctgagtctctgactgctataccagagccagccagcccacagctgctcgagactcccatacatgctagtcagattcaaaaggtcgaaccggcaggtaggagccggtttacaccagagctgcagcctaaagcttcacagagtcgcaagcgcagcctggccacaatggatagcccacctcatcagaagcaaccgcaacgcggggaagtgtcccagaaaacggtgataattaaggaggaagaggaggatactgcagagaagcctggaaaggaggaggatgtcgttactccaaaacccggtaaacggaaacgcgaccaagccgaggaggagcctaacaggatccctagtagatctctcaggcgaacaaagctgaatcaggagtcaaccgcacccaaagtgctcttcaccggtgtggtagatgctcgaggcgagcgtgcagtgctggcactgggaggatcacttgccggctccgcagctgaagctagccatttggtgaccgatcgtatcagacgtaccgttaaatttctgtgtgcactcggccgcgggattcccatcttgagcttggattggctgcatcagtcccgtaaggcaggttttttcctgcctcctgacgaatatgtggtaaccgatcccgaacaggaaaagaacttcggcttctcactgcaggatgccctgagcagggctcgggaaaggcggcttctggaggggtatgagatctacgtgaccccaggcgtgcagcctcctccaccacagatgggcgagatcatcagttgttgcgggggcacctatcttccaagtatgccacgcagttataaaccccagagggtggtcatcacctgccctcaagacttcccacattgttccatacctcttcgggtgggcctcccccttcttagccctgagtttttacttaccggggtgctgaaacaggaggcgaagcccgaggcatttgtgctgtcaccactcgagatgtcttctacttag

SEQ ID NO: 123703 - DNA, 489 bp, Artificial Sequence
  Description of Artificial Sequence: Synthetic coding sequence
atggaagatacacaagccatcgactgggacgtcgaggaagaggaagagaccgagcaatctagtgaatcactacggtgcaatgtagaaccggtcggcagactccatatcttctcaggtgcacacggacctgagaaggattttcccctacacctgggaaagaatgtcgtcggccgcatgcccgattgttctgtagcattaccatttccttccatctccaaacaacacgcggaaatcgagatccttgcctgggacaaggcgccaatacttcgagactgtggttcgctcaatggcacccaaatcctgcgcccacctaaggtgttgtctcccggggtgtcccatcggctcagagatcaggagctgatcctctttgcggatctgttatgccagtaccataggctggatgtgtcactgcccttcgtttcacgggggccccttactgttgaggaaacccctcgagtgcagggcgaaactcagcctcaaaggctttag

SEQ ID NO: 123704 - DNA, 342 bp, Artificial Sequence
  Description of Artificial Sequence: Synthetic coding sequence
atggaggatacccaggccatcgactgggatgtagaagaagaagaagagaccgaacagtcttccgagtccctgaggtgtaatgtcgagcccgtgggccgcctgcacattttctcaggtgcccacggcccagagaaggactttcctcttcacttagggaaaaacgtggtgggccggatgcctgactgttccgtggccctcccattcccgagcataagtaaacagcatgctgagatagagatcctcgcatgggataaagccccaatactgagggattgcggctccctgaacgggacgcaaatcctacgtcctcccaaagtcctcagccccggcgtaagtcactag

SEQ ID NO: 123705 - DNA, 342 bp, Artificial Sequence
  Description of Artificial Sequence: Synthetic coding sequence
atggaggacacgcaggctatcgattgggatgttgaggaggaagaagaaaccgaacagtcatcagagtctctgcggtgcaatgtggagcccgtcggccgcttgcacattttttcaggagctcatggtcccgaaaaggacttcccactgcatctagggaagaatgtagttggtcgcatgcctgactgcagtgttgctcttccctttcccagtatctctaagcagcacgcagaaatcgagatcctggcatgggataaggccccaatccttagggattgtggcagcctcaatgggacgcagattttacggccacccaaggttctcagccctggcgtaagtcattag

SEQ ID NO: 123706 - DNA, 384 bp, Artificial Sequence
  Description of Artificial Sequence: Synthetic coding sequence
atggaggacacacaggctattgactgggatgtggaggaggaggaggaaaccgagcaaagcagtgagtccctaaggtgcaatgtagaacccgtgggcagattacacatttttagcggcgcccacgggccagagaaggacttccccttacatctgggtaaaaatgtggtcggccgtatgccggattgctccgtcgccctgcctttcccctcgatttctaaacaacatgctgaaatagaaatcctggcatgggataaggcgccaatcctcagggattgtggaagcttgaacggcacccaaattctccggccacccaaggtcttgagccccggcgttagccaccgcctccgtgaccaggagctgattttgttcgccgacctgctgtag

SEQ ID NO: 123707 - DNA, 489 bp, Artificial Sequence
  Description of Artificial Sequence: Synthetic coding sequence
atggaagatacacaagcaatcgactgggacgtggaggaagaggaagagacggagcaatcttccgagtcactgagatgcaatgtggaacccgtaggacgcttgcacattttctctggggcacatggccccgagaaggacttccctctccacctggggaaaaatgtggtaggtagaatgccagactgttctgtagctcttccctttccaagcattagcaaacagcacgcagagatcgagatcctggcttgggataaagcgcctattcttagggactgcggctccctgaatggcactcagatcctgcggcccccgaaggtgcttagtccaggtgtttctcaccggctgagggaccaggaattaatcctgtttgcagacttgctgtgccaatatcacaggctcgatgtcagcctgccatttgtctctcggggcccactgactgtggaggaaactcctcgcgtgcagggagagacacagcctcagcggttgtag

SEQ ID NO: 123708 - DNA, 342 bp, Artificial Sequence
  Description of Artificial Sequence: Synthetic coding sequence
atggaagatactcaggccatagactgggacgtagaagaggaggaggaaacggaacaaagctcggagtctcttcggtgcaacgtggagcccgtcgggagactccacatatttagtggagctcacggcccagaaaaggactttcctctgcacctgggtaaaaacgttgtggggcgcatgccagattgcagcgtcgccctgccattcccatccatatcgaagcagcatgccgaaatcgaaatactggcttgggacaaggctcccattcttagggattgtgggagtctcaacggcacgcaaattctgcgcccccccaaggtgctttccccaggagtgtcccactag

SEQ ID NO: 123709 - DNA, 489 bp, Artificial Sequence
  Description of Artificial Sequence: Synthetic coding sequence
atggaggacacgcaggctattgattgggatgtagaggaagaggaagaaacagagcagtcatcagagtcactcaggtgtaatgttgagcccgtgggtagactgcacatcttctctggggcacacgggcctgagaaggacttcccgctgcaccttggtaaaaacgtcgtgggcagaatgcccgattgtagtgtcgccctgcctttcccctccatttcaaaacaacacgccgagatcgagattcttgcctgggataaagcacctattctacgagactgcggttccctgaacggcacccaaattctgcggcccccaaaggtactcagccccggcgtcagtcatcgtttaagggatcaagagctcattctgtttgcggacttgctttgtcaatatcaccggcttgatgtctcactgccatttgtgagcaggggtcccctgaccgtcgaggaaaccccccgagtccaaggcgagacccagccacagagactgtag

SEQ ID NO: 123710 - DNA, 384 bp, Artificial Sequence
  Description of Artificial Sequence: Synthetic coding sequence
atggaagacacgcaagctattgattgggacgtggaagaagaggaagagaccgagcaaagctcagagtcgctgcggtgcaatgttgagcctgtcgggagactgcatattttttcaggcgcccacggacctgagaaggatttcccattgcatctgggtaaaaatgtggtcggccggatgcctgactgctctgttgccctgcctttccctagcatctcaaagcagcacgctgaaattgaaattcttgcatgggacaaagcaccaattctcagagactgtgggagcctaaatggcactcagattctccggcctccaaaggtcctgtctcccggagtcagtcatagacttcgggaccaggaactgatcttattcgccgaccttctgtag

SEQ ID NO: 123711 - DNA, 921 bp, Artificial Sequence
  Description of Artificial Sequence: Synthetic coding sequence
tgacacgtcggcgggacgaaagactctgaggacaactacggtgactcagaagatttggacctgcaggctacacagtgtttcctggaaaaccagggtttggaagctgtccaaagtatggaggacgagccaacccaggccttcatgctcacacctccacaggaacttgggccgtcccattgttccttccagaccactggtctactcaactgtaagatgcccccagccgaaaaagcgtcacggattcgcgccgccgaaaaggtgtcacgaggtgaccaggagagccctgacgcgtgcctgcctccgaccgtgcccgaagctccagcgccaccccagaaaccactgaacagtcagtcacagaaacatctggctccccctcctctgctcagccccttactgcccagcattaaaccaaccgtgcggaaaacccgccaggacggatcccaggaggctcccgaggctccactgtcttctgaacttgaaccattccatcctaagcctaagattcggacccgcaaatcctcgaggatgaccccatttccggcaaccagcgccgcccctgaacctcacccgtctactagtaccgcccagccagtgacacccaagccaactagccaggctacgaggtctaggactaaccggagctctgtaaagacacccgagccggtcgttcccactgcacccgaactgcagccctcaacaagcaccgatcaacctgtgacctccgaaccgacatcacaagtcacacgcggacgcaagtctcgaagcagcgttaagactcccgaaaccgtcgtcccgacagccctggaactgcagccatccactagtaccgatagacctgtgaccagcgagcctacctcccaagccactaggggacgcaagaatcgctcatcagtgaagaccccggaaccggtcgtgccttag

SEQ ID NO: 123712 - DNA, 6270 bp, Artificial Sequence
  Description of Artificial Sequence: Synthetic coding sequence
atggaagacacacaggccatcgattgggatgtggaagaagaggaggaaacagaacaatcttcagaatccctgcgatgtaatgtcgagccagtcggtcgcctacatatcttttccggagcgcatggcccagagaaggactttccgctccacctgggcaaaaacgttgttggccgtatgcccgattgttccgtggccctcccctttccttccatttccaagcagcacgcagagatcgaaattctggcctgggacaaggccccaattttgagggactgcggttctctgaacggtactcagattctgcgtcccccgaaggtcttaagtccaggcgtgtcccatcggctgcgcgatcaggaactgatcctattcgccgatctcctttgccagtaccatcgcctcgacgtctcactgccgttcgtctctcggggacctctgaccgtggaagagaccccccgtgtgcagggggaaacccagccccagcggctactgttagctgaagactccgaagaggaggttgattttctttccgaacggaggatggtgaaaaaatcgagaacaacaagttcctcagtcattgtaccagaatcagacgaagaaggccattcacctgtcctggggggcttgggacccccctttgcatttaacttgaattctgatacagacgtggaggaggggcagcaacccgccaccgaggaagccagttcagctgctcgacgtggggccactgtggaggctaaacagtctgaggccgaagtagttacagaaattcagctggaaaaggatcagccattggtgaaggagagggataatgacactaaggtcaaacggggtgcgggcaatggagttgtgccagctggggtgattctggagaggtcccaaccccccggagaagattccgacaccgatgtggatgatgattcccgcccccccggcaggcccgccgaagtccatctggaacgtgcccagcctttcggcttcatcgactctgacacagacgccgaggaagaaaggattcccgctacgcctgtcgtcatccccatgaaaaaacggaaaatctttcacggtgttggtacccgaggcccgggggctcctgggctggcacacctgcaggagtctcaagctggatccgacaccgacgtggaggaggggaaagcgccccaagctgtgccgctggaaaagagtcaagcatcgatggttatcaactccgatactgacgatgaggaagaggtatctgccgctctgaccctggctcacctcaaggagtctcagcctgcaatttggaatcgtgacgccgaagaggatatgccccaacgggtggtattattacagcgatctcagacgaccaccgaaagagacagtgataccgatgtggaggaagaagaactgcctgtggaaaatcgggaggccgtgctgaaagaccacacaaagattcgcgccctggttcgggctcattccgaaaaggaccagcctccctttggcgactctgacgactccgtggaggccgataagtcatcccccggaatccacctggagcgaagtcaggcgagcaccactgtggacattaacacccaggtggaaaaggaagtcccccctgggtcagccattatccatatcaaaaaacaccaggtgagcgtggagggaacgaaccagaccgacgttaaggccgtgggaggacccgctaagttgctggtggtaagtcttgaggaggcatggcctctgcacggagattgcgagacagatgcagaggagggaactagtctcaccgcgagcgttgtcgccgacgtgagaaaaagtcaattgcctgcggagggggatgcaggtgccgaatgggctgcagcagtgctaaagcaggagagagcccacgaggttggtgctcagggtggtcctccggtggctcaggtggaacaggatctcccgattagccgcgagaacctcacagatctggtggtcgacaccgatacactgggggagagcactcaaccacaaagagaaggcgcccaagtccctaccggtagagaacgcgagcaacatgtgggcgggactaaggattcggaggataactacggggatagtgaagatctcgatctccaagccacgcagtgcttcctagagaatcagggcctggaggctgtccagtccatggaggacgagcccacacaagcgttcatgctcaccccgccacaggagttgggaccgtctcactgctcttttcagaccaccggcaccttggatgagccctgggaagtcctggccactcaaccattttgcttaagagaatcagaagacagcgagacacagccatttgatactcacctggaggcgtatggaccctgtctctcaccaccccgggctattcccggtgaccaacaccccgaatctccagttcacaccgagcctatgggcattcaggggcgagggcgccaaacagtcgataaagttatgggtatccccaaagagacagctgagcgcgtcgggcccgagcgaggcccccttgaacgcgagactgaaaagctgctgcccgagagacagacggacgttacaggcgaagaagaactaacgaaaggaaagcaggatcgggaacagaagcagctgttggcccgcgatacacagcggcaagaatccgacaaaaacggtgaatccgcgtctcccgagcgggacagggaatctctgaaggtagagatcgagaccagtgaagagattcaagagaaacaggtgcagaaacagacgctaccctccaaggcatttgaaagggaggttgaacgccccgtggccaacagagaatgcgacccagccgaactggaagagaaggtgccaaaagtaatcctggaacgagatacacaacggggcgagccagaaggcgggtctcaagaccagaaagggcaagccagttcgcctactcccgaaccgggagtaggagccggggatctgcctggacctacctcggcacctgtaccgtccggcagccaatcaggcggtcggggttctcctgtgtcacctcggcgacaccagaaaggattgctcaactgtaaaatgccgccggctgagaaagcaagcaggatcagagctgccgagaaggtgagccggggcgaccaggaatcaccagacgcgtgcctgccccccactgtgcccgaagcacccgcaccccctcaaaagcccctaaacagccagagtcaaaagcacttggcaccaccgcctctccttagccccctcctgccctccattaagcctaccgtacgcaagacacgacaggacggctcgcaggaagcacctgaagcaccattatcctctgagctggaaccatttcacccaaagcccaaaatcaggacacgcaagtcgtctaggatgacgccgtttccagcaacaagcgcagcccccgagccacatcctagcacctcgaccgcccaaccggtgactcccaagccaacaagccaggctaccaggagccggacgaacagaagctccgttaaaaccccggaacccgtcgtccccaccgcacccgagctgcagccaagtacctctacagaccaaccggtcacaagcgaacctacctctcaggtcacacggggaagaaagtcacgatcatccgttaaaacgcccgaaacagtggtaccgaccgctctggaactacagcctagcacttctacggacagaccggttactagtgaacccactagtcaagcaaccagaggcaggaaaaatagaagcagtgtgaaaacccctgaacctgtggtgcctactgctcctgagctacagccctctacctccactgaccagcctgtgaccagtgaaccaacctaccaggcaacaagagggcgcaaaaatagatccagcgtaaagactcccgaaccagttgtgccgactgctcccgagctgcggccatctacgagcaccgatcggccagtgacgcccaaaccaacaagtaggactacacggtcacgcactaatatgtcgtccgtgaagactccggaaacagtggtacccaccgcacccgaattgcagataagcaccagcacagatcagcctgtcacccctaagcctacttcaaggactactaggagccgaaccaacatgtctagtgtgaaaaatcccgagagcacggtgccgatcgcccccgagctccccccctccaccagtactgagcaacctgtcacccccgaacccacttcaagagccaccaggggccggaagaatcgctcctcaggaaagacacctgagaccctggtacctacagcaccaaagctggaacctagtaccagcaccgaccaaccagtcacacccgaacccacaagccaggctacgcggggaagaacaaatcggtcctcagtgaaaacgccggaaaccgtcgtacctacagcacccgaacttcagcctagcactagtactgaccaaccagtgactccagagccaacctcacaggccacacggggaagaactgacagatctagtgtgaaaacccccgaaactgtcgtccctacagctccagagttacaagcctcggctagcacagatcagccggtaacatccgaacctacttctcgcacaactcggggacgaaagaaccgctcatcagtgaagaccccagagacagtggtgcctgcagcccccgagctgcaaccctccacttccacagatcagcctgtaacccctgagcctacctcacgggcgacacggggccgcaccaatcggagttccgttaagacaccggagagcatagtaccaattgctcctgaattacagcccagcacgagccggaatcaacttgtgacgccagagcctacatcaagggccacccgctgtcgaacgaatcgcagctctgttaagacaccagagcccgtcgtgcccaccgcccctgagccacaccctactacctctacggatcagcccgtaactccaaaactgacgagtagagccacccgtagaaagaccaacaggtcctctgtcaagacccctaagcccgtggaacccgccgcttctgatctggagcctttcaccccaacagaccaatctgtcacccctgaggcgatcgcgcaaggcggacagagcaagacacttcgtagcagcactgtgcgggccatgccagtgcctacaacacccgagttccagagcccggtaaccacggaccagccaatcagccctgaaccaatcactcaaccgagctgcataaaacgccagcgagctgctgggaatcctggctctctggcagctccgatcgatcacaagccgtgcagcgctcccctagagcctaagagtcaagcctcacgtaaccagagatggggggcggtccgggccgcagagagtctcacagcaatcccagagcctgccagtccccaactcctcgaaactccgatccatgcctctcagattcagaaggtcgaaccagccggacgtagccgctttacacctgaacttcagccaaaggccagccagtcccgaaaaagatcacttgcgaccatggattcaccccctcaccagaagcagcctcagcgtggagaagtgagccagaagactgttattattaaggaagaggaggaggacactgcagagaaacctggcaaggaagaggatgtggtcaccccaaagcctggtaagagaaagagggatcaggctgaagaagaacctaataggatccctagcaggagtctgcgaagaacaaaactcaaccaggagagcactgctccaaaggtgttatttactggggtggttgacgctagaggagagcgcgcagtattagccctaggcggatcactcgcaggctcagccgctgaagcctcccacctggttactgacaggatccggcgcacagtgaaatttctgtgcgctttaggacggggaatccccatcctcagcttagactggctgcaccagagccgaaaggctggtttttttttgccccccgacgagtatgtggtcactgatcccgaacaggagaaaaactttggcttctctcttcaggacgccctgtctagagcgcgtgagcggcgcttgctggaagggtacgaaatttatgtaacgccaggagtgcagcccccccccccccagatgggagagataatctcatgctgtggggggacctatttgccatcaatgccgcggtcttataagccccagagggtggtgatcacctgcccgcaggattttccacattgtagtattcctctgcgagtggggctgccactgcttagcccggagtttctgctcacaggcgtgctgaagcaagaagccaaacctgaggcctttgtcctcagtcctctggaaatgtccagcacatag

SEQ ID NO: 123713 - DNA, 5409 bp, Artificial Sequence
  Description of Artificial Sequence: Synthetic coding sequence
atggaagatacccaggctattgactgggacgtggaggaggaggaggagactgaacagtctagcgagagcttacgttgcaacgtggagcctgtgggaaggctgcacatcttcagcggggcccatggtcctgaaaaagacttcccccttcacctcggtaagaatgtggtgggcagaatgccagactgctccgtggctctgcctttcccaagcatctcaaaacagcacgcagaaatcgagatactggcctgggataaagctcccatcctgagggattgtggctctctgaacgggacccagatcctgcggccgcccaaagtactgagcccaggggtgtcacaccggctgcgcgaccaggagctgattctgttcgccgatttgctgtgtcaatatcatagactagatgtcagcctgccatttgtctctcggggcccgctgaccgtcgaggagacaccccgtgttcagggagaaactcagccccagcggctgcttcttgctgaagactccgaggaagaagtcgatttcctgtctgagcgaaggatggttaagaaaagccggaccacgtcctcatccgtcatcgtgcccgaaagcgacgaagagggacatagtcccgttttggggggactaggaccgcctttcgcctttaacctaaactcggacacggatgttgaagagggccagcaacccgcaaccgaagaggccagcagcgcggcccgccggggcgccaccgtcgaagccaaacagtccgaggccgaggtagtgacagaaattcagttggaaaaggaccagcctttagtcaaggaacgcgataatgacaccaaggtgaagcgaggtgccggcaacggcgttgtcccagccggagtgatactcgagcgtagccaaccgcctggtgaggacagcgatactgatgttgatgacgattccagacccccagggagaccagctgaagtccatcttgagcgcgctcagccctttggctttatcgacagtgatacggatgctgaggaggagcgcatccccgccacccctgtagttatccctatgaaaaaacgtaagatcttccatggtgtcggaacacgggggccaggcgctccagggttagctcacttacaggaaagtcaagccggaagtgataccgacgtcgaagagggaaaagctcctcaggccgtgcccctggagaagtcccaggcaagcatggttataaacagtgacactgacgatgaagaggaggtgtccgctgccctaaccctggcccacctaaaggaatcccagccagccatctggaatagagatgctgaagaagatatgccgcaaagagtggtgctgctgcagaggagtcagactactactgaacgcgactcggataccgacgtggaagaagaagaattaccagtggagaatagggaagcagtacttaaagaccatactaagatccgagccctagtgcgcgctcactcagaaaaagaccagcctccattcggagattcggatgattctgtggaggccgacaaatcctctccaggcatccacctcgaacggagccaggcatctacgaccgttgacattaacacacaggtcgaaaaagaggttcctccaggttccgctataatccatatcaaaaagcaccaggtcagcgtcgaggggactaaccagactgatgttaaggcagtgggagggccagccaaattactggtggtcagtttggaggaggcctggccattacacggggactgtgagacagacgccgaggaaggcacaagcttgactgcctctgtcgttgcagacgtgaggaaatcacagctgccagcagagggcgatgctggtgccgagtgggcggccgccgtgctcaaacaggagcgtgcccacgaagtgggcgctcagggcgggcctccagtagcccaagtcgagcaggatctcccgatcagtcgagagaaccttactgacttagtggttgacacggacacactgggcgagagtactcagccccaaagagagggagctcaggtgcctacaggaagggaaagagaacagcacgttggcggcacaaaggattcagaggacaattacggggactctgaagacctcgatctccaggcgacccaatgcttccttgagaaccagggactggaagcagtgcagtctatggaagatgagcccactcaggcatttatgctgaccccgccccaagagcttggaccttctcattgttctttccagacaaccggcaccttagatgagccatgggaggtgctcgccacacaaccattctgtctcagagaatctgaggactccgagactcagcccttcgatacgcatctggaagcatatggaccatgcttgagcccgccaagagcaattcctggcgatcagcaccccgaatcccccgtacacaccgagcctatgggcatccagggtcgagggagacaaacagttgataaggtcatgggtattcctaaagaaacagccgagagagtgggccccgaacgcggcccacttgaaagggagactgaaaaattgcttcctgaacgacaaaccgacgttaccggagaggaggaattgacaaagggcaagcaggatagggagcagaaacagcttctcgctagggatactcagcgacaggaatcagataagaatggcgagagtgcctctcccgagagggacagagagtccctcaaagtggaaattgagacctcagaggagatccaggagaaacaggtgcagaagcagacactgccctctaaagcctttgagcgggaagtggaacggcccgtggccaacagagagtgtgacccagcagaattggaagagaaagttcccaaggttatcctagagagggacacccagcgcggtgagccagagggcggtagtcaggaccagaagggacaggccagttcccctactccagaacctggtgtgggggcaggcgacctgccaggccccaccagcgctcctgttcccagcggctcgcagtcaggaggcagaggttcccctgtgagtcctcggcgccatcaaaaaggcctcctgaactgtaagatgccacccgccgagaaggcgtctcgaatcagagccgctgagaaggtcagccgaggagatcaagaaagccccgatgcctgtttgccgcctaccgtgcccgaagctcccgccccgccccagaagccgctaaactctcagtcacagaagcacctggcaccgccaccgctcctttcacctttgctgccatctatcaaacctaccgtgcgtaagactagacaggatggctctcaggaggctccggaggctccactgtccagcgaactggagccctttcatccaaagcccaagatacgcactaggaagtccagtagaatgacccccttccctgcgacctcagctgcccccaagctggagccatctacttcaaccgatcagccagtcaccccggagcctacctcgcaagcaaccagaggaaggacaaatagatccagcgtcaaaacccctgaaactgtggtgcccacagcccccgagctccagccctccaccagtacagaccagcctgtgacgccagaacctacgagtcaagcgactcgtggccggactgataggagctccgtcaagactccagagacagttgtccctactgctcccgagctgcaggcctcggcttcaactgatcagcctgtcacctcagaacctacttcccgtactacccgcggtagaaagaaccgcagtagcgtgaaaacaccagaaaccgtcgtgccggcggctccggagctccagccctctacctccactgaccaaccggtaacacctgagcctacctctagagccacccggggccgcacaaacagatcaagcgtgaagaccccagagtcaatcgtgccgatcgctccggagctccaaccgtctaccagcaggaaccagcttgtgacccccgaacctactagcagggcaactaggtgccgaaccaacagaagttcggtgaaaacacccgaacctgttgtgcctactgcaccagaacctcaccctacaacttctacggatcagcccgtcacccctaagttaacgtctcgtgcaacccgtcgcaaaactaacaggtcttcagtcaagaccccgaaacccgtggaacccgcagcctccgacctggaaccattcaccccaaccgaccagtctgtgactcccgaggctatcgcccaaggcgggcagtctaaaaccctgcggtccagcacggtccgggcgatgcctgttccgacaacacctgagtttcagtcccccgtaacaactgaccaacctattagccccgagcctattactcagccatcgtgtatcaaaagacagcgagcagcaggaaaccctggctccctggccgcaccgatcgaccataaaccatgctctgcaccccttgagcccaagtcccaggcaagtcgtaaccagcgctggggagccgtcagagccgctgaaagcttgactgctatccccgagccagcaagccctcagctcctggaaacgcccatacacgccagccaaattcagaaggtggagccagcaggcagaagcagatttacacctgaactgcagcctaaagcgtctcaatcgcgtaaacgatccctggctaccatggatagcccgccccaccaaaagcagcctcagaggggagaagtttcccaaaaaactgtgattatcaaggaggaggaagaggatacggcagagaagcccggcaaagaagaggatgtcgtgacgcctaagcctggcaagcggaagcgggaccaggccgaggaagagcccaaccggatcccaagcaggtcgcttcgcaggactaagctgaatcaggagtctaccgccccaaaggtcttgtttacaggcgtcgttgatgctaggggtgaaagagccgtactcgccctgggtggtagcttggctgggtcggcagccgaggcctcacatttggtcacggacaggattcggaggacggtgaagttcctctgcgccctgggccgcggaatccccattctctcactcgattggcttcatcagtcgaggaaagccgggttctttctcccccccgacgagtacgtcgtcacagaccctgaacaggagaaaaattttggattctccctgcaggatgcgctctctagagcgagagaaagacgactgctagagggctacgaaatatacgtgactccaggtgtgcaacccccccctccccagatgggcgaaattatttcatgctgcggtggtacatatttacctagcatgccacggtcttacaagccacagcgcgtcgttataacctgcccccaggattttccccactgttctattccccttcgagtcggcctacctcttctcagccctgagtttcttctgaccggggtcctgaaacaagaggcaaaacccgaagcattcgtgcttagccctctcgagatgtctagtacatag

SEQ ID NO: 123714 - DNA, 342 bp, Artificial Sequence
  Description of Artificial Sequence: Synthetic coding sequence
atggaggatacccaagcgatcgactgggacgtcgaagaagaggaggaaacagagcagtcctcagagtccctgcggtgcaacgtcgagcctgtaggcaggcttcacatatttagtggcgcccacggtccagagaaagacttccccttgcatctgggcaagaacgtcgttggaaggatgcctgactgcagcgtggctctcccctttccttccatttctaagcagcatgccgagatcgagattctcgcctgggacaaggcaccgatcctgcgagactgcggctcattgaacggaacccagatacttcgccctcctaaggtcctcagccccggggtctcgcactag

SEQ ID NO: 123715 - DNA, 6270 bp, Artificial Sequence
  Description of Artificial Sequence: Synthetic coding sequence
atggaagacacccaagccatcgattgggatgtggaagaggaagaagaaactgagcagtcttcagagtccctgaggtgtaatgttgagccggtgggtcgcctgcatattttttccggggcccacggccccgagaaagattttccactacaccttggcaagaatgtggtgggccgtatgcccgactgcagtgtggctctgccatttccttccatcagcaagcagcatgcagaaatcgaaattctggcatgggacaaggctcccattttaagagattgcgggagcctgaatggcacgcaaatcctgaggcccccgaaggtgctatctccaggcgtgtcgcaccgacttcgcgaccaggagcttatcctctttgcagatctactgtgtcagtatcaccgcctggatgtatcattacccttcgtctctcgaggtcctctgactgtcgaggaaactccacgtgttcagggggagacccagccgcagcgtttgctgcttgccgaggacagcgaggaagaagttgacttcttgagcgagcggcggatggttaagaaaagccgtactacgtcctccagcgttattgttcctgagtcagatgaagagggacattcgcctgtgttaggtggcttgggcccacccttcgcctttaatcttaattctgatactgacgtggaagaaggacagcaacctgcaaccgaagaagcaagctcagccgcccgtaggggagcaaccgtcgaagcaaaacagtccgaagcagaggtggtgactgagattcagctggagaaggaccagcctctggtcaaggagcgggacaacgacactaaagtgaaaaggggagccggtaacggagtagtccccgccggcgtaattcttgagagaagtcaaccaccaggcgaagacagcgacaccgatgtcgacgacgacagcagaccccccggcaggcccgctgaggtccacctggaacgagcccagccctttggcttcatcgattctgataccgacgcagaggaggagcggattcctgcaacccctgtagtcatcccaatgaaaaaaagaaagatcttccatggtgtgggtacccgaggtcctggtgcacctggactagcccacttacaggagtctcaggctggtagtgataccgatgtggaagagggcaaagcacctcaggcagtacctctcgagaagtcgcaggcatcaatggtaattaatagcgacaccgatgacgaagaagaggtctcagcagccctgacactcgcacaccttaaagagagtcagccagctatctggaaccgggatgccgaagaagatatgccacaaagagtggttcttcttcagcgatcacagaccacaaccgagcgggattcagacaccgatgtcgaagaagaggagctcccggtcgagaacagagaggccgtgctgaaagatcacacgaaaattcgggcactggtgcgtgctcacagcgaaaaagatcagccccccttcggggacagcgacgattctgtagaagcagacaagagcagccctggaatccatttggagcgcagtcaggcgtctaccacagtggatattaatactcaagtagaaaaggaagtcccaccgggatcagcaattattcacatcaaaaagcaccaggtcagcgtggaaggcactaaccaaacagacgtgaaagccgtgggtggacccgctaaactcctggttgtgagccttgaagaagcatggccactacatggtgattgcgagaccgacgccgaagaaggtacttcactgacagcgtccgtagtggcagacgtgcgtaagtcccagcttccggccgaaggggatgctggggccgaatgggcagccgccgtgctgaaacaggagcgcgcacacgaggtgggagcccaggggggccctcccgtggcacaggtggagcaggaccttcccatctcgcgtgagaatctgacagatctggtcgtggacacagacactttaggtgagagtactcagcctcagagggagggcgctcaggtccccactggacgggaacgggagcagcacgttggggggacaaaagactccgaggataactacggagactctgaagatctggatctgcaggcaacacaatgctttttagaaaaccagggactcgaagctgtgcaaagcatggaggatgaacccacccaggcttttatgttaaccccacctcaggagttgggccccagccactgttcattccagaccaccgggacgctggatgagccgtgggaggtgctcgcaacacaacccttctgtttgcgggaaagcgaggattccgagacccaaccttttgatacccacctcgaggcctatgggccttgcctctcccccccccgggccatcccaggtgatcaacaccccgaatcccccgtgcatacagaacctatgggaatccagggaagaggacgtcagaccgtggataaggtcatggggatcccaaaggaaactgccgagcgagtggggccagaacggggccctctcgagcgtgagacagaaaaactgctgccagaacgccagacagatgtgacaggagaagaagaactgacaaaggggaagcaggacagagagcaaaagcagctgctggcacgggatacccagagacaggagtctgacaaaaacggggaatctgcctccccagagcgcgatcgggaaagtttaaaggtagaaatcgagacctcagaggagattcaggaaaagcaagtgcaaaagcaaacactgccaagtaaagctttcgagcgggaggttgagaggccagtggccaatcgcgagtgcgacccagcagagctggaggagaaagtgccaaaagtcatccttgagagggacactcagagaggtgagccagagggcggcagtcaggaccagaaagggcaagccagcagtcccactccagaacctggcgtgggggccggggacctgccaggcccgacttcagctcccgtgccaagtgggagccagtctggcggccggggctctccagtttctccgcgacgtcaccagaaaggactgttaaactgcaagatgccgcctgcagagaaggcatccagaattcgcgcggctgagaaggttagtcgtggcgatcaagagagccccgacgcatgtctgcctccgaccgtacccgaagcccctgcaccccctcagaagcccctcaattcgcagagtcagaaacatctcgccccacccccattactgagccccttattaccttctatcaagcccaccgttaggaagaccaggcaggatggcagtcaagaagcccccgaggcgcccctgagctccgagctggagcctttccatcctaaaccaaagattagaactcggaaaagttcgagaatgacaccattccccgctacctcagcagcccccgagcctcaccccagtacatctacagcccagcccgtgacacctaagccgacctctcaggccacgaggtcccgcactaaccgcagtagtgtaaagacccccgagccggtcgtcccaactgcccccgaactgcaaccctcaacctctacagatcagcccgtcacatccgaacctaccagtcaggtgacaaggggaaggaagagccgcagttcagttaaaacacccgaaaccgtcgtgccaactgcacttgaactgcaaccctctacgtcgactgatagaccagttacctcagagccgaccagtcaggccacacggggcaggaagaatcgcagttcggttaagacccctgagccggtggtcccaaccgcccctgaacttcagccatccacaagtaccgaccaacctgtgacatctgagccaacctaccaagcaacacgaggacggaaaaatcgaagcagtgtgaagactccagagcccgtcgtgcccacagcgccagagctgaggccatctacttctactgaccgccctgtgacacctaaacctaccagtcgaactacgcggtcccgtactaacatgtcctcagtgaaaacccccgagaccgtcgtgcctaccgccccagagctgcagattagtaccagcacagatcagccagtgactccaaagcctaccagcaggaccacccgctctaggaccaacatgagttcagtgaaaaatcccgaatcaaccgtgccaatcgctcccgaactccctccaagcacctcaacagagcagcccgtgacgcctgagccaaccagccgtgctacgcggggcaggaaaaatcgtagcagcggaaagacacccgaaacccttgtgccaaccgctcctaaactcgagccctccacaagtaccgatcagccagtaactccagagccaacatcccaggctactcggggccgcaccaatcgatcctcagtgaaaactccagaaacagtggtgcccaccgcgccagaactgcagccttccactagtaccgaccaacccgtgacgcctgaaccaacctcccaggccacacgaggtcggactgatcggtcctcggtgaaaacacctgagacagtggtcccaaccgcccccgaactgcaagctagcgctagtaccgatcaacccgttacgtccgaacccacttcaaggacgactcgcggccggaaaaaccggagctctgtaaagacgcccgagacagttgtccctgccgcccctgcattacagccgtcaacttctaccgaccaacctgtgacccctgagccaaccagtcgagccacaaggggaagaactaatcgatcgtcagtgaaaacaccagaaagtatagttcccatcgcaccagagctgcagccttccacttccagaaaccaactggtcacgcccgagccaaccagccgcgccacccgctgcagaactaatcgtagctccgtgaagaccccagaacccgtagttccaactgcccctgagcctcaccctactacttcaaccgaccaacctgtgacgccgaaactgacttctcgcgcaacgcggcggaagaccaatcgcagcagcgttaagactccaaaaccggtggagcccgcagcctctgacctggaaccattcactcccacggaccaatctgtaacaccggaggccattgcccagggtggacagtctaagaccctgcgctcttctacagtccgggcaatgcccgtccccaccacccctgagtttcagagcccagttaccactgatcagccaatcagccctgagcctattactcagccgagctgtataaagcgtcaacgggctgctggaaatcctggctccctcgctgcaccaatcgatcacaagccctgctccgcccccttggagcccaaaagtcaggcctctagaaaccagcggtggggagccgttcgggccgcagaaagcctcaccgccatccccgagccggcttccccccaactgctcgagactccaattcatgcatcccagattcagaaggtggaacctgcgggacgctcacgatttaccccagaactccagcccaaggcgtcacagagcaggaagaggagcctcgctaccatggactcccctcctcatcagaagcagccccagcgcggcgaagtttcacagaaaactgttataattaaggaggaagaagaggatacagccgaaaagcccgggaaagaggaagatgtggtcacacccaagcccggaaagcggaaacgagaccaagcagaggaggagccaaaccgcataccgtcccgctcattgcggcggacaaaacttaatcaagaaagcaccgcccccaaagttctgtttacaggagttgtggacgcgaggggtgagagggccgtgcttgctctggggggcagcctggcaggaagcgctgccgaagcctcccacctggtaaccgaccgtattcgaagaacagtcaagttcctgtgtgccctaggcagaggaatccctattctttcactggactggttacatcaaagtcggaaggccgggttcttccttcccccagacgaatacgttgttaccgacccggagcaggaaaagaatttcggtttctctcttcaagatgctttgagcagggctagggaacgcaggctcctagaaggctatgagatttatgtgacacctggagtgcagcctcccccccctcagatgggtgagatcataagctgctgcggcggaacatatctccccagcatgcctaggagctataaaccccaacgtgttgtgataacctgtccacaagatttccctcactgttccattccactgcgcgtcggactgccacttctgtctccagaattcctgcttacaggagtcctcaagcaggaggcgaagcccgaggcattcgtcctctcccccctggagatgtcctccacatag

SEQ ID NO: 123716 - DNA, 738 bp, Artificial Sequence
  Description of Artificial Sequence: Synthetic coding sequence
atggaggacactcaggctattgattgggacgtggaagaggaagaagagacagaacaaagttcagaaagcctgcgctgcaacgtcgagccagttggccggcttcacatctttagcggcgctcatggcccagagaaagacttccccctgcatctgggcaaaaatgtggttgggcgcatgcctgactgttccgttgccctgccgtttccctcgatttctaagcaacatgccgagatcgagatcctggcctgggacaaggctccaatcctgagggactgtggatctctcaacgggacgcagatcttgaggccccccaaggtcctgtcacctggggtgagtcatcggctgagagaccaggagctcatcttattcgcagacctgctgtgccaatatcaccgcctggacgttagcttaccttttgttagcagaggacccctgacggtggaagaaaccccccgagttcaaggggagacacagccccagagactgctgctagctgaggattcggaggaagaggtcgatttcctgagcgagagacgcatggtaaagaagagccggaccacaagctcatcagtgatcgttccggagtctgacgaagaagggcatagccccgtcctgggtgggctaggaccaccttttgctttcaacttgaactccgacaccgacgtcgaggagggccagcaaccagccaccgaagaggcatcaagcgcggctagacggggagccacggtcgaagcgtag

SEQ ID NO: 123717 - DNA, 342 bp, Artificial Sequence
  Description of Artificial Sequence: Synthetic coding sequence
atggaggacacccaagccatcgactgggacgtcgaggaagaggaggagactgagcaatccagtgagtcgctaagatgcaacgtggaaccggtaggcaggctccatatttttagtggcgcgcacggtcccgaaaaagattttcccttgcacctgggcaagaatgtggtcggccgcatgccagattgctcagttgctctgcccttcccctcaatcagcaagcagcatgcagagatcgaaatactggcctgggataaagctccgatcctcagagattgtggctccctgaatggcactcagatcctccggccccccaaagttctgtcacctggggtttcgcattag

SEQ ID NO: 123718 - DNA, 384 bp, Artificial Sequence
  Description of Artificial Sequence: Synthetic coding sequence
atggaggacactcaggccatagattgggatgtggaggaggaggaagaaacagagcaatcctctgagtctttgcgatgcaatgtggagcccgtgggaaggctgcacatcttcagcggggctcatgggccagaaaaggacttcccactccacttggggaagaacgtggtcggtagaatgcccgactgtagcgttgccctgccttttccctctatatcgaaacagcacgccgaaattgaaatcctggcttgggacaaggcccccattcttcgcgactgtggctccctgaatggtacacagatactcagaccgcccaaagtgttgagcccgggcgtcagccatagactccgtgaccaggagttgatccttttcgccgatttactgtag

SEQ ID NO: 123719 - DNA, 6270 bp, Artificial Sequence
  Description of Artificial Sequence: Synthetic coding sequence
atggaggacacccaagctatcgattgggacgtcgaagaagaagaagaaaccgagcagtcttccgaatcccttcgatgtaacgtggaaccagtcggccggttgcacatcttctctggagcccacgggccagagaaggactttcctctccatttggggaaaaacgttgtcggaaggatgcccgactgtagcgtggcactaccttttcccagcatttccaaacaacacgccgaaatagagatcctggcctgggataaggcccccatcctccgagactgtggatccctcaacggcacccaaatcctccgtccacccaaagtactgtctcctggagtgagccatcggctgcgcgatcaggagctgatcctgtttgctgatctactatgccagtatcaccggctggacgtgagcctgccatttgtcagcagaggacctcttacagtggaggagacacctagggtgcagggcgagacacagccgcagaggctcctgctggccgaggattctgaggaggaagtggactttctgagtgagcgcaggatggtgaagaagtcccgaacaactagctcttctgtcatcgtgccagaaagcgacgaagaaggtcactctcctgtccttgggggtctcggccctccctttgcattcaatctcaactctgacacagacgtggaggagggtcaacaacccgctacagaggaagccagctcagcggcccggcgtggggcaaccgtagaggccaaacagagcgaggccgaggtggtgaccgagattcagctggagaaggatcagcctctggtgaaagaaagagataacgatacaaaggtgaagcgcggagctggcaacggagtggtccccgcgggggtgatccttgagaggtctcagcctccaggagaggatagcgataccgacgtggacgacgactctcgcccaccaggcaggccagctgaggtgcacctggagcgggcccagccattcgggtttatcgactctgacacagacgctgaggaagagcggatccctgcgacacccgttgtaatcccaatgaagaaacgcaagatttttcacggagttggcaccaggggccccggggcacccgggctcgcgcaccttcaggaatcccaggcagggtccgacacggacgtcgaagaaggtaaagccccccaggccgtgcctctggagaagagtcaggcttccatggtgatcaactccgataccgacgatgaagaagaggtctccgccgctcttacgctggcccacctgaaggagtctcagccagctatctggaatcgggacgccgaggaagacatgccccaaagagtggtcctgctgcagcggtcacagaccactacagaacgagatagtgacactgatgttgaggaggaagagctccctgtggagaacagggaggccgtgttgaaggatcacaccaagatacgggcgctggtacgcgctcactccgaaaaagatcagcctccatttggcgacagcgacgacagtgtcgaggccgataagtcatctccaggcattcacttagagcgcagccaggcttctaccactgtggacattaacacgcaggtggagaaggaggtgcccccagggtcagccatcattcacatcaagaagcatcaggtgtcagtggaaggcaccaaccaaactgacgtcaaggccgtgggcgggcctgccaagttgctggttgtcagtctcgaagaggcctggccactgcacggggattgtgagacggacgccgaggaggggactagtctaactgcatccgtggttgcagatgttagaaaatcccagctgcctgctgaaggtgacgctggtgcagagtgggctgctgctgtgctgaaacaggagcgggcacacgaggttggcgcccagggcggtccaccagtggcacaagtcgaacaggacctgccaatatctcgcgaaaacctaactgatttagtcgtggacaccgatactctcggcgagagtacacaacctcaaagggaaggcgctcaggtacccactggcagggagagggagcagcacgttgggggaactaaagacagcgaggacaactatggtgactctgaagatcttgatctccaggctacacagtgctttttagagaaccagggccttgaggctgtccagagcatggaggacgaacctacccaggctttcatgctgacaccccctcaggaactagggccttcccactgtagtttccagacgacgggaacactcgatgagccatgggaagtcctggctacacagcctttctgccttagggagtccgaggattctgaaacccagccgtttgatacacacctggaagcctacggcccctgtctgagtccaccgcgagccatccccggagaccagcaccctgaatccccggtgcacactgaacccatgggcattcaaggccgcggtaggcaaacagtcgataaagtaatgggcatccctaaagagactgcagaaagagtgggaccagagcgaggcccgttggagcgtgaaaccgaaaagctgctgccggagaggcagacagacgtgaccggggaggaggaattgacaaaagggaaacaggacagggagcagaagcagttgctcgctagggatacacagcgacaagagtctgacaaaaatggcgagtctgctagccctgagagggacagagagagcctgaaagtggagattgagactagcgaggagatacaggagaaacaggtgcaaaagcagactctgcctagtaaggcctttgagcgcgaggtggaaaggcctgtggccaatcgggaatgtgatcctgccgagttggaagagaaagtgccaaaggtgatcctggaaagggatacccagaggggtgagcccgaagggggttcccaggaccaaaaaggacaagcttcttctcctacacctgaaccgggcgtcggcgccggtgacctgccagggcctaccagtgcaccagtaccgtcagggtcacagtccggcgggagagggagccctgtctccccccgaagacatcagaagggcttgctcaattgtaaaatgcctccagccgagaaagcttccagaattagagctgcagagaaggtatcccggggcgatcaggagtccccggacgcctgcctgcctccgaccgtgccagaggcacctgccccccctcagaaacctcttaatagccaaagccagaagcaccttgcaccacctccactcctctcaccgctgctgccatctataaaacccaccgtgcgaaagacaagacaggatggaagccaagaggcaccagaagcccccttgtcgagcgagctggagccattccatcctaagccaaagattcgcactcgaaaatcgtcccgaatgacaccctttcccgccacttctgcggctcctgaaccacacccctctacctccactgcccaacccgtcacccctaagccaacgagccaggcaacgaggagcagaaccaaccgttcatcagttaagacaccagaacctgtcgtgcctaccgcccctgagctgcagccttctacgagcacagatcagcctgtgacgtccgaacccacgtcgcaggtgacacgcggacgtaaatcacgcagctctgtgaaaactcccgagacggtggtgcccacagccttggaactgcagccgtcaacttcaactgataggccagtgaccagcgagcccacgagccaggctactcggggcagaaagaataggagtagtgtgaaaacccctgagccagtggtccccactgcaccggaactgcagccatcgacaagcaccgaccaacccgtaacatccgagcctacatatcaggcaacacggggaagaaaaaacaggagctcagtgaagactccggaacccgttgtgcccacagccccagagctgcgcccgtcaacatccaccgacagacctgtgacccctaagccgacatcacgcaccacacggagtcgaacaaacatgtcaagcgtgaaaacccccgagaccgtggtgcccaccgcacctgaattgcagatctctacttccactgaccagcctgtgacccctaagcctactagtagaactacacggtcccgaacaaatatgagttcagtgaaaaaccctgagagtactgtacccatcgctccagaattaccaccctccacctcaacagagcagcctgtcacccccgagcccacgtccagggccactagaggtcgcaagaataggtccagcggcaaaacaccagaaacgctggtcccaacggcaccgaagctggaaccgagcacttctacggatcagccagtcacacctgagccaacctcacaagccaccaggggaagaaccaatcgctcctccgttaagactcccgagactgtcgttccgacagcacctgaattgcagccttcgacttccaccgaccagccagtgaccccggaaccaacctcacaagccacacgcggaagaacagaccggtctagcgtgaaaaccccagaaaccgtcgtgcctaccgctcccgagcttcaggcgagcgcgtccactgaccagcctgtcacctcagaaccaaccagcaggactactcgaggccgcaagaacaggtcttccgtcaaaacgcccgagactgtggtgcctgccgcacccgagttacagccaagtacctctaccgatcagcctgttactcctgaaccgaccagtagggctacgagggggaggacgaatcgaagttcagtaaagactccagagtcaattgtccccattgcaccggagttgcaaccttctacaagccgtaatcaactggtaacacccgagccaacctccagagccactcggtgcaggacgaaccgctcctccgtaaagactcctgagccagttgtgcccaccgccccagaaccccacccaaccacttccacagatcaaccggtgacccccaagctcactagccgggcaactaggcgaaagaccaatcgatccagcgtaaaaacacctaagccggtggagccagcggccagcgacctggaacccttcaccccgaccgaccagtcagtcacccctgaagctattgctcagggtggacagagtaagacgctgcggagttctactgttagggccatgcctgtgcccaccactcctgagttccagtcacccgtcaccacggatcagccaatttccccggaacctattacacaacccagttgtatcaagcgccagcgtgccgccggcaatccaggcagcctggcagcacctattgaccacaagccatgctccgcccccctcgagccaaaatcccaggcaagcaggaaccagcgttggggcgcggtcagggccgccgagagccttacggctattcctgagccagctagccctcaattgttagagactcccattcacgcttcccaaattcagaaagtcgaacccgccgggcgcagccgatttacccctgaacttcagccaaaggcgtcgcaaagccgaaagcgctctctcgccactatggatagcccacctcatcaaaaacaacctcagcgcggtgaggtgtcccaaaagaccgttatcattaaggaagaagaggaggataccgcggagaagccaggcaaggaagaggacgtggtgacacccaagcccggcaagcgaaaacgagaccaggctgaagaggaacctaaccgaattccaagccgctcactgaggcggacaaagctcaaccaagaatctaccgctcccaaggttctgtttacaggagtagtggacgcgcgcggggagcgagccgtattagccctgggcgggtctctagctgggagtgccgccgaggcttctcacttggtgactgatcggattcgacggacggttaagttcctttgtgcgcttggccggggcatccccatcctcagcctggactggctgcaccagtcccgaaaagcaggtttcttcctgccacctgatgagtacgtggtgactgatcctgagcaggagaaaaactttggcttcagcctccaggacgcattgtcccgcgccagagagagacgtcttctggaaggatacgagatttacgtgactccgggtgtgcaaccaccaccgcctcagatgggggaaattataagctgttgtggagggacttacctgccttccatgcctcggtcctataaaccacaacgtgtggtgattacgtgtcctcaggacttcccacactgctcaattcctctgcgcgtagggttaccccttctgtcgcccgagtttctgctgactggtgtcctgaagcaggaagctaagccagaggctttcgtgctatccccactagagatgagctccacttag

SEQ ID NO: 123720 - DNA, 489 bp, Artificial Sequence
  Description of Artificial Sequence: Synthetic coding sequence
atggaggatacccaggctatcgattgggatgttgaagaagaggaggaaacagagcagtctagtgaaagccttaggtgcaatgtcgaacccgtgggtcgactgcacattttctctggggcccacggtcctgaaaaggatttcccactccatctgggaaagaacgtggtcgggaggatgcccgattgctccgtcgcacttcctttcccatccattagcaaacagcatgccgagattgagatacttgcttgggacaaagcccctattctaagagactgcggcagccttaacggcactcaaatccttaggccccctaaggtcttaagtccgggagtttcccacaggctgcgagatcaagaactgattctgtttgcggatttgctctgccagtaccatcgcttagatgtgtcactcccatttgtatccagaggacctctgaccgtagaagagaccccacgcgtgcagggtgagactcagccccagcgactgtag

SEQ ID NO: 123721 - DNA, 921 bp, Artificial Sequence
  Description of Artificial Sequence: Synthetic coding sequence
tagcacgtcggcggcactaaggattctgaagataactacggcgactccgaggatctagatttacaggcaacgcagtgcttcctagagaaccagggcttggaagctgttcagagtatggaggacgagcctactcaggcgtttatgcttactcctccacaagagctcgggccaagtcactgcagttttcagactactgggctcctcaattgcaagatgcccccagcggaaaaggcgagtcgtatcagggccgctgaaaaagtgtcaagaggggatcaggagtcaccggatgcctgtcttccccctacagtgcctgaggcacccgccccgcctcagaaaccgcttaattcccagtcccagaaacatctggctcccccgccactcctgtctcccttgttgccatctatcaagcccacggtacggaaaacacgccaggatggttcacaggaggcccccgaggctccactgagcagtgaactggaaccgttccacccaaaaccaaagataaggaccagaaagtcatcaaggatgaccccctttcctgcaacctccgccgcccccgaaccacatccgagcacatctactgcccaaccggtgacccctaaacctacgtctcaggctacaagatctagaaccaatcgcagtagcgtgaagaccccagaacctgttgtccctacagcgcctgagttacaaccatcaactagcactgatcagccggtgacttcggagcccactagccaggtcactcgtggacgaaagagccgaagctccgtcaaaacccctgagacagtggtaccgacagcactggagctccagccatccacctcaactgacaggcctgtaacaagcgagcccacatcacaggctacccggggaaggaagaatagaagtagcgttaagacccctgagccagttgtaccgtag

SEQ ID NO: 123722 - DNA, 921 bp, Artificial Sequence
  Description of Artificial Sequence: Synthetic coding sequence
tgacatgtaggaggcactaaggactccgaagacaattacggagactctgaagacctggatctgcaagcgacacagtgtttcttggaaaaccagggtctcgaggccgttcagtcgatggaggacgaacccactcaagccttcatgctgacaccccctcaagaactgggacctagtcactgctctttccagacaaccggacttttgaactgtaagatgcctcccgccgagaaggccagccgcattagagcagccgagaaggttagccgaggcgaccaggagtcccctgacgcctgcctccctcccacagtaccagaggcgccagcaccccctcagaagcctttgaacagccaatcacagaagcacttggcgccgcctccccttctctcaccccttctgccttccatcaagccaactgtcaggaaaactagacaagacgggagtcaggaggcccctgaggctccactgagctctgagttggaaccattccaccccaagccaaaaattagaaccaggaaatcttcccggatgacccctttcccagctaccagcgctgcccccgaaccgcacccatcgacttctacggcgcagccagtaacccctaagccaacctcccaggcaactagaagtcgtacaaacagatcttctgtgaaaactcctgagcctgtggtcccaaccgccccagaactgcagccttcaacatcaaccgatcagcccgtgacaagcgagcctacttctcaggtgacacggggcaggaagagtagatcatccgtgaagacacccgagaccgttgttcccacggccctcgagctgcagccaagcacttcaaccgatagacccgtaacatcagagcctacaagccaagccactcgggggcgcaaaaatcgcagctctgttaagacacctgaacctgtcgtcccatag

SEQ ID NO: 123723 - DNA, 384 bp, Artificial Sequence
  Description of Artificial Sequence: Synthetic coding sequence
atggaagacacccaggccatcgattgggacgtcgaagaggaggaggagaccgagcaaagctccgagagtctgaggtgcaacgtagagcccgtgggcagactccacatatttagcggggcccatggcccggagaaggactttcctctgcacctgggcaaaaatgtagttggaaggatgcccgattgctccgtcgctctgcccttcccgagcattagcaagcagcatgccgaaatagagatcctcgcctgggacaaggctcccattctccgagattgcggaagccttaacggtacacaaatactgcgtcccccaaaggttctctcgccaggggtgagccacagactgagggaccaggagctcattctgtttgcggacctgctctag

SEQ ID NO: 123724 - DNA, 921 bp, Artificial Sequence
  Description of Artificial Sequence: Synthetic coding sequence
tagcacgttggtgggaccaaggactcagaggataattatggcgattccgaagacctggatctccaggctacccagtgcttcctggaaaaccagggcctggaggccgtacagtctatggaggacgagccgacccaagctttcatgctgactccccctcaggagctcggacccagtcattgttcattccagactacgggccttctgaactgcaagatgcccccagcagaaaaagcctcacgaattcgcgcagccgaaaaggtttctcggggtgaccaggaatcaccagacgcttgtctccctcctaccgttccggaggcccctgccccgccacagaagcctctgaactcccagagccaaaaacatctggctccccctccgctgttatccccattgcttccatctatcaaaccaacagtgcggaaaactcggcaggatggcagccaggaggcgcctgaggcccctctgtcctcagagcttgaacccttccaccctaaaccaaagattcgaacaaggaaatcctctagaatgacacccttcccagccacctccgcggctcccgagccccacccgagtacatctacagctcagccggtaacccctaagcctaccagtcaggctacacggtctaggaccaacagatccagcgtaaagacgccagaacccgtcgtgcccaccgcccctgaacttcagcccagtacttcaaccgatcaaccagttacatctgaaccaacatctcaggtgacccgcggccgcaagtctagaagtagcgtcaaaacaccagaaactgtggtgccaaccgccctggaacttcagccgagcacatcaacggatcgcccagtgacctctgagccgacatctcaggccaccaggggcaggaagaacaggtcatctgttaagacccccgaacctgttgttccttag

SEQ ID NO: 123725 - DNA, 489 bp, Artificial Sequence
  Description of Artificial Sequence: Synthetic coding sequence
atggaagacacgcaagccattgactgggatgtagaagaggaggaggagacggagcagtcttctgagagtctgaggtgtaatgtggaacccgttggccgcctgcacatcttctctggcgcccatggcccagaaaaagacttcccacttcacctgggcaaaaatgttgtcggaagaatgccagactgcagtgttgcactccccttcccgtccatatcaaagcaacacgctgagatcgagattttggcctgggacaaggcaccaatattacgggattgtgggtctctaaatggcacccaaattctgcgccccccaaaagtattgtccccaggcgtgtcccatcgactgagagaccaggagttaatcctcttcgcagacctgctgtgtcagtaccaccgtctcgacgtgagcttgccttttgtctcccggggtcccctcaccgtggaagaaacgccaagagttcagggagagacgcagccacagcgcctgtag

SEQ ID NO: 123726 - DNA, 6270 bp, Artificial Sequence
  Description of Artificial Sequence: Synthetic coding sequence
atggaagatacacaggcaatcgattgggatgtggaagaagaggaggaaacagaacagtcatctgaaagtcttcgatgtaatgtggagcctgtgggcagacttcatattttcagtggggcccacggacccgaaaaagatttcccactacaccttgggaagaacgtggtcggcagaatgccagattgttctgtggccctgccgttcccaagtatttccaaacagcacgctgaaatagagatcttggcatgggataaggcaccgatactgcgtgactgcggttctcttaatggtacacaaatcctgagacccccaaaggtgctgtctcctggcgtcagtcacaggctaagggatcaggaattgatccttttcgccgacctcctgtgccagtatcacagactggatgtgtcacttcctttcgtgagccgcgggcccctcaccgttgaagagactcctagagtgcagggcgaaacacagccccagcggttgctgttggcagaggattccgaggaggaggttgatttcctgagcgagcgcagaatggttaagaagagtcggacgacatccagctcagttattgtgcctgaaagtgatgaggagggccattcaccggtcttaggtgggctggggccacctttcgccttcaacctcaattccgatacggacgtcgaagaaggccagcagcccgcaacggaagaagcttcatccgccgccagaagaggggccaccgtggaggctaagcagtcggaagccgaggtggtgacagagattcagctcgagaaagaccagccccttgtcaaggagagggacaacgatacaaaagttaaacggggggctggtaacggtgtcgtgcctgctggcgtgatcttggagaggtctcagccccctggtgaggattccgataccgatgtggacgacgattcaagacctcccgggagaccagctgaggtgcacttggagagagcccagccttttggatttatcgactccgacactgatgcggaggaggagaggattcctgcaacccccgtggtcatccccatgaaaaaaagaaaaatctttcacggggtagggacgcggggccccggcgcacctgggctggctcaccttcaggagtcacaagcaggttcagacaccgatgttgaggaggggaaagcaccccaggcagtgcctctggaaaagtctcaagccagtatggttatcaattctgacacagacgatgaagaagaagtcagtgcagctctaaccctcgctcatctgaaggaaagtcagcccgcaatttggaaccgcgacgccgaggaagatatgccacagcgagtcgtgctgctgcagcgctcacagaccaccacagagcgcgacagcgacaccgatgttgaggaagaggagctgcctgtcgagaatcgtgaggcagttctgaaggatcataccaagataagagctctcgtccgcgcccattccgagaaagaccaacctccatttggcgacagtgatgacagcgtagaggctgataaaagctctcctgggatccaccttgaacggagccaagcttccaccactgtggacatcaatacccaagttgagaaggaggtgccccccggcagtgccataatccacatcaaaaagcatcaggtgtcagttgagggaaccaaccagacggacgttaaggccgttggaggtcctgcaaaactcctcgttgtgtctctggaagaggcctggcccctgcatggcgattgcgaaacagacgcggaggagggcacgagtctgacagcttctgtagtagcggacgtgcggaagtctcagttgcccgccgagggcgacgctggggcggagtgggctgccgctgttctgaaacaggagcgtgcacatgaagtgggtgctcaggggggcccacctgttgcccaggtggagcaggacctgccaatctcccgcgagaatctgactgatctggtggtggataccgatacgttaggcgagtctacccagccacagagggaaggcgcccaggtgccaacaggacgcgagagagagcagcacgttggcggaactaaggactctgaggacaactacggggacagcgaagacctggacctccaggcaacgcagtgcttcctggaaaatcaggggcttgaggccgtgcagagtatggaagatgagcccacccaggcttttatgctaactccacctcaggaactgggcccctcacactgcagctttcagacaacaggcacccttgatgaaccctgggaagttctcgcaacacagcccttctgtctgcgcgagtctgaagattccgagacccaacccttcgacacccacctcgaagcatacggaccctgtctcagcccccccagggctatcccgggtgatcagcaccctgagagccctgtgcatactgagcccatgggcatccaaggccggggccggcagacagtggacaaagtgatgggcataccgaaagagacggcggaacgggtcgggcctgagcgaggtcccctcgagcgtgaaactgaaaaacttctgcctgagcgccagactgacgtgactggcgaggaagagctgactaagggaaaacaggaccgcgaacagaaacaacttctcgccagggacacacaacggcaggagtccgataagaacggcgagtcggcctctcccgaacgggaccgtgaatcgctgaaggttgagattgagacgagcgaggaaatccaggaaaagcaggttcaaaaacagacactcccatccaaggcctttgaacgcgaggttgagaggccagtggcaaatagggaatgtgacccagctgaactcgaagagaaggtgcccaaggtgatcctcgaaagggatacgcagcgtggagaacccgaaggaggatctcaagatcagaaggggcaggcttccagcccaacccctgagccaggcgttggggctggtgatctgcccggacctacaagtgcccccgtccccagtggcagccagtccgggggccgcgggagccctgtctctccacggcgccaccaaaaggggctgcttaactgtaaaatgccccctgctgagaaagccagtagaatcagagcagcagagaaggtgtcccggggcgatcaggaaagccctgacgcgtgtttgccccccacagtccctgaagccccagcccccccccagaagccattgaatagtcagagccaaaagcacctggctccgccccccttattgagtccactccttcccagcataaagcctaccgttcggaagaccagacaagatggaagccaggaggcaccagaggcaccactgtcttcagaattggaaccattccatcccaagcccaagataagaactcgaaaatcatcgagaatgaccccgttccccgcaacatctgcagccccagagccacatccttcaacctctacagctcagcctgttaccccaaagcctacttctcaagccacaaggagcagaacaaacagaagtagtgtcaagacccccgaaccagtggtccctacggcgccagagctccagccatccacaagcaccgaccagcccgttacatctgagccaacaagtcaagtgacccggggtcgcaagtcacgctcatctgtgaagacccctgagacggtggtgcctactgccctggagcttcagccatctacttctacggacaggccagtcacaagcgaaccgacctcccaggctacacgcggtcgtaagaaccgttcgtctgtgaagacccctgaacccgtggtgcctaccgcgcccgagttgcagccaagcacttccacagaccagcccgtcacctccgagcctacctaccaggctaccagaggcaggaaaaaccggtcctccgtgaagacccccgagccagtggttcctacagccccagagctgcgtccctcaaccagtacagatcggcctgtgaccccaaaacctaccagcagaaccacgcgcagcaggactaacatgtccagcgtgaagaccccggaaacagttgttcccacggctcccgagctccagatctctacatcaactgaccagcccgtgacaccaaagccaaccagtaggaccactcgctctagaacaaatatgtcttctgtgaagaacccggaatctacagtcccaatcgctccagagctcccaccctcaactagtacagagcagccagtgacaccagagcccaccagccgggcaactaggggccgcaagaataggtcctcaggaaagacacccgagacactggtgcctaccgctccaaagttggaacctagcactagcactgatcagcccgtgacacccgagcctacatcgcaggctaccaggggccgtacaaataggtctagtgtgaagacacccgaaactgtggtgccaaccgcccccgagctgcagccctcaacaagtaccgaccagcctgtcacacccgagccgacctctcaggctacccggggaaggacagatagatcttccgtcaaaactccggaaacagtggtgcctaccgctcctgaactccaagcctctgcttctaccgatcaacctgtgacgtcagaacctacatctagaactacccgtggaagaaaaaaccgaagttcagtgaaaacgccggaaaccgtggtacccgccgccccagagttgcagcccagcacctcaactgatcaaccggtcacacctgagccgacgtccagggccaccaggggacggaccaataggagttccgttaagactccagagagcatcgtccctattgcacctgaactgcagcccagtaccagtcggaaccagttagtgacaccagaacctacaagtcgtgcaacccggtgtaggaccaaccggtctagcgttaagaccccggaacctgtggtcccaacggctccggagccccatcctactactagcaccgaccagcctgtgacacctaagcttacttcaagagccactcgccggaagacaaacaggtctagcgtgaaaacaccaaagccagtggaaccagccgcaagtgatctggagcctttcactcctaccgaccaaagcgtaacccctgaggccattgcccagggaggccagagtaagacgctcaggagctcaacagtgcgcgccatgccagtacccactacccctgaattccagagcccagtcaccacagatcagcccatatcacctgagcctattacgcagccctcttgtatcaaaagacagcgcgctgcaggcaaccccggttctctcgcagcacccatcgaccacaagccgtgcagcgcccctctggaacccaaaagccaggcttcccgtaaccagcgctggggagcagtccgtgccgccgaaagcctgacagccattcccgaacccgcgagtccgcaactcctggaaaccccaatccacgccagccaaatccagaaggttgagcctgcggggaggagtaggtttacaccggagcttcagccaaaggctagtcaaagcaggaagcgctctctcgccactatggactctcccccacaccaaaagcaaccgcaacggggggaagttagccagaagacggttatcataaaggaagaggaagaagacacggccgagaagcccggcaaggaggaagatgtggtgaccccaaagcctggtaaacgcaagagagatcaggcggaggaggagcctaacagaatcccaagtcggagtctaaggcggactaaactcaaccaggagtctaccgcacccaaagttctctttactggcgtcgtcgacgctaggggggaacgagcggtactggcgttagggggatcactcgcgggctccgccgctgaggcctcccatctggtaaccgacagaatcagaagaaccgtaaagtttttgtgtgccctgggcagggggattcctatcctgagcctcgactggcttcaccagagccggaaggcaggtttctttttaccccccgacgaatatgtggtgacagatcccgagcaagagaaaaattttgggttttcattacaggatgccctatcacgtgccagagaacggcgacttctggaggggtatgagatctacgtaactccaggtgtgcaacctcccccaccccagatgggcgaaatcattagctgttgcggtgggacatatctgcctagcatgcccaggtcatacaaaccccagagggtagtcattacatgtcctcaggactttccccattgttcaatccctctgagagtgggacttccccttctgtcaccagaatttttgctcaccggggtgctgaaacaggaggcaaaaccggaggcttttgtgctttccccactcgagatgtcctccacctag

SEQ ID NO: 123727 - DNA, 735 bp, Artificial Sequence
  Description of Artificial Sequence: Synthetic coding sequence
atggaagatactcaggccatagactgggatgtggaagaagaagaggaaaccgaacagtcctctgaaagcctccgctgtaacgtggagccggtgggacgcctgcacatatttagtggcgcccacggccccgagaaagacttccccctccatttaggcaagaatgtggtgggaaggatgccagattgttctgtcgcattaccgttccccagtatctccaaacaacatgctgagatagaaatactggcatgggacaaagctcctattttaagagattgtgggtcccttaacggaacccagattcttaggcctcccaaagttcttagccccggtgtctctcacaggctcagggaccaggaactgattttatttgcggacttgttgtgtcagtatcaccgcctggacgttagtctaccctttgtgagcaggggacccctgacagtcgaagagacccccagggtccagggggagacacagccccagcgtctactcctcgccgaggattctgaggaggaagtagattttctttcggagaggaggatggtaaagaaaagcaggacaactagctctagcgttatcgtgccggaatctgatgaagaaggacactcccctgtgctcggaggcttgggcccgccctttgctttcaacctcaatagcgataccgatgtggaagaggggcagcaacctcacagaggggggctcctgtcctgtcagaagaggtgccattgtaggggttag

SEQ ID NO: 123728 - DNA, 384 bp, Artificial Sequence
  Description of Artificial Sequence: Synthetic coding sequence
atggaggacacccaggccattgactgggacgtggaggaagaagaagagacagagcaatcctccgagagcctgagatgcaacgtggagcctgtcggccggcttcacatcttttctggggctcacggaccagagaaggattttccactgcaccttggcaagaatgtagtcggacggatgcccgattgtagcgtggctctgccatttccatctatctctaaacaacacgctgaaattgagatactggcctgggataaggctcctattctgagagactgcgggtcactgaacggcactcagatcctcagaccccctaaggtactctcccccggcgtgtcccatcgtctgcgtgatcaggagcttatactcttcgctgacctgctgtag

SEQ ID NO: 123729 - DNA, 342 bp, Artificial Sequence
  Description of Artificial Sequence: Synthetic coding sequence
atggaggacacccaagctattgattgggatgtagaagaagaggaagaaacagaacagtcctctgaaagtctcaggtgcaatgtggagcccgtgggtcgtctgcatatattttccggtgcccacggacccgaaaaggattttccgctgcacttgggtaagaacgtcgtgggccggatgccggactgttctgtagccctgccattcccgagcattagcaagcagcacgctgagattgagatcctggcgtgggataaagctccaattcttcgggactgcggcagtctgaacggtactcagattttgaggcccccaaaggttctttcaccaggtgtgagccattag

SEQ ID NO: 123730 - DNA, 5409 bp, Artificial Sequence
  Description of Artificial Sequence: Synthetic coding sequence
atggaggatacacaggcaatagactgggatgtggaagaagaagaggagacagaacagtcgagcgagagcttgcgttgcaacgtcgagccagtgggcaggctccacattttttcaggcgcccatggtccggagaaagacttcccccttcacctggggaagaacgtcgtggggcgcatgcccgattgcagcgtggctctcccgttccccagcatttctaagcagcatgctgaaatagagatactggcatgggataaggctcccattctgcgggactgcggcagcctgaacggcacccagatcctgcgcccacctaaggtgcttagcccaggtgtgagtcaccgcttgcgagatcaggagctcatccttttcgctgatttactttgtcaatatcaccggcttgatgtgagcctccccttcgtctctaggggccctctgaccgtcgaggagacaccaagagttcagggagagacacagcctcagaggctgctcctggccgaggactcggaagaagaagtggatttcttgagtgagaggcgtatggtcaagaaaagcaggaccaccagttccagcgtaatcgtgcccgaatccgacgaagaaggccactcccccgtgctgggaggattggggcccccattcgcctttaatctgaattcggacaccgatgttgaggaggggcaacagcctgccactgaggaggcatcttcggctgcgcgtaggggcgcaaccgtcgaggccaaacagtctgaagctgaggttgtaacggagattcagctggaaaaggaccagccgctggtgaaggagcgcgataacgatacaaaagtcaagaggggcgccggaaacggtgtcgtgcctgcaggcgtgatcctggagcgctcacaacctcctggggaagactccgacacagacgtggacgacgactcacgccccccaggcaggcccgcggaggtccatctagaacgcgctcaaccattcggcttcatcgactccgacaccgacgccgaggaggagagaatacccgcaacaccagttgtgattcctatgaaaaagcggaagatatttcacggagtgggaacaagagggccaggtgcccctggattggcacatttgcaagagtctcaagcgggctcggatacagatgtcgaggaggggaaagcccctcaggccgttccacttgagaagtctcaggcgagcatggttattaacagcgatactgacgacgaggaagaggtgagcgctgccctgaccctagctcacctcaaggaatcccagcccgcaatttggaatagggacgctgaggaggatatgccgcagcgcgtggtgctcctccagaggagccagacaaccacggagcgggatagcgacacagacgtggaggaggaagaactgccggtggaaaatcgcgaggccgtactgaaggatcatactaagatccgcgccctcgtccgagctcatagcgagaaggaccaaccccctttcggcgacagtgatgacagcgtggaagctgataagtcatctcccggtatccacctggagcgatcccaggcctccaccactgtagatataaatacgcaggtggaaaaggaagtcccgcccggaagcgccatcatccacattaaaaaacatcaggtgtctgtagagggcactaaccagaccgatgtgaaagcggtcggcggtcctgccaaactgctcgttgtgagcctggaagaagcctggcctctgcatggagattgtgagaccgatgctgaggagggcacctctctgactgctagcgtcgtcgcagacgttcgtaagtcccagttgccagcagagggggacgctggggcagagtgggctgctgcagtccttaaacaggaacgcgctcacgaggtaggcgcacagggaggcccaccagtggcccaagtggaacaggatttacctatttctcgtgagaacttgaccgacctggtcgtggatacggacaccttgggcgagtctacacagccacagcgtgagggggcccaggtgcctactggaagggagagggagcaacacgtgggtgggaccaaggactcagaagataattatggagatagtgaggaccttgatctacaggccacacagtgttttctggagaaccagggcctcgaggcagtacagagcatggaggacgagccaactcaggcattcatgctgactcctcctcaggagctcggcccatcccactgttctttccagactaccggtactctggatgaaccctgggaagtgcttgcgacgcagccgttctgcttgagggagtccgaggacagcgaaacacagccattcgatactcacttagaagcctacgggccctgcctttcaccacctcgagccatcccaggcgatcagcaccccgaaagccctgtgcatactgagcctatgggcattcaaggtagaggaagacagaccgtagataaggtgatgggcattccgaaggaaacggccgagagagtgggtccggaacgtgggcctctcgaaagggaaaccgagaagctgctgcccgagagacagactgacgtgaccggcgaagaagaacttacaaagggtaaacaagatagggagcagaaacagttgctcgctagagacacccagcgccaggagtctgataaaaacggggaatccgcctccccagaaagggatcgagagagcttgaaggtggagatcgaaacctctgaggagattcaggaaaaacaggtccaaaagcagacattgccgtccaaggcttttgaacgtgaggtcgagagacctgtcgccaatagagagtgcgacccagccgaactcgaggaaaaagtgccaaaggtcatcctggaaagggacacccagcggggggagcccgagggcgggtctcaggaccagaaggggcaagcaagctcacccaccccagagccgggggtgggcgctggcgacctgccgggccctacaagtgccccggtcccatccggctcccagtctggaggacggggttctccagttagccccagacgtcatcagaaaggattactgaactgcaagatgccccctgcagagaaagcatctaggattagagcggcggagaaggtcagccgtggcgaccaggaatctcccgatgcttgccttcccccaaccgtgccagaagctcccgctccaccccaaaagccgctcaactctcagtcccagaagcacctcgccccaccacccctgctctccccactgctcccgtcgatcaaacctaccgtgcgcaaaacacggcaggacggttcacaggaggcacctgaagctcccctgtcctcagaattggaacctttccatcccaagcctaaaattagaacccgaaagtcctccaggatgacaccctttcctgcaacgtcagcggctccaaagttagagccatcaacctctacagaccagcccgtgacaccggaacctaccagtcaggccacgcggggacgtactaatagaagctctgtaaagacgccggagacagttgtcccaacagccccagaactacagccgagcacaagtaccgaccagcccgtgacaccagagcctacgagccaggcaacacgcggtcggacagacagatccagcgtaaaaaccccagaaactgtcgtgccgactgccccagagctccaggcatctgcaagcacagatcagccagtgacctcagaacccaccagccggaccaccagggggaggaagaatagaagtagcgtaaaaacccctgaaactgtggtccccgcggcccctgagctgcagccctctacctccacagaccagcccgtcactcccgagccaacgtcacgcgctacacgtggccggactaataggagcagcgtgaaaaccccggagtcaattgtcccaattgctcccgagctgcagccgtccaccagtaggaatcaactcgtcacaccggagcctacttctcgcgcgactagatgcagaacaaacaggtcctcagttaaaactcccgagccagtggttccaacagcccctgaaccccaccctacaacgagcaccgatcagcctgttacaccaaagctgacaagcagagccactcgccgcaagacaaacagatcctccgtgaaaacacccaaacctgtggaaccagccgcgagtgaccttgaaccttttacgcccactgaccagtcagtgacaccagaagcaattgctcagggaggacaaagtaaaactctccgctccagcacggtccgggcgatgcctgtgcctacaacccctgaattccagagcccagtgactacggatcagcctatatccccagagcccataacccagccctcatgcatcaagagacagcgcgccgccggtaacccgggatccctggccgccccaatcgatcacaagccatgttccgcccctctggagcctaaaagccaggcctctagaaaccaacggtggggtgccgtgagagcagcagaatctctgactgcaattccagagcctgccagtccgcagctgctggaaactcccatacacgcctctcagatccagaaagtcgaacctgctggtcggagtagattcacccctgagttacagcccaaggcatcccaatcgaggaagcggtccctggctacaatggacagtcccccacaccagaaacaaccacagagaggcgaagtgtcccagaagactgtgattatcaaagaggaagaagaagataccgccgagaaaccgggaaaagaggaagacgtcgtgaccccaaagcccggaaagcggaaaagggatcaggctgaggaggaaccgaaccgcattccctctcggtctctgcggagaaccaaattaaatcaggaatcaaccgcccccaaagtgctgtttacgggcgtcgtcgacgctcgcggggagagagccgtgctggcattaggcggctccctggccgggagcgctgccgaggcttcccatctcgtcacagaccggattcgtagaactgtgaaatttctttgtgctctaggtaggggaatacctatattaagcctcgattggttgcatcaatcaaggaaggcaggatttttcttgccccccgatgagtacgtggtgactgaccccgagcaggaaaaaaacttcggcttcagccttcaggacgccctgagccgcgcccgagagcgcaggctgttagaaggctacgagatttacgtcacccccggtgtgcagcccccaccaccccagatgggagagattatcagctgctgcggggggacatatctaccttcgatgcctagatcctacaagcctcagagagtcgtcatcacttgtccccaggattttccgcactgttctatacctttgagggtgggcctccctctgttgtcccctgagtttttgcttaccggcgtcctcaagcaggaagccaagccagaggcatttgtgttatcgcccctggagatgagttccacatag

SEQ ID NO: 123731 - DNA, 735 bp, Artificial Sequence
  Description of Artificial Sequence: Synthetic coding sequence
atggaagatactcaggccatagactgggacgtggaagaggaagaagaaacagaacagtcttcagagtcactacggtgcaatgtagagccagttggccgcctgcacattttctcaggtgcccatggacccgagaaggatttccctctgcacctggggaagaatgtagtgggccggatgcctgattgctctgttgcactcccgtttccttccattagcaaacagcacgcagagatcgagatcctggcttgggacaaggccccgatccttagagattgcggtagtctgaatggaacccagatactgcgcccccctaaagtcctgtctcctggggtctctcatagactcagagatcaggagctgattctatttgccgacctgttatgtcagtatcatcgccttgatgtatccttaccattcgtgagtagagggccactgacggtcgaagaaacgcccagagtgcagggagaaacccagccccagcgcttacttctggcggaggattcggaggaggaagtcgattttctcagcgaacgcagaatggttaagaagagtcggaccacatcctcgagtgtgatcgttccagaatcggatgaggaagggcactcacccgtcctgggcggacttggcccgcctttcgcgtttaatctgaattccgacacagacgtcgaggaaggacaacaaccacaccgcggaggactgctgtcctgccagaaacggtgccactgtcgtgggtag

SEQ ID NO: 123732 - DNA, 5409 bp, Artificial Sequence
  Description of Artificial Sequence: Synthetic coding sequence
atggaggacacccaggccatagactgggatgtggaagaagaagaagagacagagcagtccagtgagagcctaaggtgtaacgtggaaccagtgggccgcctgcacatcttcagtggcgcgcatggtccagagaaggattttcccctccacttaggtaaaaacgtggtgggccggatgcccgattgtagcgtggctttaccctttccctccattagcaagcagcatgccgaaattgagatcttagcctgggacaaagccccaattcttcgggattgtggttcactaaacgggacgcaaattttgcggcctcctaaagtccttagccccggtgtctctcaccgactaagggaccaggagctgattctcttcgctgacctgttgtgccaataccaccgattggatgttagcttgccatttgtctctaggggacctctgaccgtagaggaaaccccccgagtgcagggcgagacccagccacagcggctcctgttggccgaggacagtgaagaagaagtcgactttttgtcagagagacggatggtgaagaagtcaaggactacgagctcttcggtgatcgtccctgaatccgatgaggaaggtcacagcccagtgttaggaggtttgggccccccttttgcttttaatcttaacagcgatacggacgtggaggagggccagcagccagctactgaggaagcttcctcagctgccaggagaggagctaccgtggaggcgaagcaatccgaggccgaggttgtaactgagatccagctggaaaaggatcagccactggtaaaagagcgtgataatgacacgaaggtcaaacgcggcgccggcaacggggtggttcccgctggagttatattagaaagatcccaaccgcccggcgaagactcagacactgacgtagatgatgactccaggccacctggaaggcccgccgaagtgcacctggagagagctcagccctttggttttattgatagcgataccgatgccgaggaagaacggatccctgccaccccggttgttattccaatgaagaaacgaaagatctttcacggcgttgggacccgcggtccaggcgctcccggacttgcccacctccaagagagccaggccgggtcagatacagacgttgaggagggaaaggccccccaggccgtgccgttggagaaatctcaggccagcatggtaatcaatagtgatacagacgacgaagaagaggtgtcagctgcccttactctagctcacctgaaagaatctcagcctgcaatctggaatagagatgcggaagaggatatgccgcagagggtggtcctcttgcaaaggtcacagacaacaactgagcgagacagtgatactgatgtggaggaagaagagctacccgtggaaaatcgggaggctgtattgaaagaccacacaaaaattcgggcgttagtccgggcccatagcgagaaagaccagcccccattcggggattctgacgattcagtggaagccgataaaagctcaccaggaatccacctggagagaagtcaagcctcaacaaccgtcgatattaacacacaggtggagaaagaagtgccacccgggtccgccattatccatataaaaaagcatcaggtttcagtggagggtaccaaccaaaccgacgtcaaggccgtgggcggaccagccaagttgctggtggtgtcgctggaagaagcgtggccgcttcatggtgactgtgagaccgatgccgaagaggggacatcgcttacggcttccgtggtggccgatgtgagaaaaagtcaactgccagccgagggagacgccggagccgagtgggcagccgcggtgcttaaacaagaacgggcacacgaagtgggcgcacagggaggaccccccgtcgcacaggtagaacaggatctacctatcagccgagaaaacttaacagatttggtcgttgacacagacactcttggtgaatccactcagccacagcgggagggggcgcaggtaccaactggcagagaaagagaacagcatgtgggagggacgaaggatagtgaggataattacggagattcggaggatctggacttgcaggcaacacaatgttttctagaaaaccaggggctagaggctgtgcaatccatggaagacgaacctacccaggctttcatgctgactccaccacaggagctcgggccctcccattgtagctttcagactactgggactctggacgaaccttgggaggtgctggcaactcagcccttctgcctgcgtgagtccgaagacagcgagacgcagccatttgacacgcatctggaagcctatggaccgtgcttgtcaccacctcgggccattcctggagaccagcatccagagagccccgtacacactgaacctatgggaattcagggacggggaaggcagacggtcgacaaagtcatgggtatacctaaagagacagctgagagagtggggccagaaaggggaccgctagagcgcgagactgaaaaactcctcccagagaggcagactgatgtgacgggagaggaggaactgaccaagggtaagcaagacagggagcagaagcagttacttgcccgggacacccagcggcaggagagcgacaagaacggtgaatcagcctcaccagaacgggatcgtgaaagcctcaaagttgagatcgaaaccagcgaagagatacaagaaaagcaggtgcagaagcagaccctgccgtcaaaggctttcgaacgggaagtggaacggcctgtggccaatcgcgaatgcgaccctgccgagctggaggagaaagttcctaaagtaatcctcgagagagacacgcagaggggagaacccgagggagggtcgcaagatcagaaagggcaagcttcttctccgacaccagaacctggcgttggagctggggatttaccaggacctacgtccgcaccagtgccaagcggatctcagtctggcggtcggggttctcctgttagcccaagaagacaccagaaaggactgttgaactgcaagatgcctccggccgaaaaggcgtccagaatcagggcagccgaaaaggtgtctagaggcgaccaggagtcgcccgacgcctgtctaccaccaactgtaccagaggcgccggcaccccctcaaaagccactgaatagccagtcccagaaacatctggctcctcccccattgctgtcacctctgctgccatctatcaagcccacagtgcgtaaaactcggcaggatgggtcccaggaagccccagaggcacccctgtcctccgaactagaaccattccacccaaaacccaaaatccgcaccaggaaaagctcccggatgactcccttccctgccacaagcgctgctccaaagcttgaaccttcaacgagcactgaccagcctgtgacccctgaaccaaccagccaagcgacacgcgggcggactaatagaagcagcgtcaaaactcctgagactgtcgttcctaccgcacccgaactgcaaccatcaacttcaactgatcagccagtgacccctgaacccaccagccaagctactcgcggaaggacggataggagcagtgtcaaaacccccgagactgttgtccccacggcacccgagctgcaggcttctgcatccaccgaccagccagtaacaagcgaacccacctctcgcactaccagggggcggaagaaccgcagttccgtgaagacgcccgaaactgtagttcccgccgccccagaactacagccatcaacgtccaccgaccagcctgtaacccccgagcccaccagtagggccacccggggacggaccaatagaagttctgtcaaaactccagaatcgattgtgccaattgcccctgaactgcagcctagtacctcccggaaccagcttgtcactccagagccgaccagccgcgccacacgatgtcggactaatagatctagcgtcaaaacccctgagccagtagttccaaccgcccccgagccgcacccaacaacttctaccgaccagccagtgacaccaaaactcacgtctagggccacgagaaggaaaaccaacagaagctccgtgaaaacccctaagccagtcgagccagccgcttcggatctggaaccgttcacacccaccgaccagagtgtcactcccgaggccatagcccagggaggccaatctaagactctacgttctagcaccgtgagggccatgcctgtcccaacaacacccgagttccagagcccagtgactaccgaccagcccatttcacccgaacccattactcagccgagctgcattaaaagacagcgagctgctggtaaccccggatcactagctgcaccgattgatcacaagccttgcagcgcaccgcttgaacctaagagccaggcttctaggaatcagcgctggggcgccgttagagcagccgaatcattgacggcaatccctgaacccgcttcgccacaattgctcgagaccccaatccacgcatcccaaatacaaaaggtggagccagctggaaggagcaggttcacacctgaactgcagccaaaggcgtctcagtcccgcaagagaagtctcgccaccatggatagcccaccccaccagaagcagccacagcgcggggaggtgtctcagaagacagtgataattaaagaagaggaagaagataccgcagagaaacccggaaaagaagaggatgtagtgaccccgaaaccgggcaagcgcaagcgcgaccaggccgaggaagaacccaaccgcattcctagccgcagcctgcggagaaccaagctgaatcaggagagcaccgcaccaaaagtattgttcaccggagtggtggacgctcgtggggaacgtgccgtgcttgccctgggaggttccctcgctggctccgccgctgaggcatctcatctggtgacagacaggattaggcgcaccgtgaaattcctgtgcgctcttggtagggggatacccatcctctccctggattggctacaccagtctcgtaaagccggcttcttcctgccacctgatgagtacgtcgttacggatcccgagcaggagaagaactttggcttctcgctacaagacgcattgtcacgagcacgcgaacggcgcttgctggaaggctacgaaatatacgttactcctggggtgcagcctcctccgccccagatgggagagatcatctcatgttgtggtgggacatacctcccttccatgccaaggtcctacaaacctcagcgcgtcgtaatcacttgtccccaggatttccctcactgttccattcctttgagggtcgggttaccgctccttagccccgaattcctgctgaccggcgtgcttaaacaagaggcaaagccagaagctttcgtattgagccctctggagatgagtagtacctag

SEQ ID NO: 123733 - DNA, 735 bp, Artificial Sequence
  Description of Artificial Sequence: Synthetic coding sequence
atggaggatactcaggctattgactgggacgtggaagaagaagaggaaaccgagcagtccagtgagagcctgaggtgtaacgtggaacctgtcggacgtctacacatcttcagcggagctcatggacccgaaaaggatttcccgcttcacctaggcaaaaatgtcgttggccgaatgccagactgctcagtggccctgccttttccgagcatatcgaaacaacacgccgaaatagagattctcgcctgggataaagcaccaattctgcgtgattgcggctctttaaatggcacacaaatcctcaggccccccaaggtgctgtcccccggagtctcccatcgcctgcgtgatcaggaattaattttgtttgcagacctcttgtgccagtaccacaggctggatgtctctcttccatttgtttctaggggtccactcaccgtggaggagacccctcgcgtgcagggagaaacacaaccgcagcgattgctccttgccgaagacagtgaggaggaggtggattttctgagcgagcgcagaatggtgaagaagtcaaggaccaccagttctagcgtgattgtgccagaaagcgacgaggaggggcacagcccggtgttgggtggcctgggaccccctttcgcctttaatctgaatagcgacacagatgtcgaggagggacagcagccccacagagggggactgctgagctgccagaagcgatgccactgccgtggctag

SEQ ID NO: 123734 - DNA, 735 bp, Artificial Sequence
  Description of Artificial Sequence: Synthetic coding sequence
atggaggatactcaggctatcgactgggatgttgaagaggaggaggaaaccgagcaatcgagcgaatcacttcgctgtaacgtggaacctgttggaagactgcatatcttttccggggcgcatggtcccgaaaaggacttccctttacacttaggcaaaaacgtcgtaggccggatgccagattgtagcgtggccttgccgttcccttccattagcaaacagcatgccgaaatagagatcttggcctgggataaggcaccaatcctgagggattgcggatccctgaacggaacccagatccttaggcccccaaaggtcctctctcctggagtttcccaccgactgcgggaccaggaactgattctgttcgcggatcttctctgtcaatatcatcgtctggacgtttctctgccctttgtttctagaggtccactcacagtagaggagaccccaagagtgcaaggagagacacagccgcagaggctgttactggcggaagactcggaggaggaggtagactttttgtccgagagacggatggtgaaaaagagccggacaactagctccagtgtcatcgtccccgaatccgatgaggagggacacagccctgtgcttgggggacttgggcctccatttgcctttaatcttaattcggatacagacgtggaggagggtcagcagccccacaggggcgggttactttcctgccagaagcgctgccactgtcggggttag

SEQ ID NO: 123735 - DNA, 738 bp, Artificial Sequence
  Description of Artificial Sequence: Synthetic coding sequence
atggaagatacccaggccatcgattgggacgtcgaggaagaagaggaaaccgaacaaagtagtgaatcactcaggtgcaacgtggaacctgttggccggctgcatatcttctcaggagcgcacgggcccgaaaaggattttcccctccacctgggcaagaatgtggtcggcagaatgcctgattgttcggttgcgttgcccttcccgtccatctcgaagcaacacgcagagatcgaaatcctcgcttgggataaagccccgatcctgagggactgcgggtctttgaatggcactcaaatcctgcggccccccaaggttctaagtcccggagtaagccataggctgagagaccaggagctgatcctgttcgcagacctcctgtgccaatatcatcgcctggacgtgtccctgccattcgtctctagggggccactgactgtcgaagagactcctagagtccagggggagacgcagccccagcgattgctgctggcagaggattccgaagaggaagttgactttctctcagaaaggaggatggtaaagaagtctcggactacttcatcaagcgtaattgtgccagaatccgatgaggaaggacactcaccggtgttgggcggtctcggacccccatttgccttcaatctcaactctgacaccgatgtcgaagaaggccaacagccagcgactgaagaggcttcatccgctgcacggcggggcgctacggtggaagcctag

SEQ ID NO: 123736 - DNA, 5478 bp, Artificial Sequence
  Description of Artificial Sequence: Synthetic coding sequence
atggaggatacacaggccatcgactgggatgtagaggaagaagaggagacggagcagtcttcagagagtctacgatgcaacgtggaacccgtggggagactgcacattttctccggtgctcacggcccagaaaaagattttccccttcacctgggaaagaacgtggtggggcggatgcccgactgctccgtcgctctgcctttccctagcatttctaagcagcacgccgagatcgaaatcctggcatgggacaaagcccccattctgagagactgcggttcacttaacggaacacaaatacttagacctcctaaagtgctctcccccggcgtgtcccacaggctccgggaccaagagctgattctgttcgctgacctcctttgtcaataccataggttggacgtgtcccttccctttgtcagtcgggggccgctcaccgttgaagagactcctcgggtgcagggagagacacagccccagcggttgctgctcgctgaggactccgaggaagaggtggactttctatcagagcggagaatggttaaaaaaagtcggaccacctcgtcctccgttattgtcccagagagcgatgaagaaggacactcccccgtcttaggaggcctcggcccgccattcgctttcaatcttaactctgacactgatgttgaagagggccagcagcccgcgactgaggaggctagtagcgccgctagacgcggagccactgtggaagcgaagcagagcgaagccgaagtggtaactgaaatacagctcgaaaaggaccaaccccttgtgaaagaaagagacaatgatactaaggtaaagaggggagccgggaacggtgtcgtccccgccggagtaatcctggaaaggtctcagcctcccggagaagacagcgacactgacgttgacgatgatagccggcccccagggcgcccagccgaagtgcacctcgagagagcccagccttttggtttcatcgattctgacaccgatgccgaggaggagaggatacctgctacccctgtggttatccccatgaagaagagaaaaatcttccacggtgtggggacaaggggtccaggcgcacccggcctcgcccatctgcaagagagccaggcaggctccgacaccgatgtcgaggagggaaaagcaccccaggccgtccctctggaaaaatctcaagcctcaatggtgataaattccgataccgatgatgaggaggaggtgtctgcagccttaaccctcgcccacctcaaggagagccagcccgctatatggaatcgggacgcggaagaagacatgccacaacgagtcgtcctgctgcaaaggtctcaaaccactacggagcgcgattccgatactgatgttgaagaagaggaactgcccgtcgaaaatagagaagccgtgttgaaggaccacacgaagatccgggctttggtgagagcgcactccgagaaggatcagccgccattcggggactctgatgatagcgttgaggcagacaaatcgagtcccggtatacacctcgaaagatctcaggcctcaactactgtggacattaatacccaggtggagaaagaagtaccccctggaagcgctattatccatatcaagaagcaccaagttagcgtggaggggaccaaccaaacggatgtcaaagctgttgggggtcccgcaaaactgctcgtggtcagtcttgaagaggcctggcccttgcatggtgactgtgaaaccgatgccgaggaaggtacgtccctgactgcgtctgttgtggccgacgttcgcaagagtcagctgcctgccgagggagacgctggagccgagtgggcagccgcagttctcaaacaagaacgggcccatgaggtgggagctcagggtgggccccctgtggctcaggtggagcaggatttgcctatttcacgtgagaatctgaccgatctggtggtagataccgacactctaggggagagcacccagccgcagcgggagggtgcccaggtcccaacaggacgcgagcgtgagcagcacgtcgggggcaccaaggactctgaagacaactacggtgactccgaagatttggatctgcaggcaacccagtgctttctggaaaatcagggcctggaggctgttcagtcaatggaggatgaaccaacacaggctttcatgttgactcctcctcaggagttaggtcccagtcattgctctttccaaaccactggcctgttgaattgcaagatgcctcctgctgagaaggcatcccgcatacgggcggctgagaaagtttcacggggggaccaagaatcacctgacgcctgtctccccccaaccgttcccgaggctccagctcctccccagaaacccttgaattctcagtcccaaaagcacctggcgccacccccactactgtcacctctactcccgtccataaaacctacggtgaggaagactcggcaggacggaagtcaggaggccccagaagcccccttgagtagcgaattggaaccgttccatcccaagcctaagattcgaactcggaagtcgagtaggatgaccccatttccagcaacatctgccgccccagagccccacccatcgacctcgacagcccagcctgtcacccccaagcccacatcccaggcgactcggtcaaggaccaaccgatccagtgtcaagaccccagagcccgttgtgcctaccgctccggagcttcagccctccacttcaaccgatcagcctgtgacctctgagcccacatcgcaagttacgagaggcagaaagagtcggtcttccgttaagaccccggagaccgttgtccctacagctttggagcttcaaccctcaacttccactgatagaccggtaaccagcgaaccgaccagccaggcaacacgaggtagaaagaacaggtctagcgtgaagacacccgagcccgtagtacccacagcccccgagctgcagccctctacgagtaccgatcagccagtgacctccgagcctacctatcaagcaactaggggtcgcaagaatcgatcctccgtcaaaaccccagaaccagtcgttcctactgccccggagctccggcccagtactagcacagatcggcccgttactccgaagcctacctcacgtacaacacggtcccgcaccaatatgtcttcggtgaaaaccccagaaaccgtggtgcccaccgctcctgagctgcagataagcaccagcactgatcaaccagtgacgccgaaacctacttctcgcacaacacgatcccggacaaacatgtcctcggtcaaaaatcccgagtccactgtgccaattgcaccggaactcccacctagtacaagcaccgagcagccagtcactccagaaccaactagccgggccaccaggggtagaaaaaatcggtcctctgggaaaactccagaaaccctggtgcccacagctcctaagcttgagccctctaccagcacagatcagccagtgacccccgaacccacttctcaggctacacgggggaggacgaacaggtccagtgtaaaaactcccgaaaccgtggtgccaacagcccctgagctgcagccgtcaacatctacggaccagcccgtcacccctgaacctacctcccaggccacacgcggacggaccgacagatcgtcggttaaaactccggagaccgtcgtgcccaccgctcccgaactgcaggctagcgcctctaccgatcagcctgtgacgagcgaaccaacttctcggactacacggggtagaaaaaacagatcgagcgtgaaaactcccgaaacagtcgtgcctgcggcaccagagctccagccatcaacctccacggatcaacctgtcactccagagcctaccagtcgcgcaacacgcggacgaactaatcgaagtagcgtgaaaacaccagagagtattgtgcccatcgcacccgaattgcagccctcgacgtctcgcaaccagctggtcacaccggagccaacctcaagagccacccgctgcagaactaatcgttctagtgtgaagacgcctgagcccgtcgtgcctaccgctcctgagccccaccctacaacatccaccgaccagcctgtcactccaaagctgactagtcgggctaccagaaggaagacaaaccgaagttccgtgaagacgcccaaacctgtcgagcccgctgcctcggacctggagccatttacaccaacggaccagtcagtgacacctgaggccatagctcagggaggacaaagtaagacactcagaagctcaactgtgcgcgccatgcccgtgcctactactcccgaattccagtcacctgtgacgaccgatcagcccatcagccccgagcccatcacgcaacccagctgcataaaacgccagcgggcagccggaaatccaggaagcctggccgcccctattgaccacaagccatgttccgccccccttgagcccaagagccaggcttcgcgtaatcagcgctggggcgcagtgcgggccgccgagtcgttgactgctattcctgagcccgcatctccgcagctcctggagactcctattcatgcatcccaaattcagaaagttgagcctgccggccgcagccgattcactccagagctgcagcctaaggccagccagagccggaaacgcagtctggcaactatggatagtccaccacaccaaaaacagccgcagcgtggcgaggtgagccagaaaaccgtcatcattaaagaggaggaggaggacacagccgaaaaacctggcaaggaagaggacgtcgtgacaccaaagccaggcaaacgtaagcgcgaccaggccgaggaagagccaaataggattccgtctcgttccctcagacgcactaaactgaatcaggagagtactgcccctaaagtgcttttcacgggcgtcgtggatgcacgtggtgagagagcagtactcgcactgggcggcagccttgctggcagcgcagctgaagcctcccacctggtgactgatagaattcgccgcaccgtgaaatttctatgcgccctagggcgaggcataccaatactgagcttggactggctacatcaatcgcgtaaagccggtttctttctgccgccggatgaatacgtggtgacggatcccgagcaggaaaagaatttcgggttctcgctgcaagacgctctgtctcgggcccgtgaacgtcggctcctagagggatatgagatttacgtcactcccggtgtgcaacccccgccccctcagatgggcgaaatcatctcctgttgtggtggaacttatttgccgtcaatgcccaggtcttataagcctcagagagtagtgataacatgcccccaggactttccccattgttcaataccccttcgcgtcgggttacccttactgtccccggagttcctactgaccggggtattgaagcaggaggcaaaacccgaggcgtttgtcctgagccctctagagatgagcagcacttag

SEQ ID NO: 123737 - DNA, 738 bp, Artificial Sequence
  Description of Artificial Sequence: Synthetic coding sequence
atggaggatactcaggccattgactgggacgtagaagaagaggaggagactgaacagtccagtgaatcgctccggtgtaacgtggaacctgtgggccggctgcacatatttagcggcgcccatgggcctgagaaagatttcccgctgcacctggggaagaacgtggtggggcggatgccggattgctcagttgctctgccttttcccagtatctcgaaacagcatgccgagattgaaattcttgcctgggacaaggcccctattcttcgggactgtgggagtctaaatgggacccagattctgagaccacctaaggtgctcagccccggagtgtcacaccggctgcgcgatcaggaacttatcctattcgcagacttactttgtcagtatcatagactcgacgtgtcgttgccgtttgtgtctcgcggaccattgacagtggaggagactccacgggttcagggggaaactcaaccccagagactgctgctcgccgaggatagcgaagaggaagtcgacttcctgagcgaacggaggatggtgaagaagtctaggacaacctcctctagtgttattgttcctgagagcgacgaagagggtcactcccctgtgctcggggggctgggccctccttttgcctttaacctaaactcagacactgatgtcgaggaaggtcagcagcctgcgaccgaggaggcctctagtgccgctaggcggggcgcaactgtcgaagcctag

SEQ ID NO: 123738 - DNA, 5409 bp, Artificial Sequence
  Description of Artificial Sequence: Synthetic coding sequence
atggaagacacgcaagctattgactgggatgtggaagaggaggaagagaccgaacagtcctccgaatccttaagatgtaacgttgagcccgttggcaggctccatatcttctccggcgcgcatggccccgagaaagacttccccctccacctggggaaaaatgtggtcggaagaatgccggactgcagcgtcgccttaccgttccctagcatatctaagcaacacgccgagatcgagatactggcctgggataaggcgcccatcctcagagactgtggctcactcaacggcactcaaattctgcgaccccccaaagtgctctctcctggcgtcagtcaccggttgagagatcaggagctgattctgttcgccgacctgctttgccagtaccatagactggatgtcagcctgcctttcgtttctcgcgggccgctgaccgtcgaggagactcccagggttcaaggcgagactcagccccaacgcctgttgctggcggaagattctgaagaagaggtagactttctcagcgaacgtaggatggtcaagaaatctcgaacaacttcctcatccgtaatagtgcccgagagcgatgaagaggggcatagtcctgtactgggggggttgggtcctccgtttgccttcaatttaaacagcgataccgatgtggaggagggccagcagcccgcgaccgaggaagcctcaagcgccgcaagaagaggcgcgacggtggaagccaagcaatcagaggcggaggtggttacagagatccagctggaaaaagatcagcctctcgtcaaagaacgggacaatgatacgaaggtcaagcggggcgccggaaacggggtagtcccggcgggagtgatcctggagcgcagtcagccgcctggcgaagatagcgacactgatgtcgatgatgacagccggccaccaggccgaccagcagaagtccacctggagcgtgcacaaccatttggatttattgattcagacactgatgccgaggaagagaggatcccggccacccctgtggtcatacctatgaagaagcgtaaaatcttccacggggtcggcacccgcggccctggggcgcccgggctggcgcacctacaggagtcccaggctggcagcgacacagatgtagaggaaggaaaagctccccaggccgtgcccttggaaaaatctcaagcttcaatggtgattaacagcgacactgacgacgaggaagaagtgagcgccgctttaactctggctcacctaaaggaatcccagcctgcgatctggaacagagacgccgaagaggacatgcctcagcgagtggtactgttgcaacggtcgcagacgacaaccgagagagatagtgatactgatgtggaggaagaagaactccctgtcgagaacagagaggcagtgttaaaggatcacacaaaaatcagagccctggttagagcccatagtgagaaggatcagccaccttttggggattcggacgacagcgtcgaagcagacaaatctagcccgggcatccatctcgaacggagccaagcctcaaccaccgtggatatcaatacacaagttgaaaaggaggttccccccggctcagctattatccacataaagaaacaccaggtttctgtcgagggcaccaaccagacagacgttaaagccgtcggcgggcccgccaagctcctggtagtgagcctggaggaggcttggccacttcacggagattgcgaaacggacgcagaagaggggacctctctgacagcatctgtggtggccgatgtgagaaaaagccagctgcctgccgaaggagacgccggcgcagagtgggcagctgccgtcttaaaacaggagcgggctcacgaagtcggcgcgcagggtggcccacctgtcgcccaggtagaacaggacttgcccatatctagggaaaatctcacagacctggtggtggatacggacaccctgggggaatctactcaaccccagcgagagggcgcgcaggtccccacaggtagggagagggagcagcatgtcggtggcaccaaagactccgaggataactatggagactctgaggatctcgatctccaggccactcagtgtttcctcgagaaccagggacttgaggcagtccaaagcatggaagatgagccaactcaggcttttatgctgacgcctccacaggaactgggacccagtcactgtagttttcaaaccaccggtactctggacgagccgtgggaggtcctcgccacacagcccttttgtcttcgagaatcagaagactccgaaacacagccgtttgacacacacctcgaggcctacggcccttgcctgtcaccacctcgcgcaatcccaggggaccagcatcctgagagccccgtccatactgagcctatgggaatacagggccggggtcgccagaccgtggataaagttatggggattcccaaggagactgctgaacgcgtcggaccagagcgcgggcctctggagcgtgaaacagaaaagctgctccccgaacgtcagaccgatgtgacgggagaggaggaattgaccaaagggaagcaggacagggaacagaagcagctgcttgcccgggacacacagcggcaggaatcagacaaaaatggagaatcggcctcccctgagagggatagggagagtctgaaggtcgagatcgagacatctgaggagatccaggagaagcaggttcagaaacagacccttcctagtaaggcctttgaacgagaggtggaaagaccagtggctaatagagagtgcgatccggctgagctcgaagaaaaggtgcctaaagtcattcttgagcgggacacgcagcgcggggagcctgagggcggctcacaagaccagaagggtcaggcgtctagcccgactcccgagcccggcgttggcgccggtgatcttcctggtcccacaagtgcacctgtgccgtcggggagtcagtcagggggccgcggcagtcccgtatctccacgtcgacaccagaagggcctcttaaactgcaagatgccacctgcagagaaggcatcgcgtatacgggcagcagagaaggtgtcacgcggcgaccaggagagtcccgacgcatgcctgccccctacagtacccgaagcaccagcgcctcctcagaaaccgctgaactcacagagtcagaaacacctggccccaccacctctactatctcccctgttaccatccataaagccaaccgttaggaagaccagacaagatggcagtcaagaggccccagaggcgcctttgagcagcgagctcgagccatttcacccgaaaccaaagatccgcactcggaagtctagcagaatgactccattcccagccacctccgctgcgccaaaactcgagcctagcacctcaacagatcagcctgtgacccccgagcctactagccaggccaccaggggtaggaccaatcggagctccgttaaaacccccgaaacagttgtgccaacagcacctgagttgcagccttccacatcaactgatcagcctgtgacaccagagccaacatcccaagccactagaggtcgtacagatcggtcatccgtcaaaacaccagagacagtcgtccccacggcgcctgaacttcaggcatctgccagcactgatcaacccgtcaccagtgaacctacatccagaaccactcgaggcagaaaaaacaggtcttctgtgaaaactcccgaaacggtcgttccagccgccccagagctccaaccctctaccagcactgaccaacctgtcacccccgagcctacaagtcgcgccactcgcggccggactaatcgctcatctgttaaaacacccgagagcatcgtgcctattgctcccgagcttcagccctccacctctcggaaccagctggttacccccgagccaacatctagagcgacaagatgtaggaccaatcgttcctcagtaaagacccctgagcctgtcgtcccaaccgcccctgaaccccatccgactaccagcaccgaccaacccgtgactcccaagctgaccagccgcgcaactcggcgtaaaaccaaccgttctagcgtgaaaactcccaaacccgtggaacctgccgcatcagacctggaacccttcaccccaactgatcagagtgtgacacctgaagcgattgcccagggcggacagtccaagaccctaaggagcagcacagtccgggccatgcctgtgccaaccacccccgagttccagtctcccgtcaccaccgatcaaccaatttcccctgaacctattacacagcccagttgcattaaacgacaaagggctgctggcaaccccgggagcctcgcagcccccatcgatcataagccatgttcagcccccttggaaccaaaaagccaggcaagtcgaaatcagaggtggggcgcggtgcgggcagccgagtctctgactgctattccggagcccgcatcccctcagctgctcgagactccgattcacgctagccagattcaaaaagtggaaccagctggtagatcccgatttactcctgagctccagccaaaagctagccagtcgaggaagcgctcccttgccacaatggactcaccccctcaccagaagcaaccccagagaggcgaggtgtcccagaagaccgttatcataaaagaggaagaggaagacacggccgagaaacccggtaaagaggaggacgtggtgactcccaagcctggcaaacgcaagagagaccaggcagaggaggagcccaaccgaatccccagcaggtccttacgccgcacaaagctcaaccaggaatccactgcccccaaagttctttttactggggtagttgatgcacgcggggaacgggcagtgctggccttgggcggttctctggcagggagcgcagccgaggcctctcacctggtcacggatcgcatccgaagaacggtgaaattcttatgcgccctgggtcggggcatcccaatcttgagcctggactggctgcaccagtctcgcaaagctggcttctttctgcctcccgatgaatatgtggtgaccgacccagaacaggagaaaaacttcggtttcagcttgcaggatgctctcagccgcgcaagagaaaggcgacttctcgagggatacgaaatatacgtgactcccggggtgcagcccccccctcctcagatgggcgaaatcataagctgctgcggtgggacctacctcccaagcatgcccagatcatacaaaccccagcgagtcgtaatcacctgcccccaagacttcccccattgttctattcctttgcgggtgggcctgcctctgttatcgcctgagttcctcctgacaggagtactgaagcaggaggcaaaacccgaggcctttgtcctgagtccactcgaaatgtcttcgacatag

SEQ ID NO: 123739 - DNA, 738 bp, Artificial Sequence
  Description of Artificial Sequence: Synthetic coding sequence
atggaagatactcaagctatcgattgggatgtggaggaagaggaggagacggagcagagttctgagagtctgcgatgcaatgttgagcctgtggggcgactgcacatctttagtggcgcccacggacctgaaaaggattttccactccatctcggaaaaaatgtcgtcgggaggatgccagactgtagcgtggccttgccttttccaagcatctctaagcagcacgcagaaatcgagattttagcttgggataaagccccaattcttcgagattgcggaagcctaaacggcacgcagatcctacggccccccaaggtcttgagccctggagtgtcacatcgcctcagggaccaagagctcatcctgtttgccgacctactgtgccagtatcaccgtctcgatgtctccctccctttcgtaagccgtggccccctcactgtcgaagaaactccccgcgtgcagggggagacacagcctcagcgtctgctgctcgccgaggactcagaggaggaagtcgacttcctgagtgaacgcaggatggtaaagaaatcccgaactacatcgagcagcgtaatcgtccccgagtctgacgaggaaggacacagccccgtgctgggcggactcggaccaccctttgcattcaacctcaacagcgacactgatgttgaggagggtcagcaacccgctacagaagaagctagcagcgcagcacgacgtggagctacggtggaagcttag

SEQ ID NO: 123740 - DNA, 5409 bp, Artificial Sequence
  Description of Artificial Sequence: Synthetic coding sequence
atggaggacacgcaggccatcgactgggatgtggaggaggaggaagaaaccgagcagagcagcgagagcctacgatgcaatgtggaacctgtggggcgattgcacatcttttcaggtgctcacggccccgagaaagatttccccctgcatttaggcaagaatgtcgtgggacgaatgccggactgcagtgtcgccctcccattccccagcatatccaaacagcatgccgagattgaaatcctggcctgggataaggctccaatcctcagagactgcgggtctctcaacgggacccaaatcctacgccctcctaaggtgctgtcccccggggtcagtcaccggctgagggatcaggaactgatcctgttcgcagatttgttgtgtcagtatcaccgcttggacgtgtcgctgccttttgtatcaagaggtcccctgaccgtcgaggaaactcccagggtccagggcgaaacccaaccccaaagactcctgctggccgaggatagcgaggaagaggtggattttctgagcgagagacgaatggtcaagaagtcgcgcacaaccagctcatctgtcatagttcccgagagtgatgaggagggacatagccctgttctcggaggcctgggcccaccttttgcttttaacctgaacagcgataccgacgtcgaggaaggccaacagcctgccactgaagaggcctcgtccgctgctcgcaggggcgcaacggtagaggctaagcaatctgaggcagaggtcgtaaccgaaattcaactcgaaaaggaccagccccttgtgaaggagcgggacaatgataccaaggtaaagcgtggcgctggcaacggggttgtacccgcaggagtgatccttgagcgtagccagccccctggggaagacagcgacacagatgtagacgacgattctcgcccacccgggcgtccagcggaggtgcacctcgagcgagcgcagcctttcgggttcatagatagtgataccgacgccgaagaggagcggatccctgctactcctgtggtgattcctatgaagaaaagaaaaatcttccacggtgtggggactcggggccctggggcacctggccttgcacacctccaggaatcacaggccgggagtgacaccgacgtggaggagggaaaggcgccacaggctgtgccactcgagaagagccaagcaagtatggttataaattccgacacagacgacgaagaggaagtgtcagctgctctgactctggctcacctgaaggaatctcagccggccatctggaatcgggacgccgaagaagatatgcctcagcgcgtggtcttgcttcagcgcagtcagactacaaccgagcgcgacagtgacactgacgttgaagaggaggagctgcccgtcgaaaatcgtgaagctgtgctgaaggaccacaccaagatcagggccctggttagagcccattccgaaaaagatcagccaccctttggggactctgacgattccgttgaggccgataagagttctcccggcattcatctggaaaggtctcaggcctcgaccactgtcgacatcaatacccaggtggaaaaggaggtgccccccggcagcgctattatacacattaagaaacaccaagtaagtgtcgaggggacgaaccaaaccgatgtgaaggccgttggtggccctgcaaagctgcttgtcgtatctctggaagaagcctggcctcttcacggggactgcgagactgatgccgaagaaggcactagtctgacggcaagcgtcgtcgcagacgttcgaaagtcacagctccctgcagaaggcgatgccggagccgagtgggcagcagctgtgttgaagcaggagagggcccatgaagtcggagctcagggagggcctccggtggcccaggtggagcaagatctgccgattagtcgggagaacctcacagacctagtggtagacaccgataccctgggtgaaagtacgcagccacaacgtgagggcgcccaggtgccaaccggcagggaaagggagcagcacgtgggcgggacaaaggactccgaggataactatggagattctgaggatcttgacttacaagctactcaatgctttcttgagaatcagggcttggaggccgtccagagcatggaggacgaacccacacaggccttcatgttaacacctccccaggaacttggcccctcccactgctccttccagaccaccggaaccctggacgagccgtgggaggtcctggctactcagcccttctgccttagagaaagcgaggacagcgagacccagccattcgacacccacctggaggcatatggaccatgcttatctcccccaagggcaattccaggggaccagcaccccgagagcccagtccacactgagccaatgggaatccagggacggggtaggcagaccgttgataaggtgatggggatccctaaggaaaccgccgaaagggtgggcccagagcgaggtcctctcgagagggagacggaaaaactgttgccagagcggcagaccgacgtaacaggggaagaagaattaacgaagggcaaacaggaccgcgaacaaaaacagctgcttgcccgggatacgcagagacaagaatctgacaagaacggggaatccgccagccccgaacgcgacagggaatcactgaaagtggaaatcgaaaccagtgaagaaattcaagaaaaacaggttcaaaaacaaactctgccaagcaaggcatttgagcgggaggtggagcgacccgtagcgaatagagaatgtgaccccgctgaactggaggaaaaggtcccaaaggtgatcctagagcgagacacacagcggggggagcctgagggagggtcccaggaccagaaggggcaggcctcatcccctactcccgaacccggagttggtgccggggatctgcccggtcctacttctgcgcctgtgccgtctggcagccagtcgggcggacgtggaagcccagtgagccctagacgacatcagaagggtctgctcaactgtaaaatgccgcctgctgaaaaggcttcgcggattcgagctgcagaaaaggtgagtaggggcgatcaggaatcccccgatgcatgtctgccccccactgtgcccgaggcccccgcgcctccgcagaagccactgaatagccagagccagaaacacctggccccccctcctctcctgtccccacttttaccttccatcaaacccacggtaagaaaaacccgtcaagatggctcacaggaagccccagaagctcccctttcatctgaactggagccattccatcctaaacccaaaatccgaactcgcaaatccagccgcatgacacccttccccgccacatcagccgcacctaagctggaaccaagcacctcgaccgatcaaccagtgaccccggaaccgacctctcaagcaacaagggggagaacaaataggtccagcgtgaaaacccccgagacggttgtccccactgcccccgaactgcagccttcaactagcactgaccagcccgttacccctgagccaacttcacaagccacacgggggcgtactgaccgcagcagcgttaagacccctgaaactgttgtgcccacggcacccgagttgcaagccagtgcgtcgacagatcaaccagtaacctcggagccaacgtctcgcactacacggggcaggaagaatcgctcatccgtgaagaccccagagacggtggtgccagctgcgcccgccctgcaaccttccaccagtacagaccaacctgtaacacccgagccaacgtccagagccacaaggggacgcacaaaccggtccagcgttaagacaccagaatccattgtgcctattgctccagaactccagccatcgactagccggaaccagctggttacccccgaaccgaccagtcgagcgacacgttgtaggaccaaccgctcctcggtcaagactcccgagccagtagtgcctaccgctcccgagccccaccccactacatctacagatcagccagtgacacctaagttgaccagtagagcaacgaggcgcaaaactaaccgctctagtgtgaagactcccaaaccagtggagccagctgcatctgacctcgaaccattcaccccaaccgatcagagcgtgactccagaggctatcgcacagggtggccagtccaagacactgagatccagcaccgtccgggcaatgcctgtccccaccaccccagagttccagagtcccgtcaccaccgatcagccaatatcccctgaaccaattacccaacctagctgcattaaaagacaacgagccgctggcaatccaggcagcttggccgctcccatcgatcacaaaccctgcagcgctcccttagagccaaagtcccaggcaagtaggaatcagagatggggtgctgtgcgtgcagcagaatccctcacagctattccagaaccagcttccccacagctgctcgagacacccatccacgcatctcagatccagaaggtggagccagccgggcgaagcaggtttacacccgagcttcaaccaaaggcgagccagagtcgcaagagaagtctggcaactatggacagccctccccaccagaagcagccgcagagaggcgaagtttcacagaagacagtcatcataaaggaggaggaggaggacacagctgagaaacctgggaaggaggaggacgttgtcacacctaaacctggcaagagaaaacgcgaccaggcagaagaggagcccaatcggataccttctcgcagtcttcgccgcacgaaactaaatcaagagtctactgcacctaaagtcctgtttacaggagtcgtcgacgctagaggggaacgcgccgtgctggctttaggtggaagtctcgccggcagtgccgcagaagctagtcatcttgtgacagaccgtatccgcagaacagtgaagttcctctgcgctctgggaaggggcattcccattttaagtcttgattggctccatcagagcagaaaggctggattttttctccctcctgacgagtatgttgttacagacccggaacaagagaagaacttcggcttctccctccaagatgctttatctcgagcccgcgaacgtcgtctgttggaaggatacgaaatttacgtgacccctggggtccagccaccccccccccagatgggcgagatcatttcctgctgcggcggtacgtacttgccatccatgcctagatcatacaagccccagagggtcgtgatcacctgcccacaggatttcccgcactgctctattccgctgcgagtgggtctcccgcttctgagccctgagtttctcctgacaggggtgttgaaacaagaagctaagccggaggccttcgtgttatcccctctcgagatgtcctctacgtag

SEQ ID NO: 123741 - DNA, 5478 bp, Artificial Sequence
  Description of Artificial Sequence: Synthetic coding sequence
atggaggatactcaggcaattgactgggacgtggaggaggaggaggagaccgaacagtcttccgaatccttaagatgcaatgttgaaccagttggcaggctgcacattttttcaggggcccacggaccagagaaagactttcctttacatctgggaaaaaacgtggtaggacgaatgcctgattgcagcgtggctctgccatttccttctatatccaagcaacatgcagaaattgaaatactggcctgggacaaggcccccatactcagggactgtggctctctaaatggtacccagatactgaggccacccaaagtgctctcacccggggttagccacagattgcgcgatcaagagcttatcctgtttgccgatctgctgtgccagtaccatcgcctggacgtgtccctgccattcgtgagtagaggaccactgacagtggaggaaactccccgcgtccagggagaaacccagccacagcgtttgctgctcgctgaagattctgaggaggaagttgactttctatcagagcggaggatggtcaagaagagccgcaccacttccagctccgtgatagtgccagaaagcgatgaagaaggccactctcctgtactcggtggcttgggccctcctttcgccttcaacctcaattccgacacagatgtggaggagggtcaacagccagctactgaagaagcctcctcagcagctcgacggggtgccactgtcgaggccaagcagtcagaggcagaggtcgtcactgaaatacaactggagaaagaccagcccctggtcaaagagcgcgacaatgatacaaaggtgaagcgcggggctggcaacggggtggtccctgccggggtgatactagagagaagccagccgccgggcgaagatagcgataccgacgtggatgatgactcgaggccacctggaaggcctgccgaggttcaccttgagagggcacagccatttggctttatagactcagatactgacgccgaagaggagcgaattcccgcaacccctgttgtaatacctatgaagaagcggaaaatttttcacggagtcggtactagagggcccggtgcacctgggctggcccatctgcaggagagccaggcgggcagcgatactgacgtagaagagggtaaagccccgcaggccgtgcctctcgagaagtcacaggcttccatggtgataaactccgatactgacgacgaggaggaggtgagtgctgcattgacgctcgcgcatttgaaggagagccagccggctatatggaaccgggatgcggaagaggatatgccacagcgtgttgttttactgcaaaggagtcaaaccactaccgagcgggattccgacaccgacgtagaggaagaggagctgccagttgagaacagggaggcagtcctgaaggatcataccaagatccgggcgctggtccgggcacatagcgaaaaggatcagccccctttcggagactctgacgactcagtcgaagcggataaaagttccccgggaatacacttagagcggtctcaagctagcaccactgtggatattaacacacaggtagagaaggaggttccgccaggctctgccataatacacatcaagaagcaccaggtgagcgtcgaggggactaatcaaacagacgtaaaggccgtgggcgggcccgcaaaactcctggtggtatccctcgaggaagcttggccactgcacggagactgcgaaactgacgcggaggagggcacgtctctcacagccagcgttgtcgcagacgtccggaagtcgcaattgccagccgagggcgacgccggagccgaatgggcagcagctgtgctgaaacaggaacgcgcccatgaagtaggggcgcagggaggtccaccagttgcccaggttgaacaggatttgccaatctctcgcgagaatctcaccgacctggtcgtggacactgatacactgggtgaatcgactcagccccagcgagaaggtgcacaggtgcccaccggccgcgaacgcgagcagcatgtgggaggcactaaggactctgaggacaactatggtgattccgaggacctggatttacaggccacccaatgcttccttgagaaccagggtctggaggcggtacagtccatggaggatgagcctacgcaagcctttatgctgactcctccccaggagctagggccatctcattgctccttccagactacaggcttacttaattgtaagatgccacccgccgaaaaagccagcagaattcgcgccgccgagaaggtttctaggggtgatcaggaaagcccagatgcttgtctgccgccaactgtccctgaggccccagcccccccccagaaacccctcaattcccagtctcagaaacacctggccccccctcccttgctctctccgctcttaccctcaataaaacccactgttcggaagacaaggcaagacgggagccaggaagcacccgaagcaccactatcatcggaactcgaaccattccatcctaaaccaaagatcaggactcgcaagagctcacgcatgacaccattccccgccactagcgctgctcctgagccccatccttcgacgtcaactgcacaacctgtcactccaaagccaacttcacaggctactcggtcccggaccaacagaagcagcgtgaagacgccggagcccgttgttccgaccgccccagaactccagccctcaacttcaacggatcagcccgtcacatcggaacccacgtctcaggtcactaggggccgcaagagcagatccagtgttaagacgcccgagactgtggtgccaactgctttggagctccagccttctacttctactgaccggcctgtcacatcagagccaacctcacaggccacccgggggcgcaaaaataggtcctccgtaaaaactccggagcctgttgtgcctactgctcccgagctgcagccatccactagtaccgaccagccggtgaccagcgagcctacttatcaagctactcgggggcgcaagaatcgctcaagcgtgaagactcctgagcccgtggttcctacggctcccgaactgcggccgtctaccagcacggaccgcccagttacaccaaagccaacatctaggaccactaggtccagaaccaacatgtccagcgtgaagacgccagagaccgtggtccctaccgctcctgagctgcagatttccacctcgaccgatcagcccgttactcctaagcctaccagcagaacaaccagatcaagaaccaatatgagctccgtgaaaaatccggagtctaccgtgcccatagccccagagttaccaccatcaacaagcacagaacagcctgttacgcctgagccaacttcccgagctacccgtggccgaaaaaataggagctccgggaagacacccgagacactcgtccccacggccccaaagctcgagcctagtaccagtactgatcaaccagtcacacctgaacctacatcacaagccaccagggggagaaccaacagatctagtgtcaagacccctgagacagtagtgcccactgcaccagagctgcagcccagtacatccacagatcagcctgtgacccctgaaccgacatcccaggctacccgggggagaaccgaccggagttccgtaaagactccagagacagtcgttccaacggcccctgagctgcaggcctccgcctccaccgaccagcctgtgacttctgagccgacctcgcggactacccgcgggaggaagaatagaagcagcgtcaagactccagaaactgtggtgcctgcagcccccgaactacaaccatcgacttctacagaccagcccgtcaccccagaaccgacatcccgagccactagaggacggacaaataggtcatccgtgaagaccccggagtcgattgtaccaatcgcccctgaacttcagccgagcacaagcaggaaccagctggtgactccagagcctacttccagagcgacccggtgccgaactaacagatcaagcgtgaaaactcctgagcctgtcgtcccaactgcacccgagccacaccccaccaccagcacagaccagcccgttactcctaaactgacatccagagctactcggaggaaaacgaatcggagttctgttaaaactcctaaacctgtggaaccggccgctagcgacctggagcctttcacccctacagaccagagcgtaacaccagaggcaattgcccaaggcggacagagcaagacactgaggagctctaccgtgagagctatgcccgtgcctaccacccctgaatttcagtcccctgtgactacagaccagcctatatcacccgagcctataactcagcctagctgcatcaaaaggcagagggcagccggaaatccaggttcattagccgcccccattgatcacaagccttgtagcgcaccactggaacctaaatcacaagcttctcgaaaccagcggtggggcgcggttcgggccgcagaatcactcaccgccattcccgaacccgccagccctcagctgctggagacgcccattcacgcctcacagattcagaaagtcgagcccgcagggcggtctcggttcacccccgagctccagcccaaggcttcgcaatcacggaaacggagtcttgccactatggactcacccccgcatcagaagcagccacagcggggggaggtatctcagaaaacagtgatcattaaggaggaagaagaggacactgcagagaaaccaggtaaggaggaggatgttgttaccccaaagcctgggaaacgcaaaagggaccaggctgaagaggagcctaacaggatcccatccagatccctccggcggaccaagctgaaccaggagtctactgcaccaaaggtgctttttacaggggtggtcgatgcccgcggcgaacgagctgtcctcgcactagggggcagtttggcagggtctgctgctgaggcatctcatctagtgacggaccggatccggcggacggtcaaatttttgtgcgccctgggccggggaatccctatcctctcactcgattggttgcaccaatcacgcaaggcgggcttcttcctgccacctgacgagtatgttgttacagaccctgaacaggaaaagaacttcggctttagtttacaggatgcccttagtcgggctagagaacgtaggctgcttgaggggtacgagatatatgttactccaggagttcagccaccccccccacagatgggggagatcataagttgctgcggtggcacttacctgcctagtatgccccggagctacaagcctcaaagagtagtgataacctgccctcaggacttcccacattgttctatccctctgcgcgtcggactgcccctcctgtcccccgagtttctactgacaggcgtgctgaagcaagaggccaagcctgaagcattcgtcctcagtccactggaaatgtcttctacttag

SEQ ID NO: 123742 - DNA, 4968 bp, Artificial Sequence
  Description of Artificial Sequence: Synthetic coding sequence
atgtatcatcgactggacgtgagcctgccgttcgtgtcacggggacctttgacagtggaagagacacctcgtgtgcagggtgagacccagcctcaacgactcctgctggccgaggactcagaggaagaagtggacttcctttccgagagaaggatggtaaaaaaatcgcgcactaccagctcatcagtcatcgttcctgaatccgatgaggaggggcatagtccggtgcttggagggttggggccccctttcgccttcaacctgaactctgacaccgatgtggaggaagggcagcagcccgctacagaggaggccagctctgcggcaaggcggggagctacagtcgaagccaagcagtccgaggcagaagtggtcacggagatccagctggagaaggatcagccactcgtgaaggaacgagacaatgatacaaaggtcaaaaggggcgctggaaacggggtggtccccgctggtgtgatactggagcgttcgcagccccccggcgaagactcagacacagatgtcgacgatgattctcggcctccaggtagaccggcagaagttcatctggaacgcgcgcagcctttcggttttatcgacagtgacacagacgcggaggaagagaggatcccagctactcctgtggttatacccatgaagaagagaaaaatcttccacggcgtgggaactcgagggcctggcgccccaggcctggcccatctgcaggagtctcaagctgggtctgacaccgatgtggaggaagggaaggctccacaagcagtgcccttggagaaaagtcaggcaagcatggtgataaactccgacactgacgacgaggaagaagtgtcagctgctttaactctcgctcatctgaaggagagccaacctgctatctggaacagggatgctgaggaggatatgccccagcgcgttgtgcttctgcagcgtagtcagacaacgacagaacgcgactctgacaccgacgttgaggaggaggagctgccagttgagaaccgcgaggccgtgctgaaggatcatactaaaattagggcgctggtgagagcacactctgaaaaggatcagccaccatttggcgacagcgacgactccgtcgaggccgataagagctccccagggatacacctagagagatcacaagcatcaactaccgtggatattaacactcaggtggagaaagaagtgccccctgggtccgccatcatccatataaaaaaacatcaagtctcagtggaaggcaccaaccaaacggacgtaaaggcagtgggtgggcctgcgaaattattggtggtcagcttggaagaagcctggccgctgcacggagactgcgaaaccgacgccgaggagggtaccagtttaacagctagcgttgtggctgatgtgcgaaagagccagctgcctgccgaaggcgatgccggggcggaatgggcggcagctgtcttaaaacaagagcgggcccatgaagtcggtgctcaagggggtcccccagttgcgcaggtagaacaagaccttcccatttcccgtgaaaacctcacggatctggtagtggacacagatacattaggagaaagtacccagcctcagcgagagggagcccaagtgcccaccggacgcgagcgtgagcagcacgtgggcggtaccaaagacagcgaggataattatggggactcagaagacttagacctgcaggctactcaatgctttctggagaaccaggggctcgaagtgcagtccatggaggacgagccaacacaagcttttatgctcacaccccctcaggaacttgggcctagccattgtagcttccagactacaggactgttgaattgcaagatgcccccggccgagaaggcctcgcgaatccgtgctgccgaaaaagtttcacgtggagaccaagaaagccccgacgcctgtcttccaccaacagttcctgaagctcctgcaccacctcagaagcccctgaattctcagtctcagaaacatctggcccccccacccctgttgtcccctctgctgcccagcattaaacccactgtaagaaagactcgccaggacggatcccaggaagctccagaagcccccctgagctccgaactggagccattccatcccaagcccaaaattcgtacaagaaagagtagtaggatgacacccttccccgctacatctgccgctcccgagccccacccaagcacttccactgcacagcctgtgactccgaagcctacatcccaggctactcgctctaggaccaaccgaagtagcgtgaagacccccgaaccagtcgtgcctacagctcccgagctgcaacccagcacgtccacagaccaacctgttacttcagaacctactagccaggtcaccagagggcggaagtcccgctcttcggtgaaaactcctgaaactgttgtgccaacggctttggagttacaaccctctactagtacagatagaccagtgacttctgaacccacgtcccaagctacaaggggccggaagaacaggagcagcgtgaaaacaccagaacctgtggtgcccaccgcgcctgagctgcaaccgtccacaagcactgaccaacccgtgactagcgaacctacataccaagctacacggggacgaaaaaatagatctagtgttaaaacccccgagcctgtcgtgccaaccgctccagagttgcgccccagtacgtctactgaccggcctgttacccccaagccaacctcaagaaccactagaagcagaacaaacatgagtagtgtgaaaaatcctgagtcaactgtccctatagcccccgagctgccaccaagcacttccacagagcagcctgtcacgccagagccaacatcccgcgctactagggggagaaagaatagatcatcgggtaagacccctgaaactttggtacccacagcaccaaaactggagcctagcacttctacggaccagcccgtgactccagagcctacatcacaagccaccaggggaaggaccaaccgaagtagcgttaaaacacccgaaaccgtagtccccacagcccccgaactccagccttccacctccaccgatcagcctgtaacgcctgagcctacctctcaggccaccagaggccggactgatcgctcatctgtaaagacaccggaaaccgtggtgcccacagccccggagctgcaggcgtcggccagcactgatcagcctgtcacctcagagccaacttccaggacgactcggggcaggaaaaaccgctcctcggtaaagacaccagagactgtggtgcccgcagctcccgaactgcagccaagcacaagcaccgatcagcctgttacaccggagcccacaagccgggctactaggggccgcaccaatcggtcttccgtaaagacgccagagagcatagtgcctattgcaccggaactccaacctagcacatcacggaatcagctcgtgacaccggaaccaacctcaagagccacaaggtgccgtacaaaccgcagcagtgttaaaaccccggaacctgtcgtgcccactgctcccgaaccgcacccaactaccagcactgaccagcccgtaactcccaaactgactagcagggccacaagacgaaaaactaacagatcaagtgtaaaaacccctaagccagtagagcccgcagccagcgacctcgaaccatttacaccaacagaccaatccgtcacaccagaggccatagcccagggcggacaaagtaagacacttagatcgagcactgtgcgtgcaatgccggttccgacaactcccgagttccaatcaccagtgaccactgaccaaccgattagcccagaaccaatcactcagccatcctgtatcaagcgacagcgtgcggccggcaacccaggctctctggccgcaccgatagatcataagccatgctctgcaccgctggagccaaagtcccaagctagccgaaaccaaagatggggcgccgtccgcgctgccgaatcccttacagcgatacccgaacccgccagccctcagctgctcgagacacctattcacgcttctcagatccagaaagtcgaacccgcagggagatccagattcacgccagaactgcagccaaaagcttcccagagtcggaagcgaagtcttgctaccatggactcaccccctcatcagaaacagccacaaagaggcgaagtcagtcagaaaactgtgattatcaaagaggaagaagaggatacggctgagaaaccaggcaaggaggaagatgtcgtgacacccaagcccggtaagaggaaaagggatcaggctgaggaggaaccaaatagaattcctagccggtcactgcggagaaccaagttaaaccaggaatccacagcccctaaggtgctctttaccggtgtagtggatgcacggggagagagggcagtgctggctctgggagggtcattggctggatctgctgcagaggcaagtcacctggtcactgatagaattaggaggaccgttaagtttctctgcgccctaggaaggggcattccgatcctctccctggactggctgcaccaatctaggaaggctgggttcttccttccaccagacgagtatgtcgtgacagatccggaacaggaaaagaacttcggattttcgcttcaggacgcgctaagcagagctcgggaaaggcgactccttgaggggtacgaaatttatgtgacgcctggagtgcagccaccgccccctcagatgggcgaaatcatctcgtgctgtggcggtacgtacctcccatccatgcctcgcagttacaagccacaaagggttgtgattacttgcccacaggattttccgcactgctcaatacctctgcgtgtcggtctacccttactctcccccgagttcctactgacaggcgttttgaaacaggaggctaagccggaggcgttcgttctgtcaccactggagatgagcagcacctag

SEQ ID NO: 123743 - DNA, 4968 bp, Artificial Sequence
  Description of Artificial Sequence: Synthetic coding sequence
atgtatcatagattggatgtttccctaccattcgtctcccgcggacccctcaccgtggaggaaacaccaagagtgcagggagaaactcagccccagcggctactgcttgccgaggacagcgaagaagaagtcgactttctgagcgagaggcgcatggtcaaaaaatctcggacaacctcttcttcggtaatcgtgcccgagtccgatgaggagggtcacagtcctgtcctgggagggttgggtccgcccttcgctttcaacctcaactctgatacagacgttgaggaaggtcagcagcccgcaaccgaagaagcatcatcagccgcccgccgcggcgccacagtggaggctaagcagtccgaggcagaagtggtgactgagatacagctcgagaaggaccagccactcgtgaaggagcgggacaatgatacaaaggtgaaacggggtgcagggaatggcgtggttccagccggcgtgatcttggaacggtcccagccgccaggagaggacagcgacaccgacgtcgacgatgatagccggcccccaggcagacccgctgaagtccaccttgagcgtgcccaacctttcggttttatagattccgacacggatgctgaagaggagagaattccagccacccctgtggttataccaatgaagaagcggaagatctttcatggtgtcggtacccgcggaccgggcgctcccggacttgcacacttacaggagtctcaggctgggagcgatacagatgtcgaagaaggaaaggcccctcaggccgttcccttggagaagtcccaagctagtatggtcatcaactccgacacagacgacgaagaggaagtgtcagcagccctgaccctggcccatcttaaagagtcccagccagctatctggaatcgcgatgctgaggaggacatgccacagcgcgtagtactactgcaacgaagccaaaccacgactgagcgggactcagatacggacgtggaagaagaagagctgccggtagagaaccgggaagcagttttgaaagatcatactaaaattcgcgcactggtacgggcccatagcgagaaggatcaaccgccctttggtgattcagacgatagcgtggaggctgacaagtccagtccagggatacatctggagcgtagtcaggcttctacaaccgttgacataaatactcaagttgagaaggaagttcctcccgggagtgccattattcacataaaaaagcaccaggtgagcgtcgaaggtacaaatcaaaccgatgtcaaggcagtgggtggccctgcgaagctgctggtcgttagtctcgaggaagcctggcccctgcatggagactgcgagacggatgccgaggaaggcacctctctaaccgcaagcgtggtggcagacgtgcgtaagtctcaactgccggccgaaggggatgccggagccgagtgggccgcggctgtattgaagcaggagcgggcccatgaagtaggcgcacagggcggcccccccgtcgcacaggtggaacaggatctcccaatctcgcgggagaacctgacagatctggtagtcgacacagatactttaggcgagtcgacacaacctcagcgggaaggcgcccaagtgcccacgggacgggagcgagaacagcacgtggggggaacgaaagatagcgaagataattatggcgactccgaggacctggatctccaggccacacagtgcttccttgagaatcagggtttggaagtgcagtccatggaagatgagcctacacaggcgttcatgcttacgccccctcaagagcttgggccttcgcactgctcttttcagacaacggggctcctgaactgtaagatgccaccagccgagaaggcttcgcgtattcgagccgccgagaaagtgtccagaggcgatcaggagtctcctgatgcatgtctccctcctaccgtgccagaggctcccgccccgccccaaaagcctctcaattcccaaagccagaaacaccttgcacccccccctttgttatcccccctgctgccctctattaagcccacagtccggaagacaagacaggatggctctcaagaggccccagaagctcccctttcctccgagctggaaccattccaccctaaacctaaaatcagaacaaggaagtctagcaggatgacacctttccccgctacatcagccgcaccggagccacacccaagcacaagtacagcccagcccgtgactcctaagcctacaagccaggccacacggtcacgaaccaacagatcctctgtgaagactcccgaacccgtcgtacctaccgcaccagaactgcagcccagcactagtacagaccaaccagtcactagcgaaccaacgtcgcaggtgactaggggccgaaaaagcagatcttcagtgaagactcccgaaaccgttgtacctaccgcactggaactgcaacctagcacatctaccgacaggcctgttactagcgagcctacatcccaggcaactcgtggaaggaaaaatcgcagctccgtgaagacacccgaacctgtagtgcccaccgcaccagaactgcaaccatcgacaagtaccgatcagcccgtcaccagtgagccaacttaccaggcaacccgcggccgaaagaaccggagctccgttaagacgccggaaccggtggtgcccactgcgcctgagcttaggccctccacctctaccgaccgtcccgtcacccctaagcctacaagcagaacgaccagatcccggacgaatatgtctagcgtaaagaatcccgagtctaccgttcccatcgccccggaattgccaccttccaccagcacggagcagcctgtgaccccagagccaacaagtagggcaacacggggacggaagaacagatcctcaggtaagactcctgaaactctggtgcctaccgcccctaaactggagccgtctacctccacagaccagcctgtgacacccgagcccacaagtcaggccactcgcggccggaccaataggtcgtctgtgaaaacccccgagaccgttgtaccgactgctccagagctccagccttctacctccaccgaccagcctgtcacgcccgagccaaccagccaagccacaaggggcaggaccgatcggtcgtcagttaaaactccagagaccgtcgtccctactgcccctgaactgcaagcctccgcctctactgaccaacctgtgacgagcgaacccaccagtcgtaccactcggggcaggaaaaaccggtcttctgtgaagaccccagagacagtagttcccgccgcgcccgctctgcagccctccacctccacagaccagcccgtgacccctgagccaactagtcgagctacccggggccgtaccaaccgtagcagcgtgaaaactcccgagtcaatcgtgcctatcgcgccggaattacagcccagtacctcacgcaatcaattagtgacccccgaacccactagccgggccacaagatgtcggactaaccgctccagtgttaagacaccggaaccagtagtgcctacagcccctgagccccatccaaccacgtcaacggatcagccagtgacgcctaagctgacgtccagggccacaagaagaaagacaaacaggtcatcggtcaaaactccaaaaccagtcgaacccgcagcatcagatcttgaaccctttaccccaaccgaccagagcgtaactcccgaggccatcgcacagggtgggcagtctaaaacactccggagttctaccgttagagccatgcccgtccccaccacaccagagtttcagagtccagtcaccaccgatcagcctatttctccggagccaatcacccagccctcatgcattaagcgccaacgggctgcagggaatcccggcagcctggccgcccccatcgaccacaaaccatgctctgctcctctggagcctaagagccaggcctccagaaatcagaggtggggggctgtaagagccgcagagtcccttacagccattcctgagcctgcctcaccccagctcttagagaccccaattcatgcttcacaaatacagaaggtggaacctgctggcagatcccggttcacccccgagctgcaacctaaggcctcccaatcccgaaaaagaagtctcgcaacaatggactcacccccacatcaaaaacagcctcagagaggagaagtgagccagaagaccgtgatcatcaaagaagaggaagaagatactgcagaaaagcccggcaaggaggaggatgtcgtcacccccaagcctgggaagaggaaaagggaccaggctgaggaagagcccaaccgcattccctcccgaagtctcaggcggacgaagcttaatcaggaatctacagcccccaaggtcttgtttacgggggtggtggacgccagaggggaacgcgccgtgctcgctctcggcggcagccttgcgggatctgctgccgaagcctcacatcttgtcacagataggatacggcggacggtgaaattcttatgtgccttgggtagggggattcctatccttagtttggactggttgcatcagagcagaaaggctggtttctttctcccccccgacgagtacgtagtcaccgacccggagcaggagaagaatttcgggttttctttacaggacgccctgtctcgcgccagagaaaggaggctgctggaaggatatgagatttatgtgactcccggcgtccagccaccacctcctcagatgggagagatcatctcgtgttgcggtgggacttatctgccatccatgccccggtcatacaaacctcagagagttgtgatcacatgcccccaggacttcccccactgctcgatcccattacgcgtgggactccctctgctaagtcccgagttcctgctgaccggggtgctgaagcaagaggccaagccggaggccttcgtactgtctccgctagagatgagcagcacatag

SEQ ID NO: 123744 - DNA, 666 bp, Artificial Sequence
  Description of Artificial Sequence: Synthetic coding sequence
atggaggatactcaggccatcgactgggacgttgaggaggaagaagagacagagcagtccagcgagagcctccggtgtaacgtggaaccagtaggccgtttacacatattctcgggggcccacggtccagagaaggacttcccattacacctaggtaagaacgttgttgggcggatgcccgactgctctgtagcgctgcccttcccgagtatcagcaaacagcatgctgaaatcgagatcctcgcctgggacaaagccccaatcctgcgtgactgcggatcacttaatgggacccaaattctctcttcttccctccccccgcctcagaccagcttactgcctctgagtctgcggctgagactgttgggagaagagcagatagatccgctctcaaggcttctgaaacaactttcaccccagcctctctcataccgcctgcctcctccccagacctcattatcaccactatccccacatctcggcccgctgggggaggagaaaatcgggccgctgtcaagacctttgaaacagttgtgtccgcagcctctgtcatccagcctgcccccaccccagactaatttgagccctctttctccccatctggggccactgggtgctgggcagataggcccacttagtaggccgttaaatcaactgagtctctag

SEQ ID NO: 123745 - DNA, 666 bp, Artificial Sequence
  Description of Artificial Sequence: Synthetic coding sequence
atggaagacactcaggccatagactgggatgtggaagaagaggaagagactgagcagagcagtgaaagtctcaggtgtaatgtcgaaccagttggtagactgcacatattcagtggcgctcatggacctgagaaggactttccgctgcacctgggcaaaaatgtggtgggtcggatgcccgattgctcggttgccttgccctttcccagtatttctaagcagcatgccgaaatcgagatactggcatgggataaggccccaattctgagggattgcggcagtctgaacggtacacagattctgagctcctcgcttccccctccacagacatcattacttccactgtccctcaggctacgcttgctgggggaagagcagattgacccgctgtctcgtctgctcaaacagctgtctccacaacccctatcctataggttacctcctcctcagacttctctaagcccattaagcccccacttgggcccgctcggagaagagaagatcgggcctctatcacgtcccctgaaacagctttgtccacagcccctgagtagcagcttgccaccgccccagactaaccttagtcctctttctccccacctcggacctctgggtgccgggcaaatcggcccactttcccgccccctcaatcaactgtccttgtag

SEQ ID NO: 123746 - DNA, 738 bp, Artificial Sequence
  Description of Artificial Sequence: Synthetic coding sequence
atggaggatacgcaggcaattgattgggatgtggaggaagaggaagaaacagagcagtcctccgaatctctaaggtgtaatgtggagccggtgggacgcctacatattttctctggcgctcatgggccggagaaagactttcctcttcacctgggcaagaacgtagttggcagaatgcctgattgttccgtggcgctgcctttcccatctatcagcaaacagcatgccgagatcgaaatcttagcttgggataaagctcctatcctcagggactgtggcagtcttaatggcacgcagattcttcgtcctcctaaagtcctttcaccaggcgtctcgcatagactccgtgaccaggagctgattctctttgcagacttgttgtgtcagtatcaccggttggatgtgtccctgccttttgtgagtcgcgggcccctgactgtcgaggagaccccaagggttcagggcgaaactcaaccgcaacgtctgctgctggcggaagatagtgaagaggaggtggatttcttgagcgagaggcgtatggtgaaaaaaagtcgcaccacaagtagcagtgtcattgtcccagaatccgatgaggaggggcattcgccggttctcggcgggctggggccaccattcgccttcaacttaaactcagacactgacgtcgaagagggccagcagcctgctactgaggaggccagtagcgccgcacggaggggagcaacagtcgaggcctag

SEQ ID NO: 123747 - DNA, 4968 bp, Artificial Sequence
  Description of Artificial Sequence: Synthetic coding sequence
atgtaccatcgactggacgtatcattaccatttgtcagcaggggccccctcactgtggaggagactcctcgggtacagggcgagacacaacctcaacggctcttactggcggaggattccgaggaggaggtggatttcctttcagaacggaggatggtcaaaaaatccaggactacaagctctagtgtaatagtgcccgaatcagatgaggagggacactcgcccgtgttaggaggtttggggcctccatttgcgttcaatctgaactccgacactgatgtcgaagaaggccagcagcccgctacagaagaagcgagttcagctgctcggaggggagcaaccgttgaggccaagcaatcggaagcggaagtcgtgacggagattcaacttgaaaaggaccagccccttgtgaaggaaagagacaacgatactaaggtaaagcgtggcgcaggaaatggcgttgtgcccgctggggtaatattggagcgttctcagcctcctggagaagacagcgacacagacgtggatgatgacagtcgtccacccgggcgccccgccgaggtgcacctcgaaagagcacagccttttggcttcatagatagcgatacagatgctgaggaggagcgcattccagccactccggtggttataccaatgaagaagcgcaagattttccacggagtcggcacccgtggacccggggcccccggcctcgcccatctgcaggagtcacaggctggctctgataccgatgtggaggaaggaaaagccccccaggcagtccccctggagaagagccaggctagcatggtcattaatagtgataccgatgacgaagaggaagtctctgccgctctgacattggctcatctgaaggagtcacagcccgcgatctggaacagggacgccgaggaggatatgccccagcgagtagtccttctgcagagaagtcaaactaccactgaaagggacagcgataccgatgtcgaggaagaagagctaccagtcgagaatcgggaggctgttcttaaggaccatacaaagattcgggccctcgtgcgggcccattcagagaaggatcaacctccgttcggcgattcggatgactccgtggaggcagacaaaagcagtcctggaattcacctcgagaggtcacaagccagcaccactgttgatatcaatactcaagtggagaaagaggtgccgcccggctcagctataatccatatcaaaaaacatcaggtatcagtggaaggaactaatcagacagatgttaaggcggtgggtgggcctgctaagttacttgtggttagcctggaggaggcttggccactccacggcgattgcgaaacagatgcagaggagggcactagcttaacggcttctgtagtagccgacgtgagaaagagtcagttgccggcagaaggggatgccggagctgagtgggctgccgctgtcctgaagcaggagcgagcccacgaggtgggggcacagggcgggccacctgtcgcccaagtggaacaggacctgcccatttcacgggagaacctgactgatctggtcgtagacaccgatactctgggtgagagcactcagcctcagcgcgaaggggcccaggtgcctaccggcagagagcgagagcagcatgtgggaggtacgaaagattcagaagacaactatggcgatagtgaagacctggatcttcaagcaacgcaatgtttcctggaaaaccaggggctggaggtgcaatccatggaggacgagccaacacaggcgttcatgctgacgcccccgcaggagctcggcccaagtcattgtagctttcaaacgactgggttactcaactgcaagatgccccccgcagagaaagcatctcggatccgcgctgctgaaaaggtgtctcggggagaccaagaatctcccgacgcttgcctcccccccactgtccctgaagctcccgcgcccccgcagaaacccttaaactctcaaagccagaagcacttggcaccaccacctctactttcacccttactaccctcgattaaaccaaccgtccggaaaaccaggcaggatgggagtcaggaggcacctgaggcccccttgtcttccgaactggaacccttccaccccaagcccaaaattcgtaccagaaagtcatcgcggatgactcctttcccagctaccagtgctgcaccagagcctcaccctagtacgtcgaccgcgcaacctgtaacgcccaagccaacatcacaggctacacgatccagaaccaatagaagcagtgtgaagacacccgagcctgtcgtgccgactgcacccgagctgcaaccttcaacttccactgatcagcctgtcacctccgaacctacttctcaggtgacaaggggccggaagagccggagctctgttaagacacctgagacggtcgtccctactgcccttgaactgcagccctccacgtcaacagaccggccggtcacttcggagccgacctcccaagctaccagagggagaaagaaccgcagttccgtgaagaccccggagcctgtcgttcccactgcacccgagctgcaaccctcaacatcaacggaccagcccgtcacttctgaacctacctatcaggctaccagggggagaaagaacagatccagtgtcaaaactcccgagcctgtggtccccacagcccctgagttgaggccaagcacctccaccgaccggcctgtgacgcctaaacctacttccagaaccacgcgaagtcgtactaatatgtcttcagtgaagaaccctgagtccactgtgcctatcgcgcctgagcttccacctagcacgtccaccgagcagccagtgacgcccgaacctacctcaagggctacccgggggagaaaaaacaggtcgtccggcaaaactcccgagactttggtgccaacagcccccaaactggaaccgtccacctcaaccgatcagcctgtgacgcctgagcctacttctcaggccactcgcggccgaaccaatcgatctagcgtgaaaaccccagaaactgtagtgccgacagctcccgagctgcagccttctacttcaaccgaccagcccgttaccccagaacccacctcccaggcaacgcgcggacgaaccgataggtcatccgtgaaaactcctgagactgtggtccctaccgcacccgaactacaggcctctgcaagcaccgatcagcccgttacaagcgagcccacatctagaacgacacgggggcggaagaatcgctcttccgtgaagacgccggagaccgtggtacccgccgctccagagctacagccctccacatcgacagaccagcccgtcacaccggaaccgacctcccgagctacccgcggcagaacgaaccggagctccgttaaaactcctgaaagcattgtccctatcgctccggaactacagccatcaacgtcccgcaaccagctggtgacgcctgaacctacctcacgcgccactcgttgccgaacaaatcgctcctcagttaaaactcctgaaccagtggtgcccaccgcccccgagccacaccccactacaagcacagatcaaccagttactcccaagctcacttccagagccaccagacggaaaaccaaccgctcctctgtgaagaccccgaaaccggtcgaaccagccgcatctgatctggaaccatttacacccacagaccagagtgtgacaccagaggcaatcgctcaaggcggccaatctaagaccttgcggtcctcaaccgtccgcgccatgccagtaccaacaacacccgaattccagtctcccgtgaccaccgatcagcccatcagccccgagcccatcacacaaccgtcatgcatcaagaggcaaagagctgccggaaatcctggtagcttagctgcccccatcgaccataaaccttgctctgcgccgttggaaccaaagtctcaggcctcaagaaatcagcggtggggggccgttcgggcagccgaatctttgaccgctataccagagcccgcctccccgcagctgttggaaacgccaatacatgctagtcagatacagaaggtggagcccgctggacggtccagatttacccccgagttgcaacccaaggcttctcagtcccggaaacgtagtcttgcaaccatggatagccctccccatcagaaacagccgcaaaggggtgaagtcagccagaagaccgtaattattaaggaagaagaggaagatactgccgagaagcctggcaaagaagaggacgttgttactccaaagcctggtaaacgcaagcgcgaccaggccgaggaggaaccaaaccggatcccatctcggtcactccgaagaacgaagctcaaccaagagtccaccgccccgaaagttttgtttaccggtgtggtagatgcaaggggagaacgcgccgtgctggctcttggcgggtctctggccggcagtgctgcagaagcatcacatttggttacagacaggattagacggacagttaaatttctgtgtgccctcggacggggaatcccaatcttgtcgctcgattggctgcaccagtccaggaaagctggcttttttctgccaccagacgagtacgtggtcaccgacccagagcaagaaaagaattttggattctccctgcaggacgccctctcccgtgctcgggaaagacggctgttggagggatacgagatctatgttacccctggtgtgcagccaccgcctcctcagatgggtgaaatcatctcatgttgcggcggcacttatctgccctccatgccccgatcatataaaccacagagggttgtcatcacctgtcctcaggacttcccacactgctccattccactgagggtgggcttgcctctgcttagcccagagtttcttcttaccggagtcctgaaacaggaagccaagccggaggcattcgtgctctcccccctcgagatgtcctcaacttag

SEQ ID NO: 123748 - DNA, 5478 bp, Artificial Sequence
  Description of Artificial Sequence: Synthetic coding sequence
atggaagacacacaggcaatcgactgggatgtcgaggaggaagaagagaccgagcagtcaagtgaaagcctgcggtgtaacgtggagccggttggccggctccacattttctctggcgcccacgggcccgaaaaagatttcccactccacctcggcaaaaatgtggtcggcagaatgcctgattgttcagtagcccttccctttccaagtatctcaaagcagcacgctgagattgagatcctcgcatgggataaggctccaattctcagggactgcggttccctcaacggaacccagattctccggccccccaaggttctctcccctggtgtctcccataggctaagggatcaggaacttatcctattcgctgatctactctgtcaatatcaccggctggacgtcagtctccccttcgtatccagaggacccctaacagtcgaggagacccctcgcgtgcaaggtgaaacccagcctcaacgcctattgcttgctgaggatagcgaagaagaggtggacttcctttccgagcggcggatggttaagaaaagtcgcaccacatcctcttccgttattgtgcctgagtccgatgaggaaggccattctccagtcctgggcggcctggggccacctttcgctttcaacctcaatagcgatactgacgtggaggagggacagcaacctgctaccgaagaggccagctccgccgcacgcaggggtgctaccgtggaggctaagcagtcagaggccgaagtggtgactgaaattcagctggaaaaggaccagccactcgtgaaagaacgtgacaacgataccaaggtcaagcgcggggccggcaatggcgtcgttcctgctggggttatccttgagagaagccagccccccggggaggactccgataccgatgtagacgacgacagtcggcctccaggacgacccgcagaggtgcatttggaacgggcccaaccctttgggtttattgactctgacacagatgctgaagaagaaaggatcccagccacacctgttgtgattccaatgaaaaaacgaaaaatctttcatggcgtgggtaccaggggtccaggcgcaccgggcttggcccacttgcaggagagccaggcgggaagtgacacagacgtggaggaaggcaaagccccgcaagccgtcccgctggagaagagtcaggcttccatggtgatcaatagtgacactgatgacgaagaagaagtgtccgccgctctcactttggcccatttgaaggagtctcagcctgcaatttggaatagagatgctgaagaagatatgccccaacgtgtcgtcctgctgcaaagatcacagacaactaccgaaagagactccgatacagatgttgaggaagaggagctacccgtggagaatagggaggctgtgctgaaggaccataccaagatccgggcgctggtccgcgcccactcagagaaagatcagcctccgtttggcgactctgatgactcagttgaggccgataagtcctcccccgggatccacctggagagatcgcaggcttccacaactgttgatattaatacacaggttgagaaagaggtgccccccggttcagctatcatacacatcaaaaagcaccaggtttctgtggagggaaccaaccaaacggatgtgaaagccgtagggggccctgcaaaactcttagtggtctcccttgaggaagcttggccactccacggggactgcgagacagacgccgaagaaggtacttccctgacagcctccgtggtagcggatgttaggaagtctcagctccccgcagagggagacgcaggcgcggagtgggcggctgcagtcctgaaacaagagcgagcgcatgaagtcggagctcaaggcggcccgcccgtcgcgcaagtggaacaggacctgcctatttcgagggagaatttaacagatcttgtggtggatactgacaccctgggagagtctacacagccccagcgggagggcgcccaggtcccaaccggccgagagagagaacagcatgtgggtggaactaaggattccgaagacaactacggggacagcgaagacttggatcttcaggctacacagtgtttcctagagaatcaggggcttgaggccgtccagtctatggaagacgaacctacacaggcctttatgttgactccaccacaggaactgggcccgagccactgcagtttccaaaccacagggctgctcaattgtaagatgccccccgcggagaaagccagccggataagggctgcagaaaaagtatcacggggcgatcaggagagccccgatgcctgtcttccccctactgtgccagaagctccagcgccccctcagaagccactgaactctcagtcccaaaaacacctcgcccctcctccgctcttatcgcccctgctccctagcatcaagcccacagtacggaaaactcggcaggatgggtcccaggaagcccccgaggccccattatcttccgagctggaacctttccaccctaaaccaaagatcaggacaaggaagtcaagtcggatgacccccttccccgccactagcgctgccccagagccgcacccttccacctccacggctcagccagtcaccccgaaacccactagtcaggccacccgatcaagaacgaacagaagtagtgtcaaaacacccgaaccagtagtcccaaccgccccagaattgcagccttcaacgtcaaccgaccaacccgtgacaagcgaacccacatcacaggtaacaagggggaggaagtctagaagcagcgtgaagaccccagagacggttgtccccactgcgctggaactccagccatctacgagcactgacaggcccgtcacatctgagcccactagccaggctacacggggtcggaaaaataggtctagtgtcaaaaccccagagcctgttgtacccacagctccagaactgcaaccttccactagcactgatcagcccgtgacaagcgagcccacctatcaggctacgcggggccgaaaaaatcgcagctcagtgaaaaccccagagccggtggtgcccaccgcccccgagctgaggccaagcacatctactgaccggcccgtgacacccaagccgacatcccggacaacgcggtcacggacaaatatgagttcagtgaagactcccgagactgtcgtgcccacagctccagagttgcagatctctactagtactgatcagccagttacccctaagcctacctcacggacgactcggtcacgaaccaacatgagcagcgtgaaaaaccctgaatccactgtcccgatcgcccccgagctgccaccgtctacctccaccgagcagccggtgacccccgaacctacttcgcgagcgacacgcgggaggaaaaaccggtctagcggcaagacccctgagaccctcgttcctaccgctccaaagctcgaaccctcaactagcactgaccaaccggtaacccccgagcctacgtcccaggcaacaaggggaagaacgaaccgttcctcagtgaagacacctgagacggtggtcccgacagctcctgaacttcagccatctacatcaacggatcaaccagtaacacccgaacccacatcgcaggcgacaagaggccgaacagataggagcagcgtgaagacacctgagacagtagtacccactgcccccgaactacaagcttccgcatctaccgatcagccggtgacaagcgagcctacaagtcgtaccacaagaggacgtaaaaatagatcaagcgtgaagacgccagaaactgtcgttccagctgctcctgaactgcagccctcaacgtccacagaccagcccgttacgcccgaacccacatctcgggcaacacggggtaggacgaatcgcagctcggtgaagacccctgagtctatcgtgcccatcgcaccagaattacaaccttccacttctcggaatcagctggtgaccccggagccgacttcccgggccaccaggtgtcgcacaaataggtcaagcgtcaaaactcccgagccggtggtgcctacagcgcccgagcctcacccgactacatcaaccgatcagccagtcacccccaagctgacgtcgagggccaccagacgaaagactaatagatcctccgtcaagacaccaaaaccagtcgaacctgccgcctcggatttagagcccttcaccccgactgatcagtcagtgactccagaagcaattgcacagggaggtcagagcaagacactgcgaagtagtaccgtgcgagcgatgccagtgcctacaacacccgagttccagtctcctgttactactgatcagcctatcagccccgagccaattactcagccatcctgcataaagagacagcgggcggctggcaatccaggttctctggcggctccgatcgaccataagccatgctcagcgccactcgaaccaaagtctcaggcctcaagaaatcaaagatggggggccgtccgagccgctgagagcctgactgctatacccgaaccggctagcccccagctactggagacaccaatccacgccagtcagatacagaaggtcgagccagcggggagatcaagattcacaccagaacttcagcccaaggctagtcagtcacgcaaacgcagcttagcgacaatggactcgccgccacaccagaagcagccccaaaggggagaagtgagtcagaagactgtaatcatcaaagaggaagaggaggatacagccgaaaaaccaggcaaggaggaggatgttgtcaccccaaagccaggcaaaaggaaaagagaccaagcagaagaagaacctaaccggatcccttctcgatcactgcggcgcacaaagcttaatcaagaaagtactgcccctaaagtgctattcaccggggttgtggacgctcggggtgaaagagccgtcctcgctttgggcggttcactggcaggaagcgccgctgaagcctcccacctagtgacggatcggatacgaagaaccgtgaagttcctgtgcgcactgggaaggggcatcccaatactttccctcgattggttgcaccaatcccgcaaggccgggttttttctgcctcccgacgaatacgtcgtcactgatccagagcaggagaaaaattttggattttcattgcaagacgctcttagtcgagctagggagagaaggctcctagaaggttatgagatctacgtcacccccggagtccaacccccaccaccgcaaatgggggaaatcatctcctgttgtggtgggacgtacctcccatcaatgccccggagttacaagccacagcgggtggtgattacgtgcccgcaggatttcccacactgctccatcccgttgagggttggcctgcctctactgtcccccgagttccttttaaccggagtgctcaaacaggaggccaaacctgaggctttcgtgttgtcgccactggagatgtccagcacttag

SEQ ID NO: 123749 - DNA, 4968 bp, Artificial Sequence
  Description of Artificial Sequence: Synthetic coding sequence
atgtatcataggcttgacgtcagcctcccctttgtttcccgcgggcccttgactgtggaagagaccccccgcgtgcagggagagacccagccccagcgccttctgttagctgaggactccgaggaagaagtcgatttcctgagtgaaagacggatggtaaaaaaaagccggacaactagcagcagtgtgattgtaccggaatcagacgaggaaggtcactctccggttctcggcggcctgggccccccttttgcctttaacctgaactccgatactgacgtggaggaaggccagcagcctgccaccgaagaggcgtcttctgctgcccgacgcggcgctaccgtcgaagctaagcagagcgaagctgaagttgtgaccgaaattcagttggagaaggatcagcctctggtaaaggaacgcgacaacgacaccaaggtgaaacgcggcgccggaaacggcgtcgttcccgcaggagtgattcttgagcgcagccagccccctggagaggactcagacacggatgttgacgacgatagcaggccacccggccgtcctgcagaggtgcacctcgaacgggcccagccattcgggtttatcgacagtgacacagacgccgaggaagagcggatcccagctacgccagtggtgatccccatgaagaagcgtaaaatattccacggtgtcggcaccaggggcccgggcgcccctggacttgcacatctacaggagagccaagcgggctctgacactgacgtggaagagggtaaagcgcctcaggccgtgcctttagaaaagtcgcaagcaagtatggtcattaattctgatacagatgacgaagaggaggtgtcagccgccctgactttggcccaccttaaagagtcacagccagctatatggaacagagatgccgaagaagatatgccccagcgagtggtcttgttacagcggtctcagaccacgactgaaagagattccgacacagacgtcgaggaggaagagctgccggtagagaaccgggaggcagttctgaaggatcacaccaaaatacgcgccttggtgagagcacacagcgaaaaggatcagcccccatttggcgactcggatgactcagtcgaggctgacaagagctcacccggcattcacctggagaggagtcaagccagcacgaccgtcgatatcaatacacaggtggaaaaggaggtgcctccagggtccgcgatcattcacatcaagaagcatcaggtaagcgtcgaaggcactaaccagacggacgtgaaggctgttggcggccctgccaagctattagtggtgtcacttgaagaagcttggccactgcatggcgattgtgagacagacgccgaggaaggcacttctctgacagccagcgtcgtggccgacgtccgcaagagccagctgccagcagagggagatgccggtgccgaatgggctgctgcagtactgaagcaggaacgcgcccacgaggtgggggcacaggggggacctcccgtcgctcaggtagagcaggatcttccgatctcccgcgaaaatctcaccgacctggttgtcgacactgacactctcggcgagagcacccaaccacaacgagaaggagcccaagtgcccactggaagagagagggagcagcatgtggggggtaccaaggactctgaagataattatggcgattcggaggatctggatctgcaggcaacccaatgcttcctggagaatcagggtctggaggtgcagtcgatggaagacgagccgactcaggccttcatgttaactccccctcaggaacttgggccctcccattgctccttccaaactacgggcctcttgaactgcaaaatgccgccggccgagaaggcatcaaggattcgagctgccgagaaagtttcccggggcgaccaggagtcacctgacgcctgcctgcctcctacagtccccgaagctccggcgccccctcagaagcccttaaacagccagtctcagaaacacctggctcccccccccttgctaagtccactcctcccttcaataaagcctacagtcaggaaaacgaggcaagacggatcacaggaagcaccagaagcgccactctctagcgaactggagccatttcatccaaaacctaagatccgtactcgcaagtcctcgaggatgacacctttccccgcgacttccgccgcgccggagcctcacccgagcacatcaacagcccaaccggtgacccccaagccgacttcacaggctactagaagcagaaccaatagaagttccgtgaagaccccggaaccagtggtccctacagcgccagagctccagccttccacctctaccgatcagccagtgacctccgagcccaccagccaggttactcggggtcgcaaatctcggtccagcgttaagacaccagaaaccgtagtcccaacagctctcgaacttcagccctccacctctacggataggccagtgaccagtgagccgacttcccaggccactaggggcagaaaaaatcggtccagtgtaaaaacaccagagcctgtggtgcccaccgcacctgagctgcagccgagtacttcaactgatcaacctgtgacttctgagcctacctatcaggcaactagaggtaggaagaacaggtcttctgtgaaaacaccggagcccgtggtacctactgctcccgaactgagaccttccaccagtactgatcgccccgtgactccaaagccaacttcccggaccacacggtctaggaccaatatgtccagcgtgaaaaatccggagtccactgtgccgattgctccggaattgcctccaagcactagcaccgagcagccagtgacaccggagcccactagccgggctactagaggaagaaagaacagaagtagtggcaagacccccgagacccttgtgccaacagctccgaagctggagccgagcaccagtacagatcagcctgtaacccccgagcctaccagccaggccacccgcggccggaccaacagaagtagcgtgaaaacccccgaaacagtggttcccactgctccagaactccagccaagcacatcaacagaccagccagtgactccagaacccacgagccaggccactcggggccggacagataggagcagcgtaaagactcccgagactgtcgtgcccacagcgcctgaactgcaggcatctgcgagtacggaccagcctgtgacttccgagccaacgtctcggaccacacggggccgcaaaaatcgttccagtgtcaaaacccctgaaactgttgtcccagccgcccccgaactgcagccatcgactagcactgaccagcccgtgacaccggaacctacttccagggccacccggggtcgcacaaatagaagctctgttaaaacacctgaatccattgtgccaattgcaccggagttacagccatccacctcgcgtaaccagctggtgacgccagaaccaaccagcagagccacccgatgcagaacaaatcgatcatctgtgaaaacacctgaacccgttgtgccaactgcacccgaaccacacccaactacctctacggaccagccagttacgcccaaactgacctcccgggcgaccagaaggaaaacaaacagaagtagcgtgaaaactccaaagcctgttgagccagccgcctccgatctggagcctttcacacctactgaccagtcagtgactcctgaggccattgcccagggcggccagtcaaaaaccctgcgctcatccacagtaagggctatgcctgtgcctaccactcccgagttccagtcccccgttactaccgaccagccaatatcacctgaacccattacccagccctcatgcatcaaaagacagcgcgcagctggcaatcctggctctttggccgcccctatcgaccataaaccctgttccgcgcctctcgaaccaaaatctcaggcaagtaggaatcaacggtggggagcagtccgcgctgcagagtcgcttacagcgatccccgagcctgccagtcctcaacttctggaaacccccatacacgctagtcaaatccaaaaagttgagcccgccggtagaagccgattcactcctgagctgcagcctaaagcctcccagtctcgcaaaagatctcttgctactatggacagtcccccccaccaaaagcagcctcagcggggcgaggtgagccaaaagaccgtgattatcaaagaggaagaagaagacactgctgagaaacctggtaaggaggaggacgtcgtcactccgaagccgggcaaaaggaaaagggaccaggccgaggaggaacccaacaggataccatcacgaagtcttcgccgcactaagctcaatcaggagagcactgcacccaaagtgctcttcactggcgttgtggatgctcgaggcgaaagagccgttttggctcttggcggctccctagcaggctcagctgctgaggcatctcacctggtaaccgatcggatccgtcggaccgtgaagtttctgtgcgcattgggtcggggcatcccaattctgtccctggactggctccatcagagtcgcaaggcgggcttttttctgccgcccgatgagtacgtagtcactgacccagagcaagagaagaactttggtttttctctgcaggatgcactgtctcgggccagagaaagacgcttactagagggttacgagatatacgtgacacccggagttcagccacctccccctcagatgggcgaaatcatctcatgctgcgggggtacctatttgccaagcatgccacgttcttacaagccacagagggttgtaatcacctgtccgcaggactttcctcactgctctattcctctcagggtgggtctgccactgctcagcccagagttcttgctcacaggggtcctcaagcaagaagcaaagcctgaagccttcgtcctaagtccactggaaatgtctagcacttag

SEQ ID NO: 123750 - DNA, 4968 bp, Artificial Sequence
  Description of Artificial Sequence: Synthetic coding sequence
atgtatcacagactggacgtgagcctcccatttgtcagtcgagggccattgacagtggaggagacacctcgcgttcagggtgagacacagcctcagcgcctgttactcgctgaagacagcgaagaagaagtggacttcttgtcagaaaggaggatggtaaagaagagccgcaccacgtcatctagtgtaatcgtcccggagtccgatgaggagggacactcccctgttctgggcggtctaggaccccccttcgcttttaaccttaattccgataccgacgtggaggaaggccagcagccagctacagaagaagcttcctcggcagcccggcggggagcaaccgttgaagcaaaacaaagcgaagctgaggtggtcactgaaatccagttagagaaagaccagccgctcgtcaaagagagagacaatgacacaaaagtcaagcggggggctggtaatggggtagttcccgctggcgtcatcctggagaggtcacagccaccaggcgaggatagcgatacagacgttgatgatgactccaggccccctggaaggcccgcggaagtccaccttgagcgcgcccagccctttggcttcatcgatagtgacacggacgctgaagaggagcgcatacctgctaccccggttgtgatccccatgaagaaacgcaagatcttccacggggtgggcacacgcggcccaggagcccccggattagcacaccttcaggaaagccaggctggcagcgataccgatgttgaggaaggtaaggccccacaagcagttccgctcgagaagtcacaggcctctatggtgataaacagcgataccgacgatgaggaagaggtaagcgctgcacttacactcgcgcacctgaaggaatcccagcctgcaatctggaatagggatgcggaggaggatatgcctcaacgagtggtcttactacagagatctcagaccacaactgagcgggattccgacacagatgtggaagaagaggaactacccgtggaaaacagggaggcagtgctaaaagaccatacaaagataagggccctcgtgcgcgctcatagtgaaaaggatcaacccccatttggagattctgacgattctgttgaggctgataagagcagccccggaatccacctggagagatcccaggcctccacaacagtggatataaacacacaggtcgagaaggaagtccccccaggaagtgcaatcatccacattaaaaagcatcaggtctctgtggagggcaccaatcagactgacgtaaaggcagtcggagggccggctaagctgctggtcgtgagcctggaagaggcttggccgctgcacggggattgcgagactgacgccgaggaaggtacctccctgaccgcaagcgtcgtcgctgacgtgaggaagtcccaactgccagctgaaggggatgctggcgcggaatgggccgccgccgtgcttaaacaggaacgtgctcatgaggttggggcacagggcggtcctcctgtggcacaggttgagcaagacctgccaatttccagggagaatctgacagacctcgtggtcgacacagataccctgggtgagtcaacacaaccccaaagagagggggcacaagtgccgacaggccgggagcgagagcagcacgtcggcggaaccaaagactcagaggataactatggtgattcggaagacctggatctccaggctactcaatgttttctcgaaaaccaggggctggaggtccagagcatggaggatgagcccacacaagccttcatgctgactcctccccaggagctcgggccgtcgcattgctcctttcagaccactgggctcctaaattgtaagatgccaccagcagagaaagcgagcagaatacgtgcagctgagaaggtgagccggggtgaccaagaatctcccgacgcatgcctgccccccaccgtaccggaggctccagcgccaccacagaaaccgctcaatagtcagtcgcagaagcatttggcccctccccccttactaagcccacttttacctagcatcaaaccgactgtgcggaagacgagacaggatggatcacaagaggcacccgaagctccgctctcgtcagagctggagccgtttcacccgaaaccaaagatccgtacccggaagagttcaaggatgaccccatttccggccacaagcgctgcgcccgagccacacccctccacctctactgcccagcctgttacacctaagcccacctcccaggcaaccagatcccggaccaacaggagtagcgtgaaaaccccagaaccagtggtcccaacagcacccgaactccagccatcaacatcaacagatcagccagttaccagcgagcccacgtcccaggtgacccggggccggaaatccagatccagtgtcaagactcctgaaaccgtggtgccaaccgccttagaactgcagccctccacatccaccgaccgccctgttacatccgaaccgacaagtcaggccacacgcggacggaagaatcgttcatccgtgaaaacacccgagcccgtcgtgcctaccgctccggagttacaaccgtcaacatctacagatcagccggtcactagtgaacccacttaccaggccacccgcggaagaaaaaaccggtcctcggtgaaaacccccgagcccgttgtaccaacagcccccgaacttcggcctagtacgtccacagatcggccagtaacacccaagcccacttctcggactactaggtctaggaccaatatgagttcagtgaagaaccctgaatctacagtgccaatcgcacctgaactcccacctagcacatccaccgagcagcctgtaacacctgaaccaactagtcgcgccacacgtggaagaaagaacaggagttcgggtaaaactccagagactctagtgccaaccgccccaaagctggagccctccacatccacagaccagcctgtgacccctgagcctacatcgcaggccaccagagggagaacaaacagaagcagtgttaaaacacctgagactgtcgtcccgactgcccccgagctgcagccctcaaccagcaccgatcagccagttacccctgaaccaacctctcaggcaacgagagggcgaactgaccgatctagtgtgaagacacctgagaccgtggtgccaaccgcaccagaacttcaagccagcgcctcaacggaccaacctgttaccagcgagcccacatcaagaaccaccagaggtcggaaaaatagaagttcagttaaaaccccggagactgtcgttccggctgcacctgaattacagccatccacttccaccgaccagcccgttacccccgaacctacaagtagagcgacgaggggacgcaccaacaggagcagtgtaaagactccagagagtattgttccgattgccccagaattgcagcctagtacttctcgtaaccagctggtgaccccagaacccacctcccgagccacacgctgtcgcactaaccggtcctccgtaaagacccctgagccggtggtgcctacagcccccgaacctcatccaactacatccaccgatcagcctgtaacccccaaacttaccagccgagccacaagaaggaaaaccaaccgcagctcagttaagacccccaagcctgtggagccagcagcctccgacctggagcctttcacaccgaccgatcaaagcgtgacccctgaagccatcgcccaggggggccagtctaagacactcaggtcttctaccgtgcgggccatgcccgttcctacgactcccgagtttcagagtcctgtaacgaccgaccaaccaatcagcccagagccaatcactcagcccagttgtattaagaggcagagggccgctggtaatccaggcagtctggctgccccaattgaccataagccttgttcggccccactcgagcctaaatcacaggcatcaaggaaccagaggtggggtgcggtgcgggcagctgagtcactcactgccatcccagagccagcctctccacagcttcttgaaacacctatccatgcctcccaaattcagaaagtggaaccagcaggcaggtcaaggttcacaccagagctgcagcccaaggcctcccagtcacggaaacggagtcttgccaccatggattctcctccccatcagaagcaacctcagcgaggggaagtgtctcagaaaacggtgataattaaggaagaggaggaagacactgcagagaagccaggaaaggaagaggacgttgtcacccctaagcccggcaagcgtaaacgggaccaggccgaggaggaaccaaatagaattcctagccggagtctcaggcggactaaactaaaccaggagtcaacagctcctaaggtactattcaccggcgtagtggacgcacgaggcgagcgtgccgttttagccttgggcgggtcccttgctggctccgcagccgaggctagccatctggttactgacaggattagaaggacagtcaagttcttatgcgccttggggcgcggcattcccattctaagtctggactggttgcaccagagccgtaaggccggattcttcctgcccccggacgagtacgtggtcaccgacccagagcaagaaaagaactttggtttcagcctgcaggatgccttgtccagagcacgtgagagaaggctccttgaaggatatgagatatacgtgacccccggggtgcagccccctccgccccagatgggagaaataattagttgctgtggagggacatatctgcctagcatgccccgaagctacaagcctcagcgtgtcgttattacctgccctcaggatttccctcactgctcaattcccctcagggtcggactgcctctcctgtcccccgagtttctcctgacaggcgtgctgaagcaggaggccaaacctgaggcattcgtcctgtcgccgctggagatgagctctacatag

SEQ ID NO: 123751 - DNA, 735 bp, Artificial Sequence
  Description of Artificial Sequence: Synthetic coding sequence
atggaagacactcaggccattgattgggacgtggaggaagaagaagaaacggaacaatcttcagaatctctaagatgtaatgtcgaaccagttggtaggctccacatcttctcgggcgctcatgggccggagaaagattttccccttcatctgggcaagaacgttgtcggcagaatgccagactgctccgtcgccctaccatttccctctatatctaaacagcatgccgaaatcgaaatcctagcatgggataaagcacccatcctgagggactgcggctctctgaacggaactcaaattttgcgacccccaaaggttctgtctccgggcgtaagccaccgactgagggaccaagaactgattctcttcgccgacctcctgtgccaataccatcggttggacgtctcgctgcccttcgtgtcacgaggccctctcacagtggaggaaaccccgagggtccagggcgagacccagccacagcgactcctcttggctgaggattcagaggaggaagtcgatttcttatcagagcgtagaatggtaaagaagtctcgcaccacctcttcttctgtcatcgtgccggaatcagacgaggaagggcatagcccagtacttggtggcctgggccccccctttgcattcaatctcaatagcgacactgatgtcgaggaggggcagcagccacaccgcggcggcctgctttcatgccagaagagatgccactgcagggggtag

SEQ ID NO: 123752 - DNA, 5409 bp, Artificial Sequence
  Description of Artificial Sequence: Synthetic coding sequence
atggaagatacacaagccatcgactgggacgtcgaggaagaagaagagacagagcagtcctcggagagtttgaggtgtaatgtggagccagtgggaagactgcatatatttagcggcgcccacgggcctgagaaagactttcctctgcacctcggaaagaacgttgtgggtcggatgcccgattgctccgtggcactgcccttcccatctatttcgaagcagcacgccgagatcgagatcctggcttgggacaaagccccaatacttcgcgactgcggtagtctgaatggaacccaaattcttcgtcctcctaaggtgctctcacctggtgtgagccataggctgcgtgatcaggaactgatcctgttcgcggatctgctttgccaatatcatcggctcgatgtttctttgccttttgtgagcagaggccctctcacagtcgaggagacaccaagggtgcagggtgagactcagccccagcgtctgctcctagcagaggactctgaagaggaggtggatttcctatctgagcggaggatggtgaagaagtctcggaccacttcttcatccgtgattgttccagagtctgatgaggagggccactcgcccgtgttggggggtctcggccctcctttcgcctttaatctgaactccgacaccgacgtggaggagggacagcaacctgctaccgaagaggcatcttctgccgcacggcgtggggccacggtcgaggccaaacagagcgaagcagaagtagttaccgaaattcaactggagaaggaccagcccctggtgaaagagagggacaatgacacaaaagtaaaacgcggcgcaggcaacggcgtggtgccagcaggagtgattctagaacggagccaaccacctggggaggattctgatacggacgtcgatgatgactctcgtcctcctggccgcccagccgaagtccacttggaacgggcccaaccttttggcttcatcgactcggacactgatgccgaagaagaaagaatccctgcgactccagtcgtcatccctatgaaaaagcgtaaaattttccatggtgtcggtactagaggtccaggcgcgcccggactagcacacctgcaggaaagtcaggcaggcagcgatacagatgtggaagaagggaaggccccgcaggccgtgcctctggagaagagtcaggccagcatggttattaattccgacacggatgatgaggaggaggtcagcgccgcacttactctcgcacatcttaaggagagtcagccggccatctggaatagggatgctgaagaggacatgccacagagagtggtcctgttacaacggtctcaaacgactacagagcgggattcagacacagatgtggaagaggaagaactgcctgtggaaaatagagaggctgttctcaaggatcatactaaaattcgggccctcgtgcgcgctcactcagagaaagaccagcccccttttggagattcagacgactctgttgaggcagacaagtcaagtcctgggatccaccttgaaaggtctcaggccagtacaactgtggacataaacacccaagtggagaaagaagtgcctccaggaagtgccatcatacatattaaaaaacaccaggtgtccgtggagggcaccaaccagaccgacgtgaaagcagtaggaggtcctgcaaaactgctggtggtcagtctggaggaagcgtggccactccatggcgattgtgaaaccgacgcagaagagggtacatccctcacagcctcggttgtcgctgatgtccgcaagtctcagctccctgctgaaggtgacgcaggcgcggaatgggctgctgctgttctgaagcaggaacgcgcccacgaggtgggggcacagggggggccccctgttgcacaggtcgaacaggacctgcctatttctcgggagaacctgaccgacctagtggttgacaccgataccctgggggagtccactcagcctcaaagagaaggtgcccaggtgcctactggtagagagcgggagcagcacgtcggaggcactaaagactccgaggataactacggcgactcagaagatttagacttgcaagcaacacagtgctttctggaaaaccaaggccttgaggccgtacagagcatggaggacgaacctacacaagcattcatgctgacacctccccaagaactgggaccaagccactgcagtttccaaacaactggaacactggacgagccctgggaggtactggcgactcaacccttctgcctacgggaatccgaagactcagaaacacagccctttgacacacacttagaagcctacggtccatgtctgtctcccccacgcgcgataccaggtgatcagcaccctgagtcccccgtccacacagaacccatggggatccaaggtcgtgggcggcagaccgtggacaaggtgatgggaatcccaaaggagacagcagagcgggttgggcccgagcgaggtcccctggaaagggaaacggaaaagctccttcccgagcggcagaccgacgtcacaggcgaggaggaacttacaaagggaaagcaggaccgtgaacagaagcaactactcgctagagatacacagagacaggagtctgacaagaatggcgaatcagcttcccctgagagagaccgcgagtcactcaaggtggagatcgagactagcgaggagatccaagagaagcaggtacaaaaacaaaccctgccgtctaaggcgttcgaaagggaggtcgaacgaccagtggcaaaccgggagtgcgatcccgccgagttggaggagaaggtgcccaaggtcatcctggaacgagatactcagcgcggggagcctgaggggggatcccaagaccaaaagggtcaggccagcagccccaccccagaacctggcgtgggggccggggatctgccaggccccacttccgcaccggtgccatcaggcagccaaagcggcgggcgcgggtcaccagtatctcctcgtcggcaccagaaggggttactaaactgtaagatgccacctgcagagaaagccagcaggattcgcgccgcagagaaggtttcgaggggagatcaagagtcgccagacgcgtgtctgccccctaccgtgcccgaagcaccagcccctccgcagaagcctctgaactcccagtcgcaaaaacacttagcacccccacctttgctgtcaccactgctgccctcaattaaacccactgtaagaaaaacgcggcaggatggatctcaagaggcacccgaggcaccgctgtcatcagagcttgaaccgttccatcctaagcctaaaatcaggaccaggaagagctctagaatgactcccttccctgccacgagcgctgcgccaaagctcgagccgtccacaagtacggatcagcctgtcacaccagagcctacgtcacaggcgacccggggcagaacaaatagatccagcgtcaagacccctgaaacggtggtgcctactgcccccgagctccagcccagcacttcgacagaccaaccagtaactccggagccgacaagccaggccaccaggggaagaaccgatagatcttcagtgaaaacccccgaaacagtcgtacccacagctccagagctgcaggccagcgcatctacggatcagcctgtgactagtgaacctactagccgcacgacaaggggcagaaagaataggtcttccgttaaaaccccagagaccgtggtgcctgccgctcctgagttacaaccgagcacatcgaccgaccaaccggtgacccccgaacctacgtcccgcgccacccgcggcaggacgaaccggtcctccgtgaagactcctgaaagcatcgttccaatcgccccagaactgcagccgtctaccagcaggaaccagttggtgaccccagaacccactagtagggcgaccaggtgccgcacaaacaggtcgtccgtcaagactcccgagcctgtggtcccaactgcacccgagccccatcctacgactagcaccgaccagccagttacaccaaaactgacatccagggctacaaggcgcaagaccaacaggtcttcagtgaagacaccaaagccagtggaacccgctgccagcgacctggaaccctttacgcccactgaccagagcgtgactcccgaagccatagcccagggcggccagtccaagacccttcgctcctccaccgtgcgggctatgccggtgcctactactcccgaattccagtctcctgtaactaccgatcaacccatctctccggagcccatcactcagccatcatgtatcaagcgtcagagagctgccggaaacccggggtcactggcagctcccatagaccacaaaccttgtagtgccccactggagccaaaaagccaggcctccagaaaccagaggtggggtgcagtgcgcgccgccgaaagcctcacagctatcccagagcccgcaagcccacagctcctcgagacacccatacacgcttctcagatccagaaggtcgaacctgccggccgatctcgttttacgccagaactgcagcccaaggcctcccaatctcgtaagcgttcgctcgcaaccatggacagccctccacatcagaaacagccgcaacgcggcgaggtttctcaaaaaactgttataataaaagaggaagaagaagatacagccgagaaacctgggaaagaagaagatgtcgtgaccccaaagccgggcaagcggaaaagggatcaggccgaggaggagccgaacagaattccatccaggagcctccgcagaaccaagcttaaccaggagagcacagccccaaaggtgctgtttacaggggtggtcgatgctcgcggagagcgcgccgtgctggcactggggggatccctagccggttctgccgctgaagcaagccacctagtgacggatcgaatcagacggacggttaagtttctgtgcgccttgggacgaggaattcccatcctcagtctagactggctccaccagtcgcgaaaggcaggcttttttctgccgcctgatgaatacgttgttaccgatcccgaacaggagaagaactttggattctctctacaagacgcgctgtccagggctcgagagcgccggctgctcgagggttatgagatctatgtgactccgggggtgcaaccacccccaccccagatgggggagatcatctcttgctgtggtggtacgtacctgccatctatgcccagaagttacaagcctcagagagtggtgatcacatgcccccaagattttccgcattgttctatcccgctgcgcgtgggtttgccactgctgtctcctgagtttttattaacaggcgtgcttaagcaggaggccaagcccgaggccttcgtcttgtctccactcgaaatgtcatcaacctag

SEQ ID NO: 123753 - DNA, 4968 bp, Artificial Sequence
  Description of Artificial Sequence: Synthetic coding sequence
atgtatcaccgactcgatgtgagccttcccttcgtctcacggggtccactgacagtggaagagactccccgcgtccagggggagacacagccccagcgccttctcctcgctgaagactctgaagaagaggtagacttcttaagcgaaaggcggatggtgaagaaaagtaggacaaccagcagctccgttatcgtaccggagtccgacgaggaaggccattctcccgtgctaggcggcctgggcccacctttcgcattcaatttgaattctgatactgacgtggaggaagggcagcagccagccactgaggaggcttcttcagcagcacggaggggggccaccgtggaagctaaacaatccgaagcagaggtcgtgactgagatccagctagagaaagatcagcctcttgtgaaggaaagagataacgataccaaggtgaaacgcggggctgggaatggcgtggtgcccgccggtgtgatactagaacgcagccagccaccgggcgaggattccgatactgacgtagatgacgactctcgccctcccgggcggcccgcggaggtgcacctggagcgagcacaaccttttggatttatagacagcgacactgatgcagaagaagaaagaatccctgcaaccccagtcgtgatcccaatgaaaaagcgcaaaatttttcatggcgtgggaactcgaggcccaggtgcaccaggtctcgcacacttacaggaatcccaggctgggtccgatacagatgtcgaggaaggtaaagctcctcaggctgttcccttagagaagagtcaggcaagtatggtgatcaattctgacaccgatgatgaggaagaggtttctgccgcacttaccctggcccacttaaaggagtctcagccagcaatctggaatcgagatgccgaagaggatatgcctcaacgggttgttctgctgcagcgctctcagacaacaactgaaagagatagcgatacagacgtggaggaagaagagctccctgtggagaaccgggaggccgtgcttaaggaccatacaaagatccgagcactggttagggctcactctgaaaaagaccagcctccttttggcgactccgacgactctgtggaggcagataagagctcccctggcatacatctcgagaggtctcaggctagcacgacagtcgacatcaacactcaggttgaaaaggaagtcccacccggaagtgcgattattcatataaagaagcaccaggtgtctgtggagggtaccaatcaaaccgatgtgaaggctgtcggcggccctgctaagctcctcgtcgtgtctctggaagaggcctggccacttcacggcgattgtgagactgacgccgaggaagggacctcgctgactgcatcagtcgtggctgacgtcagaaagtcccagctgcctgcggagggggatgccggggcagagtgggcagctgctgtgctaaaacaagaaagagcccatgaagtcggggcccagggagggcctccagttgctcaagtagagcaggatctcccaatttcacgtgaaaatctgactgacctggtcgtggacaccgatactcttggtgagtccacccagccccaacgtgaaggggcacaggtaccaacaggtagggagagagaacagcatgtgggtgggaccaaagactctgaggataactacggggatagcgaagatctcgacctccaagcaacccagtgtttcctcgagaaccagggactcgaggtacagtcgatggaagatgagcctacccaggcttttatgctgacaccaccccaggaactaggtccgtcacactgttcttttcagacgacaggcctcttgaattgcaaaatgcctcccgccgagaaagcgagccggatacgggccgccgaaaaggtgtcgcgcggtgatcaagaatctcctgatgcatgcctaccccccactgtcccagaggcccctgcaccccctcagaagcctctcaactcgcagtcccaaaagcaccttgccccaccgcctctgttgagccctttgctgcctagtattaagccaactgtgcgaaagactagacaggacggcagtcaggaagcacccgaagcgccactcagttccgagcttgaaccgtttcatcccaagccgaaaattaggacgcgaaagagctcccgcatgaccccgtttccagcaacaagtgccgccccagagccacatccctcaacttctaccgcacaacccgtcacaccaaaacccacctcacaggccactcgtagcaggacaaatagaagttcggtcaagactcccgaacctgtcgtgccgactgccccggagctccaacctagtacatcaacagatcagcccgtgactagcgagcctacgtcacaggttactagaggccggaagtcacgtagcagtgttaagaccccagaaacggttgtgccaacagccctggagctccaaccttcgacttccactgacaggcctgtgacaagcgagcctacgagccaggcaaccaggggtcgtaaaaatcgcagctctgtcaagacgcctgaacctgtcgtccccactgccccagagctgcagccctccactagcacggatcagccagtaacaagtgagccgacataccaagcaacccgcggcagaaagaaccggtctagcgtgaagaccccagaacccgtcgtgcctacggctcccgaattacgccccagcacctccaccgatcgtccagtgacacctaaacccacttctagaaccaccagatccagaaccaacatgagttccgttaaaaacccagagagcacggttcccatagccccggaactgccaccttctacttccaccgagcagcccgtgacacctgaacccacatctagggccactcgagggcggaaaaatcggagttccgggaaaactccagagacattggtgccaacggcacctaagcttgagccgagcacaagcaccgaccagcccgtgacgcccgagcctactagccaggccactaggggtcgtaccaaccggtcaagtgttaagaccccagagacagtagttcctactgcgccggaactccaaccatccacaagtacagaccagccagtgactccagagccgacaagccaagcaacccggggacggacagatcgctcttcggtcaagacacccgagaccgttgtgcccaccgcacctgagttacaagcctctgcatctacagatcagccagttacatccgaaccaacttcgagaacaacccgtggaagaaagaatagaagcagcgtgaaaacacccgagactgttgtgccagccgcgcccgaactgcagccttccacctcaacagaccagccggtaactcccgagcccactagccgcgccacacgcggccgaactaaccggtcttcagtcaaaaccccagaatccattgtgcctatcgctccagaactgcagccctcaacttcaagaaaccagctggtcacacccgagcctacgtcacgtgccacaagatgcagaacgaatagatcttccgtaaagaccccagaacctgtggtccctacagcccccgagcctcaccccacgaccagcaccgaccagccagtaactcccaagctgactagcagagccacacggcgcaaaaccaatagatcgagtgttaaaacccctaagccggtagagcccgccgccagcgatctggagcctttcactcccactgaccagtcggtgacccctgaggctatcgcacagggtggccaatcgaagaccctgcggagcagcactgtcagggccatgcccgtccccaccacaccggagttccagtctccagttaccacggatcaaccaatctcccctgagccaatcactcaaccgtcctgtattaaaaggcaacgcgcagccggtaacccagggagcttagccgcaccaatcgatcacaagccttgttccgctcctctggagcctaaaagccaggcgtctcggaaccagagatggggggcggtgcgtgccgcagaaagtctgacagctataccggagcccgccagcccccagctgctggaaactcccatccatgctagccaaatacaaaaggtcgaaccagccggcaggtctcgcttcacgcccgagctgcaaccgaaagcgtcgcagtcccgcaaaagatccctggctacgatggactcccctccacatcagaaacagccccagagaggagaggtgtctcaaaaaactgtgatcatcaaagaagaggaagaagacaccgccgagaaacccggcaaagaggaggatgtggttacccctaagccagggaaaagaaaacgcgatcaggccgaggaagaacccaaccggataccgtccaggagcctgcggaggactaaactgaatcaagaatcgacagctcccaaggtgctctttacgggcgttgtggacgctcggggagagagggctgtactggctttaggaggttctctggcagggtctgcggcggaagcctctcacctggtgactgatcgcattagaagaacagtaaagttcctttgcgctctgggcaggggcattcccatattaagcctagattggctgcaccagtcccgcaaggcgggttttttcctgccgccagatgaatatgttgtcaccgacccagaacaggagaagaattttggcttttccctgcaagatgcactgtcccgagccagggaacggcggcttctcgaaggctatgaaatttatgtgacaccaggcgtgcaaccgcctccaccgcaaatgggagagattattagttgctgcgggggcacatatctcccctctatgcccaggagctataaacctcaacgggtagttatcacttgcccgcaagactttccacattgctccattccgctccgggtcggtctccccctgctgtcgcccgagttcctgctgacgggtgttctgaagcaggaggcaaagcccgaagcttttgtgcttagtcccctggaaatgagttccacatag

SEQ ID NO: 123754 - DNA, 5409 bp, Artificial Sequence
  Description of Artificial Sequence: Synthetic coding sequence
atggaagatacgcaggcgatcgattgggacgtggaagaggaagaggagactgaacagtccagcgagagcctaaggtgtaacgtggagccagtaggccggcttcatatctttagtggtgcccacgggccagaaaaagactttcctctgcatctgggtaagaacgttgtagggcggatgcctgactgcagtgttgccttgccattccccagcatcagtaagcaacacgctgagatcgagatccttgcttgggacaaagctccaatccttcgcgattgtggcagtctcaacggaacgcagatcctgcggccacccaaagtgctgtctcccggagtgtcacaccggttgagggaccaggagctgattctcttcgccgatcttctgtgtcagtatcatcgtctggacgtcagccttccctttgtttcccgggggccactgaccgtagaggagactccacgtgtccagggggagacacagccacaacgactactcctagcagaagacagcgaagaggaggtggatttcttgtccgaacgacgcatggtgaagaagtcacgaaccaccagtagtagtgttatagttcccgaaagtgacgaagaagggcatagccccgtccttgggggactgggtccaccctttgccttcaacctaaacagtgacacagacgtagaggaaggccagcaaccagcaactgaggaggcctcatctgccgctaggagaggagcaaccgttgaggcgaaacagagcgaagctgaagtagtgactgagatccagctggaaaaggaccagccgttagtcaaagaacgtgacaacgacaccaaagttaagagaggcgccggtaatggggtggtaccagctggggtgatcctggaacgctcgcaacccccaggtgaggatagtgatactgacgtggatgacgactctcgccctcccggtaggcccgccgaagtgcacctggaaagagctcaacccttcggtttcatcgattctgatacagacgctgaggaagagcggatcccagccacaccggtcgtgatcccaatgaagaagagaaagatttttcacggggtcggtacacggggacccggtgctcctgggctggctcatctgcaggagtcccaggcaggttcagatacagacgtggaggaaggcaaagcaccccaggccgtgccactcgagaagagtcaggcttctatggtgattaatagtgatactgatgacgaggaggaggtcagtgctgcccttactctggcccaccttaaggagagtcagcccgcaatctggaaccgagacgccgaggaagatatgccgcagcgtgtcgtgctgctacagcgcagccagacaactacagaacgagattctgatactgacgttgaagaagaagaactgcccgtcgaaaatcgcgaagccgtactaaaggatcacaccaagatcagggctctggtcagggctcattcagaaaaagaccagcctccattcggcgattccgatgatagcgtggaagctgataagagctcgcccggtatccacttggagagatcacaggcaagcacaacagttgacatcaatacccaagtggagaaggaggtacctccaggctccgcaattatacacataaaaaaacaccaggtcagcgtggaagggaccaatcaaacagatgtcaaggccgttggtggacctgccaagctcttagtggtcagcctggaggaggcttggcctctgcacggagattgtgaaacggatgctgaagaaggtacgtcgctcaccgcttctgtggtggccgacgtccggaaaagccaactccctgccgagggcgatgcaggagcagagtgggcagctgccgtgctgaagcaggagcgcgcccatgaggtcggcgcacagggaggtcctccagtcgcccaggtcgagcaggatctgcctatatcccgagagaatctgaccgaccttgtcgtcgacaccgacaccctcggggagagtacccagccccaacgagagggcgcccaggtgccaactggccgagagcgagaacagcacgtgggcggcacaaaggatagcgaagacaactacggggactcagaagatctggaccttcaggccacccagtgtttcctggagaatcagggtctggaagccgtacagagtatggaagatgagccgacacaggctttcatgttgacccccccccaggagttgggccctagccactgctcatttcagaccacagggacactggatgagccttgggaggttctcgccacccagccattttgtctgagggagagcgaagattcggagacacagccttttgatacccatctggaggcttatggaccttgtttgtcccctccccgcgctatacctggggaccagcaccccgaatcccctgtacataccgagccaatgggcatacaggggaggggcagacagaccgtggacaaggttatgggtattcccaaagaaacggcagagagggtggggccagagagaggtcctctggagagagagacggaaaaacttctgccagagagacagactgatgtgactggagaggaggaattaaccaagggcaaacaggatagggagcagaaacagctcctcgccagagacacacagcgccaggagagtgacaaaaacggcgagtccgcttctcccgaaagagaccgagagtccctgaaggtggagatcgagacatccgaggaaattcaagagaagcaggtccaaaaacagactctaccatcaaaagctttcgagcgcgaggtggaacggccggtggctaacagggagtgcgatcctgccgagcttgaggagaaggtacccaaggtgattctcgaacgcgatacacaacgtggcgagccggagggtggctctcaggatcagaagggccaggctagtagccctacccctgaacctggtgtaggggccggcgaccttcccggaccaacctctgcacctgtgccttcagggagccaatctggaggacggggctcaccggtatccccccggagacaccagaaaggtcttctgaactgtaagatgcctcccgccgagaaggcctcgagaatcagggccgccgaaaaagtatcccgaggggaccaggagtcacccgatgcttgcctgcctccaactgtcccggaggcaccagctcctccacagaaaccgctaaacagtcagagccagaagcacttagccccacctccactcctaagtccactcctccccagcatcaaaccaactgtgcggaagacgagacaagacggctcgcaggaagcccctgaggcgccactgagttccgaactggagcctttccatcccaagcctaagatcaggacccgaaaaagttctagaatgacccctttccctgctacctctgctgctcctaagctagaaccttccacatcgacagatcagccagtcacccccgaacccacttcccaggcaactcggggtcggaccaacaggtcctccgtgaaaacaccagagacagtggtacctaccgcgcccgaactccagccgtctaccagcacagaccagccggtgacgccggagcctacctcccaggccacgaggggacgcacagacagatcgtcagttaaaactcctgaaactgttgttccaacagcgcccgagctgcaggctagtgcctccacagatcagcccgttacttcggagccgacctcaaggaccacacgcggcagaaagaaccggtcttctgtgaagacgcccgagaccgttgtgccggccgctcccgagttgcagcccagcactagtaccgatcagcccgtcacaccggaacctaccagccgagcaacacgcggacgaactaacaggagcagcgtcaaaacaccggaaagcatcgttcctatagcacctgagctgcagccgagcacatcccgaaatcagctcgtcactccagaacccacaagcagggccactcgctgcagaacgaaccgctcgagcgtaaaaacgccagagccggtcgttccgaccgctcctgaaccccatccaacaaccagcacagatcagccagtcacaccaaaactcacttcacgggctactcgacggaaaaccaatagatcctcagtcaaaacgccgaaacctgtcgagcccgccgccagtgatttggaaccattcacacctactgatcagtccgtgacgcctgaggcaattgcccagggcgggcaaagtaaaacccttaggtcatcaaccgtccgggccatgcccgtgccaaccacaccagaatttcagagccccgtgaccacagatcaacccatatccccagagcctataacacaacctagttgtattaagcggcagcgcgccgcaggcaaccccggatcccttgctgcacctattgaccacaaaccgtgttctgcgcctcttgagccaaaatctcaggcttccagaaaccagcgttggggcgcagtgagggcagccgaaagcctgacagctataccagaacccgcatcaccacagctgctggagacaccaatacacgcatcccagatccagaaggttgaaccagctggcagatcgcgattcacacccgagttacagcctaaggcgtcccagtccagaaagaggtccctcgcgaccatggatagcccgccgcaccagaaacaacctcaacgcggagaggtgagtcagaaaactgtgatcattaaagaggaagaagaggacactgctgaaaagccggggaaggaggaggacgtggtcaccccaaaaccgggaaaacgcaagcgggaccaagcagaggaggagcccaataggatccccagccggtctctcaggcgaacgaagctcaaccaagagtccacagccccgaaggtgctctttacaggagtcgtagacgccaggggcgagagagccgtcctggctctgggcggatctctggcgggatctgctgctgaggcttcacatttggtgacagatcgaatcaggaggactgtcaaattcttgtgtgccttgggaaggggcatccctattcttagcctcgactggctgcaccagagcagaaaagcagggtttttcttgccgccggacgagtacgtagtgaccgatcctgagcaggaaaagaatttcggcttttccctgcaagatgccctatctagagcaagggaacgcagattactggaaggttacgaaatatatgtaacccccggggtccagccacctcccccacagatgggagagattatcagctgctgcggtgggacatacctaccaagcatgccccgttcatacaagccacagcgggtggtgatcacttgtccgcaggattttccgcactgctctattcctctgcgggtcggcctcccattgttgagtccggagtttcttctcactggagtgctgaaacaagaggcgaaacccgaagcctttgtgctcagtccactcgaaatgtcaagcacatag

SEQ ID NO: 123755 - DNA, 666 bp, Artificial Sequence
  Description of Artificial Sequence: Synthetic coding sequence
atggaagatacgcaagcaatcgattgggacgtggaggaggaggaagaaaccgagcagtccagcgaatccctgaggtgcaacgtggaacctgtaggaaggctccatatcttcagtggcgctcatggcccggaaaaagatttccctctgcaccttggtaaaaacgtcgtgggacgcatgcccgattgtagcgtggcactgccatttccctctatatccaagcagcatgcggaaatcgagatcctagcatgggacaaggcacccattctccgcgattgcggaagcctgaacgggactcagatccttagtagctcactgcctcctccgcagactagcttactaccactctcgctccgactgaggttgctgggagaggagcagattgacccgctcagccgcctgctgaagcagctgagtccccagcccctctcatatagacttccccctccccagaccagtctcagcccgctgtccccacatctgggcccactgggcgaggaaaagataggtcccttgtccaggccgctgaagcagctctgtccacagcccctgcggagtagtctcccgccaccacagacgaatttaagtccacttagcccccacctcggcccattgggtgctgggcaaattggacccttgagtcggcctttgaatcaactctccctctag

SEQ ID NO: 123756 - DNA, 666 bp, Artificial Sequence
  Description of Artificial Sequence: Synthetic coding sequence
atggaggacactcaggcgattgactgggacgtggaggaggaggaggagacagaacaatctagcgaaagcctaaggtgcaacgtcgagcctgtggggcgtttacacatcttctctggagcccatggcccagagaaggacttcccgctccacctggggaaaaatgtggtggggcggatgcccgactgctctgtagcccttccctttccctccatatctaagcagcatgccgagatcgaaatacttgcttgggataaggccccaattttacgtgactgcggcagcttaaacggcacccagattctctcttcaagcctacccccaccacagacttccctactaccgctttcactgagactcagactgctgggggaggagcagatcgaccccctctctcggctcctgaagcaactttctccccaacctctgagttacaggctgcccccaccccaaaccagcctcagcccattgtccccgcatttggggcctctaggcgaagagaaaataggcccactgagccgtcccctgaaacaactgtgcccccagccccttagttctagcttgccaccacctcagactaacctgtccccactctcaccacatctgggccctctgggtgccggtcagatcggtcccttgagcaggccactgaaccagctctccctctag

SEQ ID NO: 123757 - DNA, 738 bp, Artificial Sequence
  Description of Artificial Sequence: Synthetic coding sequence
atggaagatactcaggccattgactgggacgtcgaggaagaggaggagactgaacaaagctcagaaagcctgcgatgcaatgtggagcccgtgggtcgattgcatattttcagtggtgcgcacgggccggagaaggattttccacttcacctaggcaaaaacgtggtgggccgcatgcctgattgttctgtcgctctaccattccccagcattagcaagcagcacgccgagatcgaaattctggcttgggataaagcccccatcttgcgcgactgcggcagtctcaacggcacacagattctgagaccccctaaagtgttatcaccgggtgtgagccacaggttaagggaccaagaactaatactgtttgctgaccttctgtgtcaataccatcgcttggacgtcagcctccctttcgtctctaggggcccccttaccgtggaggagacaccccgcgtccagggggaaacgcaaccgcaaaggctcctgctggccgaggatagtgaggaagaggtcgactttctgtcagaacggcggatggttaagaagtctcgtaccacgtcatcatccgttatcgttcccgaatcagatgaggaaggccactcccccgttctgggtggtcttggccccccatttgcttttaacttaaattctgacacagacgtggaagaagggcagcagccggctaccgaagaagcctcttccgccgcccgccgcggagctacggtggaagcttag

SEQ ID NO: 123758 - DNA, 5478 bp, Artificial Sequence
  Description of Artificial Sequence: Synthetic coding sequence
atggaggatacccaggcaatcgattgggatgtcgaggaggaggaggaaacagaacagtcttccgagtccctgcggtgtaatgtcgaaccagtgggtaggcttcatattttttccggtgcccacgggccagaaaaagactttcccctgcatcttggaaagaacgttgtgggcagaatgccggattgcagcgtcgccctgcccttcccgagtatatctaaacagcatgctgagatcgaaatcctggcatgggacaaggcccccatcttgcgcgattgtggctccctgaacgggacacaaatccttcgcccaccaaaggtactgagcccgggcgtgtcacacaggcttcgagatcaggaattaattctattcgcggatctactgtgtcagtaccatcggcttgatgtctctttgccttttgtgagtagaggccctctcacggtcgaggaaacgcctcgggtgcaaggagagacgcagccgcagaggctcctcctcgcggaggattctgaggaagaagttgatttcttgagcgagcgccgcatggtgaagaagtcgcgcaccacgagctcctcggtcatcgtgcccgaaagtgatgaggaggggcacagtccagtgttgggaggtctcggccccccgttcgcattcaacttaaatagtgacactgatgtagaagaggggcagcagccagcgacggaggaggcatctagtgcggcccgcagaggagcaactgtcgaagctaagcagtccgaggcagaggtagtgactgagatacagttggaaaaagatcagcctctagtgaaggaacgggacaacgacaccaaggtgaaacgcggagctggtaacggggtcgtaccagccggcgtcattctcgagaggagccagccgcctggagaggatagtgacactgatgtggatgacgactcccgcccccccggccgacctgcagaggtgcacttggagagagcccagccttttggatttattgacagcgacaccgacgcggaagaagagcggatacccgcgactcccgtggtcatacccatgaaaaaaagaaagatcttccacggagtgggtacacgtgggccaggggcaccgggactggcccacctgcaggagagccaggccggctccgataccgacgtcgaagagggcaaggctccacaggcagtgccacttgagaaatctcaggcttctatggtcataaatagcgataccgacgatgaagaagaggtctctgcagccctaactctggcccatctgaaggaaagccagcccgcaatctggaacagggacgcagaagaggatatgccccaacgtgtcgtcctccttcagcgtagccagaccaccacagagcgcgatagcgacaccgacgtagaggaggaggaactgcctgtcgaaaatcgggaggcagtcctgaaagatcacaccaagatcagggccctggtcagagctcactccgaaaaggaccagccgcccttcggcgactccgacgactccgtcgaggctgataaatcctcccccgggatacacctcgagcggtctcaggcaagtacaacagtggacatcaacactcaagtcgagaaggaggtcccccctggctcagcgatcattcacatcaagaaacaccaagtcagcgtcgaagggaccaatcagaccgacgtgaaagctgttggaggcccagctaaacttttggtggtctcactggaggaagcttggccactgcacggagattgtgagaccgatgccgaagagggaacatccctgacagcttctgttgtcgcagacgttagaaagagtcagctgcctgctgagggcgatgccggtgctgaatgggccgctgccgtgctgaaacaggagcgcgcccatgaagtgggcgcccaaggcggcccaccggtcgcgcaggtggagcaggatctgcccattagcagggaaaatctcactgatctggtcgttgatactgacaccctgggggaatccacccagcctcaaagggaaggcgcacaggttcccactggtagagaaagggagcagcacgtgggtggcacaaaggattctgaagataattacggggattcagaagatctggatttgcaggccactcaatgttttttagagaatcaggggcttgaagcagtccagtccatggaggatgagcctactcaggctttcatgctcacccccccacaggagctgggaccaagccactgctcttttcagactacagggttgctcaattgcaagatgccccccgctgagaaagcctcccgcatccgcgccgccgagaaggtgagcagaggcgaccaggagtcacccgacgcctgtcttcccccaaccgtgccagaggcaccagctcctccacagaagccactcaactcgcagtcccagaaacatctcgctccgcccccacttctcagtcctctcctgccttccatcaagcccactgtgaggaaaactcgccaggatggaagtcaggaggcgccagaagctccattatcatctgaactcgaaccgttccacccgaagccaaaaattcggaccaggaaaagctcccgcatgacgccgttcccagcaacatccgccgcccccgaacctcaccctagcacctcaaccgcccagcctgtaacgccaaagccaacctcccaggccactaggtctcgaacaaatagaagttccgtgaagacaccggaacctgtggtgcctacagctcctgagttacagccttctacctccacagatcagccagtgacatccgaacctacttcacaggtcacccgggggaggaaaagccgttccagtgtgaagactccagaaactgtggtccccactgccttggaactacagccctccacctctacagataggcccgtgacatcggagcccacgtcccaggccaccaggggacgcaaaaaccgctcatctgtgaagacgcccgagcccgtggtgccaacagcacctgagctgcagccctctacaagcaccgaccagcctgtgacttctgaaccaacctaccaggccaccagaggtagaaagaaccggtcctctgtcaagacgccagagcccgtggtgccgactgcccctgagctacggccttctacatccaccgatcgtcctgtgacaccaaaacctacatcccggactacacggtctcgcaccaatatgagcagcgttaagaccccggaaactgtcgttcccactgcaccggagttacaaatttctacctccaccgaccaacccgtcacgcctaagcccacctctcggaccacacggtctcgcaccaacatgtcaagtgtgaagaatcccgaatcaacagtgccaatcgccccggagctgcctccgtctacgtctaccgagcaacccgtcacgcctgaacctacgtctagggcgacaagagggcgcaaaaatagaagcagcggcaagacccccgagactcttgtccccacagctcccaaacttgagccaagcactagcactgaccagcctgtgacgcccgagcctacctcgcaggcaactcgcgggaggacgaacaggagctcagtgaaaactccagaaacagtcgtccctaccgccccagaattgcagcctagcacgtctacagaccaacctgtgacacccgaacccacctcccaggcaacccggggacggacagatcgcagcagcgtgaaaacaccagaaactgttgtgccaactgcccccgagctgcaggcgagcgcctcaactgatcaaccagtgacgtccgaaccaaccagccgcacaactcgcggtagaaaaaaccgctcatcagtgaaaactcccgaaacggtagtgcctgccgcccctgaactacagccttcaacctccactgaccagccggtgactcccgaacccacatcccgcgccaccaggggacgcactaaccgatctagtgttaagacccctgagagcatagtacctatcgctccggaattacaaccaagtacctctagaaaccaactagttaccccagagccaaccagcagagccacgagatgtagaacaaaccgctcaagtgttaaaacacccgagcctgtcgtcccaaccgcacctgagcctcatccaacgacttccaccgaccagccagtcacaccgaagctgacttcccgggctacccggcgcaaaacaaatcggtctagtgtaaaaactcctaaacctgtcgagcctgccgctagtgatctggagccattcacacctacagaccaatcagtgacgcccgaagccatcgctcaaggcggccagagtaaaacgctacggagcagcacagtccgcgccatgcctgttcctactacgcctgaattccagtcaccagtaacaaccgaccaacccatctctcctgagccgattacccaaccgtcttgtataaagcgacagagagcagcagggaaccccggaagcctggccgcgcctatcgatcacaaaccttgttcagccccattggagcctaaatcacaggccagcagaaaccagaggtggggcgccgtccgcgcggccgagtcactcacggccatacctgagcccgcttccccccagctgctggagactcctatccacgcatcacagatccagaaggtggagcccgccggccgcagtcgattcactccagaactgcagccaaaggcatcccagagccgaaaaaggagcttggccacaatggattcccctcctcaccagaaacagccgcagaggggcgaagtctctcagaagaccgtgattatcaaggaagaagaggaggatacagccgaaaaacctgggaaagaggaagacgtagtcacccccaaacccgggaagagaaagcgggaccaagcagaagaagaacctaaccgtatacccagccggtccctccggcggactaagctcaaccaggagtcaaccgccccgaaggttctatttactggcgtggtagacgcccggggcgagagggcagtattagcactgggggggagcctggccggttcagcagcagaggcctcccacttagtaaccgatcggatccgccggaccgttaagttcctatgtgcactgggacgcggaatacccatactgtcgctggactggctacaccagtcaaggaaggcagggttctttctgccacccgatgaatatgtggtcaccgaccccgaacaggagaagaattttggattctcactgcaggatgccctgtcccgagccagggagaggagattgcttgagggctacgaaatctacgtaacacccggcgtgcagccgcctcctcctcagatgggcgagatcatatcttgctgcggaggcacgtacctcccctcgatgcctcgctcatataaacctcagagagtggtgataacctgccctcaggacttcccccactgttctattcccctgcgggtgggactgccactgttatcacccgagttcctattgacaggggtactgaaacaagaagccaagcctgaagctttcgtactttcccccctggaaatgagttcaacctag

SEQ ID NO: 123759 - DNA, 735 bp, Artificial Sequence
  Description of Artificial Sequence: Synthetic coding sequence
atggaggacacacaggctatcgactgggacgtggaagaggaagaggaaacagagcagtcctcagaatctcttcgctgcaacgtggaaccggtcggaagattacatatttttagtggcgctcatgggcctgagaaagactttcccttgcatctaggtaaaaacgtagtgggtagaatgccagattgttctgtagccctccctttcccaagtatctcaaagcaacacgcagaaatcgagatcctggcctgggataaagcaccaattctgcgggactgcggatctttgaatggtacccagatcttaaggccccccaaggtgctgagtcccggggtcagccatcggctgagggaccaggaactcattctctttgctgacctgctctgccagtatcacaggcttgatgtatcactcccttttgtgtccaggggcccactcacagtagaagagacccccagggttcaaggtgagacccagccgcaacgtctgctgctggcagaggattcggaggaggaggtcgactttctgagtgaaaggcgcatggtgaagaagtcacgtacaacttcgtctagcgtcatagtacctgagtctgacgaagaagggcactcaccagtgctcgggggcttgggaccaccgttcgcttttaatctcaacagtgacaccgacgtggaggagggacagcaaccgcatcgcggcggattgctgtcttgccaaaaacgttgccattgccgcgggtag

SEQ ID NO: 123760 - DNA, 735 bp, Artificial Sequence
  Description of Artificial Sequence: Synthetic coding sequence
atggaggatacccaggctattgactgggacgtggaggaggaagaggaaactgaacaaagcagcgaaagtcttaggtgtaatgtggagcccgttggacggctacatatcttcagcggagcacacggccctgagaaagattttcctctccacttgggcaagaatgtggtgggcagaatgccagattgctccgttgcactccctttcccatccatctctaagcagcacgccgagattgaaattctagcctgggataaagctccaatactcagagactgtggctccctgaacggaactcagattctccggcccccaaaggtcctaagtcccggcgtgtcccaccggttgagagaccaggaattgatcctattcgctgacctgctatgccagtaccatagactcgacgtgagcttgccctttgtaagtagggggccactcactgtagaggaaacacccagggtccagggggaaacccagccccagcggctgctgctcgccgaggatagtgaggaagaagtggatttcctgagtgagagaaggatggtgaaaaaaagcagaacaacctctagttccgtgatagtccctgagtctgatgaagaaggccactccccagtgttagggggacttgggccaccgtttgccttcaacctcaactcagatactgacgttgaggaaggtcagcagccccaccgcgggggcttattgtcatgccagaaaaggtgccattgtcggggttag

SEQ ID NO: 123761 - DNA, 666 bp, Artificial Sequence
  Description of Artificial Sequence: Synthetic coding sequence
atggaggacacacaggcgatcgactgggacgttgaggaggaggaggagacagagcagagctctgagtcacttaggtgtaatgtcgaacctgtcggacgtcttcacatattttcaggcgcacatgggccagaaaaagacttcccattgcatctaggaaaaaacgttgtgggccgcatgcctgattgttctgtcgcactgcccttcccgagcatttcaaagcagcacgccgagatagaaatcttggcttgggacaaagccccgatcttgagagattgtggctccctcaatggtacacagatcctgtcttcaagcctccccccccctcagacgagcctgctgccactctctcttagactcagactgcttggtgaggagcagatcgatccattgtctagactccttaagcaactgtccccacagcctctgtcatatcggctgcccccccctcagacctcattgagtccgttatctccccacctcggtcctctcggagaggagaagatcggccctctctctagacccctgaagcaactgtgcccccagccattatcctccagcttaccgccaccacagactaatctgtccccgctgtcgccacatctgggccctctcggtgccgggcaaataggccccttatctaggcccctgaaccagctgtctttatag

SEQ ID NO: 123762 - DNA, 666 bp, Artificial Sequence
  Description of Artificial Sequence: Synthetic coding sequence
atggaggatactcaggccattgattgggacgttgaagaggaggaagagacagagcaatcaagcgagtcgctgcgctgtaacgtggagcccgtgggcagactgcatattttctctggagcacatggccctgagaaggacttccctctccacctaggaaaaaacgtcgttggacgtatgccagattgttccgtggcgctgccgttcccctctatcagcaagcagcatgctgaaattgagattcttgcctgggataaagctccaatactacgtgattgcggttcgttgaacggtactcaaattctctcctctagtctcccccctccccagactagcttgcttcccttgagcctgaggctgcgcttattaggcgaagaacagatcgatcctctctctaggttgttaaagcaactgagccctcagccactttcgtacagattgcctcctcctcaaacgtcccttagccctctttctccacacctgggtcccctcggtgaagaaaagatcggaccactctcacgacccctcaagcaactctgccctcaaccgttatcttcctccctgccgcccccccaaacgaacttgagtccactctcaccccacctggggccactgggcgcaggccaaatcggtcccctgtccaggcccctgaatcagcttagcctgtag

SEQ ID NO: 123763 - DNA, 5478 bp, Artificial Sequence
  Description of Artificial Sequence: Synthetic coding sequence
atggaggacacccaagccatcgactgggatgtagaggaggaggaggaaaccgaacagtccagcgagagcctgcggtgtaatgtggagcctgtgggacgattacacatcttctctggagcccatgggccagaaaaggacttcccactgcatctaggcaagaatgtggtcggacgaatgccagactgcagcgtggctctaccattcccatctattagcaagcagcacgcggaaatcgaaatactggcttgggacaaggcccccattctgagggattgtggctcactaaatggcacacaaatcctgcggcctccgaaggtcttgtctcctggggtgtctcatcgcctcagggaccaggaactgatcctcttcgccgacttgttatgtcaataccatcggttggacgtaagcttacctttcgtctccaggggcccactgaccgttgaagagaccccccgggtgcagggagaaacccagcctcagaggctgcttttggctgaagacagcgaagaggaagtagactttctgtccgaacgacgcatggtcaagaagtctaggaccacctccagcagtgtgattgtgcccgagtctgatgaggaaggccattcaccggtgctcggcgggctgggaccgccgttcgctttcaacctgaactctgacacggacgtcgaggaaggtcagcagcctgcgaccgaagaggcatcaagtgctgcacgcaggggcgctaccgtcgaggcaaaacagagcgaagcggaagtggtgacagaaattcaacttgagaaggaccagccgctggtcaaagaaagggacaacgacacaaaagtaaagcggggagcggggaacggggtggttccggctggggtaatcttggaacgaagtcagcctccaggcgaggatagcgatactgatgtggatgacgatagtaggccccccggtcgacctgccgaggtgcacttggaaagagctcagccttttggttttatcgactctgacacagacgccgaagaagaaaggatacccgccacaccagtggttatcccgatgaagaaaagaaaaattttccacggcgtcgggacacggggcccaggggcaccagggttggcccacctgcaagagagtcaggccgggtctgataccgacgtggaagaggggaaggcgccccaagccgttccactggaaaagtctcaggcttctatggtaataaactctgacactgacgacgaggaagaagtctccgccgccttgactctagctcacttgaaagagtctcagcccgccatctggaaccgcgatgccgaagaagatatgccccagcgtgtcgtcttgctgcaacggagccagacaaccaccgagagagattccgacaccgatgtggaggaggaggagctgccagttgagaatcgggaagctgtgctcaaagatcatactaagattagggctcttgtgcgcgcgcattcagaaaaggatcagcccccatttggggatagtgacgactctgtggaggccgacaagagcagccctggtatacacctcgagcgtagtcaagccagcacgacagtggacatcaatactcaagttgagaaggaagtgccaccaggcagcgcaataatccacattaagaagcaccaggtgtccgtggaggggacgaaccagaccgatgtgaaagctgtgggcggaccagcaaagttgctagtggtaagtcttgaggaggcctggcctctgcacggagattgtgaaactgacgcagaagaggggacctcacttacagctagcgtagttgccgacgtgaggaaatcacagttgcctgctgagggggacgccggcgctgagtgggctgccgctgtattgaagcaagagcgggcccatgaggttggcgcccaaggtggtccacccgtggcacaggttgagcaggatctcccgatctcccgagaaaacctgaccgatctcgttgtggacaccgatactctgggtgagtctacccagccccagagggaaggcgctcaagtgcccaccggtcgtgagagggaacagcacgttgggggtaccaaagattcggaggacaactacggagactctgaggatctggatctgcaggccacccagtgtttcctggagaaccaagggctggaagccgttcagagtatggaagacgaacccactcaggcctttatgctcactccaccgcaggaacttgggccttcacactgttcattccagacaacaggtctgttgaactgcaaaatgccacccgctgagaaagccagcagaatcagagctgctgagaaggttagcaggggagatcaggagtccccggatgcatgtctcccacccactgtacctgaagctccagctccgcctcagaagcccttgaatagccagagccagaaacaccttgcccctcctcccttgctcagcccactcctgccttcgatcaagccaaccgtgaggaagacccgccaagatggtagccaggaggcccctgaggcccctctctctagcgagctcgaaccctttcatccaaagccaaagatcagaactaggaagtcatcccggatgacacctttcccagcgacttccgccgccccggaaccacatccgagcactagtacagctcaacctgtcacccccaaacctacgtctcaggcgaccaggagtcgcactaatagaagcagtgtcaaaacgcctgagcccgttgtgcctaccgcgcccgaattacagcccagtacctccacagaccaaccggtgacctccgagccaacctcccaggtgacgcggggtcggaagagccgaagtagtgttaagaccccagagactgtcgttccaacagcgcttgaactgcagccatcaacctccacagatcgacccgtcacgagcgagcccacatcacaggctactagaggaaggaaaaaccgatcctccgtcaaaacacccgagcccgtcgtcccaacggccccagaattacagccgtccacgagtaccgaccagcccgtgaccagcgaaccgacataccaggccacgaggggcagaaagaatcgaagctcggtaaagacgccagagcccgtggtgcccacagcacctgagctgcgccccagcacgtcaacagataggccggtgacgcccaaacccactagtagaacaactaggtccaggacaaatatgtcaagcgttaaaacacctgaaaccgtcgtgccgactgctccggaattacagatttcaaccagtacagatcagccagtgacgcctaaacctacctcaaggaccacaagatcacgcaccaatatgtcctccgtgaaaaaccctgagagcactgtgccaatcgccccagagctccccccgtctacctcaaccgaacaaccagtcactccggagcccactagtagagctacacgcggccggaagaaccgttcaagcgggaagacccccgagacattggtccctactgccccaaagctggaaccgagcaccagcaccgaccaacctgtaactccagaacctaccagccaggctacaaggggtcgaactaaccgatcaagcgtgaaaactcctgagaccgtggttccaaccgcaccagagctccaaccaagtacttccacagaccagccagtgactcctgaaccgactagtcaggcaactcggggacgcacagataggtccagcgtaaagacccctgaaacagtagtccccactgcgcccgaacttcaggcatcagctagcaccgatcaaccagtgacttctgagcctacctctagaaccacgagaggcaggaagaatagatcaagcgttaagacccctgaaaccgtagtgcccgccgcgcctgaactgcagccatcgacctctaccgaccagccagtcacccctgagcccacgtcgagagctacgcgcggacggaccaaccgctcctcagtgaagacccctgagtctatcgttcccatcgcccctgaactgcagccttcaacgagccgcaaccagctggtgactcctgaacctactagccgcgcgacacggtgcagaaccaatcgctcgagtgtaaaaacgcctgagcctgtcgtgcccactgcaccggaaccccaccctacaacatccactgatcagccggtgacaccaaagctgacaagccgagcaacgaggcgaaaaacgaaccgatccagcgtcaagaccccaaagccagttgaaccagctgcctctgacctggaaccgtttactcccacggaccaaagtgtgacgccagaagccatagcgcaggggggtcagtcgaagacactgcgaagctctacagttagggctatgcctgtgccaaccacgcccgaatttcagtccccagtaacaacggatcaacctatttcccccgaaccaatcacgcagccatcttgcatcaaacgccaaagggccgctggtaaccctggttcactcgctgccccaattgaccacaagccatgttctgcgccgctggaaccaaagtctcaggcctctaggaatcaacgctggggtgccgtcagagctgctgagagtctgacggcaatccctgaacctgcatcaccccagctattggagacacctattcatgcctcccagattcaaaaggtcgaacctgcaggccgtagtcgctttactcccgagctacagccgaaggcctcgcagtctcgcaagaggagcctggctacaatggacagcccacctcaccagaagcaacctcagagaggggaagtgtctcaaaaaactgttatcataaaagaagaggaggaggataccgctgagaagccgggcaaggaggaagatgtcgtcactccaaaacctggtaagaggaaacgcgatcaggcagaagaggaacccaaccggattccaagtaggagtcttagacgcacaaagctgaatcaggaaagcaccgccccaaaggtcttgtttaccggcgtagtagatgcccgcggggaacgagcagttttggccctggggggcagcttggccggctccgctgctgaagcaagccacctggtgaccgaccgcatacgacgcaccgtgaagttcctgtgtgcccttggcagaggaatccccatcctcagcctggactggctgcatcaaagcagaaaagccgggttctttctgcctccggacgagtacgttgtgactgatcctgagcaggagaagaacttcgggttctctctgcaggacgcactttcaagagcccgggaacgccgactactcgaaggatacgaaatatacgtgacacccggcgtacaaccgcctccaccccaaatgggggagatcatctcctgctgcggaggaacttatctgccgagcatgcctagaagctacaagcctcagcgtgtcgtgataacctgcccccaggacttcccccactgctctataccactgcgtgtaggtttacctctgctgtctccggaattcttgttgaccggtgtcctcaaacaggaagctaagcccgaagccttcgtcctgagccccctcgagatgagctccacttag

SEQ ID NO: 123764 - DNA, 738 bp, Artificial Sequence
  Description of Artificial Sequence: Synthetic coding sequence
atggaggacacacaagccatcgactgggacgtggaggaagaggaagagacagagcagtcctcggaatctctccggtgcaacgttgagccagtgggtagactgcacattttttccggcgctcatggaccagagaaagactttcccctgcatctgggtaaaaacgtcgtggggagaatgcccgactgtagcgtagctctgccatttcctagtattagcaagcaacatgcggaaattgaaatcttagcatgggataaggccccaatcctgagggactgcggaagtctgaatggcacacaaattctccgccctccgaaagttctgtcacctggggttagccatcgattgcgggaccaggaactgatcttatttgctgatctgctgtgtcaatatcataggctggatgtctcattgccttttgtatcacgcggaccacttaccgtggaagagacccctcgggtccaaggcgagacacaaccacagcgattattgttggctgaggactctgaggaagaggttgacttcctgagcgagcggaggatggttaagaagagcagaactacgtcttccagcgttatagtgcctgaatcggatgaggagggacacagccccgttttgggtgggctgggccccccgtttgccttcaatcttaatagcgatacggacgtggaggagggccagcagcccgctaccgaggaggcttccagcgccgccaggaggggtgccactgtggaggcttag

SEQ ID NO: 123765 - DNA, 2238 bp, Artificial Sequence
  Description of Artificial Sequence: Synthetic coding sequence
atggcgtgtagacagagaggggggagctggtccccaagcgggtggttcaatgccggatggagcacttatagatctatctccctatttttcgcactggtcaccagtggaaacagcatagatgtgagccaactcgtgaacccggcatttcctgggactgtgacctgcgacgagcgagagatcacggtagagttcccgtcctctcctggaacaaagaagtggcacgctagtgtggtagatccgctcggcttggacatgcccaactgcacgtacatcctggaccccgagaagctcaccttgagggctacatacgacaattgcactagaagggttcatggcgggcaccaaatgaccatacgggttatgaacaactcagctgccctccggcacggggcggtgatgtatcagttcttctgccccgccatgcaggtggaggaaacacagggcctgagtgctagtaccatctgccaaaaagacttcatgtcttttagcctgccacgtgtgtttagcggccttgccgacgattctaaaggtacaaaggtgcaaatgggctggagcattgaggtaggtgacggcgcacgggcaaagaccctgactctacccgaagcaatgaaggaggggttcagtctgctgatcgacaaccatcggatgaccttccacgtgccctttaacgccaccggcgtgactcattatgtgcaggggaattcacacctgtatatggtctcattgaagctgacttttatctctcccgggcagaaggttatcttttcttctcaagcaatctgcgcccctgatcctgtgacttgtaatgccacacacatgactctcaccataccggaatttccagggaaactgaagtctgtgtcctttgagaaccaaaatatcgacgtaagccaattacacgataacgggattgatttagaagcaactaacgggatgaaactccatttctccaaaacacttttgaagactaagttatccgagaagtgtctcctccaccagttctatctggccagcttgaagttaacctttctgttaagaccggaaacagtttcaatggtgatttaccctgagtgcttgtgtgagtccccggtttctatcgtcaccggcgagctgtgcacacaagatggcttcatggatgtcgaagtctactcttatcagactcagcccgcgctcgacttaggaaccttgcgggtcgggaattcttcctgccagcccgttttcgaggcccaaagccagggtttggtcagattccacatcccactgaacggttgcggcacgaggtataaatttgaagatgataaagtcgtgtacgagaatgaaattcacgcactgtggactgattttccgccttctaagatatcacgagatagtgaattccgtatgacagtaaagtgtagttatagtcgcaacgatatgttgctaaatattaatgtagaatctcttacgccccccgtggccagtgtgaaattggggcccttcacgctgatcttgcagtcctatcccgacaattcttatcaacaaccttacggagagaatgaatatccactggtgcgctttctccgccagcccatctacatggaggttcgggtgctcaaccgggatgaccctaacatcaagctcgtgctggacgactgttgggccacctcaaccatggaccctgattccttcccgcagtggaatgtagtggttgatggctgtgcctatgatctcgataactaccagaccacctttcaccctgttggaagttccgtgacgcatcctgatcactaccaaagattcgacatgaaggcgttcgcttttgtgagcgaggcccatgttctttcttcccttgtctatttccattgcagcgccttaatttgcaaccggctgagcccagactctccattgtgctccgtgacatgtccagtcagcagccggcaccgcagggctacaggagctacagaggctgaaaaaatgactgtcagtctccccggccctatcctgctcctgagtgatgacagtagtttcagaggcgttggctccagtgacctgaaagcctccggatcttctggggaaaagtcacggtccgagaccggggaggaagtgggctccaggggagccatggatacaaaaggccacaagaccgccggcgacgtgggaagtaaagctgtcgcagcggtggcagcctttgccggagtagtggctacactaggtttcatttattacctctatgaaaaacgcacggtttctaaccactag

SEQ ID NO: 123766 - DNA, 1806 bp, Artificial Sequence
  Description of Artificial Sequence: Synthetic coding sequence
atggctaagacaccctctgaccacctgttaagcacactggaggagctggtcccttatgactttgagaagtttaaattcaaactacagaacacatccgtccaaaaagaacactccaggattccaaggtctcagatacaacgggcccgccctgtaaaaatggcgacactgttggtgacctactatggcgaggagtacgcggttcagttaaccttgcaagtccttagggccatcaaccagcggctgctggctgaggaactacaccgggcggctatccaggatatggggagttgctatgtggcacaggtgggactggagttactcatctcgaacaatccacctatcttcgcaagtgagaccgccggcattaccggccgaccaccagacacagcggcctccccccggtgtcatgcccaggaaggcgatcccgtagacgggacctgtgtgcgggattcctgtagctttcccgaggccgtctcaggccacccccaggctagcgggagtcgctccccggggtgccccagatgtcaggattcccacgagaggaagtccccagggagtctgagtccccagcctctcccccagtgtaagaggcatttaaaacaggtccaacttctattctgcgaggatcatgacgagccgatctgtttgatctgctctcttagccaggagcaccagggacatagggtccgccccatagaagaagtagctctggagcacaaaaagaagattcagaagcagctggagcatctcaaaaagctgcggaagtcgggcgaggagcaacgctcctacggcgaagagaaggctgtgtcctttctcaaacagaccgaggcattgaaacagcgcgtccagcggaagttagagcaagtttattacttcctggaacaacaggagcattttttcgtggcaagcctggaagacgtggggcagatggtgggtcagatacgtaaagcatatgacacgagagtgtcgcaggatattgcactgctcgacgctctgattggtgagctcgaagccaaagaatgccaaagcgagtgggaactcttacaggatataggagacatacttcacagagctaagacggtgcctgttccagaaaagtggacgactccccaggagataaaacagaagattcagctgctacaccagaagtcagaatttgtggagaagtcaaccaaatattttagtgagacactccgttcagaaatggaaatgttcaatgtacctgagttgataggcgcccaagctcacgccgtcaacgtaatcctggatgctgaaaccgcatacccgaatctcatcttcagcgacgacctgaagtcggttcggcttggtaataaatgggaacgcctgcccgacggccctcagcgcttcgacagctgcatcattgtgttgggttctccttccttcctctctggtcgccgctattgggaagtggaggtcggggacaaaaccgcttggattcttggcgcatgcaagactagcattagtcggaaggggaatatgaccctgagccctgagaatggctattgggttgtcatcatgatgaaagaaaacgagtaccaggcatcatccgtgccaccaacccgacttctcataaaggaaccccctaaacgcgtggggatttttgtcgactacagggtaggatccatcagcttttataacgtcaccgcccgttctcacatttatacatttgctagctgtagctttagcggcccgttacagcctattttttctcccggcaccagggatggcggaaagaacactgcacctctcacaatttgtccagtggggggtcaaggcccggactag

SEQ ID NO: 123767 - DNA, 1239 bp, Artificial Sequence
  Description of Artificial Sequence: Synthetic coding sequence
atggcaaaaactccttctgaccacctcctgtctaccctggaagagttagttccctacgactttgaaaagtttaaatttaagctgcagaatacatcggtgcagaaagagcactcccggattcctaggagtcaaatacagcgcgcacgaccagtcaaaatggccacactgcttgtaacttactatggagaggagtatgctgtgcagctgacactacaggttttgcgcgccatcaatcaaaggctgttggccgaggagctccaccgggccgcgatccaagggagacctcccgataccgcagcatctcctcggtgccacgcccaggagggtgatccagtcgatggcacctgcgtcagagattcttgttccttccccgaggcagtgagcggacacccgcaggcttctggaagtcgcagtcccggctgcccacgttgtcaggatagtcacgaaagaaaatccccgggcagtctgtctccccaacccttgccacaatgcaaacggcacctgaagcaggttcagctgttattttgcgaagatcacgatgaacccatctgtcttatctgttccctttcacaggaacatcagggacaccgggtgaggccaatcgaggaagttgcactggagcataaaaagaagatccaaaagcaactggaacatctgaagaagttaagaaagtcgggcgaggagcagcggagctatggcgaagaaaaggcagtctcattcttgaaacaaacagaggctctgaagcagcgggtacaacgtaagcttgagcaggtgtattactttctcgagcaacaggagcactttttcgtggcaagtcttgaggacgtaggccagatggtcggtcagattcggaaagcctatgatactagagtttcacaggacatcgccctgctggatgctctaattggcgagctcgaggctaaggaatgccaaagcgaatgggagctcctgcaggacatcggtgatatactgcaccgagcaaagaccgttccagtacctgagaagtggacaacgccccaggaaatcaaacagaaaatacaattactccaccagaaaagcgagtttgtggagaagagcacaaaatacttttccgaaacccttaggtctgagatggagatgtttaatgatcatagtccgcaacatggcctgggtagctgggaagaaagggattacacacagcactccatgcaggggcccaagcaaggagtaccctgttttctggtggtccggaccgtatag

SEQ ID NO: 123768 - DNA, 1713 bp, Artificial Sequence
  Description of Artificial Sequence: Synthetic coding sequence
atggccaaaactccttcggatcatctgttgagcaccctcgaagagctggttccatacgacttcgaaaagttcaaatttaagctccaaaatacatccgtccagaaggaacactctcggatcccccgcagccagatacaacgggcccggcccgtgaaaatggctactctgctggttacttactacggagaggaatatgctgtccagctaacactccaggtcctgagagctatcaatcagcggttgttggccgaggagctgcaccgggcagccatccaggggcggccaccagataccgctgcttcccctcgctgtcacgcacaggagggtgatccagtggacggaacttgtgtgagagactcttgtagctttcccgaggccgtaagtggccacccgcaggctagcgggtctagatccccaggctgtcctaggtgccaggactcccacgaacggaaaagccctggcagtctatcaccccagcccctcccacaatgtaagcgtcatctgaagcaggttcagcttctattttgcgaggaccatgatgaacccatttgccttatctgctctctgagccaggaacaccagggtcaccgcgtgaggcctatagaggaggtggcactcgagcacaagaagaagatccagaaacagttggagcaccttaaaaaactgcgaaagtctggcgaggaacagagaagctatggcgaagaaaaagccgtttctttcttaaaacagaccgaagccctgaaacagagggtgcagaggaagttggagcaagtctactattttctggagcaacaggagcacttttttgttgcttccctggaagacgtcggccaaatggttgggcagattcgcaaggcctatgacactagagtcagccaagatatcgcgctattggatgctctaataggcgaacttgaggccaaggagtgccagagcgagtgggaattacttcaggacattggtgacattttgcatcgggcgaaaacggtgccagtgcccgaaaaatggactacaccccaggaaatcaagcaaaaaattcagttactgcatcagaagagcgagtttgtagagaagtcaacaaagtattttagtgaaaccttgagatctgaaatggaaatgtttaacgttcccgaactgattggagcacaggcccatgcagtcaacgtgattctggatgccgagactgcttatcctaatctaatcttctcagacgatttaaagagcgtgcgtctaggtaacaaatgggagcgtctgcctgacggtccccaaaggtttgattcctgtattatcgttctcggtagtccgtcctttttgtctggcagacgatactgggaggtggaggtgggtgataagactgcttggatactgggcgcgtgcaagacctctatctctaggaagggtaatatgacactcagtccagagaatggatactgggtagtcataatgatgaaagagaacgaatatcaggcgagtagcgtccctcctacaaggcttcttatcaaggagccaccaaagcgcgtaggcattttcgtggactatcgcgtggggagtatcagcttttacaatgtgaccgcacggtcgcacatttataccttcgcctcctgcagtttcagcggccctctgcagcctatttttagtcctgggacgcgcgacggtgggaaaaacacggctccactcaccatatgtcccgtgggcggccagggccccgactag

SEQ ID NO: 123769 - DNA, 1209 bp, Artificial Sequence
  Description of Artificial Sequence: Synthetic coding sequence
atggccaagacgccatccgaccacctcctcagtacactcgaggagctggtgccatatgactttgaaaaatttaaattcaagctacagaacacatccgttcagaaggaacactctagaattccaaggtctcagatccaacgggcacgtccagtgaaaatggctacactactggttacatattatggagaagagtacgctgtgcagttgaccctgcaggtccttcgagcgattaaccagcggttactggcagaagagctgcaccgggctgcaatacagggtcggccacccgataccgctgccagccctagatgccacgctcaggagggagacccagtcgatggtacctgtgtccgcgactcatgcagcttcccagaggccgtcagcggacatccgcaggcttccggttcccggtcaccagggtgtccacggtgccaggactctcacgaacgaaaatccccgggcagtctctctccccaacccttaccccagtgtaagcggcatttaaagcaggtccagctgctgttttgcgaagaccacgatgagcccatatgcttgatttgcagtttatcacaggaacatcagggccatcgggtacgacccatcgaggaagtagccctcgagcataaaaagaagatccagaaacagttagaacatctcaaaaagctcagaaaatcaggagaggagcagagatcgtacggagaagaaaaggccgtatctttcctgaaacagaccgaagcattgaaacagcgagttcagagaaaactcgagcaggtgtattactttctggaacagcaggagcacttcttcgtagcttcactggaagacgttggacagatggtgggtcagatcaggaaagcatatgatactcgagtcagccaagacatcgctctcctggacgctctcataggagaattggaagcaaaggaatgtcagtcagaatgggaactactgcaggatatcggtgatattcttcatagagctaagacggtcccggttccagaaaaatggaccactccccaagaaatcaagcaaaaaattcagctgttacatcagaaatcggaatttgtggagaaatcaaccaagtacttcagtgaaactttaaggtcagagatggaaatgtttaatggagagtcaagtggcaatggggtctgttggcccggagtggttgcagtgtttccttgtgcggtggaccttcggggtcctatatag

SEQ ID NO: 123770 - DNA, 1338 bp, Artificial Sequence
  Description of Artificial Sequence: Synthetic coding sequence
atggccaagactccttctgatcacctcctgagcacccttgaagagctggtgccttacgatttcgaaaagttcaaatttaaactgcaaaacactagtgttcagaaagaacattccaggattccaaggtcccaaatacagcgagcccgtcctgtgaaaatggctacactgcttgtcacctattacggagaagaatatgcagtgcagctgacactgcaggtccttcgggcaattaaccaacgtctgctcgctgaggagctgcacagagcggcgattcagggacgacctcccgataccgccgcatccccaagatgtcatgctcaggaaggcgatccggtggacgggacctgtgtaagagacagctgtagtttccccgaagctgtctctggccaccctcaagcatctggtagtcgctctcccgggtgtcctcggtgccaggacagtcatgagaggaaaagtcccggatccctttcacctcagcccctgccacagtgtaaaaggcaccttaaacaggttcagctactgttctgcgaagatcacgacgagccaatctgtcttatttgttctctgagccaggagcatcagggccatcgggtccgcccgatagaggaagtggcgcttgagcataaaaagaagatccaaaagcagctggagcatctgaaaaagctcaggaaaagcggagaggagcagaggagctacggagaggaaaaagctgtgtccttcctcaaacagactgaggctcttaagcaacgcgttcagagaaagctggagcaggtgtattattttttagagcagcaggaacattttttcgtcgcgagtctggaagatgtcggacaaatggtaggccaaattagaaaggcttatgacacaagagtctcccaagatatcgcactcctggatgccctcatcggcgagctcgaggccaaggagtgtcaaagcgaatgggaactgcttcaggatataggagacattttacatagagccaaaaccgtgccggtaccagagaagtggaccacaccacaggaaatcaagcagaaaatccagttactgcatcagaaaagcgaatttgtcgagaagtctacgaagtacttttctgagaccctgcggtccgagatggaaatgttcaacgatcacagtccacagcacggactaggaagctgggaagagagagattatacccagcactctatgcagggcccgaagcagggggtcccctgtctatcccttctgtccggacagtgcaacctggcacccctgaatgctaatgcccaggacttctttccttatctgatctttttaagaagctccggcgccgactggagatccggtacttgctgctag

SEQ ID NO: 123771 - DNA, 2067 bp, Artificial Sequence
  Description of Artificial Sequence: Synthetic coding sequence
atggcaaaaacaccctcagatcacctacttagcaccttggaagaacttgtgccatacgactttgagaagtttaagtttaaactgcagaataccagcgtgcaaaaagaacattcacggattccaaggagtcaaatccagagggctcggcctgtcaaaatggccactctactcgtgacctactacggagaagagtacgcagtgcagttgacattgcaggtactccgggcaatcaatcagcggctgctggctgaagagctgcaccgtgctgcgatccaggaatattcgactcaggagaatgggaccgacgatagtgcagctagctcttcacttggagagaacaagccacgctcgctgaaaacccccgaccaccccgaaggaaatgaagggaatggtcctaggccctatggaggtggggcagcatctttgaggtgttcccagcctgaagccgggaggggcctctctcgcaaaccgttgtctaagagacgtgaaaaggcaagtgagggacttgatgcccagggaaagccgaggacccgcagcccagctcttcccggcggacgatcaccaggtccgtgtagggcactcgaaggaggccaggccgaagtccggttgagacggaacgctagcagtgccggcaggcttcagggtctggccggaggcgccccagggcagaaagagtgccgaccatttgaagtctacctaccctccgggaagatgcgccctcggtccttagaagtcacaatctccactggtgaaaaggcccccgctaatcctgagatactcctcaccctcgaagaaaagactgccgccaaccttgacagcgctaccgagcctcgggccagacccaccccagacggcggggcctcagcagacctgaaggagggcccaggaaatccggagcacagtgtgactgggcgcccacccgacaccgccgctagtcccagatgccacgcccaggagggcgatcccgtcgatgggacctgcgttcgcgactcctgttcctttcccgaagccgtgtctggacatcctcaggccagtggctctcgcagccccggctgcccaaggtgtcaggactctcacgagaggaagtccccaggctctctgagcccacagccactcccccaatgtaagagacacttgaaacaagtccagcttttattttgtgaagatcatgatgagccgatctgtcttatatgctccttgtcccaagaacatcagggccatcgcgtgcgtcccattgaggaggtggctctggagcacaagaaaaaaattcagaagcagctggagcacctgaagaaactgagaaaaagtggcgaagagcagcggagctacggcgaagaaaaggcagtatccttcctgaagcagacagaagcattgaaacagcgagtgcaaagaaaacttgaacaggtttactatttcctggaacagcaggaacatttttttgtggcttcacttgaggacgtcggacaaatggttggacagatacggaaagcttacgatacacgtgtgtcgcaggacattgcattgctcgacgccctcatcggcgaactggaagccaaggagtgccagagtgaatgggaattgctacaagatatcggagacatactgcaccgtgcaaagacagtgccagtgcccgagaagtggacaaccccccaggagataaaacagaagatccagctgctccaccagaaatccgagtttgtcgaaaaatctaccaagtacttttccgagaccctgaggtcagaaatggaaatgtttaatgtgcctgaactcattggcgcccaggctcacgccgtcaacgtgatcctcgacgccgaaactgcctatcctaacctgatcttttcggacgacctgaaaagcgtgcggctgggaaataaatgggagaggctccccgatggtcctcaacggtttgattcctgcattatcgtcctggggtcaccatccttcctgtccggccgtcgatattgggaagtagaagtgggggataaaaggttttcctgcctgagcctcagaagttcatgggactacagaagaccacccccttgccctgctaattttcttcatttctag

SEQ ID NO: 123772 - DNA, 2796 bp, Artificial Sequence
  Description of Artificial Sequence: Synthetic coding sequence
atgcccccattgaagagtcctgccgcttttcatgaacagagaaggtcactcgagagggcgaggacagaggattacttgaagagaaaaatccgctcgaggccagagcgttcagagctggtcagaatgcacatcctggaggagacgtccgcggagccttcgctgcaggctaaacaactgaagctgaagcgtgccagactcgccgacgacctaaatgagaaaatcgctcagaggcccggacctatggaactggtcgagaaaaatatcctacctgttgaatcaagtctgaaagaagcaattatagtgggccaagtgaattaccccaaagtcgcggacagttcgtcatttgatgaggactctagcgacgcactaagcccagagcagccagccagccacgagagccagggtagcgttccctcccccctagaggcccgggttagtgagcccctgttgtctgcaacatcagcctcccccacccaggtcgtgtcgcaactcccaatgggccgggatagccgggagatgctttttctggccgagcaaccgcctctccccccccctcctctgctgccaccgtcccttaccaatggcacaactatcccaaccgccaagtcaactcctactttaattaagcagagtcagccaaaatctgcttctgagaaatcccagcgctcaaagaaagcgaaggaattaaagcccaaggtgaagaagttaaaataccaccagtatattcctcctgaccagaagcaggatcggggggcccccccgatggattcgtcctacgcgaagatattacaacaacagcagttatttttgcagctgcagatcctcaaccagcagcaacaacaacatcataattaccaggccattctgcctgcgcctccgaagagtgctggagaggctctggggagttcagggactccacctgtgcgcagtttgtctaccacgaattcctcctcatcaagtggagcacctggaccctgcggcttggctcgccagaacagtacttcactcaccggcaaacccggtgctttgccagctaacctggacgatatgaaagttgctgagttgaagcaggaactgaagttacggtccctgccggtgagcgggacaaagacggaacttatcgagcggctcagagcataccaggaccaaatctctccggtgcctggagctcctaaagctccagccgcaacttccatacttcataaggccggtgaggtggtcgtcgccttccccgcagctcgtctgagtacagggcccgccctagtagcagccggactggctcctgctgaggtagttgtcgccacagtggcatcaagtggcgttgtcaagttcgggagcaccggatcgacgccgcccgtttctccgaccccttctgaacgatcactgctatcaactggagatgaaaattcgactcctggggacacgtttggagagatggtgacttccccgctgacccagcttacgctccaggcttctccattacaaattctggtcaaagaagaagggcctcgcgccggttcctgttgcctttctccaggggggcgggcagaactagaaggccgcgataaagaccagatgctccaagaaaaggacaaacagatcgaggcattgacccggatgctacgacagaagcagcaattagtggaacgactgaagttacagctagaacaggaaaaacgggcccaacagcccgcccccgcacccgctccactgggcaccccagtaaagcaggaaaactcctttagcagctgccagttgagccaacaacctctaggcccagcccacccgttcaatccgagcttggccgcaccagcaaccaatcacatcgatccttgtgcagttgcacctggtcctcccagtgtagtggtgaagcaggaggctttacagcccgagcccgaacccgtccctgcaccgcagctgcttctcggtccacagggaccatccctgatcaaaggtgtcgcaccacctacactgatcacagattcaacgggcactcatctggtcctgacagtcaccaataagaatgccgattcgccaggcctatcatcagggagcccccagcagccgtccagtcagccaggatctcctgcccccgcccccagtgcccaaatggatctggagcatcctctgcagcctctctttgggacaccaacaagcctgctcaagaaggaacctcccgggtatgaggaggcgatgtcacaacagcctaaacagcaggaaaatggctcatcttctcagcaaatggatgacctgttcgatatcctcatccagtctggcgagatttctgccgacttcaaagagcctcctagtttgccaggcaaggagaaaccatcccctaagaccgtatgtggttcccccttagccgcacagccttccccaagtgcggaattgccacaggcagcgccccctcctcccggatcaccatctctgcctggaagactcgaagattttctggaaagctccactggactgccgcttctcacaagtgggcacgatggacccgaaccactgagcctgattgatgatttgcattctcagatgctgtcgtcaacagcaatcctcgaccatccaccatcacccatggacacaagtgagctgcacttcgtccccgagccctcatccactatgggtcttgacttggcggatggccatctagatagtatggactggctggaactgtccagcggggggcccgttctcagcctggccccgctgtccacaacggcaccctctctcttttctaccgatttcctggacgggcacgatcttcagttgcattgggactcttgtctgtag

SEQ ID NO: 123773 - DNA, 2397 bp, Artificial Sequence
  Description of Artificial Sequence: Synthetic coding sequence
atgcctcccctgaagtcccctgctgctttccacgagcagcgccgtagtctggaaagagccagaacagaagactatctcaaaaggaagattcggtcccgccctgaaagaagcgagctcgtacgaatgcacattttggaggagacaagcgccgagccaagcctccaggccaaacaacttaaactgaaacgcgcacggctggcagacgacctgaatgagaagatcgctcagcggccaggaccgatggagttggtggagaagaacatcttacctgtggagagttctcttaaagaggccataattgtcggacaggttaattaccctaaggtggctgattcctcctcattcgatgaggactccagtgacgcactttcgccagaacaacccgccagccacgaaagccagggaagcgtgccgtcccctctggaggcccgggtatccgagccgctcctgtcggctacgtcagcctcaccaacccaggtggtgtcacagctgccaatggggcgagactcaagagagatgctctttctggctgaacagcctccactgccacccccgccacttctgcctccaagtcttacaaatggtacaacaatacctaccgcaaagagtacaccaacactgattaagcagtcccagcccaaatctgcctccgaaaaatcccagaggagtaaaaaagcaaaagaactgaagccaaaagtgaaaaagttgaaataccaccagtatattccccctgatcagaaacaagaccgtggtgctcccccgatggattctagctacgctaagattctacagcagcaacagttattcctgcagctgcaaatcctgaaccagcaacagcagcagcaccataattaccaggcgattttacctgccccacccaagtcagctggtgaagcgctagggtccagtgggacaccacctgtgcggtcactcagtaccaccaactcctcctcaagctccggtgcgcctggcccctgcgggctggcacgccaaaactccacctccctgacaggaaagcccggcgccctaccagccaacctggacgacatgaaggtcgccgaacttaagcaagagctaaaacttcgcagcctgccagttagtggcacaaaaaccgagttgatcgaacgattgcgtgcgtaccaggaccagatctcccctgtccctggagcccctaaagcgcctgcagccactagcatcctgcacaaagccggagaagtcgttgtcgcgttcccagcggcccgtctgtctacagggcccgctctagttgcggccggacttgcccctgcggaagtggtggtggccaccgttgcaagctcgggtgtggtcaaattcggatctaccggctctaccccccctgttagccccacaccttctgagcggagcctcctgagcaccggtgacgagaattccacacctggagatacgtttggtgagatggttacctctcccttaacccagctcacactgcaggcttccccgttgcagatcctggtcaaggaggaaggcccgcgggctggtagctgctgtctaagccctggcggcagggccgaactggagggccgtgataaggaccagatgctgcaagagaaagacaagcagatcgaggccttaacaaggatgttacgacagaagcagcagttggtcgagcgactcaagctgcagttggagcaggagaagcgggcgcaacagcccgcacctgcccccgcccctctggggactcctgtcaaacaagaaaattcgttctcttcctgccagctgagccaacagccgctgggtcctgcgcatcccttcaatccaagccttgctgcgcccgctactaaccacattgatccctgtgctgtggctcctggaccacccagtgtggtcgtaaagcaggaggccctgcaaccagagccagaacctgtccctgctccacaactgcttcttggaccacagggaccaagtctcatcaagggcgtggctcccccaaccctgatcacagacagcactggaacccatctggtgttgaccgtgactaacaagaacgctgattcgcctggcttgtctagtggttctccgcagcaaccctccagccaacctggaagtccggccccagcgccgtccgcacagatggacttggagcacccgctccaaccactctttggtacccctaccagcttgttgaagaaagagcctcccggatatgaggaagcgatgagtcagcagcccaaacagcaagaaaatggctcaagttcacaacagatggatgatctctttgacattttgatccagtcgggcgggaacccacgaaacttttcccgcttccaaggcgctgccattccagcacgtgaaggcgaggcaatcccagaggattccctgtgggtccctcccgggtcaactgctataactttctgttag

SEQ ID NO: 123774 - DNA, 2646 bp, Artificial Sequence
  Description of Artificial Sequence: Synthetic coding sequence
atgccaccactaaagtctcccgctgcattccacgagcagagacgatcacttgagagggcacggaccgaggactacctgaaacgcaagatacgctcacgtcccgagagatctgagctggtgcgtatgcatatcctggaagagacgagcgccgaaccaagtctccaggctaaacagctaaaactgaaaagagctaggttagcggacgacctaaatgagaaaattgctcagaggccaggaccgatggagctggtggagaagaacatattacctgtggagtcctctcttaaagaggcaatcattgttggccaggtgaactaccctaaggtagctgatagttcgagctttgatgaggattcaagtgatgcgcttagccctgagcagccagcctctcacgagtcacagggtagcgtgccctctcctctagaagctcgcgtatcagagccactgctaagcgctacttccgccagccctacacagcagagccagcccaaatcggcctcagaaaagtctcaacgaagcaaaaaagccaaggaactgaagccaaaagtgaaaaaacttaaataccatcagtacattccgcctgaccagaagcaggataggggcgcgcctccaatggacagctcgtacgcgaagatactgcagcagcagcaactctttctacaactgcagatcttgaaccagcagcagcagcaacaccacaattatcaggcgatcctgcccgctcctccaaagtccgcgggcgaggccttgggatcttcgggaacaccccccgttcgctccctgagtactactaattccagttcttcctccggtgcgccaggcccatgtggcctagctcgacagaactccacctctttgaccggcaaacctggtgccttgccagcaaacctggacgacatgaaggtggctgagcttaaacaggaactaaagctgaggagcctgcctgtcagtggtaccaagaccgaactgattgagcggctgcgggcctaccaggatcaaatcagtcccgtacctggggcaccaaaagcacccgctgccacatcaatccttcataaggccggcgaagtagtggtggccttcccagcggcccgactctcaacaggcccggctctcgtggcagccgggttggctcccgctgaggtcgtggtggctaccgtagcttcatctggtgtcgtgaaattcggctctactggctcaaccccccccgtgagtccgacaccttcagagagatcactgctgagcactggcgacgagaattccacccctggcgacacctttggggaaatggtcacgtccccgttaacacaactgaccctacaggcatcacctcttcagatcttagtgaaggaagagggaccacgggccggatcctgttgcctgtcacctgggggccgagccgagctggaggggagagacaaggaccagatgcttcaggagaaggacaagcagatcgaagccctcactcgcatgctgcgacagaaacagcagctagtagaacggctgaaactgcagctcgagcaagagaagagagcccaacagccagctcccgcacctgcacccctgggtacaccagtcaagcaagagaactcgtttagctcctgccagctgtcacagcagccactcggtcctgcccacccattcaatccaagtcttgccgccccagcaacaaatcatatcgacccttgcgctgtggcgcccggtccccccagcgtggtggtgaaacaagaggcccttcagcccgagcctgaaccggttcccgctccacagttgctgctaggcccacagggtcctagtctcattaagggcgttgccccccctaccttgatcacagattctaccggcacccatctcgttcttacagttacaaacaaaaacgctgacagtccaggcttgagcagcggcagcccacaacagccgagctcccaacctggaagccccgcccctgcgcctagcgctcagatggacctggagcaccccctccagccactgttcgggacaccaacttccttgctaaagaaggaaccacccggctacgaggaggcgatgtctcagcaaccaaaacagcaggagaatggatctagctcccagcaaatggacgacctgttcgacattctgatccaaagcggcgaaatctccgccgatttcaaggaacccccctcacttccgggtaaggaaaagcccagcccaaagaccgtttgcggatctcctttggcagctcagccatctcccagcgcagaattgcctcaggcagcccctcctcctcccgggagtccgagtctgcccggacgcctcgaggacttcctcgagtcttctaccgggctcccccttttaaccagcggccatgacggccccgagccactgtctctgatagacgatttacacagccagatgttatcctcgacagcaattcttgaccatcctccaagcccaatggacacctcagagctgcattttgtccctgaacccagttccacaatggggctggatctagcggatggacacctagatagcatggattggctcgagctcagcagcggcggccctgttctgagcttagcacccttgagcactaccgctccttcgttattctctacagatttcttggacggtcatgatctgcagttacactgggatagctgtctttag

SEQ ID NO: 123775 - DNA, 2796 bp, Artificial Sequence
  Description of Artificial Sequence: Synthetic coding sequence
atgccccccctcaagtcacctgcggcctttcacgaacagagaagaagtctggaacgcgcacgtactgaagattacctcaagcgaaagatcaggtcccgacccgaacggagcgaactcgtgagaatgcacattctcgaggagacctctgcggagccttccctacaagcgaagcagttgaagctgaaaagagctcgactcgccgatgatctgaacgaaaagatcgctcagagacccggccccatggaacttgttgagaagaatattctgcccgtcgaaagctcccttaaggaagccataatcgtcggacaggttaactaccccaaagtggcggactcttcgagtttcgacgaggattcgtccgacgccctctcgccagaacagccagcaagtcatgagagccaaggttccgtgccctctccacttgaggccagagtaagtgagcctttgctgagtgcgacctctgccagtccgacccaagtggtatcccagctgcccatgggccgcgattcgcgcgaaatgctcttcctggccgagcagccacccctgccgcctccccctctgcttcccccaagtttgactaatggaaccactattcccacagcaaagagcacaccaacactgattaaacagagtcaaccgaaaagcgcctccgaaaagtctcaaagatccaaaaaagctaaggagcttaagccgaaggtcaagaaactcaagtaccaccagtacattccacccgaccagaagcaggaccgaggtgctccccctatggactcctcctacgccaagattttgcagcaacagcaactctttctccagctgcagatactcaaccaacagcagcagcagcaccacaactatcaggccattctaccagctccacccaaatccgccggcgaagcactaggatcgagcggcaccccgccagtaagatctttatctacaaccaattcttccagcagcagcggagcacccgggccatgcggcctcgctcgccagaattcaactagcctgactggtaagccaggggcactccctgcaaatctcgatgatatgaaagttgcagagctcaaacaggaactcaaattgcggagcttgcccgtaagtgggaccaagaccgaactcatagagaggttgcgcgcatatcaggatcagatttcgcctgttccaggcgcccctaaagctcctgcagcgacttcaatcttacataaagccggtgaggtcgtggttgcattcccagcagccaggcttagtaccgggcccgcactggtggctgcaggactggctccggccgaggttgttgtggctaccgtagcatcctctggggtcgtgaagtttgggtcgactggatctaccccgcctgtatcaccgacaccatctgaacggtcactgctatctactggcgatgaaaatagtacgcctggggacacattcggcgagatggtgacttcgcccttgactcagctgacgttgcaggcaagcccattgcagatcttagtgaaggaggaaggtccacgggccgggtcctgttgtctctcgccggggggaagggcagagctggagggtagggataaggatcaaatgttgcaagagaaagataagcagattgaagccctcacgaggatgctgcggcagaagcagcagctggttgaaagactgaagttacagctcgaacaagagaaaagggcacagcagcccgctccagctcccgcccccctgggcacccctgttaaacaggagaacagcttttcatcatgccaattatctcagcaaccactaggccccgcgcatccgtttaatccaagtctggccgcccccgcgaccaatcacatcgatccctgtgccgtggcaccgggaccaccttccgtagtggtcaaacaagaggctttgcagccagagccagagcccgtgccggcaccccaactgttactaggcccacaaggcccaagcttgatcaagggtgttgctccaccaactctcattaccgatagcaccggaacccacctggttcttactgtcacaaacaagaatgctgattctcccggcctctcgtccggaagtccccagcaaccctcatctcagcccggaagtcctgcccccgccccttcagcgcagatggatctggaacacccactgcagcctttgttcgggactcctacttccctgctgaagaaagaaccaccggggtacgaggaagccatgtctcagcagcctaagcagcaggaaaatggctcttcctctcaacagatggatgacctctttgatatactcatacaaagtggggagatctcggccgattttaaagagcccccaagtctgcccggcaaggagaaaccatctcccaagactgtgtgcggctctccattggccgcacaaccctcaccctctgccgagcttccgcaggccgctccaccccctcccggttccccaagcttacctgggcgtctggaagatttcttagaaagctccaccgggttgccactgctgacctcaggacatgatggcccagaacctctttccctaattgatgaccttcactctcagatgttgtccagcaccgccattcttgatcaccccccctcaccaatggatactagtgaactccatttcgtgcctgaacctagctcgactatgggcctcgacttagcagatggccatcttgactccatggactggttggagctgtcgtctggggggcccgtgctgtcattggctccgcttagtaccaccgcacccagtctgttcagcaccgacttcttggatggccatgatctgcagctgcactgggactcatgcctatag

SEQ ID NO: 123776 - DNA, 258 bp, Artificial Sequence
  Description of Artificial Sequence: Synthetic coding sequence
atgttgtcaagtacagccatattggaccacccaccctcccccatggacacatccgagctgcacttcgttccagaaccgagctcgaccatgggacttgacctggccgacggccacctggactcaatggactggctagagttgagctctggtggtccggtcctcagtctcgctcccctttctacgacagcaccatccctgtttagtacagacttcctggacgggcacgacctacaactccactgggattcatgcctgtag

SEQ ID NO: 123777 - DNA, 1524 bp, Artificial Sequence
  Description of Artificial Sequence: Synthetic coding sequence
atggctggcaggggttccctagtgtcatggagagcttttcacggttgcgactccgcagaggagctccccagggttagtcccagattcctgcgagcctggcacccaccacccgtctccgcaagaatgccgactagacgttgggctcccggaacgcagtgtatcacaaaatgtgaacacacaagacccaagccgggagagttggcgtttagaaaaggcgacgtcgtgactattttagaagcgtgcgaaaataagtcatggtatcgggtcaagcaccatacctcaggccaggaaggtctactggcggctggggccttacgggaaagagaagcacttagtgcagaccccaaactcagtctaatgccttggtttcacggcaaaatcagcggacaagaggcggtgcagcaattacagccacccgaggacggactctttttggtgcgagagagtgcccgccaccctggagactacgtgttgtgcgtgtcttttggaagggacgtcatacactacagagtgctacaccgagatggccatctgacaattgatgaggccgtcttcttttgtaacctgatggatatggttgagcactactcaaaagacaaaggggccatttgcacaaagttggtccgcccgaagcggaaacacgggacaaaatcggcagaggaggaactggcccgcgcaggttggctgctgaacctccaacacctcaccctgggcgctcagattggggagggggaatttggcgcggtactccagggagagtaccttgggcaaaaggtcgctgttaagaacattaaatgcgatgtcaccgcccaggccttccttgacgagacagctgtaatgactaagatgcagcacgaaaacctggtacgcctgctgggcgtgatccttcatcaggggctctatatagtgatggagcacgtcagcaaagggaacctcgtgaattttctccggacacgcggcagggccttagtgaataccgcccaactcctgcagttttccttacacgtggccgagggtatggaatatctggagagtaaaaaacttgtgcaccgcgacttagcagctcgaaacattttggtgtccgaagacctggtggccaaggtgagtgattttggtttagctaaggcagaaagaaaaggcctcgactctagtagactgcctgttaagtggacggctcctgaagcactgaaacatgggaaattcacctctaaatccgacgtgtggtccttcggagtcctgctgtgggaggtcttttcttacggtcgcgccccctaccccaagatgtcactgaaggaagtgtccgaggctgtggagaagggttatcgcatggagccgcctgagggctgcccaggtcccgtccatgtgctcatgtcctcgtgttgggaggcagaacccgcgaggcgaccccctttcagaaagctggctgagaaacttgccagggagctgagaagcgccggggctccagcgtccgtgtccggtcaagacgcagatggctccacctccccccggtcacaggagccatag

SEQ ID NO: 123778 - DNA, 1401 bp, Artificial Sequence
  Description of Artificial Sequence: Synthetic coding sequence
atgcccacaaggcgctgggcgcctgggacccagtgcattactaaatgcgaacacacaagaccaaaaccgggagagctggcattccgcaagggcgatgtcgtgacgatcctcgaagcctgtgagaacaaatcctggtatcgcgtgaaacaccataccagcggccaggagggactgctagcagctggcgccctccgagagcgagaagctctctccgccgatcccaaactgtccctgatgccatggtttcatgggaaaatttctggacaagaggccgtgcagcaattgcagccacctgaggacggactattcttggtgcgcgagagcgcccgccatcccggcgactacgtgctgtgcgtaagctttggaagggatgtgatacactatcgggtgctgcatcgggacggacacctcacgatcgacgaggccgtttttttctgtaacttgatggatatggttgaacactatagcaaggataagggcgccatctgcaccaaactggtgcgtcccaaacgtaagcacggcactaaatcagccgaagaggaattggcccgagcagggtggctgctgaatctgcagcacttaaccctgggcgctcagattggtgagggcgaattcggtgccgtgcttcagggagaataccttgggcagaaggtggctgttaaaaatatcaagtgcgatgtaaccgcacaggcatttctggatgagaccgctgtcatgacaaagatgcagcacgagaacctggtgcggctgcttggcgttattctgcaccaaggcttgtacattgttatggaacatgtatccaaagggaacctcgttaattttctgagaacacgaggccgtgccctagtcaataccgcccagctcttgcagttttctttacatgtggccgagggcatggaatacctggagtcaaagaaactcgtgcatcgggacctcgcagcacgcaatatcctcgtctcagaggatctggtcgcgaaggtctctgactttggcctcgcgaaggctgagagaaaggggttggactcctcgcggctgcctgtgaaatggacggcccctgaagcacttaagcatggcaaattcacatcaaagtctgatgtttggtcatttggcgtgttactgtgggaggtattttcttacggtagagccccttaccctaaaatgagcctgaaggaagtatctgaggccgtggagaagggctaccgcatggagccaccggaaggatgtcctggaccagttcacgtgctgatgagtagctgctgggaggcagaaccggcaaggagaccccctttcaggaagctggctgagaaattggcccgggaactgcgctcagccggcgctcctgcttccgtaagcggacaagatgccgacggctcgacctcacctagatctcaggaaccatag

SEQ ID NO: 123779 - DNA, 1527 bp, Artificial Sequence
  Description of Artificial Sequence: Synthetic coding sequence
atgcaggggcatttccctgcggagcgacgagaaggtcggcctaggcgggggacccggggccagcagcaacttctggtttcccctcgtttcctgcgggcttggcatcccccccccgtctccgctagaatgcccacccgcagatgggcccctggaacccaatgtatcaccaaatgtgaacatacccgtcctaagccgggcgagttagccttcagaaaaggagatgtcgtgaccatactggaggcctgcgagaacaagtcctggtatcgggtaaagcatcacacttcaggccaggaggggcttctcgccgcaggggccctaagagagagggaggcactgtccgccgaccccaagctgagtttgatgccttggtttcacggtaaaatttccggacaggaggccgtgcagcagttgcagcccccggaggacggactgtttctggtccgcgagtctgctcgacaccccggggactacgttctgtgcgttagctttggacgcgacgttatccactaccgcgtgctgcatagggacggacatctgaccattgacgaggccgtattcttctgtaacttgatggacatggtcgaacactactcgaaggataagggggctatttgcactaaacttgtacggcccaaacgcaagcatggcaccaagagtgcggaggaagaactcgctagagcgggatggctcctcaacctgcaacacctgactctaggggcacaaattggagagggggaatttggagcggtgctgcagggcgaatatctgggacagaaggtcgccgtcaagaatatcaagtgcgatgtaaccgcccaggccttccttgatgaaactgccgtgatgacaaagatgcagcatgagaatctggtacgcttgctcggagtcatcctgcaccaaggactatatatcgttatggagcatgtttcgaaagggaatttggtgaactttttacggactagaggcagagccctcgtcaacacagcccaactgctccaattttctctgcacgtggctgagggtatggagtatcttgagtctaaaaagttggtccacagagatctcgctgcacgcaatattttggtgagcgaggatctcgtagccaaggtctctgactttggcttggctaaggccgagcgtaagggcttggactccagtcgactgcccgtcaaatggacagcacccgaggccctaaaacatggaaaattcacgtccaagtctgacgtctggtctttcggcgtgcttctgtgggaagtgtttagttatggtcgtgccccctatccaaagatgtcactgaaggaggtttcagaggcagtggagaagggctataggatggagccacctgaaggctgtcctggccctgtgcatgtattaatgtcttcatgttgggaagctgagcccgccagaagaccaccatttcggaaactggcagagaaactggcccgcgaacttaggtccgcaggtgcccccgcctccgtatcaggtcaggacgcggacggatccactagccctcgatcacaagagccttag

SEQ ID NO: 123780 - DNA, 1134 bp, Artificial Sequence
  Description of Artificial Sequence: Synthetic coding sequence
atgactcaggaaccttttagggaagaattggcatacgatcggatgccgaccttggagcgtggtcggcaagaccccgcctcttacgctcccgatgctaaaccaagcgacctgcagctatcaaaacggctccccccttgcttttcgcacaaaacatgggtgttcagcgttcttatgggctcttgccttctcgttacgtccgggttctctctctatcttggaaatgttttcccagcggagatggattacctcaggtgcgccgccgggtcctgcatcccctccgccattgtgtcctttacagtttctcggaggaatgctaatgtgatcccaaacttccagattctctttgtgtctacattcgcagtaaccacgacatgtcttatttggttcggatgtaagttggtgctgaatccctcagctattaacatcaacttcaacctgattctgctgctgctgctcgaacttctcatggcagccactgtgatcatagccgcaagaagctctgaggaggattgcaagaagaaaaagggctcgatgtcagattcggccaatattttagatgaggtgccctttcccgctagggttctcaaatcttatagcgtcgtcgaggtgatcgctggcataagtgccgtgcttggtggcattatcgccctgaatgtggacgattcagtttctggtcctcatctgtccgttacctttttctggattctggtcgcatgttttccctccgcaattgccagccatgtggcagccgaatgcccaagcaagtgccttgttgaggtgctcattgccatttcatcactcaccagccctctgcttttcaccgccagcggctacctctcattttctatcatgcggattgtggagatgttcaaagactatccgccagcaataaaaccgtcttatgacgtgctgctccttctgctcttgttagttttacttttgcaagccggtctgaacactgggactgcaatacagtgcgtgcgttttaaggtgtctgctaggctccagggggccagctgggacacccagaacggccctcaggagcgcctggccggcgaggtcgctcgatccccactgaaagagtttgacaaagagaaagcgtggagggcggtggtggtgcagatggctcaatag

SEQ ID NO: 123781 - DNA, 1134 bp, Artificial Sequence
  Description of Artificial Sequence: Synthetic coding sequence
atgacccaggagccttttcgggaagaactggcctacgatcgaatgcctaccctcgaacgcggtaggcaggatcctgcttcgtacgcaccagatgccaagcccagtgatttgcaactaagcaagaggttgcccccttgcttttcgcataaaacctgggtattcagcgtgctcatgggatcttgccttctcgtcacaagcggtttctccctctacctggggaacgtctttcccgccgagatggattatcttagatgcgcggccggaagctgcatacctagtgctatcgtctcgttcaccgtaagtagaagaaacgccaatgtgattccaaactttcagatactgttcgtgtccacgttcgcagtgacaactacttgtcttatatggttcggctgtaagttggtcttaaacccgagcgccatcaacattaatttcaacctgatactgctcctcctgctggaattgttaatggctgctactgtgatcatagctgcgcgttccagtgaggaagactgtaaaaagaagaagggatcgatgtccgattcagcaaacatcctcgatgaggttcccttcccagcgcgagtcctcaaatcatactccgtcgtggaggtgatcgcaggcatcagcgcagtgctagggggcataatagccctgaacgtcgatgactcagtctccggaccccacctctctgtgaccttcttctggatcctggtcgcctgcttcccttctgcaattgcttctcatgtcgccgccgagtgccctagtaagtgtcttgtggaggtgctcattgctataagcagcctgaccagcccacttctattcaccgctagcggctatctctctttctctatcatgcggatagtggaaatgtttaaggactatccccctgcgatcaaaccaagctacgacgtactgcttctgctccttttgctggtgcttctccttcaagcgggcctcaacacaggaaccgcaatacagtgtgtgcggttcaaggtcagcgcccgtcttcagggagccagttgggacacacagaacggcccccaggaacgcctagccggtgaggtggccaggtcacccctgaaagagtttgacaaggagaaagcttggcgcgccgtggtcgtacagatggcccagtag

SEQ ID NO: 123782 - DNA, 1044 bp, Artificial Sequence
  Description of Artificial Sequence: Synthetic coding sequence
atgacccaagagccattccgcgaggagcttgcctatgacagaatgccaacgctggaaagaggtcggcaagatcccgcttcatacgcaccagacgccaagcccagcgatctgcagttgtcgaaaaggctacccccatgcttctcccacaagacgtgggtgttctcagttcttatgggctgcattcctagtgccatagtgagcttcacagtctcacgtagaaacgcaaacgtgattcccaactttcagattctcttcgtatccacattcgcagtcaccaccacttgtcttatttggtttggttgcaaactcgtccttaatccatcagcaatcaatataaactttaacttaatcctgctgttactcttagagctcctcatggctgctactgtcatcatcgcagcaaggagcagtgaggaggactgtaaaaagaagaagggaagtatgtccgactctgcaaacattctcgacgaggtgccattccccgcgcgggtcctaaagtcttactccgtagtcgaggttatagccggaatctccgctgtgctcggcggaataatagctctgaatgtggacgattccgtgagcgggccccacctgtcggtcaccttcttttggatactggtggcatgttttccaagcgctatcgcatcgcatgtggccgcagaatgcccaagcaagtgtctggtggaggtgctgatagccatttcttccctcacctcgcctctgctgtttaccgcttctgggtatctgagctttagtattatgcgcatcgtggaaatgtttaaggactacccacctgctatcaagccctcatacgatgtactgctgttgttgctactcttggttctgctgctgcaggctggcctgaacaccggcactgcaatccagtgcgtgcggttcaaagtatcggcgagattgcagggtgccagctgggacacccaaaatggcccacaggaacgcttagccggagaagtcgcacgttctccattaaaggagttcgataaggaaaaagcctggcgcgccgtcgtggtgcagatggcccaatag

SEQ ID NO: 123783 - DNA, 672 bp, Artificial Sequence
  Description of Artificial Sequence: Synthetic coding sequence
atgacccaagagccgttccgcgaagagttggcgtacgaccggatgcctaccctggaaagaggtcgacaggatcctgccagttatgcaccagacgccaagccgagcgacctccagctatcaaaaaggctgcccccgtgcttcagccataaaacgtgggttttcagcgtgctcatgggatgcattccttccgccatcgtgagtttcaccgtgtcacggcgcaatgcaaacgtaattccaaattttcagattctctttgtgtccacctttgccgtgaccacgacttgtctgatctggttcgggtgtaagcttgtcctgaacccgtctgcaatcaatataaacttcaacctcattctgctgttgctgctggagttgcttatggctgcaacggtcataatagcagcacgaagcagtgaagaggattgtaaaaagaaaaaagggtcgatgagcgacagcgccaacattctcgacgaagtgcctttcccagccagagtactgaagagttatagcgtggtcgaggtgatcgccggaatttccgctgtgttaggtggcatcatcgccttgaatgtggatgattccgtgagtgggccacatctttccgtgacgttcttctggattctggttgcctgctttccatccgccatagcatcccatgttgctgccgaatgtccttag

SEQ ID NO: 123784 - DNA, 978 bp, Artificial Sequence
  Description of Artificial Sequence: Synthetic coding sequence
atgacccaggaaccgtttagagaggaactcgcttacgatcggatgcctacccttgaacgtggccgccaggatcctgcctcatacgcccccgacgctaagcccagcgacctccaactgagcaaaaggctgccaccctgcttttctcacaagacgtgggtgttctcagtgctaatggggtcttgtctgttagttacaagcggtttctcgctgtacctggggaacgtgttcccagctgaaatggactatttaaggtgcgccgccgggtcaatcaatttcaatctaatcttactgctgctgctggaactgctgatggcggccactgtgatcattgcggcaaggagcagcgaggaggattgtaaaaagaaaaagggttctatgtccgactccgctaacatactcgacgaggtaccatttcccgccagggtgctgaagtcttattcagtagtcgaggtgattgctggaatctcagcagtactcggagggattatagctctgaatgtagatgatagtgtaagtggccctcacctgtcggttacattcttttggattctggttgcttgcttcccgtccgccatagcctctcatgtagctgccgaatgtccaagtaagtgcctggtggaggtgttgattgctatttctagtttgaccagtccactgctttttacggcatccgggtacctgagtttctccattatgcggattgtcgaaatgttcaaggactaccctcccgccatcaaaccctcttatgacgtccttttgctgctcctccttctcgtattgcttttgcaggccggcttaaacaccgggacggcaatccaatgtgttcgcttcaaagtcagtgcccgcctccaaggggcctcttgggacactcagaacgggcctcaggagcgtctcgccggcgaggtcgcaaggagtccgctgaaggagtttgataaggagaaggcctggcgcgccgtggtcgtccagatggcccagtag

SEQ ID NO: 123785 - DNA, 897 bp, Artificial Sequence
  Description of Artificial Sequence: Synthetic coding sequence
atggactacttgaggtgcgccgccgggagttgcattccttccgctatcgtgtcatttacagtgagccggcggaacgctaacgtgataccaaacttccagattctttttgtttccactttcgcagtcacaaccacatgcctgatatggtttggctgcaaactcgtgcttaacccttccgcaatcaatattaatttcaacttaatccttcttttactgctcgagctgttaatggctgccaccgtaataatcgccgccaggtcatctgaggaggattgtaaaaagaaaaaggggtcaatgtccgacagcgccaatattctcgacgaggtgcctttccctgcaagagttctcaagagctatagcgttgtcgaagtgatagccgggatctccgctgtccttggaggaataatagcccttaacgtggacgactcagtgtccggacctcacctgagcgtgacattcttctggattcttgtcgcttgcttccccagcgctattgcttcacacgtggccgctgagtgccccagtaagtgcctcgtggaagtgttgatcgcaattagcagtttaaccagcccacttctcttcaccgcctcagggtacctgtctttcagtattatgaggatcgtagagatgttcaaggattatccgccagcgattaagccatcctacgatgtgctgttactgctgctgcttctggtgttgctgttgcaagcaggtctgaacacaggcacagccatccagtgtgtccgcttcaaggtgagtgcccgacttcagggagctagctgggacacacagaacgggccccaagagcgattagcaggcgaagtggcccgcagtcctctgaaggaattcgacaaagagaaagcatggagagccgtagtggtccagatggcccagtag

SEQ ID NO: 123786 - DNA, 1032 bp, Artificial Sequence
  Description of Artificial Sequence: Synthetic coding sequence
atgacgcaggaaccttttcgggaagagcttgcttacgatcgaatgcctaccttagaaagaggcaggcaggacccagcctcttacgccccagacgccaaacctagcgatttgcaattgagtaagagactaccaccctgcttcagtcacaagacttgggtattcagtgttctaatgggcagttgtctcctagtaacgtctggttttagcctatacttgggaaacgtcttcccggcagaaatggactatctgcgctgtgccgcggggtcctgcatcccaagtgctatcgttagctttaccgtctccaggcggaacgctaacgtgataaacttcaacttgatcctcttgctccttctggaactcttaatggcagcaacagtgattatcgccgcgcggtcatccgaggaggactgcaaaaaaaagaagggtagtatgtccgacagcgccaacattttggacgaagtgccttttccagcacgcgtgttaaaaagttactccgtggtggaggtgattgctggcattagcgcggtgttaggtggcattattgcactgaacgtagacgattcggtctcgggcccccaccttagtgttacattcttttggatcctggtcgcctgcttcccgtcagctatagcgtcccatgtcgccgctgagtgcccatccaagtgtctcgtagaggtactgatcgccatttctagcttgacatccccgctgctcttcacagcctcaggctatctgtctttcagtattatgcggattgtcgagatgttcaaagactatccacctgctatcaagccatcctacgatgtcctcctcctccttctcctcttggtgcttctgctgcaggcagggctgaacaccggaacggccatccaatgtgtgcgatttaaggtgtccgcaagactgcagggcgcatcatgggatacccaaaatggaccgcaggagagactggccggggaagtcgcaagatcccctcttaaggagttcgataaggagaaagcctggcgtgccgtcgttgtgcaaatggcgcaatag

SEQ ID NO: 123787 - DNA, 267 bp, Artificial Sequence
  Description of Artificial Sequence: Synthetic coding sequence
atggcctcaagcgatgtgaaaccaaaatcagtctcccatgccaaaaaatggagcgaggaaatcgaaaacctttataggtttcaacaggctgggtatagggatgaaactgagtaccgccaggtgaaacaggtcagtatggtcgatcggtggcccgagactgggtacgtcaagaaacttcagagacgagataatacattctattattacaataaacagagggagtgtgatgataaggaagttcacaaagtgaaaatttacgcatattag

SEQ ID NO: 123788 - DNA, 267 bp, Artificial Sequence
  Description of Artificial Sequence: Synthetic coding sequence
atggcttcttctgacgttaaacccaaatctgtgagccacgcgaagaagtggtccgaggaaatagagaacctttatcggttccaacaggccggatacagggacgaaacggagtacagacaggtaaagcaggtcagcatggtcgatcggtggccagaaacaggttacgtcaaaaagctgcagaggagggacaataccttttactactataacaagcagcgtgaatgtgatgataaagaggtccacaaggtgaaaatctatgcttattag

SEQ ID NO: 123789 - DNA, 1488 bp, Artificial Sequence
  Description of Artificial Sequence: Synthetic coding sequence
atgggctccaagaggcggaacctgagttgcagtgaaagacaccagaaactggttgacgaaaattattgtaagaaactgcacgtccaggccctgaaaaatgttaattctcaaatacgcaatcaaatggtacagaacgagaatgacaacagagtccagcggaagcagttcctgaggctgctgcagaacgagcagtttgagctggatatggaggaagccatacagaaagcggaggagaacaagcggctgaaagaactccagttgaaacaggaagagaaactcgccatggaactagctaaattgaagcatgagagtttgaaggatgagaaaatgcgtcagcaggtgcgagaaaattccatcgaactgcgcgaactggagaagaagctaaaggcggcatacatgaataaggagagagcagcccagatagccgaaaaggatgccattaagtatgaacagatgaagcgggatgctgagattgcaaaaactatgatggaagagcacaagcgcataatcaaggaagagaacgcagcagaagataaacggaacaaagccaaggcacagtattatctcgatcttgagaaacagcttgaggagcaagaaaaaaaaaaacaggaggcctacgagcagctgctcaaggagaagctgatgatagacgaaatagtaagaaagatctacgaagaagatcagctggaaaagcaacagaagttggagaagatgaacgccatgcgcagatatatcgaggaatttcagaaagagcaggctctctggagaaaaaagaagcgtgaagagatggaggaagagaataggaaaattatcgaattcgctaacatgcagcagcagagagaagaagatcgaatggccaaggtccaggagaatgaagagaaacggctccagctgcaaaacgccttgacgcagaagctggaggagatgttgcgacagagagaggatctggagcaggtcagacaagaactgtaccaggaggaacaggctgagatctacaagtccaaactaaaggaagaagcagaaaagaagctgaggaaacagaaagaaatgaagcaggatttcgaagagcaaatggctctcaaagaactggttctgcaggccgcaaaagaggaagaagagaatttccgtaagacaatgctggccaaattcgccgaagatgaccgtattgagctcatgaacgctcagaagcagcgcatgaagcaactggagcataggagggctgtcgaaaaactgattgaagagcggagacagcagtttctggcagacaagcagagggagctggaggagtggcagctccagcagaggcggcaggggttcatcaatgctataatcgaagaggagagactcaagctcctcaaagagcatgctaccaacctcctgggttacttgcctaagggcgtttttaaaaaggaggacgacattgacctcttgggggaggaatttaggaaagtgtatcaacagcggtcagaaatatgtgaggagaaatag

SEQ ID NO: 123790 - DNA, 1173 bp, Artificial Sequence
  Description of Artificial Sequence: Synthetic coding sequence
atggcccaaagatatgacgacctgcctcattatgggggaatggacggcgtgggcatcccatcgactatgtacggcgatccccatgctgctcggtcaatgcagcccgtgcatcacttgaaccatggacctcccttgcattcccatcagtatccacacaccgcccacaccaacgccatggccccgtcgatgggctcttccgttaacgatgccttgaagcgcgataaagatgcaatctatgggcacccgctgtttccactgctggcactgattttcgagaaatgtgaactcgcaacctgcacgccccgcgagccaggtgtagccggcggggatgtgtgctctagcgagagtttcaacgaagatatcgccgtgttcgcaaaacagatcagagccgagaaaccgctcttctccagcaacccggagctcgacaatctcatgattcaggccatacaagtgctccggtttcacctcctagagcttgagaaagttcacgaactctgtgataacttctgccacagatatatctcctgtcttaagggaaagatgcccatcgaccttgtaatagatgatagagagggcggtagcaaatccgacagcgaagatatcaccagatctgcaaatctcaccgaccaaccctcttggaatcgcgatcacgacgacacagcctccacccgaagcgggggcacacccgggccgtcaagcggcggacacacttcacacagcggcgataattcgtctgagcaaggagatggtcttgacaactctgtagccagtccgtcaactggggacgatgacgatccggataaagataagaagaggcataaaaagcgcggcatctttccaaaggtggcaactaatattatgagggcgtggctcttccaacacctaactcatccatatcctagtgaagaacagaagaagcagttggcccaggataccggactgaccattttgcaggtgaacaactggtttattaacgctcggaggaggattgtccaaccaatgatcgatcagtctaaccgagccgtgagccagggcaccccatataacccagatggacagcccatgggtgggtttgtgatggatgggcagcaacacatgggcatcagagcccctggaccgatgagtggcatgggtatgaatatggggatggaggggcaatggcattatatgtag

SEQ ID NO: 123791 - DNA, 1392 bp, Artificial Sequence
  Description of Artificial Sequence: Synthetic coding sequence
atgcaatacgatgacctgccacattatgggggtatggacggagtcggaatcccttctaccatgtacggcgatccccacgccgcaaggagtatgcagccagtgcatcatctgaaccatggcccaccccttcacagccatcagtaccctcacacggcccacacgaacgctatggcccccagcatgggctcaagcgtcaacgacgccctgaagagagacaaagatgcaatttatgggcatccattgtttcccctgttagccttaatttttgagaaatgcgagttagcgacctgcacccctcgcgaaccaggggtggccggaggtgacgtctgcagctccgagtccttcaatgaagatatcgcggtgtttgccaagcagatacgggccgaaaagcctctgttttcatccaacccggagttggacaacctcatgattcaggccatccaggttttacgattccatttgctcgagctagagaaagtgcacgaactgtgcgacaatttctgccatcgttacatttcatgtctcaaaggcaaaatgccgatcgatttagttatcgatgatcgtgagggcggatctaaatctgacagcgaggacatcacgcgctcagccaacctcacggaccaaccctcctggaacagggaccacgacgatacggcctccactcgtagcggcggtactcctgggcccagttccggcggccacacatcccacagtggcgacaatagttccgagcagggcgacggattagataacagtgtcgcctcaccttctacaggggacgatgacgatcctgacaaagacaaaaaacgtcacaaaaaacgcggtatcttcccaaaggtggcgaccaacattatgcgggcctggctgtttcagcaccttacacacccgtaccctagtgaggagcagaagaagcaactggcgcaagataccggactgacaatcctgcaggtaaacaattggtttattaacgcgcgccgaaggattgttcagcctatgattgatcaaagtaaccgggccgtctcacagggtacaccgtataatcctgacggacagcctatggggggctttgtgatggacggacagcagcacatggggattagagctccaggacttcagtctatgccgggggaatacgtggcccggggtggcccaatgggcgtcagcatgggccaaccaagttacacccagccccaaatgccaccccaccccgctcaactgcgccacggccctcctatgcacacctatattccaggccacccccatcatcctacagtaatgatgcacgggggcccaccacaccctggcatgcctatgagcgcttcttctccaactgtactaaacaccggcgatcccacaatgtccggacaggtcatggacatccacgcccagtag

SEQ ID NO: 123792 - DNA, 762 bp, Artificial Sequence
  Description of Artificial Sequence: Synthetic coding sequence
atgattcaggcgattcaagtgctgcggttccatctgctggagctcgagaaagtacatgagctgtgtgataacttctgccataggtatatttcatgcttaaaaggcaagatgccgatagacttggtgatagacgaccgcgagggaggcagcaaatctgacagtgaggatatcaccagatccgcaaatctgacggaccagccctcgtggaatcgggaccatgacgacaccgcctccacccgctctggtggcactcccgggcctagctccggaggccacacaagccactctggcgataatagttctgagcagggcgacggtttggacaattctgtagcatctccgagcacgggcgacgatgacgaccctgataaagataagaagcgccataaaaaacgcgggatttttcctaaagtcgcaacaaatataatgcgcgcatggctgttccagcatctgacccacccatatccatctgaggaacaaaaaaaacaactggcccaggataccggtctgactatactgcaggtgaataattggttcataaacgcccgccgccgtattgttcaacctatgattgatcaatctaatagagccgttagtcaaggaacaccttataaccctgacgggcagcctatgggaggattcgtcatggacggccaacagcacatgggtattagagcacccggtcccatgagtggaatgggtatgaatatggggccgccgtgtatacgaactttcctggatacattaactactcaacaatag

SEQ ID NO: 123793 - DNA, 1398 bp, Artificial Sequence
  Description of Artificial Sequence: Synthetic coding sequence
atggcgcagcgctacgacgatctgccacactatggggggatggacggagtgggcatcccttcaactatgtacggtgatccccacgcagctaggtccatgcagccagttcatcatctcaaccatggccctcctcttcattcccaccagtaccctcacacagcccacacaaatgctatggccccatccatgggctcaagcgtgaatgatgccttgaaacgagacaaggacgctatctacggacaccccctgtttcctctgttggccctcatcttcgaaaagtgcgagctcgctacatgcaccccccgcgagccgggagtagcaggtggagatgtttgcagttcagaaagtttcaacgaggacatcgccgtgttcgctaaacagattcgggcagagaagcctctgttctccagcaatcctgagctggataacctgatgattcaggctatccaggtcctgaggttccacctcctggagttggaaaaagtccacgagttatgtgacaatttctgccataggtatataagctgtcttaagggaaaaatgcctatcgacttggtaatcgatgacagggaaggtggcagcaagtccgattcagaagacattactcggagtgcaaaccttacagatcagccatcttggaaccgtgaccacgacgatactgcatcgacccgcagcggcggaacaccaggtccatcctcaggaggccatactagtcattcaggggataacagctctgaacagggcgacggattagataactccgtcgcgagcccttctaccggggacgatgatgatcctgataaagacaaaaagcggcataagaagcgcggcatttttcccaaggtcgcaactaatattatgcgagcttggctattccagcatctcacacacccgtacccttccgaggagcaaaagaagcagttggcgcaagatactggattaaccatcttgcaggtaaataactggttcattaacgctcgccgacggattgtgcagcctatgattgatcagtcgaacagagcagtctctcaaggaacgccctataaccctgacggtcagccaatgggaggtttcgtgatggacggacagcagcatatgggcattagggcacctggcctccagtcaatgccgggggagtatgtggcccggggcgggcccatgggcgtttccatggggcagccgtcctatactcagccgcagatgccgccccaccctgcacaactccggcacggaccccctatgcacacctatatccctggtcatccccaccatccaaccgtgatgatgcatgggggacctccgcaccccgggatgcctatgagcgcttccagtcctactgtgcttaataccggtgatcccaccatgtctgggcaagttatggacatacatgcccagtag

SEQ ID NO: 123794 - DNA, 423 bp, Artificial Sequence
  Description of Artificial Sequence: Synthetic coding sequence
atgaaaaaaaatggggacgaaaaatcccctttgggtacggagattatgatgacacgccatcttctggttcaagaagagccccaagcgctccccgctgtggcgacacggcataccgttgggaccacggctgtcagcaagcatccttacccaagtgaggaacagaagaagcagttggcccaagataccggactcaccatccttcaagttaataattggttcattaatgccaggaggagaattgtccagcctatgatcgatcagagcaatagggccgtgagccagggtaccccctataatcccgatggacagccaatgggaggatttgtcatggatggccagcagcatatgggaatcagagcgcctggcccaatgtccggaatgggaatgaatatgggcatggagggacaatggcactatatgtag

SEQ ID NO: 123795 - DNA, 663 bp, Artificial Sequence
  Description of Artificial Sequence: Synthetic coding sequence
atgcagcccgtccatcacctgaatcacggaccacctctgcatagtcatcaatacccgcataccgcccacacaaacgctatggcacccagcatgggatcttccgtgaacgatgctcttaagagagacaaggacgccatctatgggcaccccctttttcccctcctggctctgatcttcgaaaagtgcgaactggcaacctgtacacccagggagccaggagtagccggtggcgatgtatgtagctccgagagctttaacgaggacattgcggtgttcgctaagcagatcagggccgaaaaacccttattcagttctaacccagaactagataatctcatgattcaagctattcaggtcctccgctttcacctgttagagctggagaaagtgcacgaactgtgcgataacttttgccatcgctatattagttgtctgaaaggcaaaatgcctatcgacctcgtgattgatgaccgagagggtgggagcaaatctgactctgaggacatcacccgctctgcaaaccttactgatcaaccctcctggaacagggaccacgacgatacagcctccacacgaagtggcggaaccccgggcccttcctctggagggcacacttcacattccggggataatagttccgagcaggcccccctgcctttctag

SEQ ID NO: 123796 - DNA, 540 bp, Artificial Sequence
  Description of Artificial Sequence: Synthetic coding sequence
atgaaaagcctactcaccttttacaagtgcgggtctgaactgttgcctgcagccgtgtggtccgccgggggctcaccatccttgtttagcgacctcaaatccaagaagggaaagaagtttagcagggaccatattgaggtgacaattagcaactgcggtgtgaatgggaatgcaaaaggggacggcttggacaacagcgtggcctcacccagcacaggcgatgacgacgatcctgacaaggacaagaagcgccacaaaaagagagggatctttcccaaggtagccacaaacattatgcgggcttggctctttcaacatctaactcacccatatccctcagaggagcagaaaaaacagcttgcacaggataccggactcactattctacaagtaaataactggttcattaacgcccgcaggcggatcgtccagcccatgattgatcaaagtaatcgagccgtgtctcagggcacgccctataatccagacggccaaccaatgggcggctttgttatggacgggcaacagcatatggggtag

SEQ ID NO: 123797 - DNA, 978 bp, Artificial Sequence
  Description of Artificial Sequence: Synthetic coding sequence
atggcccaggggctgcgtctgcaaggctcccgccgcaaagggcgacacccgctctttccactgctggcactgatcttcgaaaagtgcgagctcgctacatgtactccccgcgaaccgggcgtggccgggggcgatgtttgctccagtgaaagctttaatgaggacatagctgttttcgctaaacagatcagggctgaaaagccgctatttagcagcaacccagagctggacaacctcatgatccaggcgatccaggtgctgaggtttcatctactcgaactcgagaaggtgcacgagttgtgcgacaacttttgccatcgatacatcagctgcctgaagggcaagatgcctattgatctggtgatcgacgatcgagaaggcggaagtaagtccgactcggaggatatcacacgtagcgcaaatcttaccgaccaaccctcctggaatagagaccacgacgacacagcaagtactcggagcggcgggacccccggaccctcatcaggagggcatacttcacactcgggggacaactcaagtgaacaaggcgatggcctggacaatagcgtggcgtctccatccaccggggacgatgacgatcctgataaagacaaaaagcgccacaaaaaaagaggaatcttccccaaggtggccacaaatatcatgcgcgcttggttattccaacacttgacacatccataccccagcgaagagcaaaagaaacagcttgcacaggacactggcctgacaatcttacaggtgaacaactggttcattaatgcaagacgccgtatcgtgcagcctatgattgatcaatctaacagggccgtatcccagggcaccccctacaatccggacggccagccaatggggggcttcgtaatggacggtcagcagcacatgggcatcagggcccctggtcctatgtctggcatgggtatgaacatggggatggagggccaatggcactatatgtag

SEQ ID NO: 123798 - DNA, 1113 bp, Artificial Sequence
  Description of Artificial Sequence: Synthetic coding sequence
atggctcagcgctacgacgacctgccgcattatggcgggatggacggggtgggcattccaagtaccatgtacggggacccacacgcagcaagatccatgcaacccgtgcaccacctcaaccatgggccacccctgcatagccaccagtaccctcacacagctcataccaatgccatggctccctcaatgggctcgagtgtgaacgatgccctgaagcgcgataaggacgcgatctatggtcacccattattccccctgcttgccctgatttttgaaaaatgcgagttagcaacttgcacaccacgcgagccaggcgtcgcgggtggcgacgtgtgctcctccgagagctttaatgaggatattgcagtctttgctaagcagattagggctgaaaagccgctattctctagcaatcctgagttagataacctaatgatacaagcaattcaagttctaaggtttcacctactcgagttggagaaagtccacgaactgtgcgataacttctgccataggtacatcagttgtttgaaagggaagatgccaatagatcttgtcattgacgaccgtgaaggaggctccaaatctgattccgaggatatcacgaggagcgctaacttgacagatcaaccgagttggaatcgggatcacgacgataccgccagtacaagatccggcggcacacctggtcccagttccggtgggcatacttctcacagcggagacaatagcagcgagcagggggatggcctcgataattcagtggccagccccagtacaggtgatgacgacgaccccgataaggacaaaaaacggcacaagaaaagaggcatattccctaaggtagccactaacattatgagggcgtggctgttccagcatctgactcacccctatccttcagaggaacagaagaaacaactggcacaggacacggggctgaccatactgcaggtcaataattggtttattaatgccaggcggcgtattgtgcagccgatgattgatcagagtaaccgcgcaggaaagtcccctatcgtgaccgtctttaagtccaggaaacggaagccatcctcctcacattcacctggcggaccactgccaggcaagtag

SEQ ID NO: 123799 - DNA, 2259 bp, Artificial Sequence
  Description of Artificial Sequence: Synthetic coding sequence
acaactgctatggcacataggaagctcgagtccgtgggctccggaatgctagatcacagagttcgccccgggcccgtaccacacagtcaagagcccgaatctgaagatatggagctgcctctggaaggatatgtcccagaggggttagagctcgccgccctccgacctgaaagcccagcacccgaagagcaggagtgccacaaccattctccagacggcgattcctcctcggactatgtgaataatacaagtgaggaggaggactatgacgaggggcttccagaagaagaggagggcataacctattacattcgctactgcccagaggacgattcatatttagagggcatggactgcaacggagaggaatacctagctcatagtgctcacccagtggatacagatgagtgtcaagaagccgtcgaagaatggacagatagcgccggccctcaccctcacggccacgaagcggagggcagccaggactatcctgatggacagttacctatccccgaggatgagccctccgtgctcgaggcccatgaccaggaggaggatggccattactgtgcttcaaaggaagggtatcaagactactatccagaggaagctaatggaaacactggcgccagcccttaccgtctgcggagaggggacggggatttagaggaccaagaggaagacattgatcaaatcgtggccgaaatcaagatgtctctgtctatgacaagcatcacgagcgcctctgaagccagcccagaacatgggcccgagccaggcccggaggactccgtcgaagcctgcccacctattaaggccagttgctcaccctctaggcacgaggcaagacctaagagcctgaacctgctgcctgaagcgaagcacccaggagaccctcaacgcgggttcaagcccaagacacgcactcccgaggaaaggctcaaatggcctcacgagcaagtctgcaatggccttgagcagccccggaagcaacagaggtccgaccttaatgggcccgttgataacaataacattcctgaaactaaaaaagttgcatcttttccctccttcgtggcagttccgggaccctgcgagcccgaggatctcatagatggaattatatttgcagccaattatctggggtccacccagttacttagcgagcggaacccatccaagaacatccgcatgatgcaggcacaggaggctgtgtctagagtgaagcgaatgcagaaggctgccaaaatcaagaaaaaggctaatagtgaaggagacgctcagaccttgaccgaagttgatctttttatctccacccagcggattaaagtgctgaacgccgacacccaggaaacaatgatggaccacgcactccggactatatcgtacatcgccgacataggcaacatcgtcgtgttgatggctaggcggaggatgccccgaagtgcctctcaggactgtatcgaaaccacacccggagcccaagaaggaaagaaacagtacaagatgatttgtcatgtgtttgaaagcgaggacgctcagctgatcgcccagtcgatcggccaagctttctcggtggcctatcaggagttcctaagagccaacggcattaatcccgaggacctatcccagaaggaatatagtgatattatcaacactcaggaaatgtataacgatgacctgatacacttcagtaacagcgaaaattgcaaggagctgcaactggaaaaacataaaggagagattcttggagtggtggtagtggagtccggctggggatctatcttgcctacagtgatcttggcaaatatgatgaatgggggtcctgctgcccgctccggcaagttatcaatcggtgatcaaataatgtctataaatggaactagcttggtgggactgcctctcgctacttgtcaaggaattatcaagggtttgaagaaccagacccaggtgaagcttaatattgtctcttgcccaccagtgacaacagtcttgataaagagacccgacctgaagtatcaactcgggttttccgtccagaatggcatcatctgttctcttatgcgcggtggcatagccgagcgcgggggagtcagagttgggcatagaattatagagattaacgggcagtccgtagtggccacggctcacgagaagatcgtgcaggccctttcaaactcagttggcgaaattcatatgaaaactatgccagcggcaatgttccgtttgcttaccgggcaagagacccccctgtatatttag

SEQ ID NO: 123800 - DNA, 1413 bp, Artificial Sequence
  Description of Artificial Sequence: Synthetic coding sequence
atggcacagaggtacgacgagttgcctcactacgggggcatggatggtgtcggtgttccggcatcaatgtacggggaccctcacgctcctcggcccattccaccagtgcaccacctaaatcacggccccccgctgcacgccacacaacattatggtgcccatgctccacacccaaatgtgatgcctgcctcaatgggatcagctgttaatgatgccctcaagcgcgacaaggacgctatctatggccacccgctgttccctctgctggcacttgtgttcgaaaagtgtgagttagcaacatgcaccccaagggaacctggtgtggcaggtggcgacgtgtgctcgtccgactcctttaatgaggatatagcagtgttcgcgaaacaagtgagagccgaaaagcccctgtttagttccaaccctgagctcgataaccttatgattcaggccatccaggtgctgcggttccacttgcttgagctggagaaggtgcacgagctctgcgacaatttttgccatagatatatcagttgcctgaaaggcaagatgccgattgatctggtgatcgacgaacgcgacggcagttctaagagcgaccatgaggagctcagcgggagcagtactaatttagccgatcacaacccatcttcgtggcgcgaccatgatgacgccacgagtacacacagtgccggcacgccaggcccctccagtggggggcatgcttctcagtccggcgataattcctctgagcagggcgatggccttgataacagtgtggcctctccgggaacaggcgacgacgatgacccggacaaagacaaaaagcgccagaaaaagaggggcatattcccaaaggtcgccaccaacattatgcgggcctggctgtttcagcatctcacacacccttacccaagcgaggagcagaagaagcaactagctcaagacaccggcttgacgatcctccaggtcaataactggtttatcaacgcccgcaggagaattgtccagcctatgattgaccagagtaatcgtgccgtgtctcagggcgccgcttacagtccagaaggtcagccaatgggttcgttcgttctggatggtcagcagcatatgggtattagaccggcaggcctacagagtatgccaggagattatgtgtcacagggcggtcccatgggtatgagtatggctcagcctagttatactccaccgcagatgactccccaccccacccagctccgccacggccctccaatgcacagttatcttcctagtcatccccaccaccccgccatgatgatgcacgggggccctccaactcaccccggcatgaccatgtcagcacagagtccaactatgctgaacagcgttgatccgaatgttgggggacaggtgatggacatccatgcccaatag

SEQ ID NO: 123801 - DNA, 1146 bp, Artificial Sequence
  Description of Artificial Sequence: Synthetic coding sequence
atggacggagtgggggtgcctgctagcatgtacggcgaccctcatgccccgagacccattcccccagtccaccacctgaaccacgggcccccactccatgcaacacagcattatggggctcacgctccccaccccaatgtgatgcccgcgagtatgggttccgctgtaaatgatgccttgaaacgcgataaagacgcgatctacggtcaccctctgtttcctctgctggccctcgtgttcgaaaagtgcgaacttgctacttgtacaccccgggaacccggagtagccggaggagatgtgtgctccagcgatagctttaacgaagacattgccgtcttcgccaagcaggttagggccgaaaagcccttgttcagtagtaacccagagctggacaacctgatgatccaggctattcaagtgcttcggtttcatctgctcgagctggagaaggtgcacgagttatgcgacaacttttgtcataggtatatctcatgtcttaaagggaagatgcccatcgacctggtgatcgacgaaagggatggcagttcgaaatcggaccatgaagaactgtctggttcaagtacgaacttggctgaccacaaccccagttcatggagggatcatgacgacgctacttcaacccactcagccgggaccccggggccatcttcgggtggacacgcctcccaaagtggcgacaattcgagcgagcaaggggatggcctggataactcggtcgcgtcacctggaaccggcgacgatgacgacccagacaaggacaaaaaacggcagaaaaagcgaggcatcttcccaaaggtcgccaccaatattatgcgcgcatggctctttcaacacctgactcatccctacccaagcgaggagcaaaaaaagcagctagcacaggatacgggactgactattctgcaggtaaacaactggttcattaacgcaaggcgccggatcgttcagccaatgatagatcaaagtaaccgagctgtcagccagggcgccgcatatagtcccgaagggcagcccatggggagtttcgtcctcgatgggcagcagcatatgggcatccggcccgcaggccctatgtccggcatgggcatgaatatgggcatggatgggcagtggcattacatgtag

SEQ ID NO: 123802 - DNA, 1413 bp, Artificial Sequence
  Description of Artificial Sequence: Synthetic coding sequence
atggctcaaaggtacgacgaactaccccactatggaggaatggatggggtcggtgtgcccgcgtccatgtacggtgatccgcatgccccccgcccaattcctccagtccatcacttgaatcacggccctccactccacgcaacacaacactacggcgctcatgctccgcaccctaacgtgatgccagcctccatggggtctgctgtcaacgatgcattaaagcgggacaaagacgccatctatgggcaccctctgtttcccctcctggctctggtattcgagaaatgcgaattggctacctgcacaccacgcgagccaggagtcgctgggggggacgtgtgcagtagtgactccttcaatgaggatatcgcagtctttgccaaacaggtgcgtgctgaaaagcctttgtttagtagtaaccccgagctggataatctgatgatacaggccattcaggtactgcgctttcacttgcttgagctggaaaaggtccatgaactatgtgacaacttttgccaccgatacatctcctgcttaaaaggaaaaatgcctattgacctagtaatagacgagagagatggaagctcaaaatccgaccatgaggagctgagcgggagcagtaccaacctggccgaccataacccttcatcctggcgagatcatgacgacgcgacttctactcactccgctggcactcccggaccatccagtggtggacatgcatcacagtctggggataacagtagcgagcaaggcgacggtctggacaatagtgtggcttcgcctggcacaggcgacgacgatgacccagataaggataaaaaaagacaaaagaagaggggtatctttcccaaggtcgccacaaatatcatgcgcgcatggctgttccagcaccttacccacccttacccttcagaagaacaaaagaaacagctggcccaggacaccggcttgaccatcttgcaggtcaataactggtttataaatgcccgcaggcgcatagtgcagcccatgatcgaccagagtaatagagcagtgtctcagggcgccgcatattcaccagagggccagcccatgggctcctttgttctcgacggacagcagcacatgggcatcaggccggccggcttgcagtcaatgcccggagattatgtgagccagggaggaccaatgggcatgtcaatggcccagccctcttacactccgccacaaatgaccccccatccaacacagctgagacatggaccaccaatgcattcttacctcccttctcatcctcatcatcccgccatgatgatgcacggagggcctcctacacaccctggaatgactatgtccgcacaaagcccaactatgttgaactccgtggacccaaacgtcgggggccaagtgatggacattcatgcgcagtag

SEQ ID NO: 123803 - DNA, 921 bp, Artificial Sequence
  Description of Artificial Sequence: Synthetic coding sequence
atggctctagttttcgaaaagtgtgagctggccacttgtacacccagggaacctggtgtagctggtggcgatgtctgcagctctgatagctttaacgaagatatcgcggtctttgcaaagcaggtgcgagccgaaaagcctctgttcagctctaatccagaactggataacctcatgattcaagctatacaagtgctgcggttccatctgttagagctagagaaggtgcatgaactgtgtgacaacttctgccatcgctacattagctgtctcaagggcaagatgcccattgacctggtgatcgacgaacgagacggcagctctaagtctgatcacgaggagctctccggcagttcgaccaacctcgccgaccacaatcccagcagttggagagatcatgacgatgccactagcacacactcagccgggactcctggcccgtcttccggcgggcacgccagccagtcaggggataactcctcagaacagggcgacggcctcgacaatagcgtggcgagcccgggaaccggtgatgacgatgatccagacaaagacaagaaaagacagaaaaaacgcggtattttcccaaaggtagcaacgaatattatgagagcctggttattccaacacctaacccacccatacccttcagaggaacagaagaaacagctagcccaggacactggtttgactatcctgcaggtgaacaactggttcatcaacgctcgccgacgaatagttcagccgatgatcgaccagagcaacagagcagtatcccagggggctgcctacagtccagaaggtcaacccatgggcagtttcgtgctagacggtcagcaacatatgggaattagaccagccggacccatgtccggaatggggatgaacatgggcatggatggtcagtggcactacatgtag

SEQ ID NO: 123804 - DNA, 921 bp, Artificial Sequence
  Description of Artificial Sequence: Synthetic coding sequence
atggccctcgtgttcgaaaagtgtgagctggcgacctgtactccccgagagcccggtgtcgctgggggggatgtgtgcagctctgactccttcaatgaagatatcgccgtgtttgcgaagcaagttcgcgccgaaaaacctttgttcagctccaaccctgagctggacaatctgatgatacaggccatccaggttctgcgtttccatttgctggagctggaaaaagttcatgagctttgcgataatttctgccatcgatacatttcctgtctcaaaggcaagatgccaatcgacctggtcatcgacgagcgggatggaagcagcaaatctgaccacgaagagctgagcggcagctcaacaaatctcgcggaccacaacccgtccagctggcgcgaccatgatgatgcaacctcaacccactcagccggcaccccaggtccaagcagtggaggccatgcctcacagtctggggataatagctctgaacagggggatgggctagataactcagtggcaagccctgggactggcgacgatgacgatcctgataaggacaagaagcgccagaagaagagaggtatttttccaaaagtcgccacaaatatcatgagagcttggctgttccaacatctcactcatccatatccctccgaagaacagaagaagcagttagcacaggacaccggcctcaccatacttcaagtcaataattggtttatcaatgcccggaggcgaatagtgcagcctatgattgaccagtctaacagagctgtctcgcaaggagccgcgtacagtccagaaggacaaccgatgggctccttcgtgctggacggacagcagcatatggggatacgccccgccggaccgatgagcgggatgggaatgaatatgggaatggacgggcagtggcactacatgtag

SEQ ID NO: 123805 - DNA, 1206 bp, Artificial Sequence
  Description of Artificial Sequence: Synthetic coding sequence
atggctcagaggtatgatgagctgccacactacggaggaatggacggggtgggcgtcccagcttccatgtatggggatccgcacgcgcccagacctatacctccagtgcatcacttaaatcacggcccccctttgcacgcaactcagcactacggagcccatgctccacaccctaatgtgatgccagcttcaatgggtagcgctgttaatgacgcgttaaaacgggacaaggacgctatctatggccatccactgtttcccctcctcgccctagtcttcgagaaatgcgagctcgccacttgcacccctcgcgaaccaggcgtggccggaggggatgtgtgctcatctgattcttttaatgaggatattgccgtgtttgcaaagcaagtgcgggcagaaaagccgcttttctcctcaaaccccgaactggataacctgatgattcaggccatccaagtcctccgttttcatcttctggagctggaaaaggtccacgaactttgtgacaacttttgccataggtacatttcttgcctcaaaggaaagatgccaatcgacctggtgatcgatgaacgtgatggctccagcaaaagcgatcacgaagaactttccggcagttcaacaaacctggcagaccataatcctagctcttggcgggatcatgacgacgccacttccacacacagcgcaggcacacctgggccatcaagcggaggccatgctagccaaagcggagacaacagttctgagcaaggcgatggcctggataacagtgtggccagcccaggcaccggcgacgatgacgatcccgacaaggacaaaaaaaggcagaaaaagcgggggatatttcctaaagtcgctaccaatataatgagggcctggctctttcaacatctcacccacccatatcctagtgaagaacagaagaagcagctggcacaggatactgggctgaccatcctgcaagtgaataactggttcattaacgctcggcgccggatcgtgcagcccatgatcgaccagtccaaccgcgccggcttcttgctcgatccttcagtcagtcagggcgcagcctactcgccggaaggacagcctatgggatctttcgtgctggatggccagcagcacatgggcattaggcccgctggacccatgtcaggtatgggcatgaacatgggaatggacgggcaatggcactacatgtag

SEQ ID NO: 123806 - DNA, 1185 bp, Artificial Sequence
  Description of Artificial Sequence: Synthetic coding sequence
atggcccagcgatacgacgagctccctcactatggcgggatggatggagtgggcgttccagcctccatgtacggcgatccacacgcaccacggcccatccctcccgtccaccatcttaaccatggaccgcctctgcatgcaacacaacattacggggcccatgctccacatcctaatgtgatgcctgcctctatgggcagtgcggtcaacgatgccttaaagcgtgataaggatgctatttatgggcatcctctcttcccgctcctggcgcttgtgttcgagaagtgcgagttggccacctgcacacccagggaacccggggtggccgggggagatgtttgcagttccgacagctttaatgaggacatcgccgtgtttgccaagcaggtaagagccgagaaaccccttttcagttctaatcccgaactcgacaacctcatgattcaggcaattcaggtgctgaggtttcacctgttggagctcgagaaagtgcacgaactttgcgacaatttctgtcatagatatatttcctgtctcaaagggaagatgcctattgaccttgtcatcgacgagagagacggatcaagtaaatcagatcatgaggagctgagcgggtcttctacgaaccttgccgatcataacccaagttcctggagagaccatgatgacgcaacttcgacccacagcgctggaacccccggtcccagcagcggaggacacgcgagccagtccggcgacaattccagcgaacagggggatggactggacaactctgtggccagtcctgggactggtgatgacgacgatcctgacaaagataagaagagacagaaaaagcgcggcatctttcctaaggtggccacaaacatcatgcgtgcatggcttttccaacacctgactcacccctacccctcagaggaacaaaaaaagcagctcgctcaagatacagggctgaccatcctacaggtcaacaactggtttattaacgctagacgccggatagtacagccaatgatcgatcaatctaatagagcagtcagtcagggtgctgcatacagccctgaagggcagcccatggggtcttttgtgctcgatggacagcagcacatggggatacgcccagcgggccccatgtccgggatgggaatgaatatgggcatggacgggcagtggcactatatgtag

SEQ ID NO: 123807 - DNA, 717 bp, Artificial Sequence
  Description of Artificial Sequence: Synthetic coding sequence
atggatggcgtgggggtaccggcctcaatgtacggagatcctcacgctcctcggcctattccaccggtgcatcacttgaaccacggccccccattacatgccacacagcattatggggctcacgcaccacatccgaatgtgatgcctgcatctatggggtcggccgtgaatgatgccctcaagcgcgataaggacgccatctacggacatcctctcttccccttactggcgctggtgttcgagaagtgtgagctggccacatgtactcctcgcgaacccggagtggctggaggtgatgtttgctcatccgacagcttcaacgaagatattgccgtttttgccaaacaggtgcgggcggagaagccgctgttctcttccaaccctgagctggacaatctaatgattcaggcaattcaggtcctgagatttcacctgcttgaattggaaaaggtgcatgagctttgcgataacttctgccacaggtatatcagttgtctcaagggaaagatgcccatcgaccttgtgatcgacgagcgagacgggagctccaagtcagaccatgaggaactgagcgggagcagtacaaacttggcagatcataatcccagctcatggagggaccatgacgatgctacctccactcacagtgccggaacccctggaccctcatccggcggacacgcatcccaatcaggagacaactcatctgagcagtag

SEQ ID NO: 123808 - DNA, 240 bp, Artificial Sequence
  Description of Artificial Sequence: Synthetic coding sequence
atggctctggtctttgaaaagtgtgagctagccacttgtacaccacgggagcctggggtagcaggcggcgatgtatgcagctccgattcgttcaacgaggatatcgcagtgttcgccaagcaggtaagggccgagaagcccttgttcagttccaatccggagctagacaacctgatgatccaggcaatccaggtgctgcggtttcatcttttagagctagagaaagtgagcaggaagtag

SEQ ID NO: 123809 - DNA, 1167 bp, Artificial Sequence
  Description of Artificial Sequence: Synthetic coding sequence
atggacggagtgggagttcccgcatctatgtacggcgatccgcatgcccctagacccatccccccagttcaccatttgaatcacggcccccctctgcacgcaactcaacattacggcgcccacgctccccaccccaatgtgatgcccgctagcatgggtagcgccgtaaacgatgcacttaagagagataaagacgcaatttatggacatccgctattccctttactcgcactggtattcgaaaaatgtgagctagccacttgcaccccacgtgagcctggagtggccggcggcgatgtatgcagcagcgacagcttcaatgaggatatcgccgtattcgctaaacaggtccgtgccgagaagcctctcttcagcagtaatcctgaactggataatttaatgatccaggcaattcaggtcctgagatttcatctactggaactggagaaggtccacgagttatgtgacaatttctgccacagatacatctcttgcctcaaaggtaagatgcctatcgatttggtgatcgatgagagagacggctcaagtaaatctgaccacgaggaactttctgggtccagcactaacctagccgatcacaacccttcatcttggagggaccacgacgatgcgacctcaacgcattcagcgggcacacctgggccctcctccggagggcacgcaagtcaaagcggcgacaactccagtgagcagggtgacgggctcgataactctgtagctagccccgggaccggagacgacgacgacccagataaggataagaagcgtcagaagaaaagaggaatttttcctaaggtcgctaccaacattatgcgtgcctggctattccaacaccttacccacccctatccctccgaggagcaaaagaagcaacttgctcaagacactgggttgacgattctccaagtcaacaactggtttatcaacgctagacgccgtattgtgcagcccatgattgaccagtctaaccgtgcaggtttcctcttagaccctagcgtgtcacagggagccgcgtatagtcccgaaggccagcccatggggtcctttgtccttgacggtcaacagcacatgggtattagacccgcaggccctatgagtggcatgggcatgaacatgggtatggacggccagtggcactacatgtag

SEQ ID NO: 123810 - DNA, 1185 bp, Artificial Sequence
  Description of Artificial Sequence: Synthetic coding sequence
atggcccagaggtacgatgagctgcctcactatggaggcatggacggggtgggagtgcctgcatccatgtacggcgacccacatgctccacggcccatcccaccagtgcaccacctgaatcatggccctccgttacacgccacacagcactacggagctcacgcaccccatcctaacgtaatgccagcaagtatgggcagcgccgtcaacgatgccctcaagagggataaagatgctatttatggacaccctctgttccccctcctggccctggtcttcgaaaagtgtgagttggcaacatgtaccccccgagagcccggagtagccggcggagatgtctgctcatcagacagcttcaatgaggatattgccgttttcgcaaagcaggtgcgcgccgagaaacccctcttctcgtcgaatccagagctcgacaacctgatgatccaggcgattcaggttctccgattccatctcctggaactggaaaaagtacacgaactgtgcgataacttctgtcacaggtacattagctgcctgaaaggcaagatgcccattgacttggtaatagacgagagggacggtagcagcaagagcgatcacgaagagctgagtgggagctcaacaaatcttgcagaccacaacccgtcttcatggcgcgaccatgacgatgcaaccagcacgcactctgccggcacacctggtccctcctccggcgggcatgcctcacagtccggagacaactcatctgaacaaggcgacgggctggataattccgttgccagccctggaactggcgacgacgacgatccggacaaggataaaaaaagacagaaaaaacgtgggattttcccaaaagtcgcgaccaatatcatgagagcttggctctttcagcatctgacacacccttacccctcagaagaacagaaaaaacaactggcccaggacactgggctgacgattttgcaagtcaacaactggttcatcaacgccagaagaagaatcgtgcagcctatgattgaccaatcaaacagggcagttagccagggagccgcatacagtcctgaaggacagcctatgggatcgttcgtgctggacggccagcagcacatggggatccggccagccggtccaatgtccggtatggggatgaacatgggcatggatggccaatggcactatatgtag

SEQ ID NO: 123811 - DNA, 1434 bp, Artificial Sequence
  Description of Artificial Sequence: Synthetic coding sequence
atggcgcagcggtacgatgaactgccccactatggtggcatggatggcgtcggagtgcctgctagtatgtacggcgatccgcatgccccacggcctataccccccgtgcaccatctaaaccacggacctccgctacatgccactcagcattatggcgcccatgctcctcatccaaatgtgatgcccgcctccatgggaagcgctgtgaatgacgccctcaaacgggataaagatgctatctacgggcatcctttattccccttgcttgcgctagtcttcgaaaaatgcgagctggcaacctgcaccccccgggagccaggtgttgctggaggcgatgtgtgttcctcagactcttttaatgaagacatagccgttttcgccaagcaggttcgggccgagaaaccactgtttagttctaaccccgaactggataatctgatgatccaagccatccaggttctgcgctttcacctcctcgaacttgagaaggtgcacgagctttgcgacaatttctgccacaggtatatttcttgcctcaaaggcaaaatgccaatcgatctggtcatcgatgaacgagatggttcatctaagtcagatcatgaggaactgtccggttccagtacgaatctggctgaccacaacccttcaagctggcgcgatcacgatgatgcaacttccactcactccgccgggaccccaggtcccagctctggaggccacgcatcacagagcggggacaattcttccgagcagggtgatgggctcgataatagcgtcgcttctcccggcacaggggacgatgacgacccagataaggacaaaaaacgccaaaaaaaaagagggatctttcctaaggtcgccactaacattatgagagcctggctctttcagcacctgacacatccgtatccatcagaagagcagaaaaaacagctcgctcaggatacgggtcttaccatcctgcaggtaaataattggttcataaatgcaagaaggcgcatcgtacagcctatgatcgaccagagcaatcgcgccggcttccttttggacccctccgtgtcccagggtgcagcttactcgcccgaggggcagccgatgggaagcttcgttctggacggtcagcaacacatgggtattagacccgcggggcttcagagtatgcctggggactatgtgagccaaggaggccctatgggcatgagcatggcccagcccagttacacgcctccacagatgacgcctcaccctacacagctcagacacggcccacccatgcactcttatttgccatcacatccgcaccatcctgctatgatgatgcatggcgggccccccacccatcccggcatgaccatgtccgcacagtctcctaccatgctcaactccgtggaccctaacgtgggcggccaggtcatggacattcacgcccagtag

SEQ ID NO: 123812 - DNA, 1434 bp, Artificial Sequence
  Description of Artificial Sequence: Synthetic coding sequence
atggcccaaagatatgatgaactgccacattacgggggtatggatggggtaggcgtgcccgcgtccatgtacggggacccgcacgctccgcggccaatccccccagttcatcacttgaaccacggcccccctttgcatgcaactcaacattacggcgctcacgcaccgcaccctaacgttatgcccgcgtcaatggggagcgctgtgaatgacgctctaaagagggataaggatgccatatacgggcaccctctgttcccactgttggcccttgtattcgagaagtgcgaactggctacctgcacccccagggaaccaggcgtggctggcggagatgtatgttctagcgactctttcaatgaagacatcgccgtgtttgcgaaacaagtgagggccgagaagcctctgttctcctctaatcctgaattggataatctcatgatacaagctatacaggtcttgcgcttccacctgctggagctcgagaaagtgcatgaactatgcgacaatttctgccatagatatatctcttgcttgaaggggaagatgcccatagacctggtcattgacgagagagacgggagcagtaaatccgatcatgaagagctgtccggctccagcaccaacttggctgaccacaaccctagctcttggcgcgatcacgacgatgctactagtacccatagcgcgggtacccctggtcccagcagcggcgggcacgctagccagagcggggacaattcaagcgaacagggggatggtctggacaatagcgtggcttctccagggacaggagatgacgacgaccctgataaagataagaagcgccagaagaaaagaggtatctttcccaaggtggcaactaatattatgcgggcctggcttttccagcacctcacacacccttacccctccgaagaacaaaaaaagcagctcgcccaggacaccggcttgactatcctgcaggtcaacaattggtttattaatgctaggaggagaatcgtgcagccaatgattgaccaaagcaatagggctggatttttgcttgacccctctgtgtcccaaggtgctgcttactcacccgagggccaacccatggggtctttcgtgctggacggccagcagcatatgggcatccgacccgcagggctgcagtccatgcccggagactacgtctcccagggagggccaatgggaatgtccatggcgcagccaagctatacccctccacagatgaccccacatcccactcagctgcgtcacggacccccgatgcactcctacttgccaagtcacccccatcatcctgccatgatgatgcacgggggccctccaactcatcctggaatgactatgtcggctcaatcccctactatgctcaattcggtggatcctaatgtaggtggccaggtaatggatattcacgcccagtag

SEQ ID NO: 123813 - DNA, 357 bp, Artificial Sequence
  Description of Artificial Sequence: Synthetic coding sequence
atgccccgtgaggacgcgcactttatttacggttatcccaaaaagggacatggtcactcttacacaaccgccgaggaggccgccggtattggcatccttaccgtcattctgggcgtgctactgctgataggctgttggtactgccgcagacgcaatggatatcgggccctgatggacaagtctctccacgttgggactcagtgtgccctgacccgcaggtgccctcaggaaggcttcgatcaccgggacagtaaagtatccttgcaagaaaagaattgtgagcccgtcgtcccaaacgcccctccagcttacgagaaacttagtgccgaacagagtcctccaccatactccccctag

SEQ ID NO: 123814 - DNA, 357 bp, Artificial Sequence
  Description of Artificial Sequence: Synthetic coding sequence
atgcccagagaagatgcccactttatctatgggtatcccaagaaaggccatggccacagctacacaaccgctgaagaggcggctgggatcggaatcttgactgtaattttaggcgttctgctgctgattggatgctggtattgtaggcgccgcaacggctatcgcgcactcatggataaatccctgcatgtgggaacccagtgtgccctgaccagacgatgtccccaggagggattcgaccacagagattcaaaggtaagccttcaagaaaagaactgcgaacccgtggtgccaaatgctcctcctgcctacgagaagctgtcagctgagcagtctccgccaccatatagcccctag

SEQ ID NO: 123815 - DNA, 357 bp, Artificial Sequence
  Description of Artificial Sequence: Synthetic coding sequence
atgccccgagaggacgcccattttatctacggatatcctaagaaggggcatgggcactcctatactacagcggaggaggcggcaggcatcggaatcctgacggtgattctgggagtgctccttttaatcggctgttggtactgtcgaagaagaaatgggtatcgagctctgatggacaagagcctccacgtgggaactcaatgcgccctgactaggcgttgtccgcaggagggctttgatcaccgagacagcaaagtcagtctgcaggaaaagaattgtgaaccagtcgtgcctaatgcacctcctgcctacgagaagctgagcgcagagcagagcccccccccttacagcccctag

SEQ ID NO: 123816 - DNA, 1269 bp, Artificial Sequence
  Description of Artificial Sequence: Synthetic coding sequence
atgagcgtgggtgccatgaaaaagggcgtcggaagagctgtaggcctcggggggggcagcggctgccaggctactgaggaggaccctctccccaactgtggcgcttgcgcccccggacagggcggtaggcgatggaggctcccccagccagcttgggtggaaggatcctctgctcggctgtgggaacaagccacaggtactgggtggatggacctggaagcctcccttctgcccaccgggccaaacgccagtaacacatccgatggtccggacaacctcactagcgccggaagcccacctaggactggcagtattagttatatcaacatcatcatgccatcagtgtttggaactatctgcctgctgggtatcatcggcaatagcactgtgatttttgcggtggtgaaaaaatcaaaactacactggtgtaataatgtgccagacatcttcatcattaatctgagcgttgtagacctgcttttcctgctgggcatgcctttcatgattcaccagctgatggggaacggggtatggcactttggcgaaacaatgtgcaccttgataacagccatggatgctaatagccaatttacgtccacttacatactcacagccatggccatagaccgttatctggccacggtgcatccgattagcagtacaaagttcaggaagccctcggtagccaccctggtgatctgcctcctgtgggctctttcctttatatctattacccctgtctggctctatgctaggttgataccttttccaggtggtgccgtgggctgtggcattaggctccccaatccagacacggatttgtattggtttacactgtatcagttctttctggccttcgctttacccttcgtcgtgattactgccgcttatgtacggatccttcagagaatgactagcagcgtggccccagccagccaaaggtcaattaggttgaggaccaagagggtgaccaggacagccatcgcaatctgtcttgtgttttttgtatgttgggctccctactacgtgcttcaactgacgcagctgtccatttccagacccactctgacatttgtgtatctttataacgcagctatcagcctcggatacgcgaactcctgcctgaatcccttcgtgtacattgtactctgcgaaacattcagaaagaggttagttctttcagtgaagcccgctgcccagggacaactacgagctgtgtccaatgcccagaccgcagatgaggaacgtacggagtccaagggaacatag

SEQ ID NO: 123817 - DNA, 891 bp, Artificial Sequence
  Description of Artificial Sequence: Synthetic coding sequence
atgagcgttggggccatgaaaaaaggagtcggacgagcagtaggcttaggaggggggagtggctgccaggctacagaggaggatccactcccaaattgtggggcatgcgcaccaggccaaggagggagaagatggaggttaccacagccagcctgggtggagggctcaagcgcgcggttgtgggagcaggctaccggtaccggttggatggatttggaagccagcctgctccccacaggtcctaatgctagtaacacttctgacgggcctgataatctgacgtccgccggctctccacccaggaccggatctataagctacatcaacataattatgcctagcgtgttcggtacaatctgcctgctggggatcattgggaactctaccgtgatcttcgcagtcgtcaagaaatctaagctgcactggtgtaacaatgtaccagatatcttcatcatcaatctgagctttttccttgcatttgccctaccatttgttgtgataaccgctgcttacgtgcggatcttacagcggatgacaagttcagtggcgcccgcaagtcagaggagcatcagactgagaaccaaacgggttacacgaaccgctatcgcaatctgcctggtgttttttgtctgttgggccccatactatgtactgcagttgacacagctcagtatctcccgccctaccttgacctttgtgtatctctataacgctgctatttctctgggctatgcaaattcctgtctgaaccctttcgtgtacatcgtactgtgcgaaacatttcggaagaggttagttctctctgtgaagcctgccgcgcaggggcaattgcgtgcggtttcaaatgctcagacagccgacgaggagcgcacggagagcaaggggacttag

SEQ ID NO: 123818 - DNA, 1023 bp, Artificial Sequence
  Description of Artificial Sequence: Synthetic coding sequence
atgaatcctttccacgcgtcttgctggaacacatccgctgagctgctaaacaagtcatggaataaggaattcgcctaccagacggcatcggtggtggacacagtgatcctgccttctatgatcgggatcatatgtagcacaggcctggtcggaaacattttgatagtttttacaattatccgcagccgcaagaaaacagtccctgacatctatatatgcaacttggcagtggcagaccttgtgcacatcgttggcatgccttttctcattcatcaatgggcccggggcggagaatgggttttcggcggccctctgtgcaccataatcacctctttagatacctgcaaccagttcgcctgttctgccatcatgactgtgatgtctgtggaccgttactttgcactggttcaaccctttcggctcacccgatggaggacaagatacaagacaattagaatcaatttgggactgtgggctgcctccttcatcctcgcactccctgtgtgggtatactcaaaagtgatcaagttcaaggacggcgtggagtcctgcgcatttgacctgacctctcccgacgacgtactctggtacaccctgtaccttactattactaccttttttttccctcttcccttaatcttggtgtgttacatcctgatactgtgttacacatgggagatgtaccagcagaataaggatgcccgttgctgtaatccatccgtgcctaagcagagagtcatgaaattgaccaagatggttcttgtgctggtagtggtgtttatactttctgcagctccctaccacgtcattcaactagtcaatctgcaaatggagcagccgacattggcgttctatgtcggctactacctgagtatttgcttatcatacgcctcttcaagcattaaccccttcttgtacattctactgagtggtaacttccagaagaggctgccccagatccagcgtagagcaacagagaaagagataaacaatatgggcaatacactcaaatcccacttttag

SEQ ID NO: 123819 - DNA, 1023 bp, Artificial Sequence
  Description of Artificial Sequence: Synthetic coding sequence
atgaacccctttcacgcaagttgttggaacaccagcgctgagctactaaataaaagctggaataaagagttcgcttaccagacagcttctgtggtggataccgtgatcctgccatcaatgattggcattatatgttccactggtctggtaggaaatattcttatcgtatttaccatcattcgctctcgaaaaaagactgtgcccgacatctatatttgtaacctcgcagtggcagacctggtgcacatcgtggggatgccttttcttatccatcagtgggcccgcggcggggagtgggtatttggagggccgctgtgcacaattatcacatctcttgatacatgtaatcagttcgcatgctccgctattatgaccgtgatgagcgtggacaggtatttcgccttggtgcaaccgttcaggttgacaaggtggagaactagatataaaactattcggatcaacttagggctgtgggctgcgtcattcatcctcgccctgccagtctgggtatacagtaaggtcattaagttcaaagatggagtggaaagctgcgccttcgacctgactagccccgatgacgtattgtggtatacgctgtatctcaccatcacaacgttcttcttccccctgcccttaatccttgtgtgctatatcttgattctctgttacacctgggaaatgtatcagcaaaataaggatgccagatgttgtaatccctcagtcccaaagcaacgcgtcatgaaacttaccaagatggtattggtcttggttgtggtgttcattctttccgcggcgccctaccacgttatccagcttgtgaacttgcagatggaacagcctacacttgcgttttacgtaggctattacctgtcaatatgtttgtcgtacgcaagcagctcgatcaacccattcctttacatcctgctgtcaggcaattttcaaaagcggctgcctcaaatccaaaggagggctactgagaaagagatcaacaacatgggtaatacactgaagtctcatttctag

SEQ ID NO: 123820 - DNA, 1023 bp, Artificial Sequence
  Description of Artificial Sequence: Synthetic coding sequence
atgaacccatttcatgctagctgttggaacacctccgcagaactgctgaataagagttggaacaaagagttcgcataccaaactgccagcgtggtagataccgtcatacttccctccatgatcggtattatctgcagcaccgggctggtgggcaatatccttatagtattcaccataatcagaagtcggaaaaaaaccgtgcctgatatttacatttgcaatctggctgtcgcggacctggtgcatatcgtgggaatgcccttccttattcatcagtgggcacgaggcggtgagtgggtgtttggaggcccgctgtgtaccattattacttccctggacacatgcaaccagttcgcttgtagtgccataatgaccgtcatgagtgtggataggtacttcgcacttgtgcagcctttcagactaacgagatggcgaaccagatacaagacaatcaggattaacctggggctatgggcggcaagtttcatcctcgcattgcccgtttgggtttactccaaggtcatcaaattcaaggacggagtcgaaagctgcgcttttgacttgacaagcccagatgacgtgctgtggtatacgttgtacctgaccatcaccaccttcttttttccgctcccccttattctcgtctgttatatcctgatactatgttatacatgggagatgtaccagcagaacaaggacgccaggtgttgcaacccttcagtgccaaagcagcgggtgatgaaactgactaagatggttcttgttttggtcgtggtgtttatcctatctgcagcaccttatcatgtgatccagctggtgaatttgcagatggagcagcccaccttagccttttatgtcggctactatctgtctatctgcctgtcgtatgcatctagttccattaatcccttcctttatatcctcctatcgggcaacttccaaaaaagactaccccaaattcagcggcgtgctacagaaaaagagataaacaacatggggaatactctgaagagccacttctag

SEQ ID NO: 123821 - DNA, 519 bp, Artificial Sequence
  Description of Artificial Sequence: Synthetic coding sequence
atggctaacggcactaacgcatccgccccttactacagttatgaatattatttagactacctcgatctaatccctgtggacgagaagaagctcaaggctcacaagcatagcatcgtgatcgctttttgggtttccctcgccgcatttgtggtactactattcctgatactgctctatatgtcctggagtgcaagcccacagatgaggaactcaccaaagcaccaccagacctgtccctggtctcatggcctcaatctgcatctgtgcattcagaagtgtctgccatgccacagggaaccgcttgcaacatcgcaggcgcaggcctccagcgtggagcctgggtctcgtaccggaccagatcagccgctccggcaggaatccagctccacactgccgctgggtggatttcagacccacccaactctgctgtgggaattgaccctcaacgggggcccactggtcaggagcaaaccatctgaaccaccacccggcgataggacttcacagttgcaatcctag

SEQ ID NO: 123822 - DNA, 309 bp, Artificial Sequence
  Description of Artificial Sequence: Synthetic coding sequence
atggctaacggcaccaatgcaagtgccccctactatagctatgaatattacctggattatctggacctgatccctgtggacgaaaaaaaattgaaagcacataaacatagcatcgtgattgcgttctgggtttccctcgcggcctttgtggtgctcctcttcctgatcctgctgtacatgtcctggtccgcaagcccacagatgtccttcaacactgatgaatcccttttgcattccgaggtgcttccccagacacgcgccatttcctgtgatgagctccaagccccccgggaggagggagccgcatag

SEQ ID NO: 123823 - DNA, 519 bp, Artificial Sequence
  Description of Artificial Sequence: Synthetic coding sequence
atggccaatgggactaatgctagtgccccctactattcatatgaatactacctcgattatctggacctgatccccgttgacgagaaaaagctgaaggcccacaaacactctattgtgattgcattttgggtgagtcttgctgcttttgtggttttactgtttctgatcctactgtatatgagctggtcagctagtccccaaatgcggaactctccgaaacaccatcaaacgtgcccttggagccacggactgaacttgcatctctgcattcagaagtgtctaccttgccaccgggagcctctggccacgtcacaagcacaggcatctagcgtcgagcctggatcaagaaccgggccagaccagcctctgaggcaggagtccagctcgaccctacctctgggggggtttcagacgcaccccacactgctgtgggagttgaccctgaacggaggcccactggtgagatcgaagccatctgagcctcctccgggagaccgaacaagccaactgcagtcctag

SEQ ID NO: 123824 - DNA, 309 bp, Artificial Sequence
  Description of Artificial Sequence: Synthetic coding sequence
atggcgaatgggacaaacgcctccgcgccgtattattcctatgagtattacctagattacctagacctgatcccggtggacgagaagaaacttaaggcccacaagcactcaattgtgatcgcgttctgggtgtcactggccgcgtttgtggtcctcctattcctgatcctcttgtatatgagttggtccgcaagtccacagatgtcctttaatactgatgagtcactcctacattctgaagtgctgccccaaaccagagccatcagttgcgacgagcttcaggcccctcgagaggagggcgctgcttag

SEQ ID NO: 123825 - DNA, 1110 bp, Artificial Sequence
  Description of Artificial Sequence: Synthetic coding sequence
atgccgcgagctccgaaaaggcagaggtgtatgcccgaggaggatctgcagtcgcaaagcgagacacagggcctagaaggcgcccaggcaccattggccgtcgaggaagacgcctcatcctccacttctacatcctcttcctttccgtcatcatttccatcctccagttcgtcctcttctagctcttgttatcctctcattccgtccaccccggaagaagtttctgctgatgatgaaacacccaatccaccacagtcagcccagatcgcttgctcctcaccctccgtggttgcgagtctgcctctggatcagtctgacgaaggtagctcttcccagaaggaggagtcaccaagcaccttgcaggtcttacctgactctgagtccctgccccgctcagaaattgatgagaaagtcaccgatctggtgcagttcctgctattcaaataccagatgaaggaaccaattacaaaagccgagattttagaatccgttatcagaaactatgaagaccacttccccctattattttctgaggcatcagagtgcatgttgctggtgttcggaatcgacgttaaggaagttgatcctacagggcatagctttgtcttggtgacgagcctgggccttacttacgacggaatgctttccgatgtccaatcgatgccaaaaaccgggattcttattttgattctgtcaatcgtgtttatagagggatactgcacaccagaggaggtcatctgggaggcgcttaacatgatggggctctatgatggcatggagcatttgatttatggcgaaccgcgcaaactcctgacacaggattgggtgcaggagaattacctcgaataccgccaagtaccaggcagtgaccctgcccggtacgagttcctttggggccccagagcccacgccgaaatacggaagatgagtttactgaagttcctggccaaggtcaatggttcagatcctcgcagttttccattatggtatgaagaggcattgaaagatgaagaggagagggcgcaggatcgtattgctactactgatgacaccacggccatggcctcagcgtcttctagcgcaaccggttcgttctcctatcctgagtag

SEQ ID NO: 123826 - DNA, 1110 bp, Artificial Sequence
  Description of Artificial Sequence: Synthetic coding sequence
atgcctcgcgccccgaagcggcagaggtgtatgccagaggaggatttacaaagtcaatccgaaacgcaggggctggaaggggcccaggcccccttagccgtggaggaggacgcatcttctagcaccagtacaagtagctcatttcccagcagtttcccctcaagcagcagcagtagctcttccagttgctaccccctgatcccctcaactcccgaggaggtctcagccgatgatgagacacccaatccaccacaatccgcccaaattgcatgctcgtctccttccgtggtggcaagtctccctttggatcaaagcgacgagggttcctcttctcagaaggaagagagtcctagtactctgcaagtccttcccgactccgagtcactgcctcgctcagaaatcgatgagaaggttacagatttggtgcagtttctgctttttaagtatcagatgaaagaacctataaccaaagccgagatcctggagtcagtcatccgcaattacgaggatcactttcctcttctgttctccgaagcaagtgagtgtatgctgcttgtgttcggaatcgatgtgaaagaggtcgaccctacaggccacagcttcgtactcgtaacatccttgggcctcacatacgatggaatgctgagcgatgtgcagagcatgcctaaaaccgggattctgattcttatcctgtccatagtcttcatcgaggggtactgtacacccgaggaggttatttgggaggccctgaatatgatgggtctctacgacggtatggagcacttgatctacggcgagccacgaaagctactcactcaggactgggtgcaggagaattacctggagtacagacaagttcccggctcagacccagctagatacgagttcctctggggccctagggcccatgccgagattcgcaaaatgtctctcctgaaatttctggctaaggtcaatgggtctgaccctcggtcttttccattatggtatgaagaggcccttaaagatgaagaggagagagcacaggacagaattgccactaccgacgatacgaccgccatggcaagtgcatcctccagcgccacaggctccttttcctaccctgaatag

SEQ ID NO: 123827 - DNA, 486 bp, Artificial Sequence
  Description of Artificial Sequence: Synthetic coding sequence
atgcccagggcccctaagaggcaaaggtgcatgccagaagaagaccttcagagtcagagcgagacccaggggctcgagggcgcccaagccccattggcagtggaggaggatgcgtcctcatctacgagtacatcctccagctttccttccagcttcccttcctcctcttcctccagctctagttcctgctatccgctgattccgagcacacccgaggaagtttcagcggacgatgaaactccaaacccaccccagagcgcccagattgcctgttccagcccatcagtcgtggcttcactgccactggatcagagcgacgaaggaagcagcagccagaaagaagagagtccgagcacgctgcaggtgctgcctgactctgagtccctgccacgcagtgaaattgatgagaaagtgaccgatctcgtgcagttcctcttgttcaagtatcagatgaaagaaccaattacaaaagcggagattctttag

SEQ ID NO: 123828 - DNA, 573 bp, Artificial Sequence
  Description of Artificial Sequence: Synthetic coding sequence
atgccacgagcgcccaaacgccagaggtgtatgcccgaggaggatctccagtcccagagcgagacacagggattggaaggggcacaggccccactcgctgttgaagaggatgccagctccagtacaagcacctcctcaagcttccccagcagcttcccttcatcttcatcgtcgagtagcagctcttgctaccctttaatcccttccacgcccgaggaagtgtccgccgatgacgaaacccccaacccaccccagagcgcacaaatcgcttgtagctcacccagtgtcgttgcctcactccccttagaccagtcagatgagggctcctcaagccaaaaggaggaaagcccaagcacccttcaggttctcccagactcagagagtttgcctaggtccgagattgacgaaaaagtcacagacctggtgcaattcctgctcttcaagtatcagatgaaagaaccgatcacaaaggccgagattctggagagtgtaatcagaaattacgaagatcattttcccctccttttttccgaggcttcggagtgcatgctccttgtgttcggaattgactag

SEQ ID NO: 123829 - DNA, 1203 bp, Artificial Sequence
  Description of Artificial Sequence: Synthetic coding sequence
atgtctaaggttagcactatgttttccgaggacgatttccagtctacagaacgggccccttacggccctcagttacaatggagccaggacctacccagagtccaggttttcagggaacaggccaatttagaagacagatcaccccgcaggactcagagaattacaggtggggagcaggtactctggggacctatcacacagatcttccctaccgtgagaccagcagatctgaccagggtgatcatgcccctcgagcaaagatctcagcattgcaaacccgaagaggggctgcaagcccaggaagaggatctgggactcgttggggcccaggcattacaggccgaggaacaggaggccgcattcttcagctcaacccttaacgtcggaacccttgaagaattgccagcagccgagtcaccctctccgccccagagtccccaggaggagtcattttcccccactgctatggacgccatattcgggtctttatctgacgagggatccgggtcccaagagaaagaagggcctagcacatccccagacttaattgacccagaatcttttagccaagacattctccatgacaaaatcatagacctggtgcatctacttctcaggaagtaccgggttaaggggctcatcacaaaagcagagatgctcggaagtgtgatcaaaaactatgaggactacttcccggaaatcttccgtgaggcctcagtgtgcatgcaactcttgttcgggatcgacgtcaaggaggtggatcccactagccattcctatgtcctggttaccagcctgaacctgtcttacgatgggattcaatgcaatgaacagagtatgcctaagagcggtctgttaatcattgtcctcggagtgatctttatggaagggaactgcatccctgaggaagtgatgtgggaagttctcagtatcatgggagtatatgccggccgcgagcatttcctgtttggagaacccaagcgacttctgacccaaaactgggttcaggaaaaatacctcgtctatcgccaagtgcctggcacagacccagcttgttatgagttcttatgggggccgagggcacacgccgaaacatctaaaatgaaggtattggaatacattgctaatgcgaatgggagagatccgacgagctatccttccctgtatgaggacgcacttcgtgaagagggggaaggcgtgtag

SEQ ID NO: 123830 - DNA, 1290 bp, Artificial Sequence
  Description of Artificial Sequence: Synthetic coding sequence
atggaaactcaatttaggagagggggccttgggtgctcccccgcctcgatcaagaggaagaagaaaagagaggatagcggcgatttcggcctgcaagtgtcaaccatgttttccgaagacgatttccagagcacggagagggcaccttacggccctcaactacagtggagccaggatcttcctagggtacaggtgtttcgggagcaagccaatttagaagaccgctctcctaggcgcacccagcgcatcacagggggcgaacaggtgctgtgggggcctataactcagatatttcccaccgtgagacccgctgacctgacgcgggtgatcatgcctctggagcagaggtcccagcattgtaaaccagaagaggggctgcaggctcaagaagaggacctggggctggtgggggcccaggctttgcaggcggaagagcaagaagctgctttctttagctctaccctgaacgtagggactcttgaggaactccctgcagccgaatctccatcccccccacagagcccacaggaggagtccttcagtcccaccgctatggatgctatattcggcagtctctctgacgaaggctccggtagtcaagaaaaggaaggcccatccacctccccggacttaatcgaccccgaatctttcagccaggacatcctgcatgataagatcattgatttggtgcacttgctgcttcgcaaatatagagttaaaggcctgatcactaaggccgagatgctcgggtctgtgatcaagaactacgaggattactttcccgagattttcagggaagcctccgtttgtatgcagttgctcttcggaatcgacgtgaaggaggtggaccctactagtcacagttatgttctcgtcacatcactgaacctgtcatatgatggaatccagtgtaacgagcaatcaatgccgaaatctggcctcctgatcatagtactgggagtaatcttcatggaggggaactgcataccagaggaggtgatgtgggaagtgctgtctatcatgggcgtatatgccgggcgggaacatttcctatttggggaaccaaaaagactgctgactcaaaactgggtgcaggagaagtatttagtataccgccaggtccccggcactgatccagcctgctatgagtttctctggggaccgcgggcccacgccgagactagtaaaatgaaggtgctggaatacatcgccaacgcaaatgggcgtgaccccaccagctaccccagtctctacgaggatgcactcagggaggaaggtgaaggcgtttag

SEQ ID NO: 123831 - DNA, 945 bp, Artificial Sequence
  Description of Artificial Sequence: Synthetic coding sequence
atgccacttgagcaacggtcccaacactgtaagcctgaggaggggctggaggcgcagggagaagctttagggctggtgggggcccaggctcctgcaaccgaggagcaagaaactgcttcaagttcttccacactggtagaagttacactaagagaggttccggcagctgaatcaccatcacctccacactcaccacagggggcatccaccctccccacgacaatcaactatacattgtggagccagtctgacgagggatccagtaacgaagaacaggaaggcccatcaacgtttccggatctggaaacctcattccaggtcgcactatctcgtaaaatggcagagcttgtgcatttcctgttgctgaaataccgggcaagagaacctttcactaaagctgaaatgttaggcagtgtgatacgcaacttccaggattttttccctgttattttttctaaggcctccgaatacctccagctggtgtttgggattgaggtggtcgaagtggtgaggatcggccacctctatatattggtgacatgcctgggactgagctacgacggccttctgggagacaaccagatcgttccaaagaccggcctgctgattattgttttagctatcattgcaaaggaaggagattgtgcgcccgaggaaaaaatttgggaggaactgtccgtgttagaggccagtgatggacgggaggattcagttttcgctcatccacgcaaactcttgacccaggacctagtccaggagaattacctggagtatcgacaggtgcccgggagtgatcccgcttgctatgagttcctgtggggccctcgtgcgctggttgagacaagctacgtgaaagtgctccaccatctgctcaaaatctccggaggtccacatatctcttaccccccccttcacgagtgggccttcagggaaggagaagaatag

SEQ ID NO: 123832 - DNA, 945 bp, Artificial Sequence
  Description of Artificial Sequence: Synthetic coding sequence
atgcctttagagcaacgcagtcagcactgtaagcccgaagaaggccttgaggctcagggtgaagctctaggcttggtgggggcccaagcccctgcaacagaggagcaagaaactgcatcaagtagtagcacccttgttgaagtcaccctcagagaagtgcctgcggctgaatcgccctcacccccgcatagcccccagggcgcaagcaccctacccacaactatcaactataccctgtggtctcagtcggatgagggcagttctaacgaagaacaggagggcccctcaacctttcccgaccttgagacatcctttcaggtcgccctctccagaaaaatggctgaactggtgcattttctactactcaagtatcgcgccagggagccctttaccaaggctgaaatgctcgggagcgttattagaaacttccaagacttttttccagtgatattttccaaggcttctgagtaccttcagctagtcttcggcatagaggtggttgaggtcgtcagaataggtcacctgtacatcctggttacatgcctcggtctctcctacgacggtctcctgggcgataatcagatagtgccaaaaactggcctcctaattattgtgctggccattatcgcaaaggaaggcgactgtgccccggaggaaaagatatgggaggagctatccgtcttggaggcctcagatggaagggaggattccgtctttgcccatcctcgtaagctgctgacacaggacttggtccaagagaattatctcgaatatcggcaggtccccgggtctgatcctgcatgctatgaattcctgtggggacctcgcgccctggtagagacgtcgtacgtgaaggtgctgcatcacctgctgaagataagtggaggacctcatatctcctatccacccctccacgaatgggcattccgtgaaggggaagagtag

SEQ ID NO: 123833 - DNA, 945 bp, Artificial Sequence
  Description of Artificial Sequence: Synthetic coding sequence
atgcctctagagcagagatcgcaacattgcaagcctgaggaaggccttgaggctcagggcgaggccctggggctggtgggcgcacaggccccagccacagaggagcaggaaacagccagctcctcttctactctggtggaggtcactttgcgggaggtccctgccgccgagtccccctcacctccacacagtccacagggtgcctcaacccttccaacaactatcaattacaccctgtggtctcaatctgatgaaggttcatctaacgaggagcaggaaggccccagcacgtttcccgatttggagacgagtttccaggtggccctgtctcgaaagatggccgagctcgtccatttcctgctgctgaaatacagggcacgcgaaccctttacgaaggcggaaatgcttggctcagtcatccgtaatttccaggatttcttccctgttattttcagtaaggcgagtgaatatcttcagctggtgtttggaatagaggtggttgaagttgtccgtatcggtcatttgtacatcctggtaacctgccttggactttcctacgatggattgcttggcgataatcagatcgtgccaaagacaggactgcttattattgtgctggcaattatcgccaaggagggcgattgcgcacctgaggagaagatctgggaggagctatccgttctcgaagcttccgacggaagagaggattccgtgtttgcacaccccaggaagcttctgactcaggaccttgtgcaggaaaactatttggagtacaggcaagtgccgggatcggacccggcctgttacgagttcctctggggtcctagagccttagttgaaacctcgtacgtgaaagttctgcaccatctactgaaaatttcaggaggaccccatatatcttacccccctctgcatgagtgggctttccgagaaggagaggagtag

SEQ ID NO: 123834 - DNA, 945 bp, Artificial Sequence
  Description of Artificial Sequence: Synthetic coding sequence
atgcctcttgagcagagatcacagcactgcaagcctgaagaagggctggaggcacgcggcgaggctttggggctggttggcgcacaagctccagcgacggaggaacaacaaacggcctcaagctccagcacactggtcgaggtgactctgggggaagtaccggccgcagattccccttcaccgccccactccccacagggggcttcaagtttttccaccaccataaattacaccctgtggaggcagagtgacgaaggaagcagtaatcaagaggaagaaggcccgcgcatgttccccgatctcgagtccgaattccaagccgctatttcccgtaaaatggtggaattggtgcactttctcctactgaagtaccgggcgcgagagcccgttactaaagcagaaatgctggagtccgtgctgagaaattgccaggacttttttcccgtcatcttttccaaggcatccgagtatctgcagctcgtgtttggtatcgaagtggtggaggtggtgccaattagccacctgtatatccttgtgacttgcctaggcctcagttatgatggcttacttggagacaatcaagtgatgcccaagactgggctgctcatcatcgtgctggcaattatagcaatcgagggtgactgcgcccctgaggaaaaaatctgggaggagctctccatgctggaggtcttcgaaggtcgcgaagacagtgtttttgcacatcctagaaaacttttgatgcaggatctggtgcaagagaattatcttgaatacagacaggttcccgggtccgatcccgcctgctatgaatttctgtgggggccacgcgcgctgatcgaaacctcttatgtcaaggtcctgcatcatactctgaagatcggaggggagcctcacatcagttatccgccactgcacgagcgagccctccgcgagggagaagagtag

SEQ ID NO: 123835 - DNA, 945 bp, Artificial Sequence
  Description of Artificial Sequence: Synthetic coding sequence
atgcccctggagcagagaagtcagcactgcaaacccgaagagggtctggaggcacgtggcgaagctctcggcctggttggggctcaagccccagccaccgaggaacaacagactgccagtagttcttcaaccctggtcgaagtgacacttggtgaagtaccggcagccgattcacccagtcctcctcactctccccagggcgcctcgtccttcagcacgacaattaattacactctgtggagacagtcagacgaaggctcaagtaatcaggaggaggagggccccagaatgttccccgacctggagtcagagttccaggccgcaatctccaggaaaatggtggagctggtccactttctgctccttaagtaccgggctcgagagcccgtcactaaagctgaaatgctggagtccgtgcttcggaactgccaggattttttccccgtgatattttccaaggcctctgagtatttacagctcgtgttcggtattgaggtcgtagaagtggtcccaatatctcatttgtacattctggtcacttgtctgggattgagttacgatggcctcctaggggataaccaggtaatgccgaagacaggtttgcttataattgttcttgccatcatcgctatcgagggggactgcgcacctgaggagaagatttgggaggaactctcaatgcttgaagtgttcgagggaagggaggactcagttttcgcacacccaagaaagctgctgatgcaggacctggtccaggaaaattatctggaatatcgccaggtacccggcagtgatccggcctgttacgagttcttgtggggccccagagccctgattgagacttcatacgttaaagtgcttcaccatacgctgaaaatcggtggagaacctcacatttcatacccaccattacatgagcgggctctgagagagggggaagaatag

SEQ ID NO: 123836 - DNA, 945 bp, Artificial Sequence
  Description of Artificial Sequence: Synthetic coding sequence
atgccattggaacagcgttcgcagcactgtaagcctgaagagggccttgaggcacgcggggaagctctcggactcgtcggcgctcaggcaccagccaccgaagagcagcagacagcaagcagctcaagtactctcgtagaagtgaccttaggggaagttccagccgcagactccccatctcccccccacagcccccaaggggcgagtagttttagtactaccatcaactacacgctctggaggcaaagtgacgaggggtccagtaatcaggaggaagaagggccgcggatgttcccagatctggagagcgaattccaggcagccatcagtcgaaaaatggtggagttggtccatttccttttgctcaagtatcgggccagagaaccagtcaccaaagcggaaatgctcgagagtgtcctgcggaattgtcaggatttcttcccagtgatctttagcaaagcttccgaatacttacagcttgtgttcggtatagaggttgtggaggtagtgccaattagtcacctttatatcctcgtgacgtgcttaggcctcagttacgacggactcctgggagataatcaagtcatgccgaaaacgggcttactaattattgtgttggccatcatagcaattgagggggattgcgcaccagaggagaaaatttgggaggagctttctatgctggaggtttttgagggaagagaggactccgtgtttgcccatccaagaaaactcctgatgcaggatctggtccaagagaattacctcgaatatcgtcaggtgccgggtagcgatcctgcctgttatgagttcctctgggggcccagggcactcatcgagactagctacgtaaaggtcctccaccacacattgaagatcggtggggagccacacatttcctatcctcctctgcacgagcgggccttacgcgaaggggaagaatag

SEQ ID NO: 123837 - DNA, 945 bp, Artificial Sequence
  Description of Artificial Sequence: Synthetic coding sequence
atgcctctggagcaaagatctcagcattgcaagccagaggagggcctagaggctagaggtgaggccttgggtttggtgggggcccaggcccctgcaacagaagagcagcagactgccagttcaagcagcaccctggttgaagtcacgctcggggaagtgcctgctgctgactctcccagcccaccacactctccacagggggctagctccttctccaccactatcaattacacgctgtggcgtcagtcagatgagggatctagcaatcaggaggaagaaggacctcgaatgttcccagaccttgagtcagaatttcaggccgccatctccagaaaaatggtggaactcgtgcacttcctgctgctcaaatatcgcgctagggagcctgtcactaaggccgagatgctggagagtgtgctgaggaattgccaggatttttttcccgtgatttttagtaaggccagcgaatatctccagctcgtctttggaatagaggtggtggaagtcgttcccattagtcatttgtatatcctcgtaacttgccttgggctctcctacgatggattactgggtgataatcaagtcatgccaaagacggggctcctcattattgtcctggcaattatcgccatcgagggggactgcgctccggaggagaagatttgggaagaactctccatgctagaagtgtttgagggcagggaggatagcgtgttcgctcacccccggaaacttctcatgcaggaccttgttcaggaaaattatctcgagtataggcaggtgccgggctccgacccagcctgttacgaatttctttgggggcctcgagctttgattgagacctcatatgtcaaagtgctgcaccatacacttaagatcggcggcgaaccacacatctcctacccccctctccatgaacgggcactgagagagggcgaagaatag

SEQ ID NO: 123838 - DNA, 945 bp, Artificial Sequence
  Description of Artificial Sequence: Synthetic coding sequence
atgcctttagaacagcgctcccaacattgtaaaccagaagaaggcttggaggctcgcggggaagcgctgggtcttgtgggcgcccaggcccccgctaccgaggagcaggaggccgcaagctctagctccacgcttgtagaggtgacattgggagaggtgccggcagcggagtccccagatccacctcagtctccccaaggagctagctcgctcccaacaaccatgaactatccactgtggagccagtcatacgaggacagcagcaatcaggaggaagaaggtcccagcacctttcctgatctcgaatcggaatttcaggccgccctgagcagaaaagtggctgagctcgtgcacttcctccttctgaaatacagggcgcgggaaccagtgacaaaggccgaaatgctcggttccgtggtcgggaattggcaatacttctttcccgtgattttctccaaggctagttcttctcttcagctggtcttcggtattgagttgatggaggttgatcctatcggacacttatacatattcgccacatgcctcggcctcagttacgatgggctactgggggacaatcagattatgccaaaggccggactgctgatcattgttctggcaatcattgcaagggagggcgattgtgcaccagaggagaagatctgggaagagctctcagttctggaagtctttgagggccgagaggacagcatcctgggagaccctaagaagctgctcacccagcactttgtccaggaaaactacctagaatatcgccaggttcccgggtcagatcctgcttgctacgaatttctctgggggcctcgggctctggtcgaaacatcttatgtcaaggtgctgcaccatatggtgaagatttctgggggaccacatattagctatccacccctacacgagtgggtgctaagagagggcgaggaatag

SEQ ID NO: 123839 - DNA, 945 bp, Artificial Sequence
  Description of Artificial Sequence: Synthetic coding sequence
atgcccttagaacagaggagccaacactgcaagccagaagagggactggaggccagaggggaagctctgggtttagtgggtgcccaggcaccagccaccgaagagcaggaagccgccagttcttcaagcacactggtggaagtcactctaggtgaagttcccgccgctgaatcgccagacccaccacagagccctcaaggcgcctcttctctcccaaccaccatgaattaccccctgtggagccaatcatacgaagatagctctaatcaggaggaagaaggtccctcaacatttcccgatctggagtccgagttccaggcagcactctctcggaaggtagccgagttggtgcactttctgctgctcaagtatcgggcacgcgagcctgtaactaaggccgaaatgctgggaagcgtcgtgggaaattggcagtatttctttcccgtgatattctctaaggcatcctcttcgcttcagctggtctttggaatcgaactaatggaggttgatcctatagggcatctttacatcttcgcgacctgcctcggcttgagctatgatggactgttgggtgacaatcagatcatgccaaaggccgggctgctgataattgtgcttgctatcatcgccagagagggtgattgcgcacctgaagagaaaatttgggaggagctttccgtattagaggtctttgagggcagagaggactcaatcctgggggatcccaaaaaactgctgacgcagcattttgtacaggagaactatttggagtacaggcaggtgcccggctctgaccccgcgtgttacgaatttctctggggccctcgcgcattagtagaaacaagctacgtgaaggtgctccatcatatggtgaagatcagtggaggcccccacatctcatatccgccattacatgagtgggtcctgcgggaaggggaggaatag

SEQ ID NO: 123840 - DNA, 597 bp, Artificial Sequence
  Description of Artificial Sequence: Synthetic coding sequence
atgcctctagagcagagaagccagcattgcaaacccgaagaggggctcgaggcccgcggcgaagccctggggctggttggtgctcaggcacctgctactgaggagcaagaagctgcttcatcctcttcaacgttggtggaagtgaccctgggggaagtccctgcagccgagagcccggacccacctcagtctccgcagggcgcatccagcttgcctacaaccatgaactacccgctgtggagccagagttacgaggacagcagtaatcaggaggaagagggaccaagtacttttccagatttggaatccgaatttcaggcagcgcttagccgaaaggtggcagagctggtgcactttctgctcctgaaataccgggctagagagccagtgacaaaggcagagatgctgggttccgtcgtcgggaactggcaatacttctttccagtgattttctccaaggcaagcagcagtttacagttagtgttcggaattgaacttatggaggttgacccaatcgggcatctctatatctttgctacttgtttgggattgagctacgatggtttgctaggcgacaaccagattatgccaaaatag

SEQ ID NO: 123841 - DNA, 954 bp, Artificial Sequence
  Description of Artificial Sequence: Synthetic coding sequence
atgagcagtgagcaaaaaagtcagcactgcaagcccgaagaaggggtcgaagcacaggaggaagcattagggctagtgggtgcccaggcccctaccacagaagaacaggaggccgctgtgagcagcagctccccgcttgttccgggaacactggaggaagtcccagccgctgagtcagcaggacctccacagagtccacagggggcttccgcattgcccacgacaatatcgtttacctgttggcggcaacctaacgaaggctcaagcagccaggaggaggaaggcccgagtacaagcccggatgccgaatcactgtttcgagaggccctgtccaataaggtggacgaactggctcacttccttctgcggaagtaccgggccaaagaactcgtaaccaaagccgaaatgctagagagagtcatcaagaattataagaggtgctttcctgtgattttcggaaaggcaagtgagtctctgaaaatgatcttcggcattgatgttaaggaggtggacccagcaagcaacacctacacccttgtcacgtgtctggggttgtcctacgacggacttctgggcaacaaccagattttcccgaagaccgggctcctgatcatagtactcgggacaatcgccatggaaggagactctgctagcgaggaggagatttgggaagagctgggggtcatgggcgtgtatgacgggcgcgaacacactgtttatggcgagccacggaaattgttgacacaagactgggttcaagagaactatctggagtaccggcaggtgccaggaagcaatccggctagatatgaattcctgtggggccctagggccctagcagagacaagctatgtgaaagtcttagaacatgttgtgagggtgaatgcgagggtgcggattgcttatccttctctgcgggaagccgcactattagaagaggaggagggagtctag

SEQ ID NO: 123842 - DNA, 954 bp, Artificial Sequence
  Description of Artificial Sequence: Synthetic coding sequence
atgagctcagaacaaaaatcccaacattgcaaacctgaagagggcgtggaggctcaggaggaagcgctgggtctggtgggagcacaagccccgaccaccgaggagcaggaggccgccgtttccagtagctcccccctggtgcccgggaccctggaggaagtgccagctgcagagagcgccggcccacctcagtccccccaaggggcctccgctctgccgactaccatatcttttacttgctggcggcagccgaatgaaggaagttccagccaggaagaagagggccccagcacttctccagatgcggagagtctcttcagagaagctttaagcaataaagtagacgaactagcccatttcctgttacggaagtatcgggcaaaggagctggtaacaaaggctgagatgctggaacgcgttatcaaaaactacaaacgctgcttcccggtgatattcggcaaggcctctgaaagtctgaagatgattttcggcatcgacgtgaaggaagtggacccagcgtccaacacgtatactctagtgacctgcttggggttgtcttacgacggcctgctgggaaacaaccagattttccctaaaaccggtcttttgatcattgtgctgggtactatagccatggaaggagactctgcatcagaggaagaaatttgggaagaactcggagtgatgggggtgtacgatgggagggagcacacagtatacggcgagcccaggaaactactgacacaggattgggtgcaggagaactatctcgagtatcgccaggtccctggctcaaatcccgctaggtacgaattcctatggggcccccgggcactggccgagacatcctacgtgaaagtgctagaacatgtcgtgcgcgttaacgctagggtgagaattgcttatcctagtcttcgcgaagccgccctgttggaggaggaggagggagtgtag

SEQ ID NO: 123843 - DNA, 954 bp, Artificial Sequence
  Description of Artificial Sequence: Synthetic coding sequence
atgtcatctgagcaaaaaagtcagcactgtaagcccgaggagggcgtcgaggcacaggaggaagcattgggtcttgtcggggcgcaggcacctaccaccgaggagcaggaggcagccgtctcttctagctcccctctagttccaggtacgctagaagaagtaccagcagctgagagcgcagggccaccccagtcccctcaaggcgccagcgcactgccgactaccatttcttttacctgttggcgacagccgaacgaaggatccagcagtcaggaagaggagggtccaagcacatcaccagacgcggagagcctgtttcgagaagccttgtcaaataaggtggacgagctagcccacttcctgctgcgtaagtatagggcgaaggaactcgtcaccaaagcagaaatgctcgagagagtgatcaaaaactacaagaggtgctttcctgtgatatttggcaaggcctctgagagcctcaaaatgatctttggcattgacgtgaaagaagtggatcctgcttccaacacatacacactcgttacatgtttaggtctgtcttacgatggtctattgggtaataatcagatcttccccaagacaggtttgcttattattgtgttggggaccattgccatggagggagacagtgcctctgaagaggaaatttgggaggaactgggagtcatgggggtctacgatgggagagaacatacagtttatggtgagccccggaagctgctgacccaggattgggtgcaggaaaactacctggaataccgccaggtccctggctccaaccccgccaggtatgaattcctctggggtccaagagcactggcagagacttcctacgtgaaggtgttggaacatgttgtcagggttaacgcccgggtgaggatcgcctatccaagtttgagggaagcagccctgttagaagaagaagagggcgtttag

SEQ ID NO: 123844 - DNA, 954 bp, Artificial Sequence
  Description of Artificial Sequence: Synthetic coding sequence
atgtccagtgagcaaaagtcacagcactgtaaacccgaagagggcgtcgaggctcaggaagaagctctcggcctggttggagcccaggcacctacgacagaggaacaggaagctgccgtgagcagctcaagtcctctggtacccggcactctggaagaagtccccgcagccgaaagcgccggtcccccccaaagcccccagggggcttctgccttacctactacaatcagctttacctgctggagacaacccaatgaagggtcaagcagccaggaagaggagggcccgagtacttcccccgacgctgagtccctatttagagaggccctgtcaaataaggttgatgagctggcccactttctgttaagaaagtatagggccaaagaactggtgactaaagctgaaatgctcgagagggtaattaagaattataagcgatgtttcccagttattttcgggaaggcgtctgaaagtctgaaaatgatcttcggaattgatgttaaggaagtggaccctgcaagcaacacatataccttagtcacctgcctggggctatcttacgacggcctcctgggaaataatcagatctttccaaaaacgggcttactgattatcgtgctgggcaccatagcgatggaaggcgattccgcaagcgaggaagaaatatgggaggaattgggagtgatgggtgtttatgacgggcgggaacacactgtatacggtgagccacgaaaactgctgacccaagattgggttcaagagaattacctggaataccgccaggtgccaggatcaaatccagcgagatacgagttcctatggggaccacgcgcactcgccgagacctcctatgtaaaggtgctggagcacgtagtgcgggtgaacgcaagggtcagaatagcatatccaagcctgagagaagctgccttgttggaggaggaagagggcgtgtag

SEQ ID NO: 123845 - DNA, 954 bp, Artificial Sequence
  Description of Artificial Sequence: Synthetic coding sequence
atgtcctctgagcagaaaagtcagcactgtaagcctgaagagggagtagaggctcaggaggaggccctcggtctggttggggcacaggccccgacaaccgaggagcaggaagctgcagtgtccagttcttcacccttagtcccaggcactctagaggaagtgccagctgcggaatcagccggtccaccacaatcaccacagggggcaagtgccttacctaccacgatctctttcacatgttggcgacaacctaatgaggggtcatctagccaggaggaggaaggaccttccacttcgcccgatgcggaaagcctcttccgagaggctctgtcaaataaggtcgacgagctggcccatttcctgttacggaaatatagggccaaggagctggtcactaaagccgagatgctggagcgagtcattaagaactacaaacgatgcttcccggtgattttcggtaaggcatcagaatcgctcaaaatgatattcggaattgatgtgaaagaggtggatcctgcatctaatacatataccctcgtgacctgtctggggctaagttacgacggccttttaggaaataaccagatcttccctaagacaggtctgctaattatcgtactggggactattgctatggagggggatagtgcaagcgaagaagaaatctgggaagagctgggggtgatgggcgtatacgacgggcgggaacacacagtgtacggcgaaccccgtaagctgctgacgcaagactgggtgcaggagaattatcttgagtaccggcaagtgcccggctcgaaccctgcacggtatgaattcctctggggcccaagagccttagcagagacctcatacgtaaaagtgctcgaacacgtcgtcagagtgaatgcgagggttaggattgcttacccttctctccgtgaggccgcactgcttgaggaagaagagggcgtttag

SEQ ID NO: 123846 - DNA, 954 bp, Artificial Sequence
  Description of Artificial Sequence: Synthetic coding sequence
atgtctagtgagcagaaaagtcagcactgtaaacctgaggagggagtggaagctcaggaagaagccctgggtttagtgggtgctcaggctccaactacagaagaacaggaggctgctgtgtcttcttcttcacccctcgtccctggaaccctggaagaggtgcctgctgcagaatctgcagggcctccccaatccccccagggagccagcgccctgccaaccaccatcagcttcacttgctggcgacaaccgaatgaagggagttctagccaggaagaagaggggccgtctaccagcccagacgctgaatccctattccgggaagcactctccaataaggtggatgaactggctcattttctgctcagaaaatatcgcgccaaggaattagtgactaaagcagaaatgctagagcgggttattaaaaattataagagatgctttcctgttatcttcggaaaagcctcagaaagcctgaaaatgatctttggaattgacgtcaaggaggtggaccctgccagcaacacctacactctcgttacatgcctgggattgagctatgacggactgttaggaaataaccaaatttttcccaagactggcttgcttatcatcgttcttggtactatcgccatggagggtgattctgcatcagaggaggaaatctgggaagaactgggagtgatgggagtgtacgatgggagggagcataccgtgtacggagaaccccgtaaactgctgactcaagattgggtgcaggagaactacctggagtacaggcaggtacccggttcgaacccagcgagatacgagtttctttggggcccacgagcactggccgaaacatcctacgtgaaggtcctcgagcacgtagtgcgagtgaatgctagggtgcgcatagcttatccatcccttagagaggcagccttgctggaagaggaagagggcgtctag

SEQ ID NO: 123847 - DNA, 954 bp, Artificial Sequence
  Description of Artificial Sequence: Synthetic coding sequence
atgagctctgagcaaaaatcacaacattgtaagccagaggagggagtggaggcgcaagaggaggccttgggactggtgggagctcaggcgcctacaacagaagaacaggaggctgccgttagttcctcctctcccttggtacctggaacactagaggaagtgcccgcggctgaatccgcaggtccaccccagtccccgcaaggagcctctgcattaccgacgactatctcctttacctgctggcgccagcctaatgaaggctcaagttcgcaggaagaagaaggcccgagcacatcccccgacgcagagagtctgttcagagaggccttgtctaacaaagtagatgagctagctcactttttgcttcgaaaatacagagcaaaggaactcgtaactaaagctgaaatgctggaacgagtaataaagaattataagcgctgtttccccgtcatattcggcaaagcaagcgaatccctgaaaatgatatttgggatcgatgtgaaggaggtggatccggccagcaacacctacacccttgtcacctgcctgggtttaagttacgatgggctgcttggcaacaatcagatcttccccaaaaccgggctcttaattatcgtattgggtacaatagccatggagggagattccgcatctgaggaggagatctgggaggaattaggcgtgatgggcgtttacgatggccgtgagcacacagtgtacggggagccccgtaaattgctgacacaggattgggtgcaggaaaattacctggagtatcgccaggtcccggggtcgaaccctgccagatacgagtttttgtggggtccacgagccctggcagagaccagctacgttaaagtgctggaacatgtcgtccgagtcaacgcccgggtgcgcattgcatatcctagtcttcgggaagcagcactcttagaggaggaggaaggggtgtag

SEQ ID NO: 123848 - DNA, 693 bp, Artificial Sequence
  Description of Artificial Sequence: Synthetic coding sequence
atgtcatctgagcagaagagtcaacattgcaaaccggaggaaggtgtcgaagctcaagaagaagccctgggtctcgtgggggctcaggcgccaacaacagaggagcaggaggccgccgtctccagctcaagtcctttggtcccgggtacactggaagaggtgcccgccgccgaatctgccgggccacctcaatcccctcaaggcgcgagcgcgctgccaaccacaataagctttacgtgctggcggcagcccaacgagggttcgagctcgcaggaggaagaggggccctccacttcgcctgacgccgaaagtctgttcagggaagcactgagtaacaaagtggacgagctggctcacttcctgctgcgcaagtaccgagcaaaagagctcgtcaccaaagctgaaatgctagaacgcgttataaaaaactataaacgctgttttcctgtcattttcggaaaagcaagtgagagccttaaaatgatattcggtattgacgtgaaagaagttgatcctgcctctaacacgtacactcttgtaacctgtctgggcctctcatacgacggtctgttaggtaataatcagattttcccgaagacaggactgttgattatagtccttggcacaatcgccatggaaggggattcggcctccgaagaggagatatgggaggagctgggcgtgatgggctag

SEQ ID NO: 123849 - DNA, 654 bp, Artificial Sequence
  Description of Artificial Sequence: Synthetic coding sequence
atgtcttccgagcaaaagagccagcattgcaagcctgaagaaggcgtcgaggctcaagaagaggctttaggactcgtaggagcccaagctccaactacagaagagcaggaggccgccgtgtccagttcctcaccattggtcccaggaacccttgaggaagtaccagccgccgaaagcgccgggccaccacagagtccacagggcgcaagcgccctgccgacaacaatctctttcacatgttggaggcagcccaacgagggaagtagcagtcaggaagaggaggggccatccacttcgcctgacgcagagtcactcttccgagaagccctgagcaataaggtggacgagctagctcattttctgttgcgtaagtaccgagccaaagaactggtgactaaagcagaaatgttagaacgcgtgattaagaattacaaaagatgcttcccagtgatcttcggcaaagccagcgaatccttgaagatgatttttggcatcgatgtgaaggaagtcgaccccgcaagcaatacatatacattagtaacctgccttggcttatcctatgacggtcttttggggaacaatcagattttcccgaaaacgggtctgctcattattgtgttgggaacaatcgctatggaaggggactcggcgtag

SEQ ID NO: 123850 - DNA, 726 bp, Artificial Sequence
  Description of Artificial Sequence: Synthetic coding sequence
atgagcagtgaacagaagtctcagcactgtaaacctgaagagggggtggaggcccaggaagaagcactgggactcgtgggcgctcaagcaccaactacagaagagcaggaggccgcagtgagctcatccagcccgctggtgccggggacactggaggaggtgcccgcagcagagtctgccggacccccacagtccccccaaggcgctagcgccctgccaacaactatctcgttcacttgctggcgccagcccaatgaaggatccagttcacaggaagaggagggcccatccacatctcctgacgctgagtccctttttagagaagccctgagtaacaaggtggatgaactggcccacttccttcttaggaagtacagggctaaagagttagtcacaaaagccgagatgttagagcgtgtcattaaaaattataagaggtgttttccggtgatcttcggtaaggcctcagagtccctgaagatgatttttggtattgacgtaaaggaagtggatcccgcttcgaacacgtacacacttgttacctgtcttgggttgtcctacgacggtttgctggggaataaccagattttccctaagaccggtctgttgatcattgtgctgggcaccattgccatggagggtgattcggctagcgaggaggagatttgggaagaacttggggtcatgggggtctatgatggccgcgagcatacagtttatggttag

SEQ ID NO: 123851 - DNA, 519 bp, Artificial Sequence
  Description of Artificial Sequence: Synthetic coding sequence
atgtcctctgagcagaagtcacagcattgcaagccagaggaaggagtcgaggctcaagaagaggccctgggcctggtgggtgcacaggctccaaccactgaggagcaagaggcagcggtttcctcctcatcccccctggtgccaggcaccctggaggaggtgcctgctgccgagagcgccgggccccctcagtcccctcagggcgcctcagcactgccgactaccatttcattcacctgctggcgacagcccaacgaaggaagcagtagtcaagaggaggagggcccgtccacaagcccagacgcagaatctcttttcagggaagccctttccaacaaagtcgatgaactcgcccattttctcttaaggaaatatagggcaaaggaactggtcactaaagctgaaatgctcgaacgggtgatcaagaactataaaaggtgctttcccgtgattttcggaaaagcatcagagagcttaaaaatgatttttggaattgacgtgaaggaagttgacccctag

SEQ ID NO: 123852 - DNA, 726 bp, Artificial Sequence
  Description of Artificial Sequence: Synthetic coding sequence
atgtcatccgaacagaagtcccagcactgcaagccggaggaaggcgtcgaagcccaggaagaagcccttggcctagttggcgcgcaggcgcctactaccgaagaacaggaagcagcagtctcatcgagcagtccactggtcccaggaacgctagaggaggttccggccgctgagagtgccgggccgcctcagtcaccgcagggcgcttcagcccttccaaccacaatctcatttacatgctggcggcagcccaacgaaggctcctccagtcaggaagaggagggcccctctacgtcgccggatgccgaaagcctttttcgtgaagctcttagtaacaaagtagacgaactcgctcatttcctcctccggaagtatagggctaaggaattggtcaccaaggctgagatgctcgaacgagtgattaaaaactacaagcgttgcttccctgttattttcggcaaggcttctgagagtctcaaaatgatatttggaatcgacgtgaaagaagtggatcctgcttccaacacatatacactagtcacatgcctcggcctctcatatgacggactgctcggcaacaaccagatctttccaaagacaggcctgctcatcattgttctgggcacgatcgctatggaaggcgactcggcatccgaggaggaaatctgggaggagctcggcgtgatgggcgtgtacgatggtagagaacacaccgtgtacggttag

SEQ ID NO: 123853 - DNA, 726 bp, Artificial Sequence
  Description of Artificial Sequence: Synthetic coding sequence
atgagcagcgagcaaaagtcacaacattgcaaaccggaagagggagttgaagctcaggaagaagccctgggcctagtcggagcccaggccccgacaacagaggagcaggaagccgcagtctctagttcttctcctctggtgcccggcaccctcgaggaggtcccagccgccgagtcggccggcccccctcaaagtccccagggcgccagcgccctccccaccacaatttccttcacctgttggcgccagccgaacgagggatcttcaagtcaggaggaggagggaccctccacgagccctgacgcggaaagcttgttccgagaagcactaagcaacaaggtggatgagctggcacactttcttctgcgcaaatatagagccaaggagctcgtgaccaaggcagaaatgctcgagcgcgtaattaaaaactacaaacgatgttttcctgtgatattcgggaaagcttcagaaagcctgaagatgatctttgggattgacgttaaggaggttgatcctgccagcaacacatacaccctggtcacgtgcctgggtctctcttacgatgggctcttaggcaataatcagattttcccaaaaacaggactgctgattattgtgctgggaactatcgctatggaaggcgattctgcaagtgaggaagagatctgggaagaacttggagtgatgggcgtatatgacggtagggagcacacagtttacggatag

SEQ ID NO: 123854 - DNA, 654 bp, Artificial Sequence
  Description of Artificial Sequence: Synthetic coding sequence
atgtcctcagagcagaagtctcagcactgcaaaccagaagagggcgtggaagcccaggaggaggctcttggccttgtcggtgcacaggcacccacgactgaggagcaggaggccgccgtgtctagcagcagccccctggtgcccgggacgttagaggaagtgcctgctgctgaaagcgccggccccccacagtccccccagggagccagtgcactgcccactacaatctccttcacttgctggcgccagcccaatgagggaagcagctcccaggaggaagagggcccctctacatctcctgatgcagagtctctgttccgtgaggcgctcagtaacaaagtagatgaactcgctcactttctgctgagaaaataccgcgctaaggagttggttacaaaggccgagatgctcgagagggtcataaagaattacaaacgttgttttcccgtgattttcggtaaggcctccgaatccctgaaaatgatttttggaatagacgtgaaggaggtggatcccgccagcaacacttatacccttgtcacatgtctggggctgtcttacgacggccttctggggaataaccaaatcttccccaaaactggcctgctgatcatcgtactgggaacgatcgctatggagggtgattccgcttag

SEQ ID NO: 123855 - DNA, 726 bp, Artificial Sequence
  Description of Artificial Sequence: Synthetic coding sequence
atgagtagcgaacagaaatctcaacattgtaagcccgaagaaggggtcgaggcgcaagaggaggcgctcggactcgttggcgcccaggcccccaccacggaggagcaggaggctgccgtgtcttcaagttctcctcttgtgccaggtactcttgaagaagtccctgcggctgaatccgcaggaccaccgcaatcgcctcagggggcaagtgctctgcccaccacgattagcttcacgtgctggcgacagcctaatgagggcagctcttcacaagaggaggaggggccgagtaccagccccgatgcagagtcccttttccgtgaggccctgtcgaacaaggtggacgaattagcccactttctactgcggaagtatcgtgctaaggagctagttaccaaagcggagatgttagaacgagtcatcaagaactataaaagatgtttcccagttatctttggtaaagccagtgaatctctcaaaatgatttttggcattgacgtcaaggaggtcgacccagcttccaacacgtatacactggtgacctgcctgggtctctcctacgatggcctcttggggaacaatcaaatcttccccaaaaccggattactcattattgtgctgggcaccatcgctatggaaggggacagtgccagcgaagaggagatctgggaggagctaggtgtcatgggcgtctatgacggtcgtgaacacacagtgtacggctag

SEQ ID NO: 123856 - DNA, 945 bp, Artificial Sequence
  Description of Artificial Sequence: Synthetic coding sequence
atgccccttgagcagcgatcacagcattgcaagcccgaggaggggctggaggctcgtggggaagctttgggtctcgtgggtgcacaggctcctgccaccgaggagcaggaggctgcaagtagcagcagtacgctggtcgaggtcacacttggcgaggtgcctgccgctgaatctccagaccccccgcagtcaccacaaggtgccagcagtctgcccaccacgatgaactacccactttggtcccagagctatgaggatagtagcaatcaggaggaggaggggccgtctacttttcccgacctggagtccgagttccaggccgcccttagccggaaagtggccaagttagtgcactttctactcctgaaatatcgagcacgcgagcctgtgaccaaggctgaaatgcttgggagtgtagtaggaaattggcaatatttcttcccggtgattttttctaaggcatctgactcccttcaactagtctttggtatagagttaatggaggtggatcccatcggacatgtgtacatttttgctacttgtctgggcctctcatacgatggccttctcggtgataaccagatcatgcctaaaaccggatttctcatcatcatcctggccatcatcgccaaagagggtgactgtgcacccgaagagaagatttgggaagaactgtccgtcctggaggttttcgaagggcgagaggacagtatttttggcgatcccaaaaagctcctgacgcagtatttcgtgcaggaaaattacctcgagtaccggcaggttccaggatccgatcccgcctgttacgaatttctgtggggcccccgggcgctgatcgagacatcttatgtgaaggtgttgcatcacatggtgaagatcagtggtggtccgagaatttcttatcctctactgcatgaatgggccctccgtgagggagaggaatag

SEQ ID NO: 123857 - DNA, 606 bp, Artificial Sequence
  Description of Artificial Sequence: Synthetic coding sequence
atgcctctggagcagagaagtcagcactgcaagccagaggaggggcttgaggcccgaggtgaagcgctcggtttggtgggcgcacaggccccagctacagaagagcaagaagcagcttccagcagtagcactctggttgaggtgactcttggtgaagtgcccgctgcagagtctcccgacccccctcagtcccctcagggagcatcgtcccttccgacaactatgaattaccccctctggtcccaatcttacgaagattcttcaaatcaggaggaggaagggccatccacgttccctgatttggaaagtgagttccaggctgcactgtccaggaaggtggccaagttggtacactttctgctgctcaagtaccgcgcaagagagccagttactaaagccgaaatgctgggatcagttgtcggcaactggcagtacttttttccggtgattttctcaaaggcgtccgattctctccagctggttttcggcatcgagttgatggaggtggatcccatcggccatgtgtacattttcgcaacatgcctaggcctcagctacgacgggctgctgggggataaccaaattatgcctaagaccgggttctag

SEQ ID NO: 123858 - DNA, 708 bp, Artificial Sequence
  Description of Artificial Sequence: Synthetic coding sequence
atgcccttggagcagaggtcccaacattgtaagccggaagaggggctcgaggcgcgtggggaagcactgggcctggtcggagcccaggccccagccaccgaggaacaagaggccgcttccagcagtagcaccttggtggaggtaactctcggggaggtccccgcagcagaatctcctgaccccccacaatccccccaaggcgcatcttctctgcctacgaccatgaactatccgttgtggtcacagagctacgaggatagcagcaatcaagaagaggaaggaccgtcaacttttcctgacttggaaagtgaattccaggccgctctgagcaggaaggtggctaagttagtgcacttcctgctgctgaagtacagggcgcgagaaccagtgactaaagccgagatgctgggatcagtggtgggaaactggcaatattttttcccagttatttttagcaaggcctcggacagcctgcaactggtgttcggtatcgaattaatggaagtggaccctattggacatgtttacatttttgccacttgtctcggcctgagctacgatggactgctgggcgataatcaaataatgcctaagaccggtttcctgataattatactggcgataatagccaaggagggcgactgcgcccctgaagaaaagatctgggaggaattgagtgtccttgaagtcttcgaagggagggaatag

SEQ ID NO: 123859 - DNA, 957 bp, Artificial Sequence
  Description of Artificial Sequence: Synthetic coding sequence
atgctgcttgggcaaaaaagccagcgctataaggctgaggaaggactccaggctcagggcgaggcgcccggcctcatggacgttcagatccctactgctgaagagcaaaaagcggccagctcatcttctactctgataatgggcaccctggaggaggtgaccgattcaggctctccctctccgccccagtctccagaaggtgccagttccagcctgactgtcacggactctactctgtggagccagagtgacgagggctcttcaagcaatgaggaggaaggacccagcacctctcctgatcccgcacacctcgagtccctttttagagaagctctggacgagaaggtcgcggaactggtaaggtttctgctgagaaaatatcagatcaaagagccagtgacgaaagctgaaatgttagagtccgtgattaaaaattacaaaaaccatttccctgacatctttagtaaagcctctgaatgcatgcaggtaattttcggaatcgatgtgaaggaagtggaccctgctggccactcctacatacttgtgacatgcctcggcctttcatacgacggactgctgggtgacgatcagtcaactccaaagacaggtctgttgattattgtgctgggaatgattttgatggaagggagccgcgccccagaggaggcgatctgggaagctctttctgttatgggactttacgatggtcgggaacattccgtttactggaagctccgaaagctactgacacaggagtgggtgcaggagaattacctggaatacagacaggcccccggtagcgacccagtgcggtatgaattcctgtggggaccaagggctctggccgagacatcctacgtcaaggtgctagaacacgttgtccgggtgaatgcacgggtgcggatcagttatccctcgctgcatgaggaggcgctgggagaggagaaaggggtgtag

SEQ ID NO: 123860 - DNA, 957 bp, Artificial Sequence
  Description of Artificial Sequence: Synthetic coding sequence
atgctcctgggccagaaaagccaaagatacaaagccgaggagggccttcaggcccagggggaagctccaggcctcatggacgttcagattcccaccgccgaagagcagaaagcagcgtctagctcaagtacactgattatgggaactctcgaggaggtgaccgattccggctccccaagccccccacagtcacctgagggagccagtagttcattgaccgtgaccgattctacactgtggtcccagtctgatgaaggtagttcatctaacgaggaagagggcccttccaccagccccgatcccgcccacttagaatccttgttccgagaggcactggacgagaaagtcgccgagcttgtccgtttcctgctacgcaagtaccaaattaaagaaccagtaaccaaagccgaaatgctagaatccgtcattaaaaattataagaatcattttccggacattttctccaaagcttcggaatgtatgcaggtcatcttcgggatagacgtgaaagaggtcgatcctgcaggtcattcatacatacttgtgacctgcctcgggcttagctatgatggcctgctcggagatgatcagtctacacctaaaaccggcctactgatcatcgtgctggggatgatacttatggaaggaagtcgtgcccctgaggaagccatctgggaggcactgtcagtgatgggtttatatgatggacgcgagcattccgtctactggaagttacggaagttattgacgcaggagtgggtgcaggaaaactacttggaatatcggcaggccccaggctccgatccggtgcggtacgagttcctttggggacccagggcgctcgctgaaacgagctacgtcaaagttctggagcatgtggtgagagtgaatgccagagtgaggattagctacccctcactgcacgaagaggcactaggcgaagagaagggggtgtag

SEQ ID NO: 123861 - DNA, 957 bp, Artificial Sequence
  Description of Artificial Sequence: Synthetic coding sequence
atgctcttgggtcagaaatcccagagatacaaggcggaagaaggcctccaggcccagggagaagcaccaggattaatggacgtacagattccaactgccgaagagcagaaagcagccagttcgtcttcaacactgattatggggacacttgaagaggtgaccgattccggttcaccgtctcccccgcagagtcctgagggtgcttctagcagccttaccgtcacggattccactctctggagtcagagcgatgagggctctagcagcaatgaggaagagggtccctcgaccagccctgacccggctcatttggaaagcctgttcagggaggcattagacgaaaaagtggctgagctagtcagattcctcttgaggaagtaccagatcaaagaaccagtgacaaaggcggagatgctcgaatcggtgatcaaaaattacaagaatcacttcccagatatcttctcaaaggcctcagaatgtatgcaagtgatcttcgggatagacgtaaaagaggtagaccccgccggccattcatatattttagtcacctgtctcggactgagctacgatgggctgttgggtgacgaccagagtacacctaagactgggcttctcatcatcgtcctgggcatgatcctgatggagggatcacgcgcccccgaggaggccatctgggaggctctgtcagtcatgggcctgtatgacggcagagaacacagtgtatattggaagctgagaaaactgcttacccaggagtgggtgcaggagaactaccttgagtatcgccaggctcccggaagcgacccagttcgatacgagtttctgtggggccccagagccctggcagagacaagctacgtgaaagtgctcgagcatgtagtgagagtaaacgctagggtaagaataagctaccccagcctccacgaagaggccctgggagaggagaagggcgtgtag

SEQ ID NO: 123862 - DNA, 948 bp, Artificial Sequence
  Description of Artificial Sequence: Synthetic coding sequence
atgagtttagagcagcgctctcctcattgtaagcctgatgaagaccttgaggcccagggtgaagatctcgggctaatgggcgcacaggagcctacaggagaggaagaggagactacatcctctagcgattctaaggaggaagaagttagcgcggctggatcctctagtccgcctcagagtccacaaggaggggcgagcagcagcatctctgtctactacaccctttggtcccagtttgatgaagggagtagtagccaggaggaagaagaaccatcttcgtcagtcgatcctgcccagctcgagtttatgttccaggaggctctgaagctcaaggtggcagaattagttcacttcctgctgcataaatacagagttaaagaacctgtaaccaaggccgagatgctcgagtctgttataaaaaattacaaacggtactttcccgtgattttcggcaaagcaagtgagtttatgcaagtgattttcgggactgacgtgaaggaagtcgatccagccgggcactcttacattctggttactgccctgggattatcttgcgatagcatgctgggcgatggtcattctatgcccaaagcagcattactgatcatcgtgttgggtgtgatactcacaaaggataattgcgccccagaagaagtcatttgggaagcacttagcgtgatgggcgtgtatgtcggcaaagaacacatgttctacggagagccgcgcaaactgctgacccaagattgggtacaggagaactacctggaatatcgacaggtgccaggaagcgatccggcacactatgaattcttgtggggcagcaaagcccacgccgaaacttcatatgaaaaagttatcaattatctggtgatgctcaacgccagggaacccatctgctacccatctctttatgaggaagtgcttggggaagaacaggaaggagtgtag

SEQ ID NO: 123863 - DNA, 345 bp, Artificial Sequence
  Description of Artificial Sequence: Synthetic coding sequence
atgtcactagagcaacgctcaccccattgcaagccagacgaggatctggaggctcaaggcgaagacctcgggcttatgggggcacaggagccaactggtgaggaggaagagactacctcctcatccgattccaaagaagaggaggtctctgccgctgggagctcctctccccctcaaagtcctcagggcggtgcgtcatcctcaattagcgtgtactacactctgtggtcccaatttgacgagggatccagttctcaagaggaggaggaacccagctccagcgtggatcctgcccagcttgaattcatgttccaggaggctctgaagctaaaggtcgccgagtag

SEQ ID NO: 123864 - DNA, 930 bp, Artificial Sequence
  Description of Artificial Sequence: Synthetic coding sequence
atgtctctcgagcagaggtcgccccattgcaagccagacgaggatctagaggcccagggcgaggacctcgggctgatgggcgcacaggaaccaactggggaagaagaagagacgacaagctcaagcgattctaaggaagaggaagttagcgcagctggttcctcttctccacctcagtccccccaggggggtgcgagcagctcgatatctgtgtactatacactgtggtctcaattcgatgagggaagcagcagccaggaggaagaggagccctcttcttctgtggacccggcacagctggagtttatgttccaggaggccctgaaactgaaggtagctgagctcgtgcacttcctcctccacaagtacagagtgaaagaacctgtgactaaggccgagatgctggagtctgttataaagaattacaagcgatatttccccgtgattttcggaaaagcgtcagaatttatgcaggtgatctttgggaccgatgttaaggaggtggatcccgcaggtcactcctatatactggtgaccgcccttgggctatcatgtgatagcatgctaggagatggtcattccatgccaaaagccgcactcttaatcatcgtgctgggcgtcatcctgactaaagataattgtgcacccgaagaggtgatctgggaggccctcagcgtgatgggcgtgtacgttggcaaagaacatatgttctacggagagcccagaaaactcctcacacaagactgggtgcaggagaattatctggaatatagacaggttcctggatcagacccggctcattacgagtttctctggggatccaaagcgcacgcagagactagttacgagaaggtgatcaattatctcgtgatgttaaacgccagggaacccatctgctacccatcactgtatgaggaggtcctcggatag

SEQ ID NO: 123865 - DNA, 591 bp, Artificial Sequence
  Description of Artificial Sequence: Synthetic coding sequence
atgtccctggaacaacgttctccacactgcaaacccgatgaagacttagaagctcaaggggaagacctggggctgatgggggcccaggaaccaactggcgaagaagaagaaactacatcatccagcgatagcaaggaggaagaagtgtctgctgccgggtcatcttcaccaccgcagtccccacaagggggggcgagttcctccataagtgtctattatacgttatggagccaatttgacgaagggtcctcttcccaggaagaggaagagccctcctcttcagtggacccagctcagttagagtttatgtttcaagaggccctgaagttgaaggtggccgagctggtgcatttcctgttgcataaatatcgggtgaaagaacctgtgaccaaggccgagatgttggaatcagtcataaagaactacaaacgttactttcccgtgatattcggtaaagcaagcgagttcatgcaagttattttcggaacggatgtcaaggaagtggatcctgcaggccatagttacatcctggtgacggcgctcgggttgagctgtgacagcatgttaggcgacggacatagtatgccctag

SEQ ID NO: 123866 - DNA, 294 bp, Artificial Sequence
  Description of Artificial Sequence: Synthetic coding sequence
atgtctctggaacaacgcagccctcactgtaaaccagacgaagatctggaagctcagggagaagacttaggtctgatgggagcgcaggagcccaccggtgaggaagaggagacaacaagtagctctgacagcaaagaagaagaagtatcagcagccggatcctcatccccaccacagagcccccagggtggtgcttcctccagcattagtgtgtattacaccctgtggtcccagtttgacgaggggagctcatcacaggaagaagaagagccatccagctccgttgacccctag

SEQ ID NO: 123867 - DNA, 948 bp, Artificial Sequence
  Description of Artificial Sequence: Synthetic coding sequence
atgagtctggagcaaaggagcccacactgcaagcctgatgaggacctggaagcccagggagaggatctgggcctcatgggggcccaagaacccacgggggaggaggaggagacaacgtcctccagtgattccaaggaggaggaggtgtccgctgccggttcctcgtcacccccccaatccccccagggcggcgcttcttcaagtattagcgtgtactacacgctttggtcacagttcgacgagggttcatcatcccaggaagaggaggaacccagcagctccgtggaccccgcgcagcttgagttcatgttccaggaagcactcaagttaaaggtggccgagctggtgcatttcctgcttcacaagtaccgagtcaaggagcctgtaaccaaggcggaaatgctggagagcgtgatcaagaactacaaaaggtacttccccgtgatctttgggaaggcttcagagtttatgcaggtgatcttcggtacagatgtgaaggaggttgaccccgcagggcactcttatattctggtcaccgcgctcgggctgtcatgcgattcgatgctgggggacggccacagtatgcctaaagctgctctgctgattattgtacttggagttattctgactaaggataactgcgcccctgaggaagttatctgggaagctctcagcgttatgggggtttatgtggggaaggagcacatgttctacggcgagccgaggaaacttttgacacaggattgggtacaggagaattatctcgagtacagacaggtacccgggagcgatccagcccattacgagtttctatggggaagcaaggcccacgcagagacttcttacgagaaggtgatcaactatctggtgatgctgaatgctcgagaaccaatatgctatcctagcctttacgaggaagtgctgggcgaggaacaggaaggggtttag

SEQ ID NO: 123868 - DNA, 1044 bp, Artificial Sequence
  Description of Artificial Sequence: Synthetic coding sequence
atgccacgcggccaaaaatcaaaactgcgagcccgcgaaaaaagaagaaaagcgcgcgaggaaacacaaggattaaaggttgctcacgctacggcagccgaaaaagaggagtgtcctagctccagcccagtactgggggacacacccactagctcacccgccgcgggtattccccagaaacctcagggagctcctcccaccaccaccgccgctgccgccgtctcttgcaccgaaagtgatgaaggcgccaagtgccagggcgaggagaacgcctccttctcgcaggccactacatcaaccgagtctagcgttaaggatcccgtggcctgggaggcagggatgttgatgcactttatcctgcgaaagtacaaaatgagagagcctatcatgaaggcggacatgttgaaggtggtagacgagaaatacaaggatcatttcacagagatactcaatggcgccagccgtaggctggaactcgtctttgggctggacttgaaggaggacaacccaagcggccatacttatactttggtttccaaactgaaccttaccaatgacggcaacctctccaatgactgggacttcccccgaaacgggttattaatgccgctgctgggcgtcatcttcttaaaagggaactctgcaaccgaggaggagatctggaaattcatgaatgtactgggagcctatgatggtgaggaacatttaatctacggcgagccaaggaagtttatcacacaggatctggtccaggaaaagtatctgaaatacgaacaggtccctaactccgaccccccccggtatcagtttctctggggccctcgcgcatacgcggaaaccactaagatgaaagttctggaatttctggccaaaatgaacggggcgacgcccagggacttcccatcacactatgaggaggcccttcgagatgaggaggagagagcccaggtgagaagcagcgtaagagcacgcaggcggactactgccacaacgttccgcgccaggagccgggcaccattcagtcggtcatcccacccaatgtag

SEQ ID NO: 123869 - DNA, 1044 bp, Artificial Sequence
  Description of Artificial Sequence: Synthetic coding sequence
atgcctaggggacagaaatcaaagctgagagcccgcgaaaaacggagaaaggctagggaagaaacccaggggctcaaggtggcccatgccactgctgccgagaaggaagaatgtccgagttccagtccagtactgggggatacccccacctccagccctgcagccggtattccccagaaacctcaaggggccccacccaccacaactgcagcagccgctgttagctgcactgaaagcgacgaaggggccaaatgccaaggcgaggaaaacgccagtttctcacaggcaactacctctacggagagctctgtcaaagatcccgtggcttgggaggctggaatgctcatgcacttcattcttcgtaaatacaagatgcgggagcctatcatgaaagccgatatgctcaaagtggtggatgaaaagtacaaagatcacttcaccgaaatcctcaacggcgccagccgcagactggaactcgtgttcggtctggatctaaaagaagataatccatccggccatacatatacactcgtgagcaaacttaatctaacaaatgatgggaacctctctaatgactgggattttcctcggaacggcctgctgatgcccctcctcggcgtaatttttcttaagggcaactctgctacagaggaagaaatctggaagtttatgaacgtgctgggagcctatgatggagaggagcacctgatctacggtgaacctcgaaagttcatcacgcaggatctcgtgcaggagaagtacctgaaatatgagcaggtccccaattctgatccaccacgctaccagtttctgtggggtccacgcgcatatgccgagaccactaaaatgaaggttctcgaatttttggctaaaatgaatggtgccacgccccgcgacttcccttctcactacgaagaggctcttagagacgaggaggagagggctcaagtgaggtctagcgtgagggctcgcaggcgcacgaccgcaaccacatttagagcacgaagcagagcccctttctctcgaagctcccacccaatgtag

SEQ ID NO: 123870 - DNA, 1044 bp, Artificial Sequence
  Description of Artificial Sequence: Synthetic coding sequence
atgcctaggggtcaaaagtctaagctaagagctagggagaagcgacggaaagcgcgcgaggaaactcaagggcttaaggtggcacatgccaccgcggccgagaaagaggaatgtccttcctcatctccggtcctgggcgacacacctacctcatcccctgcggccgggatccctcagaaaccccaaggtgcaccccccactacgacggcagcggccgccgtctcatgtaccgagagcgacgaaggggccaagtgtcagggcgaagagaacgcatcattttcccaggctaccacatccaccgaaagtagcgtaaaagatcccgtggcctgggaggcggggatgctgatgcacttcatcctcaggaaatacaagatgagggaacccataatgaaggccgatatgctgaaagtagtcgacgagaagtataaagaccactttaccgagattttgaacggcgcttctagaagattggaacttgtgttcggcctggacttgaaggaagacaacccctcagggcacacctacaccctggtgagtaaactcaacctaactaatgacggaaatctgagtaacgattgggactttccaaggaatggcctgctcatgcccctgttaggtgtcatctttctaaaaggcaacagtgctacagaggaggaaatatggaagttcatgaatgttctgggcgcatatgacggagaagagcacctgatttacggtgagccacggaaattcattactcaggacctggtccaggagaaatacctgaaatatgagcaagtgcctaacagtgatcccccacgctaccagtttctttggggccccagagcttatgcggagaccacaaaaatgaaagtgcttgaatttctagcaaagatgaatggcgccactccccgtgacttcccctcgcattatgaagaagcgctgagagatgaggaagagcgggcacaggtgagaagcagcgtgcgcgcaagacgcaggacgaccgccaccaccttccgcgctcgaagcagggctccgttctccaggtccagccatccaatgtag

SEQ ID NO: 123871 - DNA, 1044 bp, Artificial Sequence
  Description of Artificial Sequence: Synthetic coding sequence
atgcccaggggacagaagtctaagctgagggcccgggagaagagaagacaggctaggggcgggcttgaggatctaatcgatgcccttgacatcctcgaggaagaagaagagtcccccccctccgcatccgcttgcctgaaggatgtgttccaaagctctctcgacggcgcttcgaacaatccacacggactacgcgaggcgcagagtaccagcaccagcgccaccgctgcttctcacactcggcatcccgaaggagtcaacgaccaaatggaagagagacctatctgcacccaggatctggaggccaccgattcttttccccgtggacccgtcgatgaaaaagtaatcattctcgtgcattacctgctctacaaataccagatgaaggaaccaatcaccaaggccgacatgctgcgtaatgtgactcaaatgtcaaaaagccagtttccggtgatactgagtcgggcaagtgagcacctggaactgatcttcgggctggaccttaaggaagtagagcccaacaagcatatttatgtcctggttaacaagttggatcttgggtgtgatgcaaagctcagcgacgagaccggcgtgcccaaaacaggactcctgatgactgtcctcggcattatcttcacgaatggaaattgtgtcgctgaagaggaagtttggaaggttttcaatactatggggctgtacgatggtatcgagcactttatgtttggcgagcctcgaaaactgctgacaaaagatcttgtcaaggagaactatctcgagtaccagcaagtaccgaacagtgaccctccgcgttaccaattcctgtggggccccagagcccatgccgagacctcaaagatgaaggtactcgagtttctggccaaagtgaatgataccgcaccaagcgaattcagcaattggtacaccgaagccctgcaggacgaagaagagcgcgccagagcccgggtggcagctaaggctagagtgagtgctacagccggagcccgcagtaaggtcaagagttccaagtctagtcagctgcagtag

SEQ ID NO: 123872 - DNA, 975 bp, Artificial Sequence
  Description of Artificial Sequence: Synthetic coding sequence
atgtcccaggatcaggagtcgcccaggtgtacccacgaccagcaccttcaaacatttagtgagactcaatcactggaggtggcgcaggtatcaaaggctctcgaaaaaaccttgctcagctcttcccacccactagtgcctggcaagctaaaagaggcaccagcagccaaggctgagagcccgctcgaggttcctcagagcttttgcagctcgagtatcgctgtcaccacgacctcttcttccgagtcagacgaagcctccagcaaccaggaagaggaagactccccttcaagctcagaggatacatctgacccaaggaacgtgccggccgacgccctggatcagaaggtcgccttccttgtcaacttcatgcttcacaagtgtcagatgaagaagcccatcacgaaggctgatatgctaaagatcatcatcaaggatgacgaaagccacttctcagagatcctcttgcgggcctccgaacacctggagatgatcttcggtctggacgtggtagaagtcgatcccacaacccactgctatggcctgtttattaagctgggccttacttacgacggcatgctgagtggtgaaaaaggggtgccaaagacgggactcttgattatcgtactcggcgtgatctttatgaaaggcaatcgcgcgaccgaggaggaggtctgggaggttctaaacctgacaggagtctatagtggcaaaaagcactttattttcggagaacctaggatgttaattacaaaggattttgtgaaggagaagtatttggagtatcaacaggtagcaaacagtgacccagctaggtacgaatttctctggggccctagggcgaaggcggagacctctaagatgaaagttctggaatttgtggcaaaggtacatggcagttatcctcattcattcccgagtcaatatgcagaggctctgaaggaagaggaagagagagcaagagcccgcatctag

SEQ ID NO: 123873 - DNA, 975 bp, Artificial Sequence
  Description of Artificial Sequence: Synthetic coding sequence
atgagtcaggatcaggagtctccccgttgtactcacgaccagcatctgcagacattttctgaaacccagtctctcgaggtcgcgcaggtatccaaagccctggaaaaaacattactctcctcgtcccaccctctcgtccctggaaaacttaaggaagcaccagccgcaaaggccgagtctcctctcgaggtgcctcagtcattctgttcctcctctatagctgtgaccactacctcctcctcagagtcagacgaggcttcctcgaaccaggaagaggaggattcaccatcctcaagtgaggacaccagcgacccaaggaatgtgcccgccgacgctctggaccaaaaggtagcatttttagtcaacttcatgctacataagtgtcaaatgaaaaagccaatcactaaggccgacatgctgaaaatcatcataaaggacgacgaaagtcatttctcagaaatcttgcttcgtgcgagtgagcacctagaaatgatctttggcctggatgtggtcgaagtggatccgacaacacattgttatggcttgtttatcaagttgggcttgacgtacgatggcatgctgagcggggaaaaaggcgtccctaaaactggcctgctgatcatcgttttgggcgtcatctttatgaaaggaaatagggcaactgaagaagaggtatgggaggttctcaacctgacaggagtttactccggaaagaaacactttatctttggtgagcctcgcatgcttatcaccaaagatttcgtgaaggagaagtatctcgagtaccagcaggtcgctaattcagatcctgcacggtacgagttcctttggggcccacgcgccaaagcagaaaccagcaagatgaaagttctagagttcgtggccaaggtgcatggcagctatcctcacagcttccctagccaatacgccgaagctctgaaggaagaggaggaacgcgccagggctcgaatttag

SEQ ID NO: 123874 - DNA, 975 bp, Artificial Sequence
  Description of Artificial Sequence: Synthetic coding sequence
atgagtcaagaccaagaatccccccgctgcacacatgatcagcacctgcaaacgttttccgaaacgcagtctcttgaagtggcgcaagtctccaaggccctggagaagaccctgctctcatcatctcacccattggtccccggtaaactcaaggaagctccggccgcgaaagcagagtccccacttgaggtccctcagtcgttttgcagcagcagtatcgccgtgactacaaccagctcctcagagtcagacgaggcctcatcaaaccaggaggaagaggatagcccctcctctagcgaagatacctccgacccgagaaatgtacctgccgacgcgttggaccaaaaagtggctttcctcgtcaatttcatgctccataagtgtcaaatgaaaaagcccatcaccaaagcagatatgctaaaaataattattaaagatgacgaatcccattttagcgaaatcctgctaagagcttcagagcatcttgaaatgatttttggcctggacgtggtcgaagtggacccgaccacacattgttacggtctttttatcaaactgggacttacatacgatggtatgttgtctggggaaaagggagtgcctaagacaggtctgttgattatcgtgctgggcgtgatctttatgaagggtaaccgcgcaaccgaagaagaagtctgggaagtactgaacttgacaggagtgtatagcggcaaaaagcattttatcttcggagaaccacggatgctcattacgaaggattttgtcaaggaaaaatatctcgagtaccagcaggtggcgaactctgaccccgcccgatacgagtttttgtggggacccagggcgaaagcggaaaccagtaagatgaaagtccttgagttcgtggcaaaagttcacggcagctacccacatagctttcccagccaatacgctgaggccctgaaagaggaagaggagagggctagagctaggatttag

SEQ ID NO: 123875 - DNA, 975 bp, Artificial Sequence
  Description of Artificial Sequence: Synthetic coding sequence
atgagccaggatcaggagtctccgaggtgtacgcacgaccagcacctccagacattctccgaaactcagtcacttgaagtggcccaggtgtccaaagctctggagaagacacttttatcctcctcacatcctttagtccccgggaaacttaaggaggcacccgctgcaaaagccgagtcccctctggaagtgcctcagagtttctgtagtagttctatcgccgtgacgacgacatccagctcagaaagtgacgaagcttccagcaatcaggaagaggaagacagtccgtctagttccgaagataccagcgatccgcgaaacgtacccgctgacgcactcgaccagaaggtggcgtttttggtgaattttatgttgcataagtgccaaatgaagaagcctattactaaagcagatatgctgaagattattatcaaggacgacgaatctcactttagtgaaatcctcctgcgggcatctgagcacctggagatgattttcggactggacgtggtcgaggtagaccccacaacgcattgctacggtctcttcatcaaactggggctgacttacgacggaatgctcagtggcgagaagggggttcctaagaccggactccttataattgtcctcggggttatcttcatgaaaggtaatagggcgactgaggaagaagtgtgggaggtgctgaatctcacaggagtgtactctggcaagaaacattttatttttggtgagcctaggatgctcattaccaaggattttgttaaagaaaagtacctagagtatcagcaggtcgccaacagcgacccagctagatatgaattcctgtggggcccgcgagctaaggccgagacaagtaaaatgaaggttctcgaatttgtggccaaggttcatggtagctacccacattcgtttccatcacaatacgcggaagctctgaaggaggaggaagagagggcgagagcgcggatttag

SEQ ID NO: 123876 - DNA, 1071 bp, Artificial Sequence
  Description of Artificial Sequence: Synthetic coding sequence
atgggtacagaggctcagccagtggttaaggctgtgattctccactgtttaccctcatgccctcattcttgtctattgcctcctaccagagtgataatgagtcaagaccaggagtcccccaggtgtactcacgaccagcacttgcagactttcagcgaaacacaaagcctggaggttgctcaagtgtctaaggccctggagaagaccctgctgtcctcatctcaccctctggttccgggtaagctcaaagaggctccagctgcaaaggctgaaagtcctctagaagttcctcagtccttctgcagctcttccatcgccgtcacgacgacaagttctagtgagtcagacgaagccagtagcaaccaggaagaggaggactcaccttcgtcatccgaggacacatcagacccaagaaacgtgcctgctgacgctctggaccagaaggtcgcctttttagtcaatttcatgcttcacaaatgccagatgaagaagccaattaccaaggcagatatgctgaaaattatcataaaagacgacgagagccacttcagcgagatcttgctgcgtgccagcgagcatctagaaatgatcttcgggctggacgtcgtggaggtggatccaacaacgcactgttacggactctttatcaagctggggcttacgtatgatgggatgctctctggcgagaaaggtgtgcctaaaacaggacttctgatcattgtccttggtgtgatctttatgaagggtaaccgggccactgaggaggaggtgtgggaggtgctaaacctgactggagtttattccggcaaaaagcatttcatatttggggagcctcggatgctgatcactaaggacttcgtcaaagaaaagtacctggaataccaacaggttgccaattcagatcctgcccgatatgagtttctctgggggccccgggccaaggcagagacatccaagatgaaggtgctcgagttcgtggccaaggtgcatggaagttacccacattcttttccctcccagtacgccgaagccctgaaggaagaggaagagagagctcgggcaagaatttag

SEQ ID NO: 123877 - DNA, 996 bp, Artificial Sequence
  Description of Artificial Sequence: Synthetic coding sequence
atgcctcggggccaggctagtaagcggagggctcgggagaaaaggcgtcaagcaaggggcgaggaccagtgtctcggcggtgctcaggccaccgctgctgagaaagagaaactaccctcgtcttcgagcccagcttgccagtcccctccacagtctttcccaaacgcgggaattccccaggaaagccagcgcgcaagctatccctcaagccccgcctccgctgtgtccctgaccagctccgacgaaggggccaaagggcagaagggcgaaagtcccaatagcttccacggtccatcatccagcgaatcgaccggacgggacctcctcaacactaaaaccggtgaactcgtgcaattcctgcttaataaatacatacggaaagaacctattaccagggaagctatgctgaaggtgattaacagaaagtataaacaacacttccctgagatcttacggcggagcacggagaacgtcgaggtggtgtttggtctgtacttgaaagagatggatccaagcagacagagttacgtactggtcggcaaactggattttccaaaccagggaagcctgtcagatggtggggggttccccctcagtggcctcctgatggttctgctgtccaccatcttcatgcacggaaatagagctactgaggaagagatgtgggagtgtctgaacgccctcgggatgtacaaaggccggaaacacttcatttatggagaacctcaggagctcgtaactaaggacctggttcgtgagggatacctggaataccagcaggtgcccagttcagatcctccgaggtacgagttcctttggggcccacgggcgagagccgaaactagcaagatgaaagtgctagaattcgtggctaagctcaacgacactgtggccagcacctacaagtcaagatatgaggaagcgctaagagaagaggaagaacaggccagagcccgcgccgtcgcccgggattctgctagggctagagcatcttag

SEQ ID NO: 123878 - DNA, 1011 bp, Artificial Sequence
  Description of Artificial Sequence: Synthetic coding sequence
atgcctagaggccaggcaagcaagaggcgggcacgcgagaagcggcgccaggcccgcggggaagaccagtgcctgggtggggcgcaagcaacagctgccgaaaaggagaaactccccagcagctccagcccagcttgtcaatcacctccacagagcttcccaaacgccggcattccgcaggagtcgcagagggcctcctatcccagctcgcccgcatctgctgtgtcacttacatcctcggacgaaggcgcaaagggccagaagggagagtcacccaattcttttcatggcccttcaagcagcgaaagcactggcagagacctgcttaacactaaaaccggggaattagtccagttcctgctgaataagtacatcaggaaggagcccattacgcgggaggctatgcttaaggttataaataggaagtacaagcaacatttccccgagattcttcgtcggtccacggagaatgtggaggtggtcttcggtctttatctcaaggagatggatcctagcaggcagtcatacgttctggtggggaaactggacttccccaaccagggatcacttagcgatggggggggcttccctctgagcgggctgcttatggtgctgctgtctacaatattcatgcatggaaatagggccaccgaggaggagatgtgggaatgtctgaatgccctgggaatgtacaaaggccgaaagcatttcatctatggtgagccccaggagctagtgacaaaagatctcgtccgagaggggtaccttgaatatcagcaggtgccttctagcgatccacctagatatgaatttctatgggggcccagggctcgggcagagacctctaagatgaaagtgcttgaatttgttgccaaactcaacgataccgtggccagcacttataagtcacgttatgaggaggctctacgtgaagaagaagagcaggcgagggctagagccgtagcccgcgactctgcccgtgcccgtgcctctcgatcttttcagccttag

SEQ ID NO: 123879 - DNA, 1011 bp, Artificial Sequence
  Description of Artificial Sequence: Synthetic coding sequence
atgccaaggggccaggctagcaagaggagggctcgtgagaaacgtagacaggcacgaggcgaagaccagtgtctgggtggagctcaagctacagccgccgaaaaagagaagctgccgagctcgtcgtccccggcatgccagtcaccgccccagagctttcccaatgccggcatccctcaggagtcacaaagggcatcttacccaagcagcccagccagcgccgtgtctcttacaagtagtgatgaaggagccaaaggtcagaagggtgagtctcccaactcttttcacgggccttcaagctccgagtcaacaggcagagacttgcttaatacaaaaacaggagagctcgtccaattcctcctcaacaaatacatcagaaaggagcctatcacccgggaggcgatgcttaaggtgataaacagaaaatataagcagcacttcccagagatcctccgtagatcaactgagaacgtagaagtggtgttcgggctgtatcttaaagagatggatccgagtcgccaatcttacgtgctggtcggcaaacttgatttcccaaaccagggatccctgtccgatggaggaggcttcccactatctggcttgctgatggtccttctgtctactatctttatgcatgggaacagggccaccgaagaggagatgtgggaatgcttaaacgctcttggcatgtataaaggccgcaagcatttcatctacggggaaccgcaggagctggtaacgaaggatctggtcagggagggctacttggagtatcagcaggtccctagctctgacccccccaggtatgagtttctctgggggcctagagcccgggcggaaactagtaaaatgaaagtactagagttcgtagcaaagctgaatgacaccgtggcttcaacatataagagccggtatgaagaagccttgcgagaggaagaagagcaggctcgcgcaagggctgtggcccgggattcagctagggctcgcgcatccaggtccttccaaccgtag

SEQ ID NO: 123880 - DNA, 960 bp, Artificial Sequence
  Description of Artificial Sequence: Synthetic coding sequence
atgcctcgcgggcagaaaagtaagctgcgagcaagggagaagaggcggaaagcccgcgacgagactagaggcctaaatgtgcctcaagtcacggaagcagaagaggaagaagcaccttgttgttcgtcttcggtctcaggaggagctgcctcaagtagccccgccgcaggtatccctcaggagccacaaagggcccccactacagccgcagccgcagcggctggcgtaagtagcaccaaaagtaaaaagggcgcaaagtcccatcagggagaaaagaatgcctcaagttctcaggctagtactagtaccaagagtccctctgaggacccccttactagaaaaagtggttcccttgtgcagtttctgttatacaaatacaagataaagaagagcgtgaccaagggcgagatgctgaagattgtcggcaaaaggtttagggaacattttcctgagatcttaaagaaggcttcagagggcttgtctgtagtgttcgggctcgagctgaataaggtgaatccaaacggacatacctacactttcattgataaagtagacttgaccgacgaggagagcctgctgtcttcctgggacttccctagaaggaaattactgatgccccttctgggcgtaattttcctgaatggcaatagtgctaccgaggaggagatttgggagttcttaaatatgctcggggtgtatgatggtgaagagcattcagtctttggagaaccgtggaaactgattaccaaagacctggtgcaggagaaatatctggagtacaagcaagtgccgagctccgaccccccaagattccaattcctttggggaccacgagcatacgcagagactagtaagatgaaggtacttgaatttttggcaaaagtcaacgggacaactccctgtgcctttcctactcactacgaagaggcacttaaagacgaggagaaggccggggtgtag

SEQ ID NO: 123881 - DNA, 1041 bp, Artificial Sequence
  Description of Artificial Sequence: Synthetic coding sequence
atgcctcggggccaaaagtccaccctgcacgccagggaaaaacgacagcagacacgcgggcaaactcaggaccaccaaggagcgcagattactgctactaacaagaagaaagtttccttctctagccctttaattcttggagccactattcagaagaaaagtgcaggtagatctcgaagtgctcttaaaaaacctcagagggctttgagtaccacgacttccgtcgacgtgtcttataaaaaatcatataagggggccaatagtaaaatcgagaaaaagcagtcgttcagtcagggcttgagctctactgtgcaatcgagaaccgatcctctgatcatgaagactaacatgctggtccagttcttgatggaaatgtataagatgaaaaagccaatcatgaaggctgatatgctcaagattgtccagaaatcacacaagaactgcttccctgagatcctgaagaaggcttcattcaatatggaggtggtcttcggagtggatttaaagaaggtagatagcacaaaggactcttatgtccttgtgtcaaagatggacctgcctaataatggcaccgtcactcgaggccgggggtttcccaaaacaggactgctcttgaatctcctgggtgtgatttttatgaaggggaattgcgctacggaggaaaagatttgggaatttttaaacaaaatgcggatctacgatggcaaaaagcattttatcttcggagagcctaggaagctcataactcaggacctggtgaaattaaaatatctggagtacagacaggtgccaaactcaaatccagctaggtacgagtttctgtggggccctcgggctcatgcggagacttcaaaaatgaaggtactggagttctgggccaaagttaataagacggtgccatccgcctttcagttctggtatgaagaggccctccgcgatgaggaggaaagggtacaggcagctgccatgctcaacgatggctcttccgctatggggcgtaaatgctccaaggccaaagcctcatcttcatcacatgcatag

SEQ ID NO: 123882 - DNA, 1041 bp, Artificial Sequence
  Description of Artificial Sequence: Synthetic coding sequence
atgccacgcgggcagaagtctaccctgcatgcccgagagaaaagacagcagacccggggccaaacccaggatcaccaaggagcccaaatcacagctaccaacaagaagaaagtgtcctttagcagtccgctgattttaggtgctacaattcaaaagaagtcagctggacggtcaagatcagctcttaagaaaccccagcgagctctgtccacgacaacatccgtcgatgtgtcatataagaagtcctataagggagccaattcaaaaatcgaaaaaaaacaatcttttagccagggcttatcaagtactgtacaatcgaggactgacccactgattatgaaaactaacatgctggtccagtttctaatggagatgtacaaaatgaaaaagcccatcatgaaggcggacatgttgaagatagttcagaaatcccacaaaaattgctttccggagatattaaaaaaagcatcttttaacatggaagttgtgttcggggtggatctgaagaaagtcgacagtacgaaagattcatacgttctggtctccaaaatggacctccccaacaacgggaccgtaactcgcgggcgaggctttccgaagaccgggctgcttctgaaccttctcggcgtgattttcatgaaggggaactgcgctacggaagaaaagatctgggagttcctcaacaaaatgcggatctacgacggtaagaaacacttcatctttggagagcctaggaaactgatcacccaggatcttgtaaagttgaagtacctggaatatcggcaggtgccgaattccaatcccgccagatacgagtttctctggggccccagggcccatgccgaaaccagcaagatgaaagtgctcgagttttgggctaaggtcaacaagaccgtacctagcgcttttcaattctggtatgaggaagcccttagggatgaagaagagagagtgcaagccgccgccatgctcaatgatggatcgtcagccatgggaaggaagtgttccaaggccaaggcaagtagctcaagccacgcctag

SEQ ID NO: 123883 - DNA, 1041 bp, Artificial Sequence
  Description of Artificial Sequence: Synthetic coding sequence
atgcctcggggccagaagtcaaaattaagggccagggagaaaaggcagcgaacccgcggacagacacaggacctgaaagtggggcagccgactgctgccgagaaggaggaaagtccatcatcgtctagctcagttctcagagacaccgcaagctcgagcctggcttttgggatcccccaagaacctcaaagagagccccctaccaccagcgctgccgctgctatgtcttgcacaggctctgacaagggagacgaatcccaagatgaggaaaatgctagctcttcccaagctagcacgagcactgagcgatcattaaaggactcactaaccagaaagaccaagatgctggtacagttcctcctgtacaagtacaagatgaaggaacccacgaccaaagcagagatgcttaagatcatctccaagaagtacaaagagcactttccagagatttttagaaaggtttcgcagcggaccgagctggtctttggcttagcacttaaagaagtaaatcccactacccatagctacatactcgtcagcatgcttgggcctaatgacggcaaccagtcaagcgcatggaccttaccacgcaatggcttgctgatgcccctgctctctgtgattttcttaaacggtaactgtgcccgggaagaagagatatgggagttcctgaatatgcttgggatctacgacggaaaacgacaccttatctttggcgaaccccggaagctgattacacaagacctggtccaggaaaagtatctcgaatatcagcaggtgcccaactcagacccccctagataccagtttctgtggggtcctcgggcacatgcagagaccagcaagatgaaggtccttgagtttctcgcgaaggtcaacgataccacccctaacaacttccctctcctgtatgaggaggcactcagagacgaagaggagagggctggagctcggccccgcgtggcagcccggcgcgggaccaccgccatgaccagcgcctattcacgcgcaacatcctctagctcgtcacagcccatgtag

SEQ ID NO: 123884 - DNA, 828 bp, Artificial Sequence
  Description of Artificial Sequence: Synthetic coding sequence
atgacttccgctggggtgttcaacgctggatcagatgagcgagcgaatagccgggatgaagaatatccgtgcagttccgaagtgagcccgtccaccgaatccagctgttctaattttatcaacatcaaagtgggactgttggaacagtttttgctctacaaatttaagatgaaacagaggatcttaaaggaagacatgctgaagatcgtgaatccaagataccagaaccagtttgcagaaatccacaggagagcttccgagcacatcgaggtggtgttcgcggtcgacctgaaagaggtcaatcctacatgtcacctgtatgatctggtgagcaagctgaagcttccaaataacggtaggattcatgtcggtaaagtgctgccaaaaactggcctcttgatgacatttttagtggtcattttccttaagggcaattgcgcaaataaggaagacacctggaagtttcttgacatgatgcagatctacgacgggaaaaaatattatatctacggggaacctagaaagctcataacacaggactttgtccgcctgacctatctagaataccaccaggtgccgtgcagctatcccgcccactatcagttcctgtggggaccacgcgcctataccgagacttcgaagatgaaggtgctggaatatttagctaaggtgaatgatattgcacctggcgcattctcaagccaatatgaggaggccctgcaggacgaggaagaatccccctctcagagatgctcccgcaactggcactattgcagtgggcaggactgtctgagggctaaattctcctcattttcacagccctattag

SEQ ID NO: 123885 - DNA, 1224 bp, Artificial Sequence
  Description of Artificial Sequence: Synthetic coding sequence
atgccacgaggccacaagagcaaattaaggacttgcgaaaagagacaggaaaccaacgggcaaccgcagggactgactggaccccaggccacagctgagaaacaagaggagtctcacagttccagctcctcttcacgtgcttgtctgggagattgtcggaggagtagtgacgcctcaattccacaagagagccagggcgtcagccctactgggtcacctgacgcagtggtatcttattctaaatcagacgtagccgcaaatggccaggacgaaaaatcacccagtacaagtcgtgatgctagtgtcccgcaggagagtcagggcgcttctccaaccggcagccctgacgccggtgtttctggaagcaagtacgatgtggcagctaacggccaggacgaaaaatcaccttcaacatcacacgatgtaagcgtgccgcaggagtcccagggggcatcacctaccggcagccccgatgctggggtatcgggaagtaaatatgatgttgctgcggagggagaggacgaggagtccgttagtgctagtcagaaggccattatcttcaagcgcctgagcaaggatgcagtgaaaaagaaggcatgcacactcgcccagttcctgcagaagaaattcgaaaaaaaagaatcaatccttaaggctgacatgctcaaatgtgttcgtcgcgaatataagccctattttccgcagatcctgaaccggacctcacagcacttagtggtagccttcggggtggaattaaaggagatggatagttcaggggaaagttacactcttgtctcaaaactgggcctgccctctgagggcattctgtccggagacaacgctcttcccaaatctggcttgctcatgagcctgctcgtggtcatttttatgaatggcaactgcgctaccgaagaggaggtctgggaattcctgggcctgctgggcatctatgatgggattctgcactctatttacggtgacgcccggaagatcattaccgaagatctggtgcaggacaagtacgtggtataccggcaggtctgcaactcagaccccccttgctacgagtttctgtggggtccacgcgcctatgctgaaaccacgaagatgcgagttttgcgcgtgctggccgattcctccaacacgtctccaggactatatccacatctttacgaagatgccttgattgacgaagtcgagagggcactcaggttgagggcctag

SEQ ID NO: 123886 - DNA, 3429 bp, Artificial Sequence
  Description of Artificial Sequence: Synthetic coding sequence
atgggtgacaaagacatgccaacagcggggatgccttccctgctgcagtcaagttctgagtcccctcaatcttgccccgagggggaagactcacagtcgcctctgcaaatcccccagtccagtccagaaagcgatgacacactatatccattgcagtctccccagagcaggagcgagggcgaagactccagcgatcctctacagcggccaccagagggtaaggatagtcagtcacctttgcagattccccagtcttcgccggagggcgatgacactcaaagtccacttcagaacagccagagttcccctgaagggaaggacagcctctcgcctctcgagatctcccagtcccctcctgaaggcgaagacgtgcagagtcccctgcaaaaccctgcctcctcttttttttcttctgcgcttctgagtatattccagagcagtccggagagtacccagtcgccctttgaggggttccctcagagcgtgctccaaattcctgtgagtgctgcttccagctccaccctcgtttctatttttcagtcttctcccgagagcacccagtcaccctttgagggttttcctcagtcccctttgcagatcccagtatcccgaagttttagcagtacccttttgagcatattccagagttcccccgagagaacccagtctacattcgaagggtttgcacagagtcctcttcagatcccggtatctccatcttcttccagtaccctgctgagcctgttccagtcattttctgagagaacccagagcacgttcgagggcttcgcgcagtcttcccttcaaataccggtttccccaagcttcagctcaaccctggtctcgctgttccagtcatcaccggaacgcacccagtccacctttgaaggattcccccagagccccttacaaattccagtcagctcttctagttcctctacactgctctcactctttcagtcttcacctgaacgcacacacagcacctttgagggattccctcaatcactgctccagatcccaatgacttctagtttcagttctacactgctctctatcttccaatcgtcacccgagtcagcgcaatctactttcgaaggtttccctcagagtcccctccagatcccaggttcaccatcgttcagctccactctgctttccctgtttcagtcaagccccgaacggacgcactccaccttcgagggctttcctcagtcacccttacagataccaatgacatctagcttcagctctactttactgtccattctgcagagttcaccagagagcgctcagtctgcattcgaaggctttccccagagtccactccagatcccagtgtcgagcagcttctcttacactctgctgagcttgttccagtctagccctgaacgaactcacagcactttcgaggggtttccccagtctcctcttcaaattcctgttagtagcagcagctcaagctcaaccctgctctctctgtttcagagctcccctgaatgcactcaatctacttttgaaggattcccccagtctcctctccagattccccagagtcctccggaaggtgagaacacacacagtcctctccagattgtaccctctctccccgaatgggaggattctctctcgccccactacttcccacagagtcctccacagggcgaggatagccttagtccccattattttccccagtctccgcctcaaggcgaggacagcttgtcaccacactatttcccccagtcgccccagggagaggattcactgagcccccattacttcccccaaagccctcctcaaggagaggactctatgagtcctttatacttcccacaatctccactgcagggagaagagtttcagagttcactccaaagcccggtgagcatttgttctagttcgactccctcatccctcccccagtccttcccagagagcagtcagtcacctcctgagggtccagtccagtctccactgcacagtccacaatctccacctgaaggcatgcactcgcagtcccccctgcaatccccagagtccgccccggagggcgaagattcactgagccctctgcaaattccccagagtccattggagggggaggactcgctcagctccttacatttccctcagagtcctcccgaatgggaagattccctgagtcccctccactttccccagttccccccccagggggaggactttcaatcctcactgcagtccccagtctcgatttgctcttctagtacttctctgagcctgccccagtcctttcccgaaagccctcagagccctcccgaggggccagcgcaaagtcccctccagagacctgtgtcatctttcttctcttacactctagcatctctgctgcagagcagccatgagtccccacagtctccgcctgagggtcctgcccagtcacccctgcagagcccagtgtcatcctttccgagtagtaccagtagctccctcagccagtcatctcctgtctcctcgttcccctcttcaacctcttctagtttatcaaaaagctcgccggagtctccactgcagtcccccgtgatatccttctcctccagcacgtctctctctcctttcagtgaagagtccagtagccctgtggacgagtacacctcatcttccgatacactcctggagagcgacagtctgacagattccgagtcactgatcgagagtgaacctctctttacttatacgctcgacgaaaaggtggatgagcttgcccggttcttattactcaaatatcaagtcaagcaaccgatcaccaaagctgaaatgctgacaaatgttatttcaaggtacacaggttactttcccgtgatctttagaaaggcccgtgaatttattgagatattattcggaatatcactgcgcgaagtcgatcctgatgacagttacgtcttcgtgaacacccttgacttgacctccgaaggatgcctgagcgacgagcaggggatgagccaaaatcgactacttattcttatactatctattatatttattaagggcacttatgcctcagaggaggtgatatgggacgtgctgtcaggcatcggagtccgagccggaagagaacatttcgcgttcggggagccacgggagctcttgaccaaagtttgggttcaggaacattacttagagtatcgagaagtgcccaattccagcccccccaggtacgagtttctgtgggggccgcgcgcacactccgaggtgatcaagagaaaagtggtggaattcttagctatgctgaaaaatacggtgcccattaccttcccttcctcctacaaagatgcccttaaagacgtggaggaaagagcacaggcaatcatcgacaccaccgacgactccactgccaccgagagcgcatcttcctcggtaatgtccccctctttcagcagtgaatag

SEQ ID NO: 123887 - DNA, 354 bp, Artificial Sequence
  Description of Artificial Sequence: Synthetic coding sequence
ggtgacaaggacatgccaacggccggtatgccaagcctgctgcagagtagtagcgagagcccacaatcttgtcccgaaggggaggactctcagtctcccctgcagattccagtgagcccatcatccagctctacactcttatccctgttccaatctttctcagaaagaacccaatccactttcgaggggtttgcccagagttccctccagattccagttagtccttccttttcgtcgacgctcgtatcactctttcaatccagcccggaacggacacagtccacattcgaggggttcccacagagtccacttcagattccagtaagttcatccagctctagcacgctcctgtag

SEQ ID NO: 123888 - DNA, 357 bp, Artificial Sequence
  Description of Artificial Sequence: Synthetic coding sequence
atgggagacaaggacatgccaactgccggcatgccctctctgctccagtcgtcttccgaaagcccacaatcttgccccgagggcgaggatagtcaaagccctctgcaaatccctgtgtccccctcttcaagctcaaccctactcagtctatttcagagttttagcgagcggacccaatccacttttgaaggctttgctcagtcctccctccagatccccgtgtcccccagtttcagcagcacgcttgtctccctcttccaatctagcccagaacgcacgcaaagtactttcgaaggctttccgcagtccccattacagattccagtctcatcctctagctcgtccactcttctctag

SEQ ID NO: 123889 - DNA, 630 bp, Artificial Sequence
  Description of Artificial Sequence: Synthetic coding sequence
atgctgaccaacgttatttcccgctacactggctatttccccgtgatattccgtaaggcccgcgagttcatcgagatcctgttcggcatttctctgcgagaagtggatcctgacgacagttacgtgtttgtaaacaccctggatttaacatctgaagggtgcttaagtgacgaacagggaatgtcgcagaacaggttgttgatcctgatactgtctatcatcttcatcaaaggtacttacgcctcagaagaggttatttgggacgtcttgtccggcatcggtgtcagggcgggaagagagcactttgcattcggggaacctagagagctgctgacgaaggtgtgggtgcaagagcactacctggaataccgagaagtgcccaacagcagcccaccaagatacgaattcctgtggggcccccgtgctcacagcgaagtgattaaacgcaaagttgtggagttcctggccatgttgaaaaatactgttcctataacgttcccttcttcatataaagatgcgctgaaggatgtggaagaaagagcccaggctattatcgatacaaccgacgactccacagctacggagagcgcctcttcctcagtgatgagcccatctttctcgagcgagtag

SEQ ID NO: 123890 - DNA, 1122 bp, Artificial Sequence
  Description of Artificial Sequence: Synthetic coding sequence
atgcctccagtaccgggagtcccctttcgtaacgtcgataacgactccccgacctcagtggagcttgaagattgggtggacgcccagcaccctactgatgaggaggaggaagaagccagctccgcttctagcacgctgtatctggtgttctccccatccagtttcagcacctcctcaagcttgattctcggcggcccagaggaggaggaagtgccaagtggcgtcattcccaatcttacagagagcatcccctcttctccgccacagggcccaccacagggcccctcgcaatcccctctgagctcctgctgctccagcttctcatggtcaagttttagcgaagaatcttcctcccagaaaggcgaagacactgggacttgccaagggctccccgacagcgaatcgtccttcacatacacgctcgacgagaaggtggccgaactggtggaatttcttcttctgaaatatgaagccgaagagcccgtgactgaggccgagatgctaatgatagttattaaatataaagactattttccagttattttgaagcgagctagggagttcatggaactgctattcggcctggcacttatcgaggtggggccggaccacttttgcgtgttcgccaacacagttggcctgaccgacgaaggcagcgacgacgagggaatgccagagaacagcctccttatcattatactgtctgtgatcttcatcaagggtaattgtgcaagcgaggaggtgatctgggaggtgttgaatgcggtcggcgtttacgcaggacgcgagcactttgtgtacggggagccacgtgaactcctgacaaaagtgtgggtgcaggggcactatcttgagtacagggaagtgccgcactcatcacccccctattacgagttcctgtggggaccccgggcccattccgaatcgataaaaaaaaaggtgctggaatttttagctaagctaaataacaccgtcccgtcttcgtttccatcctggtacaaagatgccctaaaagacgtcgaggaacgggtacaggctacaattgacaccgcagacgatgccactgtgatggcctccgagtccttgtctgttatgagctccaatgtgagtttctccgagtag

SEQ ID NO: 123891 - DNA, 1932 bp, Artificial Sequence
  Description of Artificial Sequence: Synthetic coding sequence
atgttactgccatgtcattgggtgctggatgcaacgttcagcgacgggagcttggggcaatgggtcaagaatacatgcgcaacatacgccttgtctccagtcgtgctgccccctcaaccccagcctcgcaagaaggccacagataaggactactccgcgtttcacttgggacacctgcgggaggtgcgactcttccttcgcggaggtaccagtgaccaaagaatggatagcctcgtgctttgcccgacttactttaaattgtggaggaccctcagcgggtcacctgggctgcagctcagtgatctgcattttggctcccagccagaaggaaagttttccctaagaagggctgtcagtgtgaagcagcgcgaagagccccaggattggcctttaaacgaaaagcgcacattatggaaggattcagatctcccaacttggcggagaggcaccggatataccctttctctgccagctgtgagtcctggaaagcggttgtggggcgagaaggctggaagccttcctgagtctgaacccctcttcacatatacacttgacgagaaagttgataagctggtgcaattcctgcttttgaagtaccaagccaaggaaccattaacccgtgcagaaatgcaaatgaacgtcattaatacatacacaggctatttccctatgattttccgaaaagcacgagagtttatcgagattctgttcggcattagtctgaccgaggtcgaccctgaccacttctacgttttcgtgaatacgctggaccttacctgtgagggctccttgagtgacgagcagggcatgccccagaacaggcttcttatactgatcctcagcgttattttcatcaagggaaattgtgcttctgaggaggtaatctgggaggtcttgaatgcaattgggccgtggtccgctctggcaggctttgctgacgtcctgagtcgcttggccctttgggaaagcgaagggccggaggcattttgcgaagaaagcggcctccggagcgccgaagggtccgttttggacctggctaacccacagggcctcgccggacatagacaggaggacgggagaagagggctgactgaggccagccctcaacaaaaaaagggcggcgaggacgaggatatgcccgcggcaggtatgccccccctccctcaaagcccacctgaaatccctccacagggcccgcccaaaatctcaccccaaggacctcctcagtctcccccacagtctcccctggattcatgctcctctcccctgctctggactagactggacgaggaatcgtcaagtgaggaagaggacactgccacatggcatgccctccctgagagcgagtcgcttccgaggtacgccctggacgagaaagtagcagagctcgtccagtttttgttacttaaataccaaaccaaggagccagtgacaaaagccgaaatgctcaccaccgtgatcaagaaatataaagattacttccccatgatcttcggcaaggcccatgagtttatcgaattgatcttcggaattgccctgacagacatggaccccgacaaccactcgtacttcttcgaagacactttggacttgacctacgagggctccctcatcgatgatcagggaatgcctaaaaactgtctactcatactgattttaagcatgattttcatcaaggggtcttgcgtgcctgaagaagtcatctgggaggtcctttcagctatcggccctatacagcgcccagcccgcgaggtgctggagttcctgagtaagctgtctagcatcataccaagcgcgtttccctcctggtacatggatgcactgaaagacatggaggaccgggcacaggccattattgataccaccgatgacgcaaccgcaatggctagtgcatcaccatctgtgatgagtacaaatttctgtccagagtag

SEQ ID NO: 123892 - DNA, 801 bp, Artificial Sequence
  Description of Artificial Sequence: Synthetic coding sequence
atgcctgccgctggaatgcctcctctgcctcagtcaccaccggaaatacccccccagggcccccctaagattagccctcaagggcctccacagtccccgcctcagtcacccttagactcctgttcaagccccttgctctggacccggctggatgaagagtcctctagcgaggaggaggacacagcaacctggcacgccctgccagaaagtgagtctttgccgcgatacgccctagacgaaaaggtggctgaactggtccaatttctcctcctgaagtatcagactaaggagcctgtgacaaaggcagagatgctaaccactgtgataaagaagtataaggactatttcccaatgattttcggcaaagctcacgaattcattgaactgatattcggaattgccttgaccgatatggaccccgataatcattcgtatttcttcgaggatactctggatctgacatacgaaggttctctcatagatgatcagggcatgcctaaaaattgcctccttattttgattcttagtatgattttcatcaagggctcctgtgtgcccgaggaagtcatctgggaggtgctgtccgctataggtgtgtgtgcaggacgcgagcattttatctatggcgatcccaggaaacttctgactatccactgggtgcaacgcaaataccttgagtatagagaagttccaaactcggcgccaccacggtacgaattcctctggggtccacgggcacactctgaggcgagcaagcggagcctgagagtctttatccaggccattcagtatcacccatag

SEQ ID NO: 123893 - DNA, 381 bp, Artificial Sequence
  Description of Artificial Sequence: Synthetic coding sequence
atggacacaggccaactccaactctctagagaaagatctcccggggccggacaacaggctcgcagagaactctgcggccggattgcgatttcccaacatggaggaaaagcacaggccagtccctcccacagcctgctgtctccgctggataagacggatggggaaccttggagtgcactggccggattcgccgatgtgctgagccgactcgcactgtgggaatcagaaggaccagaagccttctgtgaagagagcggactgagaagcgctgaaggctccgtcctcgaccttgctaaccctcaggggaaagggccaaagggagagctaagggacttcgccccacgcactgaagaggcgcctgtgtgtcccgccctgccctag

SEQ ID NO: 123894 - DNA, 1041 bp, Artificial Sequence
  Description of Artificial Sequence: Synthetic coding sequence
atgccactgttccccaatctgccccggttatctttcgaggaagacttccaaaacccatccgtgaccgaagacctggttgacgctcaggattccattgacgaggaggaggaggacgcctccagcacttcctcatcgagcttccactttctgtttccctcttccagttcactgagctctagctcacccctatcgtctccgttacccagcacactgatcctcggggtacccgaggacgaggacatgcccgccgctggtatgcctcctcttccccagtctcctcccgagataccacctcaggggccacccaaaatttcccctcaggggcccccacagtcaccaccccagagtcccctggacagctgtagctcaccactgctttggacccgcctcgatgaggagtcctcaagtgaggaggaggacacggctacttggcatgcacttccagaatctgaaagcctgccccgctatgccctggacgaaaaagtggcagagcttgtacagtttttactgctcaaatatcagactaaggaacctgtgacgaaagcggaaatgctgaccacagtgattaagaagtacaaggactacttccctatgatcttcggaaaagcccacgagtttattgagctgatctttggcatcgccctcaccgacatggatcccgataatcacagctacttctttgaggatacactggacctgacttacgaaggatccctaatcgacgatcagggcatgcccaaaaattgtctgctcatcctgattctgagtatgatcttcattaagggctcatgcgtgcctgaggaggtcatctgggaggtcctttccgccattggtgtttgtgcaggccgggagcatttcatctatggtgatccacggaaactacttacaatccactgggtccagcggaagtatctggaataccgggaggtgcccaattctgctccacctcgctacgaattcctgtggggtcccagagcccattctgaggcaagcaaacgctcactccgggtctttattcaggccatccaataccacccctag

SEQ ID NO: 123895 - DNA, 1041 bp, Artificial Sequence
  Description of Artificial Sequence: Synthetic coding sequence
atgcctctgttcccaaacctgcctagactctccttcgaagaggactttcagaacccttcagtaacggaagatctcgttgatgcccaggacagcatcgatgaggaggaggaggatgccagctccacatcatcttccagctttcatttcctgtttccctctagttcctctctctcctctagttcccccctgagttcacccttaccctcaacactcatcctcggagttcccgaagatgaggacatgcccgcggcaggtatgccacccctccctcaaagcccacccgaaatcccgcctcagggtcccccgaagatctctccacagggcccccctcagtctccaccccaaagtcccctggactcttgtagttcaccgctgctgtggactcgcctcgacgaggaatcttcttccgaggaggaggataccgccacttggcacgcgctcccagaaagtgaaagtctccctcgctatgcccttgatgaaaaagtggcggagctcgtacagttcctgctcctcaaataccagactaaggaacccgtcaccaaggcagagatgctgacgacagtgataaagaagtacaaggactactttcccatgattttcggcaaggctcacgaatttatcgagctgatctttgggatcgcgttgacagacatggacccagataaccatagctactttttcgaagataccctcgatctgacctacgagggctcactgatcgacgatcaaggcatgcctaagaattgtctcctcatcctcatcctgtccatgatctttatcaagggctcatgcgtacccgaagaagtcatttgggaggttcttagcgcaataggcgtttgcgcaggtagagagcattttatctacggagaccctcgaaagttgcttaccatacattgggtccagcgaaagtacctagaatacagggaggtcccgaactcagcacccccaagatacgagtttctctggggaccacgggcccattctgaggctagcaagcggagcctgcgtgtctttatccaggcgattcagtaccatccttag

SEQ ID NO: 123896 - DNA, 2337 bp, Artificial Sequence
  Description of Artificial Sequence: Synthetic coding sequence
atggcccaaaagatggactgcggggccggacttctgggctttcaagccgaggcatcagttgaggactctgcactactcatgcagactctgatggaggccatccaaataagtgaggctcctccaactaaccaggcgacggccgctgcatcgcctcaatcttcacagcctcctactgccaatgagatggctgatatccaggtgtctgccgcagccgcaaggccaaagagtgcattcaaggtgcaaaacgctaccaccaaaggacctaatggcgtgtatgatttctcccaggcccacaacgccaaggatgtgcccaacacgcagcccaaggccgccttcaaatcccagaacgccacacccaaaggccccaacgccgcatacgacttttcgcaggcagccacgactggcgaattggctgcaaataaatctgagatggcctttaaggctcaaaatgccacaaccaaggtggggcccaatgcaacgtacaacttctcacagagtttgaatgccaacgacctcgccaattctagacccaaaactccatttaaggcgtggaatgacacaaccaaggctcccactgccgatacccagacccagaacgttaaccaggctaaaatggctacctcacaggcggatattgaaacagatcccggcattagcgaacccgacggcgccactgcgcaaacctcagccgacgggagtcaggcccagaatctggaatccaggaccatcataagagggaaaagaacaaggaagatcaataatctgaatgtggaagagaattcctcgggggatcagcgtagggcaccactggcggcaggtacctggaggtccgctcctgtgcccgtaaccactcagaatccaccaggcgcccccccgaatgtgctgtggcagacgcccttggcgtggcagaacccctctggctggcagaaccagaccgcccgccagactccaccggcccgccagtcacctccagccagacagactccacctgcttggcagaatcctgtcgcctggcagaacccagtgatttggccaaacccagtaatctggcagaacccagtaatttggccaaaccctatagtatggccaggacccgtcgtttggccgaaccccctcgcctggcagaatccacccggttggcagacacccccaggttggcaaactccccccggctggcaggggccccccgactggcagggccccccagattggcctttgcccccagactggccactaccgccagactggccccttcccactgactggcctctgcctccagattggatccctgccgattggccaataccacctgattggcaaaacctacgtcctagccccaacctcaggccctccccaaatagccgggcctcacaaaacccaggggctgcccagcctcgagatgtggcactgctgcaagagcgagctaataagctggttaagtacctgatgttaaaagactacaccaaggtacccataaagagatccgaaatgctacgcgatatcatcagagagtacaccgatgtgtacccggaaataatcgagcgcgcttgtttcgtgctagagaagaaattcggtatccaactcaaggagatcgataaggaagagcacctgtatatcctcatctctactccggaatcactcgctggaatccttggcaccacaaaagatacacctaagcttggactgctgctcgtcatacttggggtgatcttcatgaatgggaaccgtgcctccgaggcagtcctgtgggaagcccttcggaagatggggttgcgaccaggagtgcgccatccccttctgggcgacctgaggaagctgttgacttacgaatttgtcaaacagaaatacctcgactaccgcagagtaccaaattcaaaccctcccgagtatgagtttttgtgggggctgcgcagctaccacgaaacgtccaaaatgaaagttctacggttcatcgccgaggtgcaaaaacgtgacccacgggattggactgcacagttcatggaagccgccgatgaagccctggacgcgctggacgcagcggctgccgaggcagaagctcgagccgaggctaggaccaggatgggcataggtgacgaggcagtgtccggaccgtggtcctgggacgacatagagttcgagctgctgacatgggacgaagagggagacttcggggacccctggtccagaattccctttactttttgggctcgatatcaccaaaacgcccgctctcggttccctcagacctttgccggacccataatcggacctggtgggaccgctagcgcaaacttcgcggccaacttcggcgcaatcggttttttctgggttgagtag

SEQ ID NO: 123897 - DNA, 2505 bp, Artificial Sequence
  Description of Artificial Sequence: Synthetic coding sequence
atggctcaaaagatggattgtggggccggcctgctcggttttcagaacccagacgcttgtcgtgccgtttgtcacccactccctcagcctcctgcttctacgttacctctcagcgcattcccaacactgtgtgaccccccctattctcagctccgtgatccccccgccgttctcagctgctactgtacaccgctgggtgcttccccagcacccgcagaggctagcgtggaggatagcgctctgttgatgcaaaccctgatggaagcgattcagatctcagaggccccaccaacaaatcaagctaccgcggctgcatcacctcagagtagtcagcctccaacggccaatgagatggcagacattcaagtatcagctgcggccgcccgcccgaagagcgccttcaaagtacagaatgcaacaaccaaaggtcccaacggggtctatgacttcagccaggcccataatgcaaaagatgttcctaacacacagccaaaggccgcatttaaaagccagaatgcaacaccaaaaggtccgaacgccgcttatgacttttcgcaggccgccaccaccggggagctggctgcgaataagagtgagatggccttcaaggcacagaacgcaacgaccaaagtgggtcccaatgctacttataatttcagccagagcttaaacgctaatgatttagcaaacagtcggcctaagacaccctttaaggcctggaacgataccaccaaggcacccaccgccgacacacagacacagaacgtaaaccaggctaaaatggccacttctcaggccgatatcgaaaccgacccagggatctccgagcccgacggagccacagcacagacgtcagccgatggcagtcaggcccaaaacttggagtccaggactattatccgagggaagagaacacgcaagattaacaatctaaatgttgaagaaaactcttccggtgaccaacgccgggcgccattggctgctggcacatggaggtctgcaccagtacctgttacaactcagaatccaccaggcgctcctccaaacgtgctttggcagaccccactggcctggcagaatccgtcaggctggcagaaccaaacagcccgccagaccccccccgcacgacagtcccctcctgcaagacagacgcctcctgcttggcagaaccctgttgcctggcagaaccccgtcatctggcccaatcctgttatttggcaaaaccccgtcatttggcccaatcccatagtgtggccgggcccagtcgtctggccgaatccccttgcctggcagaatccacccggatggcaaacccccccaggctggcagaccccacccgggtggcaaggccctcctgactggcaggggcctccagactggcctctgcctccagattggccactaccgcctgattggcctttgcctactgattggcctctgccgccggactggatccctgccgattggccgataccacctgactggcaaaatttaagaccatctccaaatcttagaccatctcctaattcacgggccagtcaaaatcccggagcagctcagcccagggatgtggccttacttcaggagcgcgctaacaagctcgttaaatacctgatgctgaaagattatactaaagtgccgattaagaggtctgaaatgctgcgtgacataatccgagagtataccgatgtttacccggaaataatcgagagagcatgcttcgtcctcgagaagaaattcggtatccagctgaaagaaattgataaggaggaacacctgtacatcctcatttctactccagaatcgcttgccggcatactgggaactacgaaggacacgccgaagctaggcctgctccttgtgatcctcggcgtgatcttcatgaatgggaatcgcgcgtcagaagccgtgctgtgggaggcactacgcaaaatggggctgcgacccggcgtgcggcacccgctgcttggcgacctacgcaagttgctgacatacgaatttgtcaagcaaaaatacctggactaccgccgggtccctaatagtaatccgccggagtacgaattcctgtggggtctcagaagctatcacgagacttccaaaatgaaggttctgcgcttcatcgccgaggttcagaaacgcgacccaagagactggaccgcacaattcatggaggctgcggacgaggccctcgacgccctggacgccgctgctgcagaggccgaggctcgcgccgaggctagaactcggatgggcatcggcgatgaggccgtgagcggcccttggagctgggacgatattgaattcgagctgttgacctgggatgaagagggcgatttcggcgacccttggtcccggatccccttcaccttctgggctagataccatcaaaacgcacgctcacggtttcctcagacgttcgcgggaccaatcatcggaccgggtggtacggcttccgctaactttgccgcaaactttggggcgataggcttcttctgggtggagtag

SEQ ID NO: 123898 - DNA, 2337 bp, Artificial Sequence
  Description of Artificial Sequence: Synthetic coding sequence
atggcccaaaagatggactgcggggctggtttgctggggtttcaggctgaggccagtgtggaggattcagctctattaatgcagacattaatggaggctatacagatctcagaggcacccccaaccaatcaagccacagccgctgccagtccacaaagctctcagcctcctaccgctaatgagatggcagacatccaggtgtctgctgccgctgctcgtcccaagtccgctttcaaggtacaaaatgctaccacaaaagggccaaacggcgtctacgatttctcccaggcccacaatgccaaagacgtgcccaacacccagcctaaggccgctttcaaaagccagaacgccacccctaaaggccccaatgccgcgtacgatttctcacaggcagccactaccggcgagctggcagcaaacaagagcgaaatggccttcaaggctcagaatgctacaactaaagtcggccctaatgcaacatacaacttctcacagtctcttaatgctaacgatctggcaaacagcagacccaaaaccccttttaaagcgtggaacgatactacaaaggcaccaacagctgatactcagacccagaacgttaatcaagccaagatggccacctcgcaggcagatatcgagactgatcctggcatctccgagcccgatggggctacagcgcagaccagtgcggatggctcccaggcacaaaacctggagtcccgtaccattatccgcggaaaaagaacccgcaagatcaataacctcaatgtcgaggaaaactcttctggagatcagcgtcgggctcctttggccgctggcacttggagaagtgcgcctgtgcccgtcactacccaaaacccccccggtgcccctcccaatgtcctctggcagacccctctggcttggcaaaaccccagcggatggcagaaccaaacggcgcggcagacgccccctgccaggcagtcccctcctgcaagacaaactccccccgcctggcagaatcctgtggcatggcagaaccctgtgatctggccgaaccctgtgatttggcagaacccagtcatatggcctaatccaatcgtatggccaggcccagtggtttggccaaatcccttggcctggcagaacccccccggatggcagaccccacccggctggcagaccccccccggatggcaaggaccccccgattggcagggccccccagactggcccctcccacccgactggccattgccgcccgactggccattgcctaccgattggccactgccccccgattggattccggctgattggccaatccctcccgactggcaaaatctccgtccctcccccaacctcaggccatctccaaacagcagagcatcccaaaaccctggcgccgcgcaacccagagatgtggctctcttacaagagcgcgccaataagttggtcaaatatctgatgctcaaagactacaccaaggttcccatcaagcgcagcgaaatgcttcgggatatcatcagggagtacacagatgtgtaccccgaaataatcgaaagggcctgtttcgtcctagagaagaaatttggcattcagttgaaggaaatcgataaagaagagcatttatatattctcatctccacccccgagtccctggcgggaatactagggaccactaaggatacgccaaagttgggactgcttctggtgatccttggagtgatttttatgaatggaaaccgggcgtccgaagctgtgctttgggaggcccttcggaaaatgggactgcggcccggcgtgcggcacccgctcttgggagacctacgcaaactgctcacctatgagtttgtgaaacagaagtacttggactacagaagggttcctaatagcaacccacccgagtatgagtttctgtgggggctccggagctaccatgaaacatccaagatgaaggtgctgcgctttattgctgaagtgcaaaagcgcgatcccagggactggacagcccagtttatggaagccgctgatgaggcactagacgccttggatgctgctgccgcagaagctgaggcacgggccgaagccagaacgcggatgggcattggcgacgaggcagtgagcggcccctggagttgggatgatatcgagttcgagttactaacatgggatgaagagggagatttcggtgatccttggtcacgcatcccttttactttctgggcccgctaccaccaaaacgcgcggtcccgatttccgcagactttcgcaggacccatcatcggccctggaggtactgcaagtgcaaacttcgccgccaactttggagcaattgggtttttctgggtggagtag

SEQ ID NO: 123899 - DNA, 2337 bp, Artificial Sequence
  Description of Artificial Sequence: Synthetic coding sequence
atggcacagaaaatggactgtggcgccggcttgctgggctttcaggccgaagcaagtgttgaggatagtgctctgctgatgcagacgctcatggaggctatccaaatctccgaagcccctccaacgaaccaagcaacggcggctgcatccccacagagctcacaaccacctactgccaacgagatggcagacatccaggtgtcagctgcagcagcaagaccaaagagtgccttcaaggtccaaaatgccacgacgaaggggcctaatggcgtatacgacttctctcaggcccataacgccaaagatgtgcctaacacccaacctaaggccgctttcaaaagccaaaatgcgactcccaagggacctaacgcagcatatgatttttcacaggctgccactaccggagagctagctgcaaataaatctgagatggccttcaaggcccaaaatgccactactaaggtaggacccaacgcaacatacaacttttcgcagtctttgaacgccaacgacctggccaactcacgccccaagacaccttttaaggcctggaatgacactactaaggctccaaccgcagatacccagacgcagaatgtcaaccaagccaagatggcaacatcacaggccgacatcgagaccgatcccggaattagtgagcccgatggtgccactgctcagactagcgccgacgggtcgcaagcccaaaacctggagagccgaaccatcatccgtgggaaaagaaccagaaagatcaataacttaaatgttgaggaaaactccagtggagatcaacgaagagctccccttgccgccggcacttggcggtcggcgccggttcccgtaaccactcagaaccctcctggggcccccccgaacgtgctctggcaaactccactcgcctggcagaatccttcggggtggcagaatcagacagctcgccagacaccacccgcccggcaaagtccaccagccaggcagaccccaccggcctggcagaatcccgtggcttggcagaatcctgttatttggcctaatccggttatctggcagaaccctgtaatatggcccaatcccatcgtgtggccagggccagtggtctggcccaatccacttgcttggcagaacccacccggatggcagactccacctggctggcagacaccccccgggtggcaggggcctcccgattggcagggaccccccgactggccactccccccggattggccgttgcctcccgactggcccctgccgacagactggccactgccaccagattggatccccgccgattggccaattccacccgactggcaaaacctgcggccctcccctaatctgagaccctctcccaactctagagccagccaaaaccccggagccgctcagccgcgcgatgtagccctgttgcaggaaagggctaataagctcgtaaagtacctgatgctcaaggactatacaaaagtcccaatcaaaagatccgaaatgttgcgtgatattatcagagaatatactgatgtgtatcctgagatcatcgaaagagcgtgtttcgtgttagagaaaaagtttgggattcagttaaaagagatcgacaaagaagaacacctctacatcctgattagtaccccagagagtctagctgggatcttgggtactaccaaggatacacccaaactcgggctgctgttagtgatccttggtgttatattcatgaatggaaatcgagccagtgaggccgtgctgtgggaggctttacggaagatgggccttcggcccggcgtcagacatccacttctgggggaccttaggaaactgctgacatacgagttcgtgaaacagaagtaccttgactatcgcagggttcctaattccaacccaccggagtatgagtttctttggggactcaggagttatcacgagactagcaagatgaaagtgttaagatttattgctgaagtgcagaagcgcgacccacgggactggactgcacagtttatggaagcagccgacgaagctctggacgcactcgacgctgctgctgccgaggcggaggctcgagccgaggcgaggacacgcatgggaataggcgacgaagccgtgtcaggcccctggtcttgggatgacatcgagttcgaactcctgacgtgggatgaggagggagattttggggatccctggagtagaatcccttttaccttttgggcaagataccaccagaatgctcgttctagatttccacaaactttcgcggggcctattattgggcccgggggcacagcctctgcaaattttgctgcaaacttcggagccataggcttcttttgggttgaatag

SEQ ID NO: 123900 - DNA, 414 bp, Artificial Sequence
  Description of Artificial Sequence: Synthetic coding sequence
atggcccaaaaaatggactgcggcgctggtttactcggatttcaggccgaagcaagtgtggaggacagcgccctgctcatgcagactctgatggaagccatccagataagtgaggcgccccccacaaatcaggctaccgcagctgcgagcccacaatcatctcaaccaccaaccgctaatgagatggcagacatccaagtgagcgctgccgctgcacggcccaaatcagcgtttaaagtgcaaaatgcaaccaccaaagggcccaacggcgtttacgatttctctcagtccctgaacgcaaatgacctcgcgaattcccgtccaaaaacccaagtaagcctgaacctgacagtgcagctccaccgccaccagcagatggtgccacgactgaggatatggagcccaggtcaatag

SEQ ID NO: 123901 - DNA, 3942 bp, Artificial Sequence
  Description of Artificial Sequence: Synthetic coding sequence
atgagcggctggcgctacctcatctgcgtctccttcctgcttaccatactgcttgagctcacttatcaggggccccctgtccctgcctccagttcgaccaagctgttgatgactagctacagtatgcgtagcacagtcgtgtccaggtatgctcacactttggtcacaagcgtgctgtttaacccccatgccgaagctcatgaggctatctttgacttggatcttccgcatctggccttcatctcaaatttcaccatgactatcaataacaaggtgtatatagcagaggttaaagagaaacatcaggctaagaagatctacgaagaggcacatcaacaagggaaaaccgccgcccatgttggaatacgcgatcgggagagcgaaaaattccgaatttccacatctctggctgccgggactgaggtaactttttccctggcctacgaggaattattgcaacgccaccaaggccagtatcagctagtggtgtctctgcgacctgggcagctggtgaagaggctctctattgaggtaacagtgtcagagcggaccgggattagttacgtccatatacccccactgcgcactgggaggcttcggacaaatgcacacgcctccgaggtcgatagccccccttctactagaatagagaggggcgaaacctgcgtgcgtattacatattgccctacattgcaagaccagagcagcattagcggatcaggaattatggctgatttcttggtgcagtatgatgtggttatggaggacattattggtgacgtgcagatatatgacgattactttattcactactttgctcctcggggactgccccccatggagaaaaacgtagtgttcgtgattgacgtgtcatcctcgatgtttggcacaaagatggagcagaccaaaacagctatgaatgtgatacttagtgacctccaggccaatgactatttcaacataatttccttttctgacactgttaacgtttggaaggccgggggaagcattcaggcaactatccaaaatgtgcactccgctaaggactatttacattgcatggaggctgacgggtggacagacgtgaatagcgccctgctggcagctgcctcagtactcaaccatagtaaccaggagccagggcgagggccgtctgtggggcgtatcccgctgatcatttttctgaccgatggagaacccaccgctggggtcaccacaccgagtgtgatcctcagtaacgttagacaggcgctgggacaccgtgttagtctcttcagcttggcctttggagacgacgccgacttcactcttttgagacgtctgtcgctcgaaaatagagggattgccaggcgaatatacgaagataccgatgctgccctgcagctgaaaggactgtatgaagagatctctatgcccctcctagcagacgtacggctgaactaccttggcggactcgttggcgcctctccttgggccgtgttccccaattacttcggtgggtcggagctggtggtcgctggacaagtccaaccaggaaagcaggagctgggtattcatctggccgcccgcgggcccaaggaccagttgttggtagcgcaccattctgaaggcgccaccaataatagccagaaggcctttgggtgtccgggtgaacctgcgcctaacgttgctcacttcataagacgactgtgggcatacgtaaccattggggagctcctggatgcccactttcaggcgagggacactaccacacgccatctgctggcagcgaaagtactgaatctgagccttgaatacaacttcgtgacccctctgacctcactggtgatggtgcaacccaagcaggcctccgaagagactaggagacaaacctctactagcgctggacccgacacaattatgccttctagttcatcccgtcatggcttgggggttagcaccgcccagcccgccttggtacctaaggttatctcaccaaagtccagaccagtgaagcctaagttctacctgagcagcactaccacagcatcaacgaaaaaaatgctatctagcaaagagctcgaacctcttggcgaaagtcctcatacactgtccatgcctacctatcctaaagccaaaattcctgcccagcaggattcagggaccctcgcccaacccactctgaggacaaagcctacgatacttgttccgagtaattcaggcacgctgctgccactgaagcccggcagtctctcccatcaaaatccagacatactgcctaccaactcccggacacaggtcccacctgtgaaaccaggcattcctgctagccctaaggccgacacagtgaagtgtgtgacccctcttcactcaaaacccggggcccccagccaccctcagctaggggcccttacttcacaggcccctaaaggcctgccccagtcccggcctggcgtatcaaccctgcaagtccctaaatatccccttcacactcgccccagagtcccagccccaaagacaaggaacaacatgccgcacttgggtcccggtatacttctgtccaaaacacccaagatcctgcttagcctcaaaccctcagctcctccccatcagatttcaaccagcatctccctgagtaagcccgagacacccaaccctcatatgccccaaactcctttaccgccacggcccgataggccacggcctccactccccgagtctctgtcaaccttccccaacacgatctcatcatcgactgggccaagctcaacaaccacgactagcgtcttgggtgagccattacccatgccctttacacccactctgccacccggccgtttttggcaccagtatgatctgcttcccggcccacaaagaacaaggcaggtactgggacccagccggcccggcgtgccaacaatgagcctgctcaatagttccagacccactcctgaagggagtccacccaaccttcccatattgttgccctcctctatcctccccgaggcgatttccctgctccttctcccagaagagctggagcttctgagtgaatccatggtagaaagcaagtttgtggagtctctgaacccccccgctttctacactttcctcaccccggatgaagacggctctcctaattgggatgggaacagcgaagagattctcggcggcgccggaggaagcatggagtcgcagggctcttccgtgggcctcgcaaaaggaaccctcccaagtatattcacattcagttcaagcgtggatggggatcctcactttgtgattcagatcccacactccgaagagaaaatatgcttcacgctgaacgggcaccccggtgacttactgcagttgattgaggaccccaaggccggattgcatgtgagcgggaagcttctcggcgccccacctaggcctggacataaagaccagacgagaacctattttcaaatcattaccgtgaccactgacaagcccagggcgtacacaataacaattagcagaagcagcatttcactgcgcggcgaaggcactttgcggctttcttgggaccaacctgctctcctaaagcgccctcagttggaactctacgtagccgccgcggccagactgactctgcgcctgggcccttatctggagttcttggtgcttagacatcggtacaggcacccttccaccctgcagttgccacaccttggtttttatgtagcaaacggctccggcctgtcccccagcgccaggggtctgatcggacagttccaacacgcagatatacgcctagtcaccgggccaatggggccttgcctccgtaggcatcacggtcctgatgtgccagtgattctgggaaaacgtcttctaaaagacagcccacggcttctgcctcggtgggcttcatgctggctggtgaagaggtctcacgtcgaactgctgttaggccacccgtacttgagttacgttctgtag

SEQ ID NO: 123902 - DNA, 1767 bp, Artificial Sequence
  Description of Artificial Sequence: Synthetic coding sequence
atgagtgacacttctgagagcggtgccggtctcacgagattccaggccgaggccagtgagaaggacagttcctctatgatgcagaccctcttgacggtgacacagaacgtcgaggttccagagacccctaaggcgagtaaggccactgaggtctctaagactccagaagcaagggaggcgcccgctacccaggcttcatccacgacccagctgacggacacccaggttctggctgccgagaacaaaagtctcgcagctgatacaaaaaagcagaatgccgaccctcaggcagtaacaatgcccgcgactgaaaccaagaaagtctctcatgtcgctgacacaaaggttaacaccaaggcacaagagactgaggccgccccctctcaggcacccgcagatgagcccgaaccagaatcagctgccgcccagtctcaggaaaaccaggatactcggccaaaagtcaaggccaagaaggctcgaaaagtgaaacatctggatggagaagaggacgggtcctctgaccagtcacaggcatccggtacaactggagggcgtcgcgtgtcaaaagcattgatggcctctatggctagaagggcctcccgaggccccatagccttctgggcaaggcgcgctagtaggaccagactggccgcgtgggctcgtagggctctattgagtcttcggtcgccgaaggcacgaaggggcaaagctcgacggcgggccgcaaagcttcagagttcgcaagagcccgaggctccgcctcctagggacgtcgctttgctgcagggtcgggcaaatgacctcgtgaagtatcttctggcaaaagaccagacaaagattcctatcaaacgctctgatatgctgaaggatatcatcaaggagtacaccgatgtgtatccagaaattatcgaacgcgccggatactccctggagaaggtgttcggaatccaactaaaagaaatagataagaacgatcacttatacatcttgcttagtaccctggaacccactgacgccggcatcttgggaactaccaaagactcccccaagctgggcctgctgatggtgttgctgagcataatcttcatgaacgggaaccgttcatccgaagccgtcatttgggaggtccttaggaaattgggcctgagacccggcatccatcacagcttattcggggacgttaagaagctgatcactgatgaattcgtcaagcagaaatacctagactacgctcgtgtccctaacagtaaccctcccgaatatgaatttttttggggattgagaagctattatgaaactagtaagatgaaggttctgaagtttgcctgcaaggttcagaagaaggatcccaaggaatgggcagcccaatacagagaggcaatggaggctgaccttaaagccgccgcagaggccgcggcagaggcaaaggctagagctgagattcgagcacgcatgggtatcggtctgggctctgaaaacgctgcaggcccttgcaactgggacgaggccgacatagggccttgggccaaggctcgtattcaggctggcgctgaagccaaggcgaaagcccaagaatccggtagtgccagtaccggcgcttccacgagcacgaataattctgcaagtgcctccgcaagcacatctggcggatttagcgccggggcctcgctgacagctacgcttacttttgggctgtttgccggtctcggaggcgcaggggccagtactagcggaagttcaggcgcctgtggtttcagttacaagtag

SEQ ID NO: 123903 - DNA, 1653 bp, Artificial Sequence
  Description of Artificial Sequence: Synthetic coding sequence
atgtggcggtcccaaaggcatagaagacctcagagagttagtaaaaccccggaggcacgagaagcccccgcaactcaggcttcctcaaccacacagctgaccgacacccaggtccttgcagccgaaaataagagcctcgcggccgatacaaagaagcaaaatgctgatccccaggcggtaacgatgccagcaactgaaaccaagaaggtgagccatgttgccgataccaaggtcaacacgaaggcgcaggagactgaagccgcaccgtcacaggccccggctgatgagcctgaacccgagagtgccgctgcccagtcacaggaaaatcaggacaccaggcccaaggtgaaggccaaaaaggcacggaaggtgaagcacctcgatggggaggaagatggttcgtctgaccaaagccaggcaagcggcactaccggagggcggcgggtctctaaggccctgatggctagcatggcgcgacgggcctcaaggggcccaattgctttttgggctcgccgagcgagtaggacacgactggccgcctgggcacgcagagccctgttgtcactacgttcccccaaagcccggagaggcaaggcaaggcggcgggcagcaaaactgcagagctcgcaggagcccgaagcgccccccccacgtgacgtcgccttgttgcaaggtcgtgccaatgatttggtgaagtatctgctagccaaagaccagacgaaaattcctattaagagaagcgatatgctgaaagacattatcaaggaatacactgacgtctatcctgagattatcgagcgcgcaggatactcacttgagaaggtttttggtattcagctgaaggagatcgacaagaacgaccatctgtacatactgctgagcactctggaacctactgatgcagggatcctgggcaccactaaggattcgccaaagctgggtttgctgatggtgctcctgtccattatattcatgaatggaaaccggagctctgaggccgtgatctgggaagttctgaggaaattgggacttaggccggggattcaccactccttattcggggacgtgaaaaagctgattaccgacgaattcgtaaagcagaaatacctcgactacgcacgagtccccaattctaacccccctgagtacgaatttttctggggcctgcgatcatattatgagacctccaagatgaaagtgttgaagtttgcctgcaaggttcagaagaaagaccctaaagagtgggcagcgcagtaccgcgaagccatggaagctgacttaaaggctgcagcagaagctgcggcagaggcaaaagctagggccgagatccgagcaaggatgggaatcggcctcggtagcgagaatgcagcaggcccatgcaattgggacgaggctgatatcggcccctgggcaaaggcacgtatccaagctggcgccgaggcaaaagccaaagcacaggaaagtggaagcgcatccaccggcgcctcaacgagtactaataatagcgcatccgcctctgcgtccacgagtgggggattctcagctggcgcctccttaactgctaccctgacgttcggcctgttcgcaggactgggaggggccggtgcaagcacatccggttccagtggcgcttgtggcttctcgtacaaatag

SEQ ID NO: 123904 - DNA, 1821 bp, Artificial Sequence
  Description of Artificial Sequence: Synthetic coding sequence
atgagcgacacaagcgagtcaggcgcaggactgacccggtttcaagctgaggcttcggagaaggattcatcttccatgatgcagacactgctcaccgtcacgcagaacgttgaagtgccagagacgcctaaagcgtccaaggctttggaggtgagtgaggacgtcaaagtgtcaaaagcttcaggagtgtctaaggcaactgaagtctccaagacaccagaagcacgcgaagctcccgcaacccaggcgagcagcaccacccagttgacggacacacaggtgttagctgccgagaataaaagtctcgcagccgacactaagaagcaaaacgccgacccccaggcagtcaccatgcccgccaccgagaccaaaaaggtatctcacgtcgccgacaccaaagttaataccaaggctcaggaaaccgaagcagccccctctcaagcccctgccgatgaacccgagccagaaagtgcggcggctcagtctcaggaaaatcaagatactagacccaaagtcaaagcaaagaaggcgcggaaagtaaagcaccttgatggagaggaagatggctcatcagaccaatctcaggcctcgggaaccacaggaggtcgccgcgtgagcaaagcgctgatggcctccatggcgcggagggctagccgggggcctatcgctttttgggctcggcgcgcttcaaggacaaggctggcagcctgggccagaagggccctgctgtcattgaggtctcccaaggcccgaagaggtaaggctaggaggcgcgccgcaaaactacaatctagccaggaacccgaggcccccccgccaagggatgtcgctttgttgcagggccgcgctaacgacctggtgaagtacctcctcgctaaggatcaaacaaagattccaattaaaagaagcgatatgttgaaggatataatcaaagagtacactgatgtgtaccccgaaattatcgaaagggccgggtattctctggaaaaggttttcggcattcagctgaaagaaattgacaagaatgatcatctgtatatcctgttgtctactctggagcctacagacgccggcatccttggcactaccaaggattcccctaaactgggactcctgatggttctactgtcgattatcttcatgaacgggaatcgttcgagtgaggcggtgatttgggaagtactgcgtaaactgggactgaggcccgggatccaccattctctgttcggcgacgtgaagaaattgataaccgacgaatttgtaaagcaaaagtatttggattatgccagggtgccaaactcaaatcctccagagtacgaattcttttgggggttgcggagctactacgaaaccagcaaaatgaaggtgttaaaattcgcctgtaaggtccaaaagaaagacccaaaggaatgggctgcccagtatcgtgaggctatggaagccgatctgaaagcggctgccgaggcagcagccgaggcaaaggcccgggccgaaatccgcgctagaatgggaattggcttaggatcagaaaacgccgccggcccctgtaactgggacgaagcggacatagggccatgggcaaaagcgcggatccaggccggggcagaagctaaggccaaggctcaggagagcggcagcgcctcaactggcgcttcaacttctaccaacaactcagccagtgcaagtgcatcgactagtggcgggttctccgctggcgcgtccctgacagctacccttacttttggactgttcgccggcctggggggggcaggcgccagtacgtctggctcctcaggtgcctgtggattctcttacaagtag

SEQ ID NO: 123905 - DNA, 1821 bp, Artificial Sequence
  Description of Artificial Sequence: Synthetic coding sequence
atgtccgatactagcgagtccggcgccggtctgacaaggtttcaggccgaggcttccgagaaagactcaagcagtatgatgcagaccttactaacagtgacacagaatgtcgaggttcccgaaacccccaaggcttccaaggccctggaggtcagcgaggatgttaaggtgtccaaagcctcaggtgtttcaaaggctacagaagtttcgaagacacccgaagcgagagaggccccggctacccaggcgtcgtccacgacacagttgacagatacacaggtgctagccgccgaaaacaagagtctggctgccgatacaaagaagcagaatgctgaccctcaagccgtgacgatgcctgcaaccgagactaagaaggtgtcccatgtcgctgataccaaggtcaatactaaagcccaggaaactgaagccgcaccctcccaggcccccgcagacgaacccgagcctgaatccgctgccgcgcagtctcaggaaaaccaagatactcgacccaaggtgaaggccaagaaggccagaaaagtcaaacatctggatggcgaagaggatggctccagcgatcaaagtcaggcgtctggtactaccggcggaagaagagtgtcaaaggctctcatggcgtccatggctcgcagggcttctagaggacctatagccttctgggctagacgggcctctcgcacaaggctcgccgcatgggctcggagggcactgttaagtctgcggagtcccaaagcccggagagggaaggcgcgcaggcgagccgccaagcttcagagctctcaagagcccgaggccccaccccccagagatgtggcccttttgcaggggagagccaacgatctggttaagtacttactcgccaaagatcagacgaagataccgattaaacggagcgatatgctcaaagacattattaaggaatacaccgacgtgtatccagagatcattgaaagggcgggatacagtctggaaaaagtgtttggaattcagctcaaagaaatcgacaagaatgaccacctgtacatcctactgagcacccttgaaccaacagacgccggcatcctcggcaccactaaggatagccctaaacttggattgcttatggtgttgttgtctatcatcttcatgaacggaaatcggtcctcagaagccgtgatatgggaggtgttgaggaaactcggtctgcggcccggtattcatcactccctgttcggtgatgtgaaaaaattaataacagacgagttcgtaaagcagaagtatctggactacgctcgggtgcctaactctaacccacccgagtacgagttcttctggggactgaggtcctattacgagacatccaagatgaaagtactgaagttcgcttgtaaggtgcagaagaaagacccaaaggagtgggccgcccagtatcgcgaggcaatggaggctgacctcaaggccgctgcggaagccgctgctgaagcaaaagcccgagccgaaattagggcacgtatgggaatcgggctggggtcggagaacgccgctggcccttgtaattgggacgaagccgacatcggtccctgggcgaaggccaggattcaagcgggagccgaggccaaagccaaagctcaggaatccggctccgcctccacaggagcatcaaccagcacaaacaacagcgcaagcgccagtgcctccacatccggcgggttctcagcaggagccagccttaccgcaacattgacatttggcctcttcgcgggtctgggaggcgctggagcatccacgagtgggagttccggggcttgcggcttttcttataaatag

SEQ ID NO: 123906 - DNA, 1566 bp, Artificial Sequence
  Description of Artificial Sequence: Synthetic coding sequence
atgtcggacactagcgaatcaggcgcaggtctaactaggttccaagctgaagccagcgaaaaagacagcagcagtatgatgcagactttactgactgtcactcagaacgttgaggtcccggagacccccaaggccagcagtaccacacagctcacagatacccaggtacttgctgccgagaataagagcctcgccgccgataccaagaaacaaaacgccgacccacaggcggtcactatgcccgcaacggagaccaaaaaggtaagtcacgttgctgacaccaaagtcaacaccaaagcccaggaaacagaggccgctccaagccaggccccagccgacgagccggaacctgagtccgctgccgctcagagccaggagaaccaagacacccggccaaaagttaaagcaaaaaaggcccgaaaagtcaagcatctggacggcgaagaggatgggtcctccgatcagagccaagcaagcggcactaccgggggccgcagggtgagcaaggctcgacggcgggcagccaagctgcaaagctcccaggaaccagaggccccgccccctcgagatgtggcgctgctgcaggggagagcaaacgatctggtgaaatatctactggctaaggaccagaccaaaatacctatcaagcggtctgacatgcttaaagacatcataaaagagtacaccgacgtctatcctgagattatagagcgcgccggttactctctggaaaaggtctttgggatccagcttaaggaaatagataaaaatgatcacctctatattctgctgtccacactggagccaaccgacgctgggatactgggtaccacaaaggattcaccaaagctgggattactcatggtgctgctaagcataatctttatgaacggaaaccgaagctccgaggccgtaatttgggaggttctgaggaaactgggtctgcggcccggtatccaccattccctatttggcgacgtcaagaaactgattacagacgaatttgtgaaacaaaagtaccttgattatgcacgcgtgcctaatagcaatcctccagagtatgaattcttctggggcctacgttcctattatgagacatcaaagatgaaggtgctgaagttcgcctgtaaagtgcagaaaaaagatcctaaagagtgggctgcccagtaccgcgaagctatggaagcagatctcaaggctgccgccgaggccgctgccgaagctaaggcacgagccgaaattcgcgcaaggatgggcattgggttgggatctgaaaacgccgccggaccttgtaactgggatgaggccgatatcggcccgtgggccaaggctcggattcaagccggggcagaggctaaggctaaagcccaagaatcgggatccgcttcaaccggggcatctacatccacaaataactcagcctctgcatccgcctccacctctgggggattcagtgctggtgctagcctgacagctaccttgactttcgggctgtttgccggcctgggcggtgccggcgcctcgacatcaggcagctctggagcgtgcgggttttcgtacaagtag

SEQ ID NO: 123907 - DNA, 1566 bp, Artificial Sequence
  Description of Artificial Sequence: Synthetic coding sequence
atgagcgatacttcagaatccggggcaggcctgacaaggtttcaggccgaggcctcggagaaggactcgtcctccatgatgcagacactgctcaccgtaacccaaaacgtcgaagtgcctgagacacccaaagcctcttccactacccagctgactgacacccaggtgttggctgccgaaaataagagtctagccgctgacacaaaaaaacagaacgctgatccccaagctgttaccatgcccgccaccgaaacaaagaaagtgtcccatgtggcggatactaaagtgaataccaaggcccaggagacagaagctgccccttcgcaggcccccgccgatgagcctgagcccgagtccgctgccgcacagtctcaggaaaatcaagatacaaggcctaaggtaaaagcaaaaaaagcacggaaggtgaaacacctggatggagaggaggacggttcttccgaccagtctcaggcctctggcactacaggcggcagacgcgtctctaaagcccgacgccgcgctgcaaagctccagtcgagccaagaacccgaggctcctcctccgagggacgtggccctcctgcaaggccgggccaacgatctggtgaaatacctgctcgctaaggatcaaaccaagatcccaattaaaaggtctgacatgcttaaggacattatcaaggaatacacagatgtctatcctgaaatcatcgagagagcaggatattctttagagaaagtgtttgggatccagttaaaggaaattgataaaaacgaccacctgtatatcctgctcagcacactggaacccactgatgcaggaattcttggaaccactaaagatagccctaaactcggtctccttatggtcctgctcagtatcatttttatgaatggtaatagatccagcgaagccgtgatctgggaggtgttacgcaagctgggcctgaggcctgggattcatcacagccttttcggcgacgtgaaaaagttgattactgatgaattcgtgaaacaaaaataccttgattatgcaagagtgcccaacagcaatccacctgagtacgagttcttttggggcctgcgcagttactacgaaacctccaaaatgaaggtgctgaaatttgcttgcaaagtgcaaaagaaggaccccaaggagtgggccgcccagtatagggaggcaatggaggcggacctcaaggcagccgccgaggctgccgccgaagcaaaagctagagccgaaatccgggcgcgcatgggcataggactgggaagcgagaatgcagccgggccctgtaactgggacgaggccgatataggaccatgggccaaagctagaattcaggcaggagctgaggccaaggcaaaggcccaagagtccggcagcgcatctacaggtgcttccacctcaactaataattccgccagtgcatcagccagcacatcaggcggattttcagccggggcatcactgaccgctaccctgacattcgggctctttgccggattgggtggagccggagctagcacttcaggctcttccggagcttgtggcttctcatataagtag

SEQ ID NO: 123908 - DNA, 1821 bp, Artificial Sequence
  Description of Artificial Sequence: Synthetic coding sequence
atgagcgatacttcggagagtggggccggcctaactagattccaagctgaagctagcgagaaggacagctccagtatgatgcagacgcttctcacggtaacacagaatgtcgaagtgccagaaactcctaaggcgagcaaagccctagaggtctcagaagatgttaaagtgagtaaagcttcaggtgttagcaaggccactgaggtttccaaaactcccgaggcacgtgaggcgccagctacacaggcctcttcgactacccagcttaccgatacacaagtcctagcagccgaaaataagtccctggcggctgatactaaaaagcagaacgcagatcctcaggcagtcaccatgcctgccaccgaaacaaagaaggtgtcccatgtcgccgacactaaagtgaatacaaaggcccaggaaactgaggcagcccccagccaggcgcctgcagatgaaccggaacctgaatccgccgccgctcaatctcaggagaaccaggacacaaggcccaaagttaaggccaagaaggctcgcaaagtgaaacacctggatggggaagaagacggatctagcgaccagtctcaggcgtcaggcaccaccggcggccgcagagtgtctaaagcactgatggcctccatggcccgtagagccagccgggggccaatcgcgttttgggcccgtcgcgcgtcccgcacgagacttgcagcctgggccagacgcgcgctcctgtcgctgaggtcacctaaagccagacgcggaaaggctcgacggagagccgccaagctccaaagcagtcaggagcctgaagccccccctccaagggatgtagccctgttgcaaggtcgcgctaacgacttggtgaaatatttactggccaaggaccagaccaaaattcctatcaaacgcagtgacatgttgaaggatataattaaggagtatactgatgtctacccagagatcatcgagagggcgggctattccctcgagaaggtgttcggcattcagctgaaggaaattgataagaatgaccatttgtacattttgctatctaccctcgaacctaccgatgctggaatactcggcactaccaaggactctcccaaattaggcctgctcatggttctgctgtctataattttcatgaatgggaataggagcagtgaggccgtgatttgggaggtactgagaaagctgggactgcgtcctggcatccatcactccctgttcggggatgttaaaaaattgatcacggatgagttcgttaagcaaaaatacctggattatgctagggtgccaaacagtaatccacccgagtacgaattcttctggggcctcaggagctattacgagaccagcaaaatgaaggtgctcaaattcgcctgtaaggttcagaaaaaggatccaaaggaatgggctgcgcaataccgtgaggctatggaggctgatctgaaggccgcagccgaggctgccgctgaggctaaagcgcgagccgagatcagagcgcgtatgggcattggcctgggcagcgagaatgcagctggcccgtgcaactgggatgaagcggacatcggcccttgggccaaggccaggattcaggccggagcagaggccaaagccaaggcccaggagagcggctccgcgagcaccggagcctcaacatcaaccaacaattctgcgtcagcaagtgccagcacttccggcgggttttctgctggcgcatcacttactgcaactctaactttcggtctgtttgccggtctaggtggcgccggcgcatctaccagtggaagttccggcgcatgcggtttctcctataaatag

SEQ ID NO: 123909 - DNA, 1821 bp, Artificial Sequence
  Description of Artificial Sequence: Synthetic coding sequence
atgtctgatacgtctgagtcaggggctggtctaacacgcttccaggctgaagcgtctgaaaaagacagttcttccatgatgcagacgttgttaaccgtgacccaaaatgtggaggtacccgagaccccaaaagcttctaaggcacttgaggtttctgaagatgtcaaggtgagcaaagccagtggtgtgagcaaggccactgaggtgagtaagacacccgaggcacgtgaggctccagccacacaggcatcttccactacacagctgaccgacacccaggtactggcagccgagaacaaaagccttgcagctgatacaaaaaagcagaacgccgatccacaggccgtgactatgcctgccacggaaacaaaaaaagtaagccacgtggctgatacgaaagttaatactaaggcccaggagactgaagccgcccccagtcaagcccccgctgacgagcccgagcccgagagcgcagcagcgcagagccaagaaaaccaggacacaaggccgaaagtcaaagcgaaaaaggccaggaaagttaagcatcttgatggggaagaagacgggtcgtctgatcagagccaggcaagcggcactaccggcggacgaagggtgagcaaagctctgatggcaagtatggcgcgaagggcaagtcgtggcccaatcgctttctgggccagacgggctagccgcactcggcttgccgcctgggccaggagagctttgctgagtctgaggtcacccaaggctagaagaggaaaagctcgtcggcgagcggcaaagcttcagagctcacaggagcccgaagcaccccctccacgagatgttgccctgctgcagggtcgggccaacgacctggttaaatacctcctcgcaaaggatcagacaaaaattccaatcaaaaggagcgacatgctgaaagatatcatcaaggagtacacagatgtctaccctgagattatagagcgggcgggatacagcttagaaaaagtcttcggtattcagctgaaagaaattgacaagaatgatcatctctacattctgctgagcacacttgaacccactgatgctggcattctcggcacgaccaaggattcacccaagctgggattgttgatggtcctactaagtatcatctttatgaacggcaatcgctcaagcgaagcagtcatctgggaggttctgcggaagctcggactccgcccaggcatccatcactctctcttcggagatgtaaagaaactgatcacagacgaatttgtgaagcagaaatatctggactatgctcgtgttcctaactctaatccacccgaatatgaattcttttggggtctcaggtcatattatgaaacttctaaaatgaaggtgctgaagtttgcctgtaaggttcaaaagaaagatcctaaggagtgggccgcacagtacagagaggcaatggaggcggatcttaaggccgcggcagaggctgccgctgaggctaaagctcgggccgagattcgggccaggatgggcatcggactagggtctgagaatgctgccggcccttgtaattgggacgaggctgacataggcccctgggcaaaggcgaggatacaggccggcgctgaggcaaaggcaaaagcgcaggagtcgggctcagcatcgaccggagcttccacctccacgaataacagcgctagtgcatctgcctctacgtctggcggattttcagcaggtgccagtcttactgccaccctgacctttggtctgtttgctggtctcggcggtgctggcgcttcgaccagtggatctagtggtgcctgtgggtttagctacaagtag

SEQ ID NO: 123910 - DNA, 2220 bp, Artificial Sequence
  Description of Artificial Sequence: Synthetic coding sequence
atggcagaaggttcgttttccgtgcaatccgagtcttattccgttgaggacatggatgaagggtcagatgaagtcggcgaggaagaaatggtggaggggaatgactacgaagaattcggggcctttgggggatacggcaccctcacctcctttgatatccatattttgcgcgcttttggatcactgggccctggactaagaatattgtcaaacgaaccctgggagctcgaaaatcctgtcctcgctcagacactcgttgaagcactgcagcttgaccctgagacactcgccaacgagactgccgctcgggccgccaacgttgcccgggctgcggcatcaaatagagccgcaagagccgccgcagccgccgcgcgcaccgcattctcacaggtggttgctagccaccgagtggcaacgccacaggtgtccggggaagatacccagccaaccacatatgctgccgaagcccagggcccaactccagagccgccattagccagccctcagacctcacagatgctcgtgacaagcaagatggcggctcccgaagctcccgccacttctgcccagtcgcagaccgggtcgcccgcgcaggaggctgcgaccgagggacctagcagtgcctgtgctttttcccaggcaccctgtgccagggaagtagacgcaaatcggccatcaactgcattcctgggccaaaacgacgtgtttgattttacccagcccgcaggggtgagcggaatggcattccccagaccaaaacgtccagcacccgcgcaggaagctgcgaccgagggtcctagtgctgccagtggagtccctcagacaggaccagggcgcgaggtggccgccacacgccccaaaaccacaaagagcggcaaagccctcgcaaaaacccggtgggtggaaccgcagaacgtagtggccgccgccgctgctaaagcaaaaatggcgacgtcaattcctgaaccagagggagccgctgcagcaactgcccaacattccgctgagccttgggcacgcatgggcgggaagagaactaagaaatcaaagcatttggacgatgaatacgaatcctccgaagaggaaagggagactcccgctgtgccaccaacctggcgggcgagccagccctcactgactgtacgggcgcagctggctccccggccgcccatggcaccaaggtcccaaattcccagcaggcatgttctgtgtctgccccccaggaacgtaactctgctccaggagagggccaataagcttgtgaaatatctcatgatcaaggattataagaagattcctatcaaacgggctgacatgctgaaagacgtgatacgagaatatgatgaacattttccagagattatagaacgtgcaacgtataccttggagaaaaagtttggcatccatctgaaagagatcgataaagaggagcacttgtacatcttagtctgtacacgggattcatcggccaggctcctgggcaagacaaaggacactcctaggctcagcttgctgctggttatcttaggtgttattttcatgaatggcaatcgggccagcgaggcagtgttatgggaagcgcttaggaagatgggcctcagacccggagttcgccatccgtttcttggagacctgagaaagctaatcaccgatgattttgtgaagcagaaatacttggagtataagaaaattcctaattccaatcctcctgagtacgaattcctctggggactcagagctcgccacgagacctccaagatgagggtcttgagattcatcgcccagaatcagaatagggatccccgcgaatggaaagcgcatttcctggaggctgtagatgatgctttcaagacgatggacgttgatatggcagaagagcatgctcgagcccagatgagagcccaaatgaacatcggagatgaggctcttattggtaggtggagctgggatgatatccaggttgagttgttgacctgggatgaggatggggactttggggatgcctgggcccgcatccctttcgcgttctgggctagatatcaccagtacattcttaactcaaatagggctaacaggcgagccacatggcgggctggagtatcctctggaactaacggaggagcatccacaagcgtactggacggaccttccacctcgagcaccattagaacccgcaatgcggcccgtgcaggagcctcctttttcagttggatccagtag

SEQ ID NO: 123911 - DNA, 2274 bp, Artificial Sequence
  Description of Artificial Sequence: Synthetic coding sequence
atggccgagggcagcttctctgttcagagcgagtcttatagcgttgaggacatggacgaggggtcagacgaagtgggcgaggaagagatggttgaaggcaacgactatgaggagttcggcgcctttggcggctatggcaccctcacgagtttcgacatacacatcttacgtgctttcggatcattgggtcccggcttgcggattctgtcaaacgaaccctgggaactagaaaatcctgtactagcccagaccctggttgaggcactccagctggaccctgagacacttgccaatgagactgccgcccgagccgctaatgttgctagagccgccgcctctaaccgggcggcccgcgctgccgccgccgctgcccgtacagctttctcacaggtggtggcttcccatagagtcgctacaccccaagtgtctggtgaagacacccaaccaactacctatgccgcggaggcacagggccctacaccagagccaccccttgcttctcctcaaacatctcagatgctagtgacgagtaagatggccgccccagaggcgcccgccacctcggcacagtcccaaacaggaagtcctgcccaggaggcagccacagaggggcccagctcagcatgcgcattttctcaggcaccctgtgcaagggaggtagacgccaatcgtcccagcacggccttcctagggcaaaatgatgtcttcgatttcacccagccggcgggtgtgtccgggatggcttttccaagacctaaaaggccagcacccgcccaggaagctgctacagagggaccgtctgctgccagcggggtgccgcaaaccgggcctggacgcgaggttgccgccacaagaccaaagacaacaaagagcggcaaggccttagctaagaccaggtgggtggaaccccaaaatgtggtggcagctgccgctgccaaagccaagatggccacgagcataccggaaccagagggcgctgccgcagccacagctcagcattccgcagaaccgtgggcccgtatgggcggaaagcgcacaaaaaaaagcaagcatctggacgacgaatacgaatcttcggaggaggaaagagagacacccgctgttccaccaacctggagggcctcccaacccagtttgaccgtgagggctcagttggccccgagacccccgatggccccacgcagtcagatcccaagtagacacgtgctatgtttgcccccacggaacgttactttgcttcaggagcgtgcaaacaagctggtgaagtacctaatgatcaaagattataaaaaaattccgatcaagcgcgccgatatgttaaaagacgtgataagggaatatgacgaacatttcccggaaatcatcgagcgcgctacatataccctcgagaaaaaatttggcatccatttgaaggaaattgacaaagaggaacatttgtacattcttgtgtgcacacgcgatagttccgcaaggctcctggggaaaacaaaggatacccccagactcagcctgctcctcgtgatcctgggggtaatttttatgaacggaaaccgggcatctgaggccgtcctgtgggaggctctgagaaagatgggtctgcggcccggtgtgcgccatcccttcctcggcgacctgaggaagcttataacagacgatttcgtaaaacagaaaaacccagaactgagggaggaaacacccctgagcatggccccgagctggtacctggaatataaaaaaatccctaactctaacccgcctgaatatgagttcctgtggggccttcgggctagacacgaaacctctaagatgcgggttctgaggtttattgctcagaatcagaatcgggacccccgtgaatggaaggcacattttctggaggccgtggatgatgcctttaaaaccatggacgtcgatatggcggaggagcacgcaagagctcagatgcgtgcgcagatgaacattggagacgaggccctgatagggcgatggagctgggatgatatccaggtggagcttctgacatgggacgaggatggggactttggggatgcttgggcccgcatacccttcgcattctgggcccgataccaccagtacattttaaattcaaacagggcgaataggagggccacttggagagctggggtgtcaagtggtacaaatggcggcgcttcaacttccgtgttggatgggccaagcacgtcgagtaccattagaaccaggaacgccgccagagccggcgccagtttcttctcatggatccaacatcgctag

SEQ ID NO: 123912 - DNA, 2226 bp, Artificial Sequence
  Description of Artificial Sequence: Synthetic coding sequence
atggccgagggaagcttttcggtgcagtcagagagttacagcgtggaggatatggacgagggttcggatgaagtgggcgaggaggagatggtggaagggaatgactatgaagagttcggcgcattcggagggtatggaacgcttactagctttgatattcatattcttcgggcctttggatccctaggcccaggattacggattttgagcaatgaaccctgggagttggagaatccagtgttggcacagacgctcgtggaggccttacagctggaccccgaaactctggccaacgagaccgccgcaagggccgctaacgtcgcacgagccgccgcgagcaacagggcagctagagctgccgcagctgcggcccgaacagcctttagtcaggtagtggcgagtcaccgagttgccactccacaggtgagcggcgaggatacccagcctaccacgtacgctgctgaggcccaagggcccacgcccgagccccccctcgccagcccccagacctcacagatgctcgttacttcaaaaatggcggctcccgaggcccctgccacatctgcacagtcgcagaccggcagcccagcccaggaggccgccaccgagggacctagtagcgcctgcgcattttcacaggcaccctgcgcccgggaggttgatgctaaccggccctctaccgccttcttgggacagaacgacgtgtttgatttcacgcagccagccggagtctccggaatggctttccccaggcccaaaaggcctgctccggctcaggaagccgctaccgaagggcccagtgccgcatctggagtgcctcagaccggcccaggacgagaggtggcggccacacgacccaagactactaaatcggggaaagcactggcaaagacacgatgggtggagccccagaatgtcgtggcagctgcagctgccaaggcgaagatggccacatccatacctgagcccgaaggagcagctgctgcaaccgcccagcattccgccgaaccgtgggctcgaatgggcggaaaaaggacaaagaagtccaaacacctggatgacgagtatgagagctctgaagaggagcgagaaactcccgctgtaccccctacgtggagggcctcccagcctagtctgactgtgcgggcccaactggcccctcgcccacctatggccccaagaagccagatcccttccagacacgttttgtgtctgccccccaggaatgtgaccttgctgcaggaacgcgccaacaaattagtgaagtatctgatgatcaaggactacaagaagatccctatcaagcgggccgacatgctaaaagatgttattcgagagtacgatgagcacttccccgagatcatagagcgagcaacttacaccctggagaaaaaatttggaatccacctgaaagaaatcgacaaggaagaacacctgtatattctcgtctgcacgcgggattcatcagcacgacttttgggcaagacaaaggacacgccccgcttgtctctcctcctggtgatactcggcgttatatttatgaacggaaaccgggcttcggaggccgtgctgtgggaggctctcaggaagatgggtttgcggccgggcgtgagacacccattcctcggcgacctcaggaagcttatcacagacgatttcgtgaaacagaagtatctggagtataagaagatcccaaacagtaatccgcctgagtatgagttcctttggggactcagggcaagacatgagacaagcaagatgagagtgttgagatttattgctcaaaatcaaaatagagatccgcgggagtggaaagcccacttcctggaggcagtggacgacgccttcaagacgatggatgtcgacatggccgaagaacatgctcgagcgcagatgagggctcagatgaatatcggtgacgaggccctcattgggcgctggagctgggatgatatccaggttgagctgctaacctgggacgaggacggtgacttcggcgacgcttgggccagaatccccttcgccttttgggcccgataccaccagtatatcttgaactcgaatcgggctaaccggagagccacttggcgagcaggagtgtcctcgggaacaaacggcggcgcaagcaccagcgtgctggacggtccctctactagtagcaccattcgtacgagaaatgcagccagagcaggcgcttcatttttctcctggattcagcatcggtag

SEQ ID NO: 123913 - DNA, 2220 bp, Artificial Sequence
  Description of Artificial Sequence: Synthetic coding sequence
atggctgagggctcattcagtgtacaaagtgagtcgtatagtgtagaggatatggacgaagggagcgacgaggtcggcgaggaggaaatggttgagggaaatgactacgaagaattcggcgcctttggtggatatggaacactcacatctttcgacatccacatcctcagagcctttggttctctcggccccggattacgtattctctcaaacgagccctgggagttggaaaaccctgtgcttgctcaaaccttggtcgaggccctgcagttggatcccgaaaccctcgctaatgagacagcagccagggccgccaatgtcgcacgagctgcggcctccaaccgtgccgctcgggcggctgccgcggccgcacggaccgctttcagtcaggtggtggccagccatagggtggcaactcctcaggtgtcaggcgaggacacgcaacctaccacgtatgcagccgaagcccaggggcctacgcctgaacccccacttgcttccccacagacatctcagatgctcgtcacctccaagatggccgcccccgaggcccccgccacatctgcacagtctcaaaccggatccccagcacaggaggccgcaacagaaggaccatcttctgcctgcgcattctcccaggccccttgcgctcgtgaggtcgacgccaatagaccttccacagcctttctcggccagaacgacgtcttcgactttacccagcccgccggagtgtctgggatggcattccccaggccgaagcgccccgccccagcccaggaagccgcaactgagggtccatccgccgcttcaggagtgcctcagaccgggccaggcagagaggttgccgccacccggcctaaaaccaccaagtctggaaaggcccttgccaaaacccggtgggtagagccccagaacgtcgtcgccgccgctgcagctaaggccaaaatggcaaccagcatccctgagcctgagggggctgcggctgccaccgcccagcacagcgctgaaccttgggcgagaatgggcggtaaacggactaaaaagtccaagcatttggacgatgaatatgagtcatctgaggaagaacgcgaaactccagccgttccacctacctggcgggcttcccagccctcactgactgtgcgggcacagctagcaccccgccctccgatggcaccacgatcacaaatacctagtaggcatgtcttatgcctgccaccacggaatgtgactcttctccaggagcgcgcgaataaactggttaagtacttgatgatcaaggactataagaaaatccccatcaagagagcggacatgctaaaggacgtcatccgagaatatgacgaacacttcccagagatcattgagcgagcgacgtacaccttagaaaaaaagttcggaattcatctgaaggagattgataaggaggaacatctctatatcctggtttgtacaagggactcaagcgccagacttctcgggaaaaccaaggacacaccgcggttaagtctcctgttggtgatcctcggtgtcatattcatgaacggtaacagagcttctgaggcagtgctgtgggaagccctgagaaagatgggcctgcggcctggtgtccggcacccgtttctaggtgacctgcggaaactgatcacagacgattttgtcaagcagaaatacctggaatataaaaagattccgaatagtaacccacccgaatacgagttcttgtggggcttacgggctcgccacgaaacaagtaaaatgcgggtgctgagattcattgcccagaaccagaatcgggaccctcgagagtggaaggcacatttcttggaagcagtggacgatgcttttaaaacaatggacgtagatatggccgaggagcatgcccgggcacaaatgcgtgcccagatgaatattggtgacgaggccctgatcggcagatggtcctgggatgatatccaggtggaactgctgacatgggatgaggatggagatttcggagacgcctgggctcgtatccccttcgccttctgggccaggtaccaccaatacattcttaatagtaaccgggcaaatcggcgagccacgtggagagcaggggtgtcatcaggtaccaacggcggtgcttcaacaagtgtgctggacggaccctctacatccagtacaatccggactcgaaacgcggcacgggcgggcgcctcctttttttcatggattcagtag

SEQ ID NO: 123914 - DNA, 2274 bp, Artificial Sequence
  Description of Artificial Sequence: Synthetic coding sequence
atggcggagggctcttttagcgtacagagcgagagctactcagttgaagacatggacgagggatccgacgaggtaggagaagaggaaatggttgagggaaatgactacgaggaatttggggcctttggtggatacggcaccctgacatctttcgatatccacattctccgggccttcggttcccttggacctggcctccgcatcctctctaatgaaccctgggagctcgaaaacccagttttagcgcagacactcgtggaggctctgcagctggatccagaaactctggccaatgaaactgctgcgcgggcggctaatgtggctcgagccgctgcttcaaatcgagctgccagggccgcagctgcagcagctaggaccgccttcagccaggtggtggcttcccatcgcgtggccaccccgcaggtttctggcgaggacactcagccaacaacttacgccgccgaggctcagggccctaccccagaaccacctctggcctctccacagaccagtcagatgctagtcacgtcaaagatggcggcccccgaagctccagcaacgtctgcacagagccagactggatcgccagcgcaggaggccgccaccgagggacctagtagcgcctgcgccttttcccaggccccatgcgctcgtgaagtggacgctaaccgaccgagcaccgcttttctggggcagaacgacgtgtttgacttcactcagcctgctggtgtgtcagggatggccttccctaggcccaagcggcccgctcccgcgcaggaggctgccaccgaggggcccagtgccgccagcggtgtgccccaaaccggcccaggacgagaagttgcagccacgaggcccaagaccacaaagtctggtaaggctttggcaaaaacccgctgggtagagcctcagaatgtggtggctgccgcagccgctaaggctaagatggccacaagcatccctgaacccgaaggggcagcagctgccacagcccagcactccgctgagccatgggcaaggatgggcggaaagagaacaaagaagtccaaacacttggatgacgaatacgagagtagtgaagaagaacgcgagacaccagcggtccctcctacttggagagccagccagccttccctgactgttcgggcacaactcgcacccaggccaccaatggcgccccggagccaaatccctagccgacacgttctgtgccttccacctcgcaatgtcactctccttcaggaacgcgctaataagctcgttaagtacctgatgattaaagattacaagaaaatccctataaagcgggccgatatgctgaaagatgtaatcagggagtacgatgagcacttcccagaaattatcgagagagccacctacacactagagaaaaagttcgggattcacttaaaagaaattgataaggaagaacatttatacatcctcgtctgcactcgggattcctcggctcgccttcttggcaagacaaaggacacaccaagactctcacttctgctcgtgatcttgggcgtcatcttcatgaatggtaacagagcatctgaagccgtgctctgggaagcgctcagaaaaatgggtctgcgacctggagtgcggcacccctttttgggtgacttgcggaaactaattacagatgacttcgttaagcagaaaaaccccgagctgcgtgaggagaccccactgagtatggcccccagttggtatttggagtacaagaaaattccgaacagcaatccgcccgagtatgaatttctgtggggcctcagagcccggcatgagaccagcaaaatgagggttctcagattcattgcccagaaccagaacagggaccccagagagtggaaggcccactttctcgaagcagtcgacgatgcgttcaaaactatggacgtggacatggctgaagagcacgctagagctcagatgcgggcacaaatgaacattggagatgaggccctgattgggagatggagttgggacgatatccaggtcgaactgcttacatgggatgaggatggcgattttggcgatgcctgggcaagaataccgttcgctttttgggcgcgataccatcaatatatactgaacagcaaccgcgctaaccggagggctacctggcgggcgggggtgagtagcggaaccaatggtggagcatcaacatctgtgttggacggaccaagcaccagctccacgataagaactcgaaatgccgcccgcgcaggggcatctttcttttcatggattcaacacaggtag

SEQ ID NO: 123915 - DNA, 2226 bp, Artificial Sequence
  Description of Artificial Sequence: Synthetic coding sequence
atggccgaaggatctttcagtgtccagtcagaaagctattccgtggaggacatggatgaagggagcgatgaagtgggtgaagaggagatggtggaagggaacgactacgaggaattcggagcattcggcgggtatggaacactgacctcctttgatattcacatccttagggccttcgggagcctgggccctggattgaggatactgtctaatgagccatgggaactggagaaccccgtcctcgctcagactttggtggaggctctgcagctggatccggagactcttgcaaatgaaacagctgcacgagctgcaaatgtggcccgggcagccgccagcaaccgggctgccagagccgccgctgctgccgctagaactgcattctcacaggttgtggctagccaccgggtggctacaccccaggtgtcaggagaggacacgcaacccactacatatgcagcagaggcccaaggacccactcccgaaccacctttggccagtccacaaacttcacagatgctcgtgactagcaaaatggcagcccccgaggcccctgccaccagtgcccagtctcagaccgggagccccgcacaggaggccgccactgagggtccaagttccgcatgtgccttcagccaggccccctgcgcccgagaggtggacgctaatcgccccagcaccgccttcctgggtcaaaatgacgttttcgactttacccagccagcaggtgtgtccgggatggcgtttccccgcccaaagcgccctgctccagcacaggaggccgctacagagggcccctccgcagcttctggagtccctcagacgggaccagggagggaggttgctgcgactcggccaaaaaccaccaagtccggcaaagcccttgccaaaacaagatgggtggagcctcaaaatgtggtggcagccgccgctgctaaggccaagatggccacgagtatcccggagccagagggggccgctgcagccaccgcgcagcattcagccgagccgtgggccaggatgggagggaagaggaccaagaagagcaagcatttggatgacgagtatgaaagtagcgaagaggagagggaaactcctgccgttcctcccacatggcgagcgagccagcccagcttaactgtccgtgcacagctggcccctagaccacctatggccccccggagccagatcccatctcggcacgttctgtgtctccctccccgaaatgtcacactgctgcaagaaagagcaaacaaattggtgaagtatctcatgattaaggattataagaagatacctataaaaagagctgacatgttgaaggatgtgatcagagaatacgacgaacactttcctgagatcatcgaaagggccacttataccctggaaaaaaaatttggcattcacttgaaggaaatagataaggaggaacatctgtatatcttggtgtgtacaagggacagttcagcaagactgctggggaaaactaaagacaccccacgcctgtccctgctgctggtgatcctgggcgtgatatttatgaacggcaatcgcgcaagcgaagccgtgctgtgggaagcgttaaggaaaatgggacttagaccaggggtgcgacacccgttcctgggcgatctgcgcaaattgatcacagacgactttgtgaaacagaagtatctggagtataaaaaaattcccaactccaaccccccagaatatgaatttttgtggggactgagagcaaggcatgagacgtccaagatgagagtgctacgtttcatcgcacagaaccagaatcgggaccctcgcgagtggaaggcccacttcctggaggcagtggatgatgcatttaagacgatggacgtggatatggctgaagagcatgcccgagcccagatgcgagcacagatgaatatcggagatgaagccctgattggtcgctggtcatgggacgacattcaagtggaactgcttacctgggacgaggacggagacttcggcgatgcttgggccaggatccctttcgcattctgggctagataccaccagtatatactgaattcaaacagagcaaatagacgcgccacatggagggctggagtgtcctccgggaccaatggtggggcttccacaagcgtgctagatggaccgtctacatcaagtactattcggacccgcaacgcggctcgggccggggcgagcttcttttcctggatacaacaccggtag

SEQ ID NO: 123916 - DNA, 2874 bp, Artificial Sequence
  Description of Artificial Sequence: Synthetic coding sequence
atgtcattagtatcacagaatagccgccgcaggcggcgaagggtggccaaggccacggcgcataactccagctggggtgagatgcaggccccaaacgcaccaggcctgccggccgacgtgccgggtagtgacgtccctcaaggcccctccgacagccagattttacagggactgtgtgcctctgaaggaccctccacctcggtcctccctactagcgctgagggcccatctacctttgtccctccgaccattagcgaggcctcttccgccagcggacagccgacaatctcagaagggcccggcacctcggtgcttcctaccccctctgagggcctgtcaacctctggaccccccactatatctaagggtctctgtacttctgtcactctcgccgcatccgagggaagaaatacgtcaaggccgcccacaagttctgaggagccttcaacatcagtacctcctaccgcaagtgaagtgccaagtactagtctgcctccaactccaggggaggggactagtacaagcgtcccccctacagcatatgagggacccagtaccagcgtggtgcctacccccgacgaggggccatccacctccgtgctgcctacaccaggcgagggtccaggcaccagtgtcccgctggccgctactgagggcctgtccaccagtgtgcaggcaacccctgacgaggggccatcaacttcagtccccccgactgccaccgagggcctcagcacacccgtgccacctactcgcgatgaaggacccagtacctcagttcccgctactcccggcgaggggccgagcacttccgtgctgcccgcagcctccgatggccagtcaatatcactcgtccctacacgcggcaagggatccagtacttctgtaccacccacagcgaccgaaggactttctaccagcgtgcagcccacagccggggaaggtagctccacaagcgtcccaccgacacctgggggaggactgtcgacctcggttccacctaccgcgaccgaagaactgtcaacttccgtccctccaacacccggagaggggccttccacttcagtgttgcctatacccggagagggtctttccacatcagtgcccccaactgcctctgatggctcagacactagcgttccgcctaccccgggggagggtgcatctaccctggttcaacccactgctcctgacggccctggaagttccgtactccccaaccccggagaggggccaagcactttgttttccagctctgcgagcgttgaccgaaacccgtctaaatgctctctggttctgccttcccccagagtcactaaagcctctgtcgattccgactcagagggtccaaaaggcgccgagggtcccatcgaatttgaagtcctgcgggattgcgagtcgccgaactctatctccattatggggcttaacacaagcagggtagcaattactttaaagccccaagaccctatggaacaaaacgttgccgaattactgcagttcttgctggtaaaggatcagagtaaataccccattagggaatctgagatgcgggagtacatcgtgaaggaatacaggaaccaattcccagaaatcttacggagagccgcagcccaccttgagtgtatcttcaggtttgagctgagggagctagaccctgaagcacacacctatatactgctgaataaactcggccccgtgcctttcgaggggctggaggagagccccaacggcccaaagatgggtttactgatgatgattctaggacagatctttttaaacggaaaccaggccaaggaggccgagatttgggaaatgctctggaggatgggagtacagcgggaacgccgactgtccatttttggcaaccctaaaagactccttagtgtggaattcgtctggcaaagatatctcgattacaggcccgtgaccgactgtaaacccgttgaatacgaattcttctggggtccccgctcacacctggagacgaccaagatgaagatcttgaagttcatggcaaagatctacaataaggaccccatggattggcctgagaaatacaatgaggcgctcgaggaagatgccgcacgcgccttcgctgaggggtggcaggccctgccacacttccggcggccatttttcgaggaagctgctgcagaagtgcctagtcctgactccgaagtgagttcttactcctccaagtatgcgcctcacagttggccagaatccaggctggagtctaaggccaggaagttagttcaactgttcctgttaatggactctactaagctgcctatacccaaaaagggtattctgtactatattgggcgagagtgctccaaagtgttccctgacctgctgaatcgtgctgcccgcacccttaaccacgtgtacggaacagagttggtagtcctcgacccccgaaaccactcctacaccttatacaatcgcagggagatggaggaaaccgaggaaattgtggacagcccaaatagacccggcaacaatttcctcatgcaggtactgagtttcattttcatcatggggaaccatgctagggaatcagccgtctgggctttccttagaggactaggcgtacaagcgggaaggaagcatgttatcacatgccgatatctctcccagcgttacatcgattccctgcgtgtaccagatagcgatcccgtccagtatgagttcgtatggggaccccgggcacgactggagacatccaaaatgaaggcccttagatatgtcgcccgcatacatagaaaagagccacaggattggccccagcaatatcgcgaggccatggaagatgaggccaaccgcgccgacgtcgggcatagacagatcttcgttcacaactttcgttag

SEQ ID NO: 123917 - DNA, 1572 bp, Artificial Sequence
  Description of Artificial Sequence: Synthetic coding sequence
atgagtctcgtcagtcagaatgcccgtcattgttccgccgaaatcactgcggactatggtgatgggcgcggagaaatccaggcaactaacgcatccgggtctccaacaagtatgttagtggtggacgcaccccaatgtccgcaggcgcccattaattcccaatgtgtcaatacctcacaagcagtccaggaccccaatgatttagaagtcctaatcgacgagcaatctcggcggctgggtgctctccgtgtgcacgaccctttagaggacagatctatcgccctggtgaatttcatgcgcatgaagtcgcagactgaaggatccatccagcagagcgagatgctggaatttctccgtgaatatagtgaccagtttcctgaaatcttaagacgtgcctccgcccacctggatcaagttttcgggcttaacctgcgcgttatcgacccccaagcagacacgtacaacttggtgagtaagagggggttccagatcacagaccgcatagccgaatccttggacatgcctaaagcaagtctcctcgccctcgtcttggggcatatcctgcttaacgggaaccgagcacgggaagcttccatttgggacctacttctaaaggtggatatgtgggataaaccccaacgcatcaataatctgtttggtaacacccgcaatcttttgaccactgacttcgtgtgcatgcggttcctggaatattggcctgtatatgggactaacccgctcgagtttgagtttctttggggctcaagggcacatcgggagatcaccaagatggaggccctgaagtttgtgagtgacgcccacgatgaggaaccttggtcttggccagaggaatacaacaaagccctggaaggcgacaagacaaaggaacgaagcttgacagcgggtctcgaattctggagcgaggatacgatgaacgacaaggctaacgatctagtgcagctggcaatctcagtcactgaagaaatgctgcctatccatcaggatgagctcttggctcatacaggaaaggaatttgaggacgtctttcctaatatcctgaaccgagctaccctgatacttgacatgttctatggcctgtcactcatagaagtggacacatctgaacacatctaccttctggttcagcagcctgaatccgaggaggagcaggtgatgctagagtcactaggccgcccgactcaggagtacgtaatgccgatcctcgggctgatctttctcatggggaatcgagttaaagaagccaatgtgtggaatctgttgcgacgattttcagtggacgtaggccgcaaacatagcattacacgaaaactgatgcgtcaacggtatctcgaatgccggccgcttagttatagcaatccagtggagtatgagctgctatggggccctcgggcacaccacgagaccatcaagatgaaagtgctcgaatacatggctcggctatatcgcaagaggcctcagaactggcctgagcagtaccgtgaggcagtggaggacgaggaggcgcgagccaagtctgaagccactataatgttcttccttgatccaacatag

SEQ ID NO: 123918 - DNA, 924 bp, Artificial Sequence
  Description of Artificial Sequence: Synthetic coding sequence
atgttgcagacaccagaatcaagagggctgcccgtgccccaggctgagggagaaaaggacgggggccatgatggggagacaagagctccaaccgcgtcacaggagcgcccaaaagaagagctcggggccggtagagaggagggagccgctgaacctgctcttaccaggaagggcgcccgtgccctggctgcaaaagctctggctaggcgcagggcctacaggcgactcaaccggacagtagccgaactggtgcagtttctgctggtgaaagacaaaaagaagtctccaatcacacggagtgaaatggtgaaatacgtgatcggggaccttaaaattctgttccctgacattattgctcgcgcagccgaacatctccgctatgtcttcggcttcgagctgaaacagttcgaccgcaagcaccacacatatattcttataaacaaacttaagcccctggaggaagaagaagaggaggaccttggtggtgacgggccaagactgggactcttgatgatgatcctgggccttatttacatgcgaggcaattccgcccgcgaggcccaagtgtgggaaatgttgagaaggttgggagtccaacccagtaagtaccatttcctttttggctacccaaagaggctgatcatggaagactttgtgcaacagcgatatctcagttatcgccgtgtgccccatactaaccctcctgagtacgaattttcctggggtccacgcagcaacctggagatcagtaaaatggaggtgctgggattcgtggctaaactgcacaaaaaggaaccccagcactggcccgtgcagtatcgggaggcactcgcagatgaggccgatcgtgcgagggccaaggctagggcggaggcaagtatgcgggcgagggccagcgctagggctggaattcacctctggtag

SEQ ID NO: 123919 - DNA, 396 bp, Artificial Sequence
  Description of Artificial Sequence: Synthetic coding sequence
atggctcggtctctggtgtgtctgggcgtgataatccttctcagcgcttttagtgggcccggcgttagaggaggacctatgccgaagctggccgatcgaaagctgtgtgccgatcaggagtgttctcatcctatctccatggctgtcgctctgcaggattacatggctcctgattgtcgcttcctcacaattcacaggggccaagttgtgtatgtattcagcaagctaaagggtaggggcagactgttctggggcggatccgtccagggcgattattacggggacctggctgcgcgcctgggatactttccaagttcaatcgttagggaggaccaaaccctgaaaccgggcaaggtggatgtgaaaacagataagtgggacttctattgtcagtag

SEQ ID NO: 123920 - DNA, 642 bp, Artificial Sequence
  Description of Artificial Sequence: Synthetic coding sequence
atggctgagacatacgactttctttttaagttccttgtgattgggagcgctggaaccgggaaatcatgcttactgcaccagttcattgaaaataaattcaaacaggacagcaatcatactattggggtggagttcgggagccgcgtcgtgaatgtgggcggcaaaacagttaagttacagatctgggatacagctggacaggaacggttcaggagtgtgacccgcagctattatagaggagccgccggcgcgcttctcgtgtatgacatcacctcacgtgagacctataactcgctagccgcttggctgacggacgccagaacactcgcctcccctaatatcgttgtcattctctgcggaaacaagaaggacttggatcctgaaagagaggtaacgttcttagaggcaagccggtttgcccaagaaaatgaactgatgttccttgaaacaagtgccctgacaggcgaaaatgtggaggaagcattcttgaaatgcgcccgaacaattctgaataagattgatagtggggaactggaccccgagagaatgggatcagggatccagtatggggacgcctcacttagacagcttcggcagcccagatctgcacaggccgtcgctcctcagccatgtgggtgctag

SEQ ID NO: 123921 - DNA, 366 bp, Artificial Sequence
  Description of Artificial Sequence: Synthetic coding sequence
atggcggagacttatgactttttgtttaagttcctcgtaattggcagcgcaggtactggcaaatcttgtctattacatcagttcatcgagaacaagttcaagcaggactccaatcatactattggcgtggagtttggctcacgagtggttaacgttggtggcaaaaccgtgaagttgcagatctgggataccgccggacaagagcggttcaggtcagtcacccggagctattaccgtggtgccgcgggagccctcttagtttatgacatcactcgagctgatgttcctggggatcaacggagtcataggagggagcgcggagggggagtgccccaagtgtgtcctcactacccacaacaggactag

SEQ ID NO: 123922 - DNA, 396 bp, Artificial Sequence
  Description of Artificial Sequence: Synthetic coding sequence
atggctcgctcattagtctgcttgggggtgataatcctgctcagtgcctttagcgggcctggcgtgaggggcgggcccatgcctaaactggcagataggaagctctgcgccgatcaagagtgttcccaccctatcagcatggcagtcgccctgcaggactacatggctccagactgccgctttctgacaattcatagaggtcaggtcgtttacgtgttttcaaagctgaaggggcgcggccgactgttctggggcggcagcgtgcaaggtgactattatggcgacctcgccgcccgtctgggctactttccatcttccatagtgcgcgaagaccagaccctaaaaccaggaaaagtagatgtcaaaactgatactagttcatccaacagctggtag

SEQ ID NO: 123923 - DNA, 2358 bp, Artificial Sequence
  Description of Artificial Sequence: Synthetic coding sequence
atggatagcgtccccgcaaccgtgccttcgatcgcagccacccctggcgatcccgagctggtcgggcctttgagtgttctctacgctgcttttatagccaagctgcttgagctggtggcaacgctgccggacgatgtccagccaggccccgatttctacgggctcccctggaagcccgtctttatcacggccttcttgggaatagccagctttgcaatctttctttggaggaccgtcttggtcgtaactgacactctagtgtccgtcaccgagcagcagatctctgaaaaattaaagacaataatgaaagagaacactgagctcgttcaaaagctttcgaactacgaacagaaaatcaaagagtctaaaaagcacgtacaggagacacgcaagcagaacatgatcctgagcgacgaagccattaagtataaagacaaaattaagacactggaaaaaaaccaggagattctcgatgataccgccaagaacttgagagttatgctggaatcagagcgtgaacagaacgtaaaaaaccaggacctgatctcagaaaataagaaatcaatcgaaaaactcaaggatgttatatccatgaacgcatctgaattcagcgaggtgcagatcgctttaaacgaagcaaagttgtcagaagaaaaggtcaaatctgaatgccaccgcgtgcaggaagagaacgctaggcttaagaaaaaaaaggaacagctccaacaggaaatcgaagactggagcaagctgcatgcggagctgtcggagcagattaagagttttgagaagagccagaaggatctcgaagttgcattgactcataaggatgataacattaacgccctgacaaactgcattactcagctgaacctcctagagtgcgaatccgagtctgaggggcaaaacaagggaggtaatgactcagatgaactcgccaacggagaagttgggggtgacagaaatgaaaagatgaaaaaccaaatcaaacaaatgatggatgtgtccagaacccaaacggctatcagcgtggtggaggaagatctcaaactgctgcagttgaagctcagggcttctgtctctaccaagtgtaacctggaagatcaggtgaaaaaactggaagatgataggaactccttgcaggccgctaaggctggactggaagacgagtgcaaaacgttaagacagaaggtggaaattctgaacgagttatatcagcaaaaggaaatggccctccagaagaaactgagccaggaggagtacgagcgccaagagagagagcatcggctatcagccgccgatgaaaaagctgtgagcgctgctgaggaggtgaaaacatataagagacggatcgaggagatggaggatgaactgcagaagaccgagagaagcttcaaaaaccaaattgcaactcacgaaaagaaagctcacgaaaattggcttaaggctcgcgcggcagaacgtgcaatcgcagaggagaaacgagaagccgcaaacctcagacacaaactgttagaacttacacagaaaatggctatgctgcaggaagaacctgtgatagtcaagcccatgcccggaaagcccaatactcagaatcccccacggcgcgggccactttcccagaatggatccttcggccccagccctgtgagtggaggcgagtgctccccaccgctcacagtggaaccccctgtcagaccactgtccgcgactctcaataggagagacatgccacgcagtgaattcggctcagttgacgggcctctgccacacccccgctggagtgcagaggcgtccggaaagccgtctcccagcgatccagggtctggcaccgccactatgatgaatagctcgagcaggggttcctctcctacccgcgtgctggatgagggtaaagtaaatatggcacctaaaggacctcctccatttcctggagttcccctgatgtccactccaatgggcggaccagtcccccctcccatcagatatggacctcccccacagctgtgcggcccttttggccctaggcctttgcctcccccttttggacctgggatgaggccgcctctcggcctgcgggagttcgcccctggggtcccgccaggtagacgagatttgccactgcatcctagaggcttcctacccggtcacgcccccttcaggccgcttgggtctctgggtccacgcgaatattttatcccaggcacacggctgcctccccccacccatggcccacaggagtacccacctccccctgccgtgcgtgaccttctaccttccggctctagggatgagccgccgcctgcaagtcagtctacttcacaggactgctcccaggcgctgaagcagtcgccttag

SEQ ID NO: 123924 - DNA, 5547 bp, Artificial Sequence
  Description of Artificial Sequence: Synthetic coding sequence
atggccgccgctcccggacttcttgtgtggctgctggtgctccggctgccttggcgggtgcccggtcagctggacccgtcaacgggaagacggttctccgaacataagctgtgcgccgatgatgagtgtagcatgctgatgtacaggggagaggcgctggaggatttcactggccctgattgccggtttgtcaacttcaaaaaaggcgacccggtttacgtttattacaagttagcccgtggatggcccgaggtctgggcgggtagcgttggacgtacttttggatacttcccaaaggatctgatccaggttgttcacgagtacaccaaggaagaattgcaagtgccgactgatgaaacagactttgtgtgttttgatggagggcgggatgatttccacaattataacgtcgaagagctcctgggctttctggagctctataattctgctgctacagattctgaaaaagctgtggagaaaactctgcaggatatggaaaaaaaccccgagctttccaaagagagggaacccgaaccagagccggtggaggcaaactccgaagagtccgactccgtgttttcggagaatacagaggaccttcaggaacagttcaccacacagaaacatcattcccacgccaatagccaggccaatcacgcccaaggtgagcaagcatcttttgagtccttcgaagagatgctccaagacaaacttaaagtgcctgaatccgagaacaacaaaacaagtaattcctcacaagtcagcaacgaacaagacaagatagatgcatataaactgttgaagaaagaaatgacgttggatctgaaaactaagttcggatctaccgctgatgccttggtatccgacgatgagacgactagactcgtgacgtccctcgaggacgattttgacgaagagttagacactgagtactatgctgtcggtaaagaggatgaggagaaccaggaagactttgacgaattgccgctgttaaccttcacagatggagaggacatgaagacaccagcgaagagtggagtggagaagtatcctactgacaaggagcagaactctaatgaggaagataaagtgcaactaaccgtgcccccagggattaaaaatgatgataagaatatccttacgacatggggtgataccatcttttccatcgtgaccggtggcgaggaaacgcgtgataccatggacctggaatcatctagctccgaggaggagaaggaggacgacgacgatgcgctcgtaccggattccaaacaggggaaaccccagagtgccacagattatagcgatcccgataacgtcgatgatggcttgtttatcgtcgacatcccgaagactaacaacgacaaggaggtgaatgccgaacaccacattaagggaaagggcaggggcgtgcaggaaagcaagcgagggttggtccaggataaaactgagcttgaggatgaaaatcaggaaggaatgacagtgcacagtagtgtgcactcaaacaacctcaacagcatgcccgccgctgaaaaggggaaagacacgctcaagagtgcgtatgatgatacagagaacgacttgaaaggggctgcaatccatatttctaaggggatgctccacgaggagaaaccaggcgagcagatacttgaaggggggtccgagagtgaaagcgcacagaaagcagcggggaaccaaatgaatgatagaaagatccagcaggagtctctggggagtgctcccctgatgggagatgatcatcctaacgcctctagggacagcgttgaaggtgatgccctggtgaatggcgctaagctgcacactctgtctgtggaacatcagcgggaggagctgaaagaggagctggtgctcaaaacccagaatcagcctaggttctcatcccctgacgagatagaccttccgcgcgaattagaggatgaggttcccatcctcgggaggaacctgccatggcaacaggaacgggatgtggccgctacagccagtaaacagatgtccgagaagatccggctgagtgaaggagaggcaaaggaagattccctcgatgaggagtttttccatcacaaggcaatgcaaggcaccgaggtggggcagacagaccagaccgattcaacgggaggaccagcctttttgtctaaggttgaagaagatgactacccctccgaagaactcctggaggatgaaaatgcaatcaacgcgaagcgaagcaaggagaaaaaccctggtaatcagggtaggcagttcgatgtgaatcttcaggtgccagatagggccgtgcttggtacaattcacccagatccagagattgaggagtccaaacaggaaacctcgatgatcttggactccgagaagaccagcgagacggccgccaagggcgttaatacgggtggcagagaacctaatacaatggtagaaaaggagaggcctctcgcagacaaaaaggcccagaggccattcgaacggtcagacttttccgattccattaagattcagacacctgagctgggcgaagtgtttcagaataaagactcggactaccttaaaaacgacaatcccgaagagcacctcaaaacatcaggcctggccggcgaaccagagggggagttatcaaaagaagaccacgagaatacggagaagtatatgggaacagaatctcaaggcagcgccgccgccgagccagaggatgactcttttcactggacccctcacacgtcggtggaacctgggcatagtgacaagcgcgaggacctgcttattatttccagtttttttaaggaacaacagtccctacagagatttcagaagtactttaatgttcatgagctggaagctctgctccaggagatgagctccaaattaaaatccgcccagcaggagtcactaccatataatatggaaaaagtgctcgacaaagtttttagggcctctgagagtcaaatcctgtctattgctgagaagatgctagatactagagttgcggagaaccgcgacttgggaatgaatgaaaataatatttttgaagaagccgctgtgctggacgacattcaggatcttatctactttgtgaggtacaaacattccactgccgaggagactgctacattagtgatggccccccccctggaagagggtctgggaggcgccatggaagagatgcaaccattacatgaggacaatttctcaagggagaaaacagcagaactcaacgtccaagttcctgaggaacccacgcacctcgaccagcgcgtcataggcgacactcacgcttccgaggtttcgcagaaaccaaatactgagaaagatctcgatccaggccccgtcactaccgaagacacgcccatggatgctattgatgccaataagcagccagagactgccgccgaggaacctgcttcggttacccctctcgagaacgcaatcttgctgatctacagcttcatgttttatctgaccaagtctttagttgctaccttgcctgacgatgtgcagccgggccctgacttctatggccttccctggaaacctgtattcataacagcattcctcggaattgcttctttcgccatctttttatggaggaccgtgcttgtcgtctctaatactgtgtattacgtgaccgagcagcaaatttccgaaaagctcaagacaatcatgaaagagaacactgagctggttcaaaagctgagcaactatgagcagaagattaaggagagcaagaagcatgtgcaagaaacaaggaaacaaaatatgatacttagcgatgaggcaattaagtacaaagacaaaataaagacgctggagaagaatcaggaaatcctggatgacaccgctaagaatcttcgggttatgctcgagagtgaaagggagcagaacgtgaaaaaccaggacctgctccagcaagagattgaagattggtcaaaattacacgctgaactgtcagagcagatcaaatcctttgaaaaaagtcagaaggatttagaggtggccctcactcacaaggatgataacataaatgccctgacaaattgtataacccagctcaatctactggaatgcgaaagcgaatcagaggggcagaataaagggggaaacgacagcgatgagctggcgaacggggaggtagggggcgatcggaacgagaaaatgaagaatcagatcaagcagatgatggacgtttctcggacacagactgctatatcagtagtcgaggaagacttaaagctgctccagttgaagttacgggcaagcgtgagtacaaagtgtaatcttgaagatcaggtaaaaaaactcgaagacgacagaaactccctgcaggcggctaaggctggactagaggacgaatgtaaaacgcttagacagaaggtggagatattgaatgagttgtatcagcagaaagagatggccttacaaaagaagctgtctcaggaagaatatgagagacaggaacgggagcatcggctgagcgctgctgacgagaaagcagtttcagccgctgaggaagtgaaaacttataaaagaaggatcgaagagatggaagatgagctgcagaagaccgagcgatcgtttaagaatcagatcgccactcacgagaaaaaagctcacgaaaactggctgaaggcccgggccgccgaaagggcaatagccgaggaaaagagagaggccgccaatctgcggcacaagctacttgagttgacccagaagatggctatgctccaggaagagcctgtgatcgttaagcctatgcctggaaagcccaacacacagaatccaccccgtcgggggcccctttcgcagaatggcagcttcgggccatccccagtcagtggcggcgagtgcagcccacccttaaccgtcgagccccccgtgcggcccctgagtgctacactgaaccgtcgggatatgcccagaagcgagttcggtagtgtcgatgggcctctccctcatcccagatggagtgcggaggccagtgggaagccaagccctagcgaccctggatccgggactgccaccatgatgaattcatcttctcgcggtagttctcctactagggtactggatgagggcaaggtcaatatggcgccaaaaggccctcctccgtttcctggcgtacccctgatgtcgacccccatgggcggaccagtgccccctcccatcaggtacggaccccccccacagctgtgcgggccttttggaccaagacccctgcctcctcctttcggcccaggtatgagaccacctcttgggctcagggagtttgcccccggtgtgccgcctgggcgtagggaccttcccctgcacccacgcgggttcttgcctgggcacgctccattcaggccactgggcagcctgggtccgagggaatatttcattcctggcacacgtttgcctccacccacgcacggacctcaggagtaccctcccccacccgccgtccgcgaccttctgccttcgggtagccgggatgaacccccacccgcttcgcagtctacctctcaagattgttcccaggcattgaaacagtccccttag

SEQ ID NO: 123925 - DNA, 2358 bp, Artificial Sequence
  Description of Artificial Sequence: Synthetic coding sequence
atggacagcgtacccgctacagttcccagcatcgctgctactccgggtgaccctgagctcgttggacccttatcggttctgtacgctgcatttattgcaaagctgctcgagctggtcgccaccctgcccgatgatgttcaaccaggccctgatttctacgggctgccttggaaacccgtcttcatcactgcttttcttggcatagcctctttcgccatctttctgtggcggacagtgctggtggttaaggatcgcgtctaccaggttacggaacagcagatcagcgaaaagcttaaaaccattatgaaggagaatacggagctggtccagaagctgtccaactatgaacagaagattaaggaaagcaaaaaacacgtccaggagacaagaaagcagaacatgatcctcagcgacgaagccatcaagtacaaagacaaaataaagacgttagaaaaaaaccaggaaatattagatgacactgcaaagaacctgagagttatgctagaatctgagcgcgaacaaaacgtgaaaaaccaggatctgatatctgaaaacaagaagagcatcgagaagttgaaggacgtcatctctatgaacgcctctgagttcagcgaagtccaaattgctctgaatgaggctaagcttagcgaggaaaaggtgaaatccgaatgccaccgcgtgcaggaagagaacgcacgtcttaagaaaaaaaaagaacaattgcagcaggagatcgaagattggagcaagctgcatgccgagctgagcgagcagatcaagtcattcgagaagagccaaaaggatttggaggttgctcttacccataaagatgacaacattaacgcactgacgaattgcataacgcagcttaaccttcttgagtgtgagtcagagagtgaaggccagaataaaggcggtaacgactctgatgagctagccaatggtgaggtgggaggcgatcggaacgagaagatgaagaaccagattaagcagatgatggatgtgagtcgtacccagaccgctatttccgtggtggaagaggacctgaagctcctgcaactcaaacttcgcgcgtctgtgtcaacaaagtgcaatctggaagaccaggttaaaaagttagaggatgaccggaattccctgcaggctgccaaggctggattagaagatgagtgtaagaccctcagacaaaaggtcgaaattctcaatgagctgtatcagcaaaaggaaatggcgctgcagaagaagctctctcaggaggagtatgagaggcaggaacgggagcatcgcctgagtgcggccgacgaaaaggctgtcagcgctgcggaagaggttaaaacatataaacgtaggatagaagaaatggaagacgagctgcagaaaacggagcggagctttaagaatcaaatcgccacccatgagaagaaggcccatgaaaattggttgaaggcccgggcggccgaacgggccatcgcagaggaaaagagggaggctgccaacctgcggcataagttgttggagctgacccagaaaatggccatgttacaggaggagccagtaattgtgaaacctatgccagggaagcccaatacgcaaaacccccctagacgggggcctctgtctcagaatggttccttcgggccatcccctgtctcgggcggcgagtgcagtcctccacttacagtggagccacctgtcagaccccttagcgccactttaaacaggcgggacatgccaagatccgaatttggcagtgtagacggcccgctgcctcatcctagatggagtgccgaggcgagcggaaagccatctccctcagacccggggtccgggactgccacaatgatgaactcttcctcccggggaagctcgcccactcgagtgctggacgaggggaaagtcaatatggctcctaaagggcctccaccattccccggagttcctttgatgagcactcctatgggtggccccgtgccacctcctataaggtacggaccccctccacaactgtgtggtccttttggacctcgtcccctgcctcccccatttggccctggtatgagacctcctttaggactaagggagttcgcccccggtgtgccacccggaagacgagacttaccccttcacccacgcgggttcctgccaggccacgcaccattcagaccactgggttcccttggacctcgtgaatactttattcctggtaccaggctaccacctcccacacatggaccacaggagtaccctcctccgcccgccgtaagggatctgctcccctccggaagccgagatgagccccctcccgcctcgcagtctaccagccaggattgcagtcaggccttaaagcagtccccttag

SEQ ID NO: 123926 - DNA, 5724 bp, Artificial Sequence
  Description of Artificial Sequence: Synthetic coding sequence
atggcggctgccccagggctcctggtgtggcttctcgttctgaggctcccttggagagttccggggcagttggacccctctaccggaaggagattttcagaacacaagttatgcgctgacgacgaatgcagcatgctgatgtataggggagaagcactcgaggacttcaccggccccgactgtaggttcgtaaactttaaaaagggtgaccctgtgtacgtctattacaaacttgccaggggctggcctgaggtctgggccggaagcgtggggcggacctttggctacttcccgaaagatctcatccaagtggtgcatgagtacacaaaggaagaacttcaggtaccaaccgatgaaacggattttgtatgcttcgacggtggtcgggatgacttccataattataatgtagaggaactgctgggttttcttgagctgtacaattcggccgccaccgactcagagaaagccgttgagaaaactctgcaggacatggaaaaaaatccagagctgagtaaagaacgggaacccgagccagagccagtagaagccaattcagaagagtccgatagtgtgttcagcgagaataccgaggatctgcaggaacagtttaccacccagaagcatcattcccatgcgaactcacaagctaatcatgcccagggcgagcaggcaagttttgagtcgtttgaggaaatgctacaggacaagcttaaggtccctgagagcgaaaacaataagacatcaaactcctctcaagtgtccaacgagcaggacaaaatagacgcatataagttacttaaaaaagagatgactttggacttgaaaacaaagtttggttccacggctgatgccctagtctccgatgacgagaccaccagactagtgacttccttggaggatgatttcgacgaagagctggacaccgaatactacgcagtgggcaaagaagacgaagagaatcaagaggacttcgatgaattgcctttactgacattcaccgatggcgaggatatgaagactccggcgaaaagtggcgtggagaagtatcctaccgataaagagcagaactccaacgaggaggacaaagtgcagctcacagtcccccctggcataaagaatgatgacaagaacatactcaccacatggggtgataccatcttttcaatcgtcacaggtggggaggagactagagacaccatggacctggagtcttcatcttctgaagaggaaaaggaggatgacgatgatgcacttgtccccgacagtaaacagggtaaaccccagagtgctacagactacagcgacccagataacgtcgatgacggcttgtttattgtcgacatacccaaaacaaataacgacaaagaggtaaacgcggagcaccatatcaagggcaaagggcgaggggtgcaggagagcaagaggggcctagtgcaagataagacggaattggaggatgagaatcaagaaggtatgacggttcactcaagcgtccatagtaataatctcaactcaatgcccgcggccgaaaagggcaaagacactctgaagtctgcctacgatgatactgagaacgacctcaaaggggcggcaatccatattagtaagggtatgcttcacgaggagaagcccggcgagcaaatccttgaaggaggatctgaatccgagtccgcccagaaggctgcaggaaaccagatgaatgataggaagattcaacaggaatctctgggttccgcaccacttatgggagatgaccacccaaatgcatccagagacagcgtggagggcgacgccctcgttaatggagcgaaactgcacacactgtctgtggagcatcagcgtgaggagttgaaagaggaattagtgctgaaaacccaaaatcagcctcggttttcatctcctgatgagatcgaccttccgagagaactggaagatgaggtgcctatacttggccgcaatctcccttggcagcaggaaagagacgtggccgcaacagcaagtaagcaaatgagcgagaagatccgcttgtccgaaggcgaagcaaaggaggactccttggacgaagagtttttccaccacaaagccatgcagggaaccgaggtggggcaaacggaccaaacagatagtacaggaggacccgcctttctcagcaaggtggaggaagacgattatccctcagaggaactcctggaggatgagaacgcaataaatgctaaacggagcaaggaaaaaaaccctggtaaccaggggagacagttcgatgtgaatttacaggttcccgacagggctgtgctgggaaccatacatccagaccctgaaatagaggagtctaaacaagaaacctctatgatattagactctgagaaaacatccgaaaccgccgcaaagggtgtgaataccggtggccgtgagcctaatacaatggtggagaaagagcgcccgttagccgataaaaaagcccaaaggcctttcgaacgatcagacttctcagactcaattaagatccagacacctgaactgggtgaggtctttcagaacaaggactcggactacctcaaaaacgacaatcctgaggagcacctgaaaacttcaggtttagccggggaacccgaaggggaactgagcaaggaggaccacgaaaacacggaaaagtacatgggaaccgagtctcaggggagcgctgctgccgagcccgaagacgattcatttcactggactccgcatactagcgtagaacctgggcactccgataagcgagaggacctcctgattatctcgtccttttttaaggagcagcagtctctacagagattccagaaatactttaacgtgcatgaattggaagcactgcttcaggagatgtcaagtaaattaaagagtgcccaacaagaatccctgccttacaatatggagaaagtgctggataaagtgttcagagcatcagagagccagatcttatccattgccgaaaagatgttggacacccgagttgccgagaatcgagatctcggtatgaatgaaaataatatcttcgaagaggcggccgtcctcgatgatatccaagatttgatatattttgtgagatataaacattctacagcagaggagactgccaccctggttatggcaccgccactagaagaaggactgggaggcgcaatggaggagatgcaacctctgcacgaggataatttttcgagggagaagacagccgagctcaacgtgcaggtccccgaggaaccaactcatttggaccagagggtaattggtgatacccacgcttcagaggtgtcccagaagcctaacacagagaaagatctggatcctggacctgtgaccacagaggatactcctatggacgctatcgacgccaataaacagcctgagacagccgcagaggaaccagccagcgtcaccccactggaaaacgcgattctgctgatatattctttcatgttctatctaactaagtcactggttgcaacactccccgacgacgtccaaccaggacctgacttctacggcctgccttggaagcctgtattcattacagctttcttaggcattgctagcttcgctattttcctatggcgcacagtgctcgtggtgagtaacaccgtgtattacgtgaccgaacagcaaattagcgaaaagctcaaaactatcatgaaagagaacactgaactcgtgcagaagctgtctaactacgagcagaaaataaaggaatccaaaaaacacgttcaagagacccgaaaacaaaatatgattctgtcggacgaggccatcaagtataaggataagattaagaccctggaaaaaaaccaagaaattctggatgacactgccaagaacctgcgcgtgatgttagagtctgaacgagagcagaatgttaagaatcaggacctgatatctgagaataagaaaagtattgagaaactgaaagacgttattagtatgaatgccagtgaatttagtgaggtgcagattgccctgaacgaagcgaaactctccgaggagaaggtgaagtctgaatgccatcgcgtgcaagaagaaaacgcacggctgaaaaaaaaaaaggaacagctccagcaggagattgaggactggtctaagctccatgcagagctgtccgagcagattaagtcattcgaaaagtctcagaaggatctcgaggtggcgctcacccacaaggacgataatattaacgcgcttaccaactgtatcacacagttaaacctgttggaatgtgagtcagagtcagaaggtcagaacaagggcggtaatgactcagatgagttggcgaatggggaggtcggtggagaccggaacgagaaaatgaaaaaccagatcaaacagatgatggacgtctcgaggactcagaccgccataagcgtcgtagaagaagacttgaaactgctccaacttaagctccgggctagcgtttctaccaagtgcaatctggaagatcaggttaaaaaactggaggacgatagaaacagcctgcaagctgccaaagccggcctggaagatgaatgcaaaactcttaggcagaaagtggagatcctgaacgaactttaccagcagaaggaaatggctctgcagaagaagttgagtcaggaggagtacgagagacaggagagggagcacaggctcagcgcagctgacgagaaggccgtgagtgccgctgaagaggtgaagacgtacaagaggaggattgaagagatggaggacgagctccagaagactgagcgctctttcaagaaccagatcgccacccacgagaagaaggcgcacgaaaactggctgaaagctcgagcagccgagagggcaattgcggaggaaaagagggaggcggccaacctcagacacaaactgctggagctaactcagaaaatggccatgctgcaagaagaacctgtgatcgttaaacccatgccaggcaaaccaaacacccaaaatccccctagacgggggccactctcacagaatggatcgtttgggccctctcccgtgtcaggcggggagtgcagcccccccctgactgtggagcccccggtgcggccactgagtgctacactgaatcgacgggacatgcctaggtccgaattcggcagtgtagatggtcctttgccccaccctcgctggtctgccgaagcaagtggcaagccgagtccatctgatccagggagcggcacagccacaatgatgaattcctcatccagaggaagctcacctacccgggtactagacgaagggaaggtcaacatggccccaaagggcccccctccctttccgggtgttcccctgatgtcaacacccatggggggacccgtgcccccccctattaggtatggccctcccccgcagttgtgtggcccattcggtccacgtcctttgccccccccctttggtcccggcatgcgccccccactgggcctgagagaattcgcacccggcgtgccccctgggagacgcgacctgccattgcatcctcgggggttcctccccgggcatgccccattccggcccctcggatcactgggccctcgggagtattttattcctggcaccaggctaccaccccctacccatggccctcaggagtatccacctccccctgccgtccgggacctgctccctagtgggtcacgcgatgaacctccaccagcctcgcagtctacttctcaggattgcagccaggccttgaagcaatccccatag

SEQ ID NO: 123927 - DNA, 1503 bp, Artificial Sequence
  Description of Artificial Sequence: Synthetic coding sequence
atggccgcggccccgggtctgttggtttggctgctcgtgttgaggctgccctggagagtcccaggccaactcgatccaagtactggaaggcgcttctccgagcacaaactgtgcgccgacgacgaatgttctatgctcatgtaccgcggcgaagcactggaagacttcactggtcctgattgccgattcgtcaatttcaaaaaaggagaccccgtgtacgtgtattacaaactcgctcgaggttggccagaggtatgggccgggagcgttgggagaaccttcgggtattttccgaaggatctgatccaggtggtacacgaatacacaaaggaagagttacaggtcccaacagacgagactgactttgtttgttttgacggcgggagagacgactttcataattataacgttgaagaactgctgggctttctcgagctctacaattcagctgcaactgattccgaaaaggccgtggagaaaactctacaagacatggagaagaatcctgagctcagtaaggagcgggaacccgaacctgaacctgtcgaggcaaactctgaagaatcagatagcgtgttttccgaaaacaccgaggacctccaggagcaattcactacacaaaagcaccacagtcatgctaatagtcaggctaatcatgcgcaaggcgaacaagcttcctttgagagttttgaagagatgttacaagataagctgaaagttcctgaatccgagaacaacaagacatccaactcatctcaagtctcaaatgagcaagataagattgacgcctataagttgttaaaaaaagagatgactttggacctgaaaactaagttcggttcaactgcggatgccctggtgagcgacgatgaaacaactcgacttgtcacaagcctcgaggatgattttgatgaagaactcgatactgagtattacgcagtcggcaaagaggacgaagaaaaccaagaagactttgatgaactacccctactgacgttcacagatggcgaggacatgaaaacgccagcaaagtcaggcgtggagaagtaccctaccgataaggagcagaactccaacgaggaggacaaggtgcagctcactgtccctcccgggattaagaatgacgacaagaacatcctcacaacatggggagataccatattttccatcgtgacgggcggagaagagacgcgcgacactatggatttggagtcatcgtctagtgaagaggagaaggaggatgacgatgatgctctggtacctgattctaagcaggggaagcctcaatcagctactgactactctgaccctgataacgttgatgacggtctatttatcgtcgatattccaaagacaaacaatgacaaggaggtcaatgctgaacaccacattaaaggtaagggacgcggtgtacaggaatccaaacgcggcctggtgcaagataagactgaattggaggacgaaaatcaagagggtttcaaaaccgaacctatcaagttgtag

SEQ ID NO: 123928 - DNA, 5724 bp, Artificial Sequence
  Description of Artificial Sequence: Synthetic coding sequence
atggcagcggccccaggccttctggtgtggttacttgtactgcgcctcccatggcgagtgcctgggcagctggacccttctaccgggcgaaggttctccgagcataagctctgtgctgacgatgagtgcagtatgctgatgtatcgaggggaagctctcgaagattttaccggacccgactgtcgcttcgtgaactttaagaagggtgatcctgtctatgtgtactacaagttggcacggggctggcctgaagtctgggcgggtagcgtgggaagaacgttcggctattttcctaaggacctgatccaggtcgttcatgagtatactaaagaggagctgcaagtgcctaccgacgagacggactttgtttgcttcgacggaggccgggacgatttccacaactacaacgtcgaggagctactggggttcctggagctgtacaatagcgccgctacggatagcgagaaggccgtcgaaaagacactgcaggacatggagaaaaatccggaactgtctaaggaacgcgagcccgaaccggagcctgtggaggctaacagcgaggagtcagactctgtcttctccgaaaataccgaggatctgcaggagcagtttacaacacagaaacatcacagtcatgcaaacagccaggcaaaccacgcccagggcgagcaggcaagttttgagagcttcgaggagatgttgcaggacaaactaaaggtgccagagtccgaaaacaataaaacctctaattccagccaggtaagcaacgagcaagataagattgacgcatacaaactgctgaagaaagaaatgacacttgacctgaagacaaaatttggcagcactgccgatgccttggtgtctgatgacgaaactacccgactcgtgacatcactggaagatgacttcgacgaggagctagacacagagtactacgccgtgggtaaagaggacgaggagaaccaggaggactttgacgagctacctctactaacatttacggatggcgaggacatgaaaacacctgccaagtccggtgtcgaaaagtatcctacggataaagagcagaacagcaacgaggaggataaggtgcaactcaccgttccacctgggattaagaacgatgataagaatattctgaccacatggggtgataccatcttctctattgtcaccgggggagaggagacaagagataccatggacctcgaaagttcttctagcgaggaggaaaaagaagatgacgatgatgctctggtacctgactccaagcaagggaaacctcagtctgcaacagactacagcgaccctgacaacgtggatgacggattgtttatcgtcgatatcccaaagacaaacaacgacaaggaggttaacgccgaacatcacataaaaggaaaaggcaggggcgttcaagagtctaagcgaggcttggtgcaagacaagaccgagctagaggacgaaaatcaggaagggatgactgtgcactcatcagtacactccaataaccttaacagtatgcccgcagcggaaaagggtaaggacacactaaagtcagcatacgatgatactgagaacgacctgaagggggctgctatccacatctctaagggcatgctacacgaagagaaaccaggcgagcagatcctcgaaggaggatcggagagcgagagtgctcaaaaggcagcggggaaccagatgaacgacaggaagatacagcaggaatctctgggctcagcacctctaatgggggatgaccacccaaacgccagtcgagactccgttgagggtgacgctcttgttaatggcgctaaattgcacactctaagcgtcgagcaccagcgcgaagagttaaaggaggaactggtactgaagactcagaatcaaccaagattttcttctccagatgaaattgatttgcccagagaacttgaggacgaagtgccgatactcggtaggaatctgccctggcagcaggagcgggacgtggccgcaaccgcaagtaagcagatgagcgagaagatccgcttgtctgagggagaagcaaaagaggattcgttggacgaagaattttttcatcacaaggccatgcaaggcaccgaggtcgggcagacggaccagactgattctactggaggacctgctttcctgtcgaaagttgaggaggacgactaccccagtgaagaactgttagaggacgaaaatgctattaatgcgaaaagatccaaagagaaaaaccctgggaatcagggcaggcagttcgacgtgaatctgcaggtcccagacagagctgtgctgggcaccattcatccagaccccgaaattgaggagtcaaaacaggagacgtccatgatccttgacagtgagaagaccagtgagaccgcagcaaagggcgtaaatactggtggaagggagccaaacacgatggttgagaaggagcgcccacttgctgacaaaaaggcccagagacctttcgagcggtcagacttcagcgactctatcaaaatacagacccccgagctgggcgaggtgttccagaataaggactccgactacctgaagaacgataatccagaggaacacctgaagacctctgggctggccggagagcccgagggagagttgagtaaggaggaccacgaaaatacagagaaatacatgggcacagaaagccagggatctgctgccgccgaacctgaagacgatagtttccactggacccctcacaccagcgtcgaaccagggcactcagataaacgggaggacctcctgattatatctagtttctttaaagaacaacaatcattgcaacgcttccagaagtactttaacgtgcatgaactggaggccttgctacaagaaatgtcgtctaagctgaaaagcgcccagcaggaatccttaccatacaatatggagaaggttcttgacaaagtctttcgcgcttccgaaagccagatcctgtctattgcggaaaaaatgctggacactagggtggccgaaaaccgagacctgggcatgaatgagaacaacatttttgaagaggctgccgtcctggacgatatccaggacctgatttacttcgtgcggtacaagcacagtaccgcagaggaaactgctacacttgtaatggctcctccattagaggaagggctcggcggagccatggaagaaatgcagccgctgcacgaagacaatttttctagggagaagactgctgagctcaatgtccaggtgcccgaagagcctacccatctggatcaacgagtgataggcgatacacatgccagcgaggtgagccagaagcccaacacagaaaaggacctcgacccagggccagtaacaactgaggatacacctatggacgccatcgatgcaaataagcagcctgagacagccgctgaggagcccgcctcagtgacgccactggaaaatgccatcctgttaatctattcattcatgttctacctgaccaagtccctcgtggctactctccccgacgacgtgcagcccggcccggacttctatggcctaccctggaagcccgtgtttattacagcctttcttgggatcgccagttttgccatcttcctttggcggacagttctggtcgttaaggaccgagtgtaccaagtaacagaacagcagatttccgaaaagctgaaaaccatcatgaaggaaaatacagagttagtgcagaagctctctaactacgagcagaagattaaggaaagtaagaaacatgtccaagaaacgagaaagcagaacatgattttatctgacgaagcaatcaagtacaaggacaaaatcaagacattagagaagaatcaagagatattggatgacactgctaaaaacttgcgtgttatgctcgaatctgagagggaacaaaacgtaaaaaatcaagatctgataagcgaaaacaagaaaagcatcgagaaattgaaagacgtgatctctatgaacgccagcgaattctcagaagtgcagatcgcactcaatgaagccaagctgagtgaggaaaaggtgaagtccgagtgtcatcgggtgcaagaggagaacgctcggctgaaaaaaaagaaagaacagcttcagcaggagatcgaagactggtctaagctgcatgccgagctctctgagcagataaagagttttgagaagagtcagaaagatctggaggtggcgcttacgcacaaggacgacaacattaacgccttgacaaactgtataacccagttaaacctgctggagtgcgagtcagaatccgagggccagaacaaaggaggaaatgacagcgatgaattggccaatggggaggtgggtggcgatcgcaacgaaaagatgaagaaccagattaaacagatgatggatgtatccaggacccagactgccatctcggtggtcgaagaagatctcaagctcctccagttgaagctcagagcctccgtgtcaactaagtgtaaccttgaggaccaggttaaaaaactggaagacgacagaaattctctgcaggccgctaaggctgggctcgaagacgaatgcaagactttgcgacagaaggtcgagattctcaacgagctttaccagcagaaggaaatggctcttcaaaaaaagctgtctcaagaagagtacgaacgccaggagcgagagcaccgcctgagcgcagctgatgagaaagccgtgtccgcagccgaagaagtgaaaacatataagcgacgaatcgaggagatggaggatgaactccagaaaacagagcgctcgtttaagaatcagattgccacccatgaaaagaaagcgcatgaaaattggctgaaggctcgcgccgctgaaagggcgattgccgaagagaagcgtgaagctgccaacctccggcataaactcctcgagctgacgcagaaaatggccatgctgcaagaagaacccgtcatcgttaagcccatgcccggaaagcccaacactcaaaaccctccgaggaggggtccactttcacagaacggcagttttggccctagtccagttagtggcggggagtgttctccgcctctcacagttgaaccacccgtgagaccgctgtctgccaccctgaaccgtcgggacatgccacgctcagagttcggtagtgtggacggtcctctgccacaccctaggtggtcagccgaagcctccgggaagccctcccctagtgatcccgggtctggtactgctactatgatgaatagttcgtccaggggcagtagccccacccgtgttttagatgaaggcaaggtgaacatggcgcctaaagggccaccccccttccctggggttccactgatgagcactcctatgggcggcccagtaccccctccgattaggtacggccctccaccgcagttatgcggcccattcggacctagaccactgcctcctcctttcggtccgggcatgcgtccacctctcggtctccgcgaattcgctccaggagtgccccccggaagaagggacctgcctcttcatccgagggggttcttacccggacatgctccgttccggcccctaggctcactgggaccacgggagtactttattcccggaactagacttccacctcccacccatgggcctcaagagtaccccccgccaccagctgtcagggacctgttaccaagcggatccagggatgaaccccctcctgcatctcagtctacaagccaggactgtagccaggccttgaagcaaagtccttag

SEQ ID NO: 123929 - DNA, 3051 bp, Artificial Sequence
  Description of Artificial Sequence: Synthetic coding sequence
tagcttgtcccagatagcaagcagggtaagccgcagagcgcaacagactacagtgaccccgacaacgtggatgacggtctcttcattgtagacatcccgaagaccaacaatgacaaggaagtgaatgcagaacatcatattaaagggaagggtaggggagtccaggagtctaagaggggccttgttcaggacaaaaccgagctcgaggatgaaaatcaggagggtatgacagtgcatagctccgtacacagtaataacctgaacagcatgccggctgcggagaagggaaaggacacattgaaatccgcatatgatgatactgaaaatgatctcaaaggggcagccatccacattagtaagggaatgttgcatgaggagaaaccaggtgagcagatcctcgaaggaggatctgagtccgaatcggcacagaaggcggcgggcaatcagatgaatgacagaaaaatccaacaggagtccttggggagcgcccctctgatgggtgacgaccaccctaatgctagccgagactctgtggagggcgacgcactggtcaatggcgcaaaactgcataccctgtcggtagaacaccaacgagaggagttgaaagaggaactagtgctgaagacacagaatcagccccgcttctcaagtcccgacgagattgatctgcctagagaacttgaggacgaggttcccatactagggaggaaccttccgtggcagcaggagcgagatgtggctgcaacggcctccaagcagatgtctgaaaagatacgcctgtccgagggcgaagctaaagaggattcacttgacgaggaattttttcaccataaggccatgcagggaaccgaggttggtcagaccgatcagactgacagcactggggggccagcctttttgtctaaggtggaagaggatgactaccctagtgaggaactgctcgaggacgaaaacgctattaacgctaagaggagcaaagaaaagaaccccgggaaccaggggcgacagtttgacgttaatttacaggttcccgatcgcgctgttctggggaccatccatcccgatcccgagattgaagagtctaagcaggaaacctccatgatcctagacagcgagaaaactagtgagacagcggccaagggcgtcaacacaggcggccgtgaaccaaataccatggtcgaaaaagagagaccgttggcagacaagaaggcccaaaggcctttcgagcgctcggacttcagtgacagtattaaaatccagacaccggagttgggggaggtctttcagaataaagactcggactatctcaaaaacgacaaccccgaagagcatctgaagacgagtgggctagcgggcgagcctgaaggtgaactaagtaaagaggaccatgagaacactgaaaagtatatggggactgaatcccagggctccgctgccgccgaaccggaggatgatagtttccactggacaccacatacgagtgtcgagccaggacatagtgataagcgagaagacttactgataatttcatccttctttaaagaacagcagtccctccagcgtttccaaaaatactttaatgtccacgagctggaggccctgctccaagagatgtcttcaaaactgaaatctgcacaacaggaatcgttaccatataacatggagaaggtccttgacaaggtcttccgtgccagcgagtctcaaatccttagcatagcggaaaaaatgctcgacacaagggtggctgagaatagagacctgggcatgaacgaaaacaatatcttcgaagaagcagccgtcttggatgatatccaagatctgatctattttgttagatacaagcactcaacagccgaggagaccgccaccctggtcatggccccaccactggaggaagggctaggcggtgctatggaagagatgcagccgctccacgaggacaattttagccgggaaaagactgccgagcttaacgtccaagtgcccgaggagcctacccatctggaccagagggttatcggagacacacatgcttctgaggtttcacagaagccaaatacagaaaaggatctggatcccggccctgtaaccactgaagacacaccgatggacgctatagatgcaaacaagcagccagagaccgccgccgaagagccggcatctgtgacccctttggaaaatgctatcctcttgatttactcctttatgttctacctaacaaagtcactggtggccacgctcccagatgatgttcaacctggtcctgatttctatgggctaccgtggaaacctgtgtttataacagcctttctgggtatcgcctcttttgccatctttctctggcgtaccgtattagtggtcaaggacagggtgtaccaggtcacggagcagcagatcagtgagaagttgaaaaccattatgaaggaaaacactgagctggtccaaaagctgagcaactatgagcagaagatcaaggagtctaaaaaacatgtacaggaaacgcgaaagcaaaatatgatactcagcgatgaggccatcaaatataaagacaagatcaagactctggagaaaaatcaggaaatccttgatgacactgcaaagaacctgagggtgatgctggaaagtgaacgagaacagaacgttaaaaaccaggacttgttgcagcaggagatagaagattggtccaaattgcatgccgaacttagcgagcaaatcaagagctttgaaaagtcacagaaggacctggaagtggcactcacacacaaggatgataacatcaatgcactgactaattgtattacgcaactcaatttgctagaatgcgaatccgaaagcgaagggcagaacaaaggggggaacgattctgacgaattagcgaatggagaggtcggcggcgacagaaatgagaagatgaagaatcagattaagcagatgatggatgtctccaggacacagaccgcaatttcagtggtcgaggaggatctaaaactgctccagttaaaacttagagcttcagtctctacaaagtgtaatctggaagatcaggtttag

SEQ ID NO: 123930 - DNA, 324 bp, Artificial Sequence
  Description of Artificial Sequence: Synthetic coding sequence
tgaagcgccgaggcctctggcaagccttccccttctgaccctggatctggaaccgccacgatgatgaattcctcctctcgcggtagttctccaactagggtccttgatgaaggcaaagttaatatggcccccaaaggccccccaccctttccgggggtacctctaatgagcacacccatggggggacccgtgcccccacccatccggtatggtcctcccccccagctctgtggaccatttgggccaagaccactgccaccaccatttgataaagatgggcgccccggtacagtcgcgcatgcgtgtaacccatccactttgtag

SEQ ID NO: 123931 - DNA, 1803 bp, Artificial Sequence
  Description of Artificial Sequence: Synthetic coding sequence
atgggtaagaaactggacctgtctaagctcaccgatgaggaggcccagcacgtgctggaggtggtgcagagggattttgatctacgcaggaaagaggaagaaagactagaagcacttaagggcaaaattaaaaaggagtcgagcaaacgcgaactactctctgacaccgctcatcttaatgagacgcactgcgcccgctgcttgcagccctatcagctgttagtcaactctaaacgccaatgcttggagtgtggtctgttcacctgcaagagctgcggacgggtgcaccccgaggaacagggatggatttgcgacccatgccatctcgctcgcgtggttaaaatcggttctctcgaatggtactatgagcacgttaaggcgaggttcaaacggtttggaagcgcgaaagtcatccggagtttacatggacgtctgcagggcggcgctgggccagagctaatatctgaggaaaggtctggggattcggatcagaccgatgaagatggcgaacccgggtcagaagcccaggcgcaggcccaaccatttggttccaaaaagaagaggctgctttcagttcacgacttcgacttcgagggcgattctgacgattccacccagcctcaaggtcatagtctgcacctatcatctgtgcctgaggctagagacagcccccagagcctcaccgacgaaagttgtagtgaaaaagccgccccgcataaagcagaggggttggaggaagcagatacgggcgcttccgggtgtcactctcacccagaagagcaacccacgtcaatctctccttcacgccatggcgctttggccgaattgtgccccccgggcgggtcccaccgcatggctttgggcaccgcagcagcgcttgggagtaatgtgatccggaacgagcagctgccattgcagtatcttgcggacgtcgacacatcagatgaggagtcaattcgggcccatgtcatggcctcccaccactctaagaggcggggacgcgccagctccgagtcccaaatattcgagctgaataagcacatcagtgcagttgagtgccttctgacatatttggagaacactgtggtaccaccactcgccaaaggcctcggggcaggagtgcgtactgaggctgatgtcgaagaggaagctttgcggaggaaactagaagaattgacgtccaatgtcagcgatcaggaaacctcttctgaagaggaagaagcaaaggatgaaaaagccgaaccaaatagagataagtcagtgggaccacttcctcaggcggatccagaagtgggcaccgcagcacaccaaaccaaccggcaagagaagtcgcctcaggaccccggagaccccgtgcagtataaccggactaccgacgaggagctgagcgagctggaggaccgggttgccgtgaccgcctctgaagtgcagcaagctgaaagtgaagttagcgacattgaatcacggattgcggccttgagagcagccggcctgacagtgaagccgagcggtaaacctcggcgcaagtcgaatctgcccatcttcctaccgcgagtggcaggaaaactgggaaagcgccccgaagacccaaatgccgacccttcgtctgaggcaaaggccatggctgttccctatctgctgagaagaaaattctctaactctctgaaaagtcaggggaaggatgatgattcttttgatcggaaatcagtgtatcgcggttccctcactcaacgcaacccaaatgcgcgcaaaggtatggccagccacacattcgctaagcctgtggtagcacatcagagttag

SEQ ID NO: 123932 - DNA, 1719 bp, Artificial Sequence
  Description of Artificial Sequence: Synthetic coding sequence
atgggaaaaaagctggatctgagcaagctcactgacgaggaggcccagcatgtgctggaggttgttcagcgcgatttcgacctgcgaaggaaggaggaggaacgattggaagcccttaaggggaagatcaagaaagaatcttcaaagagggagcttttatctgacacagcccacttaaatgaaacgcactgtgcaaggtgcctccagccctaccaactgcttgtgaattcaaagcgtcagtgccttgagtgcggcttgtttacatgtaagagttgtgggagggtccatccggaagaacaggggtggatatgtgacccttgccacctggcacgcgtagttaaaattgggtccctcgaatggtactatgagcatgttaaagcccggttcaagaggttcgggagcgcaaaggtgatcagatcattgcacggccggctgcagggtggcgccggtccagaactgatttcggaagaacgctcaggagattcggaccagacagacgaggatggggagcccggctccgaggcacaggcccaggcccagccttttggatcaaagaaaaaaagactgctgtctgtccacgactttgacttcgaaggcgattccgatgattccacgcagcctcaggggcacagcctccacctcagttccgtccccgaggcccgagattcacctcagtccctgaccgatgagtcttgctcggagaaggctgcccctcataaagcggaaggcctggaggaggcagacaccggggctagcgggtgtcactcccatcctgaggaacagccgaccagtatctctccctcaaggcacggtgctcttgcggaactgtgccccccaggcgggtcgcacaggatggctcttgggaccgctgccgccctcggatccaacgttattaggaatgagcagctccccctccagtatctggccgacgttgacacaagtgatgaggaatcaattcgagcacacgtgatggcttctcatcatagcaagcggcgcgggagagcctcctctgagtcacagggtttgggcgcaggagtgcgaacagaagcagatgtcgaagaggaggcacttcgacgcaagttagaagaactgacctcaaacgtttctgaccaggaaaccagcagtgaggaagaagaggctaaagacgagaaggccgaaccaaaccgcgacaagtctgttggccccctgcctcaggccgatcccgaggtgggtaccgccgcacaccagacgaaccgccaggaaaagtccccacaggatcctggagaccccgtgcagtacaatcgaacaaccgacgaagagttgtcggaactagaagatagagtcgccgttactgcctctgaggtgcaacaggccgagtctgaggtaagtgacatcgagagcagaatcgcagcattgcgggcggctgggctgactgttaagccatccggtaagcctcgacgcaagagcaacctgccgattttcctgccccgtgtggccggcaaactgggcaagaggccagaagacccgaacgcggaccccagttcggaggctaaagctatggctgtcccataccttcttcggaggaagttctctaattcactaaaaagccagggtaaggacgacgactcatttgatagaaaatcggtgtatcggggttccctcacccaacgaaaccccaacgcaagaaaaggcatggcctcacacaccttcgctaaacccgtagtggcccaccagtcttag

SEQ ID NO: 123933 - DNA, 396 bp, Artificial Sequence
  Description of Artificial Sequence: Synthetic coding sequence
atgggtaaaaagcttgatctcagcaagcttacagatgaggaggcccagcacgttctggaagtagtccagcgcgattttgatctgcgccggaaggaagaggagaggctggaggccctgaaggggaagatcaaaaaagagtcctctaaacgggaactactcagtgacacagcccatctgaatgagacccactgcgcacgctgcctccagccctatcagcttctcgtcaattctaaacggcagtgtctggagtgcggtctgtttacatgcaagagctgcgggcgtgtgcacccggaggagcagggatggatctgcgacccttgccacctcgctcgggtggttaagatcggctccctcgaatggtactatgagcatgtgaaggcccggttcaagagatag

SEQ ID NO: 123934 - DNA, 213 bp, Artificial Sequence
  Description of Artificial Sequence: Synthetic coding sequence
atgggcaagaaactggatctgagtaagctcacagacgaagaagcccagcacgttctggaggttgtacaacgagatttcgaccttcgtcggaaggaagaagagcgcttggaggctctgaagggaaaaatcaaaaaggaatcgtcaaaacgtgagttgctctctgacaccgcccatcttaacgagactcactgcgcaagatgtttgcagccttag

SEQ ID NO: 123935 - DNA, 1656 bp, Artificial Sequence
  Description of Artificial Sequence: Synthetic coding sequence
atgggcaaaaaactagacctctcaaaactgaccgacgaggaggctcaacatgtcctcgaagttgtgcagagagatttcgatttacggagaaaagaagaagaaagattggaagcgctgaaaggaaaaatcaaaaaggaatcttccaaacgggagttgctgtcagacaccgctcatctgaatgagactcactgtgcgagatgcctacaaccctaccagctactggtgaattccaaaaggcagtgccttgaatgtggcttatttacttgcaagtcatgtggacgcgttcatcccgaggagcagggctggatctgtgatccctgccaccttgctcgagtggttaaaatcggaagcctagagtggtattatgaacatgtgaaggctcgtttcaaacggttcggttctgcgaaagtcattaggtccttgcatggcagactgcaaggcggagccgggccagaactaatctctgaagagaggagcggcgatagtgatcagactgacgaggacggcgaaccaggcagtgaggcccaggcccaggctcaaccctttggttcaaagaaaaaacgcctgctgtctgtccacgacttcgactttgagggagacagcgatgattccactcagccacagggccacagcctgcacctctccagtgtccctgaggcaagagattcaccccaatccctgacggatgagagttgcagcgagaaagcggccccccataaggctgaaggcctggaagaggccgacacaggtgcttccggatgccactcgcaccctgaagagcagccaacttctatcagcccgagccgacacggtgcgctggcagagctgtgcccccccgggggcagccaccgtatggcccttggcacagccgcagcccttggttctaatgtcatcaggaatgaacagctgcctctgcaatacctcgcagacgtcgatacctcagatgaggagtctattagagcccacgttatggctagtcaccacagcaaacgccgcgggagagcttctagtgagtcccagatattcgagctgaacaagcacatcagcgccgtggagtgtttgttaacctatttggaaaataccgtggtgcctcccctggccaaggggcttggcgctggggtccgcaccgaggctgatgtggaagaggaagccttgagacgaaagctagaggagttaactagcaacgtgagtgaccaagagacaagttccgaggaggaagaggcaaaagatgaaaaggccgaaccgaaccgtgacaagtcagtgggacccctcccccaggcagatccagaagtcgggaccgctgcccatcagacgaatcgccaggagaagtcaccccaggaccccggggaccccgttcagtataataggacaactgacgaagagctctctgagctagaggatagggtggccgtcacagcgagcgaagtccaacaggccgagagcgaagtgagtgacatagagagtcgaatcgcggcgctgcgtgccgctgggctaacagttaaaccatccggcaagcctcggaggaaaagcaatctgccagcactatatgaagggacattgagtttgtgttctgaagacctgaagcatactcacccagatagcgtgaaaagtaaacggtctagactcaatcacgtggcaagctgtgggaacccctag

SEQ ID NO: 123936 - DNA, 675 bp, Artificial Sequence
  Description of Artificial Sequence: Synthetic coding sequence
atgggcttacgcgattggttacgaacagtgtgttgctgttgtggatgcgaatgtcttgaagagcgagcactacctgagaaagagcccctagtctctgataacaatccctacagtagctttggagcaactctggtgagagacgacgaaaagaacctgtggagcatgccacacgacgtgtctcacaccgaagcggacgacgacagaactctttataacctgattgtcatccgcaaccaacaggcgaaagattccgaagagtggcaaaagctgaattacgatattcatacgttgcgccaagtcagaagagaagtacgtaatagatggaaatgcattctggaggatctcggtttccagaaggaggccgattccctcttgagcgttaccaaactatccaccatctccgattccaagaacacacgcaaggcccgagaaatgctcctcaagctggctgaagagaccaacatcttccctacctcctgggagctttccgaaaggtacctgttcgtggtggataggttgatcgccctagatgctgccgaggagtttttcaaattagccaggcgcacctaccccaaaaaaccaggcgtgccttgcttagcagacggccagaaagaacttcatctgtggggcgacctgagctgtagattagcgcacatgcagggggttctgcattag

SEQ ID NO: 123937 - DNA, 645 bp, Artificial Sequence
  Description of Artificial Sequence: Synthetic coding sequence
atggggctgagggactggctgcggacagtgtgttgctgctgtggatgcgaatgtttggaggaaagagctctgcctgagaaggaaccactcgtatcagataacaacccctatagctcctttggagccactctcgttcgtgatgatgaaaaaaatctctggtctatgccccacgacgtttcacacactgaagccgacgacgaccggaccctctacaacctgatcgtgataaggaaccaacaggctaaggattctgaggaatggcagaaattgaattatgacatccacactctccgccaggtgcgccgtgaggtacgcaatcggtggaaatgcattctggaggacttgggattccagaaagaggctgattcactgttgagtgtgaccaaactctccaccatctccgactcgaaaaatactcggaaggcccgggagatgctcctgaagctggcagaagagaccaatattttccccacaagttgggagctgtccgagaggtatctattcgtggttgaccggctgatcgcgctcgacgcagcagaagaatttttcaaactggcgaggcggacgtacccaaaaaagccaggcgtcccttgtttggccgatggacagaaagagctgcactacttacctttcccatcgccgtag

SEQ ID NO: 123938 - DNA, 645 bp, Artificial Sequence
  Description of Artificial Sequence: Synthetic coding sequence
atggggctaagagactggctccgaactgtgtgttgctgttgtggatgcgagtgcctagaggaaagagcactgcccgagaaagaacctctggtgagcgataataacccatatagtagtttcggcgccactctggtcagagacgatgagaaaaatttatggagtatgcctcatgacgtaagtcatacggaggctgacgatgaccggacactgtacaacctgatagttattagaaaccagcaggccaaagatagtgaggagtggcagaagctgaactatgatattcacacattaaggcaggttcgccgcgaggtccgaaacaggtggaagtgcattctggaagatctggggtttcagaaagaggccgattcactgctaagcgtgacaaagctgagcactatttctgatagtaagaatacacgcaaggctagggaaatgctgctgaaactagcagaggagaccaatatcttccctacaagttgggagctgtcggagcgatacctgtttgtcgtggacaggctgatcgcgctggatgccgctgaggaatttttcaaacttgcccgtcggacataccctaagaaacctggagtcccttgcctcgctgatggccagaaagaactgcattacctgccgttcccttccccatag

SEQ ID NO: 123939 - DNA, 1053 bp, Artificial Sequence
  Description of Artificial Sequence: Synthetic coding sequence
atgcagggaaacgggtctgccctgcccaacgcttcgcagcctgtgttgaggggagatggggccagacccagttggttggcttcagctctggcttgtgtcctgatttttactatcgtggtggacattctcgggaacttgcttgttattttgtcggtgtaccgcaacaagaaactacgcaatgctggcaacatcttcgtcgtgtctctcgcggtggccgacttagtggtggctatttacccgtacccccttgttctcatgtctatttttaataatggatggaatctagggtacctgcactgtcaggtatcgggatttctgatgggcttatctgtgatcggcagtatcttcaacatcacgggaatcgccatcaatcgttattgctatatatgtcacagcctgaaatacgataaactgtatagctccaagaactctctctgctatgtgttgctaatatggcttctgacactggcagccgtcctgcctaatctacgcgcgggtacattgcagtatgaccccagaatctactcttgtactttcgcacagtccgttagcagtgcatatactattgcagttgtggtgtttcacttcctggtccctatgataatagtgattttctgttaccttaggatctggatcctcgtgttacaagtacgccaacgggtaaagcccgaccggaaaccgaaactcaaaccccaagacttccggaatttcgtaaccatgtttgtggtctttgttttgtttgctatatgctgggcacctctcaatttcatcggtctggctgtggcgtctgaccctgcttccatggtgccgcgcatcccagagtggctgtttgtggcctcatactatatggcttactttaattcttgtctgaacgcgatcatttacggactactgaatcagaactttcgtaaggagtaccggcgaatcatcgtctccttgtgcacggcccgtgtgttcttcgtggatagttctaatgacgtggcagatcgtgtgaaatggaagcccagccctctgatgactaacaataatgtggtcaaagtggattcagtgtag

SEQ ID NO: 123940 - DNA, 1089 bp, Artificial Sequence
  Description of Artificial Sequence: Synthetic coding sequence
atgtccgagaacggctcatttgcaaactgttgcgaggccggtggctgggctgtgaggcccggatggagtggagcaggaagcgcgcggccaagccgcactcctcgcccaccctgggtggccccggccttgtcggccgtgctcatcgtcacgacagcagtcgatgtagtggggaatctgctcgttattctgtccgtactacggaatcgcaagctgagaaatgctggaaatttatttcttgtcagcttagcgctagccgatctagtcgtggccttctatccctatcctctaattctcgtcgcaattttctatgatggatgggcattgggcgaagaacactgtaaggcatccgcctttgtgatgggactgtccgtaatcggaagtgtgttcaatatcactgctatcgccataaacagatattgctatatctgccactcaatggcgtatcatagaatataccggcgctggcacacaccactgcacatttgtctcatctggcttttgacagttgtggcactgttacccaatttttttgtcgggtccctggagtacgacccacgcatctattcttgcacattcattcaaacagcctcaacccaatatacagccgcggtcgtagtgatccatttcctgctgcccatcgctgtcgtgtctttttgctacttgcgtatttgggtgctggtgcttcaggcgagaaggaaagcaaaaccggaatctcggctgtgccttaaaccttctgatctccgctcttttctgactatgttcgtggtattcgtgatcttcgctatttgttgggcccccctgaattgcatcggattagccgtggccataaacccacaagagatggctccacagatcccagagggactcttcgtgacatcctaccttctggcatactttaattcctgtctcaatgctatcgtctatggtctgttgaaccagaacttcaggcgagagtataagcggatactgctggctttatggaacccacgccactgtatccaggacgcctcaaagggctcacatgccgaaggcctccagagcccagccccgccaattatcggggtccagcaccaggctgacgccctgtag

SEQ ID NO: 123941 - DNA, 3864 bp, Artificial Sequence
  Description of Artificial Sequence: Synthetic coding sequence
atgtccaaggtaattcagaagaagaatcactggaccagtagagtgcacgagtgtactgtgaagagaggaccacagggagagctcggtgttactgtgttggggggcgctgaacacggggaattcccctacgtgggagcagtcgccgctgtggaggcagccgggcttccgggcggaggcgagggacccagactgggtgagggggaactcttactggaggtgcagggggtgagagtgagcggccttccccgttacgacgtcctgggggtgattgactcatgtaaagaagccgtgaccttcaaagccgtacgccagggtgggcggctcaataaagatctacgacattttctgaaccaaaggtttcagaagggttcacccgaccacgagctgcagcagactattcgtgataacctgtacaggcacgctgtgccctgtaccactcggtctccccgagagggagaggtgccgggcgttgactacaacttcctcacggtaaaagagttcctcgacctcgagcagagcggcaccctgttagaagtgggaacttacgagggtaactattatgggacccccaaaccgcccagtcagcctgtgagtgggaaagtgattactactgatgctttgcatagcttgcaatcggggagcaaacagtcaaccccgaaaagaacaaagtcttataacgatatgcagaacgctggaattgttcatgcagaaaatgaagaagaagatgatgtcccagagatgaattccagcttcaccgcggactcaggcgagcaagaagagcacaccttgcaggagacagctctgcctccagtcaactccagcattatcgcagccccaatcacggatccatcacagaagtttcctcagtaccttcccctgagtgccgaagataacttaggccctctcccagagaattgggagatggcgtacacagagaatggtgaagtatatttcattgatcacaataccaagactacaagctggctggaccctcgctgcctaaacaagcagcagaagcctctcgaggaatgcgaggatgacgagggcgtgcacaccgaggagctggatagcgagctcgagcttcctgccggatgggaaaaaatagaggatccagtctatggcatctactacgtcgaccacataaatagaaagactcagtacgagaatcctgtcctcgaggccaaaagaaaaaagcaactggaacagcagcagcagcagcagcaacagcagcagcagcagcagcagcaacagcaacaacaacagaccgaggagtggacagaggatcacagtgcccttgttccccctgtgatccctaatcaccctcctagcaaccccgagcccgcacgcgaagttcccttgcaggggaaaccatttttcaccaggaatccttcagagctaaaaggtaagtttattcacacaaagctgagaaagtcatcacggggctttgggttcaccgtggtggggggtgacgaaccagatgagttcctgcaaataaagtcactcgtgctggacggccccgcagctctggatggtaaaatggagacaggagacgtgatcgtttcagtgaacgatacatgtgtcctggggcacactcatgcgcaggtagttaagatcttccagtcaatccctatcggggctagcgttgatctagaactttgccgcggctatccgttgccctttgatccagatgaccccaatacgtcccttgttactagcgtggcaatcctggataaagagccaattatcgtgaacggccaagagacatatgactcccctgcgtcccactccagcaagaccggcaaagtgaatggtatgaaagatgccagaccctcatctccggccgatgtggcctccaacagctcgcacggataccctaatgataccgtgtccttagctagcagtattgctacacagccagaactgataaccgtgcatattgtgaaggggccaatgggcttcggctttacgatcgctgattctccaggaggcggcggccagcgggtcaagcagattgtggacagtccaaggtgcagaggcctgaaggagggcgacttgattgtcgaggtcaataagaaaaatgtccaggctctgacacacaatcaggtcgttgacatgctggtcgaatgcccaaaagggagcgaggtgacactgcttgtgcagagaggcggattacccgtccccaagaagagtccaaagtctcagcctcttgagcgcaaagactcacagaattcaagtcagcattccgtgtcctcccaccgatctctccataccgcaagcccctcccacagcactcaggtgcttccagagtttccccctgccgaggctcaggcccccgaccagacagattccagcggccaaaagaaacctgacccctttaagatttgggcccagagccggagcatgtatgagaatcggcctatgtctccatcccctgcgtcagggctgagcaagggggagcgggagcgtgagattaattcgacaaactttggcgagtgccccatcccggactatcaggagcaggatatctttctttggagaaaagagaccggctttggcttccggattttgggcgggaatgagcctggtgagccaatttatatcggacacatcgtgccccttggcgctgccgataccgatggacgcctgaggagcggggatgagctgatctgtgtggacggcacacctgtaatcggaaaaagccaccagctggtcgtccagttgatgcagcaggccgctaagcaggggcatgtgaatctcacagtgcggagaaaggtcgtgttcgccgtgcccaaaacagagaacgaagtgccttctcctgcatcttctcaccattcatcaaatcagccagctagcctgaccgaagaaaaaagaacacctcagggttcacaaaactccttgaacaccgtaagcagtggctctggctcaacatccggaatcggatctggcggggggggaggttccggcgttgtctcgacagtggttcagccctacgacgtagagatcaggagaggtgaaaatgaagggttcggtttcgtgattgtgtctagcgtcagccgccccgaggcgggaacgacattcggaaatgcctgcgtggctatgccacataagataggcaggatcattgagggaagccctgctgaccgctgcgggaagttgaaggtaggtgacagaatcctcgctgtaaacgggtgtagcatcacaaacaaaagccactccgatatcgttaatttaatcaaagaggcagggaacacagtgaccctgcgcattattcctggcgatgaatctagtaatgcaacccttctcaccaacgccgagaaaatagctactatcacaacaacgcatactccctctcagcaggggacgcaagagaccagaaataccactaagccgaagcaggagtctcagtttgaatttaaagctccgcaagccacacaagagcaggacttctatactgttgagctcgaacggggtgcaaaggggtttggcttcagtctcagaggcggacgcgagtataacatggatctatatgttttgcggctggccgaagatgggcccgccgagcgatgtgggaagatgagaattggcgacgaaatcctggagatcaatggagaaactaccaaaaacatgaagcactccagggccattgaactgattaagaatggcggccgccgggtgcggctgtttctgaagcgcggtgacggatctgtccctgaatacgccatgattcctcccaatattgccgcctgtatgcgcaacgagaagttgggtgaagcctgtttctacctgatgggccataatcagaccaccactcccgccgccacggccacagctccaccacctgtgcataaagtgtttaggaagtag

SEQ ID NO: 123942 - DNA, 4389 bp, Artificial Sequence
  Description of Artificial Sequence: Synthetic coding sequence
atgtccaaggtaatccaaaagaaaaatcactggacctctagagtccacgagtgcactgtaaagcgaggccctcagggagagttaggggtgacggtgctgggtggagctgagcacggggagttcccctatgtgggcgccgtcgctgcagtcgaagccgccggattgcctggtgggggggaaggccctcgtttaggagagggggagctccttctggaggttcagggcgttagggtcagcggcctgcccagatatgacgtgctcggtgtgatcgactcatgcaaggaggccgtcacattcaaggcagtgcgacaggggggtaggttgaataaagatctgcggcatttcttgaatcagaggttccagaagggaagcccagatcatgagttacagcaaaccataagagacaatttgtatcgccacgccgtgccatgcaccaccaggtctcctcgggagggggaagtgccaggagtggactacaatttccttaccgtgaaagaattcttagacctggaacagtcaggcaccctgcttgaggtggggacgtatgagggcaattattacggcaccccaaagcctccaagtcagcccgtcagcggaaaagtgattactaccgacgccctgcatagcctacagtcaggatctaaacagagtacaccgaaacggaccaaaagttacaatgatatgcagaacgccgggatcgtgcatgcagagaatgaggaggaggacgacgtgcctgagatgaattccagttttacggctgatagcggcgagcaagaggagcatacccttcaagagacagcactgcctccggtcaactcgtcaattatcgccgcgccaattacagatcctagccaaaaattccctcagtacctcccattgagtgctgaggacaatttgggccctctacctgaaaattgggaaatggcctatacagaaaatggggaagtttacttcattgaccataacacgaaaacaacatcatggctggacccgcgctgccttaataagcagcagaaacccctcgaagagtgcgaggacgatgagggagtgcacacggaagagctcgactctgaactcgagctgcctgccgggtgggagaaaattgaggaccctgtgtatggcatctattacgtggatcacattaatcgcaaaacacagtatgagaatcccgtcttggaggcaaaacggaagaaacaactggagcagcagcaacaacagcagcaacagcagcaacaacagcaacaacagcagcaacagcagcaaactgaagagtggactgaggaccattccgcattggtgccgcccgtgatcccaaatcacccgccgtcgaaccccgagcctgccagagaggtcccactgcagggaaagcccttctttactagaaatccctccgagcttaagggaaagtttatccacaccaagctgaggaaatcttctcgaggattcggatttacagtggtcgggggagacgaaccagatgagtttctccaaataaaatctctggtgctcgatggacccgcagcattagatggaaagatggagacaggagatgttatagtttctgtcaacgacacgtgtgtcctgggtcacactcatgcacaggtggtgaaaatcttccaatcaattcccataggggctagcgtagacctggaattgtgcagaggctaccccttgccgtttgacccagatgaccccaatacctctctggtcacatccgtggccatattagacaaggagcccattatcgtaaatggtcaagagacctacgactcccccgcttcacactcttctaagactgggaaggtgaatggcatgaaggacgctcgcccctcctctccggcggacgtcgcgtccaactcaagccacggatatccaaacgatacagtttctctagccagctcaatcgctacacagcctgagctaataacagttcacattgtgaagggacccatgggattcggcttcaccatagctgacagccctggggggggcggtcagcgtgttaagcaaatagttgactctccccgttgccggggactgaaggagggagatctgatagttgaggtcaataagaaaaatgttcaagcccttacacataaccaggtggtggatatgcttgtagaatgccccaaggggtcggaagttactctgcttgtacagcgcggcggactgccggtcccaaaaaaatcaccaaagagtcagccactcgagcgaaaagatagtcagaacagctcacagcactctgtctctagccatcgctctctgcatacagccagtccgtcacattcgactcaggtcctgccagaattcccacctgctgaagcacaggcccctgatcagaccgattcttctgggcagaagaaacctgacccttttaagatttgggcacagtctagatctatgtacgagaatcgtctgcccgattaccaggagcaggacatcttcttatggcgcaaggaaaccggatttgggttcagaatcttaggcggcaacgaaccaggagaaccaatctatattggccacatcgtgcctctgggtgctgccgacacagatgggcgactccggtcaggggacgagctgatatgtgtggacgggaccccggtgattggcaagagtcaccagctcgtggttcaactcatgcagcaagccgctaagcaaggacacgtaaacttgactgttcgcagaaaggttgtgtttgctgtccccaagacagagaacgaggtaccgagcccagctagctcgcatcactctagtaaccagcccgcttcacttaccgaagagaagcgtaccccccagggcagtcaaaattcactgaacacggtatcttccggcagcggctccacttccgggattggctcaggtggggggggcggctctggcgtagtatcgactgtggtccagccttatgatgttgagattcgacgtggcgagaacgaagggttcggatttgtgatcgtttcaagtgtgtcgcgcccagaggctgggaccacctttggaaacgcatgcgttgctatgcctcacaagattggtcgaatcatcgaaggaagccccgccgaccgctgtggcaagctgaaggttggggaccggattcttgcggtgaacgggtgcagcattacaaacaaatcccacagcgacatcgtgaacttgattaaagaggctggaaacactgtgactcttcgcataatccccggggacgagtcatccaatgcgactctgctcactaacgctgaaaagatcgccactataacaaccactcatacacctagccagcaggggacgcaggaaacccggaacacaaccaagccaaagcaggaatcccaattcgaatttaaagctccccaggctacacaggagcaagacttctatactgtggagctggagaggggtgctaaaggcttcggttttagcctaaggggcgggcgagaatacaacatggacctgtatgtattgaggctggccgaggatgggccagccgagagatgcggtaaaatgaggataggagatgaaatccttgaaattaacggcgagacaacaaagaatatgaaacacagccgagccatcgagctgataaaaaacggcggtaggagagtccgattgtttcttaagaggggggacggcagcgtgcctgagtatgacccctcgtcagacaggcacggaccagcaaccggtccacagggcgtccctgaggtacgggctggtcctgacagacgacagcatccttcactcgagagttcttatccaccagacctccacaagtcctccccccatggcgagaagagggcccacgctagggaccccaaggggtcacgagagtatagtcgtcagccaaacgagcatcatacctggaatgggacatcccgaaagccagatagcggcgcatgcaggccaaaagacagagctcccgaaggacgcagagatgcacaggccgaacgagcagctgctgcaaatgggcccaaacgccgatcccccgaaaaacggagggaggggacccgctccgctgataatacactagagcgccgagaaaagcatgagaaaaggagagacgtgtctccagagcgccgtcgagaacgtagtccgaccaggaggagggatggatctccttctagacgccgccggtctctcgagagactcctcgagcagagacgcagtccggaacgccggaggggggggagtccggaaaggagggcaaaaagtactgacagaagaagagctcgtagtccggagcgtagaagagaacgcagccttgacaagagaaaccgagaggatagggcttcacaccgggagcgggaggaagctaatctgaagcaggatgctggcaggagtagccgacacccccccgaacaaagaagacggccatacaaggagtgctctactgatctctccatatag

SEQ ID NO: 123943 - DNA, 3552 bp, Artificial Sequence
  Description of Artificial Sequence: Synthetic coding sequence
ggggggcgcctgaacaaggatcttcgccacttcttgaatcaaagattccagaaaggcagcccggatcatgagctgcagcagaccattcgggacaacctctacaggcatgccgtcccttgtactactagatccccacgtgaaggagaggtgcctggcgtggattataacttccttactgtcaaagagttcttagacttggagcagtcaggaacacttctagaagtcgggacctatgagggaaactactatggaacccccaagcctccctcccagcctgtatcaggtaaagtgattaccacagatgctctccactcactgcagtccggatctaagcagagtacgcccaagcgaacaaaaagctataatgatatgcagaatgcgggcattgtccatgctgagaacgaagaagaggatgacgtgcctgagatgaacagctcctttaccgcagactcaggggagcaggaggaacatacactgcaggagaccgctctgccacccgttaactctagtatcatcgcggcacccattaccgatcccagccaaaagtttccacaatatcttccattatcagcagaagacaatttgggccccttacctgaaaattgggagatggcgtataccgagaacggagaggtttatttcatcgatcacaacaccaagaccacatcgtggttagacccacgctgccttaataagcagcagaagccattagaagagtgcgaggacgatgaaggagtacatactgaggaacttgactctgagcttgaactccccgccggctgggagaaaatcgaggaccccgtttacggaatatattacgtggatcacattaatagaaaaacccagtacgaaaacccggtattggaggcaaagcgcaagaagcaacttgaacagcagcaacagcagcagcagcagcagcagcagcagcaacagcagcaacagcagcaacagacagaagagtggaccgaagaccactccgctctggtgccacccgtgatccccaatcaccctccatcaaatccagagcctgcccgcgaggtccccctccagggaaagccattcttcaccaggaacccgtcagagttgaaaggcaagtttatacacaccaagctccggaaatccagtcggggctttggctttactgttgtggggggcgatgagccagacgagttccttcaaattaagtccctggtcttggacggccctgcagcattagatgggaaaatggagactggggatgtgatcgtcagcgtaaatgacacatgcgtactgggccacacacacgcacaggtggtgaagattttccaatctatcccgatcggcgcaagcgtggatcttgaattatgtagaggatatccactgcccttcgacccggacgatcccaacacctctttagtgacctctgtcgctatcctggacaaggaaccgatcattgtgaatggtcaggagacctacgactcaccagctagccactcatcaaaaaccgggaaggtcaatggaatgaaagacgccagaccttctagtccagcagacgtagcatcgaacagcagccatggctaccctaatgacaccgtctccttggcaagctctattgctactcagcctgagctgataacagttcatatcgtgaaagggccgatgggctttggattcacaatcgcagattcgccaggcgggggaggccagagagttaagcaaattgtagatagccccaggtgtcggggactgaaggaaggagatctgattgtggaggtcaacaaaaaaaacgtccaggctctgacccataaccaggtagtcgacatgctggttgaatgtccaaaaggaagcgaagtaacccttctggttcagcgtgggggactcccagtccctaagaagtcccccaagtctcagccactcgaaaggaaggactctcagaactcgtctcagcactctgtctctagccatcgctcactacacacagcgtcgccatcacacagcacacaggttctgcctgagttccctccagcagaggctcaggctccagatcagactgattcttctggtcagaagaagcccgacccctttaaaatttgggctcagtccaggtcaatgtacgagaaccgtcccatgtcaccctctcccgcaagcgggttgtctaagggagagcgggagagagaaatcaattcaaccaactttggggaatgccccatccccgactaccaggagcaggatatcttcctgtggaggaaagaaaccgggttcggtttcagaatcctgggtggaaacgagccaggagaacccatttatatagggcatatcgtgcctctcggcgccgcagacactgacggccgcctgcgaagcggcgatgagctcatatgcgtcgacggtactcccgttatcgggaaaagccatcagctcgtggttcaacttatgcagcaggctgcaaaacaaggccacgtgaaccttactgtgcgccggaaagtggtctttgcggtccctaagacagaaaacgaggtgcctagccccgcctcaagtcatcacagttccaatcaacccgctagtctgacagaggaaaagagaacaccccagggcagccagaattccttgaatacagtgtccagtggctccggaagcacgtcaggtatagggtccggaggcgggggcggtagcggagtggtatctactgtagttcagccctatgatgtggagatcagacggggggagaatgaaggcttcggttttgttatcgtgtcatcggtctcccggccagaagctggtacgacatttggcaacgcatgcgtggccatgccgcacaagatcgggcggatcattgagggaagccccgcggacagatgtgggaagctaaaagtgggagataggattctggcagtaaacggttgctctattacaaacaagagtcattctgatatcgttaatttaatcaaagaagccggaaacacagttacgctgagaattattcccggcgatgagagttcgaatgctacccttctgactaacgcagaaaagatcgctacaataactaccactcacaccccatctcaacagggcacacaggagacacgtaacaccaccaagcccaagcaggaatctcaatttgaattcaaggcacctcaggccacacaggagcaggatttctacaccgttgaattagagcgaggcgctaagggctttggtttctccttgagagggggtcgcgagtacaacatggacctgtacgtgctgcggttagccgaggacggcccggcagaaaggtgtgggaaaatgaggatcggtgacgaaatcctcgagataaacggtgagactactaagaacatgaaacattccagggcaatagagctgatcaagaatggtggcaggcgggtgcggctgtttttgaagcgcggcgacgggtctgttccagagtatgcaatgattcctcccaatatagccgcgtgtatgcgcaacgaaaagcttggtgaggcatgtttctatctgatgggtcacaatcagacgacaaccccggctgccacggccacagccccaccgcctgtccacaaagtgtttcgcaaatag

SEQ ID NO: 123944 - DNA, 3771 bp, Artificial Sequence
  Description of Artificial Sequence: Synthetic coding sequence
atgagcaaagtaatccaaaagaaaaaccactggacctctcgggtacacgagtgcacagtcaagcgagggccccaaggtgagctcggcgtcacagtgctggggggagctgaacatggcgaattcccgtacgtaggtgcagtagcagccgtggaggctgcaggattgccgggtggaggggaagggccgcgactgggggaaggcgagcttttgctggaggtgcagggcgtcagagtgtcaggattaccccgctacgatgtccttggagtgatcgacagctgtaaagaagctgttacatttaaagcagtacggcagggcggccggctgaataaagatttgcgacatttcctgaatcagcggtttcagaaagggagcccagaccatgagctacaacagactatccgggataacctataccgccacgctgtcccatgcactactcggtcaccccgagagggcgaggtacctggcgtggactataattttcttaccgttaaagagttcctggacctcgaacagagcggcactctgctggaagtgggaacatacgaggggaactactacgggacgcctaaacccccgagccagcccgtatctggcaaagtcatcacgacagacgctctccacagccttcagagtggctctaaacagagtacccctaaacggacaaaaagctataatgatatgcagaacgcagggattgttcacgccgagaatgaggaggaggacgatgtgcctgagatgaactcgtccttcactgctgacagcggcgagcaggaagagcacactttgcaagagaccgcgctgcctcccgtcaatagttccatcattgccgcccccatcactgacccttcccaaaaattcccccagtacctgccactgtcggccgaagacaacctgggtcccttgcctgagaactgggagatggcttataccgagaacggagaagtctatttcatcgaccacaacaccaagactacttcttggttggacccacgctgcttgaacaagcagcaaaaaccgcttgaagaatgcgaagacgatgaaggcgtacataccgaagaattagatagtgaactagagctgcctgctggatgggagaagatagaggaccccgtgtacggaatctattacgtggatcatataaatcgaaagactcagtatgagaatcccgtgttggaagctaaaaggaagaagcagctggagcagcagcagcaacagcagcagcaacagcaacagcagcagcagcagcagcagcaacagcagacagaagaatggacagaagaccactctgccttggtgccccccgtgattcccaaccacccaccgtctaatccagaacccgcaagagaggttccgttacagggtaagcctttttttacccggaaccctagcgaactcaaagggaaatttattcacactaagctgcgaaaatctagtaggggattcggcttcaccgttgtgggaggagacgagccggatgagtttttacagattaagtcactggtactggacgggccagccgctcttgacggcaaaatggagaccggcgacgtgatcgtgagcgtcaacgacacatgcgtgttgggacatactcatgctcaggtggtgaagattttccaaagcatcccaataggggcctctgttgatctggaactctgtcgcggttacccactacccttcgatcctgatgaccctaacacttccctcgttacaagcgtggctatcctggataaggaaccaatcattgtgaatggccaagaaacttatgatagtccagcaagtcattcgtcaaaaaccggtaaagtgaacggtatgaaagacgcaagaccaagctcccccgcagacgtggcctccaattcctcacatggttacccaaacgataccgtttcactggcttcctcaatcgctacacaacccgagttgatcacggttcacatcgtcaagggtcctatgggattcgggtttactatcgctgattcaccaggaggtggggggcaacgcgtgaaacagattgtggattcccctcggtgccggggcttgaaggagggagacctcatcgtggaggtgaataaaaagaatgtacaggcgctcactcataaccaggtggttgatatgctggttgagtgcccaaagggttctgaagttacattgctggtacaaaggggcggcctgccagtgccaaagaaatcacccaagagccagccactggaacggaaggattcgcaaaatagttctcagcactcagtgtcctcccacaggagcctccacaccgcatctcccagtcacagcacccaggtgctgcccgagttcccacctgccgaggctcaggcaccagatcagactgactccagtggtcagaagaaacccgaccccttcaagatctgggcacagagtaggtccatgtacgagaaccggcctatgtcacccagccctgcttctggactgtccaagggcgaacgcgaaagggaaatcaacagcactaatttcggagagtgcccgatacctgactaccaggagcaggacattttcctgtggagaaaagaaacgggttttggattccgcattctgggtggcaatgagcccggcgaaccaatttacatcggacacatcgttccactgggggcagccgataccgatggccgcttgagaagtggcgatgagctcatttgtgtggacggcactcctgtcattggcaagagccatcagctcgtcgtgcagctgatgcagcaggcagcaaaacaaggacatgtgaatcttactgtgaggagaaaggttgtgttcgctgtgcctaagacggagaatgaggtgccttccccagcctcatcacatcattctagtaaccaaccggcctcactaacagaggaaaaacgcacgccccagggatcacaaaactcattgaacactgtgtcctccggttccgggagcacaagtggtattgggtctggaggaggtggcgggtcaggcgtggtctctacagtggtccagccgtatgatgtcgagattagaagaggcgaaaatgagggttttggatttgtaattgtcagttctgtgagtcgtcccgaggcagggaccacattcgccgggaacgcatgcgttgccatgcctcacaaaatcgggcggattatagaggggagcccggctgaccgctgcggtaaactaaaggtgggggatcgtattctcgcggtgaacggctgctccatcaccaataagagccattctgacattgtgaacttaatcaaggaagccgggaacaccgtgaccctccgaatcatccccggtgacgagtccagcaatgccaccttattgactaatgcagaaaaaatagccactattacaactactcataccccatcccagcagggcactcaggaaacacggaacaccacaaaacctaagcaagagtctcaatttgagtttaaagcgccccaggcaactcaggaacaggatttttacactgtcgaacttgagcggggtgcaaaaggtttcggcttttccttgagggggggccgggagtataacatggatctgtacgtgttgcgtttggcagaagatggtcctgccgagagatgtggcaagatgagaattggggatgagatcttggaaattaacggcgaaaccaccaagaacatgaaacattcacgggcaatcgagttgatcaaaaacggaggtcgccgggtgcggttgtttttgaagcggggagatggatcagttccagagtacggcgggtcaaactatgagaatatcccaagctttcccggtatgaccccctag

SEQ ID NO: 123945 - DNA, 1488 bp, Artificial Sequence
  Description of Artificial Sequence: Synthetic coding sequence
atggcggccgagcctcaaccatcgtccctcagttaccggaccactgggagcacatacctgcatcccctctccgagctgctcggaatccctctcgaccaagttaattttgttgtctgccagttagtagccttgtttgcagccttctggttcaggatctacttgcggccgggcacaacgagtagcgacgtgcgccatgctgtggctacaattttcggcatttatttcgtaattttttgtttcgggtggtacagtgtgcatctgttcgtgctggttctcatgtgttatgctataatggtcaccgctagcgtgtctaacattcatcgctattctttttttgtcgcgatggggtacttgacgatttgccatatatcccgcatctacatatttcactacggcatcttgaccacagatttctcggggccgttaatgatcgtgacacaaaagatcaccacattggcctttcaggttcatgatggtctgggcaggcgggctgaagacctatctgcagaacagcacagacttgctataaaggtcaagccatcgtttctggaatatctaagctatttacttaatttcatgtccgtcattgccggcccatgtaacaacttcaaggactacatcgccttcattgaaggcaagcacatccacatgaaattgctggaagtcaattggaaacgcaagggattccacagcctgccagaaccttcacccacgggtgccgtgatccataaactcggcattacactggtgtccttgcttctatttctgacactgaccaagacatttccagtcacttgcctagtcgatgattggttcgtgcataaggccagcttccctgcgagactgtgttatctctatgtcgttatgcaggcttctaagcctaagtattattttgcttggactcttgctgatgcagtcaacaatgcagcgggatttggctttagcggggtggataagaatggaaacttctgttgggaccttctgagtaatctgaatatttggaaaatcgagacagccacctcgttcaaaatgtatttggagaattggaatattcagacagctacttggttgaagtgtgtgtgttaccagcgggtgccttggtaccctaccgttctgacgttcatcctaagcgccctatggcacggagtatacccagggtattattttacctttctgacagggattctggtgaccctagctgctcgtgctgtgagaaacaattaccgccactacttcttaagctccagagccctgaaagctgtgtacgacgctggaacttgggcagtgacacagcttgccgtgagttacacagtggcgccctttgtcatgctagctgtggagcccaccatctccctgtataaatcaatgtatttttacttgcacattatttcactactcataattctgtttctgccaatgaaaccacaggcacatacgcagagacgccctcaaaccctcaactccataaacaaacgaaagacagattag

SEQ ID NO: 123946 - DNA, 726 bp, Artificial Sequence
  Description of Artificial Sequence: Synthetic coding sequence
atggccgctgaaccccaacctagttccctaagctatagaaccacaggctctacctacctgcacccactatccgaacttctcggcataccgctggatcaggtcaattttgttgtgtgccagttggttgccctgtttgccgcattctggtttaggatatacttgcgccctggaaccacctcctctgatgtaaggcacgcggtagcgaccatattcgggatctactttgtcattttttgcttcgggtggtattcagttcacttgttcgtgttggtcctgatgtgttacgccatcatggtgactgcttctgtgtctaacattcatcgatatagtttctttgtggctatggggtacctcactatctgtcatatcagcagaatttatatcttccactacggtattttgacaacagactttagcggccccctgatgatagtgacacagaaaatcacaaccctggcctttcaggttcacgacggactcggacgaagggccgaggacctctctgctgaacagcataggcttgctattaaggtgaaaccttcattcttagaatatctctcatatttactgaactttatgtccgtaattgcggggccatgtaataatttcaaggattatatcgcgtttattgaaggaaaacacatccatatgaaattactcgaggtaaactggaaaaggaaggggttccattctttacctgaaccttctccgactgggcatctctag

SEQ ID NO: 123947 - DNA, 1041 bp, Artificial Sequence
  Description of Artificial Sequence: Synthetic coding sequence
atggagttctccctgcggatttttttagggctcggacgccgggccgaggatttatccgcagagcagcaccgattggccataaaagtcaagcctagctttctggagtacctgtcttacttgctgaatttcatgtcagtgatcgccggcccgtgtaacaacttcaaggactacattgccttcattgaagggaagcacattcatatgaaactgctagaagtcaattggaaacggaagggattccactcactgcctgagccttcacctacaggggccgtaatacataagttagggattactctcgtgtctttgttactgttcctcaccctgaccaagacgttccccgtcacatgcctggtagatgactggttcgttcataaagcgtcgttccctgccaggctgtgttatttatacgttgtcatgcaggcttcaaaaccgaaatactacttcgcttggaccttagctgacgccgtgaataatgccgccggcttcggcttttctggggtcgacaagaacgggaacttctgctgggaccttctgagtaatttgaatatttggaagattgagacagccaccagctttaagatgtacctggaaaactggaacatacagaccgctacttggctcaagtgcgtctgctatcaacgggtgccttggtatccaacagtactcacttttattctgtccgcgctgtggcacggcgtgtacccgggatactatttcacattccttacagggattctcgtcaccttggctgcaagagcggtgcgtaacaactaccgtcactacttcctgtcctcccgggcgttaaaagccgtgtatgacgctggtacctgggccgtgactcaactggccgtgagctacacagttgcccctttcgttatgttggctgtggagcctaccatttcactatacaaatccatgtatttttatctgcacataattagtctgcttatcatcctgttcctgcctatgaagccccaggcccatacccagcgacgaccccagaccctcaacagtatcaacaaacgcaagactgactag

SEQ ID NO: 123948 - DNA, 1563 bp, Artificial Sequence
  Description of Artificial Sequence: Synthetic coding sequence
atggccacgacatccactactggctccactttactccagcctctgtctaacgctgttcaactcccgatcgaccaagtgaatttcgtcgtgtgtcagctgtttgctctgttggccgcaatttggtttcgcacttacctgcactccagtaaaacaagtagtttcatcaggcatgtggtcgcaactctcctggggctgtacctcgctcttttctgctttggttggtacgcactgcattttcttgtccagagcggaatctcttattgtatcatgattatcataggggttgagaatatgcataattattgctttgtctttgctctgggctatttaacagtgtgtcaggttaccagagtttacatttttgattatggtcaatatagtgccgacttttcaggtcctatgatgattataacgcagaaaatcacatctctggcttgcgagatccatgacggcatgttcagaaaggatgaggagctcacttcttcacaaagagatctcgccgtgcgcaggatgccatccttgctcgagtaccttagctacaattgtaactttatgggcatcctcgctgggcccttatgttcctacaaagactatattacgttcatcgaagggagatcttaccacatcacacaaagcggggaaaacgggaaggaagagacacagtatgaaaggactgagccttctcctaacaccgctgtggtccaaaagctgctcgtgtgtggtcttagcctgctgtttcatttgacaatctgtacaacactcccggttgagtacaacatcgatgagcacttccaggccaccgcgagttggcccactaagattatttacctctacatctcactcctggcagccaggcccaaatactattttgcttggaccctggccgatgctataaataacgccgctggatttgggttccggggatacgatgaaaatggcgctgctagatgggatctgatctccaacttgcggattcagcagattgagatgtccacctctttcaaaatgtttttggataactggaacatacagactgctttgtggctcaagagagtgtgctacgaaagaacaagtttcagtccaacgatccaaacgttcattctgtccgccatctggcacggggtgtatcctggttactatctgacattccttacaggagtcctcatgacactcgcagctcgagcaatgcgaaataacttccggcactattttatcgagcctagccagttgaagctgttttacgacgtaataacatggatagttactcaagttgccattagctacactgttgtgccatttgtgctcctgtccatcaaaccttccttgacattctatagcagctggtactactgcctccatattctcgggatactcgtactcttattacttcccgtgaagaaaacccagcgccggaagaacacccacgaaaacattcaactcagccaaagcaaaaaattcgacgaaggtgagaactcactcggacagaactctttcagcacaacgaacaacgtatgtaaccagaatcaggagatagcttctcggcatagttcattgaagcaatag

SEQ ID NO: 123949 - DNA, 1308 bp, Artificial Sequence
  Description of Artificial Sequence: Synthetic coding sequence
atggagtggctctggcttttctttctgcaccctatctctttttaccagggcgccgctttcccattcgctctgctattcaactatctttgtatcatggactctttctccacccgcgctcgatacctttttctccttacagggggtggtgccttggccgttgctgcaatgggatcttacgcagtgctggtcttcacacctgccgtgtgtgccgtggccctgttatgttcactggccccgcagcaggtgcatcggtggaccttttgctttcaaatgtcatggcagacgctctgccatctgggcctccactacactgagtactatctgcatgaaccacctagcgtgcgcttttgtattacgttaagcagcctgatgctccttacacaaagagtgacctctctatcccttgatatttgcgaaggaaaagtgaaggcggcctctggtggcttcaggtcacgcagctctttgtccgaacatgtgtgcaaggcattgccatattttagttatcttctttttttcccagccctgctgggaggttccttgtgttcctttcagcggttccaggcccgcgtgcaggggagctctgccttacatccaagacactctttttgggccctgagttggagagggcttcagatcctcgggctcgaatgtctgaacgtcgctgtgtctagggtggtggacgctggtgctggactcactgattgtcagcaattcgagtgcatctacgtggtgtggactaccgccggtctgtttaaacttacttattattctcactggattctggatgactctttactgcacgcagcaggattcgggcctgaactgggacagtcccctggtgaagaaggttacgtgccagacgcagatatctggacgttggagagaactcaccgaatctccgtcttctcacggaagtggaatcagagcacagcccgatggcttcggcggctggtgtttcagcattctagggcttggcctctgctgcagactttcgctttcagtgcctggtggcatggcctgcacccggggcaggtgtttggcttcgtatgttgggccgtgatggtggaggctgactatttgatacatagttttgcgaatgaattcatcagaagctggcctatgcgattgttctataggactctaacctgggcacacacgcagctgattatagcatatattatgcttgctgtagaggtgcgttcactctcttctctctggctcctgtgcaattcctacaatagcgtgttccctatggtgtactgcatccttctactgctgcttgccaagcgcaaacacaagtgcaactag

SEQ ID NO: 123950 - DNA, 1341 bp, Artificial Sequence
  Description of Artificial Sequence: Synthetic coding sequence
atgactctgaaagcttctgaaggcgagtctgggggctcaatgcacacagctctctctgatctgtatctggagcaccttctccagaagaggtcacggcctgaagccgtcagccacccactcaacaccgtgacagaggatatgtatactaatggttctcccgcaccagggagtccagcccaagtaaagggacaagaggtacggaaggttcgtcttatacagtttgagaaggtaactgaagaacccatgggtattaccttaaagctcaacgagaaacaatcctgcaccgtggccaggattctccacggcggaatgatacatagacagggttccctacacgttggtgacgagattctggaaatcaatggcactaacgtgacgaaccattccgtagaccagctccagaaggccatgaaagagaccaaaggaatgatcagcctaaaggttataccgaatcaacagagccgcctccccgctttgcaggaggctgggttaaagttcgcaactggcgatatcatacagatcatcaacaaagacgactctaactggtggcagggcagagtggaaggaagttccaaagagtctgccggattaatcccctctcctgaacttcaggagtggcgcgtcgcctccatggcccagagtgcaccttctgaagctccaagctgttctccttttggaaagaaaaagaaatacaaagataaatacctcgctaagcacagctccatatttgaccaactcgatgtagtgtcatacgaggaggtcgtgcgcctgcctgctttcaaacggaagaccttggtcttaatcggtgcgtccggagtcggacgcagccatataaaaaacgcgcttctgagccagaatcccgagaaatttgtctatcctgtcccctacacgaccagaccccccagaaaaagcgaggaggacggaaaggaataccatttcatctcaaccgaggagatgacacgtaatatctccgcaaatgaatttcttgagtttggttcatatcagggaaacatgtttggcactaagttcgagacagtgcaccagatacacaagcagaataaaatcgcgattcttgatattgaaccacagaccctgaagattgtgcgcacagccgagctaagtccattcattgtgtttatcgctcccaccgatcagggaactcaaacagaagctttgcagcagttacagaaagatagcgaagccatacgttcccagtacgctcattatttcgatctctccctggtgaacaatggagtggacgagaccttaaaaaaactgcaagaggcttttgatcaggcatgtagcagcccccagtgggtccccgtgagctgggtctactag

SEQ ID NO: 123951 - DNA, 1401 bp, Artificial Sequence
  Description of Artificial Sequence: Synthetic coding sequence
atgactctcaaagccagcgagggcgagtcaggcggaagcatgcacacggccctgtccgacttatacctcgagcatctactgcagaaaagatctcgccctgaggccgtttcccatccattaaataccgtcaccgaggacatgtacaccaacgggagcccagcccccggctcacccgctcaagtaaaaggccaggaggtgaggaaagtcagactcatccagttcgaaaaggtaacagaggagcccatgggaatcacgcttaaactgaatgagaaacagtcctgcaccgttgcccggattttacacgggggcatgatacatcgccagggatcccttcacgtcggcgacgagatccttgagatcaatggcaccaatgtgacaaaccattctgtggaccagctgcagaaagctatgaaggagactaaaggcatgattagcctcaaggtaatccctaaccagcaatctaggctacccgccctccaaatgttcatgcgtgcccagttcgactatgatcctaaaaaggataatcttattccttgtaaggaggctggactgaaattcgccactggtgatattattcagataattaacaaagacgacagtaactggtggcaaggccgggtggaagggtcttccaaggagtccgccggcttgattcctagccctgaactccaggaatggcgagtagcatccatggcacagagcgctcctagtgaagccccctcctgcagcccctttgggaaaaaaaagaagtacaaggacaaatacttagccaagcactcttctattttcgaccagcttgacgtggtcagctatgaggaagtcgtaagacttccagcctttaagcgaaagacccttgtgctgatcggggcgtctggcgtaggccgatcccacataaagaacgcactgctgtcgcagaaccctgaaaagttcgtgtatccggtgccctacacaactaggccgccaaggaagagtgaggaggatggcaaggaatatcatttcatcagcactgaggagatgacccgcaatattagcgctaatgagtttctcgagtttggttcataccagggaaatatgtttggcaccaagttcgagactgtccaccagatacacaagcagaacaaaatcgctattctggacatcgagccacagaccctgaagatcgtgcgaacagctgaactctccccattcatagtcttcatagccccaacggatcaggggacccagacagaagccctgcagcaattacagaaagactcagaggcgatccgctcccagtatgctcattacttcgatctgtccctcgtgaataatggagtggatgagacccttaagaagcttcaggaagctttcgaccaggcatgcagctctcctcagtgggtgcccgtatcctgggtttactag

SEQ ID NO: 123952 - DNA, 1311 bp, Artificial Sequence
  Description of Artificial Sequence: Synthetic coding sequence
atggaaagttgggccgtgagtcacccccttaacacagtcacagaagatatgtataccaatgggtcacctgctccaggatctccagcacaagtgaaagggcaggaagtcaggaaggtaaggcttattcaatttgaaaaagtgaccgaggagcccatggggatcactcttaaactcaatgagaaacagtcctgtacagtagcacggatccttcatgggggaatgattcaccgtcaaggctcactgcacgtgggcgatgaaatcctcgaaattaatggtaccaacgttaccaaccactcggttgaccaacttcaaaaagcaatgaaggaaactaagggaatgatatcactgaaggtgatccctaatcagcagtcccgtctgccggctctacagatgttcatgagagcccagttcgattatgatcctaaaaaggacaatctcatcccgtgcaaggaagccggcctgaagtttgcaaccggggatatcattcaaattatcaacaaggacgatagcaattggtggcagggcagggtggaaggaagtagcaaagagagcgctggcctgattccgtcgcctgagctgcaagagtggagagtagcatcaatggcccagtccgctccctcagaggcacccagctgctcgcctttcggcaaaaaaaaaaaatataaagataagtatctcgctaaacacagcagcatatttgaccagcttgatgtggtgtcctacgaggaggtggttcgcttgccggctttcaaaaggaaaacgctggtgttaatcggggctagtggggtgggacgctcacatatcaagaacgctttgctcagccaaaaccccgaaaaattcgtgtatccggtgccttatacaactaggccccccagaaagagcgaggaagatgggaaagagtatcacttcatttccacagaggagatgactcggaatatcagcgctaatgaattcttagagttcgggtcttatcagggcaatatgttcggaacaaagtttgagacagttcaccagattcacaaacagaataaaattgcgatcctcgatatcgagccacaaactcttaaaatagtgcgtacagccgagctgtcgccattcatcgtgttcatcgcccccactgaccagggtacacaaaccgaggccctccaacagctacagaaggactccgaagccattcgctctcagtacgcccactatttcgatctctccctcgtgaataacggtgttgatgagacgcttaagaagctgcaagaggcgttcgatcaagcctgctcgtctcctcaatgggtccccgtttcttgggtgtattag

SEQ ID NO: 123953 - DNA, 1659 bp, Artificial Sequence
  Description of Artificial Sequence: Synthetic coding sequence
atgcccgtggcagcaactaactctgaaacagccatgcagcaagtgttggataatctcggatccctgccgagcgctacaggcgccgccgagctcgatctcatcttcttgcgggggatcatggaatcaccaattgtgaggtccctggcaaaagcccacgagcgcctagaagaaactaagctagaggccgtcagagataataatcttgaactggtccaggaaattctacgcgatctcgctcacgtagctgagcagtcgagcaccgccgccgaattagcacacatcctgcaggagcctcacttccagagcttgctggaaacgcacgacagcgtggcatctaagacttacgaaacaccacccccttcgccaggtctcgaccccactttctccaatcagccggtgccaccagacgcagttcggatggtcggaattagaaagaccgctggagagcatctcggcgttacctttcgtgtcgaaggaggcgaactggtgatcgcccggattctccacggggggatggtcgcccagcaagggctgctgcatgtgggcgacattattaaagaagtgaatgggcagcctgtggggtcagatccgcgtgcgctgcaggagctgctgaggaatgcgagcggctcagtgattctgaaaatacttccgagttaccaagaaccccatctgcctcgtcaggttttcgtgaagtgccattttgactatgaccctgctagagacagcctgattccttgcaaggaagcaggactgcgcttcaatgctggggatctgttgcagatcgtgaaccaagacgacgcaaactggtggcaggcttgccacgtggaggggggcagtgccggtcttatcccctcgcagttgttggaggagaagaggaaggctttcgtaaaacgggacctggaattgacccctaattcgggcactctgtgcgggagcctgagtggcaaaaaaaagaaacgtatgatgtatttaacaaccaagaacgcagagttcgataggcacgagctgctgatttatgaggaagtggccaggatgcccccattccggcggaaaacgctggtactcattggcgcgcaaggtgttggtaggcgttctcttaaaaataagttaattatgtgggatcccgaccggtacggcactaccgtgccttatacttcgaggcgccctaaggattctgagagagagggacagggctattcctttgtgagcagaggtgagatggaggcagacgtaagggccggccgatacctggagcatggtgagtatgagggcaatctctacgggactaggatagacagtatcagaggcgtggtggccgcgggcaaggtatgcgtgctcgacgttaacccccaggcggttaaggtactgaggacagcagaattcgtgccatatgtggtgttcattgaagccccggatttcgaaacactccgtgcgatgaaccgggccgctctcgagtcaggaatctccaccaaacagttaactgaagctgacctcagacgcactgttgaggagagttcccgaattcagagggggtatggccactacttcgatctctgcttggtcaactccaatctcgagaggaccttccgcgagctgcagactgccatggagaaactgcgcactgaacctcagtgggtcccagtgagctgggtgtattag

SEQ ID NO: 123954 - DNA, 1731 bp, Artificial Sequence
  Description of Artificial Sequence: Synthetic coding sequence
atgcccgtcgctgcaacaaacagtgagaccgcaatgcagcaagtactagataatctgggttcattaccttcggccaccggggcagctgaactcgacctgattttcttgagagggattatggaaagtcccattgtacgttccctcgccaaagtgatcatggtcctgtggttcatgcagcagaacgtgtttgtgcctatgaagtacatgctaaagtatttcggtgctcatgagcgattggaggagacgaagctggaagctgtgagggacaacaaccttgagctggttcaggagattctgcgagatcttgcccatgtagccgagcagtcatcgaccgctgccgagttagcccatatcttgcaggaaccacacttccagtcacttctggagacacacgactctgtggcgagcaaaacgtacgaaaccccaccccccagtcctggcttagatccaacattcagcaaccagcccgtgccacccgatgcagtacggatggtgggcatccgcaagacagcaggggagcaccttggagtgacatttagagtagaaggaggagaactggttatagcaagaatcttgcatgggggaatggtggcacagcagggcttactccacgtgggagacatcatcaaagaagttaatggacagcccgtgggctctgaccctagagcgttgcaggagctgcttcggaacgcgtcgggatcggtgatcctgaaaattttgcccagctaccaggagcctcacctcccccgccaggttttcgtaaaatgtcatttcgattatgatccagctcgcgatagtctaataccctgcaaggaggctggcctcaggttcaatgcaggcgacctgctacagattgtcaaccaagatgacgctaattggtggcaggcatgtcatgttgaggggggcagcgcagggctcatcccgtctcagttgttagaagagaagaggaaagccttcgtcaagcgtgacctcgaactgacaccaaattcagggacgttgtgtggatctctgtccggtaaaaaaaaaaagcggatgatgtacctcaccaccaaaaacgccgagttcgacagacatgaactgctaatctacgaagaagtggccaggatgccgccttttagacgcaaaacccttgtcttaataggcgcacagggcgtcggacggagaagtttgaaaaacaaactgattatgtgggaccctgacaggtatggtacaacggtgccatacaccagccgaagaccaaaagactccgagagagagggccaagggtacagctttgttagcagaggggagatggaggccgacgttagagcaggtaggtacctggaacatggggagtacgagggcaatttgtatggcactcgcatcgactcaatacgcggcgtggtagccgctggaaaggtgtgtgtgctggatgtgaatccacaagccgtcaaggtccttaggaccgccgaattcgtgccttatgtagtgttcatcgaggcacccgactttgagacgctgcgtgctatgaaccgggctgcactcgaatcaggtatcagcactaaacagcttacagaagcagacttgcgccggactgtagaagagagttcgagaattcagcgtggctacgggcattactttgatctttgtcttgttaactcaaatttagaacgcacctttcgggaactgcagacagcaatggagaaactcagaaccgaaccgcaatgggtccctgtatcatgggtatattag

SEQ ID NO: 123955 - DNA, 96 bp, Artificial Sequence
  Description of Artificial Sequence: Synthetic coding sequence
atgcctgtcgcggccacgaattcagagacggccatgcaacaagtccttgacaatctcggatcgctcccatcagctaccggagccgcagaactgtag

SEQ ID NO: 123956 - DNA, 456 bp, Artificial Sequence
  Description of Artificial Sequence: Synthetic coding sequence
atgccggtggcggcgaccaactcagaaactgctatgcagcaggtgctagacaatctgggctctcttccttcagcaaccggcgcagccgaattagacctcatctttcttagaggtatcatggagagtcccatcgtaagatctctagcaaaggcccacgaaagattggaggaaaccaagcttgaagccgtgagggataacaacttagaactagtgcaagagatcctccgagacctggctcacgttgctgagcagtcttccaccgccgcagaactggcccacatcctgcaagagcctcattttcagagtctgcttgaaacccacgactcagtggcgtctaagacttacgaaacgccccctccctcccccgggcttgatcccaccttttctaatcaacccgtgccacctgatgctgtgcgaatggttggcatccgtaaaacagctggggagcatctgtag

SEQ ID NO: 123957 - DNA, 381 bp, Artificial Sequence
  Description of Artificial Sequence: Synthetic coding sequence
atgcccgtggctgcaactaacagcgagacagccatgcaacaagttctagataacctaggcagcctgccctcagccaccggagcagccgaactggaccttatcttcctgaggggaatcatggagtctccgattgtccggagcctcgctaaggcacacgaaagactcgaggagaccaaactggaggccgtgcgagataacaacctggagctcgtgcaggagattctgcgcgacttggcgcatgttgcggagcagagctcaaccgctgctgagttagcccatattcttcaggaacctcattttcagtcactcttagagactcacgacagcgtggcaagcaagacttacgagacgcctcccccctcgccaggccttgatccgtag

SEQ ID NO: 123958 - DNA, 222 bp, Artificial Sequence
  Description of Artificial Sequence: Synthetic coding sequence
atgccagtggcagccactaatagtgaaacggctatgcagcaggtccttgacaacctcgggtctttgccaagtgctaccggtgcagccgaactcgatctgattttccttcggggaattatggagtccccaattgtgcggtcactggctaaagcacacgaacggcttgaggagacaaaactggaggcggtgcgggacaacaacttagaactggtccaagaatag

SEQ ID NO: 123959 - DNA, 447 bp, Artificial Sequence
  Description of Artificial Sequence: Synthetic coding sequence
atgcccgtcgccgcaacaaacagcgagactgctatgcagcaagtgctcgacaacttgggttccctgccttcagctaccggcgctgcagaacttgacctcatttttcttcgaggtataatggagtctcccatagtcaggtctctcgcaaaagcacatgagagactggaagagaccaagctggaggctgttagagataacaacctggagcttgtgcaggagattctgagggacctagcacacgtggccgagcagagctcaacagcagctgaactggcccacatactccaggaaccacatttccagtccttgcttgagacacatgattcagtggcatcaaagacgtacgaaactcctccccctagccctggattggaccctacctttagtaaccaaccagtgccaccagatgctgtacggatggttggcatcaggaagactgcaggttag

SEQ ID NO: 123960 - DNA, 1626 bp, Artificial Sequence
  Description of Artificial Sequence: Synthetic coding sequence
atgcagcaggtattggacaaccttggaagcctcccatctgccacaggagccgccgagctggatctgatcttcctgagggggattatggagtccccaatcgtgcgatctctggcgaaagctcacgagcgattggaagaaacaaagctggaagcagtcagagataacaatctggaactggttcaggagattctccgcgatctcgcccatgtcgcagaacaatccagcaccgccgcggagctggcccatatcctgcaggaacctcacttccaaagcttgctggagacccatgactctgttgcctcgaaaacttacgaaacccccccaccttctcccggactggatcccacattctctaaccagcccgtgcctccggacgccgtgcggatggtaggtatcaggaagaccgccggtgaacatttgggcgtcacctttcgcgtggaggggggggagctcgtgatagctcgcatcctgcacggcggcatggtggcccagcaggggcttctgcacgtgggggacatcattaaagaggtaaatggacagccagttggaagtgatcctcgagccctccaagagctgcttcggaatgcgtctggctctgtcatattaaagattctgcccagctaccaggaaccgcatttacctagacaggtattcgttaaatgccactttgactacgatcccgctagagacagtctcatcccgtgtaaggaggctggcttacgctttaatgcaggtgatcttttgcagatcgtcaaccaggacgacgccaactggtggcaggcttgccatgtggagggaggctccgcaggtctgatcccatcacagctattagaagaaaagagaaaggccttcgttaagcgcgatctcgaacttacgcccaacagcggtaccctctgtgggagcctctctggaaagaagaaaaagaggatgatgtatcttaccaccaagaacgccgaatttgacaggcatgaacttctcatctacgaggaggtggctcgcatgcccccattccggcgtaagaccctggtcctgattggagcccagggagtgggacggcggagcctgaagaacaagttaatcatgtgggatcccgatcgctacggaactaccgtcccctacacaagcagacggccgaaagatagtgaacgcgaaggccaggggtacagctttgtgtccaggggggagatggaggccgacgtgcgtgccggccggtatctcgagcatggagagtacgaaggcaatctgtacgggacgcgcatagactccatccggggcgtggtcgcagctggtaaggtgtgcgtgcttgacgtgaaccctcaggccgtaaaggtcctacggacagctgagttcgtgccatatgtagtcttcattgaggcgcctgatttcgagaccttgagggcaatgaatcgtgcagctcttgaaagtggaatttcaaccaagcagttgactgaggccgatctgagaaggaccgtcgaggaatcaagtcggattcagagaggctatggccactactttgacctctgcctcgtaaacagcaacctggagcggaccttccgcgaactgcagacagccatggagaagctgcggactgagccacagtgggtgcctgtgagctgggtgtactag

SEQ ID NO: 123961 - DNA, 1167 bp, Artificial Sequence
  Description of Artificial Sequence: Synthetic coding sequence
atggaacttcagtacccacccccaccgccgagccctcgcatttgccgggaaaggtctggaggtgataacgcatctatgccagttctgagcgaagactcaggactccatgaaaccctggcgctgctaacaagccaactgcgccctgacagcaaccataaagaggaaatgggctttctcagagacgtcttttcggagaaatccctctcgtacctgatgaaaattcacgaaaagctccgttactatgagcggcaatcccctacaccagtgctccatagcgccgtggctttggccgaagatgttatggaggagctccaggcggcctcggttcattcagacgagcgtgaactgcttcagctattatcgaccccacatctacgggccgtactgatggtccacgatactgtagctcagaagaacttcgacccagttctacctcccctgcctgacaatatcgacgaagacttcgacgaagagtcagtaaaaatcgtgaggttagtgaaaaacaaagagcccttgggcgccactattagaagggacgaacactcaggcgcggttgtggtcgcacggatcatgcgtggcggtgcggccgatagaagtggactggtgcacgtgggcgacgaactacgcgaagtcaacgggatagcagtgctgcacaagcgaccggatgaaatctcccaaatcctggcccagtcgcaaggatccatcacccttaaaataattcccgccacgcaagaggaggaccgcttaaaagagtcgaaggtcttcatgagagctttatttcactataatcctagggaggatcgtgccataccctgccaagaggcaggacttccctttcagcggcggcaagtgttggaagtggtgagccaagatgaccccacctggtggcaggctaagcgcgttggcgacaccaacctaagagctgggcttatcccatctaaaggatttcaagagcgcagactcagctaccgtcgtgcctatggaactcccatttctccacagtttagccagcccaagcaagagctgtcgctgccaaggcattgggcgcccacccagcttttaccgtcatgtggagcccattgccccggaggaaagggcacccatacgccgaccctgatccccattctgctgagtcctagtctccaactcgaattcatccaatattag

SEQ ID NO: 123962 - DNA, 1758 bp, Artificial Sequence
  Description of Artificial Sequence: Synthetic coding sequence
atgccagtgctgagcgaggactccggactccatgagacactggccctgttaacatcacagctcagacccgatagcaaccacaaggaggaaatgggttttttgagggatgtgttctcggaaaagtcattgtcgtatctgatgaagatccacgaaaaacttcggtactatgagcggcagtctccaactcccgtcctgcactcagccgtggccctcgccgaagatgtaatggaggagttacaagctgccagtgtgcactcagacgagcgagagctcctgcagctgctctcgacgccccacctgcgtgcagtcctcatggtgcacgacacggttgcacaaaagaattttgatccagtcctgcccccgctacctgataacatcgatgaagattttgatgaggaatcagtgaaaatcgttaggttggtgaaaaataaggagccacttggcgccacgatacgcagagacgagcattccggagccgttgtggtcgctcgcatcatgagaggaggcgctgccgacagatctggccttgtacatgtgggcgacgaattacgcgaagtcaatggcattgccgtgcttcataagcgcccagacgagatttcgcagattcttgctcagtcccaaggtagtatcactctgaaaatcatccccgctacacaggaagaagatcggctcaaggagtccaaagtattcatgcgcgcactgttccactataatcctagggaagacagggcaattccatgtcaagaggctggcctccccttccagcgacggcaagtgctcgaggtggtgtctcaggacgacccaacctggtggcaggctaaacgagtgggggataccaacctgcgggcaggactgattccgtctaaaggcttccaggaacgacggctcagctacagacgagcggctggtaccctcccatcaccacagtcgctgaggaaacccccttatgaccagccttgtgataaagagacgtgtgattgtgaagggtaccttaaggggcattatgtagcaggcttgagaagatccttccggctgggttgcagagagcgactgggtggctcacaggagggaaagatgtcttcgggagccgagagccctgagttattgacttatgaggaagtagcaagatatcaacaccaaccgggggagaggcctaggttggtagtcctaataggcagcctgggagcacgactccatgagcttaaacaaaaagttgtggccgagaatccccaacattttggtgtcgctgtgccacacacgacacgaccaaggaagtcgcacgaaaaggaaggcgtggaataccatttcgtgagtaagcaggcatttgaagccgacttgcaccacaataaatttttggagcatggagaatataaagaaaacctgtacgggactagtctggaggccatccaagccgtcatggccaagaacaaagtttgcctcgtggacgtggagcccgaggccttgaagcagctgcgaacaagcgaattcaaaccttacatcattttcgtgaagcctgccatccaggaaaagagaaagaccccccctatgagccctgcctgtgaagacaccgctgcccctttcgatgagcagcagcaggaaatggcggccagcgccgccttcattgaccggcactatggccacttggtggacgcagtgctggttaaggaagatctacagggagcttactcccagctcaaagtggttctggaaaaactgagcaaagacacccattgggttcctgttagctgggtcagatag

SEQ ID NO: 123963 - DNA, 1833 bp, Artificial Sequence
  Description of Artificial Sequence: Synthetic coding sequence
atggaattgcagtacccccctccacctccctccccccgcatatgcagggaaaggtctggaggcgataacgcaagcatgccagttttgagcgaggacagcggcctgcacgagactctggccttactcacttcacaactaagaccagactctaatcataaggaagagatgggattcctgcgcgacgtgttctcagagaaatctctgtcttaccttatgaagattcatgaaaagctgagatactatgaaagacagagccccaccccggtgctgcactcagcggttgctctggccgaggatgtaatggaagaacttcaagctgcctccgtgcatagtgacgagcgtgagctgctgcagttgctgagcacccctcacctgagggccgtgcttatggtgcacgatacggtcgcccagaagaacttcgacccggtcctaccacccctcccagataatatagatgaagattttgatgaagagagcgttaaaatagtacggctagtgaagaataaggaacccttgggcgccactatccggcgcgatgaacactccggggctgtggtcgtagccaggatcatgcgaggcggcgccgccgaccgcagtgggctcgtgcacgtgggcgacgagcttcgcgaggtgaacggcatcgcggtcctccataaacggcctgacgaaatctctcagatcctcgcccaatcacagggatccatcacattaaagattattcctgctacacaggaagaagatcgcctcaaagaatcgaaggtctttatgcgggccctgttccactacaatccacgagaggatagggccataccttgtcaggaggccggtctccccttccagcggcggcaggtcttagaggtcgtgtcacaggacgacccgacatggtggcaagcgaaacgggttggagacaccaacctccgggcgggcctgattccctctaaaggatttcaggaacggcgactaagctacagaagggcagctggcactctgcctagtcctcagtcacttcggaaaccaccctacgatcagccctgcgataaagaaacgtgtgactgtgaggggtatctgaaaggccactatgtcgctgggctgcgaagaagctttaggctcggctgtagagagcgcctggggggttcacaagagggtaagatgagctccggggccgaatccccggagttgctgacttacgaagaagtggcgaggtatcagcaccaacccggcgagagacctcggctggtcgttctgatcggaagcctgggagcaagactgcatgaacttaagcagaaggtagtggccgagaacccccagcacttcggagtggccgttccccatacaacacggcctcgcaagagtcacgagaaggaaggagtggagtatcacttcgtctccaagcaggctttcgaggctgacctccaccacaacaagttcctagagcatggcgagtacaaggagaacctttacggtacttctcttgaagctattcaggctgtaatggctaagaacaaagtatgtctggtggacgtcgaaccagaggcactgaagcagcttcgaacctccgaatttaagccgtatattatcttcgtgaagccggccatccaggagaaacgaaagacgcccccaatgtcgccagcctgtgaggataccgcagcacctttcgacgaacagcagcaggaaatggccgcctctgccgctttcatcgatagacactacggccatctcgtagatgctgtgttagtaaaagaagacctgcagggggcatattctcaattgaaggtggtgctcgagaaactctcaaaagatactcattgggtgcccgtaagctgggtgagatag

SEQ ID NO: 123964 - DNA, 1782 bp, Artificial Sequence
  Description of Artificial Sequence: Synthetic coding sequence
atgatccagtctgacaaaggtgccgatccacccgataaaaaagacatgaaactgtcgaccgctaccaacccacaaaatggtctctcgcagatcctcagactagttctccaggagctgtcactgttttatgggagggacgtgaatggtgtgtgcctgctctatgatttgcttcattccccgtggctgcaggctctactgaagatctatgattgcttgcaggagttcaaggaaaagaaattagtacctgcaacaccccacgcccaggtactgagttatgaggtagtggagcttctcagagaaacccctacctcccccgagattcaggagcttcgccagatgctccaggccccacactttaaggccctgctgagcgctcatgacaccatcgcacagaaggactttgaaccactgctcccgccccttccagataacatcccagaaagtgaagaggccatgaggatcgtgtgcttggtcaagaatcagcagcccctgggagcaacaattaagcgacacgaaatgaccggagacatactagtcgcacgcattatccacggggggctcgctgaacgctctggattactgtacgcaggagacaagcttgtcgaggttaatggagtttccgtagaaggcctggatcctgagcaggtcattcatatcctggcgatgagtcggggcacgattatgtttaaagtggttcctgtatcggatcctcccgtgaactcacagcaaatggaccctgatattccatgcatggatgccggcttgccattccagaagggggacattcttcagatcgtcgaccaaaacgatgctttgtggtggcaggctcgcaaaatatccgatcccgccacctgcgctggactggtcccttcgaaccatctgctgaagcgaaaacagagagagttctggtggagtcagccatatcagccccatacatgcctcaagtcaaccctctataaggaggagttcgtcgggtatggacagaaattttttatagctggatttaggcggtctatgcggctgtgccggcggaagtctcacttgtcccccttgcatgcttcagtttgctgcactgggagctgctactctgccgtgggggcaccctacgaggaagtggtgaggtatcaacgtaggccctccgacaagtatcgactgatcgtgttgatggggccttctggcgtgggcgtgaatgagttgcgccgccagctgattgagttcaacccttctcacttccagagcgcagttccacatactacccgcacaaaaaaaagctatgagatgaatggaagagagtaccactatgtctctaaggaaacctttgagaacttgatttatagtcatcgcatgttagaatatggtgaatataaaggccacctgtatggcacaagcgtcgatgctgtccagacagttctcgtcgagggcaaaatctgcgttatggatctggaacctcaagacatacaaggtgtgcgtacccacgagttaaaaccgtacgtgatctttattaagccttctaatatgcggtgtatgaagcagagcaggaagaatgccaaggtcattactgattattatgtggatatgaagtttaaagatgaggacctccaggaaatggaaaaccttgctcagagaatggaaactcagttcggccagttcttcgaccatgttattgtgaacgacagcctccatgacgcgtgtgcacagttgctctctgctatccagaaggctcaggaggaacctcagtgggttccagccacttggattagttccgatacagagtctcagtag

SEQ ID NO: 123965 - DNA, 1809 bp, Artificial Sequence
  Description of Artificial Sequence: Synthetic coding sequence
atgattcagagtgataaaggggctgatccgcctgacaaaaaggacatgaaattgtcaaccgcaacaaacccccaaaacggcttatcacagatcttgagactcgttcttcaggaactgtctctgttctatggcagggatgtgaacggcgtatgcctcctttacgacctgctacattcgccttggcttcaggcgctactcaagatttatgattgtctgcaggagtttaaggaaaaaaaactggtcccagcgactcctcatgctcaagtattaagttatgaggtggtggaacttctgcgagaaaccccaacctctcccgagatacaagagctcaggcagatgcttcaagcgccccattttaaaggagccacaataaagagacacgagatgaccggcgacattctggtggctaggatcattcatggtggactagccgagaggtctggcctgctatatgctggtgacaagttggttgaggttaatggcgtgtctgtggaaggtctcgaccccgagcaggtgatacatatactcgccatgagccgagggaccattatgttcaaggtggtgcccgtgtctgaccctcctgtgaatagccagcaaatggtttacgtgagagcaatgacggagtactggccacaggaggacccagatatcccatgcatggacgccggtctcccctttcagaaaggggatattctccagatcgtcgaccagaatgacgcgctctggtggcaggccagaaaaatctcggaccctgctacgtgcgccgggcttgtgccgtcaaaccacttgttaaagcggtggtccttcgcccttgtggcacaggcgggagtgcaatggcattacttagattccctccaacccctccccccagggttcaagcggttctcgtgtctgtccctgcctcgatcatgggactatattgaggacgatatgaaaattgatgaaaaatgcgtggaagctgagaaagagagtattgagaccgacaaggaagagttcgtgggttatgggcagaagtttttcattgcgggctttcgccgctccatgcggctctgccggcggaaatcccacctgagtcccctgcacgccagcgtgtgctgtaccggtagctgctacagtgccgtgggcgccccttatgaagaggtggtccgataccaaaggcgtcctagtgacaagtaccgcctaatagtactgatgggaccatccggagtgggtgtcaatgagctcaggagacagttaatcgagtttaacccatcccacttccagtctgccgtcccccataccacccgcaccaagaaatcttacgaaatgaatggcagggagtaccactacgtctccaaagaaacatttgaaaacctaatctactcacacagaatgctagagtatggggagtacaaggggcatctatacggaaccagtgtggatgcagttcagaccgttctggttgagggcaagatttgcgtgatggatcttgagcctcaggacatccagggcgttagaacacacgagctgaagccctatgtcatctttatcaagccaagcaacatgcgttgtatgaagcagagtcgaaaaaatgcaaaggtgattacagactactacgtcgatatgaaatttaaagatgaggatctccaggaaatggagaatctggcccagaggatggagacgcagtttgggcagttctttgatcacgtgattgttaatgattccctccacgacgcctgtgcgcagctcctgagtgccattcagaaggcacaggaagagccccaatgggtccccgccacatggatcagctccgataccgagtcccagtag

SEQ ID NO: 123966 - DNA, 1914 bp, Artificial Sequence
  Description of Artificial Sequence: Synthetic coding sequence
atgatccagtccgacaaaggcgccgatcctcctgacaagaaagacatgaagctgtcgactgctaccaatccccaaaatgggctcagtcagattttacgactagtactgcaagaactctctctgttttatggccgggacgtgaacggcgtttgcctcctctacgatttgctccacagcccctggctgcaggccttacttaaaatttatgactgtcttcaggagtttaaagagaaaaaattggtccccgctaccccacacgcacaggtgctttcctacgaggtggtagagcttctgagagaaaccccaacgagcccagagatccaggaactcaggcagatgctgcaggccccacatttcaaggctctcctcagtgctcacgacacaattgcccaaaaagatttcgaaccacttcttccaccactcccagataatatcccggagtcagaagaagcaatgagaatcgtatgtcttgtcaagaatcaacagccactgggcgcgactataaagcgccatgaaatgaccggcgatattctggtggcacgcataattcatggcgggcttgcggagcgatcaggtcttttgtatgctggagataagctcgtggaggtgaatggggtgtctgtggaggggctggaccccgaacaagtgattcacatactggcgatgtcccgcggaactataatgttcaaagtggtgccagtgagcgatccgcccgtgaactcacagcaaatggtgtatgttcgagccatgactgaatactggccacaggaggaccccgacattccttgtatggatgcagggctgcctttccaaaaaggagacattctgcaaatcgtcgaccaaaatgatgcactgtggtggcaggcaaggaaaatctctgatcccgccacctgtgccggactcgtgccctcgaatcatctcttgaagagaaagcaacgagaattctggtggtcccagccttaccagcctcatacctgtctgaagagtaccctgtcaatttcgctgaaaggcgaagacgatatgaaaattgacgagaaatgcgtcgaagccgagaattcaacagccgagagcgaggagctaaacagtgacaaagaagagttcgtgggctacggccagaagttcttcatcgctgggtttagacggtcaatgaggctctgccgacgtaagagtcacctgtctcccctgcacgccagcgtgtgttgtacaggctcctgctacagtgcagtgggagccccctacgaagaggtggtacgttaccagcggaggcccagtgataaatatcgcctgatagttctcatgggcccctccggagtgggcgtgaacgagctgcggaggcaactgattgaatttaacccttctcactttcagagtgccgtcccacacacaaccagaacaaaaaaatcatatgagatgaatggccgcgagtaccactatgtgagtaaagagacttttgagaacttaatttattcccacaggatgttagaatacggagagtacaagggtcatttgtatggaacgtccgtagacgcggtacagaccgtcctggttgagggtaagatttgtgtcatggatctagaacctcaggatatacagggggtgcgtacacatgaattaaagccctatgttattttcatcaagcctagcaacatgagatgtatgaagcagagtagaaagaacgctaaggttatcaccgattattatgtggacatgaaattcaaagatgaggacttacaagaaatggagaatctggcccagcggatggagactcagttcggccaatttttcgaccatgtgattgttaatgactcactgcacgacgcatgcgcgcagctgttgagcgctatccagaaagcacaagaggaaccgcagtgggttcctgctacgtggatcagtagtgataccgaaagccagtag

SEQ ID NO: 123967 - DNA, 1701 bp, Artificial Sequence
  Description of Artificial Sequence: Synthetic coding sequence
atgattcagtccgacaagggcgccgacccacccgataagaaggacatgaagcttagtaccgccaccaatccgcagaatggcctaagtcaaattctgcgattggtgttgcaggaactgtccctcttttacggccgggatgtgaatggggtgtgcctcctatacgaccttctgcattccccttggttacaggccctcctcaaaatttacgactgcctgcaggagttcaaagagaaaaaactcgtgcccgcaactccccatgcacaggtcctgtcctatgagggggccacaatcaaacgtcacgaaatgacaggcgatatactcgtagctcggattattcatggaggactggctgagcgatccgggctcctttacgcaggcgacaagctggtggaggtaaacggagtgtctgtggaagggctcgatcctgagcaagtgattcacattctggcaatgtctagaggcaccattatgttcaaagtcgtgccagtgtccgacccccccgttaactcacagcagatggtgtacgtgagagctatgacagaatattggccgcaggaagaccctgacatcccatgcatggatgccggcctgccgtttcagaaaggggacattctacagattgtcgaccagaacgatgcattgtggtggcaagctagaaagattagcgacccggcgacttgtgctggactggttccctcaaaccacttgctcaagcgcaaacagagagaattctggtggagtcagccataccagccacacacttgtctcaaaagcactctctcaatctcactgaaaggcgaagacgatatgaagattgacgaaaaatgcgtggaggcggagaatagcaccgccgagagcgaggagctcaatagcgataaggaagagtttgtgggatatggacaaaaattcttcatagcaggctttcggcggagcatgcgactgtgccggaggaagtctcacctgagtccccttcacgccagtgtatgctgcactggctcctgttattccgcagtaggcgctccctacgaggaggttgtgagataccaacgtcgccccagcgataaatatcgactgatcgtgctgatggggccaagtggcgttggagtgaacgagctgcggcgtcagctcattgagtttaatccatcccactttcagagcgcagtgccacatactaccaggacaaagaaatcatacgagatgaacggaagggaataccactacgtctctaaagaaaccttcgagaacttgatatattcccaccggatgctcgaatacggtgaatacaagggccatttgtatggaacatctgtggacgccgttcaaacagtccttgtggaaggtaaaatatgtgtgatggacctggagccccaggacatccaaggggtcaggacccacgagctgaaaccttatgtgatatttatcaaaccctcgaatatgcggtgtatgaagcagagccgcaagaatgccaaagtgatcacagattactacgtggacatgaagtttaaagacgaggatctccaagagatggaaaatttagcgcagcgcatggagacacagttcggccaattctttgatcacgttattgtgaacgatagtctgcacgatgcatgcgcgcagctgcttagcgccatccagaaggcacaggaggagcctcagtgggttcccgctacttggatctcctctgacaccgagagccagtag

SEQ ID NO: 123968 - DNA, 1914 bp, Artificial Sequence
  Description of Artificial Sequence: Synthetic coding sequence
atgattcagtctgacaagggggctgacccaccggacaaaaaagacatgaaactgtcaaccgcaactaacccccagaatggtctttcacagatccttcgcctggttctccaagagctgtcgttgttctatgggcgcgacgttaacggggtgtgcctcctgtacgacctgctacactcaccatggttgcaggccctccttaaaatttacgattgcctacaggagttcaaagaaaagaagttagtgcccgctacgccccatgctcaggtgctaagctacgaagtcgtagagctgctgagagagactccaactagccccgaaattcaggaactacgtcagatgctccaggccccacactttaaggctctgttgagcgcccatgacactatcgcacagaaggatttcgagccgctcctgccacctctccccgacaacatccctgagagcgaggaagctatgagaatcgtatgtttagtgaaaaaccagcagcctctgggagctacaattaagcggcatgaaatgaccggcgacatactagtggcccggattatccacggaggtctggctgagcggtctggcctgctctacgcgggcgacaaactcgtggaggtgaatggtgtctcggtggaaggtctcgatcctgagcaggtaatacatattctggccatgagccggggcacgattatgttcaaggtcgtcccagtgagtgatccgccagtgaattcgcagcaaatggtctacgttcgcgctatgaccgaatactggcctcaggaggaccctgatatcccttgtatggatgctggcttgccctttcagaagggagacattctgcagattgtggatcagaatgacgcgctgtggtggcaggcacgaaaaatttcagacccagccacctgtgcaggtctggttccctcaaaccacctgctaaagcgcaaacagcgggagttctggtggtctcaaccttatcaaccgcatacatgtctgaaatccaccctttctatcagtatggaggaagaagacgacatgaagattgatgaaaagtgcgttgaggccgacgaggagacattcgaaagcgaggagttgagcgaagacaaggaggagttcgtgggttatggccagaagttctttatcgccggattccgtcgctctatgagattatgccgccgaaaaagccacctgtcacccctccacgcaagcgtctgttgcactggtagctgctatagcgctgtaggcgccccgtatgaagaagtggtgaggtaccagcgcaggccatcagacaaatatagacttatcgtactcatgggtccctcgggcgtgggcgtcaatgaactgagaaggcagctgatcgagtttaatccttcccacttccagagcgccgtgccccacaccacccggacaaaaaagagttacgagatgaacggtagggaataccattacgtatccaaagaaaccttcgaaaatctcatttactcccatagaatgctggagtatggggagtacaaaggccacctctatgggacttcggtggatgccgttcagactgtgctcgtggaaggaaagatctgtgtgatggacctcgagccacaggatatccagggcgtgcgaacccacgagttgaagccctacgttatctttattaaaccctccaatatgaggtgtatgaagcagtcccgcaaaaacgccaaggtgatcactgactactacgttgatatgaagttcaaggatgaggatctccaggagatggaaaacttagctcagagaatggagacgcaatttggccagtttttcgatcatgtgattgtgaatgactctctgcacgacgcttgtgctcagctgctgtcggccatccagaaggcacaggaagagccacagtgggttcccgcgacttggatctcctcagacacggaaagccaatag

SEQ ID NO: 123969 - DNA, 2028 bp, Artificial Sequence
  Description of Artificial Sequence: Synthetic coding sequence
atgaccacttctcacatgaatggccacgttaccgaagagagcgattcagaagtcaaaaacgtggacctggcttcgcctgaagagcatcagaagcatagagaaatggcagtggattgtcccggagatctcggcacgaggatgatgcccatacggcgcagtgcccaattggaacggatcaggcaacaacaggaggacatgcggaggcgacgcgaggaagagggtaagaagcaagaacttgacctaaatagttcaatgcgactgaagaaactcgcccagataccccctaaaaccggtatagacaacccaatgttcgatactgaggaggggatcgtgctcgaatcccctcactatgccgtcaagatcttggaaattgaagacctgttctcaagcctgaagcacatccagcacaccctagttgacagccagagccaggaggatatttctctgctgctgcagctggtacagaataaggatttccagaacgcttttaaaattcataacgcaattaccgttcatatgaataaagcctccccccccttcccactcatttccaacgcacaggatctggcacaggaggtgcagaccgtgctgaagcctgtccaccataaggaggggcaggaactcacagctttgctgaatacaccccatatccaggctctcctcctggctcacgataaagttgccgagcaagagatgcagctcgaacccatcaccgacgagagagtgtacgagtctatcggccagtatggtggggagactgtgaagatcgtcagaatcgagaaggctagggatatcccgctcggcgcgacagtgcgaaatgaaatggattctgtgatcatctcgcgcatcgtcaaggggggcgcagctgagaaatccggcctgctgcatgaaggtgatgaagttttagaaatcaatggtatagaaatccggggcaaagatgtgaatgaagtctttgatttgctgtctgacatgcatggaactttaacattcgtgctcattcccagccagcagattaagccgcccccggcaaaggagaccgtgattcatgtgaaggcacattttgactatgatccatcagatgacccatatgtgccatgtcgcgagctggggctgtcttttcagaaaggggatattctgcacgttatttcccaggaggatcccaattggtggcaggcatatagggagggagacgaggataatcagccgctggctggattggtcccgggaaaatcgttccagcagcagagggaggccatgaagcagactattgaggaggataaagagcccgaaaaatccgggaagctctggtgtgcgaaaaagaacaaaaagaagaggaagaaggtcctgtacaacgcaaacaaaaacgatgactacgacaatgaggaaatcctaacttacgaggaaatgtcactgtatcaccagcccgctaatagaaaaagaccaattattcttataggccctcagaactgtggtcaaaacgaacttcggcagaggttgatgaataaggagaaagatagatttgctagcgcagtgcctcataccaccagatcaagaagagaccaagaggtcgctggtcgcgactaccacttcgtcagtcgtcaggcttttgaagccgatatcgccgctggcaaattcatcgaacacggcgaatttgagaaaaacctgtacgggacctccattgatagcgtgaggcaggtcattaatagtggcaaaatatgcctcttgtctcttcggacccagtccctcaagaccctaagaaatagtgatttgaaaccgtacattatctttatcgcacccccatcgcaagagcggctgagagccctgttggcgaaagagggtaaaaacccaaagcctgaagagctgagagagatcatcgaaaaaacgagagagatggaacagaataatggacattatttcgacaccgctatagttaacagtgacctcgacaaggcatatcaggaacttttgcggttgatcaacaaactggacactgagccacagtgggtgccatcaacctggctgaggtag

SEQ ID NO: 123970 - DNA, 1926 bp, Artificial Sequence
  Description of Artificial Sequence: Synthetic coding sequence
atggccgtggactgtcctggggatctggggaccagaatgatgcctatccgcaggtcagcgcagctggaacgaattcggcagcagcaggaggacatgaggagaagaagggaggaagagggtaagaagcaggagctggacttgaactcttctatgcggttaaaaaaactggcccagattccgccgaagactggcatcgacaatcctatgtttgacacagaagaaggcatcgttctggaatctccacattatgctgtcaagatccttgaaatcgaagacctttttagctcacttaaacatatccagcacacgttagtggattcacaaagccaggaagacatctccttgctcctccagctggtgcagaacaaggacttccaaaacgcattcaaaatccataatgccatcaccgtgcacatgaacaaagccagcccccctttccctctgataagcaatgctcaagacctggctcaggaagtgcaaacagttctgaaacccgtgcaccacaaggagggccaagagctgactgcacttttaaatactccacatattcaagctctcctattggctcatgataaggtcgctgagcaggagatgcagcttgagccaattaccgatgagagggtttatgaatctataggtcagtatggaggcgaaaccgtgaagattgttcgcattgagaaggcaagagacattcctctaggcgcaaccgtcaggaacgaaatggactctgtgatcatcagtcgcattgtgaaaggaggagcggcggagaagtctggtttactgcacgagggggacgaggttctggaaatcaacggcatcgaaattcgcggaaaagacgtgaatgaagtgttcgacctcctcagtgacatgcacggaacactgacatttgtgcttatacctagccagcagatcaagccaccccctgcaaaggagacggtgattcacgtcaaagcccactttgactatgaccctagcgacgacccatatgtgccttgcagggaattggggttgagcttccagaagggcgacatcctccatgtcatttctcaggaagatccgaactggtggcaggcttatagagaaggagatgaagataaccagcccctcgcgggcctggtgccagggaaatcctttcagcagcagagggaggccatgaagcagacaatcgaggaggataaggagcctgagaaatcggggaagctctggtgcgccaagaaaaataagaaaaaaagaaaaaaggtgctatacaacgctaacaaaaacgacgactatgataatgaggagatcctgacatacgaggagatgtctctctaccaccagccggctaacaggaagaggccaataatcctgatcggaccgcagaattgtggacagaatgagctccgccagaggcttatgaacaaagagaaagatcgtttcgcgagcgctgtgcctcacactaccagatcccgccgtgatcaggaggtggctgggagagattatcactttgtgagccgccaggcctttgaggcagatatcgctgctggcaagtttatcgaacatggggagtttgagaagaacctgtacggaacatcaatcgatagcgtgcggcaggtgattaattctggaaagatctgcctgttgtcactgcgcacccagagtctcaagacactgagaaattcggacctaaagccctacattatcttcattgcaccaccatcccaggaaaggttgagggccctgctggccaaggaggggaagaaccctaagcccgaagagcttagggaaataatagagaaaactcgtgagatggagcagaacaacggccattatttcgatacggcaatagtcaacagcgacttggacaaggcctaccaggaactgctgcgcctgatcaacaaacttgacactgaacctcagtgggtgccatccacatggctgagatag

SEQ ID NO: 123971 - DNA, 15 bp, Artificial Sequence
  Description of Artificial Sequence: Synthetic coding sequence
atggcagtggactag

SEQ ID NO: 123972 - DNA, 450 bp, Artificial Sequence
  Description of Artificial Sequence: Synthetic coding sequence
atggctgtggactgtccgggcgacctaggcacgaggatgatgcccattcgcagaagcgctcaactggagaggatcaggcagcaacaagaggacatgcgtagaaggagggaggaggagggaaagaaacaagagcttgacctgaactcttctatgcgacttaaaaaactggctcagattcctccaaagacaggcatcgacaacccaatgtttgacacagaggagggcattgtccttgagtccccccattatgccgttaagatactggagatcgaagacctctttagcagcttaaaacacatccaacacacactggtggattcgcagtcccaggaggacatttctctgctactccagttggtccagaacaaagatttccagaacgcctttaaaatccacaacgctatcacagtgcatatgaataaagcttctcccccatttccactaatttag

SEQ ID NO: 123973 - DNA, 870 bp, Artificial Sequence
  Description of Artificial Sequence: Synthetic coding sequence
atgacaggcgttttcgatagacgggtgccttctataagatccggcgatttccaggcccctttccagacttctgcagccatgcaccacccaagccaggagtcacctaccctgccagagagctctgctactgacagtgactattactcccccactggcggggctcctcatggatactgcagcccgacctcggccagctacggcaaggcacttaacccttaccagtatcagtaccacggcgtgaatggctctgccggttcctatcccgccaaggcgtacgcggactattcatatgcgagttcataccatcagtatggtggagcctataatcgtgttccgagcgctaccaatcagcctgaaaaggaagttacagagccagaggtgagaatggttaacgggaagcccaagaaggtgaggaagcctcgaacaatttattctagctttcagttagccgctttgcaacgcagattccagaagacacagtatctggcactgccggagagggcagagctggcagcaagtttgggtctgacacagacccaggtgaagatctggtttcagaataagaggtcaaagataaaaaagattatgaagaacggcgagatgccccctgaacactcccccagttcttctgatcccatggcctgtaatagcccgcaatctcccgctgtgtgggaaccacagggctccagtcgctccctcagtcaccaccctcacgcccatccgcctacaagtaatcagtctcccgcttctagttatctggaaaactcagcttcttggtacacttctgctgcctcttcaataaactcccatctccccccaccggggtctttgcagcatccattagccctggcctcaggaactctctactag

SEQ ID NO: 123974 - DNA, 1623 bp, Artificial Sequence
  Description of Artificial Sequence: Synthetic coding sequence
atgcagcaggttctagaaaacctgaccgagctgccgtcttcgaccggggccgaggaaatcgatttaatttttttaaagggcataatggaaaacccgattgtaaaatctctggccaaagcccacgagaggcttgaggatagcaaacttgaagcggtgtctgacaacaacttagagctggtgaacgagatcctggaggatattactcccctcatcaacgtggacgaaaacgtggcagagctagttggaattctgaaagaaccgcatttccagagtctgctggaagctcatgacattgtggcatcaaaatgttacgacagtcctccctcaagccctgaaatgaacaatagttccattaataatcagcttctacccgtggatgccatccggatcttgggaatacacaaaagagctggcgagcccttaggagtgaccttccgggtggagaataatgacctggtaatcgcccggatcctccacggtggcatgattgatcgccagggattgctccacgtgggggacattatcaaggaagtgaacgggcacgaggttggaaacaatccgaaagagctgcaggaattgctcaagaatatcagtgggagtgtgacactcaaaatactcccatcctatcgcgacaccatcacccctcagcaggtgttcgtaaaatgtcactttgattacaacccctataatgataaccttatcccctgcaaggaagccgggctgaagttctccaagggcgaaattctacaaattgtgaatcgcgaggaccctaactggtggcaagcctcacacgtgaaagaagggggctctgcaggcttgatccctagccagtttctggaagagaagaggaaggccttcgtgcgaagagattgggacaattccggacctttttgcggcactatctccagcaaaaaaaagaagaagatgatgtacttaaccacaaggaatgctgagtttgatagacatgagattcaaatctacgaagaagtcgcaaagatgcccccttttcagcggaagacgctcgtcctgattggggcgcagggggtgggcaggagaagcttgaaaaaccgattcattgttttgaaccccaccagattcggtacgaccgtcccatttaccagccggaagccccgcgaggatgagaaagatggacaggcatataaattcgtgtctcgctcagaaatggaagccgatataaaggccggtaagtatctggagcatggagaatatgagggcaacctgtatggaacaaagattgatagcatcctcgaggttgtgcagactggaagaacatgtattctcgacgttaatccccaggccctgaaagtgttgaggacctctgagttcatgccgtacgtggtgtttatcgcggcccccgagctcgagactctccgggctatgcacaaggccgtggtcgacgctgggataacaactaagttgttgacggattcggatttaaaaaagactgtcgatgagtctgcacggatccagcgagcctataatcactacttcgatctcataattattaacgataatctggataaggccttcgaaaaattgcagaccgctatcgaaaaattgcgtatggagcctcaatgggttcccatttcttgggtctattag

SEQ ID NO: 123975 - DNA, 1287 bp, Artificial Sequence
  Description of Artificial Sequence: Synthetic coding sequence
atgaataactcatcaattaataaccaacttctccctgtcgatgcgattcgcattctgggcatccataagcgcgctggagagccgctgggggttacatttagggtcgagaataatgacctggtgattgctcggatcctgcatggcgggatgatcgaccggcaaggcctgttacatgtcggggatataatcaaggaagtcaacggtcatgaggtcggcaataatccgaaagaattacaagagctcctcaagaatatctctggatcagtgaccctcaagatcctcccatcatacagagacactatcactcctcagcaagtgtttgtgaagtgtcactttgattacaacccttataatgacaacctaattccatgtaaggaagccgggttgaagttctctaaaggggagatcctgcaaattgtgaatcgcgaagatcccaactggtggcaggcaagccacgtaaaagagggcgggtccgcaggtctcataccaagccagttcctggaagagaagagaaaagctttcgtaaggcgtgactgggataacagcgggcccttctgtggtaccattagctcaaagaagaaaaagaagatgatgtatcttacaacgcgcaatgccgaattcgatagacacgagatccaaatttatgaggaggtcgctaaaatgccccccttccagcggaagactctggtgctgattggggctcagggggtgggccggaggtcacttaagaataggtttatcgtgctgaaccctacaaggttcggcaccacagtcccttttaccagtagaaaaccccgggaggacgagaaggacggacaggcgtataagtttgtgtctaggtccgaaatggaggccgacatcaaggctgggaaatacctggagcatggagagtatgagggcaatctttatggaacaaaaatcgactctatcttggaggtggtgcaaacaggcagaacttgcattttggatgtgaatccccaggccctgaaggtgctccgaacctcagagttcatgccctatgtagtatttatagccgctccggaactggaaacgttgagggccatgcataaggcggtcgtcgacgctggcataaccactaaactgctgactgactccgatcttaaaaagactgtagacgaatctgctcgtatccagcgcgcgtataatcattatttcgacttgatcatcatcaacgacaatttggacaaggcatttgagaagctgcagacagcaatagaaaagttgcggatggaaccacaatgggtgccaatctcatgggtatactag

SEQ ID NO: 123976 - DNA, 924 bp, Artificial Sequence
  Description of Artificial Sequence: Synthetic coding sequence
atgcagcaggtattggagaacctgaccgagctcccctcatcgacaggcgcagaggaaattgatttaatatttctgaagggcatcatggaaaacccgatcgttaagtccctggctaaagcgcacgagcggctggaggattctaagctggaggccgtgagcgataacaatcttgaactggtgaacgagatccttgaggacataactccactgatcaacgtggatgagaatgtagcagagttggtgggaatcctcaaggaaccccactttcagagcctgctggaggcacacgatatcgtggcaagcaaatgttatgactcccccccctcctcacccgaaatgaacaatagcagcatcaataatcaacttctccctgttgatgccataagaattctggggatccataaacgcgcaggtgaaccgcttggagtgacgtttagagtggaaaacaacgacctcgtgatcgcccggatacttcatggaggcatgatcgacaggcagggccttcttcatgttggcgacattattaaagaagtgaacggtcatgaagtgggcaacaaccccaaggagctccaggagcttctcaagaatataagcgggagcgttaccctcaaaatcctcccatcttaccgggacacaatcacacctcaacaggtgtttgtaaaatgccatttcgattacaatccctataatgacaatttaattccttgcaaagaagcgggcctgaaattctcaaaaggcgagatactgcagattgtcaacagggaggatcccaactggtggcaggcatcccacgtaaaagagggaggctctgccggactgatccctagccaattcctcgaggagaagcgaaaggcttttgtacgtagggattgggacaatagtgggccattttgcggaacgatcagctctaagaaaaagaagtag

SEQ ID NO: 123977 - DNA, 654 bp, Artificial Sequence
  Description of Artificial Sequence: Synthetic coding sequence
atgcagcaagtgctagagaacttaactgagctgccttccagcaccggtgcggaagaaatagatctcatattcctcaaaggaattatggagaacccaattgtgaaaagccttgccaaagcccatgagcgtttggaagactccaagctcgaggctgtgtcagacaacaacctggaacttgtgaatgagattttggaagatatcaccccactcattaacgtcgatgagaacgtcgctgaactggtggggattctgaaggaaccacatttccagtctctgctggaggcccacgacatcgttgccagcaagtgttatgattccccccccagctcaccggaaatgaataattcctcgatcaataatcagttgctgccggtggatgccatccgaatcctgggcatccataaaagagcaggggaacccctaggcgtgacctttcgagtggagaataacgatcttgtcatcgcccgcattctgcacggcgggatgattgaccgccaagggctgctgcatgtcggcgatatcatcaaagaggttaatggccacgaagtgggaaataaccccaaggagctgcaggaactcctcaaaaatatcagcggtagcgtgactctgaaaatcctgccctcataccgagacacgatcacgccacagcagtag

SEQ ID NO: 123978 - DNA, 1731 bp, Artificial Sequence
  Description of Artificial Sequence: Synthetic coding sequence
atgcccgccctgtccacaggttcgggaagtgatacaggcctgtatgagctgctggcggccctgccagcccagctgcagccacacgtcgatagccaagaagatctcacgttcttgtgggacatgtttggcgaaaagtctctccactctctcgtcaagatccacgaaaagctgcattactacgaaaaacagagcccagtcccgattcttcatggcgccgctgccttagctgatgatctggccgaggaactccagaacaagccattgaactctgaaatccgagagctgcttaaactcctgagcaaacctaacgttaaagcactgctgtctgtacatgacacggtcgcccagaagaattacgaccctgtgctgcctcctatgcccgaggacatagacgacgaagaagactcggtaaagatcatcagactggtgaagaaccgggaacccctcggcgctacgatcaagaaggacgaacagactggagcgataatagtggcgcgcattatgaggggcggcgctgcagaccggagcggactgatacatgtgggcgacgagttgagggaggtgaacggtattccagtggaagacaagcgtcccgaggaaattatacagatacttgcccagagccaaggagctatcacgtttaaaattatcccagggtccaaggaggaaacacctagcaaggagggtaagatgtttatcaaggcccttttcgattacaacccgaacgaagacaaagctatcccttgtaaagaggccggtttgtccttcaagaagggagacattctgcagattatgagccaggacgacgctacctggtggcaggctaagcatgaggctgatgcgaaccctcgggccgggctcattccctccaagcactttcaggagaggagactagccctccgccgtccagaaatcctggtgcagcctctgaaggtctctaatcgaaaaagtagtggcttcagaaagagttttcggctcagccgtaaggataagaaaactaataaatccatgtatgagtgtaaaaagtccgatcaatacgataccgccgacgtgcccacttatgaagaagtgacgccttatcgcaggcagaccaatgaaaaatatcgtctagttgttttagtgggcccggtgggagtgggactaaatgaactgaagcgcaagctgctgatttcagacacccagcactatggagtgacagtcccgcacactactagagctcggagatcccaggaatccgacggggtggaatacatctttatctccaagcatctcttcgagactgatgtgcagaataacaagtttatcgagtatggtgagtacaaaaacaactactacggcaccagcattgacagcgtgcgttcagtgttggcgaaaaacaaggtatgcttgctagatgttcagcctcacaccgttaagcatcttcgtacccttgagtttaagccgtatgtcatttttatcaaacctccatcaatagagcgacttcgtgaaacacgcaagaatgccaagatcatctctagccgagatgatcagggggcagctaagcctttcactgaagaggattttcaggaaatgatcaaatctgcacagattatggagtcccagtacggccacctatttgacaaaataattattaatgacgacctcaccgttgcgttcaacgagctcaaaacaacctttgacaagctggagaccgagacacattgggtcccagtgagctggctgcattcgtag

SEQ ID NO: 123979 - DNA, 1731 bp, Artificial Sequence
  Description of Artificial Sequence: Synthetic coding sequence
atgcctgccctttcaaccggttctggctccgacaccggcctttacgagctgctggccgcgttacctgcccaactgcagcctcacgtggacagccaagaagatctcacattcctctgggatatgttcggagagaaatcacttcatagcttggtgaagatccatgagaagctgcactattatgagaagcagtccccggtgcctatactgcacggcgctgccgccctggccgacgacctcgcggaggaacttcagaataagcctctaaactccgagataagagaattactgaagttgctgtccaaacctaacgtaaaagctctcctatccgtgcacgacacggtcgcccagaaaaactatgaccctgtgcttcccccaatgcccgaagacatcgatgatgaagaagattcagtgaaaatcattagactggttaaaaatcgcgagcctcttggagcgaccatcaaaaaagatgagcagacaggcgcaattatcgtggcgcgcataatgagaggcggtgcagcagacagaagcggtctaatccacgttggggacgagctccgggaggtgaatgggattcctgtagaagacaagcgccctgaggaaatcattcaaattttggctcagagccaaggcgcaatcacgtttaagattatcccaggaagcaaggaggaaacccccagtaaagagggaaagatgttcatcaaagcactctttgactacaatccaaacgaggataaagctatcccatgtaaggaagcaggcttgtcatttaagaagggggatattctgcagatcatgagtcaggatgatgccacatggtggcaggctaagcatgaagcagatgccaacccgcgtgcggggctgattccatccaagcactttcaagaacgaagactagcgctgaggaggccagagattctagtacagccccttaaggtgagcaaccggaagtcatctggattcagaaaatctttccgtctgtcccgcaaagataagaaaacaaataagagcatgtacgaatgcaagaaaagtgatcagtatgatactgccgatgtaccaacctacgaagaggtaaccccctataggcggcagacaaacgaaaagtaccggctcgtcgtgctggttggtcccgtaggggttgggctgaacgagctgaagagaaaactgttgatcagtgacacccagcattatggtgtcacggtgccacacacaacgcgagcgcggcgaagtcaggagtccgacggagtggagtacattttcatctctaaacacctgtttgaaaccgatgtgcagaacaacaagtttatagagtacggggagtacaagaacaattattacgggacctccatcgacagtgtaagaagcgtactggcgaaaaacaaggtgtgtctgctcgatgtacaaccacacactgtcaagcatctgcgtactttagagtttaagccctatgtgatcttcataaagccgccaagcatcgaaagattaagagaaacaaggaaaaacgccaagatcatctcctcccgagatgaccagggagccgccaaacccttcaccgaagaggatttccaagaaatgataaagtcagctcagatcatggagtcgcagtacgggcacctgtttgacaagattattattaatgatgatctcactgtggcctttaatgagttgaaaacaacttttgataagctggaaacggaaacccactgggtgcccgtctcatggctgcactcatag

SEQ ID NO: 123980 - DNA, 1731 bp, Artificial Sequence
  Description of Artificial Sequence: Synthetic coding sequence
atgccagccctgtcaactggatctggatccgacaccggactctatgaactgttggccgcgctccccgctcagttacagccccacgtggactctcaggaggatctgacgtttctgtgggatatgttcggcgaaaaatctttgcactcgcttgttaaaatacacgaaaagctccactattatgaaaaacagagcccagtgcctatcctgcacggcgcggccgcactggccgacgatttagcggaggagctacaaaacaagcccctcaattcagaaatcagggaactactcaagcttctatccaagcctaacgtgaaagctctactgagcgtccatgataccgtcgcccaaaaaaactatgaccctgtactacctccaatgcctgaggatatcgatgacgaagaagactcagttaaaattatccggctggtcaagaaccgcgagcccctgggcgctaccatcaaaaaggatgagcaaaccggagccataatcgtagcgaggatcatgagaggcggtgccgcggatcggtccggcctcatacacgtgggagacgagctaagggaagtgaatggaattcccgtggaggacaagaggcctgaagagataattcagattctggcacaaagccagggagcaataacatttaaaatcattccaggatctaaggaagagactcccagtaaggagggaaagatgtttataaaagccctcttcgactacaatccaaatgaggacaaagccatcccatgcaaggaggctggcctcagttttaagaagggcgacatactgcagattatgtctcaggatgatgccacatggtggcaggctaagcacgaagccgatgccaatccgcgggcgggcctcattcctagtaagcatttccaagaacgccgcctagctctgcggagaccagagattttagtgcagcctctgaaagtgtctaacagaaagtcttctggttttcgtaaatcctttcgactgtcaaggaaagataagaagaccaataaatccatgtacgagtgtaaaaaatcggatcagtacgatacagccgacgttccgacatatgaggaagtgaccccttaccggagacagaccaacgagaaatacaggctggtcgtgcttgtcgggcccgtcggtgtcggtctcaatgaacttaaacgcaaattgctaatttcagacacccagcactacggagtcaccgtgccccacaccacccgagcgcgccgctcccaggaaagtgacggagtggagtatatctttattagcaagcacctatttgagacagacgtgcagaacaataagtttattgagtatggagagtacaagaataattattatggcaccagcatcgacagcgttcgcagtgtgcttgcaaagaataaggtgtgccttttagacgtacagccacacacggttaagcatcttcgaacactggagttcaagccgtacgtgatcttcatcaaaccaccaagcatagagcgcctgcgggagacaaggaagaacgctaagattatcagttctcgcgatgatcagggcgccgccaaaccttttacagaagaggacttccaagagatgattaagtccgcccagataatggagtctcagtatggtcatctctttgacaaaatcattattaacgacgacctcacggtcgccttcaatgagctcaaaaccacttttgataaacttgaaaccgagacccactgggtgcctgtatcttggctgcacagttag

SEQ ID NO: 123981 - DNA, 939 bp, Artificial Sequence
  Description of Artificial Sequence: Synthetic coding sequence
atgcccgctttgtccactggatctggcagcgataccgggctgtacgaactccttgcagctctgccagcccagcttcaaccgcatgtggattcacaggaggatctgacatttctgtgggacatgtttggagagaagtccctgcactctctcgttaaacactttcaggagagaaggctggccttgagaagaccagaaatcctggtgcagccgcttaaggtaagcaatcgcaagagcagcggcttcagaaaatcctttaggttaagtcgcaaagacaaaaaaacaaacaaaagtatgtatgagtgtaagaaatctgatcagtacgataccgcggatgttccgacctatgaagaggttactccgtatcgccgccagactaacgagaagtacaggctggtcgtgttagtggggccagtgggagtgggcttgaatgaactgaagcgtaaattgctgatctccgacacccaacactacggagtcactgtgccccatacaacaagggcacgccgaagccaggaatcggacggagtcgagtatatctttatctctaaacatctgttcgagacagatgtgcagaacaataaattcatagagtacggcgagtacaagaataattactacggtacaagcatcgatagtgtcagatctgtgttagcaaaaaataaagtatgccttttggatgtgcaacctcacacagtcaagcatctccgtacattggaatttaagccgtatgtaatttttattaagccgccctcaatagaacgcctccgcgagaccagaaaaaacgctaagattatatcctcgcgcgacgatcagggggccgcgaagccctttacggaggaagattttcaagaaatgatcaaaagtgcacagatcatggaaagccagtacggtcatctgttcgacaagatcattattaacgatgacctgacagtggcatag

SEQ ID NO: 123982 - DNA, 1125 bp, Artificial Sequence
  Description of Artificial Sequence: Synthetic coding sequence
atgccggaggacatcgatgacgaagaggatagcgtgaaaatcatcaggctggtgaagaatcgagaacctctcggcgccacaatcaagaaagacgaacaaacaggcgccattatcgttgctcggattatgagggggggagccgccgacaggagtggactgatccacgtgggagacgaactgcgcgaggtcaatgggattccggtcgaagataagaggcctgaagagataattcagatcctggcccagtcacagggcgctatcaccttcaagatcatcccagggagcaaggaggagacaccttcaaaggaaggcaaaatgttcatcaaagcactcttcgactacaatcctaacgaagacaaggccatcccctgcaaggaggccgggctgtcatttaagaaaggcgacatactgcaaattatgagccaggacgatgctacctggtggcaggcaaagcacgaggcagatgccaacccaagagctggcttgataccctctaagcacttccaagagagacgactggccctgcggaggccagaaatactggtgcagccgttgaaggtctccaatcggaagtcaagcgggtttaggaaatcctttcgcttgtctagaaaagacaagaagacaaacaaatccatgtatgaatgcaaaaagtcagaccaatacgatactgcggatgtgccaacatacgaggaggtgaccccatataggagacagactaatgagaagtacagattggttgtgctagtaggtcctgttggcgtaggcttgaatgagctgaagaggaagttactgatatccgatacccagcactatggcgttactgtccctcacacgaccagggccaggcgttcccaggagagtgatggcgtagagtacatcttcattagcaagcatctattcgaaactgacgtccaaaataacaaattcattgagtacggggagtataagaacaattattatggcaccagcatcgatagcgtcaggagtgtcctggcaaagaacaaggtctgccttcttgatgtgcaaccacacggcccctggttccttctgcctctgatggcagtcccatggggcgctaaaccccctaatgcccggatgacttgtggtagtcccctggatctatag

SEQ ID NO: 123983 - DNA, 1731 bp, Artificial Sequence
  Description of Artificial Sequence: Synthetic coding sequence
atgcccgctcttagtactggcagcggttctgatactggcttatacgagctcttggccgccctgccagctcaattacagccccacgtagacagtcaggaggacttgactttcctttgggatatgtttggggagaaaagcttgcatagcctggtgaagatccatgagaagctccactattacgaaaagcagtctcctgtgcctatattacacggggcggccgctcttgcagacgatctagccgaggagctccagaacaagcccctcaatagcgaaatccgagagttgcttaaactcctatccaagcctaacgtgaaagcactgctgagcgtgcacgatactgtggctcagaagaactacgatccggttttgcccccgatgcctgaggatattgatgacgaggaggacagtgtgaaaatcattaggttggtcaagaaccgcgaaccattgggtgccaccattaaaaaggatgagcaaaccggcgccatcatagttgctcgaatcatgcggggcggagccgcagataggtccggccttatccatgtcggggacgagctgagggaagtgaatggcattcccgtcgaggacaagcggcctgaagagatcatccagatcctcgcccagagtcagggagccatcaccttcaaaatcattccgggcagtaaagaggagactccttcaaaggaaggaaaaatgttcatcaaagctctctttgattacaatccaaacgaggacaaggccattccctgcaaggaagccggattatccttcaagaagggcgatatccttcagatcatgtcccaggacgacgccacatggtggcaggcaaagcatgaggccgatgccaatccccgggccggcctcatacctagcaagcactttcaggaaaggagactggcattacgccgtccagagatcctggtgcaacccttaaaggtgagtaaccgcaagtccagtggattccgcaagtctttccggctgtctcgcaaagacaaaaaaacgaataaatcaatgtatgagtgcaagaagagcgatcagtacgacacggctgatgtgcccacctatgaggaggtgacaccatacagaaggcagacaaacgaaaaatatcggctggtcgtgctcgttggtcctgtgggcgtgggcctcaatgagctgaaaaggaagcttctaatcagtgatacacagcactatggagtcacagtaccacacaccacacgggctcgcaggtctcaggaaagtgacggtgttgagtacatttttatttccaaacatctgttcgaaaccgacgtccaaaacaacaagtttatcgagtacggggaatacaagaataattactacggaacctctatcgattcagtcagatcggtcttggctaaaaacaaggtgtgccttttagacgttcagccccacactgtgaagcacttgcgtacactagaatttaagccgtatgtgattttcattaagccccctagcattgagaggctgagggagacgcgcaagaatgccaagattatctccagcagagatgatcagggggctgcaaagccatttacagaagaggacttccaagagatgatcaagagcgcccagatcatggaatctcagtatggtcacctgttcgataaaatcataattaacgatgatctgactgtagcgttcaatgagctgaagacaacattcgacaaactggaaacagaaactcattgggtccctgtgagctggctccacagctag

SEQ ID NO: 123984 - DNA, 870 bp, Artificial Sequence
  Description of Artificial Sequence: Synthetic coding sequence
atgttggggtggtgcgaagcgatagcacggaacccgcaccgtattcctaacaacactcggacccctgagatctcaggggacctcgctgatgcttcccagaccagcacactgaatgaaaagtctcctggacgatctgcctcacgcagttcaaatatcagtaaggcgtctagtccgaccacaggaactgccccgcggtcacagtccaggctctcggtgtgcccttctacacaggacatctgccggatctgtcactgtgaaggtgacgaggagtctcctctcatcaccccctgtaggtgtacagggactcttcgattcgttcaccagtcatgtctgcatcagtggattaaaagctccgatactagatgctgcgaactgtgcaagtatgactttattatggaaacgaagttaaagccacttagaaagtgggaaaaattacagatgaccactagcgaaaggaggaagattttttgcagcgtgactttccacgtgatcgctataacctgtgttgtgtggagcctttatgtcctgatcgacagaacggctgaggagattaaacagggtaatgataatggagtgcttgaatggcccttctggaccaaattggtcgtggtggccatcggtttcactggagggttagtgttcatgtacgtgcaatgcaaagtctacgttcagctgtggcgtcgactcaaggcctataacagggttattttcgtgcagaattgtccagatactgccaagaaacttgagaagaatttctcttgtaacgtgaatacagatattaaggacgccgtggtggtgcctgtaccccagactggagccaactcactacctagcgccgaaggaggtcctcctgaggtggtcagcgtgtag

SEQ ID NO: 123985 - DNA, 819 bp, Artificial Sequence
  Description of Artificial Sequence: Synthetic coding sequence
atgacgtcaagtcacgtctgttgcaactttcttaacatgtggaaaaaatcaaagatcagcacaatgtactatcttaatcaagacgcaaagctgagcaatctttttctgcaagcctcctctcccacaactggaaccgcgccaagatcccagtctcgcctcagtgtgtgtcctagtacacaggacatttgtagaatatgccactgtgaaggcgatgaggagtctcccttaattactccctgtaggtgtaccggcacactacggttcgtccaccaatcctgtttacaccaatggatcaaaagcagtgacactagatgttgcgagctttgtaagtatgactttatcatggagaccaagctcaaaccactacgaaaatgggagaaactgcagatgacgaccagtgagcggcgtaaaatcttctgctctgtcacctttcacgtcattgccattacatgtgtggtctggtcactgtacgtgctcattgataggaccgcggaggagatcaaacagggcaacgacaatggcgtgctagaatggcctttctggacaaaactcgtcgtggttgccatcggctttaccggagggctcgtttttatgtatgtgcagtgcaaggtgtacgtgcaactgtggcgccggctgaaagcctacaacagggtgatcttcgtgcagaactgtccagatacggctaagaagctcgagaagaactttagctgtaacgtgaacaccgacatcaaagatgcggtggtcgttcccgttccacagacaggcgccaattccttgccctctgcggaagggggaccgcctgaagtcgtctctgtgtag

SEQ ID NO: 123986 - DNA, 870 bp, Artificial Sequence
  Description of Artificial Sequence: Synthetic coding sequence
atgctgggctggtgtgaggcaattgctagaaacccccaccgtatcccgaacaatacaaggactcccgaaattagcggcgacctggctgacgcctcgcagaccagtacactgaacgagaagagtcccggtcgctctgcatcccgatcctctaatatatctaaggcaagcagcccaaccactggaacagcccctcgctcacagagtaggctttctgtgtgtccttctacacaggatatctgtcgaatatgccattgtgagggcgacgaagagtcccccttaataacaccctgtaggtgtacaggcacactgagatttgttcatcagtcatgcctccatcagtggattaaaagctcagatactcgatgttgtgaactctgcaagtatgattttataatggaaaccaagttaaagcccctgaggaaatgggaaaaactgcagatgacaacctccgagagaagaaagattttctgtagcgtcacctttcacgtgattgctattacatgtgttgtttggtcactttacgttcttattgatcgcaccgctgaagagattaagcaaggcaatgataatggcgtcctggaatggccattctggacaaaactggtggttgttgctattggctttacgggcgggttggtgtttatgtacgtccagtgtaaagtgtatgtccaactttggagacgccttaaggcttataaccgggttatctttgtgcagaattgtcctgacacagctaaaaaactggagaaaaatttttcctgtaatgttaatacagatattaaggacgccgtggtggtgccggtgccccagacaggtgcaaactcactaccttccgctgagggggggccacctgaagtggtaagcgtttag

SEQ ID NO: 123987 - DNA, 426 bp, Artificial Sequence
  Description of Artificial Sequence: Synthetic coding sequence
atgttaggctggtgcgaagccatcgcccgtaatccacatcgaatccctaataatacaagaactcctgagatctccggagacttggccgatgcaagccagacatccaccttgaatgagaaatctccagggcgcagcgcgtccaggtcttccaatatttccaaggcttccagtccgactactggcacagctcccagaagccaatcacgactgtctgtctgcccatccacccaggacatttgcaggatttgccactgcgaaggtgacgaagaaagccctttgattactccctgtcgctgcaccgggacactgagatttgtacaccaatcatgcctgcaccagtggatcaaatcaagcgatacccgctgctgtgagctttgtaaatatgatttcatcatggaaacaaaactgaaaccgcttagaaagtag

SEQ ID NO: 123988 - DNA, 2427 bp, Artificial Sequence
  Description of Artificial Sequence: Synthetic coding sequence
atgctgcacgatgcacgggacaggcagaagtttttcagcgatgtacagtatcttcgggacatgcaacataaggtggacagcgagtaccaggcttgtctgaggaggcaggaataccgtagggaccccaacgagaaaaaaagggatcagttttggggccaagaaacttctttcgaacggtcacggttcagttcccggagcagctcaaagcagtcgagcagcgaggaggacgcactcaccgagcccagaagcagtatcaaaatttcggcatttaaatgcgacagcaagctcccggccatagatcagacctctgtgaagcaaaagcacaaatcaactatgacggttcgtaaggcagaaaaagtagatccgtccgagccctcacctgcagaccaggcgcctatggtgctgttacgcaaacgaaagcctaatttgcggcggtttacagtgtcccccgaaagccacagtcctcgagccagtggcgataggagcagacagaaacagcagtggcctgccaaagtgcctgtgccacggggtgcagaccaggttgtgcagcaagagggactgatgtgcaatactaaacttaagcggccaaaccaggagcgtcggaacctggtgccgagcagtcagcctatgacagagaacgcaccagatcgagctaagaagggagatccttcagccccctcacagagcgaactgcaccctgccttgagccaggcctttcagggcaaaaactcacctcaggtgctgtccgaatttagcggcccaccattgacgccgactactgtaggaggccctcgcaaagcctcttttcggttccgggatgaggacttttacagcatcctgtcactcaattcgcggagggaatccgatgacaccgaagaggagacccaatccgaagagtgcctgtgggttggcgtccggagcccatgttccccgagccatcacaagcggtcacgttttggtggaacctccactcctcaggccaagaataaaaactttgaagagaacgcagaaaactgtcgaggccactcctctcggcggagtgagccatctcacgggtcccttagaatctctaatgcaatggagccagctacagagcggccttccgccggacagcgactttcgcaggatccaggtttacccgacagagagtcagcaacagaaaaggaccgcggtggctccgagaatgctaagaagagtccattgtcctgggacacaaaaagcgaaccccgccaggaagtgggcgtgaatgctgaaaatgtgtggtctgattgcattagcgtagaacaccggcccgggacacacgacagtgaaggatactggaaggattaccttaactcgagccaaaatagcctggactatttcatctctgggcggccgatttcccccagaagtagcgtgaactcaagctataatccccccgcaagctttatgcactccgccctgagggacgacatcccagtggatctgtcgatgagcagtacatctgtccacagttcagattctgagggcaactccggattccacgtgtgccagcccctctcccccatccgcaacagaacgccgttcgcttcagcagaaaatcacaactatttccccgtgaattctgcccacgaatttgcagtgagagaggctgaggacacaaccctaacgagccagccacagggcgcccctctctatactgacctgctactcaatcctcagggcaatctgagcttggtcgattcgtcgtctagcagccccagtcgaatgaattctgaagggcacctgcatgtgagcggctctcttcaggaaaatacacccttcaccttttttgccgtgtcacattttcccaatcagaatgataacggtagtcgaatggccgcttccgggttcaccgacgagaaagagacgtccaagatcaaggccgacccagagaaactgaagaaactccaagaatctctgttagaagaagacagtgaggaagaaggggatctgtgcaggatttgtcagatagccggtggcagtcctagcaacccgctcttggagccctgtgggtgcgtgggctctctccaatttgtccaccaggagtgcttgaagaaatggctgaaggtgaaaattacaagcggagcagacctgggcgccgttaagacatgcgagatgtgcaaacaaggcctgttggtcgacctgggcgattttaatatgatcgagttttaccagaagcaccagcaatcacaagcgcagaatgagctcatgaattcaggactctacctagtcctgttgctgcatttatatgaacagaggtttgccgagctcatgcgtctgaatcacaatcaggttgagagggaacgattaagccgcaactacccacaaccgcgaaccgaagagaacgagaattcggagctcggtgacggcaacgaggggagcatctcccaaagccaggtagtgtag

SEQ ID NO: 123989 - DNA, 2427 bp, Artificial Sequence
  Description of Artificial Sequence: Synthetic coding sequence
atgttgcatgatgctcgggatcggcagaaattcttctccgacgtgcagtacctgcgggatatgcagcataaagtcgacagtgagtatcaggcttgcctcaggcgccaagagtatagaagagacccaaatgagaagaaacgtgatcagttctggggtcaagagacatcatttgagaggagtcggttttcatcaaggtccagcagcaagcaatcttcttccgaagaggacgcacttaccgaacctcgctcaagtatcaaaatcagcgcttttaagtgcgattccaagcttcccgctatcgaccagacctcagtgaaacagaagcataaatcaaccatgacagtgcgtaaagctgagaaagtggacccaagcgaaccaagccctgccgatcaagctcctatggtcctgctgaggaagagaaagcctaacctccgacgcttcactgtaagtcctgagagccactcaccaagggccagcggcgatcgatcccgacaaaaacagcagtggcctgcaaaggtgcctgtgccccggggcgctgatcaggtagtgcagcaggagggtttgatgtgtaacactaagctcaaaagacccaatcaagagcgcaggaatctggtcccatcgtctcagccaatgaccgaaaacgctcccgaccgcgctaaaaagggggatccttctgctccttcgcagtctgagttacaccctgctctgtctcaggcattccaggggaagaatagcccacaggtgttgagcgagttctccgggcctccactgacacccacaaccgtgggaggcccgcggaaggccagctttcgcttccgagatgaagatttctacagcattttaagtttaaatagtcgaagggaatccgatgatactgaggaagagactcagagtgaggagtgcctgtgggtcggcgttaggagcccgtgcagcccttcccaccataagcgttcaagattcggaggtacgtccaccccccaggccaaaaacaaaaacttcgaggagaacgcggaaaactgcaggggccactcctctcgccgtagcgaaccgtctcacggatctttacgaatttctaacgcaatggagcctgccactgagaggccatctgccggccagcggctaagccaagaccccgggcttccagacagagagagcgcaactgaaaaggataggggtggatcggaaaacgccaaaaaaagcccactgtcgtgggacaccaagtctgagccacggcaggaagtaggcgtcaacgctgaaaacgtgtggtcggattgcattagcgtcgagcataggcctggcacccacgactctgagggctattggaaagattatctgaactcctcccagaattcattggactactttatttctggccggcccatctccccacgctcttcagtgaattcatcatacaaccctccagctagcttcatgcatagcgcgctgcgagatgacatccccgttgatctatcgatgagcagtacgtctgtgcactcatcagacagcgaggggaactcagggtttcacgtctgccagcccctctccccgataaggaaccggacaccctttgcctctgcagagaaccacaattactttcctgtgaatagcgcccacgagttcgccgtgagggaagcagaagacactaccttgacttcacagccccagggggcccctctttatactgacctcctcctaaatccccaaggtaacctgtctctcgtcgactcttccagctcatctccaagcaggatgaacagtgagggacacttgcacgtgtcgggttctctgcaggagaatacccccttcacttttttcgcggtctcacacttcccgaaccagaatgacaatggttcccgcatggctgccagtggatttacagacgagaaagaaaccagcaaaatcaaagctgatccagaaaaattgaagaagctccaagagagcctgctggaagaagactctgaggaggagggggacctgtgccgtatttgccaaattgcaggtgggtcaccttcgaaccccctactcgagccatgcggttgcgttggttctctacaatttgtgcatcaggaatgtttaaaaaagtggttgaaagtaaagataactagcggagctgacttaggagccgtaaagacctgtgagatgtgcaaacaggggctattggttgacctaggggacttcaacatgattgagttctatcagaaacaccagcagagccaagctcagaacgaactcatgaactccggcctctacttggttctgctgctacacctctacgagcaaaggttcgcagagctcatgcggctgaatcacaatcaagtggagcgggagcgacttagcagaaattacccccagccacgaaccgaagagaacgaaaattctgagctgggagatggtaatgaaggctctatatcccagagccaggtcgtgtag

SEQ ID NO: 123990 - DNA, 2400 bp, Artificial Sequence
  Description of Artificial Sequence: Synthetic coding sequence
atgcttcatgacgcccgggacaggcagaagttcttctctgatgtacagtatctacgcgatatgcagcataaggtcgattcagagtatcaggcatgtcttcgacgacaggaataccggcgtgatcccaatgaaaagaagcgcgatcagttttggggtcaggagaccagtttcgagagaagtagatttagctcccgctcatcatcaaaacagagttcgtcagaagaggacgccctgactgagccaagaagcagcatcaaaatctccgcctttaaatgcgactcgaagctgcccgcaattgaccagacatccgtgaaacaaaagcataagtctactatgacagtccgtaaggcagaaaaggtcgatccgtccgaaccttccccagaccaggcgcctatggttttactgcgtaagaggaaaccaaatctgcgtcgattcactgtctcgccagagtctcacagtccaagggcctccggcgaccggagccgccagaagcagcagtggcccgcaaaggtacccgtgccccgaggtgccgaccaagttgtgcagcaggagggcctgatgtgcaatactaaacttaaaagaccaaaccaggagcgtagaaacctagtccctagcagtcagcccatgaccgagaatgcccctgatagggcgaaaaagggggatccatctgctccttcccagagcgaactgcacccagctctgtctcaggcattccagggtaaaaattcaccccaggtgctgtccgagttctctggtccacccttgaccccgaccaccgtggggggtccgaggaaggcgtcatttcgattccgtgacgaagacttttactccattctgagccttaactccaggcgggagtcagacgatacggaggaggagacacagtcagaagagtgcttatgggtcggagtgaggagtccctgctctccatcgcaccacaaacggtcgcgtttcggcgggacctctaccccacaggctaagaacaagaattttgaggagaacgctgaaaattgcagaggccatagctcgaggagatcagagccatctcacggtagtctccgtattagcaatgcaatggagccagctaccgagcgcccaagtgcaggacagcgactgtcgcaggaccctggtctcccagatcgggagtcagctacagagaaggacaggggcggctcagaaaatgcgaagaagtcacccttaagctgggacaccaagtccgaacctaggcaggaagttggcgtaaacgctgaaaacgtgtggtcagattgcattagcgtggaacataggcctggtacccatgatagcgagggatactggaaggactacctcaattcaagtcagaatagcctggattactttatttctggccggcctatatcgccccgctctagcgttaattcttcctataatccgcctgcctcattcatgcactctgctctgagagacgatatcccggtggatttgagcatgtcctctacctctgtccatagtagcgatagcgaaggcaatagcggctttcacgtgtgccagccgctcagtcccattcggaacagaaccccattcgcctccgctgagaatcataactattttccagtcaattcagcgcatgaattcgcagtgagagaggccgaagatactaccttaacatcacagccacagggcgcaccactgtacactgatttactactgaacccacagggcaatctgtcattagtcgatagttcctcctcaagcccttctagaatgaattccgagggacacctccatgtgagtggtagcctccaggagaatacccctttcaccttcttcgctgtgagccactttcccaatcaaaacgacaatggatccaggatggcagcctcgggtttcactgatgaaaaagaaacctccaaaattaaggctgaccccgagaagttgaagaagctgcaggagtcactgctggaagaggactccgaggaagagggagacctatgccgtatctgccagatcgccggagggagcccttccaatcctctgcttgagccctgcggatgcgtcggcagcctacagtttgtgcatcaggaatgcctgaaaaaatggttaaaagtgaaaatcacttctggggcagacctgggggccgtgaaaacatgcgagatgtgtaaacagggactcctcgtcgatctcggcgatttcaacatgatcgagttttaccagaaacaccagcaatcccaggcccagaacgagctgatgaattcgggcctgtaccttgtgctgcttcttcatctgtacgagcagagatttgcggaattgatgcggctcaatcataatcaggttgagagagaacgactctctagaaattatccacagcctaggaccgaggagaatgaatcccggttctggggcccagtgctccccttctag

SEQ ID NO: 123991 - DNA, 1209 bp, Artificial Sequence
  Description of Artificial Sequence: Synthetic coding sequence
atgagttttgagggaggccatggggggtcccggtgtagaggagccgaatctggcgatgccgagccaccaccccagcctccacctcctccaccgcctacaccccctccaggggagcccgctccagtgcccgcggccccaaggtatctcccccctttgcccgcgtctcccgaaactcccgagagggctgcaggccccagcgaacctctgggcgaagtcgcaccacgatgtcgcggcgctgatgagctccctccgccacctctccccctacagcccgccggccaagaggtggcagctgccggcgacagcggagagggccctaggcggctcccggaagcagctgctgcaaaaggaggtcccggagaaagcgaagcgggagctggaggagaacgagaaagaagaggtgccggcgaccagccagagaccagatccgtttgcagcagtcgctcctctagttccggtggcggtgatcagagagctggccatcagcaccagcaccatcagcctatctgcaaaatatgctttcagggtgcagaacagggggaactgctaaacccatgccgctgcgacggctccgtaaggtatacacaccagctctgcctactcaagtggatttccgaaaggggcagctggacctgtgagctctgttgctacagataccacgtgattgctattaaaatgaagcagccctgtcagtggcaatcgatatctatcacactagtggaaaaagtccagatgatcgccgtgattctgggatccctttttcttatcgcatcagtgacatggctcctctggagcgcctttagcccctacgcagtgtggcagcggaaggatatcctgttccagatctgttacggcatgtatggctttatggatttggtttgtattggactcatcgtccacgaaggagccgccgtgtacagggtctttaagcggtggcgggccgtcaatctccactgggacgtgctgaactatgacaaagccacggacatcgaggagagctctagaggagagagcagcacaagccgtacgttgtggttgcctctgacagcactgcgcaatcggaatttagttcatcccacccagctcaccagtcctcgatttcaatgtggatatgtgctcctgcacctctttaatcggatgaggccacacgaagacctaagcgaagacaatagctctggtgaagtcgtgatgcgggttacaagcgtgtag

SEQ ID NO: 123992 - DNA, 1818 bp, Artificial Sequence
  Description of Artificial Sequence: Synthetic coding sequence
atggccctcagaaaagggggtttagcccttgcactcctactgctgtcctgggtggcactgggccctcgtagcctggagggggccgaccccggcacacccggcgaagcagagggccccgcctgtcctgcagcttgtgtatgcagctatgacgatgacgctgatgaactgagtgttttctgtagtagccgaaacttaacccgccttcccgatggagtgccaggagggacacaggcactctggctagacggcaacaatctatcttccgtgccccccgccgcatttcaaaatctttccagcctaggattccttaatttgcagggcggccagttagggtcattagaaccgcaggccctattagggctggaaaacctgtgccacttgcacctggagcgcaaccagctcaggtctctagctcttggaacctttgcgcacactcctgccttagcaagcctgggattgtccaataaccggttgtctaggttagaggatgggctcttcgaggggctgggcagcctgtgggatctgaatctgggctggaattcactggcagtactgcccgacgccgccttcaggggccttggctccttgcgggagctggtgctagccggcaacagactggcctatttgcagcccgccctgttctccggcctggccgagctcagggagttggatctttcccggaacgcactgcgcgcaataaaagccaacgtttttgtgcagctgccccggcttcagaagttatatttggatagaaacctgatcgccgccgtggctccaggggcctttctaggcctgaaggccctgcggtggctcgatctgagtcacaatcgcgtggccgggctccttgaggatacattccctggacttctcggtctgcgggtacttcggctgtcccataatgctatcgcttccctgaggccacgcacattcaaggatctgcactttctagaagagctccagctggggcataaccgcatcagacaactggccgagcggagctttgaaggtttagggcaacttgaggttctgactctggaccacaaccaattgcaggaggtgaaagctggcgccttcctgggtctcaccaatgtggccgtgatgaatctcagtggaaactgcctccgtaatctccccgagcaggtatttcgaggactcggcaagttacatagcctacatttggaaggaagttgcttgggacggattcggccacatacatttaccggactttcaggacttcgcaggctgtttcttaaggataacggtctggtcggcattgaggagcagtcactgtgggggctggccgaactgctagagctggacctgacttctaatcaactgacccacttgccccaccgtctgttccaggggctcggaaagctggagtatctgctgctgtcgcggaatcgcctcgctgaattgcccgcagatgctctcgggcctttacagagggctttttggctcgacgtctcccacaatcggttagaggcacttcctaacagcctcctggcgccgctgggccgccttcgctacctgtccctgcgcaacaatagcctgcggacatttacacctcaaccccccggcctggaacgactatggctggagggtaacccctgggactgtggctgtccgctcaaggcactgcgcgacttcgctttacagaatccttcagcagtgccccgctttgtgcaagctatatgtgaaggtgacgattgccaacctcccgcgtacacctataacaacattacctgtgcatcaccccccgaagtggtgggattagatctccgcgatctctctgaagcccactttgcaccttgttag

SEQ ID NO: 123993 - DNA, 531 bp, Artificial Sequence
  Description of Artificial Sequence: Synthetic coding sequence
atgactactggggactgctgtcacttgcctggcagcctgtgtgactgttctgggagccccgccttttctaaggtggtggaggcaactggcctcgggcccccgcagtatgtcgctcaggtaacatcccgtgacggcagactcctctcgactgtcatccgggcgctggacacaccctcagacggccccttttgtcggatatgccacgagggcgcgaatggggagtgtcttcttagcccatgcgggtgtactggcaccctgggtgccgtgcacaagtcttgcctggagaagtggctgtcgagctctaatacttcttattgcgaactgtgtcacactgaattcgccgttgagaaacgacctcggcctttaactgaagtgtccttccgatatcactgtcagttatacagcgagtggcgcaagactaatcagaaggtcagactgaagattcgcgaggcggactccccagaggggccacagcactcgccactggccgccggactgctgaagaaagtggccgaagagaccccagtgtag

SEQ ID NO: 123994 - DNA, 741 bp, Artificial Sequence
  Description of Artificial Sequence: Synthetic coding sequence
atgaccactggagactgttgccatctgccgggatctttatgcgactgctctggctcccctgctttctctaaagtggtcgaggctactggacttgggccgcctcagtacgttgcacaggtaaccagtcgtgatggtagactcttgagcactgtgatccgggccttggacactccaagcgatggtcctttttgccggatttgtcatgaaggggcaaatggagaatgcttgctctctccatgcggatgtactggaaccctgggcgctgtccacaagagctgtcttgaaaaatggctttcatccagtaatactagttactgcgagctgtgccataccgagttcgccgtagagaagcggcctcgccccctaactgagtggctgaaggatcctggtccaaggacagagaagagaaccctgtgttgtgacatggtatgtttcttgttcattactcctctcgccgctatcagtggatggctgtgcctcagaggggcacaggatcatcttcgactgcattcacagctggaggctgtgggcctgatagcattaacaatagccttatttacaatttacgttctgtggaccctggtttcttttagatatcattgtcaactgtacagtgaatggagaaaaaccaatcaaaaggtgagattaaagatcagagaggccgacagccccgaaggcccccagcattcacccctggccgcggggcttttgaaaaaggtggcggaggaaactcctgtatag

SEQ ID NO: 123995 - DNA, 762 bp, Artificial Sequence
  Description of Artificial Sequence: Synthetic coding sequence
atgaccacctcacgttgctcccacctccccgaggtgcttcccgattgtactagctctgcggccccagttgtgaaaacagtcgaggactgtggaagcttggtaaatggtcagcctcagtatgtcatgcaggtctctgctaaggatggacagctgctcagtacggtggttaggactctggccacccagagcccatttaacgatcgaccaatgtgtcggatctgccacgaagggtccagtcaagaggatcttttgagcccttgcgagtgtacagggacgctgggaacaatccacaggagctgtctggagcactggctctcgtcgtctaacacgtcttactgcgagttgtgccatttccggttcgcggttgaacgaaagccacgtccacttgtagaatggttaagaaatcctggccctcaacacgaaaaaagaaccctctttggcgatatggtatgtttcctgttcatcaccccacttgctaccattagtggttggctctgtctcaggggggcagtcgatcacctgcacttctccagcaggctggaagccgtcggactcattgcccttacagttgccctgtttacaatctacttgttctggacactggtcagcttccgctatcattgtcggctgtacaatgaatggagaaggacaaaccagcgggtaatccttctgatcccaaagtccgtcaatgttccttcaaaccagccatccctgttggggctgcattctgtgaaaagaaacagtaaagagaccgtcgtgtag

SEQ ID NO: 123996 - DNA, 1233 bp, Artificial Sequence
  Description of Artificial Sequence: Synthetic coding sequence
atgttgatgcctctatgtgggctcctgtggtggtggtggtgttgttgctccggctggtactgctacggcctgtgtgcacccgctccccagatgctgcggcatcagggacttctcaagtgcaggtgtcgcatgctgttcaatgaccttaaagtctttttgctgagaaggcctccgcaggcgcccctgccgatgcacggcgacccccagcctcctggccttgctgcgaataatactctccctgccctgggggccggtggctgggcaggctggagagggccccgagaagtggttggccgggagccccctcccgtgccgccccccccgcctctccctccatcctcagttgaggatgattgggggggccccgccaccgaaccacccgcaagcctactttcctccgcttcaagcgacgatttttgtaaggaaaaaactgaagataggtatagcctcggctcttcgctagatagtggcatgcgtacccctctctgtcgcatttgctttcagggcccggagcagggggaactgctctccccatgccggtgtgatggatccgtgaagtgtacccatcaaccttgccttattaaatggataagtgagagaggatgctggtcgtgcgagctgtgctactataagtaccacgtgatcgctatttccaccaaaaacccacttcagtggcaggcaatcagcctcaccgtgatcgagaaggttcaggtggccgcagcaatactcggctcactttttcttattgctagtatcagctggctcatttggagtaccttttctccctctgcgaggtggcagagacaggatctgctgtttcagatctgctacggcatgtatgggtttatggacgtagtctgtatagggcttattatccatgagggccctagcgtatatagaatttttaaaagatggcaggcagtcaatcagcagtggaaagtgttgaactacgacaagacaaaagacttagaagatcagaaagcgggcgggcgcacgaaccccaggacctcctcaagtacgcaggccaacatcccatcaagtgaggaagagacagctggcacaccagccccagagcagggacctgctcaggctgccgggcacccatctggtcctctgagccaccaccattgtgcctataccattttacatattctctcccacctgcggcctcacgagcagaggtccccgccaggctctagtcgagaacttgtgatgcgggtgacgacagtatag

SEQ ID NO: 123997 - DNA, 837 bp, Artificial Sequence
  Description of Artificial Sequence: Synthetic coding sequence
atgcctgaccaggcccttcaacagatgttagataggtcctgctgggtgtgttttgccaccgatgaggacgatcgcaccgctgagtgggtccggccctgccggtgccgcggatctacgaagtgggtacaccaggcctgtctccaaaggtgggttgacgagaaacagcggggtaactctacagctagagtggcatgccctcagtgcaacgccgaatacctgatagtgttcccgaaacttggtccagtggtttacgtgctggatctggccgaccgcctgatcagcaaggcctgcccatttgcggcagcaggcattatggtgggctcaatctactggactgctgtcacctacggtgcagtgactgtcatgcaagtggtggggcacaaagaggggctggatgtgatggaacgggccgatccactattcctcctcattggactccccactatcccagtgatgttaatcctgggtaaaatgatccgctgggaggactatgtgctgaggctctggagaaagtacagcaataagttgcaaatccttaactcaatttttcctgggatcggatgccccgtgcctcgcattcctgctgaggctaatccactggctgaccacgtcagtgcaacaaggatcttgtgcggggctctagtttttccgacaatcgccacaattgtcggtaagctgatgttcagctctgttaacagtaacttacagcgtacaattctgggcggtatcgcattcgttgctatcaagggcgcattcaaagtgtattttaagcagcaacagtatctcagacaggcccatcggaagatcttgaattatcccgaacaggaagaagcctag

SEQ ID NO: 123998 - DNA, 2733 bp, Artificial Sequence
  Description of Artificial Sequence: Synthetic coding sequence
atggacaccgcagaggaggatatatgcagggtgtgtcggtcagagggaacacccgagaaacccctctaccacccttgcgtgtgtacaggaagtattaaatttatacaccaggagtgcctggtgcagtggctgaaacatagccgcaaggaatattgcgagttgtgtaagcaccgctttgcattcacacccatatatagccctgatatgccatcccgtctgcctattcaggatatttttgcaggcctggttacatccatcggcacggcaatacgatattggttccattacaccttagtggctttcgcttggctgggtgttgtccctctcaccgcctgccggatatacaagtgcctgttcacaggctcggtgtcctctctccttaccctcccacttgatatgctgtctaccgagaaccttctcgcagattgtctgcaaggttgttttgtagtgacatgcaccctctgcgcgttcatcagcctggtttggctccgggaacaaatcgtgcatggcggcgctccaatctggctggaacacgctgctccaccctttaacgctgccggccaccaccagaatgaagcccccgcgggaggcaatggtgccgaaaatgtagctgctgaccagcctgcaaacccccctgccgagaacgccgttgtcggagagaatcctgacgctcaggacgaccaggccgaagaagaggaggaggacaacgaggaggaggacgacgcgggcgtggaggatgcggcagacgcaaataacggggctcaggatgatatgaactggaatgccctagagtgggatcgcgctgcggaagaacttacctgggaacgcatgcttggtctagatgggtctttggtgttcctggaacatgtgttttgggtcgtgtcattgaacactctgtttattctggtgtttgccttttgtccttaccatatcggtcacttttccctcgtgggcctcggattcgaggagcacgtgcaggcctctcattttgagggcctcataacaacaatcgtggggtatattctcctcgctattactctgatcatatgtcatggcttggccacactcgtgaagttccataggtctaggcggctgctcggcgtttgctatatcgtggtcaaggtgagtctgctcgttgttgttgaaataggtgtgtttcccctcatctgtggatggtggctggatatctgttctttggagatgttcgatgccacacttaaagatagagaactgtcctttcagagcgctcccggcactacaatgttcctgcattggctggtgggcatggtgtacgtcttctactttgcctcatttatcctgctgcttcgcgaggtgctgaggccgggcgtgctttggtttttacgaaacctgaacgacccagacttcaacccggtgcaggagatgatccatctgccaatctatagacaccttaggaggtttatcctgtccgtaatagtgtttggctccatcgtgcttttgatgctttggctgcctattcgaatcatcaagtcagtgcttcccaacttcctcccatataacgtgatgctgtactccgacgccccggtgtccgagttatcattagagctgctcctcctacaggtggtcctgcccgcacttctcgagcaggggcatacacgacaatggctgaagggcctggtgagggcttggactgtgacggctggctatttgctggatctgcacagttacctgctgggggatcaggaagagaacgaaaactcggccaatcagcaggtgaacaacaaccagcacgctcgtaacaacaacgctatccctgtagtgggggagggactccatgctgcccaccaggctattctgcagcagggcggacctgtgggttttcagccatatcgcagacctctgaattttccactcagaatcttcttgctgattgtctttatgtgcatcacattgttaatcgcatcattaatttgcctcaccctccccgtttttgccggcagatggctgatgtctttctggacggggacagcaaagatccacgagttatatacagctgcttgtggattgtatgtatgctggctgacaatccgagctgtaactgtcatggtggcgtggatgcctcaggggcggagagttatcttccagaaagtcaaggaatggtccttgatgatcatgaaaacgctgattgtagccgtgctgctcgccggggttgtgccgctactgctcggtttgctctttgagctcgtgatcgtcgctcctctcagagtgccgctggaccagacaccccttttctacccttggcaagactgggccctgggtgtgctccatgcgaaaattattgccgcaattaccctgatgggaccccaatggtggctgaaaactgtcatagagcaggtgtatgcaaatggcattcgcaacattgacctgcattatatcgtccgcaagttagctgcccccgttatttccgtcttactgctctcgctttgcgttccctatgtgatcgcttctggtgtggtgcccctgcttggcgtgacagctgagatgcaaaatctggtccataggcggatctaccctttccttctgatggtagtggtgctgatggcaattttatccttccaggttcggcagtttaagaggctttatgaacatattaagaacgataaatacttggtgggacagagactggtgaactacgagcgcaaaagcggaaaacagggttcatcgccacctccaccgcagtcatcgcaggagtag

SEQ ID NO: 123999 - DNA, 2115 bp, Artificial Sequence
  Description of Artificial Sequence: Synthetic coding sequence
atggagagtaaaccaagtaggatcccacggcgtattagtgttcagccctcctcatcactatccgcgcgaatgatgtccggctcgaggggttcttcactcaacgacacctatcacagtagggattcctccttcaggctcgacagcgaataccagtccaccagcgctagcgcttcagcatccccatttcagtctgcgtggtatagcgaaagcgagataactcagggcgccaggtccagaagtcagaatcaacagcgagatcacgattcaaagcgaccaaagttgtcatgcactaactgtactacaagtgcaggtcgcaatgtcggcaacggcctcaatacgctgagcgactcgtcttggcgccattcccaggtaccacggtcttcttctatggtcctgggaagcttcggaaccgatctgatgcgcgagcgaagggatctggaaagaagaacagattcctctatcagtaacctgatggattattcacaccggtctggggatttcaccacctccagctatgtacaggacagagttcccagttactctcaaggagctcgcccaaaggaaaattccatgtctaccttgcagctgaatacttcgagcaccaaccatcagctgccctctgagcaccagactattctctcctcaagggacagtcgaaactcactgcggtcgaatttctcgtccagggaatctgaatcctctaggagcaatacacaaccaggctttagctattcatcctcaagagatgaagcacctatcatttctaactcagaacgggttgtatcttcacaacgcccattccaggagtcctccgacaacgagggaagaagaaccacgcgtcgactgttaagcaggattgccagcagtatgagctccaccttttttagtcgccgcagtagccaggactctttaaatactcgcagcctgaattccgagaacagctacgtgtctcctcggatcctgacagcatcacaatctagatccaacgtgcctagcgcctctgaagtaccagataaccgagctagcgaggcaagccagggcttccgattcttgagacgtaggtggggcctcagctctctgtctcacaatcatagttccgaatctgactccgagaactttaaccaggaatctgaaggcagaaacaccgggccttggctctcctcatccctgcgaaataggtgcaccccactattttctaggaggagacgggagggccgggacgagagttcccgcattcctacctccgatacaagtagccgctcccacattttccggcgggaaagcaacgaagtagtgcatcttgaagcacagaacgatcccttgggggctgctgctaatagaccccaagcatccgcagcttcaagttctgcaaccaccggtggtagcaccagcgattcggcacaaggcggccgcaataccggcatttccgggatcctgcccggctcgctgttccgattcgcagttcctcccgctcttggaagcaatctcacagataacgtgatgattacagtggacatcattccgtctggatggaactcagccgatggcaaaagtgacaaaaccaagtctgcgccaagccgggatcctgaacgcctgcagaagatcaaagagagcttgctcctcgaagattctgaagaggaggagggagacctctgtagaatctgccaaatggctgcagcctctagttccaatctgctgatagagccatgcaagtgcactggatctcttcagtacgtacatcaggattgtatgaagaagtggcttcaggctaagataaatagcggaagctctctggaggccgtgacaacatgcgagttatgcaaagaaaagttagagctgaacttagaagactttgatatccatgagctccatcgggcacatgcgaatgaacaagccgagtatgagtttatttcgagcgggctgtatctggttgttcttcttcatctctgcgaacaatctttctctgacatgatgggaaatactaatgaaccgtccactagggtgcggttcattaatctggcaaggacacttcaggcgcatatggaggaccttgaaacaagtgaggacgattctgaggaggacggcgatcataatagaaccttcgacattgcatag

SEQ ID NO: 124000 - DNA, 2115 bp, Artificial Sequence
  Description of Artificial Sequence: Synthetic coding sequence
atggaaagcaagccgtctcgtatccctagaagaatatctgtacagccttcttcgtccttaagtgcaaggatgatgtctgggtctcgggggtctagcctcaacgatacttatcattcacgagacagcagctttcgcctggattcagaataccagagcacttccgcgtcggcatcagccagtccttttcagagcgcctggtattccgagtccgagattacacaaggagccaggagtcggtcacagaaccagcagcgcgaccatgattctaagcgaccaaagctttcctgtacaaattgcacgaccagcgccggccgcaacgtcgggaacggccttaataccctgtctgactcctcttggagacattcccaggtgccaagatcaagttcaatggttctgggttccttcggcacagacttaatgagagagcgccgcgatctggagaggcgcactgacagttctatttctaacctcatggattattcacataggtcaggtgattttacaacatcaagctacgtgcaggacagggttcctagctattctcagggagcgaggcctaaagagaattctatgtccaccctacagcttaatacctccagcacgaaccaccaactgccctccgagcatcaaaccattttgagctctcgcgactctcggaacagtctgcggtctaattttagttcacgggagtcagaatcttcaagatccaacacacagccaggattctcttattcaagcagtcgagatgaagctcctatcataagtaactccgagcgcgtcgtaagtagtcaaaggcccttccaggaaagctctgacaatgaggggcgccggacgacaagacgcttgctgtccaggatcgcttcttccatgagctccacatttttttctagaaggtcctcccaagactctttgaatacccggtcccttaattctgaaaacagctacgtcagcccccgtattttgaccgctagccagtcaaggtccaatgtcccctctgctagcgaagtgccagataatcgtgcttccgaagccagtcaaggcttccggttcctacgacgccggtggggactgtcctccttgtcacataatcactcatcagaaagcgactccgaaaacttcaatcaagagagcgaagggaggaatactggcccgtggctaagttcctcactacggaacaggtgcacccctctgttcagccgcagaaggcgggaaggacgggatgagtcgagtcgcatacccacgtccgataccagttctaggagccacatctttcgtcgggaatccaatgaggtggtacatcttgaggcccaaaatgacccactcggagctgcagccaacaggccccaggcttctgccgccagtagcagcgccactacaggtggatccacaagcgactctgcacaggggggcaggaacactggaattagcggtattctgccagggtcactgttccggttcgcagtacccccagccctgggcagcaatttgactgacaacgtgatgatcacggttgacattattccatctgggtggaatagcgccgatgggaaaagcgacaagactaagtccgccccttcacgcgaccccgagaggttacagaagattaaagaatccctattgctcgaggattctgaggaggaggagggggacctgtgccgaatctgtcagatggcagccgccagttctagtaatctattgattgaaccctgcaagtgtactggcagcctccaatacgtccaccaagattgcatgaagaaatggctgcaggcaaagattaattccggctcaagcctggaagcagtgaccacatgcgagctgtgtaaggaaaagctggaactgaatctggaggattttgacattcacgaactgcatcgagcgcacgctaacgaacaggccgagtatgaattcatatcttctggtctatatctggtcgttctgctgcatttatgtgaacagtcatttagcgacatgatgggcaataccaatgagccttcaactcgtgtaaggtttattaatctggcccggactctccaggcacacatggaggacctcgaaaccagcgaggatgactctgaagaggatggagatcacaatcgtacttttgacattgcctag

SEQ ID NO: 124001 - DNA, 306 bp, Artificial Sequence
  Description of Artificial Sequence: Synthetic coding sequence
atggagagcaagccatcccgaatcccgcgcaggatttctgtgcagccttcttcttctcttagtgcacgtatgatgagcggatctagaggtagctccctgaatgacacctaccactcgagggacagcagtttccgcctagactctgaatatcagagtactagtgcctcagcctccgcatctcccttccaatccgcctggtacagtgagagcgagatcacccagggcgcccggtctcgtagccagaatcagcagagggatcatgatagcaagcgccccaagctgtcttgcaccaattgtaccacatag

SEQ ID NO: 124002 - DNA, 1908 bp, Artificial Sequence
  Description of Artificial Sequence: Synthetic coding sequence
atggagtccaagccttctcggatccctagacgtatcagtgtacagccaagttcatcactttctgctcggatgatgagcggatccagaggatctagcctcaacgacacctaccactcgcgcgattcaagcttccggctggacagcgagtatcagagcacctctgcgagcgcgagcgcgtccccattccaatcggcttggtattccgagagcgagatcacccagggcgcacgatctagaagtcagaaccaacaacgagaccatgatagcaagcgacccaagctaagctgcaccaactgtacgacatcagctggcagaaacgtgggcaacggattaaataccctgagcgacgtccaagatagagttcccagttactcccaaggcgcaagaccgaaggagaattcgatgagcaccctccaactgaacacgagctcaactaatcaccagttgccatctgagcaccagaccattctgtccagccgtgactccaggaactccctcaggtctaactttagcagtcgcgaatccgagagttcacggagcaacactcagcctgggtttagttacagcagtagcagagatgaggcccccatcattagtaatagcgaacgggttgtgagtagtcagaggcccttccaagagagttcggacaacgaaggcaggcgaactacccgcagactgctcagcaggatagcgtcttccatgagttccacgttcttctcacgccgaagctcacaggacagtttgaacactagatctctcaatagcgaaaactcctacgtgagcccacgaatattgactgcctcccagtcccgttccaacgtgccctccgcctccgaagtacctgataaccgtgcgtcggaagcctcgcagggttttaggtttctccggcgccgatgggggctctcctcgctgagccataatcattcctctgagagtgactctgagaactttaaccaggaatccgaaggtaggaatacagggccctggttaagttcgtcactccggaataggtgtaccccactcttcagtcgcagacggcgcgagggccgtgatgaaagctcacgaataccaacctcagatacaagcagccgctcccacattttccgccgagaatcaaacgaggttgtgcatctcgaagcccagaatgaccctctgggcgcagccgccaacagaccccaggctagcgctgcatcaagcagcgccaccaccggcggcagcacttctgactctgcgcagggtggcagaaacacgggcatcagtggaatcctgcccgggtccttattccgcttcgctgtgccacccgcacttgggagtaacttgaccgacaacgtcatgatcactgtggatattattcccagtggttggaactctgcagatgggaagagcgataaaacaaagtctgctcccagccgggaccccgagagactccagaagataaaagaaagccttttactggaggactctgaagaagaggaaggagatctgtgccggatttgccaaatggcagctgcctcaagctcaaacctccttattgaaccatgcaaatgcaccggcagtctgcaatacgtgcaccaggactgtatgaagaagtggctgcaggcgaagattaattccggctcttctttggaggccgtaacaacatgtgaattgtgtaaagagaagcttgagctcaatctggaagacttcgacatacacgagcttcaccgcgcccacgccaatgaacaggctgagtacgagttcattagcagcggactttacctcgtggtcctactgcacctctgcgagcagtccttctccgacatgatgggcaacacaaacgagccttcgacccgcgtgcgcttgcagcgtatgatcccaaagaagacagagacaataaccggacacctcatcttgcctaactttatatag

SEQ ID NO: 124003 - DNA, 876 bp, Artificial Sequence
  Description of Artificial Sequence: Synthetic coding sequence
atgtccatgcccttgcaccagatttccgcaattcccagccaggacgccatcagcgcccgcgtgtaccgttctaagacaaaagagaaagagcgggaggaacagaatgagaaaactttagggcatttcatgtcccacagcagcaatatttcaaaagcagggagccccccaagcgctagcgctcccgcccccgtgagctcattctctcggacgtctattacaccaagctcacaggacatctgcagaatctgccactgcgagggggacgatgagtctcccctgattacgccttgtcattgcactggaagcctgcacttcgtacaccaagcttgcctgcaacagtggattaagtcttccgatacaaggtgctgcgaactttgtaaatacgagtttatcatggaaacaaagctgaagcccctgcgtaagtgggagaagctacagatgacatcttctgagaggaggaagataatgtgttccgttaccttccacgtgattgccatcacttgtgtggtgtggagtctgtatgtccttatcgaccgaactgctgaagagattaagcagggccaggctaccggaatcctggagtggccattctggacaaaacttgtggttgtcgccattgggtttactggcggactgctttttatgtatgtgcagtgtaaagtgtatgtgcagctgtggaagcggctgaaagcttataacagggtaatctatgtacaaaactgtcccgagacgtcaaagaagaatatctttgagaaatcccccttgactgaaccaaactttgaaaacaaacacggatatggaatatgccactctgacacaaacagcagctgctgcacagaaccagaggatacaggcgccgagatcatccacgtgtag

SEQ ID NO: 124004 - DNA, 876 bp, Artificial Sequence
  Description of Artificial Sequence: Synthetic coding sequence
atgtctatgcccctgcaccagatttccgccatcccatcccaggacgccatctcagctagagtttacaggtccaaaactaaggaaaaagagcgcgaggagcagaatgagaaaacactgggtcactttatgagtcactctagcaatatttctaaagccggcagtccgccctcagctagtgccccagctccggtttctagttttagtcggaccagcataaccccctcctcccaggatatctgcagaatttgtcactgcgaaggcgatgacgagtctccactcatcacaccttgtcattgtacgggttcacttcactttgtccaccaagcttgcctccagcagtggattaaatccagcgacactaggtgttgcgaactctgtaaatacgagtttatcatggaaactaagctgaaacctctgagaaaatgggagaagctccagatgacaagttctgagagacgcaaaattatgtgttccgtgacttttcatgtgatcgcaattacctgcgttgtctggtcgctgtacgtgctgattgacagaactgctgaagagattaagcaaggccaggccacgggtatactagagtggcccttttggactaaattagtcgtggtggccatcgggtttaccggtggcctgctctttatgtatgtgcagtgtaaggtctatgtccaattgtggaaaaggttaaaagcctacaatcgggtgatctacgtccagaactgcccagaaacttccaagaagaacatttttgaaaaatctccccttaccgagccaaactttgaaaacaagcacgggtatggcatttgccatagtgataccaatagctcttgttgcaccgagcccgaagacaccggtgcagaaattatccatgtatag

SEQ ID NO: 124005 - DNA, 876 bp, Artificial Sequence
  Description of Artificial Sequence: Synthetic coding sequence
atgagcatgcctctccatcagatttctgctattccatctcaggacgccatcagcgcccgcgtctataggtcaaaaacaaaggaaaaggagagagaagagcagaacgagaagaccttaggccattttatgtcccactcctcgaatattagcaaggctgggagcccgccctccgctagcgcacctgccccagtgagtagcttcagtaggactagcataacccctagctctcaagacatttgccgcatttgtcattgtgagggagacgatgagagcccccttatcactccatgccattgtacaggatctttgcacttcgtgcatcaggcctgcctgcaacagtggattaagtcttccgacacacgttgttgcgagctctgcaaatacgagtttattatggaaactaagctcaaaccactgaggaaatgggaaaagttgcagatgacctcaagcgagcggcgaaaaatcatgtgcagtgtgactttccacgtgatcgccattacttgcgtggtctggtccctatatgtgctgattgacaggacagccgaggaaatcaagcagggtcaggcgactggtattctagagtggccattctggaccaaactggtcgtcgttgcaattggcttcacaggtggattactttttatgtacgttcagtgcaaggtttatgttcagctctggaaacggctaaaggcatataacagagttatctacgttcagaattgtcccgaaacctcaaagaaaaacatattcgagaagtctccacttacagagcccaatttcgagaacaaacatgggtacgggatctgtcatagtgataccaacagctcctgttgcaccgagcccgaagacacaggtgcagagataatccacgtatag

SEQ ID NO: 124006 - DNA, 1371 bp, Artificial Sequence
  Description of Artificial Sequence: Synthetic coding sequence
tgaatatgtaaggacacactgcaggcttctaaaagaaacagcttcgggagcgagtgggcccaggctctaaaacctgcaaaaaacactaaggcacgtcggacgctgaaattcagccggtctcttaacgacgtcggggagaaggctcaggatacgtcagagtctttcgcatacgttgagaggacgtgttcagaagggaagttgatcctcccacaggatacctgcttaaggactaataggttccaccacaaggagaagcgtacactgaaccacaaacccttaggcaattcaaagcattcatgcgtgtcctgtctgagtgctggaaggagtacggctagtgaggtcgaggccgggaaagggggcagaccgggcctacttctcgaggagaaggctgacggggaagcgacttctcggtcccggcagctgcttcaatacctctttagtctgagtcacgggctttctgcttcctccctccatcggttccatgagctcgagagctgcgcggctcgactgcacaccgccaagagcagcagcgggcttgctggttctatgggattctgtagcgatgaaatgggggacgacgacgtctttgaggactccacgagtgccaagttgaagtcccgcgtcctccgggcccctctctgcagcacggagaaagacagcgacctagactgtcccagccccttctccgagaagctgcctcctatttctcccgtttcgactagcggggatgtctgccggatatgtcactgcgagggcgacgatgaatctccattaatcactccctgccactgtacaggatcccttcactttgtgcaccaggcatgccttcaacagtggattaagagctctgacacgcgttgctgcgagctgtgcaaatatgagttcatcatggagacgaaactgaagcctcttagaaaatgggaaaagttgcagatgacctcaagcgaaagacggaagatcatgtgctccgttaccttccacgtcattgcaatcacctgcgtcgtttggagcctgtatgtccttatcgacaggacagcagaggagataaaacaaggccaagcgacaggaatcctggagtggcccttttggactaaattagtggtggtcgctattggcttcactggcggcctgctattcatgtatgttcaatgcaaggtatacgtgcagctttggaagcgtctgaaagcttataaccgtgtgatttatgtccaaaattgtccagaaactagcaaaaagaacatcttcgaaaaatcccccctcactgagcccaatttcgaaaataaacatgggtacgggatttgtcacagtgatacgaatagctcctgctgcaccgagcccgaggacaccggagccgagatcattcatgtttag

SEQ ID NO: 124007 - DNA, 270 bp, Artificial Sequence
  Description of Artificial Sequence: Synthetic coding sequence
atgagtatgccactacatcagatctctgccatcccttcccaggatgctatcagtgcccgtgtatatagatccaagactaaggagaaggaacgggaggagcagaacgagaagaccctcggccatttcatgagccacagcagtaatatttccaaggcagggtcaccaccctccgccagcgccccggccccagtgtcttctttttcacggacctctatcaccccaagcagccaggatatctgcaggatttgccattgtgaaggtgatgattag

SEQ ID NO: 124008 - DNA, 1041 bp, Artificial Sequence
  Description of Artificial Sequence: Synthetic coding sequence
atgctcaagtctcggctgcgcatgtttttgaacgagctaaagctcctcgtattgaccggggggggccggcctagggcagaaccacagccacgtggcgggaggggcggaggctgtgggtgggcccctttcgcggggtgctcaacccgcgacggcgacggcgatgaggaagagtactatgggtccgagcctagggctcgtggcctggctggcgataaagaaccacgagccggccctctcccacctccagcccctccacttcctccgcctggcgccctggacgctttatccctgtcttcctctctggactcaggtctgcggacgcctcaatgtcgaatttgctttcagggaccagaacagggtgaactcctgtctccgtgccgctgtgacggaagcgtccgctgtactcaccagccatgtctcattcgctggatttctgaaagaggatcctggagctgcgagctctgctattttaaatatcaagtcttggccatctctacaaagaatccgctccagtggcaggcaataagcctgaccgtgatcgaaaaagtgcagatcgccgctattgtccttggctccctgttcttggttgcctctatttcctggttgatctggagcagcctgagcccaagcgctaagtggcagcgtcaggacctcttgttccagatttgttacgggatgtatggttttatggacgtcgtgtgcatcgggcttattattcacgagggcagcagcgtttaccggatcttcaagcgctggcaggccgtgaatcagcagtggaaagtgctgaactacgataagaccaaggatattggcggggacgcggggggaggcacggctggtaaatccggccccaggaatagcagaaccgggcccacctcaggcgccacgtctcggccaccggccgctcagagaatgcgcaccctcctgccccagagatgtggctacacgatactgcatctcttgggacagctgagacctccggacgcccgctcatccagccattccgggcgggaggtcgtgatgagagtgacaacagtttag

SEQ ID NO: 124009 - DNA, 702 bp, Artificial Sequence
  Description of Artificial Sequence: Synthetic coding sequence
atggtaagcgacaaatgtcacatcctggacctcatcaaagcacagaggcggcagatgcttatcttgccagaaggcttccgggaggggtcatggtccaccctcctgtttcgcgcaacacaccacctggccctgcatcccttccttggcctgttcggtgccctttctccaacccagtggcaggccattagtctgacggtcatcgagaaagttcagattgctgcgatcgtgcttggctccctgttcctcgttgccagtatctcttggctcatctggtctagcctgagccctagtgccaaatggcaacgtcaagacctgctatttcagatctgttacgggatgtatggcttcatggacgttgtctgtatcggcctgattatccatgagggcagtagcgtataccgcatatttaagaggtggcaagctgtcaaccagcagtggaaagtcttgaactatgataaaacaaaagacatcgggggcgacgcaggaggcggaacggcgggtaaaagcggccccaggaactcacgaaccggcccgacgagtggtgccacaagcaggcctccggcggcccaacgaatgagaactctactcccccagaggtgcggatatacgattctacacctccttggacaactgcgtcctcccgatgcccgaagttcttcgcactctggcagggaagtggtaatgcgggtcacaacggtgtag

SEQ ID NO: 124010 - DNA, 3159 bp, Artificial Sequence
  Description of Artificial Sequence: Synthetic coding sequence
atgaaactggtgaatatctggttgctcttgctggtggtgctcctgtgcgggaaaaagcacctcggtgaccgcctcgaaaaaaagagttttgagaaagcaccgtgtccgggatgctcacacctcacattgaaagtggagttttcctcgaccgtggtagaatacgagtatattgtcgcctttaatggctacttcaccgcaaaggcccgtaactcatttatatcttcagctctgaaatcatccgaggtggataattggcgtattattccaagaaataacccgtcaagtgattatccgagtgattttgaggttatccagataaaggaaaagcagaaggccggcttgctgacgctggaagatcatcccaatattaagagggtgacccctcagaggaaagtgtttcggtctttgaaatacgccgagagcgatccgactgtaccgtgtaacgaaaccaggtggtcacaaaagtggcaatcgtctcggccgttacggcgggcctcgctgagtctgggttccgggttttggcacgctacaggcaggcactcctccaggcgtctcctgcgtgctatcccaagacaggtggcacaaacactccaggcagatgtgttgtggcaaatggggtatacaggagccaacgtgcgcgttgccgtatttgatacgggtttaagcgaaaagcatccacacttcaaaaacgttaaggagagaactaactggacaaatgaacggaccctggatgacggccttggtcatggcacatttgttgccggcgtaatcgccagcatgcgggagtgccaaggttttgccccggacgcggaacttcatatatttagagtgtttactaacaaccaagtgtcctacacctcctggtttttggatgcctttaactatgctatcctaaagaagattgatgtcctaaacctctcaattggaggcccggattttatggatcatccctttgtggataaggtgtgggaacttaccgcaaataacgtcatcatggtgtccgccatcggcaatgacggcccgctctacggaacgttgaacaacccagctgatcagatggatgttatcggggtgggtgggatcgactttgaagacaacattgcgagattttccagtcgcgggatgacaacttgggaattgccaggaggctatggcagaatgaagccggacattgtgacatacggagccggtgtgcggggttcgggcgtgaagggtgggtgtagagcattaagcggcacaagtgtagcaagccctgttgtagccggagccgtcactttgctggtatccacagtgcagaaacgagagttggtgaacccagcgtctatgaagcaagccctgatagcgtctgcccgaagactacccggagttaacatgtttgagcagggccacggaaagcttgaccttctgcgagcttaccagatcctcaactcttacaagcctcaggcctcgctgtccccttcctatattgatctgacggagtgtccctacatgtggccatattgcagccagccaatttattatggcggcatgccgaccgtagtcaatgtaacaattctgaatggaatgggagtcaccgggcgtattgttgacaagcctgattggcagccttatctgcctcagaacggagataacatcgaggtagccttttcttatagctccgtgctgtggccatggtctggttatctcgctatctccattagtgtcaccaagaaggcagcctcatgggaaggcatagctcaaggccacgtgatgatcaccgtggcatcaccagccgagaccgaatctaaaaatggcgcagaacaaacatcaaccgtcaagctacctatcaaggtaaagatcattccaacacccccccggagtaagagagtgctttgggatcaatatcataatctgaggtaccccccagggtacttccctcgggataatcttcgaatgaagaatgacccattggattggaatggcgaccacatccatactaattttcgcgacatgtaccagcacctgagaagcatggggtatttcgtcgaggtgcttggggcccccttcacttgtttcgacgctagtcagtatggcaccttactgatggttgactcggaagaggagtatttccccgaggaaatcgctaagttaaggcgcgacgtggataatgggctatcactggtaattttttctgactggtacaacacctcagttatgcggaaagtcaagttctacgacgagaacactaggcagtggtggatgcccgataccggcggagcaaatattcccgcacttaacgagctcctgagtgtctggaacatgggctttagtgatgggctctacgaaggcgagttcacgttagccaatcacgacatgtactacgcctccggttgttcaattgccaagtttcctgaagacggggttgtgattacccaaactttcaaggatcagggcctggaagtgcttaagcaggaaacagccgtggtagaaaatgttcccatactggggttataccaaatccccgccgaaggtggaggtcgaatagttctgtatggagattcaaattgtctggatgacagccacaggcagaaggattgtttttggttactggatgctctgcttcagtacacctcgtatggcgtgacccccccttcactcagccattccggcaataggcagcggccgcctagtggcgccgggtccgtgactcccgaacgcatggaaggaaaccacctccacaggtattctaaggtgttagaggcccatcttggcgacccaaaaccgagacccctacccgcgtgcccccggctatcatgggctaagcctcagcccctcaatgaaaccgcccctagcaacttatggaaacaccagaaattgctctcgatcgatctggacaaggtcgtgttacctaactttaggtccaatagaccgcaggtgcggcccctcagtccgggagagagtggcgcctgggacatcccaggcggcatcatgcccggtagatataaccaggaagtgggtcaaaccatcccggtgtttgcattcctgggggctatggttgtgctggcatttttcgtggtccaaattaacaaagccaagtctaggccaaagaggcgaaagcctcgggtgaagaggccacagctgatgcagcaggtacacccccctaagaccccgagcgtatag

SEQ ID NO: 124011 - DNA, 1494 bp, Artificial Sequence
  Description of Artificial Sequence: Synthetic coding sequence
atggcacttgtcggactgcctgggcacctgcatttctgtgaccaagagtccggattcttagggcgacattgtagcgggccgtgccacgaccactgcggcttccccagccgggatcgcgtaaagaagtggtgtcggaccgactttaattccaaattgccaatcaaggtcaagattattccaaccccaccacgctccaaaagagtgctatgggatcaatatcataatcttcgttaccctcccggatattttcctcgggacaatctgaggatgaagaacgaccccctggactggaacggagaccacatccataccaattttcgggacatgtatcagcacctgagatccatggggtatttcgtggaggtcctgggcgcccccttcacctgctttgatgcctcccagtatggaaccctgctgatggtggattctgaggaagaatatttcccagaggagatcgcaaagttacggcgggatgtagacaatggattatctctcgtaatattttctgactggtataataccagcgtcatgcgcaaggtcaaattctacgacgagaacactcggcaatggtggatgcccgatacaggtggagccaacataccagccctcaacgagctcttatctgtctggaatatgggattctcagacgggctttacgagggcgagttcactctcgctaaccacgacatgtactacgcttcaggctgctcgattgccaagtttcctgaggatggagtcgtcatcacacaaacatttaaggatcaggggctggaggtgctcaagcaggagacagctgtggtagaaaatgtgcccatcttgggtctataccagattcccgccgaaggcggagggcgaatcgttctgtacggtgatagtaattgtcttgatgactcccaccgtcagaaggattgcttttggctgcttgatgctttgctgcagtatacctcttacggcgtgacaccccccagcctgtcacattctggtaatcgccaacgcccaccgtccggcgctggcagcgtgacaccagagagaatggagggcaaccatctccaccgatactcaaaagtgctcgaggcgcacctaggggatccaaaacctagaccactgcccgcctgtccacgcctgagctgggctaaaccacagcctctaaatgagactgccccaagcaatctatggaaacaccagaaactactcagcatagatctggacaaggtggttctcccaaatttccggagcaatagaccacaggtccgtccactgtcgccgggagagagcggagcctgggacattccaggcggaatcatgcccgggagatacaaccaggaagtggggcagaccataccggttttcgcgtttctgggggctatggtggtgcttgccttttttgtggttcagattaacaaggctaagtctaggcccaagcgacgtaagccaagagtgaagcggccccagttaatgcagcaagtccatccccctaagaccccctcagtctag

SEQ ID NO: 124012 - DNA, 993 bp, Artificial Sequence
  Description of Artificial Sequence: Synthetic coding sequence
atgatcccagtttcacttgtggtcgtggtcgtgggcggatggacagtcgtgtatcttacggatctggtgctgaaaagcagcgtgtactttaaacattcatatgaggattggctagaaaataatggcctgtccatcagtccatttcacattcgatggcagaccgccgtattcaacagggcattttacagttggggtagaaggaaagctaggatgctgtaccagtggtttaatttcggaatggtatttggggtcattgcaatgttcagtagcttctttctactcggaaagaccttgatgcagaccctggcccaaatgatggctgactcaccaagcagctacagctccagttcttcgtctagcagctcatccagctcctcttctagttcatcgtcctcctcctcgagctctctccataatgaacaggtgctgcaagtggtggtccctggtataaacctcccagttaatcagcttacttacttttttaccgcggtgctcatttccggcgtagttcacgagatcggtcacggaattgcagcaattcgcgaacaagtcaggtttaacggttttggaattttcctgttcattatatatccaggggcattcgtggacctgtttaccacccacctgcagctgattagcccagtgcagcaactacgcatattctgtgcggggatctggcacaactttgttctggcattactgggaatattggcgcttgtacttctcccagtgattttactacccttctactatacaggagtaggagtcctcattaccgaggtggccgaagactccccagccatagggccacgtggtctgtttgtgggcgatctggtaactcacctgcaggattgtccggttaccaacgttcaggattggaacgaatgtttagacactattgcctacgaaccccagattggttactgtattagcgcgtccactctgcagcagctgagttttcccgtacggggcgtttacatttcttccatttag

SEQ ID NO: 124013 - DNA, 1560 bp, Artificial Sequence
  Description of Artificial Sequence: Synthetic coding sequence
atgataccagtgagcttggtggtagtcgtggtgggaggatggacagtggtctatctgacagatctggttttgaagagttctgtctacttcaaacactcctacgaagattggctcgagaataatggccttagcatctcgccttttcatattagatggcagactgccgtgttcaaccgcgctttctactcatggggccgcaggaaagcccggatgctctatcagtggttcaacttcggcatggtgtttggagtgattgccatgttcagttccttttttctgctgggaaagacattaatgcagactctggcccagatgatggcggactcgcccagctcttactcaagtagctcttcctcttcttcctctagctcatctagctcatcgtccagctcaagcagctcaagctccctgcacaatgagcaggtactgcaagttgtcgtacccggaattaatctgcccgtcaaccaacttacatacttctttactgcagtgttgattagcggagtggtccatgagatcgggcacggcatcgcagccatccgcgaacaggtgcggttcaatggatttggaattttcctgtttatcatctacccgggcgctttcgtggacctgttcacaacacatttgcagctgatttcccccgtgcagcagcttcgcatcttttgcgctggcatctggcataatttcgttctagcgctattagggatacttgctctggtgctgctacccgtgatactcctccctttctattatactggagtaggcgtgctcataactgaggttgccgaggactcccctgccatcggcccaagaggcctgttcgtgggggacctagtgactcaccttcaggactgccccgtcactaacgtgcaggactggaatgaatgtcttgatactattgcctatgaaccgcagatcggctactgcatctctgcaagcacactacagcagctcagctttcctgtgagggcttacaaacgactcgacgggtctacagaatgttgtaataaccattccctgacagacgtctgcttttcctatcgaaataattttaacaagagactacacacctgtcttccagcaaggaaggcagtggaggccacgcaggtctgccgcactaataaggactgtaaaaagagttcgtcctctagcttttgtatcattccttctctggagacccacacaaggctcatcaaggtcaagcatccaccacagatcgacatgctgtatgtcggacaccccctgcacctgcactatacagtgtccatcacttccttcataccgagatttaacttccttagtatcgatctccctgtcgtcgtcgaaacctttgtgaaatatttgataagcttgtcaggggcattggccatcgtaaatgccgtcccttgctttgccctagacggacagtggatcctcaactcttttctagacgcgacgttgacctctgtgatcggagataatgatgtgaaggacctgatcggtttctttatcctgttaggggggagcgttctattggcggcaaatgtcaccctcggtctgtggatggtgactgctagatag

SEQ ID NO: 124014 - DNA, 207 bp, Artificial Sequence
  Description of Artificial Sequence: Synthetic coding sequence
atgcatcagacatactcgcgccactgccggcctgaggaacggtggtcccaggagggttggaatatccccgcaaacgggttcaatatttgcagatgcctgaatataggtatgaaactgcggttatggaataacctcaacaagagtaatatacttggggcccttaaaatcaagaggcgggagattcgggctccttttttactcccctag

SEQ ID NO: 124015 - DNA, 762 bp, Artificial Sequence
  Description of Artificial Sequence: Synthetic coding sequence
atggtgctgttgaaacttctggaggtgtaccgcaagggctcggcgggaacctttcataagagtacgatctttggaaatactatcatgacttcacagccagtccctaatgaaacaatcattgttttgccttccaacgtgatcaacttctcacaagccgaaaagccggagccgactaatcaaggacaagacagtctgaagaaacacttgcacgcagagataaaggtaatagggacaatccagattttgtgtggaatgatggttctgtccctcggaataattctcgcctcagcctctttctcacccaactttactcaggtgactagcacactgttaaacagcgcatatccttttattggcccgttcttctttatcatcagtgggagtctctcaattgctactgaaaagaggctgaccaaacttttagtacactcatccctggtaggatctatcctgtctgcactgtcggccctggtgggtttcattatactgagtgtcaagcaagcgacgttgaaccctgcttccctacagtgcgaattggacaaaaacaacatccctacacgttcatacgtgtcctatttctaccatgactctctttacactacagattgttacaccgcaaaagctagtttggccggcactctgtcactgatgctgatatgtactctgctggagttctgcttggcagtgctcacagcagtgctgaggtggaaacaagcatactccgactttcctggcgtatctgtcctggcggggtttacctag

SEQ ID NO: 124016 - DNA, 804 bp, Artificial Sequence
  Description of Artificial Sequence: Synthetic coding sequence
atgaaggcagaagccactgtaattccctcaaggtgtgcgaggggcttacccagttggcaggttctttcccccgttcagccatggcagacctcagccccccagaacaccacacagccaaagcttttggcacctcaccaacacgagaagtcgcaaaaaaagtccagtctccttaaagagttgggtgccttccacattacaatcgccctgcttcatctagtattcggcggttacctggcttcaatagtaaagaatcttcatctcgtcgtcctgaagagttggtacccattttggggagcagccagcttcctcatttccgggatacttgcgataactatgaaaacattcagcaaaacctatctcaaaatgctctgcttgatgactaacctcatatctctgttttgtgtgcttagtggattgtttgtcatcagcaaagaccttttcctcgaatcaccatttgaaagtccaatctggcggatgtaccctaattctactgtccacatacagaggttggagcttgctctcctttgcttcaccgtgttagagctgtttctgcccgtgccaacagcggtcacagcctggaggggggactgtccttctgcaaaaaatgacgatgcttgcctggtgcccaacacccccctacacttaaaaggcctccccgtggaaccaccaccatcctaccagagtgtgatccagggggacgcccagcacaaacagcaccaacgattgcgcgaagttaagcaggtggcaccagatacttggatcgttacggatggggccgcaatctggactcagaccgctaattag

SEQ ID NO: 124017 - DNA, 804 bp, Artificial Sequence
  Description of Artificial Sequence: Synthetic coding sequence
atgatgtcgtcaaaaccaaccagccacgccgaggtgaacgagaccataccgaacccttacccaccttcctccttcatggcccccggcttccagcagcctctgggtagcataaatctggaaaaccaggcacagggcgcccagcgagcccagccttatgggattacctctcccggcatattcgccagctcccaacccggccaggggaatatccaaatgatcaacccctccgtgggaaccgcggtcatgaactttaaggaggaagcgaaggcactgggcgtgatccagatcatggttgggctcatgcatattggtttcggtatcgtgttgtgtctgatatctttttccttcagggaggtcttgggatttgcctcaacggcggttatcggcggttacccattctggggaggcctctctttcatcatttccggaagcctgtcggtctcagctagtaaagaattatctcggtgtcttgtgaagggaagtctaggaatgaatatcgtgagtagtatcctcgcctttattggcgtgattctgctcctcgtggatatgtgcattaatggagtcgcaggccaggattactgggccgtcttgtcaggaaagggaatctccgcaacactaatgattttttcattactggagttcttcgttgcctgcgccaccgcccactttgccaatcaggctaataccactactaacatgtccgtactggtaatccctaatatgtatgagagtaaccctgtgacccctgccagcagcagtgctccccctcgttgtaacaactactcggctaatgcccctaaatag

SEQ ID NO: 124018 - DNA, 345 bp, Artificial Sequence
  Description of Artificial Sequence: Synthetic coding sequence
atgatgtcgagtaaacctacctcgcacgccgaagttaatgagacaatccccaatccgtacccacctagcagttttatggccccaggatttcaacagccactgggcagtattaacctggagaaccaggcgcagggggcccaacgggcacaaccttatggcattacaagtcctggaatcttcgctagctcgcaacccggccaggggaatatacagatgatcaatccttccgtggggaccgccgttatgaactttaaagaggaggcgaaggccctgggcgtaattcagataatggtggggctcatgcatattggctttggcattgtgctgtgtctgattagcttttag

SEQ ID NO: 124019 - DNA, 666 bp, Artificial Sequence
  Description of Artificial Sequence: Synthetic coding sequence
atgatgtcgtctaaacctacaagccatgccgaagtgaacgagacaatcccgaacccctatccccctagttcgtttatggcgcctgggttccagcaacccctaggatcgatcaacttagaaaatcaagcgcagggcgcccaacgagctcaaccctacggtattaccagccctggtattttcgcctcgtcccagccaggccagggaaacatccaaatgattaaccccagtgtgggtacagccgtgatgaacttcaaagaggaggctaaggcacttgggtttattatctcgggaagtttgtccgtctcagcttccaaggagttatcacggtgcctggtgaaaggcagcttgggtatgaatatcgtctcatctatactggcctttatcggagtcattctgttgctggtcgacatgtgtatcaatggagtggcagggcaggattattgggctgtgctgagtgggaaaggcatttccgccactctcatgatattctccctcctggagttctttgtagcctgcgccacggcccacttcgctaatcaagctaacaccaccacaaacatgtctgtgctcgttatccccaacatgtacgaatccaacccggtcacccctgccagttcatcggctccaccgagatgcaataactatagcgcaaatgccccaaagtag

SEQ ID NO: 124020 - DNA, 972 bp, Artificial Sequence
  Description of Artificial Sequence: Synthetic coding sequence
atgaccgagcaggttatcggcgcgaattccgttcccggtatcatcgcgcctgataatgtccatgttatacagccttccaatcctgtggcgagtggcaaccaccttcagccaagcgaagtaacaacctatccaattagcccgaaagtgatccactgcgacaccggtagagcgaacttgcagaacctgttggtggttaatcagaattctgctgctggcgtgcagtcccaacctatcgggtatcagcggcaataccctgttggcactgccagcttgcagacagtgccaggagtcatccagtacacacagggaactacaaatctgcagacctggccaggtgatctccagaaccccctgaatgctaatcctggccttacccatacctctaattcctcgcagtggaacacatctttcgcgtcctttacatcattcaatccaaaaaagttcatcaatgaggaggttcgtacccttggcgctattcaaattctaatcggacttactcatatttttagcgcaattaatccagtcctttactactaccccttcgtgacctggctaagcgggtatcctttgtggggcggcctcagttatatcgttagtgggtccctgtccgtttgggctgctaaagatccttccccctgtgtcgtgaacagctccatttcattcaacatcatatcagccctttttgcctttgcaggcattttcattatcattactgacttgtcactttactacgtgaccacatatagcaaggccgtgagtggtggccttctgccgttcgccctgctcgagtttatcttaacctgcgttgtgagccacttcggatgtcaggccacttgttgcaggcagtttgaaaacgtggcggtgatccctaccgtgttttcctttaaccccgcaaacactacgacatcccccgttaacgccactacagggcccgtcaacgcagccaccgggcccgtttccgctacaaattag

SEQ ID NO: 124021 - DNA, 735 bp, Artificial Sequence
  Description of Artificial Sequence: Synthetic coding sequence
atggatacagaatcaaatcgcagagccaatctggccctaccccaagaaccttcttccgtgcccgccttcgaagtgctcgagatcagcccccaggaagtgagttctggccgattgctgaagagcgctagtagccctccgcttcacacatggctaaccgtgttgaagaaagaacaggaattcttgggggtgactcaaatactgacagcaatgatctgcctgtgttttggcaccgtggtgtgctctgtactggacatctcccacatcgagggggatatcttttcatccttcaaggctggctacccgttctggggcgccatattctttagcatatctgggatgttgtctatcatcagcgaacgtcggaacgccacctacctcgtccggggcagtctgggagccaacacagccagttcaatcgctgggggtaccggtatcaccattttgatcattaacctaaaaaagtccctggcctacattcacatacattcttgtcagaaattcttcgaaaccaagtgcttcatggccagtttctcgacggagatcgtggttatgatgttgtttctaaccatccttgggctcggctctgcggtttcactgacaatatgcggagctggggaagaattgaaagggaacaaagttccggaggatagggtatatgaagagctcaacatctatagcgccacctattctgagctggaggatccaggggagatgtcccctcctatcgatctgtag

SEQ ID NO: 124022 - DNA, 126 bp, Artificial Sequence
  Description of Artificial Sequence: Synthetic coding sequence
atggacacggagtccaaccgtagagcaaacctggcactgccccaggaacccagtagcgtcccagcttttgaagtcctggaaatctccccacaggaagttagctctgggaggttacttaaatcttag

SEQ ID NO: 124023 - DNA, 645 bp, Artificial Sequence
  Description of Artificial Sequence: Synthetic coding sequence
atggctagtcatgaggtggacaacgctgaactcgggagcgcgtctgcccacggaacacctggctccgaagcggggccagaagaactaaacacaagcgtttatcagccaatcgacggaagtcccgattatcagaaggcaaagctgcaagtcctgggcgccattcagatcttgaatgccgcgatgatactggccctgggcgtctttctggggtctctccagtatccctatcattttcagaagcacttttttttctttactttctatacgggctaccccatttggggagcagtgtttttctgctcgtccggtactctgagcgttgtggcgggtatcaaaccgacgagaacgtggatccagaacagttttggcatgaacatcgcgagtgccactatcgcactggtcgggaccgctttcttgagtctgaatatagctgtcaatatccagagcctccgtagctgccattcatcttccgagtcccctgatttgtgtaactatatggggtcaatcagcaatgggatggtgtccttgctgctcatcttaaccctactggagctgtgcgtgactatctctacaattgctatgtggtgcaatgccaattgctgcaattcccgcgaagagatttcctctccccccaatagcgtctag

SEQ ID NO: 124024 - DNA, 507 bp, Artificial Sequence
  Description of Artificial Sequence: Synthetic coding sequence
atggcatcccatgaggtcgataatgcagagcttgggagcgcgtctgctcatggaacgccggggtctgaggcgggccccgaggaactgaatacctcagtctaccagcccattgacggctcaccagactatcaaaaggcgaaattacaagttctgggtttttgctctagtggaacactcagcgtcgtcgctggcatcaagccaacacgcacctggatccaaaattctttcggaatgaacattgcgagtgccaccatcgcgttagtggggactgctttcctatccctgaatattgccgtgaatatccaatcactacgtagctgccactcgtcctcggaaagccctgacctgtgcaactatatgggatcgatttccaatggaatggtttccctcctgctcattctgacactgttggagctgtgcgtcacaattagcaccatcgccatgtggtgtaatgccaattgctgtaattcgcgagaagaaattagtagtccacctaattctgtatag

SEQ ID NO: 124025 - DNA, 276 bp, Artificial Sequence
  Description of Artificial Sequence: Synthetic coding sequence
atgaatatcgcctctgctactattgcactcgtgggcaccgccttcctgagtctgaatattgccgtcaatattcagtccctccgatcttgccactcttcatctgagagtcctgacttgtgcaactatatggggtctataagtaacggtatggtgagtctgttactgatcctgactttgctagaactctgcgttacaatatccaccatagcaatgtggtgtaatgctaactgctgtaactcacgtgaggaaattagcagtccccctaacagtgtttag

SEQ ID NO: 124026 - DNA, 507 bp, Artificial Sequence
  Description of Artificial Sequence: Synthetic coding sequence
atggcttctcacgaagtagataacgccgaactagggtctgcaagcgctcacggaactcccggaagtgaggccggacctgaggagttgaacacctccgtgtaccaacccatagatgggagcccagattatcagaaggcaaagctgcaggtgctcggtttttgctctagcggtactttaagtgtcgtggcaggtatcaaacctacaagaacatggattcagaattcttttggcatgaacattgcttccgcaacaatcgccctcgtagggaccgccttcctgagtcttaatatcgcagttaatatccagtctctgaggtcatgccactcctcgtcggagtctcccgatctgtgtaactacatggggtccataagtaacggcatggtgagcctgttgctgatattgaccctcctcgagctgtgcgtgactatcagtactatcgcaatgtggtgtaacgctaattgctgtaactccagggaggagatatcttcccccccaaatagtgtgtag

SEQ ID NO: 124027 - DNA, 720 bp, Artificial Sequence
  Description of Artificial Sequence: Synthetic coding sequence
atgcatcagacttactcacgacattgtaggccagaagaatcaacattctccgctgctatgactactatgcaaggcatggagcaggccatgcccggtgctggaccaggggttccacagctcgggaatatggccgtcatacactctcacctgtggaaaggacttcaggaaaagttcctgaagggggaaccaaaagtccttggagttgtgcagatcctaaccgcgcttatgtccctgagcatgggaattacgatgatgtgcatggcttcaaacacctacggctcaaatcctataagtgtgtacatcggctatactatctggggtagcgtgatgttcatcataagcggaagtctgtccatcgccgcaggaatccgcacgacaaaaggactggtgcgcgggagccttggcatgaacataacgtcatcagtcctggccgcatctgggattctgatcaacacgttttcactcgccttttattcctttcatcacccatactgcaactattatggaaatagtaataattgtcacggcacaatgagtattctaatgggacttgacggtatggtgttgttactgtctgtccttgagttttgtatcgcagtgtcactttccgccttcgggtgtaaggtcctctgctgcactccagggggtgtcgtgctgatcctgcctagtcactcacacatggccgagacagcgtcaccaaccccacttaacgaagtctag

SEQ ID NO: 124028 - DNA, 663 bp, Artificial Sequence
  Description of Artificial Sequence: Synthetic coding sequence
atgactaccatgcagggtatggaacaggcaatgcccggcgccggacccggagttccccagctgggcaatatggctgtgatccacagccatctctggaagggccttcaggaaaagttcctaaagggggagcccaaggtgctcggcgtagttcaaattctaacggctctcatgagtttaagcatgggaataaccatgatgtgcatggcatcgaatacttacggcagcaaccccatctctgtatatatcggctacacgatctggggaagtgtaatgttcatcatatctggttcactttctattgcagctggaattagaaccacaaaaggcctggtcagagggagtctgggcatgaacattacgtctagcgtgttggcagccagcggaatcctgataaacacattctcactcgccttttattcatttcaccatccctattgtaactactacgggaatagcaacaactgccacggaaccatgtcaatcctgatgggcctcgatgggatggtcctcctgttatcagtgctggaattctgtattgcagtgagcctcagcgcatttggatgtaaagtcttgtgttgtactcctggaggggtggtgctcatcctccccagccactcccatatggccgagacagccagtccaacaccacttaatgaagtttag

SEQ ID NO: 124029 - DNA, 663 bp, Artificial Sequence
  Description of Artificial Sequence: Synthetic coding sequence
atgacaaccatgcaaggcatggaacaagctatgccaggagccggaccaggcgtgccgcagcttgggaacatggctgtgattcattctcatttatggaaggggctgcaggagaaatttctcaagggggaacccaaggtactcggcgtggtacaaatcctcaccgctcttatgtccctgtccatgggaatcactatgatgtgtatggcttctaatacatacggctcaaacccaatctccgtatatatcggctacacaatctggggctcagtcatgttcattatctctggtagtctttccatcgccgccggaatcagaaccacaaaagggctggtgcgtggcagtctaggaatgaatattacaagctccgtccttgctgcaagcgggatcctgattaataccttcagtctcgcattttactccttccaccacccttattgcaactactatggcaacagtaacaattgccacgggacgatgtctatcctgatggggctggacggaatggtgctgttgctgtcggttctggagttctgtatcgcagtgagcctgagcgcttttgggtgcaaagttctgtgctgtactcccgggggcgtggtgctgatactgccatcccactctcacatggctgagaccgcttctcctacgcccttgaacgaggtgtag

SEQ ID NO: 124030 - DNA, 561 bp, Artificial Sequence
  Description of Artificial Sequence: Synthetic coding sequence
atgcatcagacctactctcggcattgtaggcccgaggagtcgaccttttcagcagctatgacaactatgcaagggatggagcaggctatgcctggggccggacctggggtcccccaattgggcaacatggctgtcatccacagccacttatggaagggtctgcaagagaaatttctgaaaggcgaacctaaagtgttgggagtggttcagattctgaccgccctgatgtcactctccatgggcattaccatgatgtgcatggcttcaaacacctatggctcaaatcccatatcagtgtacatcggctacaccatttggggctctgtcatgttcattatctctgggtctctttctatagccgccggcatccggacaacaaagggcctagggctggacgggatggttctgctcctgagcgtgctagaattttgcatcgccgtgagtctttcggcctttggctgcaaagtgctctgctgcacgcctggcggcgtcgtgctcatcctccctagccactctcatatggccgagacagccagtccaactccactgaatgaagtttag

SEQ ID NO: 124031 - DNA, 399 bp, Artificial Sequence
  Description of Artificial Sequence: Synthetic coding sequence
atgaccaccatgcaggggatggagcaaacaacacctggggcagggcccgatgtaccccagctgggcaatatagacgtgattcactcctacttgtgcaaggggcttcaggaaaaattctttaaaagaaaaccaaaggtgctcggcgtggtgcgcattcttatcgctttgatgagcctttctatgggcattattatgatgtgcgtcgcgttctccagctatgaggagcatccgatctttgtgtacgtcgcctacacaatctgggggtcagtcatgtacccctaccagttgcagcaagagctggaacaacagaaagtgtggaattatctcaagaatctgtcctggaggattatgggctcctacctgtgttttggggagaggagtgaactcaaaccgctctag

SEQ ID NO: 124032 - DNA, 333 bp, Artificial Sequence
  Description of Artificial Sequence: Synthetic coding sequence
atgactactatgcagggcatggaacagacaactcctggcgccggccccgacgtgccccaactgggtaacatcgatgttatccactcttatctgtgcaagggcctgcaagaaaagttctttaagagaaagcccaaggtccttggggtgttgtgtggccataagtttagtacccactccgtttcattaagcgttgctgctggaatcagaacgacgaagggactggaattgtcggaggaatttaaactggagaacaatgggatcatcttcgtgttctggagggagattagagtggagacgacgattcgaaggcaggttaggagattattaaagtag

SEQ ID NO: 124033 - DNA, 615 bp, Artificial Sequence
  Description of Artificial Sequence: Synthetic coding sequence
atgtcttacattcacatctgcgtgaaagactgtaagaggtcatctagcagagggaaccctaaaagtttgggtttttgcgttgatatttcatttcagctgatccgagttgtccgcattctaatagcactgatgagcctgtccatggggattattatgatgtgtgtggcattcagcagctacgaagagcacccaatcttcgtgtacgtcgcttatacaatttggggctctgtaatgtacccctaccagctgcaacaggagctcgagcagcagaaggtgtgcatttacagagtgctcaacggtgcacaggcaggtgttcagtggagggatctgggcagcctacagcctcctcctccaagccggctgccatggccacctaaagtgcccagggttcaacctcttcccggtcgacatccagtgtgggaagttcgctccgtgtccgcctggccaccaatcgtctgggacgttcggagtcccagcgcatggctgccatctctggaatcagaggagaggctgtgtcccgctgctatacccagcaggaaatggggagcccccctcccgggacaccatccaatttgggaggtgaggtcagtgtcggcccggcccccaatcttctag

SEQ ID NO: 124034 - DNA, 399 bp, Artificial Sequence
  Description of Artificial Sequence: Synthetic coding sequence
atgaccacaatgcaagggatggagcagaccacccctggagcaggtccagatgtgcctcagcttggcaatattgacgtgattcatagctacctctgcaagggcctgcaagagaagttcttcaaacgcaagcctaaagtccttggcgtggttcggattctcattgcgctgatgagtctgtccatgggtattatcatgatgtgcgttgcgttcagctcctacgaggagcaccctatttttgtgtatgtggcatacacaatctgggggagcgtaatgtacccctaccaattgcagcaagagctcgaacagcagaaagtatggaactaccttaaaaacctgagctggaggattatgggtagctacctgtgttttggggagcgatctgagctgaaaccactgtag

SEQ ID NO: 124035 - DNA, 603 bp, Artificial Sequence
  Description of Artificial Sequence: Synthetic coding sequence
atggatagctctaccgctcacagcccagtgttccttgttttcccacctgaaataactgcttctgagtatgagagtacagaactctccgcaaccactttcagcacccagtcccccctgcagaagcttttcgcacgcaaaatgaagatccttggaaccattcagatcctatttggcatcatgactttctccttcggtgtgatcttccttttcacactgctgaagccttatcctcgcttcccgttcatattcctctctggctacccgttctggggctcagtcctatttatcaattctggggccttcctgattgccgtcaaacgaaaaacaaccgagacactgattattttatcgaggataatgaacttcctgtcggctctgggagccattgcaggtataatcctactcacctttggtttcatcctggaccagaattatatctgcgggtatagccatcagaactcacaatgcaaggctgtcaccgttctattcctgggcatcctcattacgctgatgacattctctattatcgaactctttatttctctccctttcagcattctcgggtgccacagcgaggattgtgactgtgaacaatgttgctag

SEQ ID NO: 124036 - DNA, 747 bp, Artificial Sequence
  Description of Artificial Sequence: Synthetic coding sequence
atgacaagccagcccgtgcccaatgaaacgataatagtccttccatcgaatgtgatcaatttcagccaagctgaaaagccagaaccaaccaatcaggggcaagatagtctgaagaaacatctccatgcagaaatcaaagttattggcacaatacaaattctttgcggcatgatggtcctctccttgggcatcattcttgctagcgcatcattctcaccgaattttactcaggtgacatccaccctgcttaattcggcctatccatttatcggaccattttttttcataatatcaggatccctcagcatcgctaccgagaaacgtcttactaagctgttggtacacagctctctggttgggagcatcttgtctgctctgtctgcactggttgggtttatcatcctgtccgtgaagcaggcaactttgaatcccgcctccctgcagtgcgagctggataaaaataacattcctacgcggtcctacgtttcttatttctaccacgactcgttgtatactacggactgttatacagcaaaagcctctctagccgggactctgtccttgatgttaatatgtaccctattagaattctgcctcgccgtcttgacggccgtgttgcgttggaagcaggcctattccgacttccccgggtccgtgctgttcctgccacactcttacatagggaatagcggaatgtcgagtaaaatgacacacgactgcgggtacgaggagttgctcacttcttag

SEQ ID NO: 124037 - DNA, 537 bp, Artificial Sequence
  Description of Artificial Sequence: Synthetic coding sequence
atgacatctcagcctgtcccgaacgaaactataatcgtcctaccttcaaatgtgatcaacttttctcaggctgaaaaacctgagccgactaatcaggggcaggactctttgaagaagcatttgcacgcggagattaaagtaattgggacaattcaaattctttgtggcatgatggtgttgtccctgggcatcatccttgctagtgccagttttagtcctaacttcactcaggtgactagcacactgctgaattctgcctaccccttcatagggccatttttcttcatcatcagcgggtctttgtcaatagccactgaaaaacgtctaactaagctcctggtgcatagcagcttggtgggttctattttgtccgccttgagtgctctggtgggctttattattttgtcggtgaagcaagcaacacttaatccagcttccttacagtggaactccctaagcgatgccgatctccattcggctggtatccttccctcctgtgcccattgttgcgctgcagtggagaccggtttattgtag

SEQ ID NO: 124038 - DNA, 543 bp, Artificial Sequence
  Description of Artificial Sequence: Synthetic coding sequence
atgacttcccagccagttcccaatgagactattatagtcttgccgtctaatgtgattaatttttcacaggcggagaagccggagccgaccaatcaggggcaggatagtttgaagaagcacttacacgcagaaataaaggttatcggcttcattatttccgggagtctttctattgccaccgagaagagactgacaaaacttctagtccactcctctctcgtaggaagcatcctgtccgccttgtccgctttagtaggatttatcatcctgtcagtgaaacaggctacactgaatccagcatccctgcaatgcgaactggacaagaacaacattccaacccgctcttatgtgagctacttctaccacgactctctgtataccaccgactgttacacagccaaagcaagccttgctggaacactgtctctgatgctgatctgcaccctgctggagttctgcctagccgtcctgacggccgttttaaggtggaaacaggcctactccgactttcccggtgtgtccgtattagccgggttcacctag

SEQ ID NO: 124039 - DNA, 678 bp, Artificial Sequence
  Description of Artificial Sequence: Synthetic coding sequence
atgacttcccagccagttccaaacgagacaattatagtgttgccatctaacgtgatcaattttagtcaggcggaaaagccagagcccaccaaccaggggcaagattctctgaagaaacacctgcacgccgaaattaaagtaattggaacaattcagatactttgcggaatgatggttctttctctaggtatcattcttgcctccgcatcattctcaccaaactttacccaggtgacatctacattgctcaactcagcttatccctttattggtcccttcttctttataatcagcggctcactgagcatcgcaaccgagaaaagactcactaagttgctggtgcacagtagcctggtgggctcgattctgagcgctttgtccgccctagtgggatttattatcctctccgtcaagcaggcgacactcaacccagccagtttgcagtgtgaactcgacaagaacaatattccaaccaggtcatatgtgagctacttctatcacgacagtctgtacaccacagattgttacacagccaaggcgagcttggctggcacgttgtctctcatgctcatttgcacattactggagttttgcctagccgtacttactgctgtcctcaggtggaagcaagcttacagcgatttccccggcgtgtccgttctcgccgggttcacttag

SEQ ID NO: 124040 - DNA, 831 bp, Artificial Sequence
  Description of Artificial Sequence: Synthetic coding sequence
atggtgctcctcaagttgctcgaggtctaccggaagggaagcgccggcacattccacaagtccactatcttcggaaatacaattatgactagccagcccgtgcccaacgaaactattatcgtactgccatccaacgttataaactttagccaagccgaaaagcctgaacccacgaaccaggggcaggacagcctgaaaaagcaccttcacgctgagatcaaggtcatcggcaccattcagattttgtgcggcatgatggtcctttcattgggtatcatcctcgcttctgcttctttcagcccgaacttcactcaggttacttccaccctgctgaattctgcgtacccctttatcggtccattcttcttcatcatatcagggtcattgtcaatcgcaaccgaaaagaggctgaccaaattgttagttcattcttcacttgtcggtagtattttatcggcactctccgcattagtgggctttatcatcttgagcgttaagcaggcgacccttaatcctgcctcgctccagtgtgagctggacaagaacaacatcccaaccaggagttacgtaagctatttctaccacgacagcctgtacaccaccgattgttataccgccaaggctagtctcgcaggaaccctgtctttgatgctcatttgtaccttgcttgaattttgtctggctgtattgactgccgttctccggtggaaacaagcatatagcgatttcccaggcagtgtgttgttcctccctcattcctacatcggtaacagcgggatgtcctctaagatgacacatgattgtggatacgaggagttactgacctcatag

SEQ ID NO: 124041 - DNA, 747 bp, Artificial Sequence
  Description of Artificial Sequence: Synthetic coding sequence
atgacttcccagcccgtccccaatgaaactataattgttctgcctagtaacgtgattaacttctcccaggccgaaaaaccagagcctacaaatcaggggcaagactctctgaaaaagcacttgcatgctgagatcaaggttatcggcacgattcagatcctctgcgggatgatggtcctctctctcggaataattctggccagtgcttcgttctctcctaattttacccaggtgactagcaccttgctgaattcggcctaccccttcattggcccctttttttttattatctccgggagcctgtcaattgctaccgaaaagaggcttacaaaactactggttcatagcagcttggttggctccatcctcagcgcgctgtcagcgctggtggggttcatcatcctctccgtgaaacaggcaacgttaaatcctgctagtctccagtgcgaactggataaaaacaacattcctacgagaagttatgtatcttacttctatcacgatagtctgtacactacagactgttacacagctaaggcctcactggccggaacactatccctgatgttaatttgtaccctgctagaattctgcctggccgtgctcacggcagtacttaggtggaagcaagcatactccgatttcccaggaagtgtgctgtttctgccccactcttatatcgggaacagcgggatgagctcaaaaatgacacacgactgcgggtacgaggaactgcttacaagctag

SEQ ID NO: 124042 - DNA, 72 bp, Artificial Sequence
  Description of Artificial Sequence: Synthetic coding sequence
atgacctcacagccagtaccaaatgagacaatcattgtccttcccagcaacgtaatcaacttctcgcaatag

SEQ ID NO: 124043 - DNA, 444 bp, Artificial Sequence
  Description of Artificial Sequence: Synthetic coding sequence
atgactagccagcccatctctaatgaaaccatcattatgttgccaagcaacgtgatcaatttctcacaggctgagaagccggagcctacgaaccaaggacaggattccctgaagaagcgccttcaagctaaggttaaggtgatcggcgtgcactccagcctagctggatcaatcttgtcagcactcagcgctctcgtcggcttcattctgctttccgtgaatccggccgccctgaatcctgcctctctgcagtgcaagcttgatgagaaagacatacccacaagactcctactgtcttatgactaccactcaccttacacaatggactgtcatcgcgccaaggctagcctcgcaggcaccctatctttgatgttggttagtactgtcctggagttttgtcttgctgtactgacagctgtcctccaatggaaacagacagtctag

SEQ ID NO: 124044 - DNA, 723 bp, Artificial Sequence
  Description of Artificial Sequence: Synthetic coding sequence
atgctcttacagagccaaaccatgggagtttctcattccttcaccccgaaggggatcaccatcccccagagagagaaaccaggccacatgtaccagaacgaggactacctgcagaacgggctgccgactgaaacaacagttctggggactgtccaaattctttgctgtctgcttataagtagcctgggcgctattcttgttttcgctccctatcccagccatttcaaccccgccatttccaccacactcatgagtggctacccgtttcttggcgccctttgctttggaatcaccggctccctgtctataatctcaggcaagcagtccactaagccgttcgacctgagcagcttgacgtcaaacgccgtgtcatcggtaaccgccggtgctggcttatttctgctggctgattcgatggtggctcttagaactgcatctcaacactgcggtagcgaaatggattacctgtcatcgctgccatatagcgaatactattaccccatatacgaaatcaaagactgcctgttaactagtgtctcactgacaggcgtactcgttgtcatgttgatctttacagtgttagaattgctcctcgccgcatattcaagcgtgttctggtggaaacagctgtattccaataatcctggatcgtccttttcatcaactcaaagccaggatcatatccaacaggtcaaaaaatcatcctcacgatcttggatctag

SEQ ID NO: 124045 - DNA, 588 bp, Artificial Sequence
  Description of Artificial Sequence: Synthetic coding sequence
atgctgttacaaagccaaaccatgggtgtctctcattcctttacccctaagggtattacaatcccacagagggagaaacccgggcatatgtatcagaatgaggattacttacaaaatggtctgccgaccgaaactaccgtcctgggctttgggattacaggaagtctgtctatcatctccggtaaacagagtaccaaacccttcgatctgtcttcccttacttcaaatgccgtgagcagtgtgaccgccggggctgggctgtttctgttggctgattctatggtggccctacgcactgcctcacagcactgcggatctgagatggactacctctcctcactcccttatagtgagtactattatccaatttacgagataaaagattgcttactgacttccgtcagcttgacgggggtgctcgtggtgatgttgatttttaccgtgctagagttgctcctcgctgcttattccagcgtgttttggtggaaacagttgtattctaataatcccgggtccagcttttctagcacacagagtcaagatcacattcagcaggtgaaaaagagtagtagtcgttcatggatctag

SEQ ID NO: 124046 - DNA, 510 bp, Artificial Sequence
  Description of Artificial Sequence: Synthetic coding sequence
atgctcctgcagtcccagacaatgggcgtaagccacagtttcactcccaaaggcattactatcccccaacgtgagaagcctggtcacatgtaccagaatgaggattatttacagaatggcctcccaactgagacgactgtgcttgggttcggaataacaggtagtttgtctatcatttcaggtaagcagtctacgaagccattcgacctttccagcctgacatccaacgccgtgagcagcgtgactgccggcgctgggctgtttctgctcgctgactccatggtcgctctgaggacggccagccaacactgcgggtctgaaatggactatctttctagcttgccttactcagaatattattaccccatctacgagattaaggactgtttactcactagtgtatccctaacaggggtcctcgtagtgatgctgatcttcacagtcttagaactgctcttagctgcttactcctcagtgttctggtggaagcagctgtatagtaataattag

SEQ ID NO: 124047 - DNA, 588 bp, Artificial Sequence
  Description of Artificial Sequence: Synthetic coding sequence
atgctgctccagtcccagacgatgggcgtatctcattctttcacccccaaaggcattacaatcccccagagggagaaacccggccatatgtaccagaatgaagactaccttcagaatggcctcccaacagaaacaactgtgctcggttttggaatcaccgggtcgctgagcataatttctgggaaacaatcaacaaaacccttcgatctgtcatccttaacatccaacgcagtgtcttcagtcacagccggtgctggcttatttcttctggctgatagcatggtcgcattacggacggcctcacagcactgcggctctgagatggattacctgtctagtctaccttactcagagtactattaccctatctacgagatcaaagactgcctcctgacctcagtgtcactgaccggggtgctggttgtgatgctgattttcaccgttttggagctgctgctggctgcatacagttccgtattttggtggaagcaactgtactctaataatccgggatcttccttcagctctacccaaagtcaggatcacatccagcaggtcaagaagtccagtagcagatcgtggatttag

SEQ ID NO: 124048 - DNA, 753 bp, Artificial Sequence
  Description of Artificial Sequence: Synthetic coding sequence
atgaactctatgaccagtgccgtccctgtggcaaacagcgtgctagtggttgcaccacataatggctatcctgtaaccccagggatcatgtcacatgtgcccctgtaccccaactctcaaccgcaagtccacctggtgcccggcaatcctccctccttggtcagtaacgtgaacggccagccggtgcagaaggcactgaaggagggaaaaacactcggcgccatccagattataattgggctggctcatattggattgggatctatcatggctaccgtcctagtcggcgaatatctgagtatatcattctatggtggcttcccattttggggcggcctgtggtttataatttccggctccctctccgttgccgccgagaaccagccatacagttattgcctcctctcgggatctttaggcctgaacatcgtttccgcgatctgttctgcagtgggcgttattctgttcatcacggacctttctattccccacccctacgcctaccctgattattacccttacgcctggggagtcaatcctggaatggccataagcggagtgctcctagtgttttgtcttttagagttcggaatcgcttgtgcaagcagccatttcggatgccaactggtgtgttgccagtcctcaaatgtttctgttatatacccaaatatctacgccgccaatccagtgatcacacccgagcccgtgacttctcctccatcatactcctcagagatacaagccaataagtag

SEQ ID NO: 124049 - DNA, 2550 bp, Artificial Sequence
  Description of Artificial Sequence: Synthetic coding sequence
atggttcagaaggaatctcaggccacgctggaggagagagaaagcgagcttagttctaaccccgctgcatccgccggggcttctcttgagccgcctgccgcccctgctcctggagaggacaaccccgcgggggcaggtggagccgccgtcgccggtgcggctggcggcgcccgccggttcctgtgcggcgtggtagagggattttatggcagaccttgggtgatggagcaacgaaaggagctgtttcggagactgcaaaaatgggagctgaatacctacctgtacgccccgaaagacgactataagcatcgcatgttttggcgagagatgtattctgtcgaggaggccgagcagctgatgaccctaatcagcgcagcaagggagtacgagatcgagtttatctatgccattagtccagggctagacattacgttctcaaacccaaaggaagtgagcaccttaaagagaaagctagatcaagttagtcagtttgggtgtcgatcatttgctcttcttttcgacgacattgatcacaacatgtgtgccgccgataaagaggtgttcagctccttcgctcacgctcaggttagcattacaaacgagatctaccaatacctgggcgagcctgagacttttctattttgtccaacagaatactgtggcactttttgttacccaaacgtttcccaaagtccctacctgaggactgtgggagaaaaactgcttcccggcattgaggttctgtggacaggacctaaggtggtctctaaggagatcccagtggaatcaattgaagaagtcagcaaaattatcaaaagagccccagtgatctgggacaatatccacgccaacgactacgaccagaagcgcctgtttctaggaccctataaaggcaggagcaccgagctaattcctcggttaaaaggtgtacttaccaatccaaactgcgagtttgaggccaactacgtcgctatccacacccttgcaacttggtacaagtcaaacatgaacggggtcaggaaagacgtggtgatgagcaggcaggtggcccacagcggggcgaaagcctcggttgttgatggcacccccttggtcgctgcgccctctctgaatgctaccactgttgttacgacagtgtaccaagagcctatcatgagccagggcgccgcattaagtggcgagccgaccacccttaccaaagaagaagagaagaagcagcctgatgaggagcctatggacatggtggtggagaagcaagaggagacagaccacaagaatgataatcagattctatccgaaattgttgaggccaaaatggctgaagaactcaagccaatggacactgacaaggagagcatagccgagagtaagtcccctgaaatgtcaatgcaagaagactgtatctccgacatcgcacctatgcagaccgacgagcagactaataaggaacaatttgtacccggaccaaacgagaagcccctttacaccgcggagccagtgacactagaggatctccagctgctggccgatctgttctacctgccctacgaacacggccctaaaggagcccagatgcttcgggaatttcagtggttacgagccaatagctcagtcgtttccgtgaattgcaagggaaaagactccgagaagatcgaggagtggcgttccagggctgcgaaattcgaagagatgtgtggactggttatgggaatgtttacccgtctttccaattgtgccaaccgaactattctctacgatatgtacagttacgtgtgggatattaagtccattatgtcaatggtgaagtctttcgttcagtggcttgggtgtagaagtcattcgtccgcgcagtttttgattggcgaccaggagccgtgggcatttcgcggtggactggccggtgagtttcaacctccgcccctgactcctaccagtaaggtttatacaatccggccttacttccccaaagatgaggccagtgtttacaagatctgtcgagagatgtatgacgatggggtcgggctgccattccagagtcagcctgatttgatcggcgacaaactggtcgggggcctgctgtccctgtcccttgactattgctttgtgctggaagacgaagacgggatatgcgggtatgcactcggcacggtagacgtgacacctttcataaaaaaatgcaagatttcttggatccccttcatgcaggagaagtacacgaagcctaatggcgacaaggagctttctgaggctgagaagattatgctgtcattccatgaggagcaggaagtcctgccagagacttttctggccaattttcccagcctgatcaagatggatatacacaaaaaagtgacagatccctccgttgcgaaatccatgatggcatgtctcttgagcagcctaaaagctaacggtagccgcggggcattttgtgaagtgcggccagacgataagcggatcttggagttctacagcaagttgggctgttttgaaatcgctaagatggaaggttttcccaaggatgtggtcatcctgggacggagcctctag

SEQ ID NO: 124050 - DNA, 2751 bp, Artificial Sequence
  Description of Artificial Sequence: Synthetic coding sequence
atggtccagaaagagtcccaggctaccctggaagaacgggagagcgagttgtccagtaacccagctgcctcagccggggcctcactggagccacctgctgctccggcaccaggagaagataaccccgcaggcgccggcggggcagccgtcgctggcgcagccgggggcgcacggcgctttctttgtggcgtagtcgaggggttttacggtcggccctgggtcatggagcagcgcaaagaactgtttcgaagattacaaaaatgggagctgaacacctacttgtatgcaccaaaggacgattacaagcatcggatgttttggagagaaatgtatagcgtggaggaagccgagcagctcatgacgctcattagcgcagccagagagtatgagatcgaattcatttatgccatcagtcccggtctcgatattacatttagtaacccaaaggaggtctcaacactgaaaaggaaattggaccaggtgtctcaattcggctgtcgctcctttgccctcctttttgatgatattgaccataacatgtgtgccgcagataaggaagtgtttagttccttcgctcatgcccaggtttccattaccaatgaaatctatcagtacttaggggagccagaaacattcctgttctgcccaaccgagtactgcggtactttctgctacccaaacgtgagtcagtcgccgtacctgagaacagtgggcgaaaagcttctgcccggaattgaggtgttatggacagggcctaaggtggtttcaaaggagattccggtcgaaagcattgaagaggtgtcaaagatcatcaaacgtgcccccgtcatctgggacaacatacacgcaaacgactatgaccagaagagactcttcttgggaccatacaagggcagatcaaccgagctgatcccgcgcttgaagggcgtactgactaatccaaattgcgaatttgaggccaattacgtcgccatccatacccttgccacttggtacaagtccaatatgaacggcgtgcgcaaagatgtggtgatgacggattctgaggattcaacagtgtcaattcagattaaactggagaatgaaggaagtgacgaggatatcgaaactgatgttctgtattcgccccagatggccctgaaactcgcgcttaccgaatggttgcaagagtttggcgtgccgcaccagtattctagtcggcaagttgcacatagcggggcaaaggcatccgtcgtggatggtacgcccctggtggccgcgcccagtctgaacgccacaaccgtcgtgactaccgtctatcaggaacccataatgagccaaggggccgccctgtccggcgagcccaccactctgaccaaagaggaagagaagaaacagccggacgaagaacccatggacatggtagttgaaaagcaagaggaaacagatcacaagaacgataatcagatcctgagcgaaatcgtggaagccaagatggctgaggaactgaagccaatggataccgataaggaatcaattgcagagtccaagagcccagaaatgagcatgcaggaagattgtataagcgatatagcacccatgcagacagacgagcagacaaataaggaacagttcgttcctgggcctaatgagaagccactgtacactgccgaacccgtgacccttgaagaccttcagctgctcgctgatctgttttacctgccctacgagcatggtcctaagggcgcacaaatgttacgagaatttcagtggctgcgggctaactccagtgtggtgtccgtcaactgcaagggcaaggactcagagaaaatcgaagaatggcggtcccgggctgccaagtttgaagagatgtgtggcctggtgatgggcatgttcactagactctctaactgcgccaatcggacgatattgtatgacatgtactcttacgtatgggatatcaaatcaattatgtctatggtgaaatctttcgtccagtggctggggtgcaggtctcatagctcagcccaattcttaatcggggatcaagaaccttgggcgttccgcggtggcctggctggggagttccagcggctgctgcccatagatggggctaacgatctctttttccagcccccacctctcacccctactagcaaagtgtataccattaggccgtactttcccaaggacgaagcctcagtctacaaaatttgtagggagatgtacgacgatggagtaggactacctttccaaagtcagcccgacctcataggggataaactggtcggtgggctactttccctgtccctcgactactgcttcgtgctggaggatgaggatggcatatgtggctacgccctcggcactgtcgacgtcacgccatttatcaaaaaatgtaagattagttggattccgttcatgcaggagaagtacacaaagcccaacggtgataaggagctcagcgaggccgagaagattatgttgtcctttcacgaggaacaggaggtcctccccgagacgttccttgctaatttcccgtctctgattaagatggacatccataaaaaggtgaccgaccctagcgtggccaaaagtatgatggcatgtcttctttcttctcttaaggctaatggatcacggggagctttctgcgaggtgcggcctgatgacaagcgtatcctggaattttactccaagttaggatgtttcgaaatcgctaagatggagggctttccaaaagatgtcgtcattctggggagaagcttgtag

SEQ ID NO: 124051 - DNA, 2034 bp, Artificial Sequence
  Description of Artificial Sequence: Synthetic coding sequence
atggtgcaaaaggagtcacaggctaccctcgaggagagggagtcagagctgtcttcaaacccggccgcctcagctggcgccagccttgaacctcctgcggcccccgctcctggcgaagataatcctgccggcgccggcggggctgccgtggcgggtgcggccgggggcgcaaggagattcctgtgcggggtcgtggaaggcttctacggcagaccatgggttatggaacagaggaaagaactgtttagacgcttacaaaagtgggaactgaatacttacctgtatgcccctaaagacgactataaacataggatgttctggagagaaatgtattcagtcgaagaggcggagcagctgatgactctgatcagtgcagcgcgagagtacgagatcgagttcatttatgctataagccctgggctcgacataacctttagcaaccctaaagaagtttccacactcaaacgcaaattggaccaggtctctcaattcggctgtagatcctttgctttgctcttcgatgatatcgatcataacatgtgtgccgcagacaaagaggtgttttcaagcttcgcccacgcacaggtgtcaattacaaacgagatctaccagtacctgggagagcccgaaacattcttattctgccctacagagtattgtggtacattctgctaccccaacgtctctcagtccccttatctgcgaaccgttggtgagaagctgcttcctgggattgaggtgctctggaccggccctaaggtggtgagcaaagaaattccagtcgaatcaattgaggaagtgtctaagatcattaaaagggccccagtcatttgggataatatacacgccaatgactacgatcagaaacgactgttccttggtccctacaaaggcaggtccactgagctgatacctcgattgaagggagtcctgaccaatccaaattgtgaatttgaagccaactatgttgcaattcacactctggcgacatggtacaaaagcaacatgaacggcgtgaggaaggacgtcgtaatgacggattcagaggattctacggtctctatacagatcaaactcgagaatgagggaagcgacgaagatattgagacggacgtgctgtactctccgcagatggccttaaaactggcactgacagaatggttgcaggaatttggggtgccccatcagtactcatcacggcaggtggcacacagtggcgctaaggcctcggtcgtcgacgggacaccactagtggccgccccaagcctgaatgccactaccgtggttaccactgtttaccaggaacctatcatgagccagggggcagccctgagcggtgagcctacaactcttactaaggaggaagaaaaaaagcaaccagacgaggagccgatggacatggttgtggagaagcaggaggaaacagatcacaaaaatgacaaccagatactgagcgaaatagtggaggccaagatggcggaagagctgaagccaatggatactgataaggagtccatcgctgagagcaaatcgccagagatgtccatgcaggaagattgcatatcagacatcgccccgatgcagactgacgaacaaactaacaaagaacagttcgtgccagggccaaacgagaagccgttgtatactgctgagccagtaacattagaggatctccagctgctcgccgaccttttttacctgccatacgagcacgggcctaagggcgcccagatgttgcgcgaattccagtggctgagggcaaactctagtgttgtgtctgtaaactgtaaggggaaagacagcgaaaagattgaggaatggcggagtcgggcagccaaattcgaagagatgtgtgggcttgtaatgggcatgtttacccggttgtccaactgcgctaacaggaccattctatacgatatgtactcttatgtgtgggacataaagtccattatgtccatggtgaagagcttcgttcagtggctggggaggtgtaccaggaataatcttttttcaagtaatatcttatctctgtag

SEQ ID NO: 124052 - DNA, 456 bp, Artificial Sequence
  Description of Artificial Sequence: Synthetic coding sequence
atggtgcagaaggagtcccaggcgactctcgaagagcgggaatccgagctgagcagtaatcccgcagcctctgcaggagcatctctcgaaccccctgccgcacctgcacccggcgaggataaccccgccggcgccggtggcgccgctgtggccggcgcagctggtggtgcacggcgctttctctgtggcgtcgtggaagggttttatgggcgcccatgggtgatggaacaacggaaagagctgttccgtaggctacagaaatgggaactgaacacatacctctatgctcccaaagacgattacaaacatcgaatgttctggcgagaaatgtactcagtagaagaggccggatcattcttgtttttctacctggtgaccatccagctggctgagattgaacgcgttttatgtgcctcgaaggtgatgacaatttgtgtgatcagctgggcatgctag

SEQ ID NO: 124053 - DNA, 771 bp, Artificial Sequence
  Description of Artificial Sequence: Synthetic coding sequence
gccgccggcggcgctaggcggttcctgtgtggagtggtggagggcttctatgggcgcccttgggtaatggagcagcgaaaggagctcttccggcgcttgcagaagtgggagttaaacacatacctctacgcacccaaagatgactataagcaccggatgttctggcgtgagatgtattcggtggaagaggccgagcagctcatgaccttgatttctgctgcccgtgaatacgagattgagttcatctatgctataagccccggattagatatcactttctcaaacccaaaagaggtgtccactctaaagcgcaaactggatcaagtctctcagttcgggtgccggtctttcgcgctgctgttcgacgacatcgatcataacatgtgcgcagcagataaagaagtgttttccagctttgcacacgctcaggtaagtattactaatgaaatttatcagtacttgggggaacccgaaacgtttctgttctgtccaactggaccgaaagtggtgtcaaaggagatccccgtcgagagcatcgaggaggtttcaaagatcatcaagcgggcacctgttatctgggataacatccacgccaacgattacgaccagaaaaggctctttcttggcccttacaagggacgctccaccgagctcatacctcggctgaagggagtgcttaccaaccccaactgcgagttcgaggctaactacgttgctatccatacactggcgacatggtacaaaagcaacatgaacggggtcagaaagtag

SEQ ID NO: 124054 - DNA, 2592 bp, Artificial Sequence
  Description of Artificial Sequence: Synthetic coding sequence
atggttcagaaggagtcccaggcgacactggaagagcgggagagtgagctgagctctaaccctgcggccagcgcgggcgcctcattggaacctcctgctgcccccgcgcctggggaagacaaccccgctggggcaggtggagctgcagttgcaggagccgccgggggagctcgccgttttctctgcggcgtagtagagggcttttacggcagaccttgggtgatggaacagcggaaagaactatttcgtagactccagaagtgggaattaaatacttatctctacgctccaaaagatgattataaacatcgcatgttttggcgcgagatgtactctgtcgaggaagctgagcagctgatgacattgatctccgccgcaagggaatatgaaatcgagttcatttacgccataagcccggggctcgacatcaccttttcaaaccccaaggaggtcagtacgctgaagaggaagctcgatcaggtgagccagttcggttgccgtagtttcgcgctcctcttcgatgatatagatcataacatgtgcgcagctgataaagaagtgttctcttccttcgcacatgcacaggtgagcatcactaatgaaatataccagtaccttggggagccggaaacattcctcttttgtcctaccgaatattgcgggactttctgttaccccaatgtgtcacaatcgccatatctccggactgtcggtgagaaattacttcccggcattgaggttctctggacgggtccaaaggtggtatccaaggaaatcccagtggagagcatcgaggaggtgtcaaagattatcaagcgggcacccgtaatctgggataacatccacgcaaacgactatgaccaaaagcgcctgttcctgggcccatacaaaggacgctctacagaattgataccccggctgaaaggagtgcttaccaaccctaattgtgaattcgaagccaattatgttgccatacacacattggctacctggtataaatccaatatgaatggagttcgaaaagatgtcgtcatgtctagacaggtggcccattctggagccaaggcttccgtggtggatgggacccctctggttgccgcaccatccctaaacgcaacaactgtggtgacaacagtctaccaggagccgatcatgtctcagggcgctgcattgtccggcgaacccacgactctgacgaaagaagaggagaagaaacagcccgatgaagagcctatggatatggtagttgaaaaacaggaagaaacggatcacaagaacgacaaccagatcttgtccgagatcgtcgaagctaagatggccgaagagctcaaacccatggacacagacaaggagagcattgccgagagtaagtccccagagatgtccatgcaagaggattgcatctcagatattgcgcccatgcagaccgacgagcagaccaataaggagcagtttgtgccgggaccaaatgaaaagcccctgtataccgcggagccagtcactctcgaggacttacaactgcttgcggatctgttctacctgccatatgaacatggacctaaaggagcccagatgctgcgggagttccagtggctaagggccaactcctctgtggtcagcgtgaattgcaaggggaaagactcagaaaagattgaggaatggcgttcacgcgctgcaaagtttgaggaaatgtgtggcctggttatgggtatgttcactagactgtctaactgcgccaatcgcaccatcctttacgatatgtattcttacgtgtgggatattaaaagcattatgagtatggtgaaatcattcgtacaatggctgggatgcaggagccactcaagcgcccagttcctgattggagatcaggagccatgggcctttagaggagggctcgccggcgaatttcagaggttacttcctatcgatggggcaaatgatctgtttttccagcctccacctctgacgcctacatccaaggtttacacaattcgcccttatttccctaaggacgaagcgtcggtctacaagatctgccgcgagatgtatgatgatggtgttggcctacccttccagtcccagcccgatttgattggggataagctggtggggggcttgctctcactatcacttgattattgtttcgtgctcgaggacgaggacgggatctgtgggtatgccttaggaactgttgacgttacccccttcataaagaaatgcaagataagctggataccttttatgcaggagaagtataccaagcccaatggtgacaaggagctgtctgaagctgagaagatcatgttgtccttccacgaggagcaagaagtgctgccagaaacctttctggccaattttccatcgctgataaaaatggacattcacaagaaagtaaccgatccatctgtggccaagtctatgatggcatgcctgctgtcttccttaaaagctaatgggtcacgcggcgcattttgcgaagttcgaccggacgacaaacgcatcctcgagttctattctaaactggggtgcttcgaaatagcaaagatggaaggtttccctaaggacgtcgtgatcctggggagatctctttag

SEQ ID NO: 124055 - DNA, 1545 bp, Artificial Sequence
  Description of Artificial Sequence: Synthetic coding sequence
atggctgtttggctagctcaatggctcggtccactgttgttagtgagcttgtggggtttgctggcgcccgcctctctgctgagaaggttgggcgagcacatccagcagttccaggaatcgagtgcgcagggcctcggtctgagtttggggcccggtgcggcagcactccctaaggttgggtggctggagcagctcctggaccccttcaacgtttccgaccgacgctcatttcttcaaagatactgggtcaatgatcaacattgggtagggcaggacggtcccatttttctgcacctaggaggagagggatctctcgggccgggttctgttatgaggggccaccctgccgccctggctccggcttggggcgcattagtgatctcgctggagcaccgattctacggactgtcaatacccgccggcggcctggagatggcccagctgcgttttctcagcagccggctggctctagctgacgttgtctctgcacgcctcgccctgagccgcttatttaacattagttccagtagcccatggatctgttttggcggatcatatgcaggctccctagccgcctgggcacgcctgaaattcccccacctaatttttgctagtgtagcaagttccgctcccgtcagggccgtgttagacttttccgagtacaacgacgtggtttcccgctctctgatgtccactgctataggcggatctctagagtgcagagcagctgtctcagttgcattcgccgaggtagaacgccgactgagatcaggtggagcagctcaagccgctctgcgtacagaactatccgcgtgtggccctctaggacgtgcagagaaccaggctgaacttttgggggcattacaagccctggtgggcggagtcgtgcaatacgatggacagaccggggcacccctctctgttaggcagctatgtgggcttctgttaggcggcggcggtaacagatctcacagcactccttactgtggcttgaggcgcgctgtgcagatcgtgctccattctcttggccaaaagtgtctctccttctcacgggcagagaccgtagcccagttacggagcaccgagccgcagctgagcggcgtcggcgatcgccagtggctgtaccagacatgcactgaattcggattttacgttacttgtgagaatcctcggtgccccttttcccagctgcccgcgctgcctagtcagctcgatctgtgtgaacaggtatttggactatccgccttatccgtcgcccaggctgttgctcagaccaactcttactacggaggccaaacgccaggggccaacaaggtgctgttcgtaaatggggatacagacccgtggcacgtgctgagcgtcacccaggccctgggcagctccgagagcacacttctaataaggactggaagccactgtttggacatggcccctgagagaccttctgattccccatcacttcgactaggccgccaaaatatctttcagcagcttcagacatggctcaagctggccaaagaaagccagattaaaggcgaggtgtag

SEQ ID NO: 124056 - DNA, 2106 bp, Artificial Sequence
  Description of Artificial Sequence: Synthetic coding sequence
atggacctatggaacttaagctggttccttttccttgacgctctgctcgtgatctccggcctggctactccagagaacttcgatgtggatggaggcatggaccaggacatatttgatatcaatgaggggctggggcttgacctgtttgaaggggacatccggctggatagggcgcagattcgcaatagcatcatcggcgaaaagtataggtggccccacaccatcccgtatgtgctggaggacagtctggagatgaacgccaaaggggtgattctgaacgcatttgagagataccgcctgaaaacgtgtatcgacttcaaaccttgggctggggagaccaattacattagcgtgttcaaaggttctggctgctggagctccgtgggcaatcgccgcgtagggaaacaggagctcagcattggcgccaattgcgaccggatcgcaactgtgcagcatgaatttcttcacgccctgggcttttggcatgaacagtcccgctcagaccgtgacgactatgttagaattatgtgggaccggatccttagcggtcgcgaacacaatttcaatacttattccgatgatattagtgattccttgaatgttccctatgattacacctcagtcatgcactattcaaagacagccttccagaacggaacagagcctaccatcgtgactcgaatatcggatttcgaggatgttatcggtcagagaatggatttctcggacagcgatctccttaaactgaaccagttgtacaattgcagctcttccttgagctttatggattcgtgttcattcgagttagagaacgtctgtggaatgattcaatctagcggtgacaacgccgactggcaaagggtctctcaggtcccgagaggccccgaaagtgatcacagtaacatgggccagtgccagggctctgggttctttatgcatttcgacagctctagcgtgaacgtgggcgccaccgctgtcctggagagtagaaccttatatcccaagcgaggttttcagtgcctacagttttacctttacaatagtggcagtgaaagcgatcagctcaacatctatatacgagagtattcagcggacaacgtggatgggaacctgacactagtagaagagattaaggaaatccctaccggctcgtggcagctctaccacgtgacccttaaggtcacgaaaaagttccgggttgtgtttgaggggcggaaaggtagcggggcttctcttggtggactctctatagatgatattaacctgtccgagacgagatgtccccatcacatctggcatattaggaacttcacacagttcattggatcaccaaatgggacactgtacagccctcccttctatagcagtaagggctacgccttccagatttatctgaacctggcgcatgttaccaatgccgggatctattttcatctgatctccggtgcaaacgacgaccaactgcaatggccctgtccttggcagcaagccactatgaccctgttggatcagaacccggatatacggcagcggatgtccaatcagagatcaatcactactgacccgttcatgactactgacaatggaaattatttttgggacagaccttcaaaagtaggcacagtggcattgttttcaaacggcactcaattcaggcggggcggaggatatgggaccagcgcattcataacacacgagaggctgaaatcccgggactttatcaaaggtgatgatgtgtatattctgctgactgtggaggatattagtcacctcaactccactcagattcaacttactcccgccccgtcggttcaagatctgtgtagcaagacaacatgtaagaatgatggggtgtgcaccgtgcgagatggaaaggccgagtgccgctgtcagagcggggaagactggtggtacatgggtgagcgatgtgagaagaggggaagcacacgtgacactattgtgatcgccgtctccagtactgtcgcggtgttcgctttgatgctgataatcactttggtgtccgtgtattgcacccgtaagaaatacagggagagaatgagcagtaatcggccaaacctgacaccacagaatcagcatgctttctag

SEQ ID NO: 124057 - DNA, 894 bp, Artificial Sequence
  Description of Artificial Sequence: Synthetic coding sequence
atggcgtcaccccagctttgcagagccctcgtttctgcacagtgggttgcagaagctctgagggccccacgggctggccagccactgcagctattggacgcatcatggtacctacctaagctgggcagagacgcccggcgggaattcgaggaacgccatatccctggagccgcattcttcgatattgaccagtgttcagaccggaccagtccctacgatcatatgctgcccggtgcggaacacttcgctgaatatgccggccgacttggtgtgggggccgcaactcacgtggtaatctacgatgccagtgaccaaggattgtactctgccccacgtgtctggtggatgttccgtgcattcggtcatcatgctgtgtccctactagacggtggtcttaggcactggctgcgtcagaacctgcctctctcttctggaaaatctcagcccgcgccagctgagttccgagcgcaactggacccagctttcatcaagacctacgaggatattaaggagaacctggaatccagacgttttcaggttgttgacagcagggctactggaaggtttcggggaacggagcctgagcctcgcgacggtatcgaacccgggcatatacctggtaccgtcaatattcccttcactgacttcctgtcacaggagggcctcgagaaatcacctgaggagataagacacctgttccaggagaaaaaggtcgacctgtctaaacccctggtcgcaacctgtggttccggggttacggcatgccatgttgctctcggggcctatctgtgcgggaagcccgacgttcctatttatgatgggagctgggtcgaatggtatatgagagcccgtccagaggacgtgattagtgagggcaggggcaagacccactag

SEQ ID NO: 124058 - DNA, 954 bp, Artificial Sequence
  Description of Artificial Sequence: Synthetic coding sequence
atggcagagcccggatctcgcgaatcagaaaccagagctagatctccatccgtagctgcgatggccagcccacaattgtgccgcgctctggttagcgcccaatgggttgccgaggctctccgggcgcccagagccggccagcccctgcagctgctcgacgctagttggtacttgccaaaattggggagggacgcacgtcgagagttcgaagaaaggcacatacctggtgccgcctttttcgacattgaccagtgcagtgatcgaacctctccctatgaccatatgctacccggggctgagcactttgccgagtatgctggccgtcttggagtgggagctgcaacccatgtggtcatttacgatgcaagcgatcaaggtctgtactcagcaccccgcgtgtggtggatgttcagggccttcggacaccatgcagttagtctcctcgacggcggtctgcgccactggctaagacagaacttgccattatctagtgggaaaagtcagccagcccccgcagaatttagggcccaacttgatcctgccttcatcaaaacctatgaagacatcaaagagaaccttgaatccagacgcttccaagtcgtcgatagcagagctacgggccggtttaggggcactgagccggagccaagggatggcattgagccaggccacatacctggaacggttaacatacctttcaccgattttctgtcacaggaaggcttggagaaatcacctgaagagatccgccatctattccaggaaaagaaagtggatctttccaagcctttagtcgcgacctgtggatccggcgttacagcatgccatgttgccttaggggcctacctctgcggtaagccagacgtgcccatctatgacgggtcatgggtggaatggtacatgagagcaaggcctgaagatgttatttcagagggtcgcggcaagacccactag

SEQ ID NO: 124059 - DNA, 894 bp, Artificial Sequence
  Description of Artificial Sequence: Synthetic coding sequence
atggcctcaccccagttgtgtcgggccttggtgagcgcccagtgggttgccgaagcgttgcgcgctcctcgggcaggccaacctttacaattgctggatgcatcctggtatctgccaaaacttggccgggacgcacgcagggagtttgaggaacggcacattccaggagccgcatttttcgatatcgatcagtgtagtgaccgcacgtccccgtatgaccacatgctccccggagccgagcatttcgccgaatacgccggacgcctcggggtgggtgcagctacacatgttgtcatctatgatgcatctgatcagggcttatatagtgctcctcgggtgtggtggatgtttagagctttcggacatcacgcagtctccctgctggatggcggactaaggcactggcttcggcaaaacctccccctgtcttctggcaaatcacaacccgcacccgcggaattccgggcccagttggaccccgcctttatcaagacgtacgaggatatcaaagaaaacctcgaatcacgtcgatttcaggttgtcgacagccgtgccacggggcgcttccgagggacggagcctgaaccccgggacggcatagagcctggccacattcctggtaccgtaaatatcccattcacggattttctgtcccaggaaggcctggaaaagtctcctgaagagatacgacacctgtttcaggaaaagaaagtagacctgagtaagcccttagtcgcaacgtgcggctccggggtgactgcttgccacgtagccctgggggcctacctgtgcggaaaaccagacgtacccatctatgacggttcctgggtggagtggtacatgcgagcccgacccgaagatgtgatctcggaggggcgagggaaaacccactag

SEQ ID NO: 124060 - DNA, 894 bp, Artificial Sequence
  Description of Artificial Sequence: Synthetic coding sequence
atggcatcaccccagctctgccgagccctggtgtccgctcagtgggttgctgaggcactccgcgccccacgggctggacagccgttacagctactggacgcatcttggtatttgcccaagctaggcagagacgcccgaagggagtttgaggagcgacacatccctggcgctgccttctttgacattgaccagtgcagtgatcgcacctcaccttacgatcatatgctgcctggcgccgagcactttgccgagtatgcaggtagactgggggttggtgcagccacccacgtggtgatatacgacgcatctgaccagggcctgtattctgcccccagggtgtggtggatgttccgagctttcggtcaccacgctgtgtctttgctggacggcgggctgcggcactggctaagacagaatttacctttgagctccggcaaatcgcaacccgctccagccgagttccgggctcagctcgacccggcattcattaagacctacgaggacataaaagagaacctagagtctcgccgattccaggtggtggattcacgggcaacaggccgctttaggggcaccgagccagagcctcgggatggcatcgagcctggccatatccccggcactgtcaacatccccttcaccgattttctgtcccaggaggggctggagaaaagccccgaggaaatcaggcatctcttccaggagaagaaggttgacctcagcaagccactcgtagcaacctgtggatcaggagtgaccgcatgtcacgtcgcactgggtgcatacctgtgtggtaaaccagacgttcccatttacgacgggtcttgggtggagtggtacatgagggcccgtccagaggatgtgatcagcgagggcaggggtaaaacacattag

SEQ ID NO: 124061 - DNA, 894 bp, Artificial Sequence
  Description of Artificial Sequence: Synthetic coding sequence
atggcttctccacagctgtgtagggctttggtgtccgctcagtgggtggctgaagctctgagagcaccccgggccgggcagcccctgcagctgctcgatgccagttggtacctccccaagctggggagggacgcaagacgagaatttgaagagaggcacatcccaggagccgccttcttcgacatcgaccagtgctcagatagaacgagcccatacgatcatatgctgcccggcgccgaacatttcgccgagtacgctggccgccttggcgttggagccgccacacatgtggtcatctatgatgcttcagaccagggcctctatagtgccccgcgcgtgtggtggatgtttcgcgctttcgggcaccacgctgtgtcactgttggacggcggcctcagacactggctgagacagaatctcccattatcttcaggaaagagccagcccgcacctgcggagttcagagctcaactggatcctgcattcatcaagacctatgaggatattaaagaaaacctggaatctagaaggttccaggtggtagactcgcgggctaccggcaggttccgcggcacggaaccagagccaagggacggaatcgagcctgggcacattcctggcaccgtgaatattccattcacggatttcctttcgcaggaggggctggaaaaaagccctgaggaaattcgccatctattccaggaaaagaaagtggatctgagcaaacctcttgtcgccacttgcgggtcaggcgtcaccgcctgtcacgttgcacttggagcttacctgtgcggcaagcccgacgtcccaatatatgacggcagctgggtggagtggtacatgcgagcccgtccagaggacgtgatttcagagggccggggcaaaacacattag

SEQ ID NO: 124062 - DNA, 894 bp, Artificial Sequence
  Description of Artificial Sequence: Synthetic coding sequence
atggcgagcccccagctctgcagggctctggtgagcgctcagtgggttgccgaggctcttagagcccctcgagccggccaacccctccaattgttagacgccagctggtatctacccaagttgggaagggatgctcgaagagaattcgaagagcggcacatccctggggccgccttttttgatatcgatcagtgttctgacagaacctccccctatgatcatatgctccctggcgctgagcacttcgcagaatatgctggccggctcggggtgggtgccgctacccatgttgtgatctacgacgcctccgaccagggcctgtattcagcgcctcgcgtgtggtggatgttccgagcctttgggcaccacgccgtatctctgcttgacggcggactgcgccactggctcagacagaatctgcccctgagctctggcaagtcacaacctgcccctgcggagttccgcgcacagttagatcctgccttcattaagacctacgaagatatcaaagaaaacttagaaagccgacgttttcaggttgtggacagtagagccactggaagattccggggaacagaacctgagccccgggatggaattgagccgggccacatacctggcactgttaacataccttttaccgattttttatctcaggaaggccttgagaagtcacctgaagagatccgacatcttttccaggaaaaaaaagtggacctgtccaagccgctggtggccacatgcggatctggcgtgacggcatgccatgtggccctgggtgcttacctgtgtggcaaaccggacgtcccgatttatgacggttcatgggtcgaatggtacatgcgcgcaagaccggaagatgtgatcagcgagggaagggggaagacacattag

SEQ ID NO: 124063 - DNA, 738 bp, Artificial Sequence
  Description of Artificial Sequence: Synthetic coding sequence
atggcgtctccccagctctgtagagccctggtgtcggcccaatgggtggccgaagccctgcgagcccctagggccgggcagccccttcagctgctggatgccagttggtacttaccaaagctcggacgggacgcacggagggagttcgaagagcgccacatcccgggtgcggccttttttgacatagaccaatgcagcgacagaaccagcccatacgatcacatgctgcctggcgccgagcacttcgccgagtacgccggaagactgggcgtgggggcagcgacgcacgtcgttatttacgacgcctctgaccagggcctctattctgcaccacgagtgtggtggatgtttcgagctttcgggcatcacgccgtgtctctccttgacggaggcttgagacattggttgaggcagaacttgcccctatcctccggcaagtcacagcctgctccagcggaattccgggcacagctggacccagccttcatcaaaacctatgaagacatcaaggagaacttagaaagtcgccggtttcaggttgttgacagcagagcaaccggacggttccgaggaactgagccggaacctcctgccgtaggcattgagcccggtcacattccggggactgttaacattcccttcacggatttcctgagccaagatggctcctgggtggagtggtacatgagagctcgaccagaggacgttattagtgagggaaggggaaaaactcattag

SEQ ID NO: 124064 - DNA, 765 bp, Artificial Sequence
  Description of Artificial Sequence: Synthetic coding sequence
atggaccctgcagcctcttcttgcatgcggagtctccagcctcccgcaccagtgtggggatgcctgcgaaatccgcactcggaaggaaacggtgccagcggcttgccacactatccccctactcctttttcgtttcatcaaaaacctgattttctcgctacagccaccgctgcgtaccccgacttctctgcatcgtgccttgcagcaactccacactcacttccacaggaggaacatatctttacggaacaacacccagcatttccgcagtcccctaattggcacttcccagtaagtgatgctagacggaggcccaacagcggccctgcaggtggaagcaaggagatgggtacaagctctctggggctcgtggacactaccggaggacctggcgatgactacggtgtgttagggtccaccgctaatgaaaccgagaagaagtcctctaggcgaaggaaggagtcgagcgataaccaggaaaatagagggaagccagaaggttcaagcaaggcccggaaagaaaggacagccttcaccaaagagcaactgcgggagcttgaggccgagttcgcccatcataattacctcacccgcttaagacgttatgaaatcgccgtcaacctggacctgtcggagagacaggtgaaggtgtggttccagaatcgccgaatgaagtggaagcgggtcaagggcgggcagcctattagtcctaacggccaggatccagaagatggcgacagcacagccagcccgagttccgagtag

SEQ ID NO: 124065 - DNA, 555 bp, Artificial Sequence
  Description of Artificial Sequence: Synthetic coding sequence
atggatcccgcagcttcatcatgcatgaggagcctgcagcccccagcaccggtgtggggctgcctgcgaaacccgcatagcgaagggaatggtgcaagcggtttacctcactatccacctacccctttcagttttcatcagaaacccgatttcctggccactgccaccgcagcctaccccgatttcagcgcttcatgtcttgctgccactccacacagtcttccacaggaggaacacatcttcactgagcagcaccctgcattcccacagagccccaattggcacttccccgtgtcagatgcccggcgacggccaaactcaggacccgccggcggaagtaaagaaatgggaaccagttctctaggactggttgataccacgggtggcccaggtgatgactacggcgtccttggcagcactgccaacgagacagaaaagaagtcctcccgccggagaaaggagtctagcgggcagtccgtggtgcccgaacccaaggacgaggtggaggcttgcgaaggcaggtctgcacatctacctcagtgggcaggtccttag

SEQ ID NO: 124066 - DNA, 420 bp, Artificial Sequence
  Description of Artificial Sequence: Synthetic coding sequence
atgggtactagctccctggggctggtcgacaccacaggaggtccaggagatgattacggagtcctggggagcaccgctaatgagacagagaaaaagtcttcgcgtagaaggaaagagtcctcagataaccaagagaatcgaggaaaaccagagggctctagcaaggcacgcaaggagagaactgcctttactaaagagcagctgcgtgaactcgaagcggaattcgcacaccacaattacctaacccgcctgaggcgctatgagattgccgtcaatctagacttgagtgagagacaggtaaaagtgtggtttcagaatcggcggatgaagtggaagcgggtgaaaggcggccagcccatcagtcctaatgggcaggatcctgaggatggcgattccactgcgagtcctagttcggaatag

SEQ ID NO: 124067 - DNA, 915 bp, Artificial Sequence
  Description of Artificial Sequence: Synthetic coding sequence
atggagcacccgctctttggttgcctcagatcccctcatgccactgcccagggactgcaccccttctctcaaagttctctcgctctgcacggaaggagtgaccatatgtcctatcccgagctgtcaacttcttcatccagttgtattatcgccggctatccaaacgaagaggggatgtttgcatctcaacatcataggggacaccaccatcaccaccatcaccatcaccaccaccatcaccaacagcaacagcaccaggctcttcaaacgaactggcatttacctcagatgtccagccctccctcagccgccaggcattctctgtgtttgcagcccgattctggcggtccacctgaacttggcagctcaccacctgttctatgttctaatagctcttctctgggaagctccactccgacgggcgctgcgtgtgctcccggggactacgggcgccaggcactgtcccccgccgaggcggaaaaacggagtgggggcaagcggaagtctgactcttccgactcccaggagggcaattataagagcgaggttaattcaaagcctaggaaagagcgcacggcctttaccaaggaacagatacgagagttggaagcggagttcgcacatcataattatcttacgagactgaggaggtacgaaatcgctgtgaacctggaccttaccgaacgccaagtgaaagtttggtttcaaaataggcgaatgaaatggaagagagtcaagggtgggcagcagggtgctgctgcccgggaaaaagaattagtgaatgtgaaaaagggtactcttctcccatctgagctttctggtattggcgccgcaacactgcagcagactggagactctattgccaatgaggacagccacgactccgatcattcttccgaacacgcgcatctgtag

SEQ ID NO: 124068 - DNA, 705 bp, Artificial Sequence
  Description of Artificial Sequence: Synthetic coding sequence
atggccgcatccagatgggccagaaaagccgtggtcctgctgtgcgcgtcggatctacttctgcttctcttactcctccccccacccggcagttgcgctgccgaaggttcacccgggacacctgatgagtccacaccccccccgcggaagaagaagaaagatatcagggattacaacgacgccgatatggctagactcctggagcaatgggagaaggacgatgacatagaagagggcgatctgcccgagcacaagcgaccatccgctccagttgacttttcaaaaattgatccgagcaagccagagtctattctcaagatgacaaaaaagggtaagacactgatgatgttcgttactgtgagtgggtctccaaccgagaaagaaactgaagagatcacctctctgtggcaggggtctctgttcaatgctaactatgacgtccagagattcatagtcggctccgacagagccatatttatgctcagggacggatcctacgcttgggagattaaagacttcctagtgggacaggaccggtgcgctgatgttacactggaggggcaggtatacccaggtaaaggcggaggttcaaaggagaaaaacaagacaaaacaggacaaaggtaaaaaaaaaaaggagggagaccttaaaagtcggagctctaaggaggaaaatagagctggaaataaaagagaggatctatag

SEQ ID NO: 124069 - DNA, 705 bp, Artificial Sequence
  Description of Artificial Sequence: Synthetic coding sequence
atggccgcaagccgatgggcacggaaggctgtggtcctgctgtgcgctagtgaccttctgctactcctgctgctgctgcctccgcccggaagttgtgccgctgagggaagccccggcaccccagatgaatccactccaccaccgaggaaaaaaaagaaagacattagagactacaacgacgccgatatggctcgactattggaacagtgggagaaggatgatgacatagaggaaggtgacctgccagagcacaaaagaccctctgcaccagtagatttttcgaagatcgacccgagtaaacccgagtctattcttaaaatgaccaagaagggaaagactctgatgatgttcgtgactgtgtcaggctcaccgaccgagaaagagacagaggagatcacaagcctgtggcagggctccctgttcaacgccaactacgatgtgcagaggttcatagtcggctcagatcgagctattttcatgctgcgggatgggtcgtatgcttgggagatcaaggacttcctggtgggacaggatcgttgcgcagatgtcactctcgaagggcaggtgtaccctgggaaaggcggcggctccaaagagaagaacaaaacgaaacaggacaaaggaaagaagaaaaaagaaggcgatctgaaaagcagatcatccaaagaagagaaccgggccggaaacaagcgcgaagacctatag

SEQ ID NO: 124070 - DNA, 1194 bp, Artificial Sequence
  Description of Artificial Sequence: Synthetic coding sequence
atggcgcagtcgccaccgcctcagagcttgttaggccatgatcattggatttttgcccagggctggggatgggcagggcactgggattctacctcccctgcctcttctagtgattctagcgggtcttgcccttgcgatggagcgcgtggcctcccccagccacaaccccccagctgcagctcccgggccgccgaagccgccgcaaccacgccacgccgggccagaacaggtcccgcaggcggacagaggcagagcgcctcagagcgcgagaagctgaggatgagaactctcgctagggcactgcatgagctgaggagattcctgcctccatcactagctccagcaggccagtccttaactaagatagaaacactgcgccttgcaatccgctatatcggccatttgtcagcagtgttgggtttgtccgaggaatcactccagtgtagacgccgtcaacgcggcgacgctggttctccatggggttgccccctgtgccccgatcgcggacctgctgaagctcagacccaggccgaggggcaaggacagggacaggggcaggggcaggggcagggccagggccaagggcaggggcaggggcaaggccagggccagggccgccggccgggcctggtgagtgctgtgctggcggaggcctcgtggggaagccccagtgcctgtccaggagctcaggcggctcctgaacgcctgggcagaggcgttcacgacactgatccatgggcgacacccccctattgccctaagatacagtcgcccccctattctagccagggaaccactagcgacgctagcctgtggactccgccacaaggctgcccatggacacagtcctctccagaacccagaaacccgccagttccgtggaccgccgcccccgctactcttgaactagctgccgtttaccagggcctgtccgtatcccccgaaccctgcctctcgctgggcgccccctctctcctgccacatccgagctgccagaggctacagccacagacaccagggaggtgttggtcacactcggctgaggtggtgccgaactctgaagaccagggaccaggggcagctttccagctttccgaagcttcaccaccgcagtcgtcaggcttaaggttttcaggctgtccggagttgtggcaggaggacttggagggtgctagactgggcatcttctattag

SEQ ID NO: 124071 - DNA, 3510 bp, Artificial Sequence
  Description of Artificial Sequence: Synthetic coding sequence
atggagcctagggaaagcggcaaggcccccgtcacattcgatgacatcactgtgtatttgttacaagaagagtgggtcctcctctcacagcagcagaaagagctatgtggctctaacaagttggtcgctcctctaggacctactgtggctaatcctgagctgtttaggaagttcggacggggccccgagccttggctgggaagtgtccagggacaaaggtccttgctggaacaccatccggggaaaaaacagatgggatacatgggggagatggaggtgcagggaccaactagagagagcggccaaagtctcccacctcagaagaaggcatatttatcccacctgtctactgggtccggacacatagagggagactgggctggaagaaatagaaagttacttaaacctagatccattcagaaaagctggttcgtgcagttcccatggctcatcatgaatgaggagcaaactgccttgttctgctccgcctgtagggagtacccaagcattcgggacaagagaagccggcttatcgaaggctacactggtccgtttaaggtggagaccttgaaatatcatgctaaaagtaaggctcacatgttctgcgtgaatgccctggcggcccgagacccaatatgggcagctcgctttcgctctattcgcgacccacctggagatgtgttggcctccccggaacctctgttcaccgctgactgtccaatcttctaccccccagggccactgggcggattcgatagcatggccgagcttctcccttcgtcacgtgcagagctggaagatcctgggggtgatggcgcaattcccgctatgtatttggactgcattagtgatctgcggcagaaggagatcactgatgggatccatagctcttcagacataaacatcctgtacaacgacgcggtggaatcttgtatccaagatccttccgctgagggactttctgaggaggttccagttgtattcgaagagctgccagtagtctttgaagatgtggctgtttatttcactagggaagaatggggcatgctggacaagcgccagaaggagctctatcgagacgtcatgagaatgaattacgagctgttggctagcctcggtcctgccgctgcaaagcccgacctgatctccaagctggaaaggcgagccgctccatggatcaaagatccaaacgggcccaagtggggaaaagggaggccaccaggcaataagaaaatggtcgccgtgagggaagcggatacccaggcctccgcagccgattcagccctattgcccggcagcccagtcgaggcacgtgccagttgttgctcctcaagtatctgtgaagagggcgacggaccccggcgcataaaaagaacttataggccccgctccatccagcggtcatggtttggtcagtttccttggctggtcatcgatcccaaggagaccaagctgttctgctctgcgtgcattgaaaggcctaatctgcacgacaaatcatctcgcctcgtgaggggatacactggacctttcaaagtggagactctgaaataccacgaggtcagcaaggcccatcggctttgcgtcaacaccgtggagatcaaagaggacacacctcatacagccctcgttcccgaaatctccagcgacctgatggccaatatggagcactttttcaacgctgcttattcaatagcctaccattcccggccgttgaacgattttgaaaagatcctccaactcctccaaagtactggaaccgtgatcttgggtaagtaccggaataggacagcctgtacccaattcatcaaatatatctccgaaactctgaagcgggaaatcttggaagacgtgcggaacagcccgtgcgtgtcagtgctgttagacagctccaccgacgccagtgagcaggcctgcgtcggtatttacataaggtactttaaacagatggaggtgaaggaaagttatatcactctggcccccctctattctgaaacagccgacggctatttcgagaccattgttagcgctctggacgagctcgacatcccattccgcaaacccgggtgggtcgtgggccttggtacagatggcagcgccatgctcagctgccggggcggactggtggaaaagtttcaagaggtcatacctcagctgctgccagtacactgtgttgcccaccgactgcatctcgctgtggttgacgcatgcggcagcatcgatctggttaagaagtgcgatcggcatatccggacagtgttcaagttttatcaatcatccaacaagaggttgaacgaactccaggagggggctgcgcctctcgagcaggaaatcattcgactgaaagatctgaacgccgtcaggtgggtggctagtcgacgccggactctgcacgctctcctggtgagctggccagccttggcccgccatctgcagagagtagcagaggccggcgggcagatcgggcaccgggcaaaaggtatgctcaagctgatgcgtggcttccatttcgtgaaattttgtcattttttactggacttcctgtctatttataggccattgtcagaggtgtgccagaaagaaattgtcttaataaccgaggtcaacgctacactgggccgcgcctatgtcgccctcgagtcgctgaggcatcaggccggacccaaagaggaggagtttaacgcgagttttaaagatggacggctgcacggcatctgtcttgataaactcgaggtggctgagcaacgctttcaggcggatcgagagcgcactgtattaactggaatagaatatctgcagcagcggtttgacgcagatagacccccccaactgaagaacatggaggtgtttgatacaatggcctggccgtccggcattgagctcgcgagtttcgggaacgatgatatcctcaacctggcacggtactttgaatgttctctgccaaccggatattctgaggaagcattattggaagaatggttaggcctgaaaaccattgcgcagcacctgcccttcagtatgctctgcaaaaatgcgctggcccagcattgccgtttccctttgctcagtaagctcatggctgtggtcgtgtgcgtacctattagtactagctgctgtgaaaggggcttcaaggccatgaatagaatccgcactgacgaaaggaccaagctgtccaacgaagttctcaatatgctgatgatgacggccgtcaatggagtggccgtcactgagtacgacccacaacccgccatacagcattggtacctgactagctctgggaggcggtttagccacgtttatacctgtgcccaggtgcctgcccgctcccctgcctccgctcgcctcagaaaggaggagatgggggctctgtatgtagaagagccccggacccaaaagccacccatactgccttcacgcgaggccgccgaggtactgaaggattgcatcatggagccccctgaacgccttttgtacccacacacctcccaggaagctcctgggatgagttag

SEQ ID NO: 124072 - DNA, 981 bp, Artificial Sequence
  Description of Artificial Sequence: Synthetic coding sequence
atgagagaatggtgggttcaggtcggtctgctggccgtaccactgctcgctgcgtatctgcacatcccccccccccagctgagccctgcgctccactcttggaaaagtagtgggaagttcttcacttataagggactccgtatcttctaccaggactccgttggtgtagtcggctcacccgagatcgtcgtgctgctccacggatttccaacttcctcctacgattggtacaagatttgggagggtctcaccctgcgatttcatcgggtcatcgcactcgacttcctggggttcggattctctgataaacctagaccacaccactattcaattttcgagcaagctagtattgtggaggccctgctgcggcacttgggactgcaaaatagaaggattaatctcctgtcccatgactatggagacatcgtggcccaggaattgttgtatagatataagcagaatcggtccggaaggctaaccatcaagagcctgtgtcttagcaatggcggcatttttcccgaaacacataggcccctcttactccagaagctgctcaaagacggaggtgtgctgtctccaatcttaactcgtctcatgaacttttttgtcttcagcagagggctgactcctgtgttcggaccatacactagaccctccgagagtgaattgtgggatatgtgggccggaatcagaaacaatgatggcaatcttgttattgactctttgctacagtatattaaccagcggaaaaagtttcggaggaggtgggtcggagcgctggccagcgtgactatcccgattcactttatttacggaccccttgacccagttaacccttaccccgaattcctggagctctacagaaaaaccctgcctaggtccacagtctccatcctggatgaccacatctctcattatccccagttggaagacccaatgggctttctgaatgcctatatgggcttcataaactctttctag

SEQ ID NO: 124073 - DNA, 981 bp, Artificial Sequence
  Description of Artificial Sequence: Synthetic coding sequence
atgcgcgagtggtgggtacaggtcgggctactcgcggttcccctgctcgccgcctacctccacatcccacccccgcagctctctcctgctcttcattcttggaaatcgagcggcaagttcttcacctacaagggtctgagaattttttatcaggattcagtgggcgtcgtagggtctcccgaaatcgtcgtcctgctgcatgggttccctacctccagctacgattggtacaaaatttgggagggactgaccttaaggtttcatcgggtgatcgccttggatttcttgggtttcggcttctctgataagccacggccccaccattactcaatttttgagcaggctagcattgtggaggccctcctgcgccacctggggctgcaaaatagacgcataaatctcctcagtcatgactatggagatatcgttgcacaggaactgctataccggtataagcaaaaccgaagcggaagactgaccatcaagtccctctgtctaagtaatggaggcatctttccggagacccaccgccccctattgctccaaaagctcttgaaggatgggggagtgttatctccaatcctcaccaggcttatgaacttcttcgtcttctccagaggtctgacgcccgtgtttgggccatatactcggccttctgagagtgagttgtgggacatgtgggccggcatccggaataatgatggcaatctggttatcgacagccttctccagtatatcaatcagagaaaaaaattcaggcgacgatgggttggagccctagcatcagttaccattcctattcacttcatctacggcccattggatcccgtgaacccttatccagagttcctagaactgtatcgcaaaacgctgcctcgctccacagtcagcattttagacgaccacatctctcactatccgcaactggaagacccgatgggcttcctgaacgcctacatgggcttcatcaattcattctag

SEQ ID NO: 124074 - DNA, 357 bp, Artificial Sequence
  Description of Artificial Sequence: Synthetic coding sequence
atgcgcgaatggtgggtgcaggttgggctcctggctgtccctcttctcgccgcatacctgcacatccccccaccccaactctcaccagcactccactcctggaagagcagtgggaaattttttacgtacaaaggacttcgcatattctatcaggattcggttggggtggtgggcagtcccgagatcgtggttttgctgcacgggtttccaactagtagctacgattggtacaagatatgggagggactgacccttaggttccaccgcgtgatcgccctggatttcctgggcttcggcttttccgacaagcctagaccacatcactattccatcttcgaacaggcaagcattgtgtag

SEQ ID NO: 124075 - DNA, 624 bp, Artificial Sequence
  Description of Artificial Sequence: Synthetic coding sequence
atgcgggagtggtgggtccaagtggggctactggccgtgcctctactcgctgcctacctgcatatccctcctccacagctctctcccgcactgcactcttggaagtcctcaggcaagtttttcacatataagggactgcgtattttctaccaggattccgttggtgttgtcggctcccctgagattgtggtgttgcttcacgggttccctacctccagctacgactggtacaagatctgggaggggcttaccttgaggttccaccgagtgattgccctggatttcctgggcttcgggttcagtgacaaaccgagaccccaccactatagcatcttcgagcaagcatcgatcgtggaggcgttgcttaggcatttagggctacagaatcggagaatcaatctgctctcccacgactacggggatattgtggcccaggagctgctgtaccgttataaacagaacagaagcggacggctcaccatcaagtctctctgccttagtaatggaggaatttttcccgaaactcatagaccattgcttctccagaagctactcaaagacggcggggttctttcgcctatcttgacccgcttgatgaacttttttgtgttcagtagaggctag

SEQ ID NO: 124076 - DNA, 483 bp, Artificial Sequence
  Description of Artificial Sequence: Synthetic coding sequence
atgcgcgaatggtgggttcaggttggcctgctggccgtgcccctgttggccgcataccttcacatccccccaccccagttgtcccccgcgcttcattcgtggaagagttccggcaagttcttcacttacaaagggctcagaatcttctatcaggattccgtgggagtggtggggagtccagagattgttgtattgctccatggcttcccaacaagttcctacgattggtacaagatctgggagggtctgacacttagattccaccgagtgattgccctggactttttaggattcggctttagcgataagcctcgcccacatcactactccatctttgagcaggcctccatagtggaagccctgttgagacatctgggactgcagaacagaagaataaatctgctctctcacgattatggtgatatcgttgcccaagaactgttataccggtataaacagaatagaagtggtagactcacctag

SEQ ID NO: 124077 - DNA, 384 bp, Artificial Sequence
  Description of Artificial Sequence: Synthetic coding sequence
atgcgcgagtggtgggtccaggtggggctgctggcagttccccttctggccgcctatctgcatataccgccgcctcaactgagtccggctcttcacagctggaaatcttctggaaaattctttacttacaagggtctgcgcatcttttatcaggactctgtgggagtggtgggcagccccgaaatcgtagtcctattgcacggctttccgacatcctcatacgactggtacaaaatctgggaaggtttgacccttagatttcacagggtcatcgctctggattttctgggattcgggttctccgataaaccccggccccaccattactctatattcgagcaagcatcaatcgtcgaagcgctgctgcgacacttggggctatag

SEQ ID NO: 124078 - DNA, 522 bp, Artificial Sequence
  Description of Artificial Sequence: Synthetic coding sequence
atgagagagtggtgggtccaagtgggcctgctggccgtacctctcctggccgcttaccttcatatccccccgcctcagctaagccccgccctacattcttggaagagcagcggcaaattcttcacttataaaggcttaagaattttctatcaagattctgttggcgtggttggatctcccgagatagtcgtgcttctgcatggatttccgacatccagctatgattggtataaaatctgggaaggtctgaccctgaggttccaccgggtgatagctctggatttcctcgggttcggctttagcgacaagccccgaccgcatcactatagcattttcgagcaggccagtatcgtcgaagctttgctgaggcacctcggactgcagaaccggcggataaatctgctcagccacgactacggcgatattgtggcacaggagctcctctaccgctacaagcagaataggagcgggaggcttaccatcaaaagcctgtgcctctccaatggcggcaattgcctctag

SEQ ID NO: 124079 - DNA, 879 bp, Artificial Sequence
  Description of Artificial Sequence: Synthetic coding sequence
atgagggaatggtgggtgcaggttggactactggctgtgcctctgctggccgcttacttgcacatccctcccccccagttgtctcccgctttgcatagttggaagtcctcgggcaagtttttcacatataaagggctgaggatattctatcaggactcagtgggtgtggttggcagccccgaaatcgtcgtcctacttcacggcttccccactagcagctatgactggtacaagatttgggaaggactgaccctcaggttccaccgggttattgcacttgattttctgggatttggtttttccgataaaccccggccccaccactatagtatctttgaacaggcatccatcgtcgaggccctcctcagacacttagggctccaaaacagacggataaaccttctcagccatgactatggcgatattgtggcacaggagctcctgtatagatacaaacagaatagaagcggtaggcttaccattaagtctctttgtctttccaacggcggaatctttccggaaactcacagaccccttctactgcagaagctgctcaaagatggaggcgtcttgtcccctatactgacgagacttatgaattttttcgtattttcgcgaggcctgcttcagtacatcaaccagcggaagaagtttcgccggagatgggtcggagctcttgcttcagtgacgattccgatccatttcatatacggccctctggaccccgtgaatccatatcccgaattcttggagttatatcggaaaactcttcctcgcagcaccgtctccatcctcgacgaccacatctctcattacccacagctggaagatcctatgggtttcctgaacgcctatatgggcttcataaacagtttctag

SEQ ID NO: 124080 - DNA, 879 bp, Artificial Sequence
  Description of Artificial Sequence: Synthetic coding sequence
atgagagagtggtgggtccaggttggtctcttggcagtccctctgctcgctgcatacctccatatccctccacctcagctgagcccagcactccatagttggaagtcttccggaaagtttttcacctataaaggcctcagaatcttctaccaggactcagtgggcgtggtaggttcccccgaaatcgttgtcttacttcacgggttcccaaccagctcttatgactggtacaaaatttgggaaggtttgactctccggttccaccgcgttatagcattggatttcctgggctttggctttagtgataagccgcgcccccatcactattctattttcgagcaggcgtctatcgtcgaggccctgctgcggcacctggggttgcagaatcgacgcataaatctgcttagtcatgattatggtgatatcgtcgcgcaggaactgctctataggtataaacagaaccggtccggtaggcttactattaaatcactgtgtctgtctaatggcggaatctttccagagacccacagaccactgcttctacagaagttgcttaaagacggcggtgtgctatcccccattttgactaggcttatgaatttttttgtgttttcacggggcctcctccagtatataaatcagcgaaagaagttccggaggcggtgggtgggcgcactggcatccgtcacaatccctattcatttcatttacggtcccctggatccggtgaatccctaccctgagttcttggagctttatcgaaaaaccctgccacgctccacagtgagcattctggatgatcacatctcccattacccccagctggaagaccctatgggcttccttaatgcatacatgggttttataaattccttttag

SEQ ID NO: 124081 - DNA, 582 bp, Artificial Sequence
  Description of Artificial Sequence: Synthetic coding sequence
atggataatctacgagaaacgttcctgtctcttgaagatggtctgggtagctccgatagcccaggacttctgtcctcgtgggactggaaggatcgcgctggacccttcgagctgaatcaagcatcaccttcccagagtttatcccctgcaccgagtctcgaaagttacagcagctctccatgccctgcggtggcgggactgccttgcgaacatggaggcgcgtcttccggcggtagtgaaggctgttcagtgggcggggcatccggcctcgtggaagtggactataatatgttggcttttcagccaacgcaccttcagggtggtggtggacccaaggcacaaaaaggtactaaagtgcgaatgtccgtgcaacgcaggcggaaggcatctgagagggagaagcttcggatgaggaccttagccgacgccctgcacactctgagaaactatttgccccccgtgtattcacagaggggccagcccctaactaaaattcaaaccctcaagtacaccataaagtatatcggagaactgaccgatttgctcaataggggccgcgaaccacgggctcagtccgcatag

SEQ ID NO: 124082 - DNA, 1893 bp, Artificial Sequence
  Description of Artificial Sequence: Synthetic coding sequence
atggcccttcctactgcccggccactgctgggctcctgcggtaccccagcattgggttccctgctgttcctcctttttagcctcgggtgggtgcaaccttcaaggacgctggctggcgaaaccgggcaggaagcagctcccttagatggcgtccttgctaatcccccaaacattagctctcttagccctcgtcagctgctcggcttcccatgtgcggaagtcagcggcctgagcacagagcgggtgcgcgaactggccgtggcccttgctcaaaaaaatgtcaagctaagcactgaacagctacgctgtctcgcccatcggctttctgaacccccagaagatcttgatgccttgccactggacctgcttttgttcctgaacccggacgcattcagtggaccccaggcttgcacccggttcttttctcgtatcactaaagcgaacgtcgatctgttaccgcgtggtgcccctgaacgtcaaagactgctgcccgccgccttagcctgctggggtgtgcggggctccctgctgtccgaggccgatgtgagagccctgggaggacttgcctgtgacttgccaggcaggtttgttgctgagagcgcggaagtgctactgcctaggcttgtcagttgccctggtccccttgaccaggaccagcaggaagccgcccgcgctgccctgcagggaggaggccccccatacggccccccctcgacctggtccgtctctacaatggacgctttgcggggtcttctaccagtgcttggacagccgattattcgatcaatccctcagggtattgtcgctgcctggagacagcggtcctctcgggacccttcctggagacagcctgaacggacaatcctccgaccccggtttcgcagggaggtggaaaagactgcttgtccatctggtaagaaagcacgagaaattgatgaaagcctcatcttttacaaaaagtgggaactggaagcgtgcgtggacgccgcactgctcgcaacacagatggacagagtcaatgcgatacccttcacctatgagcaactggatgtgctgaagcataaactcgatgaattgtacccacagggatatcccgaaagcgtaattcagcacctgggctacttgtttctgaaaatgtctccggaagacattagaaaatggaacgtcacctccctggaaaccctgaaagccctactggaagtgaacaaaggtcatgagatgtctccccaggctcccagacgccctctaccccaggtagccactctgatcgataggtttgttaagggccgcggacagctcgacaaagacaccctggataccctgactgctttttacccaggatacctttgcagcctttcccccgaggaactctcgagtgtccctcctagctctatctgggcagtgaggcctcaagatttagacacctgtgacccgaggcagctggatgttctttacccaaaggcaaggttggcttttcaaaatatgaacggttccgagtattttgtgaagattcagagtttcctgggtggagctccgaccgaagacctcaaggctctgtcccagcagaatgtcagcatggatctcgccacttttatgaaactccggaccgatgccgtgctgcctctgactgtcgccgaagtccaaaaacttttgggaccccacgtcgagggtttaaaagcagaggagcgccaccggccagtgcgagattggatactccggcaacgacaagatgacctggacacgttggggttaggtttacagggaggcatccccaatgggtatctagtgcttgacctgagtatgcaggaggccttgtcaggaaccccttgtctgttagggccaggcccagtgctgaccgtgctggctctcctgctggcctcgacgctggcctag

SEQ ID NO: 124083 - DNA, 1869 bp, Artificial Sequence
  Description of Artificial Sequence: Synthetic coding sequence
atggcactgcccacagcccggccattgctcggaagctgtggcactcctgcccttggctcactgctgtttcttctcttctctttaggctgggttcagccctcccgcacccttgcgggggagactggacaggaggctgcccccctcgacggtgtgctggcaaaccctccaaacatttcctccctgagcccgcgacaactactggggtttccttgtgctgaagtttcagggctttctactgagcgcgtgcgtgaactggctgttgcgctggcccagaagaatgtgaagttaagcacagagcagctgaggtgcctagctcacaggttgtccgagccccctgaggatctggacgcacttcctttggatctgctgcttttcctcaatcctgatgccttctctggcccccaggcctgtacgcgcttcttcagccgtattacgaaagctaacgtggacttgctgcctaggggggcccccgagcggcagagactgctgccagcagcccttgcatgctggggggttcggggaagccttttgagcgaggcggacgtccgggccctcggaggtctggcctgcgacctccctggtcgcttcgtggcagagtccgccgaagttctgctgcctcgcctcgtgtcctgtccgggccccctcgaccaggaccagcaagaggctgcacgcgcagcactgcaggggggtggccccccctacggtccaccctcaacatggtctgtcagtacaatggacgctttgaggggacttctcccagtactgggccaaccaattatcaggtcgattccccaaggaatcgtcgcggcatggcggcagcgaagcagtcgagacccctcctggaggcagcctgaacgtacgatcctccgcccgagatttaggcgggaggttgagaagaccgcttgtcccagcggtaaaaaagcaagagaaattgacgaaagcctaatcttctacaaaaaatgggagttagaggcctgtgttgatgcagctctcctcgcaacacagatggacagggtgaacgctattccttttacttatgaacagctcgatgtgttgaaacacaagttagacgagctctatccgcaaggctatcctgagagtgtgatccagcacctgggatacctttttctaaagatgagtccagaggacatccgcaagtggaacgtcactagcctggagacactaaaagccctgctggaggtgaataaggggcacgaaatgtcaccccaggttgctactctgattgatagattcgtgaaaggtcggggccagctcgacaaagacaccttagacactctgacagctttttatcctggctacctctgctctctaagtcccgaggagctttcttctgtgccacccagcagtatttgggccgtgaggccgcaagacttggatacatgtgacccccgccagctggatgtgctgtatccgaaagctaggcttgctttccagaacatgaacggcagtgagtatttcgttaaaatacagtcctttctggggggtgcacccaccgaggacctcaaagccctctctcagcagaatgtgtcaatggatctggcaaccttcatgaagctcaggaccgatgctgtgttaccacttactgtggcagaggtgcagaagctgctgggaccccacgttgaaggtctcaaggctgaggaacgacacagaccagtcagggactggatcttgaggcagaggcaggacgatctagataccctgggattaggccttcagggagggatccccaatggatacctggttctcgacctgagcatgcaagaggccttgtccggaaccccatgtttattgggtcctggcccagtgttgactgtcctggctctcctcctggcatctaccctcgcatag

SEQ ID NO: 124084 - DNA, 1893 bp, Artificial Sequence
  Description of Artificial Sequence: Synthetic coding sequence
atggccctcccaactgcccgccctctcctgggctcctgcgggactccagccctaggaagtctgctctttttgttgttcagtctgggctgggtgcaaccaagccggaccctcgccggcgagacaggacaggaagctgcacctctggacggtgtgctagccaacccgcctaacatctcgtccctgtcccctagacagcttctgggatttccatgcgctgaggtctctgggctcagcactgaacgggtgagggagctggccgtggcactcgctcagaagaacgtgaagcttagcaccgagcaactgaggtgcttggcccaccggctgagtgagcccccggaggatttagacgcgctccctcttgatctgctgctctttctcaatccagatgctttcagcgggccgcaggcttgcactagattcttctcacggatcaccaaggctaacgtggatctcctgccgagaggagctccagagagacagcggctcctgcctgccgcactggcctgctggggtgtgagggggtcactgttgtccgaggccgacgtgcgcgcactcggaggacttgcctgcgacctgcccggaagatttgtggctgaatcagccgaggtgctcctccctagactagtttcttgccccggacctctcgaccaggaccagcaggaagcagcccgcgctgcactccaagggggcggtccaccatacggccccccctcaacctggtccgtctccacgatggatgctctacgaggcctacttccagttctggggcaacctatcatcaggtcgattccacaaggtatcgtcgcagcctggcgccagagaagcagtagggatccgtcatggaggcagcccgagcgtaccatactgcgacccagattcaggagggaagtggagaagacagcctgtcccagcggaaagaaggcccgtgagattgacgaaagtctgattttttataagaagtgggaactggaggcttgcgtagatgccgccctcctggctacacaaatggatagggtcaacgcgattccatttacatacgagcagctggacgtgcttaagcacaagctcgacgagttgtatccccagggatatccggagtccgtaattcagcatttgggctatctgtttctgaagatgagtcctgaagacatccgaaagtggaacgtcacttcattggagactctcaaggcattactggaggtcaataaggggcatgagatgagccctcaggcgccacgccgccctttgcctcaggtagcgaccctgattgacaggttcgttaagggcagaggtcagctcgataaggataccctagatacattgacagcattctaccccgggtacctttgtagccttagtcccgaggaacttagcagcgttcctccttcctctatctgggccgtacggccacaggatttagacacctgcgacccaaggcagctagacgttctgtatcctaaggcgcggctggcgtttcagaatatgaatggttccgagtactttgtgaagatccagagctttctcggaggggctccaacggaggacctcaaagctctgagccagcagaatgtttctatggacctcgccactttcatgaagctgcgcactgacgctgtacttcctctcactgtagccgaggttcagaagctactgggcccccatgttgagggcctgaaggctgaagagcgacatcgcccagtgagggattggattctgcgccaaaggcaggatgatctggatactctcggcctcggactgcaaggaggcatccctaatgggtatctggtgctcgatctgtctatgcaggaggcactaagtggaacaccttgtttgctcggccctggacctgttttgacagtgctggccctactattggccagtaccctggcttag

SEQ ID NO: 124085 - DNA, 1869 bp, Artificial Sequence
  Description of Artificial Sequence: Synthetic coding sequence
atggcactccccactgccagaccgctcctgggcagttgcgggacaccagcactgggcagcctcctcttcctgctgttctcactcggctgggtgcagcctagcagaactctggccggcgagaccggccaggaagctgcgcccctcgatggcgtgctcgccaatccacccaatatcagctcgctcagcccgaggcagctcctgggctttccttgtgctgaagtcagtggactgtccacagaacgggtgagggagcttgccgtggcattagcacagaaaaatgtcaagctctcgaccgaacagctgcgatgcttggcacacagactgagcgaaccccccgaggacctggacgctcttccactggacttactcctgtttctgaatcccgatgccttttcaggtccgcaggcctgtactcggttcttttcccggattaccaaagcaaatgtggatcttctgcccaggggagctcccgagagacagcggctcctcccagcagcgctggcctgctggggcgttaggggttccctcctgagcgaagcagacgttcgtgccctcggtggactagcttgcgacctgccagggcggttcgtggccgagagtgccgaggtgttgctgcctagactcgtcagctgtccaggccccttggatcaggaccagcaggaggcagctcgggccgctttgcagggcggtgggccaccttacgggcctcctagtacatggtccgtctctaccatggatgccttgcgcgggctgctgccggtgctggggcagcccataatacgttcgattccccagggcattgttgccgcatggcgccagcgaagcagccgtgaccccagttggcgccagccagagcgaactattctcaggccacgcttcaggcgggaagtggagaagaccgcttgtccaagtggcaagaaggccagggagatcgatgagagcttaatattttataagaaatgggagttggaggcttgtgtcgacgcagccctgttggcaacccagatggaccgggtgaacgctatcccgtttacttacgaacagctagatgttctgaaacacaaattggatgagctgtaccctcagggctatccggaatccgtcattcagcacctggggtacctattcctgaagatgtccccggaggacatcagaaagtggaatgtgactagcctagagaccctcaaagccttactggaggtcaacaagggccatgagatgagcccacaagtggcgacactgatcgaccgcttcgtaaagggcagaggccaactggacaaggataccttggacacactcaccgccttctatcctggttacctctgctcactgtcccccgaggagctgagtagcgttcccccgagctctatctgggctgtacggccccaggaccttgacacctgtgatcctcggcagctggacgtcctttacccaaaagctagactggccttccaaaatatgaacggctccgaatatttcgtaaaaattcaatcctttttgggcggggcacccacagaagatttgaaggcgttgagtcagcagaacgtgtctatggatttggctacctttatgaagctcagaacagacgcagtgctgccactgaccgtggcagaagtgcagaagctgttaggcccccatgtcgaagggcttaaagcagaggaacggcatcggccagtccgggactggatcctcaggcagaggcaggatgatttagacacattaggcttgggattgcaggggggtatccccaatggctatctcgtgctggacctttctatgcaggaggctctgagtggaacgccatgccttctgggcccaggtccagtgttgacagtactggccctgctattagcaagcacgttggcttag

SEQ ID NO: 124086 - DNA, 1869 bp, Artificial Sequence
  Description of Artificial Sequence: Synthetic coding sequence
atggcgctgccgaccgctaggcccctgcttggaagctgtgggacacccgccctcggcagcttattgttcctcctgttttcccttggttgggtgcagccatcccgcacattggcaggagagaccggccaggaggctgcccccctcgatggggttctggcgaatccccccaatatttcctctttatcccctagacagttgctgggtttcccctgtgccgaagtttccgggctctctaccgagcgagtccgcgagctggccgtggctctggctcagaagaacgtgaaactcagcacggagcaactgaggtgtctcgcacatagactgagtgagccacctgaggatcttgacgccctcccattggaccttcttctgttcttgaatccagacgcattttctgggcctcaagcatgtacacgcttcttttcacgcatcacaaaggccaatgtggacttgttgccccgaggagcccccgagcggcagaggctcctgccagctgctctggcttgttggggagtgcggggatcactcctgagtgaggctgatgtcagagcacttgggggcctggcttgtgaccttcccggcaggttcgtggctgaatcagccgaagtgcttctaccccggttagtatcatgtccaggccccttggaccaggatcagcaggaagcggcaagggccgctctccagggtggcggaccaccctatggcccgccctctacttggtccgtgagtaccatggacgcgttacgtggcctactgccagttctgggccagcccatcattcgaagcatccctcagggtatcgtggcagcatggcgacagaggagttccagagaccccagctggcggcagccagaacggacgatattgagaccaagatttcgccgagaagtcgaaaagacagcctgccccagtggaaaaaaggccagagaaattgacgagtccttgattttttacaagaaatgggaactagaggcttgcgtggacgcggccctactagccacccagatggatcgcgtgaacgccatcccatttacctatgagcagttggacgttcttaagcataagctagacgagttatatccccaaggctacccagagtccgtcattcagcacctcggctacctctttttaaagatgagtcctgaggatatcaggaagtggaatgtgacctccttggaaaccctcaaggcactactggaggtcaacaaggggcacgaaatgtctccacaggtggccacgctcattgaccggtttgtgaaaggccgcgggcagctggacaaagataccttggataccctgactgccttctatcccggctatctgtgctcactctctcctgaggagctttcctccgtgccccccagctccatctgggccgtccgcccccaggatctcgacacatgcgatccgcggcagctggacgtcttgtacccaaaggccaggctcgccttccagaacatgaatggctctgaatatttcgtcaagatccagagcttcctcggcggcgcgcccaccgaagacctgaaggctctgtcgcaacagaatgttagcatggatttggcaaccttcatgaaactcaggaccgatgcggtgcttcccttgaccgtggccgaagtacagaagctgctgggccctcatgtggaaggactgaaggccgaggaaaggcacagaccagtgcgggactggatcctaagacaacggcaggacgaccttgacaccctggggctggggctgcagggaggcataccaaatgggtatttggtgctggacctttcaatgcaggaggctttatccggaacaccatgtctgctggggcccggaccagttctaacggttttggctttacttctggcctcaacccttgcctag

SEQ ID NO: 124087 - DNA, 1782 bp, Artificial Sequence
  Description of Artificial Sequence: Synthetic coding sequence
atgagggatagcactggcgccggaaattctctcgtgcataagaggagtccattgcggcgtaaccagaagacacctacttcactgactaagctgtcgctccaagatggacataaggcaaagaaacctgcttgcaagtttgaagagggccaagacgtgctggcacggtggtcggacggcctcttctacctggggacaataaagaaaataaacatcctgaagcaatcctgcttcattatctttgaggactctagcaaaagctgggtgctgtggaaagacatacagacaggagccactgggagcggggagatggtgtgtacgatatgtcaggaggagtactcagaggcgcccaacgagatggtgatttgtgacaagtgcggtcaagggtatcatcagctctgccacactccgcatatcgactgcagtgtgatcgattccgacgagaagtggttgtgcagacagtgcgtgttcgcaactacaacaaagagaggcggggctttgaaaaaagggccgaacgcaaaggctctgcaggttatgaaacaaaccctgccatattctgtcgccgatctggaatgggacgcaggtcacaagaccaatgtgcagcagtgctattgttactgcggcggaccaggcgactggtatctaaagatgcttcaatgctgtaagtgtaagcagtggtttcacgaggcatgtgtgcagtgcctccagaagcctatgctatttggcgacaggttttacactttcatctgcagcgtgtgcagttcaggcccagaatatctgaaaaggctgcccctccagtgggtggacatcgctcacttatgcctgtacaacctgagcgtgatccacaagaaaaagtactttgattctgagctggagctaatgacatatatcaacgaaaattgggatcgcttgcatcctggcgagctcgctgacacccctaaaagtgagcggtatgaacacgtgctcgaggccctcaatgactataaaaccatgtttatgtctggaaaggagattaagaaaaaaaaacatcttttcggtctgcgcatccgtgtaccccctgtgcctccgaatgtggcctttaaagccgagaaggagccagaggggacgtcacacgaatttaaaattaagggtcgcaaggcctctaaacctatctctgactcccgagaggtttcaaacggcattgagaagaaggggaagaagaaatctgtgggacggcccccagggccctacacaaggaaaatgatccagaagactgccgagcctctcttggataaggagtctatctcagaaaacccaactcttgacctcccttgttccatcggccgtactgagggtacagcccacagttcgaataccagcgacgtggatttcacaggggccagctcagcaaaggagaccacctcctcctcgatcagtcggcactacgggctatccgacagtcggaaacggaccagaacgggcaggagctggcctgcagccattcctcacttgcgcagaagacgagggaggttaccccggcgagccctccaaacccagaactcagagattgtcaaggacgacgaggggaaagaggactaccaatttgacgagttgaatacggagatccttaataatcttgccgatcaggaactgcagttgaatcacctgaaaaattccattacctcttactttggagcagcaggacgaattgcctgtggcgaaaaatacagggtccttgcaagacgtgtgacactggatggaaaggtgcagtacttagtggagtgggaaggcgctaccgcatcctag

SEQ ID NO: 124088 - DNA, 1611 bp, Artificial Sequence
  Description of Artificial Sequence: Synthetic coding sequence
atgcgggattccacaggtgctggaaacagtctggtacacaagagatcccccctcaggcgtaaccaaaaaacccccactagccttaccaagctgagtcttcaggatggtcataaagctaagaagccagcttgcaaatttgaggaagggcaagacgttctggcgcggtggtctgacggactgttttacctgggcacaatcaagaaaatcaacatactaaaacaaagttgctttatcatttttgaggacagttcgaagtcctgggtgctctggaaagatatccagacgggcgcgacgggtagtggggaaatggtgtgtacaatctgtcaggaggaatactcagaggcacccaacgaaatggtaatctgcgataaatgcggacagggataccatcagctttgccacacgcctcacattgattgtagcgtgattgatagcgatgagaaatggctgtgccgccagtgcgtctttgccacaacaactaaacgcgggggcgccctcaaaaaaggtccgaatgctaaggccctccaggtcatgaaacagactttgccatatagtgtggccgacctggagtgggacgcaggacataaaaccaacgtgcaacagtgttactgctattgcggaggccccggggattggtacctgaagatgctgcagtgttgcaaatgcaagcagtggttccacgaggcctgcgtgcagtgtctccagaagcccatgttatttggagaccggttttatacatttatttgttcagtgtgtagctcggggcccgagtatctgaagcgattgcctctgcaatgggtggacattgcccatctgtgcctgtataacctcagtgtcattcataagaagaagtactttgattcagaactcgagctaatgacgtatatcaatgaaaactgggaccggctccatccaggcgagttggccgatacaccaaaaagcgagagatacgaacacgtcctcgaggcactcaatgattacaagacaatggaagtctcgaatggaattgaaaagaaagggaagaagaaaagcgttggccgtcctccaggaccctatacccgcaagatgatccagaaaaccgccgagccgctgctggacaaagagagcattagtgaaaaccctacgttggatttgccttgttccatcgggcgtaccgagggtaccgcgcacagctccaacacttcagacgttgatttcactggtgcatctagcgccaaggaaactacaagctcttctattagcagacactacggtctaagcgacagcagaaagaggacacggacaggccggtcatggccagccgccattcctcacttacgccgaaggaggggaagactgccccgtcgcgccctgcagactcaaaattctgaaatcgtgaaagatgacgaggggaaagaagattaccagttcgatgaactgaacactgaaatcctaaacaatctggccgatcaggagctgcagctgaatcatctgaaaaattccattactagttatttcggcgctgccggccgcatagcatgtggagagaagtaccgcgtactggctaggcgagtgacactggacggtaaggtgcagtacttagtggagtgggagggtgcaactgcttcatag

SEQ ID NO: 124089 - DNA, 861 bp, Artificial Sequence
  Description of Artificial Sequence: Synthetic coding sequence
atggtttgcaccatttgtcaagaggagtacagcgaagcaccaaatgagatggtaatttgcgataagtgcggccaagggtaccatcaactgtgtcatacgccccatattgattgctctgttatagacagtgacgagaagtggctctgtcgccagtgcgttttcgcgactacgaccaagagaggtggagcactcaaaaaaggacccaacgccaaagctttgcaagtcatgaagcaaaccctcccatactctgtggccgacctcgagtgggacgccggacacaaaaccaacgtgcagcaatgctattgttactgtggtggccccggagactggtacctcaagatgttacaatgctgcaaatgtaaacagtggttccacgaggcatgtgtgcagtgcttacaaaagccaatgttgttcggtgaccgtttttatacattcatatgttccgtctgttcatccgggcctgaatacctgaagaggctcccattgcaatgggtggatatcgctcacctgtgcctgtacaatctgtccgtgatacacaaaaagaaatactttgatagcgagctggagctgatgacctatattaacgagaattgggaccgtctgcatcctggtgagctggcagatacccctaaaagtgaaagatatgagcacgtgcttgaggccctcaatgactataaaaccatgtttatgtctgggaaagagatcaaaaaaaaaaaacatctgtttggtctgcggattcgggtaccaccggttccgccaaacgttgcattcaaagccgagaaagagccagagggcacgtctcacgaattcaagctgaaagcagagcggcacccaaacctgtacctcatccaaggaaaatag

SEQ ID NO: 124090 - DNA, 1476 bp, Artificial Sequence
  Description of Artificial Sequence: Synthetic coding sequence
atggtctgcaccatttgccaagaggagtattctgaagctcctaatgaaatggtcatttgcgacaaatgtggccaggggtatcaccagctatgccataccccacatatcgattgctctgtgatcgactccgatgagaagtggctgtgtcgacagtgcgtcttcgctacgactaccaagcgaggcggcgcgctgaagaagggtcccaacgccaaggccctccaggtgatgaaacaaaccttgccatattccgttgcagatctagagtgggacgctggccacaagactaacgtgcagcagtgctactgctactgtggcggccccggtgactggtacctgaaaatgctccagtgctgcaagtgcaagcagtggtttcacgaggcatgcgttcagtgtttgcaaaagcctatgctgttcggtgataggttctacacatttatttgctcagtttgttctagtggccctgagtatttaaagcggctgcccctgcagtgggtggatatcgcccatctctgtctgtacaacttaagtgtgattcacaagaagaagtactttgatagcgagctggagcttatgacatacataaatgagaactgggaccgtctgcacccgggcgagctcgccgatactcctaagagtgagcgatatgaacacgtcctggaagccctgaacgactacaagactatgtttatgtccggaaaagagataaaaaagaaaaaacatctgttcggactgagaattcgggtgccacccgtaccccccaatgttgcttttaaagccgagaaggagcccgagggcacctcacacgaatttaaaatcaagggccgcaaggctagtaaacccattagcgattcccgcgaggtctccaatggcatcgaaaagaaaggtaaaaagaaatccgtgggcagaccacctgggccatacacacgaaagatgatacagaagacagccgagccacttctggataaagagtccatctcagagaatcccactttggatctgccttgttccattggtcgcacagagggtactgcgcactctagcaacacatctgacgtagattttaccggagccagtagcgccaaggagactactagcagcagcatttcacggcactacggcctcagcgacagccgaaagagaacgaggactgggcgatcttggcctgcagcaatacctcacctcagacgccgccgcggcaggctgcctaggagggctttgcaaacccaaaacagcgaaattgtgaaggacgatgaaggtaaggaagattatcagtttgatgagctcaacaccgagattctgaataacctggccgatcaagagctccagctaaatcacttaaagaattccataaccagttattttggtgcggcgggacggatcgcatgcggtgagaaatatcgggttctggcacgcagagtgactcttgacggaaaagtccagtatctggtggaatgggagggagcgacggcaagctag

SEQ ID NO: 124091 - DNA, 1476 bp, Artificial Sequence
  Description of Artificial Sequence: Synthetic coding sequence
atggtatgcaccatttgtcaagaagaatattctgaggcacccaacgagatggtgatctgtgataaatgtgggcagggatatcaccaactgtgtcatacccctcacattgattgttctgtcattgatagtgacgaaaaatggctttgtagacagtgtgtgttcgccacaacaaccaaacgaggcggcgcattaaagaagggacccaatgctaaagccttgcaggtcatgaaacagacactaccctatagcgtggcagatctggagtgggacgcgggccataagacaaatgtgcagcagtgttactgctattgcggcggccccggggattggtacctcaagatgctgcagtgttgtaaatgcaagcagtggttccatgaggcttgcgtgcagtgcctgcagaagccaatgctgttcggcgaccgcttttacaccttcatatgcagtgtctgttcatcagggccagagtatctaaagcggctccccttgcaatgggtcgatattgcccacctgtgcctgtacaatctttctgtcattcacaagaagaagtatttcgactccgagttggaactcatgacatatatcaacgagaattgggaccggctgcaccctggtgagctggcagacacaccaaagtcagagcggtacgaacacgtgcttgaggcactcaatgactataaaacaatgtttatgtccggtaaggagataaaaaagaaaaagcacctcttcggtctgcgaattagggtgcccccagtccctcccaatgtggcattcaaagcggagaaggagcccgaagggacctcccatgaatttaagattaagggaagaaaggccagtaagccaatttctgatagccgggaggtgtcaaatggcatagagaagaagggcaagaagaagagcgtgggacgcccaccaggaccttatacacgaaaaatgatccaaaaaaccgctgaacccctgctggacaaggagtcaattagtgagaaccccaccttagacctgccttgctcaatcggcagaaccgaaggaaccgcccattcatcaaatacatccgatgtggactttacgggcgcgagttctgctaaggaaaccaccagttcctcgattagtagacattacggactcagcgattcccgaaagagaacccgcaccggccgaagctggcctgccgcgattccacatctacgccgtcgccgcggccggctgcccagaagggctcttcagacacagaactctgagatcgtcaaagatgacgaaggcaaagaggactaccaatttgatgagctgaataccgaaatcttgaacaatcttgctgaccaagagctgcagcttaaccatctgaagaattccattactagctacttcggcgctgcagggcgtatagcctgcggggagaagtatcgcgtgctcgcacgtagagttactcttgatggcaaggtccagtacttagtggagtgggagggagcaacagcaagctag

SEQ ID NO: 124092 - DNA, 1191 bp, Artificial Sequence
  Description of Artificial Sequence: Synthetic coding sequence
atggcgatgatcgaattgggatttggacggcagaatttccatcccctaaaacgcaaatctagcctgctgctgaagctcatagctgtggtgttcgcagtgctgcttttttgcgagtttttgatttattacctcgctattttccagtgcaattggcccgaggtcaaaaccaccgctagcgatggtgagcagactacccgggaaccagtgttgaaagcaatgttcctagcagatacgcacctgcttggtgagtttttagggcattggttagacaaactgagacgagagtggcagatggaaagagctttccagactgccttgtggctactccagccagaggtggtgtttatcctaggtgacatcttcgatgaaggtaaatggtccacaccggaggcatgggccgatgacgtagaaaggtttcagaagatgttcagacacccatcccatgttcagctgaaggtcgtagccgggaaccacgatataggattccactatgaaatgaacacatataaagtggagagatttgagaaagttttctccagcgagaggctgtttagctggaagggcatcaatttcgtgatggttaacagtgtggctttaaatggggatggatgtgggatttgcagcgagaccgaggcagagctaatagaagtgagccatcgtctgaattgtagccgcgaagcacgtggatcctcccgatgtggcccgggtccactccttcccactagtgccccagtactcttacagcactaccctctgtaccgtaggtctgacgcgaattgcagtggcgaagatgcggccccagccgaggaaagggacatcccatttaaggagaactacgatgtcttgagccgggaggccagtcagaagctcctctggtggctgcagccccggctggttctctccgggcatactcacagtgcttgcgaagtgcatcacgggggccgtgtaccagaattaagtgtgcccagtttctcttggcgcaacagaaacaaccctagtttcatcatgggatccatcaccccgaccgactacaccctcagtaaatgttacctgcccagggaagacgttgtcctgataatttactgcggggtggtgggttttttggtcgtgttgacattgacccatttcggattgttagccagtccttttctgtccggcctcaatctgctagggaagcgcaaaactaggtag

SEQ ID NO: 124093 - DNA, 1002 bp, Artificial Sequence
  Description of Artificial Sequence: Synthetic coding sequence
atggccatgatcgaactgggatttggcagacagaatttccacccacttaagcgtaaatctagcctgctgctgaagctgattgctgtggtctttgctgtcctgctgttttgcgagtttctcatttattatctcgcaatattccagtgtaactggccagaagttaagacaaccgcctctgatggcgaacaaactactagggagcccgttctgaaagccatgttcctcgccgacacccacctgcttggtgaattcctgggacactggctagataagctgagaagagagtggcagatggagcgggcattccagacagcactgtggctgttacagcctgaggtggtgttcatcttgggagacatcttcgacgagggcaagtggtccacacccgaagcgtgggcggatgacgtagagcgcttccagaaaatgttccggcatccatcccatgttcagctcaaggtggtggccgggaaccacgatatcggcttccattacgagatgaatacatataaggtggaaagattcgaaaaggtgttctcctcggagagactcttcagctggaagggtattaattttgtaatggttaactctgtggcactgaatggggatggatgcggcatatgctctgaaacggaggctgaactgattgaggtaagccaccggctcaattgcagccgcgaattactctggtggctgcagcctagactggtcctgagcggccatacccactccgcttgcgaagttcaccacggcgggagagtgcctgagctgagtgttccttcatttagttggagaaacagaaataatcccagtttcataatgggcagcatcactcccacagattataccctgtctaaatgttatttaccccgggaagatgttgtgcttatcatatattgtggagtcgtgggtttcctggtggtgctgaccttgacacatttcggactgctcgcctctcccttcctgagcggactgaatctgctcggcaagcggaagacccggtag

SEQ ID NO: 124094 - DNA, 732 bp, Artificial Sequence
  Description of Artificial Sequence: Synthetic coding sequence
atggagagggccttccagacagctctgtggctcttgcagccggaggtggtgtttattctcggcgacattttcgacgaggggaaatggagtacgcctgaggcctgggctgatgacgtagagagattccagaagatgttcagacatccttctcacgtccagctaaaggttgttgcggggaaccatgatattgggtttcattatgagatgaacacatataaggtggaacgcttcgagaaggtatttagcagcgagcggttattcagttggaaagggatcaattttgttatggtgaatagtgtggcccttaacggagacggatgtggaatctgttccgaaactgaggccgaacttatcgaggtgtcccacaggcttaattgtagtcgggaggccagaggaagcagtcgctgcggaccaggacccctgctcccaacctccgcgcccgtgcttttgcagcactatccattgtacaggagaagcgacgcaaactgctccggcgaagatgcagctccagcagaggaacgtgacatcccattcaaggaaaattatgacgtgctgtccagagaggcatcccagaaactactctggtggctccagccgagactggtgctctctggtcatacacattctgcatgtgaagtgcatcacggtgggagggtgcctgagctgtcagttccaagcttcagctggaggaaccggaacaaccccagcttcatcatgggtactgatgcttag

SEQ ID NO: 124095 - DNA, 1194 bp, Artificial Sequence
  Description of Artificial Sequence: Synthetic coding sequence
atggctatgatcgaattgggtttcggtagacagaacttccatcctctgaaacgcaagtcctcactcctgctgaaactgattgccgtggtgttcgctgtgctgctgttttgcgaattcctgatttattatctcgctattttccaatgcaattggcccgaggttaaaacgaccgccagcgatggcgaacagaccacaagggagcctgtgctcaaggcaatgttcctggccgatacgcaccttcttggcgagttcctggggcactggctggataagcttcggagggagtggcagatggagagagcctttcagacggcattgtggcttctgcagccggaggtggtgttcattctgggagatatctttgatgagggcaagtggtccactccggaagcgtgggctgacgatgtcgagcggttccagaaaatgtttaggcatccctcccacgtgcagctgaaagtggtggcagggaaccatgacattgggttccattacgaaatgaacacctataaagttgagaggtttgagaaagtcttttcttccgagagactctttagctggaaaggtattaattttgtgatggtcaactctgtggcactgaatggagatggatgcggtatctgttcagagaccgaagctgagctgatcgaagtgagtcataggcttaactgtagcagagagcaggctcggggaagcagccgatgtggccccggtcccctgttaccaacaagtgccccagtattgttgcaacactatccattgtatagaagatcagacgccaattgcagcggagaagatgctgccccggccgaagaacgcgacatcccctttaaagaaaattacgacgtgctcagtcgggaggcgtcccagaaactgttgtggtggttgcagccacgcctggtcctttcgggccatacccactcagcatgcgaagtacatcacggcggccgtgtgcccgaattgagcgtacccagcttctcctggcgcaatagaaataacccttccttcattatgggctccataaccccgaccgattataccctgtccaaatgctatctcccccgcgaggacgttgtgctaataatttactgcggtgtggtgggatttttggtcgtgttaaccctcactcattttgggctactggcctcgcccttcttgagtggactgaacttgttgggtaagaggaagacaagatag

SEQ ID NO: 124096 - DNA, 1026 bp, Artificial Sequence
  Description of Artificial Sequence: Synthetic coding sequence
atggccatgattgaacttggctttggtagacagaacttccacccactcaaaaggaaaagtagtctgctgttaaaactgatagccgtcgtgtttgccgtgctcttgttctgtgagttcctgatctattacctagcaatctttcaatgtaactggccagaggtcaagactactgcctctgacggcgaacagaccactcgagagcccgtgctcaaagcaatgtttttagccgatacacacctgctgggggaattccttggtcactggcttgacaagctgcgccgcgagtggcagatggaacgcgcctttcagactgctctgtggctccttcagcctgaagttgtgtttatcctgggcgatatattcgatgagggcaagtggtctacgcccgaggcttgggccgacgacgtcgagagatttcagaagatgtttcggcatccttcacacgtccaactgaaggtcgtcgctggcaaccatgatataggcttccactatgaaatgaacacctataaagtggagaggttcgaaaaagtgttttcaagtgagaggctgttctcctggaaaggcatcaacttcgtcatggtgaacagcgtggctctcaatggcgatggttgcggaatctgttccgaaaccgaggccgaactcatcgaggtatcacatcgtctgaactgctctagagaacaggctcggggttcgagcaggtgcggcccgggaccgctgctgcctactagcgcccccgtcctgttacagcactaccctttatatagacgatcagacgccaattgctctggcgaggatgccgcacccgcagaagagagggacataccatttaaagagaattatgatgtgctgagccgggaagcttcacagaagttactgtggtggctgcagccacggcttgtgttgtctggccacacccactccgcctgtgaggtgcatcacggcggaagggtgcctgaactatccgttcctagcttctcatggcggaaccgaaacaatcctagctttattatgggcaccgacgcgtag

SEQ ID NO: 124097 - DNA, 1191 bp, Artificial Sequence
  Description of Artificial Sequence: Synthetic coding sequence
atggcaatgatagagctgggtttcgggcggcagaattttcatcctctgaagaggaagtcatccctcctgctcaagcttatcgcagtggtctttgccgtactgctcttctgcgaattcttaatctactacttggccatcttccaatgcaattggcccgaggtcaagaccactgcttccgacggggagcaaacgaccagggaacccgtcttaaaagccatgttcttggccgacactcatctcctgggcgagtttttgggacactggcttgacaaacttcgcagggagtggcaaatggagagagccttccagacagctctgtggctgttgcagcccgaggtggtgtttattctgggggatatctttgatgaaggaaagtggtcaacacctgaggcctgggctgacgatgtagaaagattccagaaaatgtttcgccatcccagccatgtgcagctgaaggtggttgctggcaatcatgacatcggattccattatgaaatgaacacctacaaggtggagaggttcgagaaggtgttctcttcggagcgattattctcgtggaagggcataaacttcgtcatggttaatagtgtggctctcaatggcgacggttgtgggatatgtagtgagacagaagcggagctgattgaagtcagtcaccgattgaattgcagtcgcgaggcacgaggtagctcccgctgcggccctggccctttactacccacctccgctcctgtcctcctgcaacattaccccctgtacagacggagcgatgcgaactgtagcggtgaagacgctgcccccgctgaggagagagatatcccatttaaggagaactacgacgttctgtcaagggaagctagccagaagctgctgtggtggctgcagccaaggcttgtgttaagcgggcacacgcactctgcatgtgaagttcaccacggcggacgggtccctgaactgtccgttccctctttttcttggagaaaccggaataatccaagttttatcatggggagcattactccgacagattataccctgtccaaatgttacttaccccgtgaggacgtcgttctgatcatttattgtggcgtagtgggatttcttgttgtgctaacattgacacacttcgggcttttagcctctcccttcctttcgggcttaaacttgctgggcaaacgaaagactcgctag

SEQ ID NO: 124098 - DNA, 360 bp, Artificial Sequence
  Description of Artificial Sequence: Synthetic coding sequence
atgtggcgatcaaggtgggacgcctcagttctgaaagccgaggccttggctctgctcccctgcggactaggcatggcattctctcagagccacgtgatggccgcaaggcggcaccagcatagtaggcttataattgaggtagatgaatactcctctaatccgactcaggccttcacgttttacaatatcaaccaagggaggttccagccccctcatgtgcagatggttgatcccgttccgcatgacgcccccaagccccccggctacacccgttttgtgtgtgtgtccgacacacacagcaggaccgacccaattcagatgccatacggggacgtcctgatccatgccggcgatttttag

SEQ ID NO: 124099 - DNA, 663 bp, Artificial Sequence
  Description of Artificial Sequence: Synthetic coding sequence
atgccatacggggacgttcttatccacgctggcgattttacggaactcgggctgccttcagaagtgaagaagttcaatgagtggctgggatctctgccttacgaatacaaaattgtgatcgccggtaatcacgaactaacatttgaccaggaattcatggccgacttgatcaaacaggatttttattactttccgagtgtgagcaagctgaagcctgaaaactatgagaacgtccagagcctcctgacgaactgcatatacctgcaagattcagaggtgactgtgcgtggctttcgcatctacggctctccctggcagccatggttttatggctgggggttcaacctccctcgtgggcaggccctcctagagaagtggaatctaattccggagggagttgatatattgatcactcacggcccccctttgggcttcctggactgggtgccgaagaaaatgcagagagtggggtgcgtggaactcctgaacactgtgcagaggcgggtgcaaccacgtttgcacgtgtttgggcacatccacgaaggctacggagtcatggccgatggaaccactacgtacgtcaatgcctccgtgtgcacagtgaattaccagcctgtgaaccctcctattgtgattgacctcccaaccccacgcaacagttag

SEQ ID NO: 124100 - DNA, 981 bp, Artificial Sequence
  Description of Artificial Sequence: Synthetic coding sequence
atgtggcgctcccgctgggacgcctcagttctgaaagcggaggcactagccctacttccttgtggcctgggcatggcgttcagtcagtcccacgtgatggcagcccgtcgccatcagcactcgcgactgattattgaggttgacgagtacagtagtaacccaacccaggccttcacattttacaatatcaaccaaggcagatttcagccacctcacgtgcaaatggtggacccagttccacatgacgcccccaagcctccgggctatacacgcttcgtctgtgtctctgatacccactccagaacagaccccatacagatgccgtatggagatgtgctcatccatgctggggattttacggagctgggccttccatcagaggtgaagaaatttaacgagtggttaggttctctcccttacgagtacaaaatcgtgattgctggaaaccatgagcttacatttgatcaggaattcatggccgatctcattaaacaagatttttattatttcccaagcgtcagcaagctcaagcctgaaaattacgaaaacgtgcagagtctgctgaccaattgcatatatctccaggactcggaagtgacagtgcgcggattcaggatatatggaagcccgtggcaaccatggttctatggatggggatttaatctgccccgtgggcaggcactgctggaaaagtggaatctgatccctgagggagtggacatactcatcactcatggtccgcccctcgggtttttagactgggtccccaaaaagatgcagcgggtcggctgcgtcgaactgctgaatactgtgcagaggagggtccagccacggcttcacgtttttggacacattcatgagggatatggtgttatggcagacggcactactacatacgtcaacgcttctgtgtgtacagtgaactaccagcctgtgaaccccccgatagtaattgaccttccaaccccaaggaactcttag

SEQ ID NO: 124101 - DNA, 507 bp, Artificial Sequence
  Description of Artificial Sequence: Synthetic coding sequence
atggccgacttaatcaaacaggacttttattacttccccagtgttagtaagctcaagccggagaactacgaaaatgtacagtctctactgaccaattgtatttacttgcaggatagcgaagtaacggtgcgaggcttccggatatacgggtcaccatggcagccctggttttacgggtggggattcaatctccctagaggacaggctctgttagagaagtggaacctcattcccgaaggggtcgatatccttatcacccacggaccccccctaggttttttagactgggtacctaaaaaaatgcagcgcgtgggctgcgttgagctgcttaatacagtgcagcgtcgagttcagccccgactgcacgtgttcgggcatatccatgagggctatggcgtgatggcggacgggactacaacttatgtcaatgcctcagtctgtacagtgaattatcagcctgtgaaccctcccatcgtgatagatcttcccactccaaggaatagctag

SEQ ID NO: 124102 - DNA, 981 bp, Artificial Sequence
  Description of Artificial Sequence: Synthetic coding sequence
atgtggcgttcaagatgggacgcctctgtgttgaaagccgaggccctggctctactaccttgtgggctgggaatggccttcagccaaagtcacgtaatggcggctagaagacatcaacattctaggctgatcattgaggtcgacgagtatagttccaatcccacacaagctttcaccttttataatattaatcaggggaggttccagccaccgcacgtccagatggttgatcccgttcctcacgatgctcccaaaccccccggctatactcggtttgtgtgcgtctcagatacgcatagcaggaccgatcctatccaaatgccctatggagacgtgcttatccacgccggcgacttcaccgagctcgggttgcccagtgaggtcaaaaagttcaatgaatggcttggaagcctcccctacgaatataagattgtgattgcaggcaatcatgagttgacatttgatcaagagtttatggccgacctgataaagcaggatttctactacttcccctcggtgtccaagttaaagcccgagaactacgagaacgtgcagagtctcctgaccaactgcatctacctgcaggatagcgaagtgaccgtccgcgggttcaggatctacggtagcccttggcagccatggttctatgggtggggcttcaacttgccccgagggcaagcactgctcgaaaaatggaacctgattcccgagggggtcgacatcctgattacccacggtcctccactcggatttctggattgggtgcccaagaaaatgcagcgagttgggtgtgtggagctgctcaataccgtccagaggagagtgcagccccggctgcacgtgttcggtcatattcatgaggggtatggggtgatggcagacggaaccacaacctatgttaacgcctccgtgtgtaccgtgaactatcagcctgtgaacccccctatcgtgatcgatcttcccaccccgagaaactcctag

SEQ ID NO: 124103 - DNA, 225 bp, Artificial Sequence
  Description of Artificial Sequence: Synthetic coding sequence
atgtggcgatcccgttgggacgcttcagtgctaaaagccgaggccctggcgctcctcccctgtggccttggcatggccttcagtcagtctcacgtaatggccgctaggcggcaccagcattctagactgatcatcgaggtggacgaatattcctcaaatccaactcaggcattcactttctataacattaaccagggaaggttccagcccccgcacgtgcagtag

SEQ ID NO: 124104 - DNA, 1080 bp, Artificial Sequence
  Description of Artificial Sequence: Synthetic coding sequence
atgaatggtagagagacacagagtgtcagtcgaagcggaggaggccctggctgtggcggaggttctggcggacggtgtagaggaggtcgaagacggagtatgtggaggagcaggtgggacgccagcgtgctgaaagcagaggccctagctctgctcccctgtggcctcggaatggccttttcccagtctcacgtgatggcggcccgcaggcaccagcacagccggctcataatcgaagtggatgaatattctagtaatccaactcaagccttcactttttataatatcaaccagggacgcttccagcctccccacgtgcaaatggtggatcctgttccgcacgatgctccaaagccacccggctatacacggttcgtttgtgtatcagacacccactcgagaactgaccctatccagatgccatacggggacgttttgattcacgccggggatttcactgaactgggactgccctccgaggtcaaaaagttcaacgagtggttgggatctcttccatatgaatacaagatcgtgatagcaggtaaccacgagttgaccttcgaccaggagtttatggctgaccttatcaagcaggatttctattattttccctctgtgtctaagttgaagcctgaaaactacgagaacgtgcagagtcttcttactaattgtatatacctccaggactctgaggtcaccgttcgcggctttcggatctatggcagtccatggcagccatggttttacgggtggggttttaacttaccacgaggacaggctctgctggagaaatggaatcttattcccgaaggtgtagacatacttattacccacggtcctccattagggtttctggattgggtcccaaaaaaaatgcagagggtcgggtgcgtagagcttctgaatacagtccaacggcgggtgcagccacgactgcacgtgtttggacacatccacgagggatacggagtcatggcggacggcaccactacctacgtgaacgcgtccgtttgtaccgtgaattaccagcccgttaacccgccgatagtgattgacttgcccacccccagaaacagctag

SEQ ID NO: 124105 - DNA, 981 bp, Artificial Sequence
  Description of Artificial Sequence: Synthetic coding sequence
atgtggagaagcaggtgggacgctagcgttctgaaggctgaagctctggccctgctgccgtgcggactgggtatggccttttcccaatctcatgtgatggcggctcgccggcatcagcactctagacttattatcgaagtcgacgagtatagttccaatcccacccaggcattcaccttctacaacataaatcaaggacgcttccagcctccacatgtgcagatggtagatccggtgcctcacgatgctcccaaaccaccaggttacaccaggttcgtgtgtgtgagtgacacgcatagtagaactgatcctattcagatgccatacggcgacgtactcattcacgctggagattttacagagttaggactgccctctgaagtgaagaaatttaacgaatggctgggatcattgccctacgagtacaaaattgtgattgcgggcaaccacgaattgacctttgatcaggagtttatggccgacttaatcaaacaagacttctattacttccctagcgtgagcaaacttaagccagaaaactacgagaatgtgcaaagcctgctgacaaattgtatctacctgcaagacagtgaggtgacggtgagggggtttcgcatatacgggagcccctggcagccttggttctatggttggggattcaacctacctcgaggccaggctctactggaaaagtggaacctaattcctgaaggggtggacatcctgattacacatggaccgcctctcggctttctggactgggtgcccaagaaaatgcagagagtcggatgtgtcgaattgctcaacaccgtgcagagacgggtacaaccccggctccacgtgtttggccacatacacgagggatacggtgtaatggcagatgggaccaccacatacgtgaatgccagtgtctgtactgttaattatcagccggttaacccccccatcgtcatcgatctgccaacaccacgtaattcctag

SEQ ID NO: 124106 - DNA, 915 bp, Artificial Sequence
  Description of Artificial Sequence: Synthetic coding sequence
atgtggcgcagcttctctcaatctcatgtgatggccgctagacgccaccagcattctagactaatcattgaagtcgatgagtattcatcaaaccctacccaggccttcactttttacaatattaatcagggccgtttccagccgccacatgtgcagatggtggaccctgtgcctcatgacgcccccaagccccccggctacacacgcttcgtctgcgtttcagacacacatagcaggactgaccccatccaaatgccgtacggagacgtcctaattcatgccggcgatttcactgaacttggcctgccatccgaagtgaagaaattcaacgagtggctggggagtcttccctacgaatacaagatcgtcatcgccggaaatcatgaactcacattcgaccaagaattcatggccgatctgatcaagcaggacttctattattttccttcagtttctaagttgaaaccggagaattatgagaacgtgcagtccctgctgacgaattgtatctatcttcaggactctgaggtaacagtgagaggcttccgcatctacggctcaccatggcaaccctggttctatggctggggctttaacctgccacgaggccaggcactgctggaaaagtggaacctcattccagaaggggtcgacatactcattactcatgggcctcccctcgggtttctagactgggtgcctaagaaaatgcagcgagtcggctgtgtggagttgttaaacactgtccaacgacgtgttcagccccgcctgcacgtctttggacatatacacgagggttacggggtcatggctgatggaactacaacttatgtaaacgcttccgtatgcaccgtgaactatcagcccgtgaatccaccaattgtgattgatctgcctaccccccgaaactcatag

SEQ ID NO: 124107 - DNA, 885 bp, Artificial Sequence
  Description of Artificial Sequence: Synthetic coding sequence
atggcccatggcatacccagtcaggggaaggtgacgatcactgtggatgagtactcttccaatccaacgcaggccttcacccactataacatcaatcagagtcgattccagcctccccatgtccatatggtggatcctattccctacgatacccccaaacccgctgggcacaccagatttgtctgcattagtgatacacactctagaactgatggcatacagatgccgtatggggatatattgttgcacactggagactttaccgaactgggtcttccttcagaagtgaaaaaatttaacgactggttgggtaatctgccatacgaatacaagattgtaatcgccggcaatcatgagctgaccttcgataaggaattcatggctgacctagtcaaacaggattactatcggttccctagcgtttcaaagctgaaaccagaggacttcgacaatgtgcaaagtctgctaacaaactccatttacctacaggactcagaggttaccgtcaagggtttccgcatttacggcgccccttggactccatggttcaacgggtggggctttaatcttcctaggggacagtcgcttcttgacaaatggaaccttatcccagagggcatcgatattctgatgacgcacggacctcccctgggcttccgagattgggtccctaaagagttgcagagggtgggctgcgtggagctactgaacacagtgcaacgacgggtgagacccaagctgcatgtgtttggcgggatccacgaggggtatggcatcatgaccgacggctacactacatatattaatgcctccacttgcacggtgtcctttcagccaacaaatcctcccataatcttcgacctgccgaatcctcagggtagctag

SEQ ID NO: 124108 - DNA, 834 bp, Artificial Sequence
  Description of Artificial Sequence: Synthetic coding sequence
atggcgcacggaattccctcccaggggaaggtgacaatcacggttgatgagtatagctcaaatcccactcaggctttcacacattacaatattaatcagagcaggttccagcctccacacgtccacatggtcgaccccatcccctatgatacccccaagccggcaggacatacacgatttgtatgtattagcgacactcacagccgcacagacggaatccaaatgccttacggtgatatcctcctccataccggggacttcacagagctcggcttgccatcagaggtaaagaagttcaatgattggttaggcaacctgccttacgaatacaagattgtgatagccggcaatcatgagctcacctttgacaaggaatttatggccgacctggtgaagcaagattattatcgatttcctagcgtttcaaagctgaagcctgaagatttcgataatgtacagagcttgctgactaacagcatttatctgcaggattccgaggtcacagttaaggggtttagaatctacggagccccctggacaccgtggttcaacggatggggatttaatctacctcggggccagtcacttcttgataaatggaaccttatccccgagggcatcgacatcctgatgacgcacgggccacccctgggctttcgagattgggtgcctaaggaacttcagagagtcgggtgtgtcgagttgctgaatacagtccagcgtagagtgcgacctaaactccacgtattcggggggatccacgaagtaaaccccgtaagcatttctaaagcgctccgaaccaaaatttgcagcctgccttccaagacgtcatag

SEQ ID NO: 124109 - DNA, 132 bp, Artificial Sequence
  Description of Artificial Sequence: Synthetic coding sequence
atggcacatgggattccatcgcaaggcaaggtgaccataactgtggacgaatactcttccaatcccactcaggctttcacgcattataacataaatcagtccaggttccaacctcctcacgtgcacatgtag

SEQ ID NO: 124110 - DNA, 186 bp, Artificial Sequence
  Description of Artificial Sequence: Synthetic coding sequence
atggaccctaactgttcctgcgccaccggagggagctgtacctgcaccgggtcgtgcaaatgcaaggaatgcaaatgcacctcctgcaaaaagtcatgttgtagctgttgtcccatgtcttgcgcgaaatgtgcacaagggtgcatttgcaaaggcgcgagcgagaagtgttcttgttgcgcatag

SEQ ID NO: 124111 - DNA, 186 bp, Artificial Sequence
  Description of Artificial Sequence: Synthetic coding sequence
atggatccaaactgcagttgcaccaccggtgggagctgcgcatgtgctgggagttgtaaatgcaaagaatgtaagtgtacctcctgtaagaagtgctgctgctcttgttgccccgtcggttgtgcgaagtgtgcccaagggtgcgtatgcaaaggtagcagtgagaagtgcaggtgctgtgcgtag

SEQ ID NO: 124112 - DNA, 186 bp, Artificial Sequence
  Description of Artificial Sequence: Synthetic coding sequence
atggatcctaattgcagctgcgccactggtgggtcttgcacatgtgccggaagttgtaagtgtaaagagtgcaagtgtacatcatgtaagaagtcatgttgcagttgctgcccagtggggtgtgcaaaatgcgcacagggctgtgtttgcaagggtgcctccgaaaagtgctcctgctgtgcctag

SEQ ID NO: 124113 - DNA, 384 bp, Artificial Sequence
  Description of Artificial Sequence: Synthetic coding sequence
atggatcctaactgctcctgcgccaccggcggatcctgcacttgcgcgggctcatgcaagtgcaaggaatgcaaatgtacaagttgcaagaagagtgagtgtggggccatctcgcggaacttgggactgtggctgcgtctagggggcaactcacgcctggccctctctgcgagcttttgggggacagggcttagcctgcctagcttgccggtgtctttccccctgcaggccttttgcccaaagttccggtggggccgcacggctttcttcagttgggacaccaaccccaactgtactccttacggctttcggactgaattgtgtcagactaaaaaaagtatcctctgggtgtgggttctgagctcttcccaggcttgctactag

SEQ ID NO: 124114 - DNA, 186 bp, Artificial Sequence
  Description of Artificial Sequence: Synthetic coding sequence
atggaccccaattgtagctgtgccgctggtgtgtcctgtacctgtgccgggagttgcaagtgtaaagagtgtaagtgtacatcatgtaaaaaatcctgctgcagctgctgtccagtaggctgcagtaagtgtgcacagggctgtgtctgcaaaggggcctctgagaagtgttcctgttgtgactag

SEQ ID NO: 124115 - DNA, 189 bp, Artificial Sequence
  Description of Artificial Sequence: Synthetic coding sequence
atggaccccaattgttcttgtgccgcagcaggcgtttcttgcacctgtgccggaagctgcaaatgcaaagagtgtaaatgcactagctgcaagaaaagttgctgcagctgttgccccgttggttgcagtaagtgcgctcagggatgtgtgtgtaaaggggcctccgagaagtgcagctgctgcgattag

SEQ ID NO: 124116 - DNA, 189 bp, Artificial Sequence
  Description of Artificial Sequence: Synthetic coding sequence
atggaccctaactgttcttgcgcggcagctggcgtgagctgcacatgcgcgagttcctgcaagtgcaaagaatgcaagtgcacctcttgcaaaaaaagttgctgctcttgttgcccagtcggctgcgccaaatgcgcccaaggctgtatttgtaagggagcctccgagaagtgttcatgctgcgcctag

SEQ ID NO: 124117 - DNA, 186 bp, Artificial Sequence
  Description of Artificial Sequence: Synthetic coding sequence
atggaccccaattgttcttgcgccgctggcgtgagttgcacctgtgcctcctcttgcaaatgtaaggaatgcaagtgtacctcctgcaagaaatcctgttgttcctgttgtcctgtagggtgcgccaagtgcgcacaggggtgcatttgcaagggcgctagcgaaaagtgtagctgttgcgcttag

SEQ ID NO: 124118 - DNA, 186 bp, Artificial Sequence
  Description of Artificial Sequence: Synthetic coding sequence
atggatccaaattgtagctgtgaggccgggggatcatgtgcatgcgcagggtcatgtaaatgcaagaaatgcaaatgtaccagttgtaaaaagtcctgctgtagctgctgtcccttggggtgcgccaaatgtgcccaaggatgcatttgcaagggtgcatccgagaagtgctcatgttgcgcttag

SEQ ID NO: 124119 - DNA, 186 bp, Artificial Sequence
  Description of Artificial Sequence: Synthetic coding sequence
atggaccccaattgttcatgttctcccgtaggcagctgcgcctgtgccggctcctgtaaatgcaaggaatgtaaatgtaccagctgtaagaagtcttgttgcagctgctgtccagttgggtgtgccaagtgtgctcaagggtgcatttgcaagggcacatcagacaaatgctcctgctgtgcctag

SEQ ID NO: 124120 - DNA, 186 bp, Artificial Sequence
  Description of Artificial Sequence: Synthetic coding sequence
atggatcccaattgttcttgcgcagccggcgattcttgtacctgcgctggtagctgcaagtgcaaagaatgcaagtgtaccagttgcaaaaagtcctgctgctcctgttgtcccgtgggctgtgctaagtgcgctcaaggctgcatctgcaagggtgcctctgacaagtgctcttgctgcgcttag

SEQ ID NO: 124121 - DNA, 207 bp, Artificial Sequence
  Description of Artificial Sequence: Synthetic coding sequence
atggatccagagacctgtccctgcccttccgggggatcatgcacctgtgccgacagttgtaaatgtgagggctgcaagtgtaccagctgcaaaaagtcctgctgttcatgctgcccagccgagtgcgagaagtgtgcgaaggactgtgtttgcaaaggtggcgaagcggctgaagcggaagccgaaaagtgtagttgctgtcaatag

SEQ ID NO: 124122 - DNA, 687 bp, Artificial Sequence
  Description of Artificial Sequence: Synthetic coding sequence
atgaagatcaagcccggatttatggggaaagcgacaccaccatacgatgtgcagttccatatggaagcaagtgtagagaattgtataatagtctccatgaacacagcagatcctggaagccagggaattacgcattccctgctcctacaagtgattgacgataagggatctattctcccgccgaacaccgaaggaaatatcggaattagaataaagcccgtgcgtcctgtctctctatttatgtgctacgagggggaccccgagaagactgcaaaagtagaatgtggcgatttctacaataccggcgatagagggaagatggacgaggaggggtatatctgttttttgggacgctcagatgatattattaatgccagcggctatagaataggacccgccgaggtggagtcagccctggtggagcacccggctgtcgctgagagcgccgtcgtcggtagtcctgatcctatccgtggggaggtcgtcaaggccttcatagtgttgactccgcagttcctgtctcacgacaaggatcagctgacaaaagagctacagcaacatgtcaagtccgtgactgccccctacaagtacccccggaaagtggagttcgtatcggagcttccaaagactatcacagggaagattgaacgcaaggaactgcgcaagaaagaaaccggtcagatgtag

SEQ ID NO: 124123 - DNA, 1527 bp, Artificial Sequence
  Description of Artificial Sequence: Synthetic coding sequence
atggaggaaggccccctccctggggggctaccgtcacccgaggacgctatggtgaccgagctgctgagtcctgaagggccatttgcctccgagaacattgggctgaaagctcctgtcaaatatgaggaagacgagttccatgtgtttaaagaagcctacttgggcccagccgaccctaaagagccagtgctacacgcatttaatccggctctgggtgcggattgtaagggtcaagttaaggcaaaactggccggcggagactccgatgggggggaactcctcggcgagtaccctggaatccctgagttatcagccctggaagatgttgccttgcttcaggcgccgcaacctcctgcctgtaacgttcactttctgagctcattgctccccgctcacagaagtcccgccgtgctacccttaggggcttgggtcctcgaaggcgccagccacccgggcgtacgcatgatccccgtggagataaaggaagcagggggtaccacaacctcaaacaacccagaggaagcaaccttacaaaatctcctagctcaggaaagctgctgcaagtttcccagcagccaggagctggaagatgccagctgctgctctctgaaaaaagatagcaatcctatggtcatttgccagctaaaggggggtactcagatgctgtgcattgataattccaggactcgagagttgaaggctctccacctcgtgcctcaatatcaggaccagaataattatctgcaaagtgatgtccccaaacctatgacagccttggtgggcagatttttgccagccagcacaaaactgaacctcataacccagcagctggagggagccctaccatctgtcgtgaatggcagtgcatttccctccgggtcaacccttcctggacctcccaagatcactctggccggctactgtgactgcttcgccagtggagatttctgtaataactgcaactgcaacaactgttgcaataatctacaccacgacatcgagaggtttaaagccattaaggcttgtctcgggaggaacccggaagcctttcagcccaagatcggtaagggacagttgggcaatgttaagccccagcataataagggatgtaactgtcgtaggagtggttgtttgaagaactactgtgaatgttatgaggcccagatcatgtgcagctccatctgcaagtgcatcggttgtaagaactacgaggagtctccagaacgaaaaacactgatgtcgatgccaaactatatgcagacgggaggcctcgaaggctcccactatctgccccctaccaaattttctggccttcccaggttcagccatgaccgtcggcctagcagttgtataagctgggaagtggtcgaagcaacctgcgcctgtctcctcgcccagggcgaagaggctgagaaggagcattgctctaagtgtttggctgagcagatgatcctggaagagtttgggcgctgtctgtcccagattcttcacaccgagttcaagagtaagggcttgaaaatggagtag

SEQ ID NO: 124124 - DNA, 756 bp, Artificial Sequence
  Description of Artificial Sequence: Synthetic coding sequence
atggaagaggggccccttcctggaggtctgcccagtccagaggacgccatggtgactgagctgcttagccccgaaggtccattcgccagcgagaatatcggcctgaaagcccctgtcaaatacgaggaggatgagtttcatgtctttaaggaggcttacctaggaccagctgatcccaaagagccggtgcttcatgccttcaatcccgccctgggcgcagactgcaaaggtcaggtaaaggctaaactagcgggtggcgattcggacggtggcgagctcctaggggagtacccaggcattcccgaactctctgctttagaagacgttgcactgttgcaggcccctcagccacccgcctgtaacgtgcattttctgtcatcattactgcctgcacacagatctccagccgtcttaccactcggtgcttgggttctggaaggggcttcccatccgggcgtcagaatgattcccgtcgaaatcaaagaggcaggaggcacaacaacgagtaacaaccccgaagaggcgaccctacaaaacctcctagcacaggagagttgctgtaaatttccctcctctcaagagctggaagatgcgtcctgttgctcactgaagaaggattctaaccccatggtcatctgccagctgaaaggcggcacacaaatgctgtgtattgacaattccagaacaagagagctgaaggctcttcacctggtgcctcagtaccaagaccaaaacaactatctacaaagtgcttag

SEQ ID NO: 124125 - DNA, 921 bp, Artificial Sequence
  Description of Artificial Sequence: Synthetic coding sequence
atggaggaaggtccactgcccgggggactgccaagccctgaggatgctatggttacagaactgctgtcccccgaggggccgtttgcgagtgaaaacatcggcctgaaggcacctgtcaaatatgaagaggatgaattccatgtttttaaggaggcttacctgggccctgcagacccaaaggagcccgtgcttcacgcatttaatccagcgctgggagctgactgtaaagggcaggtgaaggccaaactggcaggaggggacagcgatgggggggaactcttaggagagtaccctggcatccctgagctgtccgccctcgaggacgtcgctctgcttcaggcaccacagccgccagcatgtaatgtgcactttctgtcgtctctccttcccgcccacagatccccagcagtgctcccgctaggtgcatgggtgctggagggggctagccatcccggtgttcgcatgattccggtcgagatcaaagaggcgggcggcacaacaaccagtaacaatccagaggaagccacactgcagaatctactggctcaagagtcatgttgcaaattcccctccagccaggagctggaagacgccagttgttgctcgctaaagaaagactccaaccctatggtgatatgccagctgaagggaggcactcaaatgctgtgtatcgacaactcaagaacccgagagctgaaagcccttcatctagtccctcagtatcaggaccaaaataactatctgcagtctgatgtcccaaagccaatgactgcgctggtcgggagatttctgcccgctagcacaaagctaaacctgattacacagcagctcgagggagccctaccatctgtggtgaatgggtctgcctttccttctgggagtacacttccggggccccccaaaatcactctcgcggggtag

SEQ ID NO: 124126 - DNA, 2262 bp, Artificial Sequence
  Description of Artificial Sequence: Synthetic coding sequence
atgggcgaacactcacccgacaacaacatcatttacttcgaggcagaagaagacgaactaacacctgatgacaagatgctgaggttcgtcgacaagaacggcctggtcccttcatcttccgggacagtgtacgaccgaacaactgttttaatcgaacaggaccccggtacattggaggatgaagatgacgatggtcagtgtggcgagcacctgccttttctagtaggcggggaagaaggattccacctcatcgaccatgaagctatgtctcaaggttacgtccagcatatcatctctcccgatcagatccaccttaccattaacccaggctccacaccaatgccgcgtaatatcgagggcgccacactgacgctccagagcgagtgccctgagacaaagcggaaggaagttaagcgataccagtgcacattcgagggctgccctagaacatactccaccgccggaaacctgaggactcaccaaaaaactcaccgaggtgaatatacttttgtttgtaatcaggaaggatgcggcaaggcattcttgacttcctacagcctaagaatccacgtgcgagttcacacaaaggagaaaccctttgagtgtgacgtgcaggggtgtgagaaggcctttaatacactgtaccgactcaaggcacatcagcgactccatacaggtaaaacttttaactgtgagagtgagggttgctccaaatattttacaaccctgtcagatctgaggaagcatatcaggacccacacaggagaaaaaccgtttcgttgcgaccacgacggatgcggcaaggctttcgctgctagtcaccacctgaagactcacgtcagaacgcacacaggcgagagaccattcttttgcccttctaatggctgtgagaaaaccttctctactcagtatagccttaagtcccatatgaaggggcacgacaacaaaggtcacagttataacgctttgcctcagcataacggttccgaggacaccaaccactcactgtgtctgtctgatcttagtcttctgtcaacagacagcgagctgcgagagaattcatctacgacccaaggccaggacttgtccaccatctctccagctattattttcgagtcaatgtttcagaattctgacgatacagccatccaggaggatccacagcaaaccgcatccctaaccgagagctttaacggtgacgctgagtccgtatcagacgtgcccccaagcaccggcaactccgcctctctgtccttgccgctggtgttgcagcccgggctgtccgagcctccccagcctctcctgcccgcctcggccccttctgcaccacctcctgcaccaagcttgggtcccgggtcgcagcaggctgctttcggcaaccctccggctctgttacaaccccccgaagtaccagtaccccactccacccagttcgccgctaatcaccaggagtttttaccacacccccaagctccgcagcccatcgttcctgggttgagcgtagtggcaggggcatcagcatccgctgccgccgtggcatccgccgtggctgccccagcccctcctcagagcacaactgagccactgcctgcgatggttcaaacattgccactcggggctaattctgttctgacaaataatcctaccatcactatcactccaacgcctaataccgctatattacaatctagcctggtgatgggagaacagaacctgcaatggatactaaatggagctacctccagtccgcagaatcaagaacaaatccagcaagcttccaaggtggagaaagtgttcttcaccactgccgtgcctgtggctagctcccctggctccagcgtccagcagattggactgagcgtgccagtgataatcatcaaacaggaggaagcctgccagtgccagtgcgcctgtcgcgacagcgccaaagagcgggcaagctcaagacgcaaaggctgctccagcccccctccacctgaacctagccctcaagctcctgatggacctagcctgcagctccctgctcaaacattttcctccgctcccgtaccagggtcgagttcctccacacttccaagcagttgtgagcagtcaaggcaggccgagaccccaagcgacccgcagacagagacactgtcagccatggatgtctccgagttcctgtccctgcagagtctggacaccccctctaacttgataccaatcgaagcgctccttcagggagaggaagaaatgggcttgacatcatcatttagcaagtag

SEQ ID NO: 124127 - DNA, 603 bp, Artificial Sequence
  Description of Artificial Sequence: Synthetic coding sequence
aaacagagccaggtcaagaggtaccagtgtacattcgaagggtgccctcgcacatactctacagctgggaacttgcggacacaccaaaaaacccaccgcggagaatacacgtttgtatgcaaccaggagggctgtggaaaggcgtttttaactagctactctctacgtattcatgtgagagtacataccaaggaaaagccatttgagtgcgacgtgcaggggtgtgaaaaggcatttaacacgctctacaggctgaaggcccaccagcgtttacatactggcaagacttttaattgcgagtccgagggctgttcaaagtatttcaccaccctgtcggatctgaggaagcatatccggacacatacgggcgagaaaccatttagatgcgaccatgatggctgcggaaaggcctttgcggcatcccaccatctgaaaactcacgtgagaactcatactggtgagcgaccttttttttgtccgtccaatgggtgtgagaaaacttttagcactcagtactctttgaaatcacacatgaagggccatgacaacaagggccatagctataacgcgctcccgcagcacaacggatccgagtccacctag

SEQ ID NO: 124128 - DNA, 2559 bp, Artificial Sequence
  Description of Artificial Sequence: Synthetic coding sequence
atgcttataaccgagcggaagcacttcagatccggccggattgcccagagtatgtcagaggcaaaccttatagatatggaggccggtaaactgtccaaatcctgcaacatcacagaatgccaagatcctgatcttctgcataattggcccgatgcatttaccctccggggcaacaacgcttcaaaggtggccaacccattttggaatcagctatctgcctccaatcccttcctcgacgatatcactcaattacggaacaacagaaagaggaacaatatctcaatcttgaaagaagacccttttctgttctgccgggagatcgagaacggaaattcttttgattcctcaggggatgagctggatgtgcatcagctcctccgtcaaacatctagcagaaatagtggacgcagtaagtcagtgagcgagttgctagacattctggacgatacagcccacgcacaccagtccatacacaatagtgaccagatactcctgcatgaccttgagtggttaaaaaatgacagggaagcctataaaatggcgtggctcagccagcgccagctagcccggtcatgtctggatctgaacacgatctcacaatctccggggtgggctcagacacagctggctgaggtgaccatagcttgcaaagtcaatcatcaaggtggatcagtgcagttaccggagtccgacataacagtgcatgtccctcaaggacacgtcgctgttggagagtttcaggaggtaagcctgagagccttcctcgatccacctcacatgttaaaccatgatttatcatgtactgtgtctccactcctggagatcatgctgggcaacttgaatactatggaggccttactcctggagatgaaaatcggtgcagaagtgagaaaagatcctttcagccaggtgatgactgagatggtttgtctgcatagtctaggtaaggaaggtccgtttaaagtgttgagcaattgttacatatacaaggacacaatacaagttaaattaatcgacctctcccaggtcatgtatttggtggttgctgcccaagctaaagctctgcccagtcccgcagctacaatttgggattatatccacaagacaacctctatcggaatctatgggcccaagtacatccacccctcctttactgtggtcttgacggtgtgtggccataattatatgcctggccagctgacaatcagcgacattaagaagggcggtaaaaacatatcacccgtggtcttccagttgtgggggaagcagtcatttctcctggataaacctcaagatctgtccatttccatattctcctgtgaccctgactttgaggttaagacagagggggagaggaaggagattaagcagaaacaactggaagctggggaggtagtacatcagcagtttctgttctctcttgtggagcatagagagatgcatctgtttgacttttgcgttcaagtagagcccccaaacggagagccagtcgctcagttttccatcacaacacccgatcctaccccaaacctgaaaagacttagcaacctcccagggtatctgcagaaaaaagaagaaatcaagtctgcccctctctccccaaagattcttgttaaatacccaaccttccaggataagaccctgaatttttcaaactatggtgttacactgaaagctgtgctacgtcagtcaaagatcgactacttcctggaatacttcaagggggacactatcgccttgctcggcgagggcaaagtcaaggcaattggccagtcaaaggtgaaggaatggtacgtgggagtgctacggggcaagattggactggttcactgcaaaaacgtgaaagtaataagcaaagagcaggtaatgttcatgtcagatagtgtctttacaacgcggaatctgctggagcagattgtgttgcctctgaagaaactaacctatatttattccgtcgtgttgacgctagtgtccgagaaggtatacgactggaaggtgttggcagatgtactgggctactctcacctctctctcgaggacttcgaccagattcaagccgataaggagagtgagaaggtgagctacgtcattaaaaagttgaaagaggactgccacaccgagaggaataccagaaaattcctctatgaacttattgtggctttgctcaaaatggattgccaggagctggtggcaaggctgatccaggaggctgccgtgctcacaagcgccgtcaaactgggtaagggttggagggagctagcagagaaactcgtgagactgaccaaacaacagatggaggcctacgaaatcccccaccggggtaacacaggggacgtggccgtggaaatgatgtggaaaccagcctatgacttcctttacacctggtcagcccattatgggaacaactatagggacgtcttgcaggacctacagagcgccctggatcgaatgaagaaccccgtgaccaagcattggagagaactgactggtgttctgattttggtgaacagtttagaagtcctgcgtgtgacggcattttcaacgagcgaggaggtctag

SEQ ID NO: 124129 - DNA, 2559 bp, Artificial Sequence
  Description of Artificial Sequence: Synthetic coding sequence
atgctcattaccgagcgcaagcatttccgctccggtcgtatcgcccagtctatgagcgaggccaatttgattgatatggaggctggaaaactaagtaaaagttgtaacattacagagtgccaggaccccgatctgctccacaattggcctgacgccttcaccctcaggggcaataacgcaagtaaggtggctaatccgttctggaaccagctctcagccagtaacccattcctcgatgatattacccagttgagaaacaaccggaaaaggaataacatttcaattctcaaagaggacccgtttctgttttgtagagaaatcgagaacggcaactctttcgactcttcgggcgacgagttggacgtacatcagcttctccggcagacgtcttctcggaattccggccggtcaaagagtgtgtctgagctgctagatattctggacgacactgcacacgctcatcaatccatccacaattctgaccagatcctcctgcatgaccttgaatggttaaaaaacgaccgtgaggcctataaaatggcgtggctgagtcagaggcagttagcgcggtcttgtctcgacctgaacaccatctcacagagcccgggctgggcccagacacagctggcggaagttaccatcgcctgtaaggttaatcaccagggtggtagtgtgcaattgcctgagagcgacatcactgtacacgtgcctcagggccatgttgccgtgggcgagttccaggaggtatcccttagggcttttctcgaccccccccatatgctgaatcacgatctgtcatgcactgtctcccctttgttggaaatcatgcttggcaacctgaacaccatggaagctctgctactggaaatgaagattggtgctgaagtgaggaaggacccttttagccaggtgatgacagaaatggtctgcctccattccctgggtaaagaggggccattcaaggtgctaagcaactgttatatctacaaggataccatccaagtcaaattgatagacctgtcacaagtgatgtatctggtagtcgctgcccaagcaaaagcactgccatcccctgccgccactatctgggactatattcataagaccaccagtatagggatatatgggcccaagtatatccacccaagttttactgtagtgcttaccgtctgtgggcataattatatgcctgggcagctgaccatctctgacattaagaaaggaggaaaaaacatcagccccgtggtgttccagttgtgggggaagcaaagttttctgctggacaagcctcaggatttaagtattagcatctttagctgtgatcccgattttgaggtgaagactgaaggcgagaggaaggagatcaaacagaagcagctggaagccggagaagtggtgcaccagcagttcctctttagcttagtggagcatagagaaatgcacctttttgacttctgtgtacaggttgaacctcccaacggagagccagtcgcacagtttagcattacgactccagatcccacaccgaacctgaagcgtctctctaatcttccaggctatctgcagaaaaaagaggaaatcaagtcggccccgctgtcccctaagatcctagtcaagtacccgacttttcaggacaagaccctcaacttctccaactacggggtgacactaaaagctgtgctccgccagagtaagatcgactactttttagaatattttaagggggacacaattgccttattgggggaaggcaaagtaaaagctattgggcaatctaaggtgaaagaatggtatgtgggcgtgctgcggggcaagatcgggctagttcattgcaaaaacgtgaaggtcatctctaaggaacaagtaatgttcatgagcgacagcgtgtttacaacacgaaatctcctggaacaaattgtcctgcctctaaaaaaactcacatacatttacagcgtcgtgctgacactcgtatccgaaaaggtgtatgattggaaagtactcgccgatgtcttgggctatagtcaccttagtctggaagatttcgaccagattcaggccgataaggaatccgaaaaggtatcttacgtcatcaagaaattgaaagaggactgtcacaccgagagaaacacaagaaagttcctgtacgagctgattgtggccctgttgaaaatggattgtcaggaactggtggctaggctgattcaggaagcagcagtgttaacatcagccgttaaactgggaaaaggctggcgggagctcgccgagaagttagtgcgcctaacaaagcagcagatggaagcgtatgagattccgcatcgagggaacactggcgatgtggccgttgagatgatgtggaagccagcgtacgattttctctacacatggtcagctcattatggaaataactatagggatgtactacaggatctgcagtctgcactggatagaatgaagaacccagtgacaaagcattggagagaattaacaggggttcttattctagtgaatagtctggaggtcctccgtgttaccgccttctccacgtctgaggaggtatag

SEQ ID NO: 124130 - DNA, 1308 bp, Artificial Sequence
  Description of Artificial Sequence: Synthetic coding sequence
atgctgctcggcggaccaccccgatcgcctcgatccggaacaagtccaaaaggaccgtggtccagcacaggacacgttcagttcggaaagtctccccaaacatggcctcggaggacccgtccgcgcagcccagagccagctgccccgtctggcgtgaggggcagtacttggacccgccggcgtgatacaccccggcgggcgggtcccactgcactgagccgctatgttgggcacttatggatgggaaggcggccccctagtcccgaagcacggggtcctgtacctcggtcatctgccgcttctagagccaggagatcattggcttccccaggcatcagcccaggtcctctgactgcaacgattggcggcgccgttgctggcggggggcctcgacagggacgcgccgaagcccataaggaagtgttccccgggcagagggtgggtaagatggctgctcccatggaactgttctgctggtccggcggatggggattaccaagtgtagaccttgatagtctggctgttctcacctacgctcggtttactggtgcaccactgaaggtgcataagattagcaacccgtggcagtccccatccggcacactccccgcactgagaacatctcacggagaagtgattagcgtccctcacaagattataacacacttaagaaaggaggtgcacaccttctggattgacactaaaaactacgtggaggtgacaagaaaatggtatgccgaggccatgcccttccctctgaacttcttcctgccaggccgtatgcaaaggcagtacatggaacgtctccagctcttgacaggggagcaccgcccagaagatgaggaggagcttgagaaagaactctatagggaggctcgtgagtgtctgaccctgttgtctcaacgactgggctcacagaagttttttttcggcgacgcacccgccagtctcgacgcatttgtgttcagctacctcgcgctcctgctccaggctaaactgccatcgggcaagctgcaggtccatctgagaggattgcataacttgtgtgcgtactgcacacatatcttaagcctctactttccttgggacggcgccgaggtcccacctcagcggcagactcctgctggtccggagacagaggaagaaccctatcgccgcagaaatcagattctatcagtgctggccggactcgccgccatggtaggttacgccctcttgtccgggatcgtgagcatccagcgcgccactcctgctcgggcaccagggactcgcactctggggatggcagaagaggacgaggaggaatag

SEQ ID NO: 124131 - DNA, 1401 bp, Artificial Sequence
  Description of Artificial Sequence: Synthetic coding sequence
atgctgctcggtggtcctcccagatctcctcgctcgggaacgtctccaaagggcccgtggtcctccaccgggcacgtgcagttcggtaagtctcctcagacctggccccggcggaccaggccacgcagtccggaaccagccgctccctcaggcgtgaggggtagcacttggacgcgccgccgtgatacccccagacgggcaggcccgaccgctcttagcaggtacgtgggccacctctggatgggtaggcggcctccctcgcctgaggcccggggccccgtgccacgttcctccgcagcgtcgagggctagaaggtcactcgccagccctggaattagcccaggcccgctgaccgccaccattggaggagcagtagcagggggcggccccagacaggggcgggcggaagcccacaaggaggtgttccctgggcagcgcgtcggcaagatggccgcacctatggaactgttctgttggagtggcgggtgggggctccccagcgtggatctcgactcattagccgtcctgacatatgcccggttcacgggtgcccccctgaaggtccataagatttccaacccatggcagtcaccctctggaaccctgccagcattaaggacgtctcacggagaagtgataagtgtcccccacaaaatcattacacacttacggaaagaaaagtataacgcagactatgacctcagcgctagacagggagccgatacactggctttcatgtccctgctggaggaaaagctcctgccagtattagtgcatacgttttggatcgataccaagaactacgtcgaagtgaccagaaagtggtatgccgaggccatgccctttccactcaactttttcctgcctggccggatgcaacggcagtacatggaacgactgcagctgctcacgggggaacaccgcccagaagatgaggaggagctggaaaaggaactctacagggaggcccgagagtgcttaacactcctttcccagcggctagggtctcagaaattcttctttggcgacgcccccgcttcactggatgcattcgtgttttcatacctggctctgttattgcaggccaagctgccaagcggtaaactgcaggtgcatctccgaggcctgcataatttatgtgcatattgtacccatatactgtccctgtactttccgtgggacggggctgaggtgccccctcagagacagacacccgctggcccagagacagaggaggagccatataggcggagaaaccagatcctgagcgttctcgccggcctcgcagcaatggtcgggtacgcactgctgtcgggcattgtgtccatccagagagcaaccccagctcgggcccctgggactagaactcttgggatggccgaagaggatgaggaagaatag

SEQ ID NO: 124132 - DNA, 951 bp, Artificial Sequence
  Description of Artificial Sequence: Synthetic coding sequence
taggagggaggacaagatggaggagctcatggtgcggtgctgctggttagagggctgggagccgcggtaagtgggcccggacagcctggaagagcagacctctgccagatctattggtgctctaccgagggcacacaggatcagcagccactggccgagcctttccggtatccagtgagcctgggtggcacgctccctgcgctaaggaccagccatggggaggtgatctccgtcccacacaaaattattacccatttacggaaagagaagtataacgctgactacgatttgtccgcccgacaaggagctgacaccctcgcctttatgagtcttttagaagagaagctgctgccggtcttggtgcataccttctggattgacaccaagaactacgtggaggttacccggaagtggtatgcagaagctatgcctttccctttgaacttctttctgcccgggcgcatgcagcgccagtacatggaacgactgcagttgctaacaggggaacatcgacctgaggatgaagaggaactggagaaggaactgtaccgagaggcacgggaatgcctgacactgttgtcccagagactcggatcacagaagttttttttcggcgatgcccccgcaagcttggacgcctttgtgttttcgtacctagccttgctgctccaggccaagttaccaagcgggaagctccaagtgcatctgcgaggactgcacaatctctgcgcctattgcacacacattctgagtctgtacttcccttgggacggtgccgaggtacctcctcagagacagactccagccgggccggagacagaagaggagccttatcgcaggcgtaatcaaattctctctgtgctggccgggcttgcagctatggtaggatatgcacttctgtccggaatagtctccatacagcgggccacaccagcaagggcgcctggctag

SEQ ID NO: 124133 - DNA, 1188 bp, Artificial Sequence
  Description of Artificial Sequence: Synthetic coding sequence
atgaatggccctgtggacggcctttgtgatcattccctgtccgaaggggtgttcatgttcacttctgagtcagtcggcgaggggcatcctgacaagatttgtgatcagataagcgacgccgtgctggacgcccatctcaagcaagatcctaacgcaaaggttgcttgtgaaactgtgtgtaagacaggtatggtcctactgtgcggagagatcacatcaatggccatggtggattatcagcgcgtcgttagggacaccatcaagcacataggctacgacgactccgcaaagggattcgatttcaaaacctgcaatgtcctggtcgccttggaacagcaatcccccgacatcgcccagtgcgtgcatcttgatcggaatgaagaagacgtgggtgctggggaccaaggacttatgtttggttatgccactgatgaaacggaggagtgtatgccactgacaatcatcctggctcataaactcaacgcacggatggctgatttacgaagatctggactgttaccctggctccggcctgacagcaagacccaggtgacagtgcagtacatgcaagacaacggcgcagtcatccctgttcgaatccacacaatcgtgatttcagttcaacacaacgaggacatcacgctggaggaaatgcgccgagcactgaaggagcaggtcattagagctgtggtgccagcaaaatacttggacgaagatacagtctaccacctccagccatcggggcgattcgttatcggcggcccccagggagatgcaggtgtgaccggcaggaaaataattgttgacacatacggcggatggggtgcacacggaggcggggcattcagcggtaaggattatactaaagtcgacaggtcagctgcctacgctgccagatgggtggccaagtccctggtcaaggccggactgtgccgacgggtgctggtacaggtgtcatatgctatcggggtggctgagccactgtccattagcatctttacttacggtacttcccaaaaaaccgaaagggaactgctggacgttgtgcacaaaaatttcgacctccgacctggcgtaattgttcgagatctggatttaaaaaagcctatctaccagaagactgcctgctacggacatttcggacgaagcgagttcccatgggaagtcccgcgcaaactggtattctag

SEQ ID NO: 124134 - DNA, 1188 bp, Artificial Sequence
  Description of Artificial Sequence: Synthetic coding sequence
atgaatggacccgtggatggtctgtgcgaccatagcctttcggaaggcgtatttatgttcacttcagaatccgtgggcgagggccatcccgacaagatctgtgatcagatttccgatgccgttctggatgcacatctgaaacaagatcccaacgctaaggtagcatgtgaaacagtttgcaagacaggcatggtcctgctctgcggcgaaataaccagcatggctatggtggactaccagcgggtcgtgcgggacacgataaaacacataggctacgatgacagtgcaaagggctttgacttcaagacatgcaacgtcctcgttgccctcgaacagcagtcgcctgatatagcccagtgtgtgcaccttgataggaacgaggaggacgtgggcgccggcgaccagggactgatgtttggctacgcaacggatgagacagaagaatgcatgcctctgacaatcatactggcccataagttgaacgcacgtatggcggatcttcgacgatcaggacttctgccctggttgcgtccggattccaagacgcaggtgactgtccaatacatgcaagacaacggagctgtcattcctgtgagaattcataccatcgtcatctcagttcagcataacgaggacatcactcttgaagagatgagacgggccttgaaggaacaggtcattagggcggttgtccccgccaagtatcttgatgaggacacagtttaccacctgcagccttccggaaggttcgtcattggaggacctcagggagacgctggtgtaaccggtagaaagattattgtggacacctacggcggatggggggctcacggcggtggcgcattctcaggcaaagactatactaaggtcgaccgctcagccgcttacgccgctcggtgggtagccaaaagtttggttaaggcgggtttgtgccggcgagtgctggtccaagtctcttatgctatcggagtcgccgagccattatcgatctccatttttacttatggtacttctcagaaaactgagcgcgaattattggatgtcgttcacaagaattttgatctaagacctggtgtgattgtgcgtgatctggatcttaagaagccaatatatcaaaagaccgcatgctatggacacttcggccggtcagaatttccatgggaagtgcctcgcaagttagtgttctag

SEQ ID NO: 124135 - DNA, 438 bp, Artificial Sequence
  Description of Artificial Sequence: Synthetic coding sequence
gaatcagtaggcgagggacacccggataagatctgcgatcagatttcagacgccgtcttagatgcccaccttaagcaggacccaaatgcaaaggtggcatgcgggtttgactttaagacctgcaatgtcctggtcgccctggagcaacagagtcctgatattgcccaatgtgttcacctggaccgcaatgaagaggacgtaggagcgggggaccagggcctgatgtttggatacgccacagacgaaacagaagagtgtatgccgcttactataatcctcgctcataagctcaatgcaagaatggccgatctgcggcgctccggcttgttaccttggttacgacctgactccaagactcaggtgactgtgcaatacatgcaggataacggtgccgtcattccagtccgtatccatactatcgtgatttcagttcagtag

SEQ ID NO: 124136 - DNA, 1188 bp, Artificial Sequence
  Description of Artificial Sequence: Synthetic coding sequence
atgaacggacagctcaatggcttccacgaagcatttatagaggagggcaccttcctcttcacatccgagtctgtcggggagggtcatcccgataaaatttgcgatcagatctcagatgcggtactggatgctcacttgcagcaagatcctgatgccaaagttgcctgtgaaacggtcgctaagacaggcatgatactcttagccggggagataaccagtcgggctgctgtggactatcagaaggtagttagggaagcggtcaaacacattgggtacgatgactcctccaaagggtttgattacaaaacttgtaacgtgcttgttgcactagagcaacagtcccccgacatcgctcagggcgtgcacctggatagaaacgaggaagacatcggggctggtgaccaaggcctcatgtttggttacgctacagatgaaactgaagagtgcatgcccctgacaattgtattggcacacaagctcaacgctaaactggcagaactgcgcaggaatggaaccctcccatggttgcggcccgactccaagactcaagtgaccgtacagtatatgcaggacaggggggcagtactgccaataagagtgcacactatcgtcatctccgtgcaacacgacgaggaggtttgtttggatgagatgcgagatgccctaaaggagaaagttatcaaggctgtggtaccggctaagtacctcgatgaggatactatttatcatttgcagccaagcgggcgcttcgtgatcggtggaccgcagggtgatgctgggctgacggggaggaaaattatcgtggacacctatggaggatggggggcccacggtggcggggcctttagcggtaaggactatactaaagtggatcgctcagctgcttatgcagcccgctgggttgctaaatccctggtcaaaggcggattgtgcaggagagttctggtgcaggtgtcctatgccatcggagtctctcatcctctctccattagcatcttccactacggcacctcccaaaaatccgagcgagagctgctggaaattgtgaaaaagaatttcgacctgcgtcccggggtcatcgtccgcgacctcgacctgaagaaacccatctatcagcggaccgccgcctacggtcactttggccgtgacagctttccgtgggaggtcccgaagaaactgaagtactag

SEQ ID NO: 124137 - DNA, 531 bp, Artificial Sequence
  Description of Artificial Sequence: Synthetic coding sequence
atgaatggacaactaaacggattccatgaagcctttattgaggaaggtacttttctcttcacctctgaaagcgtcggcgaggggcaccctgacaaaatatgcgaccagatcggagacgcggggcttacaggtaggaaaatcatcgttgatacatacggaggctggggtgcccacggaggtggagctttctcagggaaggactataccaaggtggaccgcagcgctgcctatgctgctaggtgggttgctaaaagcttggtgaagggaggtttgtgccgtcgggttcttgtccaggtcagctatgccatcggggtctcccaccctctgagcatttccattttccattacgggacttctcaaaaatcggagcgcgagctgctggagatcgtcaaaaaaaactttgatctccgcccgggagtgatagtacgtgacttggacttgaaaaagcctatttaccagaggactgctgcctatggccattttgggagagattcttttccatgggaggtgccgaaaaagctgaagtactag

SEQ ID NO: 124138 - DNA, 549 bp, Artificial Sequence
  Description of Artificial Sequence: Synthetic coding sequence
atggctagactcctgtggttgcttcgcgggttgacacttgggacagcacctaggagggccgtgcgaggacaagctgggggtggtggaccaggtaccggcccaggtctcggtgaagctgggtcactggcaacctgtgaactcccactcgccaaatccgaatggcaaaagaagctgacccccgagcagttttacgtgaccagagagaagggcacagaacctccattctctggcatctacctcaacaataaggaagcgggtatgtaccactgcgtctgctgcgactccccattattttcctcagaaaaaaaatactgttcaggcacgggatggccttctttttcagaagcccatgggacatctggcagcgacgagtcacacacgggcattcttaggcgcctagatacaagtcttggctctgctcgaacagaagtcgtgtgcaaacaatgcgaggcacacctggggcatgtctttccagatggaccaggacctaatgggcaaagattctgcattaacagcgtcgccttaaagtttaagcccagaaagcactag

SEQ ID NO: 124139 - DNA, 558 bp, Artificial Sequence
  Description of Artificial Sequence: Synthetic coding sequence
atgagtgcatttaatctgctccacttagtgactaagtcccagcctgtcgccctcagggcctgcggtctcccttctgggagttgtcgggacaagaagaactgtaaagtggtgttttcccagcaggaactccgcaaacgactgacaccgttacaataccacgtgacccaggaaaagggcacagaaagtgccttcgaaggagagtatactcatcacaaagaccccggtatttataaatgtgtcgtgtgtggtaccccccttttcaagtctgaaaccaaattcgattctgggtcgggctggccatctttccacgacgtcatcaactctgaagcaatcacttttaccgatgactttagttacgggatgcaccgtgtggaaacttcctgtagtcagtgcggagcacatctgggccatattttcgatgacggtccccgccccaccggcaaacggtactgcattaatagtgccgccctgtccttcacacccgctgacagtagtgggacggctgagggcggtagcggagtggcaagcccagcgcaggccgacaaggcagagctgtag

SEQ ID NO: 124140 - DNA, 579 bp, Artificial Sequence
  Description of Artificial Sequence: Synthetic coding sequence
atgtctccgagacgcacattgccaagacctctgagcctgtgtttatccctgtgcctgtgcctctgtttagctgcagccctcggaagtgcccaatccggatcttgtcgcgataaaaagaactgtaaagtcgtgttcagccaacaggagctgcgcaagaggctgacaccacttcagtaccacgttacacaggaaaagggcacggaaagcgcattcgaaggagaatacacacaccacaaagaccccggtatctataagtgtgtcgtttgcggcacgcccctgtttaagtccgagaccaaatttgattctggctctggttggccgtcattccatgacgtgattaactctgaagccattacttttactgacgatttttcatacggtatgcaccgcgtcgagacttcgtgctcacagtgcggcgcgcaccttggacatatttttgacgatggccctcgccctacggggaagagatattgcattaattctgccgccctgtcattcacacccgccgattcatcaggaactgccgaaggtggcagcggagtagcgagcccagctcaggcagacaaggctgaactgtag

SEQ ID NO: 124141 - DNA, 495 bp, Artificial Sequence
  Description of Artificial Sequence: Synthetic coding sequence
atgagcgcttttaatctcttgcacctggtgaccaagtcccagcctgtggccctacgggcctgcggcctcccatcagggagctgcagggacaagaagaactgtaaagtggtgttctctcagcaggaactgcggaaacggcttactccacttcaataccatgtcactcaggaaaaaggcaccgaatcagccttcgaaggtgaatacacacaccacaaggatccgggtatatataagtgcgtcgtatgtggaacacccttgttcaagagcgaaaccaaatttgactctggttcaggttggccatcttttcatgacgtgatcaacagcgaagccatcaccttcaccgacgacttttcttatgggatgcaccgggttgagaccagttgttctcaatgtggggcccatctgggacacattttcgacgatgggccacggcccacgggcaaacggtattgcatcaatagcgctgccttgtcattcactccagcagatagttag

SEQ ID NO: 124142 - DNA, 558 bp, Artificial Sequence
  Description of Artificial Sequence: Synthetic coding sequence
atgtcggcttttaatcttcttcacctggttaccaagagccagccagtcgcgttgcgagcttgtggactgccatccgggtcctgtagagacaagaaaaattgcaaggtggttttttcacagcaggaattacgtaagcgcctcacacctctgcagtaccatgtgacgcaggaaaagggaacagagtcagcattcgagggagagtacacccatcacaaggaccctggcatctataaatgcgtggtctgcggcacacccctcttcaaatccgagacaaaattcgatagcgggtcaggatggccgtccttccacgatgtcatcaacagtgaggcaatcacctttaccgatgatttctcatacggtatgcatcgtgtggagacgtcctgctctcagtgcggcgcacacctgggccatatcttcgatgatggaccacggcccacaggcaaaaggtattgcattaacagtgccgccttgtcatttacccccgctgacagcagcggcaccgctgaaggtggcagcggtgttgcttcccccgcccaggccgacaaagccgaactctag

SEQ ID NO: 124143 - DNA, 354 bp, Artificial Sequence
  Description of Artificial Sequence: Synthetic coding sequence
atgtccgcttttaatctgctgcacttagttacaaagagccagccagtcgctttgcgggcttgtggtctaccttccgggagctgccgtgacaagaagaattgtaaggtggtgttctcccaacaggagttacggaaacgtctgaccccgctccaatatcacgtgacccaggagaaaggaactgaatcagcttttgaaggcgaatatacacaccacaaggaccctggtatttacaaatgtgtggtctgtggaacccctcttttcaagagcgagaccaaatttgattccggcagtgggtggccctccttccatgatgtgattaactccgaggcgatcacttttaccgatgacttctag

SEQ ID NO: 124144 - DNA, 2703 bp, Artificial Sequence
  Description of Artificial Sequence: Synthetic coding sequence
atgaggctctttgtctccgacggcgtcccaggttgtcttcccgtcttagccgccgccgggcgggccaggggacgagccgaggtgttgatttctaccgtaggtcctgaggactgtgtggtcccattcttaactcgtccaaaggtgcccgtgcttcagctcgactcgggtaactatttattttctacatctgccatttgtaggtatttttttcttctgtcagggtgggaacaggatgacctgacgaaccagtggctggagtgggaggccacagagctgcaacctgcactgtcagctgccctctactacctggtggtgcaagggaaaaaaggtgaggatgtcctaggaagcgtccgcagagcactgactcatatagaccactctttgagccgccaaaattgcccgtttttggccggggaaaccgaatctttggccgacatcgtcttgtggggagctttataccccttgctgcaagaccctgcatacctgcccgaggaactgtccgccttgcactcttggtttcaaaccctatcaacgcaggaaccgtgccaacgcgcggccgagacagtgcttaagcagcagggtgtgctcgccctaaggccgtacctgcagaagcagccccagcctagtcctgcagaggggagggcggtgaccaacgaacctgaggaggaagaactggccacactgtccgaagaagagatagctatggccgtcaccgcttgggagaagggattggagagcctccctcctctgagaccacagcaaaacccggtcctgcctgtggctggcgagagaaatgtccttattacaagtgcactgccttacgtcaacaacgtaccgcatcttgggaacatcataggatgcgtgctcagtgccgacgtatttgcccgttacagcaggctgcgccagtggaatacattatacctatgcggcacagacgaatatggaactgccaccgagaccaaggctctggaagaaggacttacacctcaggaaatctgcgacaagtaccatattatccacgcagacatctataggtggtttaatattagcttcgatatatttggccgtacaactactccgcaacagaccaagatcactcaggacattttccaacagctcttaaagaggggattcgtgctccaggataccgtggagcagttgcggtgcgagcactgtgcaagatttttggctgaccggtttgtggaaggagtgtgtccattctgcggatacgaggaagctagaggggatcagtgtgacaaatgtggcaagttgatcaacgcggtggagctcaaaaaacctcagtgcaaagtatgccggagctgcccagttgtgcagtcttcacagcatctctttctggacctgcctaaactggagaaacgcctcgaggaatggctggggcggactttgccagggtccgactggaccccgaatgcacagttcatcacccggtcctggctccgggatggcctgaagcctaggtgtatcacccgggatctcaaatggggtacaccagtccctctggagggctttgaggacaaagtgttttatgtctggtttgacgctacaattggttacttatccataacagccaactataccgatcaatgggaacgctggtggaagaaccccgagcaggtggacctctatcagtttatggccaaagataatgtgccattccattctctggttttcccctgtagtgccctgggagcagaggataattatacactggtctcacatctgatcgccactgagtatttaaattacgaagacggaaagttctcgaaatctcgtggtgtaggggtttttggcgatatggcccaggataccggcattcccgcggacatatggaggttctatctgctgtacatccgccctgaggggcaagattctgccttctcttggacagaccttcttttaaagaataactctgagctgctgaataacctggggaacttcataaaccgagctggtatgttcgtgagtaaattctttggcgggtatgtgcctgagatggtccttacaccggacgatcagagactgctagcacacgtgaccctggagcttcaacactaccaccagcttctcgagaaagttagaattcgggatgcactgaggagcattctgacaatcagtagacacggtaaccaatacatccaggtcaacgagccctggaagcgaatcaaagggtcagaggccgacaggcagcgggccggaactgttaccggtctggccgtaaacattgccgctctgctttctgtgatgctccaaccctacatgccaactgtgtccgcgaccattcaggcccagctacaactcccacccccagcgtgctctattttactcaccaacttcctgtgtacgctgccagcagggcatcaaatcggaacagtctcccccctcttccaaaagctggagaacgatcagattgagtctctgagacaacgttttggcggcgggcaggcaaaaacatcccccaaaccagcagtggtggaaactgtaaccaccgccaaaccccagcaaatccaggctctgatggatgaagtgaccaagcagggaaatatcgtgcgcgagctgaaggcgcagaaggcggacaagaatgaggtagccgcggaagtggccaaacttttggatttaaagaagcagctggctgttgctgagggaaaaccacccgaggcacctaagggcaaaaaaaaaaagtag

SEQ ID NO: 124145 - DNA, 1908 bp, Artificial Sequence
  Description of Artificial Sequence: Synthetic coding sequence
atggccgttaccgcctgggagaaaggtttggaatcccttccaccgctgcgaccacagcagaaccctgtccttcctgtggccggcgaaaggaatgttttaattacgagtgccttgccatatgttaataatgtgcctcatttgggaaatatcatcgggtgcgtattgagtgccgatgttttcgcacgatatagccggctccggcagtggaacacgctgtatctttgcggtaccgacgagtacggaacagcaactgagaccaaagccctggaggaagggctaaccccacaggaaatttgcgacaaataccacatcattcacgctgacatttacagatggtttaacatcagtttcgacatcttcggacgcactacgaccccccagcagacgaagatcacccaggatattttccagcaactgttgaaaaggggattcgtgttgcaagacactgtcgagcaactccggtgcgagcactgtgcacgattcctggcagacagattcgttgagggggtatgccctttttgcggctacgaagaagctagaggtgaccagtgcgacaaatgcgggaagttaattaacgccgtcgaactaaagaaaccccagtgcaaagtttgtcggtcttgtcctgtcgtccagagcagccagcacttgtttctggacctacccaagctcgaaaagagattggaagagtggctgggcagaacactccccggaagcgactggactccaaacgcgcagttcataacccgatcttggctccgagatggcctcaaacctcgctgcatcacgagggacttgaaatggggaaccccagtccctctggaaggctttgaggacaaagtgttctacgtgtggtttgacgccacaataggttatctgagtattacggcgaattacacagaccaatgggagaggtggtggaagaatccagagcaggtcgatctgtatcaatttatggctaaagacaacgtgcccttccatagtttggtcttcccctgctcagctctgggcgccgaggacaactatactttggtgtcacatcttattgctaccgagtatcttaattatgaggatggcaaattcagtaagagtcggggtgtgggagtgttcggtgatatggctcaggatacgggtattcctgctgacatttggaggttctacttactgtacatacgtcctgaggggcaggattcagccttttcatggacagatctcctgctcaaaaacaacagtgaattactgaacaacttaggcaactttattaatagagccgggatgttcgtctctaagtttttcgggggctacgtccctgagatggtcttgacgccagacgatcagcgcctcttagcccacgtaaccctggagctgcagcactatcaccagctgctggaaaaggtgcggataagagatgctttgcggagcatactgaccatcagcagacatggcaaccagtacattcaggttaatgagccctggaaacgaattaaaggctcagaggctgaccgacaaagagcgggaactgtcactggcctggccgtgaatatcgccgccctgctgagcgtcatgctgcaaccatacatgccaactgtgtctgccacgatccaagcacagcttcaactgcccccacctgcatgctccattctcctgaccaattttctgtgcacgctgcccgcaggtcatcagatcggcacagtttccccactcttccagaagctagagaacgaccagattgaaagtctcagacagcggtttggaggcggccaggttagaaagctcaaagcagtaccttccctgcacaattcgcatagtatcacgtctttgatttccctcagcagcccccaccccagcctattcccaagtttcggccccgcagcaagttcactgacagtgttcctgtcctgccttaactag

SEQ ID NO: 124146 - DNA, 1641 bp, Artificial Sequence
  Description of Artificial Sequence: Synthetic coding sequence
atgcgcctgtttgtctccgatggggttccagggtgcttacctgtgctagcagccgcaggcagggcccggggccgggccgaagttctgattagcacagtgggccccgaggattgcgttgtcccattcctcactaggccgaaggtgccagtcctgcagctggattccggaaattatctgttctccacctccgccatctgccgctatttctttcttttgtcagggtgggaacaggatgacctgacaaaccagtggcttgaatgggaggccacagagctccaaccagctctaagcgccgcactgtattacctggttgtgcaaggaaaaaagggagaagacgtgctcggcagtgtgcgcagagccctgactcatatagatcacagtcttagtaggcagaattgcccattcttagctggcgagaccgagtccctggctgatattgtgctatggggcgccctctatcccctcctccaggacccagcctacctgcccgaggagcttagcgctctgcactcctggtttcaaaccctgtcaacacaggaaccgtgccagcgcgcggctgagaccgtgctcaaacagcagggtgtgcttgctctgcgcccatacctgcagaagcagccccagccttcgccggccgagggccgagctgtgactaatgagcccgaagaagaggagttggccacactgagcgaagaggaaattgcaatggcggtcacagcatgggagaaaggcctggagtcactgccacccctcaggcctcagcaaaatcccgtactgcccgtggctggggaaagaaatgtattgataacgagcgcactaccatacgttaacaatgtgcctcatctgggaaacatcatcggctgtgtcctctccgcagacgtgtttgcgcgatacagtaggttgcgccaatggaacacactctatctgtgcggaactgatgaatacgggacagctactgaaactaaggcgctggaggagggcctcacacctcaggaaatttgcgataaatatcatatcattcacgccgacatttaccgttggttcaacatcagcttcgacatctttggcaggaccaccaccccccagcaaaccaaaatcacccaggatatcttccaacaactcttgaaacggggcttcgttctgcaggacacagtggagcaactgcgctgcgagcattgcgcaagatttctggcagaccgttttgttgaaggtgtttgtccattctgcggctatgaggaagcacggggggaccagtgcgacaagtgcggtaagctgatcaatgctgtggagctaaaaaagcctcaatgtaaggtgtgtcgtagctgtcccgtcgtacagtcatctcagcacctcttcctggacctgcccaaactcgagaagcgactggaggaatggctaggaaggaccctgcctgggtccgactggactcctaatgcacagttcatcacccgcagttggctaagagacgggctgaaaccacgctgcataacccgggaccttaaatggggtactccggtccctctcgagggctttgaggacaaggtgttttacgtttggtttgacgctactatcggctacctgagcattacagctaactataccgaccagtgggagcggtggtggaagaatccagaacagccttag

SEQ ID NO: 124147 - DNA, 1782 bp, Artificial Sequence
  Description of Artificial Sequence: Synthetic coding sequence
atgctcagaacaagcgtgctgagacttttagggaggacaggtgcctcacgcctatccctgctggaggatttcggaccccggtactactccagtggcagcctgagcgctggagatgacgcttgtgacgtgagagcctattttaccacacctatcttctatgtgaatgcagctccccacattggtcacctttattcagcccttctcgctgatgccttgtgcaggcatcgcagactgaggggacctagcacagcagccacccgctttagtacaggcacggacgagcacggactgaagatccaacaggccgcggccactgctggcctggctcctaccgagctttgtgaccgggtgtcagaacagttccagcagctgttccaggaagctggcattagttgcactgattttatccgaactaccgaggcccgccacagagtggccgtccagcatttttggggagttctgaagagcaggggcctcctctacaaaggcgtttatgaaggatggtattgtgcttcggacgagtgtttcttgcccgaggctaaggttacccaacaacccggaccgagcggcgatagctttcctgtgtcgttggaatctgggcatccagtgagctggacaaaggaagagaactacatcttccgcctttcgcaattccgtaagcccctgcaacgatggctgcggggtaaccctcaggctattacacccgagccctttcaccatgtggtactgcagtggttggacgaggagttgccagacctttctgtgagtcgccgcagctcacatcttcactgggggattccagtgccaggcgacgatagccaaacgatctatgtttggctagatgctctggtgaactacctgacggttattggatacccgaacgccgaattcaaatcatggtggcctgctactagccacattatcgggaaagatatcctcaagttccacgccatctattggccggcatttctgctcggggcgggcatgagcccaccccagcgtatttgtgtgcacagccattggactgtatgcggccagaaaatgagcaagagtctaggtaacgtggtggacccgcgcacttgcttgaaccgatacacagtagacgggtttaggtacttcctcctgaggcagggggtacctaattgggattgcgactactacgacgagaaagtagtgaaactgctgaactccgaactcgcagacgcccttggtggcttactgaacagatgcacggcaaagagaattaacccctctgagacctatccagccttctgcaccacttgctttccatcagagcctggtttagtgggcccaagcgttagagcccaggccgaagattatgcgctagtgagtgccgtggcaacattaccaaaacaagtcgccgaccattatgataacttccgaatctacaaggccttggaggccgtctctagctgtgtccgccagaccaacggcttcgtacaacggcacgccccctggaaactcaattgggaatctccggtggacgctccctggttaggaaccgttctgcacgttgcactggagtgtctgagggtcttcggtacactgctgcagccggtgactccaagtcttgccgacaagctcctaagccggttaggggtgtctgcctctgagcggagtctcggcgaactatacttcttaccacgattttacggacatccttgcccttttgagggccggcggctgggacctgaaacaggcttgctatttcccagattggaccagtcgcggacctggctggtaaaagcccaccgaacctag

SEQ ID NO: 124148 - DNA, 1563 bp, Artificial Sequence
  Description of Artificial Sequence: Synthetic coding sequence
atgttgcgtacctccgtgctccgactgcttggcaggaccggagcgtctcgcttgtcactgctggaggacttcggtcccaggtattactcctctggtagtctgtctgccggtgacgacgcttgcgacgtccgggcctattttaccacgccaattttctatgtcaacgccgccccccacatcggccatctgtactccgcattattggccgatgccctctgccggcatagacggttgcgaggcccttctaccgccgctactcgtttttctactggtacagatgaacatggactaaagatccagcaggccgcagcaaccgctggcttagctcccacagaactctgtgaccgggtgtctgaacagttccaacaactgtttcaggaggctggcatttcctggactaaggaggagaactatatattcaggttgagccagttcaggaaacctctgcagaggtggctgcgaggcaacccccaagccattactcctgaaccatttcatcacgtagtgctccagtggcttgatgaggagttgcccgatctttcagtgagccgacgttcgtcacacctgcactggggcattccggtacccggcgacgattcacagactatctacgtgtggttggatgcccttgtgaattatctgaccgtcatcgggtatccgaacgcagaattcaaatcttggtggccagccacatctcacataattggaaaagacatcctgaagttccacgcaatttactggccagcctttctcttgggggccggcatgtcaccaccacagcgtatctgcgtacactctcattggactgtctgtggacagaaaatgtccaaatccttgggcaacgtggtggacccccgaacttgcctgaatcgctacacggtggatggattccgctactttttgcttagacagggagtgcctaattgggattgtgactattacgacgaaaaagttgtgaagcttttaaacagtgaactggcggacgctctgggcggactgcttaaccggtgtactgcaaaaaggataaatccatccgagacttaccctgctttctgtacaacctgtttcccaagcgaaccggggttagttggcccttctgtcagggcacaggctgaggactatgctctggtgagtgccgtggccacgctgccgaaacaggtagccgatcactatgacaatttcagaatttacaaggcattggaggctgtcagcagctgcgtccggcagaccaacggctttgtccagaggcacgccccctggaagctgaattgggaatcacccgtggacgctccctggctgggtacagtgttacacgtggcgctggagtgcctgcgcgtgttcggtacccttctccagcctgtgacacctagcctggctgataaactactatcccgcctgggcgtttctgcttcagagagaagcttgggtgagctgtacttcctgccccgcttttatggccatccgtgccctttcgagggccgccggctgggtcctgagacaggcctcctattcccccgccttgaccagtctcgcacctggctcgtcaaagcacatcgcacatag

SEQ ID NO: 124149 - DNA, 1461 bp, Artificial Sequence
  Description of Artificial Sequence: Synthetic coding sequence
atggttgccggtatgctcgggttaagggaagaaaagagcgaagatcaggatctgcaggggctaaaagacaaaccactgaagtttaaaaaagttaagaaagacaagaaggaggagaaggagggaaaacacgaacccgttcaaccttcggcacaccatagcgccgagcccgccgaggcaggcaaagcggagacaagcgaggggtccggaagtgcaccagcggttccggaggcgtccgcctctccaaagcagaggagatccatcatccgtgacaggggccccatgtatgacgaccctactctcccagagggctggactaggaagttgaaacagagaaagagcggccgatctgccggcaagtacgatgtgtacctgattaacccccaaggcaaggccttcaggtctaaagttgagctcatcgcttacttcgaaaaagtgggagacaccagtcttgacccaaacgatttcgactttaccgtcacaggtcggggcagtccgtctagacgcgagcaaaaaccacccaaaaaacccaaatcgcctaaagctcctggcaccggaagaggccggggaagacccaagggatcagggacaaccaggccaaaggccgcaacatctgaaggggtacaggtgaaaagagtcctggagaaatcaccagggaaactattagtcaaaatgcccttccagacatctccgggcggcaaagcagagggaggtggagcgacaacttcaacacaggttatggtgattaaaaggccaggacgcaaaagaaaggccgaggctgacccccaggccattcctaaaaagcggggaaggaagccaggctccgttgtcgccgcggcagcagcagaagcaaaaaaaaaggccgttaaggagtctagcatccgaagtgtccaagagacagtgctgcccattaaaaagaggaaaacccgagaaacagtatccatcgaagtcaaggaggttgtgaagcccctgctggtcagtacacttggcgagaaatcaggaaagggacttaaaacttgcaaatctcccggccgtaaatcgaaggagtcatcccctaagggacgctcaagctccgcctccagcccccctaaaaaggagcaccaccaccatcaccatcattctgagagtcccaaagcgcctgtgcctctgctaccccctctgccccctccacctcccgagccagagagctccgaagacccaacctcgcccccggagcctcaagacctctcttcgtctgtgtgcaaagaggaaaagatgccgcgaggagggtcactggagagtgacggctgtcccaaagagccggccaaaacacaacccgccgttgccacggccgctaccgccgcagagaaatataagcataggggcgagggagagcgaaaggacatagtttcctccagtatgcctcgtcctaacagagaggagcccgtggattctagaactccagttaccgagcgggtgagctag

SEQ ID NO: 124150 - DNA, 816 bp, Artificial Sequence
  Description of Artificial Sequence: Synthetic coding sequence
atggttgccgggatgctaggcctgcgtgaggaaaagagtgaagaccaggatcttcagggcctgaaagataaaccccttaagttcaagaaagtgaaaaaggataaaaaggaggaaaaggagggaaaacatgaacccgtacagccttcagcccaccatagcgccgagccagcagaggctggcaaagctgagacctccgaagggagcgggtcagcaccagctgtgcctgaggccagtgcctcacccaagcagagacggtcgattattcgggatagaggccccatgtacgacgatcccacactcccggaaggatggactaggaagctgaaacagagaaagtcggggcggagtgccggtaaatacgatgtttatctcatcaacccccaaggtaaagcatttcgctctaaggtggagctgatcgcctactttgagaaggtcggagacacatccctggacccgaatgactttgatttcacggtgaccggcagaggctccccctcccggcgggaacagaagccacccaagaagcccaaaagcccaaaagcccctggtacaggtaggggccgaggcagacccaaaggcagtggaaccacaaggccaaaggccgcaacttccgaaggggtacaggttaaaagggtgttggagaagagtcccggcaagcttcttgtaaagatgccattccagacgagccctggggggaaagctgagggaggaggggccacgacatccacccaggtcatggttatcaagaggcccggccgcaagcggtccccccgggcaccacgcacccctcccgcccctctctccccacgaacctag

SEQ ID NO: 124151 - DNA, 153 bp, Artificial Sequence
  Description of Artificial Sequence: Synthetic coding sequence
atggtggccggtatgttgggtttaagggaggaaaagagcgaggaccaggatctgcagggcttaaaggacaagccccttaaatttaagaaggtgaagaaagataaaaaggaagaaaaagagggtaagcacgaacctgttcaaccctctgcctag

SEQ ID NO: 124152 - DNA, 1497 bp, Artificial Sequence
  Description of Artificial Sequence: Synthetic coding sequence
atggcagccgctgcagccgctgcaccgagtggcgggggcgggggcggagaggaagaaaggctcgaagagaagtcagaggaccaagaccttcaagggctgaaggacaagccactgaaattcaaaaaggtaaagaaggataaaaaggaggaaaaggaaggcaaacatgagcctgtccaacctagcgcccaccattccgccgaacccgctgaggctggaaaggcagaaacctcagaaggatcaggtagtgcaccggcagtgcccgaagcctcagcaagccctaagcagaggaggtctataatcagagatcgaggccccatgtacgacgaccccacactgccggagggatggacacgaaagctgaagcagcgcaagtccggtagaagcgctgggaagtatgacgtgtacctgattaaccctcagggtaaagccttcagatctaaagtggaactcattgcctactttgaaaaggtaggagatacctccctcgaccctaatgactttgactttaccgtgacaggaaggggctcacctagccgtcgcgaacaaaaaccacccaaaaaacctaagtcacccaaggccccgggtaccggtagagggcgtggccgccctaaaggatcagggacaacgagacccaaagccgcgacatcagaaggcgtgcaggtgaagagggtcctagaaaagtctccggggaaactgctagtcaagatgcccttccagaccagcccaggggggaaggctgagggtggcggtgcaacaaccagcacacaggtgatggtcatcaagagaccaggtagaaagcggaaggccgaggctgaccctcaggccatccctaagaagagaggacgaaagccggggtctgtcgtggctgcagctgccgctgaggcaaaaaagaaagccgttaaggaatctagcattagatcagtccaagaaactgtgctccccataaagaagcgaaagacacgggagaccgtttctatcgaagttaaagaggtcgtgaagccgctgctggtgagtacactcggcgaaaagtctgggaaaggtcttaagacctgtaagagcccggggcgtaagtcaaaagaatccagccccaaagggagatcatcatcagcaagtagccccccaaaaaaggagcaccaccaccaccatcaccactccgagtctccgaaggcccctgtgcctctgttgcctccgttaccgccacccccaccagaacccgagagttctgaggatcccacttcacctcccgagccacaggatctatccagcagcgtgtgtaaagaagaaaagatgccaagaggcggaagcttagaatcggacgggtgccctaaggagccggcaaaaacccagcccgcagttgctacggccgccaccgccgcagagaaatataaacaccgcggagaaggtgaacggaaggacatagtgtcatcatctatgccccgacccaatcgagaggaaccagtggatagccgaacacctgtgacggagcgtgtgtcctag

SEQ ID NO: 124153 - DNA, 1185 bp, Artificial Sequence
  Description of Artificial Sequence: Synthetic coding sequence
atggtggctggcatgttgggccttagggaagagaagtccgaagaccaggatctccaaggtttaaaagataagcctcttaaattcaagaaggtcaagaaagacaaaaaagaggagaaagaaggcaagcacgagccagttcagccaagtgcccaccatagcgcagagccagccgaggcaggaaaggcagagaccagtgaggggagtggctccgcccccgcggtccctgaggccagtgcatctccgaagcagaggagatccatcatccgggacagaggcccaatgtacgatgaccccacgctccccgagggctggacaaggaagctgaaacagaggaaaagtggaaggagcgccggcaagtacgacgtgtacctgatcaacccacaggggaaggcttttcggtctaaggtggagctcattgcctactttgaaaaggttggcgacacgagtttggaccccaatgactttgattttacagtgaccggacgcgggtccccctctcgccgggagcagaagccacccaaaaagcctaaatcgcctaaggctccaggaacagggcgaggtagggggcgtcccaaaggcagcgggaccaccaggccaaaggccgccacatccgaaggggtccaggttaaacgcgtcctggagaagtcgccagggaagcttcttgttaaaatgccgtttcagacctctccagggggaaaagcagagggcgggggcgccaccacttctactcaggtgatggtcattaaacgacctggacgtaaaagaaaagccgaggccgaccctcaagccataccgaagaagcgtggccggaagcccgggagtgttgtggctgcagctgcggctgaggctaagaagaaggcagttaaagagtcttcgattagaagcgtgcaggagactgtgctcccaatcaaaaagcgtaagaccagggagactgtctccattgaggtgaaagaagttgtgaagccgcttcttgtgagcaccctgggggaaaaatcaggaaagggactcaagacttgcaaatcccccggccggaaaagcaaggagtcttccccaaaaggtcggtcctcctctgcatcatcgccgcctaaaaaagaacatcatcatcatcatcaccacagcgagtcacccaaggccccagtgccaactcgaataaaggccgctgtggtgagttccccctatgggtag

SEQ ID NO: 124154 - DNA, 1818 bp, Artificial Sequence
  Description of Artificial Sequence: Synthetic coding sequence
atggcggaggattggctcgattgccccgcgctaggccctgggtggaagagacgcgaggtgttccgcaaaagcggcgcaacttgcggtaggtccgacacctactatcagtcccctacaggcgaccgcataaggtccaaggtggagctgacccgctacctggggcctgcctgtgacctgaccctctttgattttaaacagggcatactctgctaccctgccccgaaggcgcacccagtagcagtagccagcaaaaagcggaagaagccatcgcgcccagccaagactaggaaaaggcaggtgggtccgcagtcaggagaggttcgcaaggaggcaccacgcgacgaaacgaaggccgacacagacactgcgccagcaagcttccctgcccctggctgttgtgagaattgcggcatttccttttccggggatggaactcagcgccagagactgaagacactttgcaaagactgcagggctcagcgcattgcctttaacagagaacaaagaatgtttaaacgggtgggctgtggtgaatgcgctgcctgtcaggtgactgaggactgcggggcctgctcaacatgcctacttcagctcccacatgacgtcgcaagtggcctgttctgcaaatgcgagaggcgccgatgcctgcggatcgtcgagcgctctcgaggatgtggcgtgtgtagaggttgtcagactcaggaagactgtggacactgtcccatatgtctgagacctcccaggcctgggctacgacggcagtggaagtgtgtgcagaggcgatgtctgagaggcaagcacgccagaagaaaagggggatgcgacagtaagatggccgcgaggagacgcccgggcgcccaacccttgcccccccccccaccttcccaaagccctgaaccgactgagccccatccgcgagccctggcgccctcccctcctgccgagtttatttactattgtgtcgacgaggatgaattgcagccttacactaacagaagacaaaacaggaagtgcggcgcatgtgctgcatgcttgaggagaatggactgtggccgatgcgacttttgttgtgataagccaaaatttgggggaagcaatcagaaaaggcagaaatgtagatggagacagtgcctgcagttcgccatgaaaaggctgctcccgagcgtctggtcggaatcggaggacggcgccgggtccccccccccctaccggcggaggaagcggcctagctcagctcggcggcatcacctcggacctacgctaaagccaacactggcaacaaggaccgcccagcctgaccacacacaggcacccaccaaacaggaagccggcggaggtttcgtgctcccacctccaggaaccgatctcgtgttcctccgcgagggagctagtagcccggttcaggtgcccggtcctgttgctgctagtaccgaagccctgctgcaggaagctcagtgtagtggattgagttgggtcgtcgcgttaccacaggtcaagcaagaaaaggccgacactcaggatgaatggacacccggaaccgctgtgctgacatcacctgtacttgtgccggggtgcccatccaaagccgtagatcctggccttccctcagtgaagcaggagccgcccgacccagaagaggataaagaggagaataaggacgactcggcgagcaagctcgctccagaagaggaagccgggggggctggaacacctgtgatcacagaaatctttagtctcggcggaaccagatttagggatacagcggtctggctgcccagatctaaagatttgaagaaacctggagctcgcaaacaatag

SEQ ID NO: 124155 - DNA, 1761 bp, Artificial Sequence
  Description of Artificial Sequence: Synthetic coding sequence
atggctgaagactggttggattgccccgctctggggcccggctggaaacgacgcgaggtttttagaaagagcggcgcaacttgtggccgttcagacacctattaccagagtccaactggcgatcgcatccggagtaaagtcgagcttaccagatacctgggcccagcgtgcgatttgacactgttcgactttaaacagggtatcctttgttaccctgcacccaaagcccacccagtggctgtggcgagcaagaaacggaagaagcccagcagaccggccaagactaggaagaggcaggtaggtccacagtccggcgaggttcggaaggaggccccgcgcgacgagacaaaagcggacactgacacagccccggccagctttcctgccccaggctgctgcgagaactgcggaatttcgttttcgggcgacggcactcagagacagaggctaaagaccttgtgtaaagattgccgggcccagcggattgcgttcaacagagaacagaggatgttcaagcgcgttggctgcggcgagtgtgcagcttgtcaggtaaccgaagactgcggcgcttgttccacttgcctgctgcagcttccccacgatgtcgcctccggcctgttctgcaagtgcgaacggcggcggtgtctgcggattgtcgagcgctctcgcggatgtggagtctgtaggggttgtcagacccaggaagattgtggtcactgtcccatctgtctgcgccccccacggccaggtctccgcagacagtggaaatgcgtacaacgacggtgtctgcgaggcaaacacgctagacggaaggggggctgtgattcaaagatggctgccagacgtaggccaggagctcaacctcttccacccccccctccctctcagagcccagagcccaccgagccccaaccctataccaaccgccgccaaaatcggaagtgtggcgcttgcgccgcatgcctgcgcagaatggattgtggcagatgcgacttctgctgcgataagcctaaatttggcggtagtaatcaaaagcggcagaagtgccgatggcgccagtgcttgcagtttgctatgaaaagattgctgcccagtgtctggagcgagtccgaggatggagccggttcccctcctccatatcggagacggaaacggccgtcaagtgcccgccgccatcatttgggaccaacgctcaagcccacactggcgacccgcacggcacagcccgatcatacacaagccccaaccaaacaggaggcaggcggcgggtttgtgctgcctcctccaggaaccgatcttgtatttctgcgcgagggagctagcagcccagtgcaagtcccaggccctgtggctgcaagcaccgaagcgctgctgcaggccgtggaccccggactgccctccgttaaacaggagccacccgacccagaagaggataaggaggagaataaagacgacagcgcttctaaactagcacctgaagaggaggccgggggagctggcacccctgtgattaccgagatatttagccttggagggactagattcagagacacagcagtctggctccctagcctgcagggccgccacagcggtcgcgaagacggctgtaaagtgtgggaaacggaggacacggttgaaccaacctcaaccagttggaacccaagggggtggcccgggacacacgtcagcctgtccccgccccctgcttccatgatgtgggtttcctgtagacgttcatggtgtccctcgagtcagtcgtag

SEQ ID NO: 124156 - DNA, 1653 bp, Artificial Sequence
  Description of Artificial Sequence: Synthetic coding sequence
atggctgaggattggcttgactgccccgcactgggtcccggttggaaacggcgcgaagtctttcggaaatccggagccacatgtggtagatccgatacctactaccaaagcccgacgggagatcgtataagaagcaaggtagagctgacacggtatctcggacctgcctgcgatttaaccttgttcgacttcaaacaggggatcctctgttatccagctcccaaggctcaccccgtcgccgtcgcaagcaaaaagaggaagaagccctcacgcccggctaagacccgtaaacgccaggtgggaccacagagcggggaagtgcgaaaagaagcaccgcgagacgaaaccaaagccgacaccgacaccgcaccggcctcttttcctgctcccgggtgctgcgaaaattgtggaatcagctttagcggcgatggtacccagagacagcgcttgaaaaccctgtgcaaagactgtcgcgcccagagaattgcctttaatagggagcagagaatgttcaagagagtcgggtgtggtgagtgcgctgcttgtcaggtgacagaggactgtggggcctgctctacttgtctgctccagctccctcatgatgtggctagcggacttttctgtaagtgcgagaggcgacggtgtttgagaattgtagagcgctccagaggatgtggagtctgcaggggctgtcagacccaggaggactgcggtcattgccctatctgtttgagaccaccacgccctgggttgcggaggcaatggaagtgcgtccagcgacggtgtctgcgcggaaaacacgctcgtcggaaaggaggttgcgactcaaaaatggctgctcgcaggaggccgggcgcgcagcccttgccacctccacccccctcacagtcaccggagcccacagaaccccatccccgagccctcgctccaagtccgcctgccgaattcatttattactgtgtcgacgaggacgagctgcagccctataccaacaggcggcagaatcgcaagtgcggcgcctgtgctgcctgtctgcgtcgcatggactgtggccggtgcgatttttgttgtgataagcctaaattcggtggtagtaatcagaaacgacagaaatgtaggtggaggcaatgtctacagttcgccatgaagagattgctgccttctgtatggagcgagtctgaggacggggccgggtccccacccccatatagacgacgcaaacgcccctctagtgcacgacgccaccacctggggcccacgttaaagcctactttagctactcggacagcacagccagaccacactcaggccccaacgaaacaggaggccggcgggggttttgttctcccgccccctggtactgacctggtctttctgcgcgagggtgccagcagtcctgtgcaagtacctggacccgtggctgcatccaccgaggctctactgcaggcggtggaccccggacttccgtcagtcaaacaggaaccacctgaccccgaggaggacaaggaagagaataaggatgattccgcttcgaagttagcgccggaagaggaggcaggcggcgccgggactcctgtggaacctacgactcaaccgcaatacagcggaaatttcgataatgacctgtatgaaatatacctgatcgacatctag

SEQ ID NO: 124157 - DNA, 1650 bp, Artificial Sequence
  Description of Artificial Sequence: Synthetic coding sequence
atggccgaagactggctcgactgcccagccctcggcccggggtggaaaagaagagaggtctttaggaaatctggcgcaacttgtggacgatctgatacctactatcagtcccctaccggggaccgcattaggtccaaggtagagctgacccgttatctgggccccgcctgtgaccttactctgttcgactttaagcagggaattctttgttatccagccccgaaagcacaccctgttgctgtcgcatctaaaaagagaaaaaagccctcccgccctgctaaaacccggaaacgacaggtgggtccgcagtctggcgaggtgcgtaaagaggcccccagggacgagaccaaggctgataccgacaccgcacccgcctctttcccagcaccagggtgttgcgagaattgcgggatctcattttccggcgacggcacacaacgacagcggttgaagactctgtgcaaggattgtagggcacagcggatcgctttcaaccgggagcaaaggatgtttaaaagggtgggctgcggcgagtgcgctgcttgtcaagtgacagaagactgtggcgcatgtagtacgtgtctactccagctccctcatgacgttgcatccggactgttctgcaaatgtgagcggcgcaggtgccttcgcattgtcgaacgaagtcgcggctgcggtgtctgcaggggctgtcagacccaagaagattgtgggcattgtcccatttgtctacgccctccaagacctggcctccggcggcaatggaagtgtgtccagcgccgttgcttgagagggaaacacgctaggaggaagggcggatgtgactcgaaaatggctgcacgcagacgcccaggcgcccagcccctgccccccccaccaccaagccagagccccgaaccgaccgaaccacacccgcgcgcccttgccccaagccctcccgcagagtttatttactattgtgtggatgaggacgagcttaaaagactattgcctagtgtttggagtgaatctgaagacggtgccggctcccctccgccatacaggaggcgcaagcgaccttcatccgctcgccggcaccaccttgggccaactttgaagccgacccttgctacgaggacagcccaacctgaccatactcaggcacccaccaagcaagaagctggaggcggtttcgtcttgccaccaccgggaactgacctggtttttctgcgggagggagcttcttcaccagtgcaagtacctggtcccgtagctgcgtccactgaggcactgctgcaagaggcacagtgctctggcttgagttgggttgttgccctcccccaggtgaagcaggagaaagcagacacacaggatgagtggacacccggaactgccgtcttgacttctcccgtcttggtgccaggatgtccttccaaagcagtggatcctggactgccatccgtgaaacaggaacctcctgaccccgaggaagacaaagaagagaataaggacgactctgccagtaaattggcccccgaagaggaagcaggtggagctgggacgccagtcatcaccgaaatctttagcctggggggaacccgcttcagggataccgccgtgtggttgccaaggagcaaagatctgaaaaaaccaggagctagaaagcagtag

SEQ ID NO: 124158 - DNA, 1512 bp, Artificial Sequence
  Description of Artificial Sequence: Synthetic coding sequence
atggctgaggactggctcgactgccctgccctgggcccgggatggaaaaggagagaggtttttcgcaaaagcggagccacatgtggccggtccgacacatactaccagtccccaaccggcgaccgtatcagatctaaagtggagcttacgaggtacttaggacctgcttgcgacctcaccctgtttgatttcaagcagggtatcctttgttaccctgctcccaaagcgcatccagtggccgttgcgtccaagaagcggaaaaagccaagtagaccagccaagactagaaaaagacaagtgggcccacagtccggagaagtgcgcaaagaggctccaagagatgaaacgaaagccgataccgacacagcccctgcttcttttcccgcgcctggctgctgcgaaaactgtggtatttcctttagtggggatggcacccagaggcaacgcttgaagacgttgtgtaaggattgtcgcgcacagaggatagcttttaatcgtgaacagaggatgtttaagcgcgtcgggtgcggagaatgtgccgcttgtcaggtgacagaggactgcggagcctgcagcacttgcctcctgcaactgcctcatgacgttgcttccggattgttctgcaaatgcgagcgccgccggtgcttgcgcatagttgagagaagccgcggatgcggcgtgtgtaggggttgccagacgcaggaggattgcggccattgccccatatgcctgcgccctccccgacccggactgcgaaggcagtggaagtgtgtgcagaggcggtgtctgagggggaagcacgctcgcagaaagggaggatgcgatagcaagatggccgcccgcaggagaccaggggcccagcctttgccacctcctcccccaagtcaaagcccagaacctacagagccacaccctcgagcccttgcaccctctccgccagccgagtttatatactactgcgttgatgaagacgaacttaagagactgttgccctcagtctggtctgaatctgaagatggcgctggctccccccccccttatagacggagaaagaggccaagctccgccagaagacatcacctgggcccaacactgaagccaaccctagccactcgaactgcacagccagatcacactcaggctcccacgaagcaagaagccggtggcggattcgtgctaccgcctcccggcaccgatctggtcttcctgagagaaggagcatcctccccagtgcaggtccctggtcccgtcgctgcatcaaccgaggccctgttgcaagcagtggacccagggctgccttccgtcaaacaggaaccccccgatcccgaggaagacaaggaggagaataaggatgatagtgcttctaagttggccccagaggaggaggcaggcggtgccgggacacctgtgatcacagaaattttttcactgggcggtacccgcttccgagacacggccgtctggttgccgagatcgaaagacttgaaaaagcccggagctaggaaacaatag

SEQ ID NO: 124159 - DNA, 1671 bp, Artificial Sequence
  Description of Artificial Sequence: Synthetic coding sequence
atggctgaagactggcttgattgcccagcattgggtcccggatggaaacggcgggaagtatttagaaaatcaggtgctacttgcgggcggtccgatacatattaccaatctcccacaggcgacaggattaggtctaaggtagagctcactcggtatttagggcccgcctgcgatctgacattgtttgacttcaaacagggaatcctctgctaccccgccccgaaggcgcaccctgtggcagtggctagcaaaaagcgtaagaaacccagtcgccctgcaaaaaccaggaaaagacaggtcggacctcagtccggcgaagtgcggaaggaggcccctagggacgagacgaaggccgatacggataccgcaccggcatcttttcccgccccggggtgttgtgagaattgtggcatttccttctcgggggacggaactcagcggcagcggcttaagacgctatgcaaagattgtagagcacaacgcattgcttttaacagggagcagcgtatgttcaaaagcagaggctgcggagtgtgtcggggctgtcagactcaggaagactgcggccactgtccaatatgccttcgcccacctcggccaggccttagacggcagtggaagtgtgtgcagcgtcgctgcctacgagggaagcatgctaggagaaaaggaggttgcgattctaaaatggctgctaggcggcgcccaggtgctcagcccctgccaccccctccaccatcacaaagccccgagcctaccgagccacatccccgagcactggcaccgtcaccccctgccgaattcatttactactgtgtcgacgaagacgagttacagccctacactaaccgacgtcagaaccgcaagtgcggagcctgtgccgcttgcttgcgccggatggattgtggtcgttgtgatttctgctgcgacaaaccaaagtttggcgggtccaatcagaagagacagaaatgtaggtggcgacagtgcctccagttcgctatgaaaaggcttctgcccagcgtttggagtgaatcagaagatggagcaggcagccccccaccttacaggagacgcaagagaccaagctctgcacgacggcatcatttaggtcccaccctgaagccaacattggccactagaaccgcccaacctgaccacactcaagcccccactaaacaagaggcgggcgggggattcgtcctcccacccccaggcacagacctggtgttcctgcgtgagggtgcttctagccccgtgcaggtgccagggccagtcgcagccagtactgaagctctactgcaggaggctcaatgtagcggcctaagctgggtggtcgccctcccccaggttaagcaagaaaaagccgatacccaagacgaatggaccccagggactgccgtgctgactagcccagttcttgtgcccggatgccccagtaaagcagtggatcccggactgccttccgtcaagcaggagccgcctgatcctgaagaagacaaagaggagaacaaggacgattcagccagcaaactggctcctgaagaggaggccggtggggcaggaaccccggttattacagagatcttcagcctgggcgggacgcggtttagagatacggccgtttggctgccacgctctaaggacctgaaaaagcctggagcgaggaagcaatag

SEQ ID NO: 124160 - DNA, 1818 bp, Artificial Sequence
  Description of Artificial Sequence: Synthetic coding sequence
atggctgaggattggcttgattgtcccgcccttggccccggttggaaacggcgcgaagttttccggaagtcgggcgctacgtgtgggaggtccgacacttattaccaatccccaacaggtgaccgaatccggtcaaaggtcgaactgacgcgttacctgggtccagcgtgtgacttaacactgtttgacttcaaacagggtatattatgctatcctgctccgaaggcccatcctgttgcggtcgcaagcaagaaacgaaaaaaaccttcaagacccgcaaagactaggaagagacaggtgggccctcaatccggtgaggtgagaaaagaggcccctcgggacgaaaccaaagctgatactgacacagcccctgccagttttccggcccctggttgttgcgaaaattgcggaatttcctttagcggagatgggactcagagacagagactgaagaccttatgcaaagattgccgcgctcagcgtatcgcattcaacagagagcaacggatgttcaaaagggtagggtgcggagagtgtgccgcctgccaagtgactgaagattgtggcgcctgcagcacctgtctgctgcagcttccccatgacgtagcgtcagggttattttgcaaatgtgagcgacggcgatgcttgcgaatagtcgaacgaagtagagggtgtggcgtttgtcggggttgccagactcaggaggactgtgggcattgcccaatctgtctgagacccccccgcccggggctgcgacggcaatggaaatgtgtccagcggcgatgcttgcgcggaaagcacgctaggcggaagggcggctgcgactcaaagatggccgccagaagaaggcccggagcccagcctctgccgcccccccccccgtcacagagtccagagccaaccgaacctcacccacgcgcccttgctccttctcctcccgccgagtttatctattactgtgttgatgaggatgagcttcaaccttacaccaacagacgccagaaccgcaaatgcggggcctgcgccgcctgtctaagacgcatggattgtggacggtgtgacttttgctgtgataagccaaaattcgggggcagcaatcagaagagacagaagtgccgctggcgtcagtgcctgcaattcgctatgaaacgcttattgccgtccgtgtggtctgagagcgaagatggagcaggaagtccaccaccttatcgtagacggaagcgcccgtcaagcgcacgacgacatcacctgggtcctacactgaaacccacgctcgccacaaggacggcacagcccgaccatactcaggctccaacgaagcaggaggccggaggtggtttcgtgctgccaccgccaggtaccgatctggtgttcctgagagagggagcatctagccccgtacaggtgcccggccctgtggccgcaagtactgaggccctgctgcaggaagctcaatgctccgggttgagctgggtggtggctcttcctcaggtgaaacaggagaaagctgatacacaggacgaatggacccctggcaccgcagttctcacaagcccggtcctggtgcctggttgtccaagtaaggccgtcgacccaggactgccgtctgtcaaacaggaaccaccggatcccgaggaggacaaggaggaaaacaaggacgactcggcaagcaagcttgcccccgaagaagaagccggcggggctggcactcccgtcattacagagattttcagcctaggaggtacacgcttccgggatactgctgtttggctccctcggtccaaggatctgaagaagcctggcgcacgaaagcaatag

SEQ ID NO: 124161 - DNA, 1512 bp, Artificial Sequence
  Description of Artificial Sequence: Synthetic coding sequence
atggcggaggactggttagattgtcccgcgcttggccctggctggaagagacgggaagtgtttagaaaatcgggagccacctgcgggcgatctgatacttactaccagtccccaaccggtgaccggatcagatctaaggtggaactgacccgttacctcggccctgcctgtgaccttacactcttcgattttaagcagggcattctttgctaccctgctcccaaggcccaccctgtggccgtggcctctaagaagcgaaaaaagccgtcacgacctgccaagaccaggaagcgacaggttggccctcagtccggggaagttaggaaggaggcccctcgggatgaaaccaaggcagacaccgatactgcacccgcttctttcccagcaccaggctgttgcgagaactgcgggatcagcttttccggcgacgggacccagagacaacggctcaaaaccctttgtaaggattgccgtgcccagaggatcgccttcaatcgagaacagaggatgtttaaacgggtaggatgtggagaatgtgctgcttgtcaggtgactgaagactgtggtgcctgttccacatgtctgctccaacttccacatgacgtggcaagtggactgttctgcaagtgcgagcgtcgccgctgcttacgcattgtagaacgatcgagaggctgcggggtctgtcgcggttgccagacccaagaagattgcgggcattgtcctatctgcctccgcccaccaaggcctggcctgcggcggcagtggaaatgtgtgcagcgccggtgtctgcgcggaaagcacgcccgacgcaaaggaggctgtgattctaagatggccgctagaagaaggcctggggcgcagccgctccctcctcccccgccctctcagagtcctgaacccacagagcctcatcctcgagccctggcaccatcccctccagccgagttcatctattactgcgtagacgaggacgaactgaagcgcttactcccatctgtgtggagcgagagtgaggatggcgcaggaagtcctcccccttaccgccgtaggaagcgccccagttcggcgaggaggcatcaccttgggcccacactcaagcctacattggctacccgcactgcacagccagatcacacccaggcccctaccaagcaggaggcaggaggaggatttgtccttccgccacccggaacggatctggtcttcctgcgggagggtgcctcatcacccgtgcaggtgcccggcccggtggcggcgtctaccgaagcacttctccaggcagtcgacccaggactgccctccgtgaagcaggagcctccggatcctgaggaggacaaggaggaaaataaagacgactctgctagtaaattagcccctgaggaggaggccgggggcgcagggacccctgtgattaccgaaatcttttccttggggggcactcgctttcgagacacggcggtgtggctccccagaagcaaagacctcaaaaagcctggtgcccgaaagcagtag

SEQ ID NO: 124162 - DNA, 1650 bp, Artificial Sequence
  Description of Artificial Sequence: Synthetic coding sequence
atggcagaagactggcttgactgcccggccctagggccagggtggaaacgacgcgaggtgtttcgtaaatccggcgcaacctgcggcagatctgacacctactatcagagcccaacaggagatcgcatacgctctaaagtcgaattgacgcggtatctcggcccggcctgcgacctcaccctgtttgattttaagcagggaatcttgtgctatcccgcccctaaagcccaccccgtggccgtggcaagtaagaagcggaagaagcctagcaggcctgccaagactcgaaaaagacaggtgggtccacaatccggcgaggtccgtaaagaggccccccgggatgaaacaaaagcggacactgacacagcccccgcgagtttccccgcgccagggtgttgcgaaaattgcggaatttccttttctggggacgggacgcagcgccagcggcttaaaaccctgtgtaaggattgtagagcccagcgtattgcctttaaccgcgaacaaagaatgtttaaaagagtggggtgtggggaatgcgccgcctgccaggttactgaggactgtggcgcttgttcaacatgtctcctccagttgccccatgacgtcgcgagtgggctgttctgcaagtgcgagaggcgccgctgtctccggatcgttgagcgatctcgagggtgtggtgtgtgccggggttgtcagacccaggaggattgcggacactgccccatctgtctgaggcctccacgacccggcttacgccgtcagtggaaatgtgtgcagagaaggtgtctgaggggtaagcacgcgcggcgaaaaggcggctgtgacagtaagatggccgccagacggcgacccggggcccaaccactgccccctcctccaccatcgcagtcgccggaaccaacagaaccccatcctagagcgctggccccttccccccctgctgaatttatatattactgcgtcgacgaggacgaactcaagcgcctcctccctagtgtgtggagcgaatcagaagatggcgccggatccccaccgccataccgcaggcgcaaacgcccttctagtgccagacggcatcatctggggccaacacttaagcccacactcgcgactagaactgctcagccagaccatacccaggcacctactaagcaggaggccggtggaggattcgtccttcccccccctggtaccgacttggtgttcctcagagaaggagccagctcccctgtccaagttcctggacccgtggccgctagcaccgaggcgttgttgcaggaggcgcagtgttcggggctgtcttgggttgtggccctaccccaggtgaagcaggagaaagcagatactcaagacgagtggacccccggtaccgccgtgttaacttcgcccgttctagtgccaggctgccccagtaaggccgtcgaccctggactcccatctgtcaaacaggaaccccccgatcccgaggaggacaaagaggaaaacaaagatgacagcgcgagtaaattggctcccgaagaggaagccggaggcgccggcacccccgtgattaccgagatcttttcgctggggggcacacgctttcgggacaccgctgtttggctccctcgatccaaggatctaaaaaaacccggggcccggaaacagtag

SEQ ID NO: 124163 - DNA, 1818 bp, Artificial Sequence
  Description of Artificial Sequence: Synthetic coding sequence
atggctgaagactggttggattgtccagccctcggtcccgggtggaaaaggagggaagtgttccgcaaaagcggggcgacgtgtggcagaagtgacacatattaccagtcgccaactggagacagaattcggagcaaggtggagctgacaaggtacctgggaccagcttgcgacctgacactttttgactttaaacaaggaattctatgctaccctgctcccaaagcccatcctgttgctgtcgccagtaaaaagagaaagaagccctcccggcctgccaaaacacggaaacgccaagtgggaccccagagtggagaggttaggaaagaagctcctcgggacgagaccaaggcggatacggacacggcaccggcctctttcccagccccaggttgctgtgaaaattgcggcatttccttttctggagatggaacccaacggcagaggctgaaaacattgtgtaaggactgtcgcgcacaaagaatcgccttcaatcgcgagcagagaatgttcaaaagggtggggtgtggggaatgcgcagcttgtcaggtgacagaggattgtggcgcctgcagcacttgcctcctgcagctcccccatgacgttgccagcggcctgttttgtaagtgcgagagacgtcggtgtctacgcatagtcgagaggagcagggggtgcggcgtttgtagagggtgtcaaacacaggaggactgtggacattgtcccatctgtctcaggccccccagaccaggcctcaggcggcagtggaagtgcgtgcagcgacggtgtctgcggggaaaacacgcgcggcgcaagggcggatgcgacagtaagatggccgcacgacgccgtccaggagctcagccgcttccccccccccccccgagtcaaagtccagagccgactgaacctcaccctcgggcactcgctccaagccctcccgctgagtttatttattactgcgtggacgaggacgagctgcagccatataccaaccgtcgccagaacaggaagtgtggagcttgtgccgcctgcctgcggaggatggactgcggccgctgcgacttttgttgcgataagcctaagttcggagggtctaatcagaaaagacaaaagtgccggtggcggcagtgtctacaattcgctatgaagcgcctcctgccatccgtctggtccgagtcagaagacggggctggatcccctcccccataccgaagaaggaaacgaccaagcagcgcaaggaggcaccacctgggccccactctgaaacccactctggctactcgaacagcacagcccgaccacacgcaggccccaaccaagcaagaggcagggggtgggttcgtgcttccacccccagggactgacttagtgttcctcagggagggtgcttctagtcctgtgcaagtaccggggcccgtggccgcctcaaccgaggccctactacaagaggcgcagtgctccgggttgagctgggttgtggctctcccccaggtgaagcaggagaaggcagacacccaagacgaatggacccccggcacagctgtcttgacatcgcctgtattggtgcccggctgccccagtaaagcagtagacccaggcttgccttctgtgaagcaggaaccccccgacccagaggaagataaagaggagaataaagacgacagcgcttccaagctggcccccgaagaggaagctggcggggcagggacacctgtcattactgaaattttttcactggggggtaccaggtttagggacacagccgtttggctgccccgttctaaagatcttaagaagcccggcgctcggaaacagtag

SEQ ID NO: 124164 - DNA, 1971 bp, Artificial Sequence
  Description of Artificial Sequence: Synthetic coding sequence
atgggcgggttcaggctaagaactggcagaaatgccgcgttaaacagcgatcggctgctgctgctacctgtggcatcaatggctgaagattggctcgactgtcctgccctgggtccaggctggaagcgtcgtgaggtctttagaaagtccggcgccacttgcggaagatccgatacatactaccaatcacccacaggtgacaggatccgcagcaaggtggagttaacaagatatctcggccccgcgtgcgatctcactctgtttgactttaagcaaggcattctgtgctaccctgcgccaaaagcacaccccgtagccgttgcttcgaaaaagcgtaagaagccttctcgtccagccaagacaaggaaaagacaggtgggaccccagtctggcgaagttcgcaaggaggcaccccgggatgagactaaggctgataccgacactgctccagcctcattcccagcccccggatgttgcgagaattgtggtatttcttttagcggagatggcacgcaaaggcagcggctgaaaaccctgtgcaaagattgtcgcgcccagagaatcgcattcaacagagaacagcggatgtttaagagggtgggctgtggagagtgtgcagcctgccaagtcacggaagattgtggtgcttgctctacctgcctacttcaactgcctcatgacgtcgcgtccggtttgttctgtaaatgtgagagacgacggtgtctccgcatcgtggagaggtccagggggtgcggggtctgcaggggatgccaaacgcaggaagactgtggacactgccccatctgccttaggccgcccaggcccggacttcgtcgacagtggaaatgtgtgcaaagaaggtgcctgcgacacctggcccacaggttacggcgccggcaccagaggtgtcagcgcagaactcccctggcagttgctccgcccaccggcaagcacgccaggcgaaaaggaggttgtgatagcaagatggctgcccgtcgacggccgggagcacaaccactgccacctccccccccctcccaaagccccgaaccaactgagcctcatccccgtgcccttgcaccttcaccaccggctgaatttatatactattgcgtggatgaggacgagttacagccctacactaatcggagacagaatcgtaagtgcggcgcttgtgctgcatgtctgcgacgaatggattgtggtagatgcgacttctgttgtgacaaacctaaatttggcggaagcaaccagaagcgtcaaaagtgtaggtggcgtcagtgcttgcaatttgcaatgaagagactgctgcctagcgtttggtccgaaagcgaagacggggccggaagcccaccaccttaccggcgccgcaagcgcccttcctcagctcgtagacaccacttgggtccaacgctgaagccaacactggcaactagaactgcccagccagatcacactcaagctccgactaagcaggaggcaggtggaggcttcgtgctgccaccaccgggcacagacctggtgtttttacgggagggggcatcatccccagtccaagtcccggggcctgtagcagctagtactgaggccttgctccaggaggcccagtgttctggactgagctgggtcgtcgccctccctcaggtgaaacaggagaaggccgatacccaggatgaatggacccctggaaccgcagtgcttacgtcccccgtgctcgtgccaggatgcccctctaaggcggtggatccaggtcttccaagcgtaaagcaggaaccccccgatccggaggaggacaaagaggagaataaggatgactctgcttccaagctcgcacctgaagaggaagccgggggggccggaactcccgtcatcactgaaatcttttctctaggtggcacacgcttcagggacacagccgtctggcttccgagatcaaaggacctgaagaagccgggcgctagaaagcaatag

SEQ ID NO: 124165 - DNA, 1611 bp, Artificial Sequence
  Description of Artificial Sequence: Synthetic coding sequence
atggccgaagactggctcgattgcccagctttagggcccgggtggaagcgacgcgaggtgttcagaaagtcaggggccacctgcggaagatccgatacgtactatcagtcacccacaggagacagaatacggtccaaggtcgagttgacccgttacctcggacctgcctgcgatctaaccctgttcgacttcaaacaaggaattttatgctacccagccccaaaggcccaccccgtggccgtggcctccaagaagcgcaagaagccatctcgccctgcaaagacacgtaaacggcaggtggggcctcagtcgggggaggttaggaaggaagcgcctagggatgaaacaaaagctgacaccgatactgccccagctagctttcccgctccaggctgttgcgaaaactgcggtatcagtttctctggcgatgggactcagcgccagagattaaagacgctgtgcaaggactgtcgcgcacagagaatcgcctttaaccgcgagcagcggatgttcaaaagggtcggttgtggggaatgcgccgcctgccaagttacggaagactgcggagcctgctctacttgcctgctccagctcccacacgatgtcgcctctgggctgttctgcaagtgcgagaggcggcgatgtttgcgaattgtcgagcgctctcggggttgcggtgtctgcagaggctgtcagacacaagaagactgtgggcactgcccaatctgcttgagaccccccagacccgggcttaggcggcaatggaaatgcgtccaacggcgatgtctgcggggtaagcacgcaagaaggaagggaggatgcgattccaaaatggctgcccggcggcggcccggggctcagccgttaccacctccgccccccagccagtcccctgaacctaccgagccacagccctacaccaatcgacggcagaaccgcaagtgcggcgcctgcgccgcatgtctccggaggatggactgtggtcgatgcgatttctgctgcgataaacccaagttcgggggcagcaaccagaagcggcagaagtgtagatggcggcagtgccttcagtttgcaatgaaaagacttctgccatcagtttggtcagagagcgaggacggggcaggtagtcctcctccataccgtagacggaaaaggccttctagcgcacgccgccaccatttggggccaaccctgaagccaactctggctaccagaactgcgcaacctgaccatacccaagctcccacaaaacaggaagccggtggggggtttgtgttaccgccacccggcacggatttagtgtttttgagagagggggctagtagtccggttcaggtgcctggaccagtcgcagcctccacggaagctctattgcaagccgtagaccctggtctcccttctgtgaaacaggagccaccagacccagaagaagataaagaggagaacaaggacgacagtgcctctaagttagcccctgaggaagaggccggcggcgcgggtactcctgtaattactgaaatcttttcactcggtggcacaaggtttcgcgataccgcggtgtggttacctaggtccaaagacctgaaaaagcccggcgctcgaaaacagtag

SEQ ID NO: 124166 - DNA, 1893 bp, Artificial Sequence
  Description of Artificial Sequence: Synthetic coding sequence
atggccgaagattggctggactgcccagcccttgggcctggatggaagcgccgcgaagtgtttcggaagagcggagccacctgtgggaggagcgacacatattaccagtccccgactggggacaggatacgcagcaaagtcgagctgacccgctatctgggaccggcgtgtgatctgactctcttcgatttcaagcaggggattctgtgctaccctgcccccaaagcccaccctgtggcagtggccagcaagaagcgcaagaagcctagtcgccccgccaagacaagaaaacgacaggtgggcccgcagtccggggaggtccgaaaggaggcacccagagacgagaccaaagcagacacggacaccgccccagcttccttcccagcaccgggatgttgcgaaaattgtggaatctctttctccggtgacgggactcagaggcagcgcctcaaaacgctctgcaaggattgtagggcccagaggattgcattcaatcgcgagcagcgtatgttcaagcgggtagggtgcggagagtgcgccgcatgccaggtgaccgaggattgcggcgcgtgcagcacctgcttgctgcaactccctcacgacgtggcgtcaggactgttttgcaaatgtgagcggcgaaggtgcctgcggatcgtggagaggtccagaggctgtggcgtctgtcgtggttgtcagacccaggaggactgtggccactgccccatttgcttacgcccacctagaccaggcctgaggagacaatggaagtgtgttcaaaggagatgtctacgacacctggcgcatcgcctgcggagacggcaccagcgatgccagcgaagaactcctctggcggtcgcgcctccaaccggaaagcatgctcgacggaaaggaggttgcgactctaagatggccgcccggcggcgacctggtgcccagccactgccccctccgcctccatcacagtcccccgaacctactgagccacacccgagggcgcttgcaccgagtccgcccgccgagttcatctactattgcgtggatgaagatgaactccaaccatacaccaatagaaggcaaaatagaaaatgcggcgcctgtgcagcttgtttgcgtagaatggactgcggcaggtgtgacttctgttgcgacaaacccaagtttggagggtctaatcagaagcgacagaaatgcaggtggagacagtgcttgcaattcgccatgaaaagattgctgccctcagtatggtctgaaagcgaagatggcgcaggctccccacccccatatcgaagaaggaagcggcctagttcggcaaggcgacatcacttgggtcctaccctaaagcctactcttgcaactcggaccgctcagccagatcatacacaagcccccacaaaacaagaggctggggggggcttcgtcttgccacctcccgggaccgatttggtgttcctcagagagggcgccagttctcctgttcaggttccagggccagtggcggcctctaccgaggccctcttgcaagaggcccagtgttctggcttatcatgggttgtcgcactgccacaggtcaaacaggagaaggccgatacacaagacgagtggactcctggcaccgctgtactgacttctcctgtcctcgtgccgggttgtcctagcaaggcggttgaccctggtcttccatctgtgaagcaggaacctcctgatccggaggaggacaaggaagagaataaggacgattccgcctctaagcttgcccctgaagaggaagcagggggtgccgggacaccagtgatcacagagatcttcagtctagggggcactcggtttagagacacagcagtgtggctgcctcgctccaaagacctgaaaaagcccggagctcggaagcaatag

SEQ ID NO: 124167 - DNA, 1704 bp, Artificial Sequence
  Description of Artificial Sequence: Synthetic coding sequence
atggctgaggattggctggattgccctgcattaggtccagggtggaagcgaagggaggttttccgcaagagcggcgctacgtgtggcaggagtgacacttattaccagtcacccactggagatagaatcagatcaaaggtggaactcacgaggtacctgggtccagcgtgtgacctgaccctcttcgactttaaacaaggcatactctgttatcctgcacccaaagcccatcccgtggctgtggctagtaaaaagaggaaaaagccctctagaccggccaagactagaaagaggcaagtgggtccccagtccggcgaggttaggaaggaagcgcctagagacgagactaaagctgacaccgataccgcccccgcctcctttcctgctccgggctgttgtgaaaactgtggtataagcttttccggcgatggaacgcagagacagcgcctaaagacactttgtaaagattgccgcgcgcaacgcatagcattcaatcgagagcagcggatgttcaagtcacgcggctgtggggtatgccgaggatgtcagacccaagaggattgcggccattgtcctatctgcctgcgacctcctcgccccggactgagacgacagtggaagtgtgtgcagcgccgatgtctccgtggcaagcatgcgcgccggaagggcggctgcgattctaaaatggccgcccgaagacgtccaggcgctcagccactgcccccaccaccaccgtcacagtcccctgagcccaccgagccgcatccgcgcgctctcgcccctagcccccccgccgagtttatttattattgtgttgatgaggacgaactaccttatacaaaccgccggcaaaatagaaaatgcggagcatgtgccgcttgcctcagaaggatggattgtggccggtgcgacttttgctgtgacaagcccaaattcggaggctcaaaccagaagcgacaaaaatgccggtggaggcagtgcctccaattcgctatgaagcggctgctgccctccgtctggagtgagtccgaagatggggccggttcaccacccccttataggagaagaaaacggccgagctctgccaggagacatcacctcggccctactctgaagcccactctggctactcgcaccgcccagcctgatcacacccaggctcctacaaagcaggaggcggggggtgggttcgttctgccaccacctggcacggatctagtcttcctcagagaaggtgccagcagccctgtgcaagtaccgggccccgtggccgcctccacggaggccctgctgcaggaggcgcagtgcagcggcctttcctgggtcgtggctctcccccaggtaaagcaagagaaggccgacacgcaagatgagtggacccctggaaccgccgtgctcaccagtcccgttttggtgcccggctgtccttcaaaggccgtagatccaggcctgccatccgtgaagcaagaacctcctgaccctgaggaggataaggaggaaaacaaggatgatagcgcttccaaattggcgccagaagaagaggccggtggggcgggtacacccgtcatcaccgagatcttctccttgggagggacacgcttcagggacacggccgtttggttacctcgctactaccacctggccctggattggaagtgcaactgcggctatcatctgtgctgcaggagcgtcctcgtgccatag

SEQ ID NO: 124168 - DNA, 1608 bp, Artificial Sequence
  Description of Artificial Sequence: Synthetic coding sequence
atggccgaggattggttggactgccccgctcttggccccggctggaagagaagagaagtcttccggaaatctggggccacttgtggtcggtctgacacttactatcagtcacccacaggagatagaattcgctctaaagtcgagctaaccaggtatctgggacctgcgtgcgacttgaccctattcgactttaaacagggcatcctgtgctatcctgcccccaaagcccaccccgtcgcagttgcttctaagaagagaaaaaaaccgtctaggccagctaaaactagaaaaaggcaggtgggcccccagtctggcgaggtgaggaaggaagcaccgcgggacgagactaaagccgacactgacacagcccccgcaagcttccccgcccccggctgctgcgaaaattgcggcatcagcttcagtggcgacggaactcagaggcaaaggttaaagaccttgtgtaaggactgcagagcgcagagaatcgccttcaatcgggagcagagaatgttcaagcgggtgggatgtggagagtgtgccgcctgtcaggtcactgaggattgcggcgcttgcagcacatgtctccttcagttgccccatgatgttgcctcaggcctgttctgcaagtgtgagaggcggcgttgtctgagaatagtcgaacgatcgaggggctgtggggtgtgtagaggatgccagacccaggaagactgtgggcactgccccatctgtctgaggcctccccgtccaggcttacgaaggcagtggaagtgtgtgcagcggcgctgcctaagggggaagcacgctaggagaaaggggggctgcgatagtaaaatggctgctaggcggcggccaggcgcccagccactgccgcccccaccgccctctcagagccccgagccaacagagcctcatccccgtgcccttgcacctagcccaccggccgagttcatctactattgcgtggacgaggatgagctgaaaagactgctgccgtcagtgtggtccgagagcgaggacggcgctggttcccctcccccttacaggaggcgcaagcgcccctcaagcgcccgaaggcatcatctcggtcccaccctgaaacctacactcgcaacacgtacggcacaaccagaccatactcaggcacctaccaaacaggaagccggtggtggatttgttcttcccccgcctggaacagacctggtctttctaagagaaggagcatcgagcccagtccaagtgcctggtccagtggccgcatccacagaggccctcctgcaagccgtcgaccctggcctgcccagcgttaaacaagagccgccagatcccgaggaagataaggaggagaataaagatgatagcgcaagcaagctggcgccagaggaggaggctgggggagccggcactcccgtgattaccgagatcttcagtctaggcggcacacggttccgggataccgcggtgtggctccctcgggccggtaccagagaaggaaagatggatgtgaaatgcggtcggcctcgcacccaatggagcccgcgcgctcgtgccggcacacatgaggatggtctggagcccatgtcggtcagtcatcatttacagctaaggtag

SEQ ID NO: 124169 - DNA, 1968 bp, Artificial Sequence
  Description of Artificial Sequence: Synthetic coding sequence
atggctgaagattggctggactgccctgctctgggaccagggtggaaaagaagagaagtttttcggaagagcggcgccacatgcggtaggagcgatacctactatcaaagccctacaggcgatcggatccgtagtaaagtcgaactcacacggtatctgggacccgcatgcgacctgacactctttgattttaagcaggggattctgtgttaccctgcgcccaaggcccaccccgtggcagtggcctcaaagaagaggaaaaagcccagccgccccgcgaaaactcgcaaacgacaagttggtccgcagtccggagaggtgcgtaaggaggctccccgggacgagacaaaagccgacactgataccgccccggcaagctttcctgcacctggatgttgcgagaactgtggaattagtttttccggcgacggaacgcagaggcagcggctgaaaaccctgtgcaaggattgcagagcccagcgcattgcctttaacagggagcagaggatgtttaagcgggttggttgcggagagtgcgccgcatgtcaagtaactgaggactgtggagcttgctccacctgtctgctccagctcccccatgacgtggcctccgggcttttctgtaaatgcgaaagaagacgatgcctcagaatagtagagcggagccgcgggtgcggggtgtgccggggctgtcagacgcaagaggactgcgggcattgtccaatatgcctccgccctccgagacctggactgaggcggcaatggaagtgcgttcagaggcgttgtttgagggggaagcacgctagaaggaaaggtggttgcgacagcaagatggccgctagacgcagaccaggtgcccaacccctgcctcctccaccacccagtcagtccccagagcccaccgagccccaccctcgagcgctggctccatcccctcccgcagagtttatctactattgcgtggatgaggatgagttgcagccatataccaaccggaggcagaaccggaagtgcggtgcttgtgcggcctgtttgcgtcgtatggactgtgggcggtgtgacttttgctgtgacaagccaaagttcgggggcagcaatcagaaacgccagaagtgcaggtggagacagtgtctgcagttcgcaatgaaaagactgttacctagtgtgtggagtgaaagcgaagatggagctggatcccctccaccgtatcgtcgcaggaaaagaccatcatctgctaggaggcatcatctggggcccacactcaaaccaacactggccacaagaactgcacagccggatcatacacaagcccccacaaaacaggaggccggaggcggtttcgtgttgccccctcctgggactgatctggtgtttcttagggaaggcgcaagtagtcctgtgcaggtgcccggaccagtcgccgcgagtaccgaagctctgctccaggaggctcagtgtagcggcctgagctgggtggttgcactgccccaggtcaagcaggagaaggcagatacccaggatgagtggaccccaggcaccgccgtcctgacgagccctgtcctggtgccaggctgtccatccaaagccgtggatcccggcctgccaagcgtcaaacaagagcctccggatcctgaagaagataaagaggagaataaggacgatagcgcctccaagctcgcccctgaggaagaagccggtggggccggcacccctgtcattaccgagatcttcagcctcggcggcacacggttccgagacactgcagtttggttgccgagcctacaggggaggcacagcggtcgtgaagatggctgtaaggtctgggagaccgaggacaccgttgagccaaccagcacatcttggaatccccgggggtggcccgggacgcacgtctctctgagcccgccccccgctagtatgatgtgggttagttgcaggcgctcatggtgtcccagcagtcagtcttag

SEQ ID NO: 124170 - DNA, 1236 bp, Artificial Sequence
  Description of Artificial Sequence: Synthetic coding sequence
atgagggcccaccctggcggcggaagatgttgccctgagcaggaggagggtgaatctgcagcaggaggatcaggcgctgggggtgatagtgcaatcgagcaaggtggacaaggttccgccctcgcccctagcccggtttccggtgtgcggcgcgaaggtgcaagaggaggcggccgggggcgaggccgatggaagcaggccgggaggggaggtggcgtctgtggaaggggccgcggcaggggccgcgggcgcggcaggggtagaggccggggacgtggtcggggcaggccgccttcgggtggaagcgggctaggaggagatgggggtggctgtggcggaggtggcagcggtggcggaggggcaccccgccgggagcctgtcccttttccctccggctctgctggacccggaccgagaggacctagggcaacggaatctgggaaacgtatggattgtcctgctctaccgcctggatggaaaaaagaggaagtgattaggaagtcaggcttaagtgccggcaaatctgacgtgtattatttctcaccatccggcaagaagttcaggtccaagccgcagctcgcccggtacctaggaaacacagtcgatttgagtagcttcgatttccggaccgggaaaatgatgcccagtaaactccaaaagaacaagcagagattacgaaacgatccccttaaccagaataaggggaaacccgaccttaacactaccttgcctatcaggcagacagccagcatcttcaagcagccggtgaccaaggtgactaaccatcctagtaacaaagtgaagtcagacccacagagaatgaatgagcagccgaggcaactgttttgggagaagaggctccagggcctctcagcttccgacgttactgagcagattatcaaaaccatggaactgccaaagggcctgcaaggagtcggtccaggcagcaacgatgagacacttctatcagccgtggcctccgccctgcacacctcttcagcaccaataactgggcaggtgagcgcagctgttgaaaaaaatcctgctgtgtggctgaacacttctcaacctctctgcaaagcgttcatcgtcacagatgaggatattcgaaaacaggaagagcgggtgcaacaagtgaggaaaaagttggaggaggccctgatggcggacatcctttcaagagccgctgatacagaggagatggatatagagatggactccggcgatgaggcatag

SEQ ID NO: 124171 - DNA, 909 bp, Artificial Sequence
  Description of Artificial Sequence: Synthetic coding sequence
atgagagcacatcccggaggagggcgttgctgtcccgagcaggaagagggcgaaagcgcggcaggtggatctggtgctgggggagattcagctatcgaacaagggggtcaaggatcggctctggcccctagccccgtgtctggggtcaggcgcgagggagcgagagggggaggaagggggcggggcaggtggaaacaagctggacgggggggcggagtatgcggtagaggacgcgggcgcggacggggccggggcagaggcagggggagagggcgtggaaggggtcgaccacccagcgggggctcgggtctcggtggcgatggaggaggttgtggaggcggcggctctggcggagggggagctccacgccgggagcccgtcccattcccctcaggcagcgccggacctggcccacgtggccccagagcaaccgagtccggaaaaagaatggactgcccggctcttcctcccgggtggaaaaaggaggaagttatacgcaagagtggactctctgccggcaagtctgatgtgtactacttcagcccgagcggcaaaaagttccggtcaaaaccacaactggcgcggtacctggggaacaccgtggatctgagctccttcgattttagaacaggtaagatgatgccctctaaactgcagaagaacaagcagcgactcaggaacgatcccctgaatcagaataaattgcgctggaatacacataggcccgcaccatggcatgcactgtcacgcttgtgtttattgatccggtgcctgctctgcttggaatgcgcctacccactgccgctccatctggttaattcatactcgagtaagacgcagctccactgtctgcacctctgggaggcctgccccgcatacagcaggcagaatcagagctttccaccctag

SEQ ID NO: 124172 - DNA, 909 bp, Artificial Sequence
  Description of Artificial Sequence: Synthetic coding sequence
atgcgggcccaccccgggggtggcaggtgctgccccgaacaggaggagggtgaatctgccgccggtggaagcggagctggtggggactccgctatagagcaaggtgggcaggggtcagccctagccccctctcccgtcagtggcgttcgaagagaaggcgccagaggcggaggaagggggcgcggccgctggaaacaggctggaagagggggaggggtgtgtggtcggggtagaggccgcggccgaggccgcgggcgcgggaggggaaggggcagggggaggggccgacctccatccgggggcagcggtctgggtggtgatgggggtggctgcggaggcggcggaagtgggggcgggggggcccctcggagagagcccgtcccctttccgtccggctcagccggccccggaccgcggggaccacgggctacagagtccggcaaaaggatggactgccccgctctgccccccggttggaaaaaggaagaggttatccgcaagtctggcttaagtgccgggaaaagtgacgtgtactactttagtcctagtggcaagaaatttcgtagcaagccacagctggcaaggtatttggggaatacagtagacttatctagttttgactttcgcaccggaaaaatgatgccctctaagcttcaaaaaaacaagcagcggctcagaaacgaccctctaaaccagaacaaacttaggtggaatacccaccgccccgctccatggcatgctctctcacgactttgcctgctgatccggtgtctcctgtgtctggagtgcgcataccctcttccgctgcatttagtgaatagctattccagcaagacccaactgcactgcctgcatctgtgggaagcatgtccggcctacagccggcagaatcagtcattcccaccttag

SEQ ID NO: 124173 - DNA, 876 bp, Artificial Sequence
  Description of Artificial Sequence: Synthetic coding sequence
atggagcgcaagcgttgggagtgtcccgcccttcctcagggttgggaaagggaggaggtccctcggcgcagcgggctgagcgctggccacagggacgtgttttattacagcccatctggcaaaaagtttagaagcaagccccagctcgcccgatacctcggaggctctatggacctctccacttttgactttcgcacaggcaagatgctgatgtcgaaaatgaacaagtctaggcagcgcgtgcggtacgactcttcgaaccaggttaagggaaaacccgacttaaacaccgctttacctgtgcgccagacagccagtatctttaagcaaccagtgacaaaaatcaccaaccatccatcaaataaggtgaagtcggacccacagaaggccgtggatcagcccaggcaactcttctgggagaaaaaactgtctggactgaatgcctttgatatagctgaagagctcgtcaaaactatggatttgccaaagggtttgcagggggtcggtccagggtgtaccgacgagacactgctctctgccatagcaagtgcactgcatacctcaaccatgcctatcaccggccagctgtccgcagcggtggagaagaaccctggagtgtggttgaatacgacacagccgctctgtaaggccttcatggttactgatgaggatatccggaaacaagaagagttggttcagcaggtaagaaagaggctagaggaggccctgatggctgacatgttggcacacgtcgaggagctcgccagggacggcgaggcacccctcgacaaggcttgtgctgaggacgacgacgaggaggacgaagaggaggaagaggaagaacccgaccctgatcccgagatggagcacgtgtag

SEQ ID NO: 124174 - DNA, 780 bp, Artificial Sequence
  Description of Artificial Sequence: Synthetic coding sequence
atggaacgtaaatccccctcaggaaaaaaattcagaagcaaacctcaactggctaggtatttgggcggcagcatggacttgagcacttttgattttcgtaccggcaagatgctgatgtcgaaaatgaataaatcaagacagcgcgtccggtatgactcctccaatcaggtgaaggggaaacctgacctaaataccgccctgcctgttcgccagacagcgtcaatcttcaagcagccagttacaaagatcacaaaccatccttcaaacaaagtcaagtctgatccgcagaaagcggtggaccagcccaggcaactattctgggagaaaaaactgtctggtctgaatgcgtttgacatcgccgaagagttggttaagaccatggacctgcccaagggactgcagggtgtcggtcctggatgtacagatgaaactctgttgagtgcgatcgcttccgccttgcacacctccaccatgcctattactggccagctgagtgcagctgtggaaaagaaccccggcgtgtggctcaacaccacacagccgctctgcaaggcattcatggtaaccgacgaggacatccgaaaacaggaggaactggtgcagcaggtgagaaagagactggaggaagcactgatggctgatatgctggcgcacgtagaggagctggctcgtgatggcgaggcgccccttgacaaggcctgtgccgaagacgacgatgaagaagatgaggaggaggaggaggaagagcccgaccctgacccagagatggagcacgtatag

SEQ ID NO: 124175 - DNA, 4485 bp, Artificial Sequence
  Description of Artificial Sequence: Synthetic coding sequence
atgaacggcggaaaggagtgtgacggtggggacaaggaaggcggactccctgccatccaggttccggtcggttggcagcggagagttgaccaaaacggggtgctctatgtctctccaagcgggtcacttttaagctgtctggagcaagttaagacatacctgctgaccgatggaacctgtaaatgtggtctcgagtgcccgctgattctcccaaaagtttttaactttgatcctggcgcagccgtaaagcagagaactgccgaagacgtgaaagcagacgaagatgtaacgaaattatgcatacacaagcggaaaattatcgcagtggccactctccataagtctatggaagccccacacccctccctcgtcctgacctcccctggcggcggaactaatgctacgcccgtcgttccgagcagggccgccacacctcgatcagtaaggaacaagagtcacgaggggataacaaatagcgttatgccagagtgtaagaatccctttaaacttatgattggaagcagtaatgccatggggcgactttatgtgcaggagctcccaggcagccagcagcaggagctccaccccgtgtacccaagacagaggctcggttctagtgaacacggccagaagtcacctttcaggggatcccatggtggcctcccctcccccgcctctagtggatcacagatatatggcgacggctcaatcagcccccggactgaccctttggggagtcccgacgtgtttacccggagcaaccccggcttccatggcgctccaaacagttcaccaatccacttgaacagaaccccccttagtcccccctccgtcatgcttcacgggagtcctgttcaaagctcctgcgctatggccggccggacaaacatccccctctccccgaccctcactaccaaatcccctgttatgaaaaagcccatgtgtaacttcagcacaaatatggagatccctagggccatgttccaccataagccaccccagggccctccaccgcctccccccccaagttgcgccctccagaagaaacccctgacaagtgagaaggacccgctgggtattttggatcccatcccctccaagcccgtgaatcagaatccagtgataattaacccgacctcattccacagcaacgttcatagccaggtgcccatgatgaacgttagtatgcctccagcagtagtccctctaccttctaaccttcccttaccgacagtgaagccagggcacatgaaccacggctctcacgtgcagagagttcagcacagtgcctccaccagtctcagcccctctcctgtaacctcccccgtccatatgatggggaccggcattgggcgaatcgaagccagccctcagcggagcaggtcttcgagtacatcttccgatcacggcaacttcatgatgccccccgtggggccccaagctacgtcaagcgggattaaggtgccgcctaggagtccccggtccacaatcggttcacctagacccagcatgcctagttccccctccacaaagtctgacggacatcatcagtacaaggacattcccaaccctctcattgccgggatttcgaacgttctgaataccccaagcagcgctgctttccctaccgcctcagcgggcagcagctcagtcaagagccaacctggcctgctcgggatgccactgaatcagatcttgaatcagcataacgccgccagcttcccggccagtagcttactgtccgctgctgccaaggctcagctggccaaccaaaacaagctagcaggcaacaactcatccagcagctccaattcgggggctgtagctggctccggaaacacagaggggcacagtaccctcaatacaatgttccccccgacagccaatatgttgcttcccaccggagaaggtcagtcgggccgcgccgccctgcgagacaagttgatgtcccagcaaaaggacgcccttcgcaaacgcaagcagccccccaccaccgtgctctcactgctcagacaaagtcagatggactcatccgctgtgcccaaacctgggcctgacctgctgagaaagcaaggccaagggtcgtttcccatctccagcatgagccagttgctgcaaagtatgtcctgtcagtcctctcacctctcttccaattccaccccgggctgtggggccagtaatactgctctgccatgctctgctaaccaactccactttaccgaccccagcatgaattcttccgtgcttcagaacattcccctgcggggagaggcagtgcactgccacaatgctaacacaaatttcgtgcattcaaactcacctgtgcctaatcaccatctggctgggctgattaaccagatacaggcttccggaaattgtggaatgctaagccaatctggtatggctctcggcaactcacttcacccaaaccctccccagagtcgaatctctacgtccagtaccccagtcatcccaaattccatcgtttcctcttacaatcagacttcaagtgaagcagggggcagtggtcctagtagctctattgcaatagctgggactaatcacccggctataactaagactactagcgtgctgcaagacggtgtaatagtcacaaccgcagctggaaatccgcttcagagccagctccctattggctccgactttccctttgtaggtcaggaacacgcattacatttcccctctaattccacctcaaacaatcatctaccccaccctttgaatccttctctgctctcgtcactgcctatttcgttaccagtgaatcagcagcacctcctgaatcagaacctcttgaatattctgcagccatctgctggggagggggatatgagctccattaataacactctgtctaaccaccaactcacccatctgcaatctctgttgaacaataaccaaatgtttcccccaaatcagcagcagcagcaactgctccagggctaccagaatttgcaggcatttcagggacaatccacaatcccgtgtccagccaacaataacccaatggcttgtcttttccagaattttcaggtgcggatgcaagaggacgcagccctgctcaacaaacgaatcagtacccaacccggtttgactgctctgcccgaaaatccgaatacaacactgccaccattccaggacactccatgtgagctgcagccccgaatagatcctagcttgggccagcaggtgaaagacggcctggtcgtcggaggcccaggcgacgcgagcgtggacgctatctacaaggctgttgtggacgctgccagtaaggggatgcaggttgtgatcaccactgcggtgaactccaccacccaaatcagtcctatcccggctctgagcgccatgtccgccttcaccgccagcatcggagacccactgaatctgagcagtgccgtgtcagcggtgatccatggcaggaatatgggtggagttgatcatgacggtagactcagaaactcccgcggcgcccggctccccaagaacctggatcatgggaagaatgtgaacgagggcgatggattcgagtattttaagtccgctagctgccacacatcgaagaagcagtgggacggtgagcagagtcctcgtggcgagcgcaatcgctggaagtatgaggagttcctcgaccatccgggacatattcattcttccccttgccacgagaggcccaacaacgtgtccacgctccccttcctgccaggcgaacaacacccgatcttgctccccccccgcaattgtcctggagataaaattttggaggaaaatttcagatacaataactacaaaagaactatgatgagctttaaggaaagactcgagaacacagttgagagatgtgcgcatataaatggcaatcgtccccgtcaatctagaggcttcggtgagcttctgtcaaccgccaagcaagacctggtcctggaggaacaatccccaagctcctctaactcccttgagaattcattagtgaaggattacatccattacaacggggatttcaatgctaagagcgtgaacggttgcgtaccaagcccttccgacgccaagtcgatcagttcggaggacgacctgaggaacccggatagcccctcaagcaatgaactgatccactacagaccacgcacatttaatgtgggagacctcgtttggggtcagatcaagggactcacctcctggcctggcaaactggtgcgggaggatgacgtgcataactcgtgtcagcaaagcccagaagaaggcaaagtagagccagagaagcttaaaactctaactgaggggctcgaggcatatagtagagtcaggaagagaaataggaagagcggaaagttaaataaccatctggaggccgccattcatgaagcgatgtcagagctggataagatgtcagggaccgtgcatcagattccacagggggacagacagatgaggccacctaagccaaagaggcggaaaatatcacgatag

SEQ ID NO: 124176 - DNA, 2178 bp, Artificial Sequence
  Description of Artificial Sequence: Synthetic coding sequence
atggccgcggcctcagcagtgtctgtcctacttgtggctgctgaaaggaaccggtggcataggcttccaagtctgcttctacctccgaggacgtgggtatggcgccaaaggacgatgaaatacacgaccgccaccggcaggaacataacaaaggtgctgatagcaaaccgcggcgaaatcgcttgccgggtcatgcgcacagccaaaaagctcggggtgcagaccgtggctgtctattccgaggcagatcgcaattcaatgcatgttgacatggccgacgaggcgtattcgataggccctgctcccagccagcagagctacctatcaatggagaagatcatccaagtggctaagactagtgcagcccaggctatccaccccggctgtggctttctgtccgagaatatggaatttgcggagctgtgcaagcaggaaggcattatattcatcgggccgcctcctagtgctattcgggatatgggcattaagagcacctctaagagcattatggcagcagctggagttccggttgtcgagggatatcacggcgaggaccagtcggatcaatgtctgaaagaacacgcccggcgcatcgggtatcccgtcatgatcaaggcagtgagaggaggtggtgggaaaggcatgagaatcgtaaggtccgagcaggaatttcaggagcagctcgagagtgcccgaagggaggctaagaagagcttcaatgatgacgcaatgcttatcgagaaattcgtggacaccccgagacacgtggaggttcaggtgttcggcgatcaccacggaaacgccgtgtatttgttcgagcgcgattgctctgttcagaggaggcaccagaaaatcatcgaggaggcccccgctcccgggatcaaatctgaggtccgaaagaaactaggagaagctgcagtgcgcgctgctaaggccgtgaactacgttggtgcaggcactgtggagtttataatggacagcaaacacaatttctgcttcatggagatgaatactaggctccaggttgagcacccagtcaccgagatgattacagggacggaccttgtggaatggcaactgcgcatcgctgcgggcgagaagattcccctctctcaggaggagatcacgctccaaggtcacgctttcgaagcacgcatttacgccgaagacccatcaaataattttatgcccgtggccggcccacttgtgcacctgtccacgccacgtgctgacccatcgaccaggatagagactggggtgcgccagggagatgaagtcagcgttcactatgaccctatgattgctaagctcgtggtgtgggctgcagatagacaggcggccctgaccaagctgcggtacagcttgagacagtacaacattgtcggacttcacacgaatatcgattttttgttgaacctgtccggccatcccgagttcgaggctggcaacgtacacaccgacttcattcctcaacaccataaacagctgctgctgtcccgaaaagccgctgctaaagaatcgctttgccaggccgccctgggcctgatcttgaaggagaaagccatgaccgacaccttcacgctacaagctcatgatcagttcagtccattttcctcttcaagcggccgcagattgaacatctcatacacccgaaacatgactttaaaggacggaaagaacaatgtggctatcgctgtaacttacaatcacgatggctcatattccatgcaaatcgaggataagacctttcaggttctgggcaacctgtattccgagggtgattgtacctatttaaagtgtagtgtgaatggggtggcttctaaagccaagctcatcatcctcgagaacacaatctatttgttctccaaagagggctccatcgaaatcgacatacccgtgcctaagtatcttagctctgtgtcctcccaagagacacaaggtggtcctcttgcccctatgactggaaccatcgaaaaagtgttcgtaaaggctggcgataaggtaaaggctggcgattcactgatggtgatgattgctatgaaaatggagcacacaataaaaagtccaaaggacggcaccgtgaaaaaagtcttttaccgcgagggagcgcaggccaatcgtcataccccacttgtagagttcgaggaggaagagagcgacaagcgtgagagcgagtag

SEQ ID NO: 124177 - DNA, 1728 bp, Artificial Sequence
  Description of Artificial Sequence: Synthetic coding sequence
atggagaagatcatacaagttgctaaaacttcggcagctcagcatattcagagtatcatggccgccgctggtgtccctgtagttgagggttatcatggggaggatcagagcgaccagtgccttaaggaacacgcacgtcggattgggtaccccgtgatgatcaaagcagtccgggggggagggggaaaaggcatgcggatcgtccgctctgagcaggaatttcaggagcagctggagtccgcccgccgggaggcaaaaaagtccttcaacgacgacgctatgctgattgaaaagttcgtcgacactcccagacatgtcgaagtccaggtgtttggtgaccaccatggaaacgcggtctacctgttcgaaagggattgctcagttcagcggagacatcagaagattatcgaggaggcacccgcacccggtatcaaatctgaggtgaggaaaaagcttggcgaggctgccgtacgcgcagcaaaagcagtgaactatgtaggcgctggcaccgttgagttcattatggacagtaagcataacttctgtttcatggaaatgaatactcggttgcaggttgagcacccagttacagaaatgattactggcacagacttggttgaatggcagcttaggatcgccgcgggggagaagatcccactgtcacaggaggaaatcacccttcaaggacacgcctttgaggcgaggatctacgcagaggaccccagcaacaactttatgcctgtcgcaggacccctggtgcacctttccactcccagggcggacccctctacccgcatcgaaactggagttagacagggtgacgaggtgtcagtccattacgatcctatgatcgctaaactcgtggtttgggctgcagacaggcaagctgcactcaccaaactgcggtatagcttgcggcagtacaatatcgtgggcctgcacactaacatcgactttctgctgaaccttagcggccatcctgaatttgaagctggtaacgtccacactgactttatcccacaacaccataagcagctgctcctgtctcgaaaggcagccgccaaggagagcctgtgccaggcggcccttggcctgatcttaaaggaaaaagcgatgacagacacttttaccttgcaggctcacgaccagtttagccccttctcttcctctagtggccgacggctcaacatctcatatacacgaaatatgactctgaaagatggcaagaataacgtggcaatagctgtcacatacaaccacgacggatcatactctatgcagatagaggataagactttccaagtactgggaaatctctattcggagggagactgcacctatcttaaatgctcggtcaatggtgtggcaagtaaggctaagctcataatccttgagaacaccatttacctgttttccaaggaaggcagtatcgagattgatatccctgtccctaaatacctctcctcagtgagttcacaggaaactcaggggggcccactggcgcctatgacgggaaccatcgaaaaggtattcgtgaaagcgggcgataaggtcaaagcaggtgattcactaatggtgatgattgccatgaaaatggaacataccatcaagtcacctaaagacggaacggtgaagaaagttttctaccgagagggcgcacaggctaacagacataccccacttgttgaatttgaggaggaagagtccgataagagggagagcgagtag

SEQ ID NO: 124178 - DNA, 1425 bp, Artificial Sequence
  Description of Artificial Sequence: Synthetic coding sequence
atggccgcagcaagcgcagtgagtgtcttactggttgccgctgaacggaatcgctggcataggctgccaagtctgcttctgccacctcgtacctgggtgtggaggcaacggaccatgaagtataccacagcaaccgatgaagcctacagcatcggacctgccccttcccagcagtcatatctttctatggagaaaatcatacaggttgcgaagacttccgcagcccaggcaattcatcccgggtgtggcttcctgagcgaaaatatggaatttgccgagctgtgcaagcaagaaggaatcatattcattggaccacctccttccgcaatcagggacatgggcatcaagagtactagtaagagtattatggccgctgccggtgtgcctgtagtggagggctaccacggggaagatcagtctgatcagtgcttaaaggagcacgctaggcggatcggttaccctgtgatgattaaggcggtcagggggggtggtggaaagggcatgcgcatcgttcggagtgagcaggaattccaggagcagctggagtccgcgcgtcgagaagccaaaaaatctttcaatgatgacgcaatgcttatcgagaaatttgttgacaccccaaggcatgttgaagtgcaggtatttggagatcaccatggcaatgcggtctatctcttcgagagagactgctcggtgcagcgcaggcatcaaaagattatcgaagaggccccagctccagggattaagtctgaggtgcggaagaagctgggtgaagccgctgtccgggcagccaaagccgtgaactacgtcggagccggcactgtagaattcattatggattccaagcataacttctgctttatggaaatgaacacgagactgcaggtggagcatccagtgactgaaatgatcacaggtacagatctggtggagtggcagcttaggatcgctgctggggagaaaatccctttatcacaggaggagattacgctgcaggggcacgcttttgaagccagaatttacgccgaggatccttccaataattttatgccagtggctggaccacttgtgcacctttccacgcctagagctgatccttccaccagaatcgagactggcgtaaggcagggcgacgaggtcagcgttcactacgatccgatgatcgccaagctggtcgtgtgggccgcggacaggcaggcagctttaaccaagctaagatactcattgcgccagtacaatatcgtagggttacacacaaacctgactagctactcgacctgcttagccactcagagcctcaagctagggacgtgtaccctaatttcctccctcaacaccactaacagttgctgcagtgtggggcggctgcagccaaaatcactgtatgcccggcaaccttgggtatcctcatctagacgaaagccctag

SEQ ID NO: 124179 - DNA, 1281 bp, Artificial Sequence
  Description of Artificial Sequence: Synthetic coding sequence
atggaatttgctgagctctgtaaacaggagggaatcatattcatcgggccccctcccagtgctattcgagatatgggtattaaatcaacatcaaagtctattatggccgcagctggggtcccagttgtggaagggtatcatggcgaggatcaaagcgaccagtgcctcaaggagcacgcccggcggatcggatatcccgtgatgatcaaggccgttcgaggagggggaggcaaaggtatgaggattgtgcgctccgaacaggagttccaggagcagctggaatccgccaggagagaggcaaaaaaaagcttcaatgatgacgccatgttgattgagaagtttgtagatacccctcgccacgtggaggttcaggttttcggagatcaccatggtaacgcagtctacctatttgaaagagactgctcggtccaacgtcgtcaccagaagatcatcgaggaagcaccagccccaggcataaagagcgaagtgcggaagaaactgggcgaagcggcggtgagagccgccaaagctgtgaactacgtgggggcaggcactgtcgaattcatcatggactccaaacataacttttgttttatggagatgaacacccgcctgcaggtagaacaccctgtaactgaaatgatcaccggcaccgatctcgtcgagtggcagctacggatcgctgccggagaaaaaatccccctgtctcaggaagaaataaccctgcagggtcacgctttcgaggcccgcatctatgccgaggacccgagtaataatttcatgcccgttgccgggccactggttcacctgtcgacaccaagggcggatccaagcactcgtatagagacgggggtgcgccagggggatgaggtttctgtgcattatgatccaatgattgctaagctggttgtctgggccgccgacaggcaggccgcgctgacgaaactgagatactccctgaggcagtataacatcgtggggctccatacaaacattgattttctcctaaatctctctggccaccccgagtttgaggccggaaacgtgcataccgattttattccacagcaccacaagcagctgctgctgtcacggaaggccgccgctaaggagtctctctgtcaggcagctctcggtctaatcctgaaggagaaggccatgactgacacgttcactctgcaggcacatgaccagtttagcccattcagttcctcttccggtcgccgcctaaacatttcgtacactaggaacatgactctcaaagatggaaagaacaactag

SEQ ID NO: 124180 - DNA, 603 bp, Artificial Sequence
  Description of Artificial Sequence: Synthetic coding sequence
atggagaagatcatccaagtagccaagacttcagcagcgcaggccatacatccaggctgtggcttcctgtcagaaaacatggaatttgccgaactgtgtaaacaggaaggtattatttttattggtcctccaccaagcgccatacgtgatatggggatcaagtcaacatctaagtccattatggctgcggctggtgtacctgtggtggaagggtatcatggcgaggaccagtctgaccagtgcctgaaggaacacgcccggcgaataggatatccagtcatgatcaaagccgtccgagggggcgggggtaagggcatgaggatcgtccggagcgagcaggaatttcaggaacagctggagtccgctcgccgcgaggcaaagaagagcttcaacgatgacgcgatgttaatagagaagtttgtggataccccgaggcacgtggaagtccaggtgtttggcgaccaccacgggaatgctgtgtacttgtttgagcgggattgctccgttcaaagaagacaccagaagattatcgaggaagcccctgcacctggtattaaaagtgaagtgcggaagaagggacgcagttgtagtcagtcctgttag

SEQ ID NO: 124181 - DNA, 1578 bp, Artificial Sequence
  Description of Artificial Sequence: Synthetic coding sequence
atgtgggccgtgttgcgtctggcattgcgcccatgcgcgcgtgcaagcccagccggtcctcgagcctaccatggcgattctgtcgcatctttgggaacgcaaccagatctgggctcagcgttgtaccaggaaaactacaagcagatgaaggctctggtcaaccaactgcacgagcgggtagaacatattaaattggggggaggggaaaaggcccgggcgctccacatcagtcggggaaaactgctccccagagaaaggatcgataatctgatagatcccggcagcccattcctcgagctgagtcagtttgcaggatatcagttatacgataacgaggaagtgcccggcggcggcattatcactggcatcggcagggtgagcggggtggagtgcatgatcattgccaacgacgctacagtgaagggtggggcctactatccagtaacagtaaaaaagcagttgcgcgctcaggagattgctatgcagaataggctaccttgtatttatctcgtagattcagggggggcctacttgcctcggcaagcagatgtatttccagacagagatcacttcgggcgaacattttacaatcaggctatcatgagcagtaaaaacatcgctcaggttaaagccgcgaccggggaggaggtgtccgcagaggacctgggtggggccgatctccattgccgaaagagcggggtgagcgaccactgggctcttgatgaccatcatgccctgcacctgacacggaaagtagtaagaaatttaaactatcagaagaaattagacgtgacaatcgagcctagcgaggaaccactctttccagccgacgagctgtatgggattgtgggggccaatctcaagcggagctttgacgtccgcgaagtgatcgcccgaatcgtggacggatcccgatttacagagttcaaggctttttacggcgacacactcgtgacagggttcgccagaattttcggctaccccgtgggtattgttggcaacaacggcgtcctgttcagtgagtctgccaaaaaggggactcacttcgtgcaactttgctgtcaaagaaatatccccctgctgtttctgcaaaacataacgggtttcatggtagggagagaatacgaggcagaaggcatcgccaaggatggagcaaaaatggtggcagccgtggcttgcgctcaagtgccgaaaatcacattgatcatcgggggttcctacggagctggaaattacggtatgtgcggccgggcgtattctccgcgttttctttacatctggcccaatgctagaatatcggtgatgggcggggagcaggcagcaaacgtactggcaaccatcaccaaagaccagagagctagggaggggaagcagttttcttctgctgatgaagcagcccttaaagaaccaattatcaaaaagttcgaggaagaaggcaacccttactatagctccgccagggtatgggatgacgggataatagaccccgcagatactcggctggtcctcggcttgtcgttttcagccgctcttaatgctcccattgaaaagaccgatttcggcatctttcgaatgtag

SEQ ID NO: 124182 - DNA, 1692 bp, Artificial Sequence
  Description of Artificial Sequence: Synthetic coding sequence
atgtgggccgtgcttcgcttggccctgcgcccgtgcgccagggcttctccagcaggccctcgcgcgtaccatggcgacagcgtagccagtctcggtacccagccggatctgggcagcgctctgtatcaggaaaattacaaacagatgaaggctttggtaaaccagcttcacgagagggttgagcatataaagcttggcggcggggaaaaggcccgcgccctccatattagccgtgggaaattgctccctcgagagagaatcgacaatctgatagaccccggttctccctttttagagttgagtcaatttgcaggctatcagctgtacgacaatgaagaggttccaggggggggaatcattactggcatcggcagggtgagcggagtggaatgcatgatcattgccaatgatgcaaccgtcaaaggtggggcatattatccggtcacagttaagaagcagctcagggctcaggagatcgcaatgcagaaccgactgccctgcatctatttggtcgacagtggtggcgcgtacctaccaaggcaagctgatgtcttccccgaccgagaccatttcggaaggaccttttacaaccaggccatcatgagcagtaaaaatatagctcagatagccgtagtgatgggctcttgcactgctggcggagcatatgtgccagccatggccgacgaaaacattatcgtaagaaagcagggaacaatcttccttgccggcccaccactggttaaggccgctaccggggaagaggtctctgccgaagatctcggtggagccgatctgcactgtaggaagagtggcgttagcgatcactgggcccttgacgatcatcacgcactgcatctcaccagaaaggtggttcggaacctgaactaccagaaaaaactggacgtgactatcgaaccctcagaggagcccctatttcccgccgatgagctctacgggattgtcggggcaaatctcaaacgctcattcgatgtgcgggaggtgatcgccagaatcgtcgacggcagtcggtttacggaattcaaggctttttatggcgatactttggtgacggggttcgctcgcatctttggatatcctgtcggaatagtcgggaacaatggtgtgctgttctcagaaagcgctaaaaagggcactcatttcgtccagctgtgctgtcagagaaacattcctctgctctttctccagaacatcaccggctttatggtggggcgcgagtacgaggccgaaggcatcgctaaggatggcgctaagatggtcgcagcggttgcctgtgcccaagtgccaaaaattactctgatcatcgggggctcatacggagcggggaactacggcatgtgtggtcgagcctattctccccggtttctttacatatggcccaatgcacgcatttccgtcatgggtggcgaacaggcagctaatgtgctcgccacaatcactaaggatcaacgggcccgcgagggaaaacaattctcgtcagctgacgaggctgcgctcaaggagcccattattaagaaatttgaagaagaaggcaacccgtactacagctccgccagagtttgggacgatggcataattgatccggcagacacaagactcgtgttgggtctgagtttcagcgccgcgttgaacgctcctatagagaagactgactttgggatattccgcatgtag

SEQ ID NO: 124183 - DNA, 870 bp, Artificial Sequence
  Description of Artificial Sequence: Synthetic coding sequence
atggctaagcacatccagaaggagatccagagaggcgtggagtcttgggtgtctctgggcaaccgcaggcctcaccttagcataatcctggtgggtgataatcctgcgtcgcatacctacgtcagaaataagatccgtgccgcaagcgccgtgggcatctgttctgagctcatccttaagcctaaagatgtgagtcaagaggagcttctagatgtgacagaccagctgaatatggacccacgtgtctcagggatcctcgttcagctccctctcccagatcacgtggacgagcggacaatctgtaacggtatcgcccctgagaaggatgtcgatgggttccatatcataaacataggaaggctctgcctcgatcaacactcgcttattccagctactgccagcgctgtatgggagatcatcaaacggacggggatacagacattcggcaaaaacgtcgtggttgccggtaggtctaagaacgtgggaatgccgatagcaatgctcttgcatacggacggtgaacacgaaaggccaggtggcgatgccaccgtcactatcgcccatcggtacacccccaaggagcaactgaaaatccatacacaactggcagacatcattattgttgcagcaggaatacctaaactaatcactagcgacatggtgaaggagggcgccgctgtgattgatgtgggaattaactacgtgcatgaccccgtgaccggcaaaaccaagttggtgggagacgtggattttgaagcagtcaagaagaaagcggggtttatcacccctgtgccggggggcgttggacctatgacggttgcaatgcttctcaaaaatacactgctggcggctaaaaaaatcatttattag

SEQ ID NO: 124184 - DNA, 672 bp, Artificial Sequence
  Description of Artificial Sequence: Synthetic coding sequence
atggctaagcacattcagaaagaaattcagcggggcgtcgaaagctgggtgtcactagggaacagacgaccacatctgtccatcattttggtcggggataacccggcttctcatacctacgtgcgtaataagatcagagcggcgagcgccgtgggcatatgttcagagcttatcctgaagcccaaagacgtgtctcaagaggagcttttagacgtaaccgatcagctgaatatggaccccagggtatctggtattctggtgcagttgccactgcccgaccatgtggacgaacgcacaatttgcaacgggatagcccccgagaaagacgttgatgggttccatattataaatattggacggttatgtctagaccagcactcactgatccccgcaacagcctctgcagtgtgggagataatcaaacggaccggaattcaaacctttggcaagaatgttgtggtggcgggccgcagtaaaaacgtgggcatgcctatcgctatgctgctgcacaccgacggcgagcatgagcgccccggtggggatgccaccgttacgatcgcccataggtatactcctaaagagcagctgaaaatccacacgcaactcgcagacatcataattgtggcggcagagcgttttcaccactttgcgcaggatcttagcaactcttag

SEQ ID NO: 124185 - DNA, 762 bp, Artificial Sequence
  Description of Artificial Sequence: Synthetic coding sequence
atggctaagcacatccagaaagaaatacaaagaggggtggaatcctgggtgtccctggggaatcggaggccacatctgagtattatactggtaggtgataatccagctagccacacatatgttaggaacaagatcagagccgcgtccgcggtcggcatttgcagtgaactcatcctgaagcctaaagacgtcagccaagaagaacttcttgacgtgactgaccaattgaatatggaccccagagtcagtggcatcctggtgcaattaccactgccagatcatgtggatgagagaaccatctgtaacggcattgcccctgagaaggacgttgatggctttcacatcatcaatattgggcgactttgtctggatcagcactccctaattcccgctacagcttcggctgtgtgggagattatcaaaagaactgggatccaaacattcggcaagaacgtggtggtggccgggcggtcaaagaacgtgggtatgccgatcgccatgctgttgcacaccgatggtgaacacgagaggccaggcggagacgcgacagttacgatcgcacatcggtatactccaaaggagcagctgaagatacacacacagctggctgacatcatcattgtggctgccggtatcccaaaacttatcaccagcgacatggtgaaagaaggagccgctgtgatcgacgtgggcataaactacgtacatgatccggtgaccgggaagaccaaattggttggcgatgtggatttcgaggcttag

SEQ ID NO: 124186 - DNA, 1044 bp, Artificial Sequence
  Description of Artificial Sequence: Synthetic coding sequence
atgaccgtgccggttagaggtttttctctgctcagagggcgtctcggacgagcccccgcactgggaagatcaaccgcaccctcagtccgagcaccaggagagccaggtagtgcttttcggggattccggtcatctggggtccgccacgaggccataatcatatccggcacagaaatggccaagcacattcagaaagaaatccagcggggcgtggagagctgggtcagcttagggaatcgcaggcctcaccttagcatcattctagttggtgacaacccagccagccacacttacgtgcgtaacaagattcgcgccgcgagtgcggttggtatatgcagcgaactgatactcaagccaaaggatgtgagccaggaggagctattggacgtgactgaccaactgaacatggaccccagagttagcggaatcctggtacagctgcctctgccagaccatgtggatgagaggacaatttgcaacggcattgccccggaaaaggacgttgacggattccacattataaatataggacgtctatgcttggaccagcactcgcttatacctgcaactgcctcagcggtatgggagatcatcaagaggacagggattcagacttttggaaaaaacgtggtcgttgctggccgatctaagaatgtcggcatgcctatcgccatgctgctccacaccgatggggagcacgaaaggcccggaggggacgccaccgttacgatcgctcaccgttatacgcccaaggaacagctgaagatccacactcagctggcagacatcatcattgtggccgccgggatccctaagctgatcacttccgacatggtcaaagagggtgctgccgttatcgacgtgggaattaactacgtccacgacccagttacaggcaagacgaaacttgtgggggatgtcgattttgaggccgtaaagaaaaaagccggcttcattacccctgtgcccggaggcgtcgggcctatgacggttgcaatgctgctgaagaataccctactggccgcgaagaagatcatatactag

SEQ ID NO: 124187 - DNA, 441 bp, Artificial Sequence
  Description of Artificial Sequence: Synthetic coding sequence
atggacccacgcgtatcagggatccttgtgcagctgcccctccctgatcatgtggacgaacgaactatatgcaacgggatcgcccccgagaaggatgttgatgggtttcacatcatcaacattggaaggctgtgtctcgatcagcacagtcttattccagcaacggctagcgccgtatgggagatcataaagcgcaccggaattcagactttcgggaaaaacgtcgtggtggccgggcgctctaagaatgtaggaatgcctattgctatgttgctgcacacagacggagagcatgaaagacccggaggcgatgccacagtgacgatcgctcacaggtatactcctaaggaacaattaaagatccatacacaactcgcagatatcattatcgtagccgccgagcgctttcaccattttgctcaagatctgagcaatagttag

SEQ ID NO: 124188 - DNA, 1257 bp, Artificial Sequence
  Description of Artificial Sequence: Synthetic coding sequence
atgcccatgcttcttcctcatcctcaccaacattttctcaaaggtttgctccgtgcaccatttagatgttaccatttcatatttcactcctcaacacatctcggttccggtataccctgcgcacagccctttaactccctagggctccattgcaccaaatggatgctgcttagtgatggactgaagaggaaactatgtgtccagactaccctgaaggatcacacagagggcctgtctgacaaggaacagagattcgttgacaaactgtataccggcctcattcagggccagcgcgcgtgtctagcagaagccatcactttagttgagtccactcattctcgtaagaaggagctggctcaggtgctgctgcagaaggtactactgtaccaccgggagcaagaacagagtaataaaggcaagccactggcatttagagtagggctctctggcccaccaggcgccggcaagtcaacttttatagagtacttcggcaagatgctcaccgaaaggggccacaagctcagcgtcctggcggtcgacccaagttcatgtactagcggcgggagtctcctcggggacaagaccagaatgaccgagttgagccgagatatgaacgcatacatcagaccctcccctacaagaggcaccttaggcggagtgacccggactacaaatgaggccattttactttgtgaaggcgcaggctatgacatcatactgatagagactgttggagtgggccagagcgaatttgctgtggcagacatggtggacatgtttgtgctgctgcttccgcctgccggcggcgatgaactgcaggggatcaagcggggaataatagaaatggccgacctggtcgcggttacgaagtccgacggcgatctcattgtgcccgcccgacggatacaggccgaatatgtaagtgcacttaaactcctgcgaaaaaggtcacaagtgtggaagcctaaggtcatcaggatctccgccaggtccggagagggaattagcgaaatgtgggataagatgaaggatttccaggacctgatgctcgctagtggggaactgaccgctaaacgccgcaagcagcaaaaggtctggatgtggaatttgatccaagaatcagttctcgaacacttccggacacacccaaccgtaagggaacagattcccctgctggaacaaaaggtgttgataggagctctgtcacccgggctggccgcagatttcctactcaaagccttcaaaagccgtgattag

SEQ ID NO: 124189 - DNA, 1275 bp, Artificial Sequence
  Description of Artificial Sequence: Synthetic coding sequence
atgcccatgctgttgcctcacccccaccagcactttcttaagggcctcctgcgggctccttttagatgctaccattttatcttccattctagcacgcatctgggatccggcatcccctgtgcacaacccttcaactctctcggacttcactgtactaaatggatgctactcagcgatggacttaagcggaagctgtgtgtgcagacgaccctgaaagatcacaccgaaggcctttctgataaagagcagcggtttgttgacaaactgtacactggccttatacagggtcagcgggcatgcctggctgaggcaatcacattggtggaaagcacacacagccggaagaaggaacttgcacaggtgctcttgcaaaaagtcctgttgtaccaccgcgagcaggaacagagtaataagggcaaacctttggcctttagggttggcctctccggcccccccggcgccggcaaatccaccttcatcgaatattttggcaaaatgctcacagaacggggtcacaagttgagcgttctggctgtggatccctcgagctgtaccagcggcggttccctgctaggcgataaaaccagaatgaccgagctgtccagggacatgaatgcttatattagaccatcccctactagagggacgctaggtggcgttacgagaacaacaaacgaggcaattcttctatgcgagggagcagggtacgacatcatcctgattgagacggtgggagtggggcagagcgaatttgcagtcgccgacatggttgacatgttcgtgttgctgttacctccagcagggggggacgagctgcaggggatcaagcgggggatcattgagatggctgatctcgttgcggtgacaaaatcggatggagacctaattgtcccagcacgccgcatccaagccgaatatgtttcggccctgaaactgctcagaaaaagaagtcaggtctggaaaccaaaagtcattaggatttccgcccgcagcggcgaggggatttccgaaatgtgggataagatgaaggacttccaagatctcatgttggccagcggagagctgactgcaaaacggcgtaagcagcagaaggtttggatgtggaacctcattcaggaaagtgttctcgagcattttcggacccaccccactgtacgcgagcagatcccacttctggaacagaaggtgctgatcggtgcactttcacctggattagctgccgattttttgctaaaggccctgaaggcagaaacaaataagatccacccagtgtag

SEQ ID NO: 124190 - DNA, 414 bp, Artificial Sequence
  Description of Artificial Sequence: Synthetic coding sequence
atggccgatctcgttgctgtgactaagagtgacggagacctgatagttcccgccagacggattcaggccgaatacgtgtcagcactgaagctgctgcgtaaaaggagccaagtgtggaagccaaaagtaatacgaatatccgctaggagcggtgaggggatttcggagatgtgggataaaatgaaagatttccaagacctcatgcttgcctctggggaacttacagccaagcgacgaaagcagcagaaggtgtggatgtggaatctaattcaggaaagtgtcctggagcacttccggacccaccctaccgtccgcgaacagatccctctcttggagcagaaggtgctgattggtgccttgagcccgggactcgccgcagattttctcctgaaagcgtttaaatctagggattag

SEQ ID NO: 124191 - DNA, 480 bp, Artificial Sequence
  Description of Artificial Sequence: Synthetic coding sequence
atggctggccttactagattcgccttggaacttgttacagaaaagggacacaccttcgctgaggagttgcagaaaatccaatgtaccctgcaagacgttggtagtgctctggcaacaccatgcagttccgccagagaagcgcatctgaagtataccactttcaaagccgggccaatactggaattagagcagtggattgataaatacacttcccagctgccccctcttaccgctttcatactgccttccggcggaaagattagtagcgccctgcatttctgccgagctgtctgtcgtcgcgctgaaaggagagtggttcccctggtgcagatgggcgaaacagatgccaatgtggccaaatttctgaatagattgagcgactacttgttcacactggctcgctatgccgcaatgaaggaagggaatcaagaaaaaatctatatgaagaatgatccctcagccgaatccgagggcctttag

SEQ ID NO: 124192 - DNA, 753 bp, Artificial Sequence
  Description of Artificial Sequence: Synthetic coding sequence
atggccgtgtgtgggctgggcagtcgcctgggcttggggagtaggttgggtctccgtggatgtttcggagccgcgaggctgctttacccacggtttcaaagccgaggcccgcagggagtcgaagatggggaccggccccagccttccagcaaaacccctagaattcctaagatatacacgaagaccggtgataagggattttcctcgactttcacgggagagcgccgaccaaaagatgatcaagtgtttgaggccgtgggcacaactgatgaactcagctctgccatcggtttcgcgctggaattggtcactgaaaagggacacacattcgcagaggaactgcaaaaaattcagtgtaccctacaagacgtgggcagcgccctcgcaacaccctgttcatccgcgagggaggcacacttaaaatatactaccttcaaagcaggacctatcttagagctcgagcaatggattgataagtatacaagtcagttgcctccgctgaccgccttcatactgcccagcggcggcaaaatttccagcgctctgcacttctgcagagctgtatgccgcagggcggaacgcagggtggtgcctctggttcagatgggcgaaactgatgcaaatgtggctaagttccttaatcgcctgtcagattacttattcaccctcgctcggtatgccgcgatgaaggaggggaatcaggaaaagatctatatgaaaaacgacccctcagctgagagcgagggattatag

SEQ ID NO: 124193 - DNA, 849 bp, Artificial Sequence
  Description of Artificial Sequence: Synthetic coding sequence
atggaacctaaagtggcagagctgaagcagaagatcgaagataccctgtgtccttttgggtttgaagtgtatcctttccaggtggcctggtacaatgagctcctgcccccggcatttcacctgccacttcctgggccgaccctggctttcttggtcctgtctactcctgcaatgttcgatcgggcacttaaacctttcctgcagtcttgtcatctgaggatgttgacagatcctgtggatcagtgtgtggcctaccatcttggccgggtgagggaatcactgcctgaactacagattgaaattatcgccgattacgaggtgcatcctaaccggcgaccaaagatccttgcccaaacagccgcccacgttgcaggggcagcgtactattaccagcggcaggacgtagaggcagacccttggggaaatcaaagaatctcaggggtctgcattcatcccaggttcgggggctggttcgccatccgtggtgtggtgctgttgcctggaattgaggtacctgatctccccccaaggaaaccccacgattgtgtgcccactcgcgctgataggatagccctactggaaggtttcaactttcattggcgcgactggacctaccgggatgccgtgacccctcaggaacggtactcggaggagcagaaagcctactttagcacaccacctgctcagagactcgccctcctgggccttgcccagcccagtgagaagccgagcagcccatctcccgacttgccattcaccactcccgcaccaaaaaagccgggaaacccatcaagagccaggagttggctttcacctagagtgtctcccccagcctccccgggaccttag

SEQ ID NO: 124194 - DNA, 891 bp, Artificial Sequence
  Description of Artificial Sequence: Synthetic coding sequence
atggctaatgtgctgtgtaatagagcccgactggtgtcttatcttcccggattctgtagcttagtgaagcgcgtcgtgaatcctaaagctttctcgacagctggatccagcggcagcgacgaatcccacgtggctgctgcacctccggatatctgcagcaggacggtttggcccgacgagaccatgggacccttcggccctcaggaccagcgctttcagctgccaggaaatatcggctttgactgccacttgaacggcaccgcaagtcagaaaaaatccctcgtgcacaagaccctgcccgacgtgctcgccgagccattgtcttctgaaagacacgagtttgtgatggctcagtacgtcaacgagtttcaggggaatgacgccccagtggaacaggaaattaattctgcggagacatatttcgagagcgctagggtggagtgtgccattcagacttgcccggagctactgaggaaggacttcgagtcactttttcccgaagtcgcaaacggaaagctgatgattctaaccgtgacccaaaagaccaagaatgacatgacagtgtggtccgaagaggtcgagattgagagagaagtgctgttggagaagtttattaacggagcaaaagagatatgttatgcactgagagccgaaggttactgggccgatttcattgacccctcctccggcctcgctttcttcggcccttacacgaacaacacattgttcgaaaccgatgaaagatacagacacttaggattctctgtggatgacctgggatgctgcaaagtgatcaggcacagcctgtggggcacccacgttgtcgtgggctccatttttacaaacgccacccctgattcacacattatgaaaaagttgagcggcaactag

SEQ ID NO: 124195 - DNA, 891 bp, Artificial Sequence
  Description of Artificial Sequence: Synthetic coding sequence
atggccaatgtactctgcaacagggccagacttgtttcatatctgccagggttctgtagtcttgtgaagcgtgttgtcaacccaaaggctttctccacggccggatcttcgggcagcgacgagagccatgtggctgccgccccgccagacatctgctcacggaccgtatggccggatgagactatgggtccatttggaccccaggaccagcgctttcagcttcccgggaatatcgggttcgactgccacctgaacggaaccgcatcccagaagaagtctctcgtccataagacacttccagacgtgctggcagagccgctctctagcgaaagacatgagtttgtaatggcccagtacgtcaacgagttccaaggaaatgatgcgccagtcgagcaggagatcaactccgctgagacctactttgaaagcgccagggtcgaatgtgctattcaaacatgtccagaattacttagaaaggacttcgagtcgctgtttccagaagtggcaaatggtaaactaatgattctgacagtcacgcagaagacgaagaacgacatgacagtttggagcgaggaggtggagatcgagcgtgaggtcctgttagagaagttcatcaacggagcgaaagagatctgctatgcgctccgggccgaggggtattgggccgacttcatcgacccaagtagcggccttgctttctttggcccctataccaataacaccctgtttgaaactgatgagcgctatagacatctcggctttagtgtcgacgacctgggctgttgcaaggttatcaggcattctctatgggggacacatgtcgtagttggaagtatctttactaatgccacccctgacagccatatcatgaaaaaactatccgggaactag

SEQ ID NO: 124196 - DNA, 531 bp, Artificial Sequence
  Description of Artificial Sequence: Synthetic coding sequence
atggctcgagttctgaaggcagcggcagccaacgccgtgggactgtttagtaggctgcaggcccctatccccaccgtgcgcgccagttcaacgtcccaaccattagatcaagtcaccggatctgtgtggaacctgggccggctgaatcacgttgctatcgccgtgccggatctggaaaaagccgctgcgttttacaaaaacatactgggagctcaagtaagcgaggctgtccctctccctgagcacggagtcagcgttgtgtttgtgaatctgggtaataccaagatggagcttctgcaccccttaggccgtgacagccccatcgccggcttcctgcagaagaacaaggctggtggcatgcaccatatttgcatagaagtagataacatcaacgccgccgtcatggacctcaaaaagaagaaaatcagatctcttagcgaggaagtcaagataggcgcccacggcaagcccgtgatctttctgcaccccaaagactgcggaggggtgctcgttgaactggaacaggcatag

SEQ ID NO: 124197 - DNA, 2070 bp, Artificial Sequence
  Description of Artificial Sequence: Synthetic coding sequence
atgatcgaaatggccgctgagaaggagccatttttggttccggcacctccccctcctttgaaagacgaaagtggcggcggcggcggacctacggtgcccccccaccaggaagccgcatcgggcgaattgcgcggcgggaccgaacgcggaccagggagatgtgcgccaagtgcgggctctcccgctgccgctgtagggagagagagcccaggcgcagcagccacctctagctctggccctcaggcacagcagcataggggaggaggccctcaggcacagtcgcacggtgaggccaggttgtccgatcctcctgggcgcgccgcccctccggacgtgggtgaggagcgcagagggggcgggggaaccgagttgggcccccccgctcctccacggcctagaaacggctaccagccgcataggccccctggaggcgggggaggaaagcggagaaattcctgcaatgtgggaggcggcgggggcgggttcaagcaccctgcatttaagcgccggaggcgcgtgaattctgactgcgattctgtgcttccaagtaactttctattgggaggcaacatcttcgaccctctgaaccttaacagcctgcttgatgaggaagtctctaggacgttaaatgctgagacacccaaaagctccccactgcccgccaaaggaagagatcccgtcgaaattttgattcctaaagatattaccgaccctctgagcctcaacacctgtacggacgaaggacacgtcgtgcttgcatcacccctgaaaacaggacgaaagagacacaggcatcggggccagcatcatcagcagcagcaggctgcgggaggttcagagagccaccccgtccctcccaccgccccactaacccccttgctgcacggtgagggggcctcccagcagccaagacatcgggggcagaaccgggatgcgcctcagccatacgagctgaacactgctatcaattgccgcgacgaggtggtcagtccactgcccagcgctctgcaggggccctccggcagtctaagtgctccccccgccgccagcgtgatctcagccccgccaagctcttcatcccgtcaccggaagcgcaggcgtacgagtagcaagagcgaagctggggcacggggcgggggccaggggagcaaggagaaagggcgcgggagttgggggggacgccaccatcatcaccacccgttgcctgccgcgggtttcaaaaagcaacagaggaagttccagtacggcaactactgcaagtactatggttaccggaatcccagctgcgaggatggccggctccgggtgctgaaacccgaatggtttcggggtagggatgtgctggatctaggttgcaatgtgggccatctgacgctctctattgcctgcaagtggggaccaagtcggatggtagggctcgatatcgactctaggttgatacactcagcgagacagaacattcgccactacttgtctgaggagcttcgcctgcccccacagacacttgaaggcgaccctggggcagaaggggaagaaggcactaccaccgtgaggaagcggagttgtttccccgcctccctcaccgcaagtcgtgggcccatcgctgccccacaggttccgttggacggcgcagatacctcagttttccctaacaatgtggtctttgtgaccggcaactacgtattggatcgcgacgatctcgtggaagctcagacccccgagtacgacgtggttctgtgtctgtccctgaccaaatgggtgcacttaaactggggcgacgagggactcaaacggatgttccgccggatatacagacatttgcggccggggggcatcttggtgttagagccccaaccttggtcctcatacgggaagcgcaagaccctgactgagaccatctacaaaaactattatcgcattcagctgaaacccgagcagttctcctcttatcttacttctccggatgtaggcttctcatcatatgaactggtagccaccccacacaacaccagtaaagggttccagcggcctgtttatctgttccacaaagcccgctcaccgagccactag

SEQ ID NO: 124198 - DNA, 663 bp, Artificial Sequence
  Description of Artificial Sequence: Synthetic coding sequence
atggtaggactagacattgatagtaggttaatccactcggcccggcagaacattcgacactatctgagtgaggaactgcggctcccacctcagactctcgagggagatccgggagccgagggggaagaaggtacaactactgtgcgaaaacgatcctgttttccggcctctctcaccgcatcgcgtgggcccatcgccgcaccacaggttccactcgacggcgccgacacaagcgtatttccaaacaacgtggttttcgtgactggcaactatgttttggatcgagacgacctggtggaagcacagactcctgaatatgacgtggtgttatgcctctcactcaccaagtgggtccacctgaactggggggacgagggcctcaaacgaatgttccggcgaatataccgtcacctaaggccagggggaattttggtgctggaaccgcagccctggtctagctatggaaagcggaagaccttgaccgagacgatctataagaactactacagaattcagctaaagcctgaacagttttcttcatatttgaccagccccgatgtaggattctcctcatatgagctggtggcaaccccccacaatacctcaaaggggtttcaaaggccagtgtatctattccacaaggctcgatcacctagtcactag

SEQ ID NO: 124199 - DNA, 852 bp, Artificial Sequence
  Description of Artificial Sequence: Synthetic coding sequence
atggctagcgggaccacgaccaccgcagtgaagattggtattattggcggcaccggactggacgacccagaaatcctggaaggcaggactgagaagtatgtggataccccctttggaaagccatcagacgctctcatcctagggaaaattaaaaatgtggactgtgtcctccttgcgaggcacggaaggcagcatacaatcatgccaagtaaagtgaattatcaagccaacatatgggcccttaaggaggaaggatgtacccatgtcattgtgaccaccgcatgtggctcactcagggaagaaattcagcctggcgacatagtcattatcgaccagttcattgaccggactaccatgcggccccagtcattctacgacgggtcccactcctgcgctagaggcgtctgtcacatcccgatggctgagccattctgtcccaaaaccagggaagttttaatagagacagcaaaaaagctcgggctccggtgccatagcaagggtactatggtgacaattgaaggcccccgcttctcatccagggccgaatcttttatgttccgaacatggggtgcagatgtaatcaacatgacaacagtgcctgaggtggtgctagcaaaggaggctggaatctgttacgcttctatagcaatggccacggattacgactgttggaaagagcacgaggaggccgtaagcgtggatagagttctgaagaccctgaaggaaaatgctaacaaagccaagtctctcctgcttaccactattccacagatagggagcactgagtggagtgagaccctgcacaacttgaaaaatatggcccagtttagtgtgttgctgcctcgccactag

SEQ ID NO: 124200 - DNA, 468 bp, Artificial Sequence
  Description of Artificial Sequence: Synthetic coding sequence
atggcagccgaaacgagaaatgttgctggagctgaggcgccccccccccaaaaacggtactacagacagcgggcacatagcaatcctatggcagaccacacccttaggtatccagttaaacccgaggaaatggattggtcagagctctaccccgagttttttgctcctttgactcaaaatcaaagccacgatgaccccaaggacaaaaaggagaagagggcccaggcccaggtggagttcgcagacatcggctgcgggtatggcggactgctcgccgataaggatgtcttacccttacctcgacctacatttcaggccgacaaagcgcaggtggcaaatcaccagtcccaccctgcctctcgaatatgcctgagagccaaatcctggggcgctggggtgtaccacaatcggtgtgcgggggccacacgcctggacgtgcactctttcagacgagcacctactgtgtag

SEQ ID NO: 124201 - DNA, 831 bp, Artificial Sequence
  Description of Artificial Sequence: Synthetic coding sequence
atggccgcagaaaccaggaacgtggcaggagccgaggctcctccacctcagaagcgatattatagacagagggctcattccaaccctatggcagatcacaccctgcggtaccccgtcaaaccagaggagatggattggagtgaactgtatccggagttcttcgcgcccctcacccaaaatcaaagccatgatgacccaaaggataaaaaggagaaacgcgcccaggcccaggtggagttcgcagacatcgggtgcgggtacggcgggctgctcgtggagttgtccccactgttccccgacaccctgattctgggcttggaaattcgggtgaaggtgagcgattatgtgcaagacaggatcagggcactgagagccgcccctgccgggggctttcagaacattgcatgcctgaggtctaacgcgatgaaacacttgcctaactttttctacaagggacagcttaccaaaatgtttttcctattccctgatccccacttcaagcgtacaaaacataaatggcggataatcagcccaaccctcctagccgaatacgcatacgtcttacgcgtgggcggcctggtgtacaccattacagacgtcctggagttacacgactggatgtgtacccattttgaagaacatcctctgttcgagagggtccccctggaggatttgtcggaggatcccgtggtcggccatctcggtacctccactgaggagggcaaaaaagtcctgaggaacggcggaaagaactttcccgccatctttaggagaatccaggatcccgtattgcaggccgtgaccagccagacatcactgccgggacactag

SEQ ID NO: 124202 - DNA, 2274 bp, Artificial Sequence
  Description of Artificial Sequence: Synthetic coding sequence
atggccgaggtggggcggacgggaatcagctaccctggcgccctgctccctcagggtttctgggctgctgtggaagtgtggcttgaaagaccccaagtggctaacaagaggctctgcggagcgcggctggaggcccgctggtccgccgctctgccatgcgcggaggcccgaggacctggaacctctgccgggagtgagcagaaggaaagaggccccggccctggtcagggatctccaggcgggggacctgggccaagaagcctgtcaggccctgagcagggcacggcatgctgcgaactggaagaagctcaggggcagtgccaacaggaagaggcccagcgggaggctgcctccgtgccactccgggacagcggccaccccgggcacgccgagggacgtgaaggtgattttcctgctgccgatctggattccctttgggaagacttctcccagtcattggccagaggaaactctgagttacttgctttcctaactagttctggggctggttctcagccagaagcgcagcgcgagctggacgtggtgctgagaaccgtcatccccaaaacgtcccctcattgcccattaaccacccctagaagagagatcgttgtgcaagacgtgctgaatggtaccattacattcctcccccttgaagaagatgacgaaggcaaccttaaagttaagatgtccaatgtctaccagatccaactgtcccactccaaggaggagtggtttatcagcgtgctgatattttgcccagaacgctggcattccgacggaatcgtctaccccaaacccacatggttgggtgaggaactgctggcaaagttagcaaaatggtctgtagagaataaaaagagcgacttcaagtcaaccctctccctaattagcattatgaaatactcaaaagcctatcaggagttgaaggaaaaatacaaggagatggtgaaagtgtggccggaagtgaccgaccccgagaagtttgtgtacgaggatgtggccatcgccgcatacctccttatcctgtgggaagaagaaagggctgaacgtaggctcactgcacggcagagtttcgtcgacctagggtgtggtaacggcttgttagtgcacatcctgtcttccgagggccacccggggcgcggcatagacgtgaggaggcggaagatttgggacatgtacggcccacagacacaactggaggaggatgccatcacacccaacgataagacactcttccccgacgtggactggctaatcggcaatcactcagatgagctcacgccttggattcccgtcattgcggccagatcttcctataattgtcgattttttgttctaccatgttgtttcttcgacttcattggacgttacagcagaagacagagcaagaaaactcaatatagggaatacctggatttcatcaaagaggtcggctttacttgtgggttccatgtggatgaggactgcctcaggattccatctaccaagcgggtttgtctcgtcggcaagtcccgcacatacccatcctcccgggaggcctccgttgatgagaagagaacccaatacatcaagagcagaagagggtgcccagtttctcctcctggatgggagctgagcccgagcccgcgctgggtggccgccggctcagccgggcactgcgatggtcagcaggccctggacgctcgagtcggctgcgtgacacgcgcctgggccgccgaacatggcgcgggtccacaagctgaggggccgtggctcccgggatttcaccccagagagaaggctgaacgcgtaagaaactgtgccgctcttcccagagactttattgaccaagtggtccttcaagtagccaacttgctgctgggaggtaaacagcttaatacacgatctagtaggaacgggagtctgaagacatggaatggtggggagtccctgtccctggcggaagtagccaatgagctagataccgagactctgagacgcctcaaacgggaatgcggggggttgcagacattgctcagaaacagccatcaggtattccaggttgtaaacggaagagtccatatccgtgactggcgcgaggaaaccctgtggaagactaagcagcccgaggcaaagcagaggctcctgagtgaagcctgcaagacccggctatgctggtttttcatgcatcaccctgacggctgcgctctctctactgattgttgcccttttgcccatgggcctgcagagttacgcccaccgagaaccactcccaggaagaagatctcatag

SEQ ID NO: 124203 - DNA, 1236 bp, Artificial Sequence
  Description of Artificial Sequence: Synthetic coding sequence
atgtgcatcaaattcagctcagttatcgcaaaaaaaaacgagcgctggcatagcgacggaattgtatacccgaagccaacttggctaggcgaagagctgctggcaaaactggctaaatggagcgtggaaaacaagaagtcagacttcaaatcaacactcagtttgatctcaatcatgaagtactccaaagcctaccaagagctgaaggagaaatataaggaaatggtgaaagtgtggcccgaagtgaccgatcccgaaaaattcgtatacgaggatgtggcaatcgccgcttacctgctgattctatgggaagaggagagggctgaaagaaggttaacagctcggcagtctttcgtcgatcttgggtgtggcaatggactgttagtccatattttgagctctgaggggcatcctggccgcggcatagatgtgcgtcggcggaagatttgggacatgtacggccctcaaactcagctcgaagaggacgctattacaccaaacgacaagactctgttccccgatgttgattggctcatagggaatcattctgatgaactcactccatggattcctgtcattgcggcccggagtagctacaactgcagattcttcgttctgccatgttgtttcttcgattttatcgggcgatactctcgtcggcaatccaaaaaaacccagtatcgagagtacttggattttataaaggaggtcgggtttacatgcggctttcacgtggacgaggattgtttacgcatcccgtccactaaacgcgtgtgcctcgtcggtaagtccagaacctacccgagctcgagagaagccagcgtggacgagaagcgtactcaatatatcaaaagccgtcgcggttgtcctgtgtctccaccaggctgggagctgtctccctccccccggtgggtagcagccggatccgccgggcattgcgatgggcagcaggctctggacgctagagtcggttgtgtgactcgcgcttgggccgccgaacacggagcgggcccccaggccgaaggcccctggctccctgggttccatccacgggagaaggccgagcgtgtgagaaattgcgccgctttgccacgagactttatcgatcaggttgtgctacaggtagcaaatctcctactgggcgggaaacagcttaatactcggagttcacggaatggctctctgaagacttggaatggaggcggcaagctgtctacaattttaggcaggggctag

SEQ ID NO: 124204 - DNA, 1743 bp, Artificial Sequence
  Description of Artificial Sequence: Synthetic coding sequence
atgagcgatacatggagttctatccaagcccataaaaagcagctcgactccttaagagagcgcctgcaacgccggcgcaaacaggatagcggccatctggacctccggaatccggaggccgctctgtctcccacattcagatcggactcaccagtacctactgctcccacatcaggaggtcccaagccctctacagcaagcgcagtacccgaattagccacagaccctgaactggaaaagaagctgctgcaccatctgtccgacctcgcccttacacttcctacagatgccgtatctatttgtctcgcgatatcaacccctgatgccccagccacccaggacggcgtagagtctctgctccaaaagttcgcagctcaggagctcatcgaagttaagagaggacttctccaggatgacgcccaccctacactggtgacctacgcggatcactcaaagctgagcgctatgatgggcgcggtggccgagaagaaaggcccaggggaagtcgccggtacagtcactggacagaagcgccgggctgaacaggactccacgacagtcgcagcgtttgcttctagcctggtcagtggcctcaattcttccgccagcgaacctgctaaagagcccgccaaaaaaagccgcaaacatgccgcctctgacgtggatctggagatcgaatccctgctgaatcaacagagtacgaaagaacagcaatccaagaaggtgtctcaggaaatcctggagctcctgaataccaccaccgcaaaagagcagtcaatagtggaaaagttcaggtcaaggggacgagcccaggtccaggagttttgcgactacggtacgaaggaagagtgcatgaaagcttccgacgctgacaggccctgcaggaaacttcattttagacgaatcatcaataagcacaccgatgaatccttgggagactgctctttcctcaacacctgcttccatatggacacctgcaaatacgtccattacgaaattgacgcatgcatggactcagaagctccgggctccaaggatcacacaccttcgcaggaactcgcactgacacaaagcgtgggtggagattcatctgcagatcgtctgtttcccccccagtggatctgctgcgacataaggtaccttgatgtgtctattctgggtaaattcgccgtggtgatggccgacccgccatgggacatccacatggagctcccttacggaaccttgaccgatgacgaaatgagaaggctcaacatacccgtcttacaggatgacggattcctatttctctgggttactgggcgagccatggagcttggccgcgagtgcctcaacctgtgggggtatgagcgagtggatgaaattatatgggtgaagacaaaccagctgcagaggatcatcagaaccggcaggacggggcattggctgaaccatggcaaggagcactgtctcgttggcgtgaaagggaatccccagggcttcaatcagggcttggactgcgatgtgatcgttgccgaggtccgctcgacctcccataaacctgatgagatctacgggatgatcgagcggctcagccctggaacaaggaagattgagctcttcggacgtcctcacaacgttcagcccaattggatcaccttgggaaatcagctcgatgggatacacctgctggacccagacgttgtcgcacgttttaaacaacgttatcctgacgggatcatctctaaacccaagaacttgtag

SEQ ID NO: 124205 - DNA, 492 bp, Artificial Sequence
  Description of Artificial Sequence: Synthetic coding sequence
atgagcgatacgtggtccagcatccaggcccacaaaaagcagcttgacagtctacgagagcggctgcagagacgccgcaagcaagatagtggccacctggacctgagaaacccagaggcggctttatctcctaccttccgctccgactccccagtgcccacggcccctacctcgggcggcccgaagcctagtactgcctctgctgtccccgagttggccacagaccccgaacttgaaaagaagctgctacatcacctctctgatctggcgctgaccctaccaacagacgccgtgtccatctgtttagccatttctacacctgatgcccccgccacgcaggacggggtcgaaagtctccttcagaagttcgccgcccaggaactgatagaggttaagcggggcctgctacaggacgatgcccatcccaccttagtcacttacgcagaccactccaagctctcagccatgatgggagcggtggccgaaaagtag

SEQ ID NO: 124206 - DNA, 462 bp, Artificial Sequence
  Description of Artificial Sequence: Synthetic coding sequence
atgtccgatacatggtcctcaatccaggcacacaagaagcagctggattccctgagggagcggctgcaacggcgaaggaaacaggattctggacatttagatctgcgcaaccccgaggctgccctctccccaaccttccggagcgacagtcctgttcccacagcgcctacctccggaggaccaaagccttcaaccgccagcgccgtccccgagttagccaccgacccggagctcgagaagaagctcctgcatcacttgtctgatctcgcgctcaccctacccaccgacgccgtcagtatttgtcttgccatctccactcctgacgcacccgccacccaggatggagtggagtccttgttgcagaaatttgctgcacaagaactcattgaacaccggaaccagcaaagatctcagcctcgtaatcaggggaacatgctaccgcagatgttgatctggaggtag

SEQ ID NO: 124207 - DNA, 879 bp, Artificial Sequence
  Description of Artificial Sequence: Synthetic coding sequence
atgctgggggcctgggcggtggaaggaaccgctgtagcactccttcgcctcttactgctcttactgcctccggccatacgtggcccgggcctgggcgtggcaggagtggccggcgccgcaggggcaggccttccggagagtgtgatttgggcagtgaatgccggcggcgaggcccacgtggacgtgcacggtattcactttcggaaggatccccttgagggtagggtgggcagagcctcagattacggcatgaaactgccaattctccgctccaatccggaagatcagatcctgtatcaaacagagaggtacaacgaggagacgttcggctacgaggtgccaattaaagaagaaggcgactatgtgctagtgttaaagtttgcagaagtgtacttcgcccaatcacagcaaaaggtgttcgacgtccggctgaacggccacgttgtcgtcaaggacctggatatcttcgacagagtggggcactctactgcgcatgatgagataatcccgatgagcattaggaagggcaagcttagcgtccagggagaggtgtccaccttcaccggcaagctgtacatagaatttgtgaaaggatattacgataatcctaaagtgtgcgccctttacatcatggctggaaccgtcgacgatgtgcctaagctccaaccccacccgggcctcgaaaaaaaggaggaggaggaggaagaggaggagtatgacgaagggtctaatctcaaaaagcagaccaataagaatagagtgcaatcaggccccaggacccccaacccttacgctagtgacaactcctctctgatgttcccaatactggtcgctttcggggtctttattcccaccttgttctgtttgtgtcggctctag

SEQ ID NO: 124208 - DNA, 1035 bp, Artificial Sequence
  Description of Artificial Sequence: Synthetic coding sequence
atgctttctgaagtcctactggtttctgctccgggaaaagttatcctgcacggggaacacgccgtcgtccatggtaaagtggcgttggcagtgtctctgaatcttcgcaccttcctacgcctgcagccccatagcaatggcaaggtggatctgagtctgccaaatatcggtattaagagggcatgggacgtggcccgcctgcagtctctggacacaagttttttggagcagggggacgtgactacgccgacatcggaacaggttgagaaacttaaagaggtggccggcctgcccgatgattgcgcagttacggaaagattggctgtgttggctttcttatatctctacctgagcatctgtcgcaagcagagatggaccaaggaggacctggagttgatcaacaagtgggcatttcagggagaacgaatgatccatggtaacccttcaggtgtggataacgctgtctccacctggggtggggcactcaggtatcatcaggggaagattagtagtctgaagcgcagtcccgccctccaaatactcctcacaaacactaaagtacctcgaaatacccgcgccctggtcgccggcgtcaggaataggttgctgaagttccccgagatcgtggcccctttgctgacgagcattgacgctataagtctcgagtgtgagcgggtgctgggcgaaatgggtgaggcaccagctccagaacagtaccttgtgcttgaagaactgatcgacatgaatcagcatcacctcaacgcgctgggggttggacacgcgtccctggatcaactgtgccaagttactcgggcacgcgggcttcatagtaagctcactggggccgggggaggagggtgcgggattactttactgaagcccggattagaacagcccgaagtggaggcaactaagcaggccctgacgtcatgtggtttcgactgcctggagacctctatcggcgctccaggggtttcaatccactccgcaacctccctggattcccgggtccagcaggctctcgacgggctctag

SEQ ID NO: 124209 - DNA, 516 bp, Artificial Sequence
  Description of Artificial Sequence: Synthetic coding sequence
atgctaagtgaggtacttctggtgtctgcacctgggaaggtgattttacacggtgagcatgctgtggtccatggcaaggttgctctggcagttagcttgaatttgcgtactttccttagactgcagccacacagtaatggcaaagtggatctgtccctccctaatattggcatcaaaagagcgtgggacgtcgctagactgcagtctctcgatacctcttttctggagcagggggacgtcacgacccccacaagtgagcaggtggaaaaactgaaggaagtagccggtcttcccgacgattgcgccgtgaccgagagattggccgttttggcctttctctatctgtatttatcaatttgtagaaaacagcgcgccttgccttccctagatatagttgtctggtctgaactgcccccaggggcggggttgggatcctcagcagcatattctgtgtgtctggctgctgctctcttgaccgtgtgtgaagaaatcccaaatcccctgaaggacgggtag

SEQ ID NO: 124210 - DNA, 1035 bp, Artificial Sequence
  Description of Artificial Sequence: Synthetic coding sequence
atgctgagcgaggtgctcctcgtctcagcaccaggtaaagtgatcctgcatggagaacatgccgttgtacatggaaaagtggcactcgccgtgagcttgaatttgcgtacatttctgagacttcagccacacagtaacggcaaagtggatttaagtttacccaacatcggcattaaaagagcctgggacgttgccaggttgcagtcgctggatacatccttcttggaacagggcgacgtaacgacaccgacctccgaacaggtggaaaagcttaaagaggtggccggactgcctgatgactgtgctgttacagagagactggcagtgttagcttttctctacctatacctttcaatttgccgaaagcagagatggacgaaggaagacctcgagttgatcaataagtgggcttttcagggcgaacggatgatccatggtaatccgtccggcgtggataacgcggtgtctacctggggaggagccctgagataccaccagggcaagatcagctcactgaaacgttcccccgcccttcagatcctactcactaatacgaaggtccctcgcaacacgcgggccctcgtcgcgggagtgcgcaacaggttgctgaaattccctgagattgttgccccgttgctgacctcaattgacgccatctcccttgagtgcgaaagggttctaggagagatgggagaggctcccgctcccgaacagtatctagtactggaagagctgatcgatatgaatcagcatcacctgaatgctcttggggtgggacacgcatccctggatcaactgtgccaagtcaccagggctagaggtcttcattccaagctgaccggcgccggcgggggtggctgtgggatcacactgctgaaaccaggcttagagcaaccagaagtggaggctactaagcaggctttgactagctgtggatttgattgcttggagacgtcgataggtgccccgggagtgagcatccacagcgccacgagtctcgattcaagagtccagcaggctttagacggtctatag

SEQ ID NO: 124211 - DNA, 609 bp, Artificial Sequence
  Description of Artificial Sequence: Synthetic coding sequence
atgatccatggcaatccgtcaggcgtcgacaacgcagtgagcacttggggaggcgccctccgatatcaccagggtaaaatcagtagcctgaagagaagccctgcactacagatcctgcttacaaataccaaggtccctcgtaacactagggctctggtggcaggagtgcgtaaccgactgctgaaattccctgaaatagtcgccccccttctcacttcaatcgacgccattagcttggaatgtgagcgtgtgctcggtgaaatgggagaagccccagcccccgaacagtacttggtactggaggagctgatagacatgaaccagcaccacttaaacgctttgggggtaggccatgcctctcttgatcagctgtgtcaggtcacaagggcacggggactgcattcgaagctcactggcgcaggcggagggggctgcgggataaccctcctgaaacctggactggagcagcccgaagtggaggccacaaagcaggccctcacttcatgcggctttgattgtcttgaaacatccatcggcgcccctggagtctcgatccacagcgctacatccttggattcccgagtgcagcaggctctggacggcctgtag

SEQ ID NO: 124212 - DNA, 606 bp, Artificial Sequence
  Description of Artificial Sequence: Synthetic coding sequence
atgttgtctgaggtgctgctggtcagcgcacctgggaaggtgatcctccatggtgagcacgccgtggtgcacgggaaggtggctctggctgtttcattgaacctaaggacatttttgaggctccagccgcactcaaatggtaaggtggatctgtctctccctaacatcggcatcaaacgcgcttgggacgtagcccggctgcagtctctcgacacctctttcttggagcaaggggacgtcacgacaccaacatctgaacaggtggaaaaactcaaagaggtggcagggctcccagacgactgcgctgtaactgaacgcctggctgtgttggccttcctgtacctatatctttctatctgccgaaagcaacgtgccctcccctcactggacatcgtggtgtggtccgagcttccacccggcgccggtctcggatcatctgccgcctacagcgtctgtctggcagccgcgctcctcacagtgtgtgaggagatccccaacccactgaaagacggagactgtgtgaatagatggacaaaagaggatctcgagttgatcaacaaatgggcttttcagggagaacggatgatccacggcaatccaagctag

SEQ ID NO: 124213 - DNA, 1563 bp, Artificial Sequence
  Description of Artificial Sequence: Synthetic coding sequence
atgccatcactcgtagtctcaggcataatggagcgcaacggggggtttggcgagcttgggtgcttcggcggctcagcaaaggacaggggcctgctcgaggacgaacgcgcgctgcaacttgcgctggaccagctgtgtctccttgggctgggagaacctccagcaccaaccgcaggagaagacggcggcggtggaggcggaggtgctcctgcccaacccgcagcccccccacagccagcccccccaccccccccggccgcgccaccagctgcgcctactgctgcccctgccgcccaaacaccccaacctccaactgcgcccaaaggagcgagcgacgcgaaactgtgcgctctgtacaaggaggcagaattgaggctgaagggctcctccaacactaccgagtgcgtgccggtgcctacctcagagcacgttgccgaaatcgtcggcaggcagggctgcaagatcaaggccttgcgagcaaaaaccaacacatatataaagactccggtccgtggagaggaacccgtcttcatggtcacaggacggagagaggatgtcgccaccgcccgtagggaaataattagtgctgcagaacactttagcatgatacgagcaagcaggaacaaaagcggggcagccttcggtgttgcacctgctctgcctggccaggtaactatccgtgtgcgcgtgccctacagggtcgtcgggctcgttgttgggcctaagggggcaaccatcaaaagaatccagcagcagaccaatacttatatcataacaccatctcgcgatagagaccccgtttttgaaatcacaggggcccccggcaatgtggaacgcgcaagagaggaaatcgagacacacattgcggtccgcaccgggaaaatacttgagtacaacaatgagaacgattttctcgctggttcccccgacgcagccatcgacagcaggtattctgacgcctggcgagtgcatcaaccagggtgcaagccgctcagcacgttcagacagaattccctcggatgcatcggtgaatgtggggttgattccggattcgaagccccccgtctgggcgagcagggcggagacttcgggtatggcggctatctttttccaggctacggggtagggaagcaagacgtgtattatggagtagcagagacctcaccgcctctgtgggcaggccaggagaacgcaacccctaccagcgtgctattttcatccgccagtagctcaagttcgtcctctgctaaggccagggcaggacctccgggcgcccatcggagtcccgctacttccgccggaccagaactggcagggctccctcgaaggcccccaggcgaaccactgcagggcttttcaaagctcggggggggcggactccgcagtccggggggcggaagagactgcatggtgtgctttgaaagcgaggttaccgccgctttggtgccatgtggacacaacctgttttgcatggagtgtgcggttcgaatctgtgagcgaacagaccctgaatgtccagtgtgtcacatcaccgcaactcaagctatccggattttttcctag

SEQ ID NO: 124214 - DNA, 1710 bp, Artificial Sequence
  Description of Artificial Sequence: Synthetic coding sequence
atgccttcaagcctcttcgcagacctggaaagaaatgggtcaggaggaggcggcggcggaagcagcggaggtggggaaacactcgatgaccagagggccctgcagctggccctcgatcagctgtcactactgggtttggattcagacgaaggtgcatccctgtacgacagcgagcctcgcaagaagtccgttaacatgacagaatgtgtcccggtgcccagtagtgaacacgtcgctgagatcgtcgggagacagggttgcaaaatcaaagcactgcgcgccaagactaatacatatatcaaaacccccgtgaggggagaggagcccgtttttgtggttaccggtcgaaaagaggacgttgctatggccagacgtgagatcataagcgctgccgaacatttttctatgattcgagctagccgcaataaaaatacggcgcttaatggggcagtaccagggcctcccaatttaccgggccaaaccacgatacaggtccgggtaccctacagggtggtcggtctagtggtcggcccaaagggagccaccattaaaagaatccagcagcaaacgcacacttacatagtcacacccagccgagacaaggagccagtctttgaggtcactggtatgcccgagaatgtcgatagagctagggaggaaatagaggctcatatagctctgagaactggcgggataatagagcttacagacgaaaatgattttcacgccaacggcacagatgtgggatttgacttgcatcacggaagcggaggcagcggacccgggtccctgtggtctaaaccaacccccagcatcactcctactcccggacgcaaacccttctcgtcctatagaaatgactcatcttcctcccttggcagcgcttctaccgactcttatttcggcggaggtacgtcatcatctgccgccgctacccagcgccttgccgattacagcccaccgagtcctgccctgtcatttgcccacaatgggaacaataacaataatgggaacggatacacatacactgctgggggagaggccagcgttccatctcccgacggttgtccagagctgcagccaacattcgacccagcccctgcaccccccccgggtgcacctttgatctgggcacagttcgagcgttcccccggggggggccctgcagctccagtgtccagcagctgttccagcagcgctagctctagtgccagcagctctagtgtagtgtttccgggaggcggtgcatccgccccgtcgaacgccaacctgggactgctagtccatcgaaggctgcaccccggcacatcttgcccaaggctgtcacctccattgcatatggcccccggcgccggagaacaccatctggcccgaagagtcagatctgaccccggaggcggcgggttggcctacgccgcctatgccaatgggctgggagctcagctacctggcctgcagccatccgatacttccggatcctctagctctagcagtagctcttcatcctcttcatctagtagttctggactccggcgaaagggcagtagagattgcagtgtctgcttcgaatccgaggtcatcgcggccctagttccttgcgggcataatctgttctgcatggagtgcgccaacaggatctgtgagaagagtgagccggagtgtccagtttgccacacggccgtcacgcaggctattagaatcttcagctag

SEQ ID NO: 124215 - DNA, 1980 bp, Artificial Sequence
  Description of Artificial Sequence: Synthetic coding sequence
atgccttcaggctcatccgcagctctcgctcttgctgccgcacccgcacctctcccgcagcccccacccccccctccgccccctcctcccccccttcccccgcccagcggcggacccgagctcgagggcgacggtttacttctccgggagagactggccgccctgggcttggacgaccccagcccagccgagcccggagctccagctctgagggcgcccgctgcagcagcacagggccaggcaagacgtgcggccgaactgagccctgaggagcgggcccctccagggagacccggcgctcccgaagctgcagagctggaacttgaagaggacgaagaagaaggggaagaggccgaactcgatggtgatttacttgaggaggaagaactcgaggaagccgaggaggaggatcggtcctccttgctgctccttagtccgccagctgccacggctagtcagacacagcagatccctggcggaagccttgggagcgttcttctccccgcagccagatttgacgcccgagaggccgccgcggccgcagctgctgcaggggttctttatgggggggatgacgcgcagggaatgatggccgcgatgctctcgcacgcgtacgggcccggcggctgcggcgccgcagccgccgccctgaacggcgaacaggcagcactacttaggcggaaaagtgtaaacaccacagagtgtgttcccgtgcccagcagcgagcatgtcgcagagatcgtgggaaggcagggttgtaagatcaaggcactgcgcgccaagacaaacacctatattaaaacacccgtacgaggtgaggagcctatcttcgttgtcacaggccggaaggaagatgtggctatggccaaacgagagatcctgagcgccgcggaacacttctcgatgattagggcatcacgaaataagaatgggccggccttggggggtctgtcatgctcacccaacctgccagggcagaccacagtgcaggtcagagtgccatatagagtagtgggcctcgtcgtgggacctaaaggtgccaccataaagagaattcaacagcagactcatacatatattgtgactccttctcgagataaagagcccgtgtttgaagtgacaggcatgcctgaaaatgttgacagggcacgggaagagatagaaatgcatattgccatgaggactggcaattacatcgagctgaatgaggaaaatgattttcattataacggcactgatgtgtcattcgagggaggaaccttaggtagcgcatggttgagctcaaatcctgtgcctccatccagggcccggatgatttcaaactatagaaacgattctagtagcagcttaggttctgggtctactgatagctactttggttccaacaggctcgctgatttcagcccaaccagccctttcagcactggaaacttctggttcggggatacgcttccctctgtaggcagtgaggacctggccgtggattcacccgcattcgactcattaccaacatcggctcagacgatctggacaccatttgaaccagtcaatcccctgtcaggttttgggagcgacccttccggaaacatgaaaacacaacggcgcgggagccaaccatctacccctcgactgtcacctaccttcccagaaagtatcgaacaccccctcgcaaggcgcgtacgaagcgaccccccgtccactggtaaccacgtcggcctgcctatttatatcccggccttctcaaatggcacaaactcctattcatccagcaacggaggcagcacctctagcagcccgccggaaagtaggcggaagcatgactgtgtcatttgtttcgagaacgaggtcatcgcagcccttgtgccatgtggacacaacttattctgtatggagtgcgcgaacaaaatatgtgagaagcggacaccctcttgtcccgtttgtcagacagccgtcacacaagccatccagattcactcttag

SEQ ID NO: 124216 - DNA, 498 bp, Artificial Sequence
  Description of Artificial Sequence: Synthetic coding sequence
tggagatggacaagttgccgaagatccgggtggggcgccctcgcaacacgcacccgaagaggccgccctggcacacctcccccgccgcggccaagtccccctgacgtgttcgcagggttcgcgccccacccagctgcgctaggaccacctacattattagccgaccagatgtccgtcataggatcccgaaaaaagtcagtgaatatgactgagtgcgttccagtgccgagttcagaacacgtggccgagatcgtcggaagacagggctgcaaaattaaagccctgcgcgctaaaactaacacatacatcaagacacctgtgcggggagaagaacctgtgttcatcgtaacaggtcgtaaggaagatgttgagatggctaaacgcgagatcctgtctgctgctgagcacttctctattatccgcgctacacgatctaaagctggcgggctgccaggcgccgcacaaggacctcccaatcttcccggccagacaacatag

SEQ ID NO: 124217 - DNA, 2001 bp, Artificial Sequence
  Description of Artificial Sequence: Synthetic coding sequence
atgccttcctcactgggccagcccgatggaggtggaggcgggggtggtggtggcggcggcgtcggtgccgccggagaagaccctggtcctgggcccgccccaccccctgagggagctcaggaagccgcacctgcccccagaccaccacccgaacctgacgacgccgctgctgccctgagactggctcttgaccagctatctgctctcggcttaggcggtgcaggagacaccgacgaggagggcgctgccggcgatggagcggccgctgccggaggcgctgatggcggcgccgcccccgagcccgttccacccgacggtccagaagcgggtgccccccctactctggcgcctgcagtggcgccggggtctttaccactcctagaccctaatgcatccccccctccacccccccccccccggccatcacctccagatgtgttcgcagggtttgcaccccatcccgctgctttgggaccaccgacgttactggccgatcagatgtcggtcatcggaagtcgtaagaagtccgtcaatatgactgagtgtgtacccgtgccttcttccgagcacgttgcagaaattgtgggtaggcagggctgtaaaattaaggcacttagggccaaaacaaatacctacatcaagaccccggtccgcggtgaggaaccagtctttatcgtgaccgggcgcaaggaggatgtggagatggctaagcgggagattctgtcagcagccgaacatttctctatcatccgcgccacacgcagtaaggccgggggcctgcccggggccgcccagggtccacctaatttacctggtcaaacaactatacaggtccgcgtgccttaccgcgtggtgggattggttgtgggacctaaaggcgccactattaagcgtatccagcagagaacccacacatacattgtgacccctggccgggacaaggaacccgtgttcgccgttacaggaatgcctgagaacgtggaccgcgccagggaggaaatcgaagcccacataacactgagaacaggcgcatttaccgacgctggcccagattcagactttcacgccaacggcacagatgtgtgcctggaccttctgggtgccgccgccagcctttgggctaaaacacccaatcagggaagacgcccccccacggcaacagccgggttgagaggggacacagcactgggagcgccatccgctcccgaggcattttacgctgggagccgaggcggcccttcggtgcctgaccccgggcccgccagcccctattccggctcaggaaacgggggcttcgcctttggggcagaaggtccaggggcccccgtgggaacagctgcccccgatgattgtgatttcgggttcgattttgatttcttagctcttgatcttacagtgcccgccgccgccaccatctgggcccctttcgagcgagctgccccactgcctgccttctcaggatgcagtaccgtgaatggcgctcctggtcccccggccgccggcgcccggcgatcaagcggagccggcacaccacgccattcacctaccctgccagagcccggagggcttcgtctagagttaccactgagccgccggggcgctcccgaccccgtgggcgcactgagctggcgacctccacagggacccgtctctttccccggcggtgcagccttcagcactgccacgtcactgccgagcagtccagcggccgcggcgtgcgccccactggatagtggcgcctcagagaactcgcgcaaacctccttctgcatccagtgcgcctgccctagcccgtgagtgtgtggtgtgtgccgagggcgaagtgatggctgccctggtaccctgcggccataatttgttttgcatggattgtgccgtgcggatctgtggcaagagtgaaccggaatgcccggcttgcaggacccctgcaacacaggcaatccgtgtcgaaacggaaacaccgcagcctggaggtgcctccgcattgcaaagacagtattag

SEQ ID NO: 124218 - DNA, 1956 bp, Artificial Sequence
  Description of Artificial Sequence: Synthetic coding sequence
atgccgtcatcccttgggcagccggacggcggaggcggtggtggcggtggcggcggaggcgtgggagctgccggagaggaccctggacctgggcctgcccccccacccgaaggcgcccaggaagctgcacccgcacctcggcctcccccagaacccgatgacgctgcagccgcgctgcggctggcattggatcagcttagtgcacttggcttagggggcgccggcgatacggacgaagagggcgccgctggtgacggcgccgcagccgctggaggagcggatggcggggctgccccagagccagtaccgcctgatgggcctgaggcgggtgctcctcctactttagctcccgccgttgcacccggctccctccctcttctcgaccccaacgccagcccaccgcccccgccacccccacggccctctcccccggatgtatttgctggctttgcccctcatcctgccgcactcggacctcccaccctgcttgcggaccagatgtccgtgattggctctcggaaaaaatctgtaaatatgaccgagtgtgtccctgtcccatcaagcgaacatgtggccgagattgtcggcagacagggatgcaagattaaagcactcagggcaaagaccaatacctacatcaagaccccagtgagaggcgaggagccagtgttcatcgtaactggcagaaaagaagacgtggagatggctaaacgggagatactgagcgcagccgaacacttctccattatccgcgctacaagatccaaggcggggggcttgccaggggctgctcaaggacccccgaacctgcccgggcagaccaccatacaagtcagagtaccctatcgggtggtcggtctcgtggtggggcctaaaggtgcaacaatcaagaggattcaacagcgcacccacacctacatagtcaccccaggccgcgataaagagccagtgtttgcagtgacaggtatgccggaaaacgttgatagggcgagggaggagatcgaggctcacattacgctgagaaccggcgcgtttacagatgccgggccggacagcgattttcacgctaatgggactgatgtgtgcctagatctgttaggtgccgccgcttctctttgggcaaaaaccccaaaccagggccgaagaccacctacagcaaccgccggcctgcgaggagatacagccttgggagccccttctgcacctgaagcattttatgccggctctagaggaggaccaagtgtcccagaccccggcccggcatctccttattccgggtccggcaacggcggttttgcgttcggggcagagggcccaggcgccccggtcgggacagccgcgcctgatgactgcgacttcggcttcgatttcgactttctggcactagacctaacagtgcccgccgccgctaccatttgggcccccttcgaacgagccgcccccctcccggccttttcaggatgctctactgtcaacggtgcacccggcccccctgcggccggagcaagaaggtcgagcggggccggaacacccagacatagtccaaccctgccagaacctggcgggttgaggctcgaactgccactgtcgcggcggggcgcccccgaccctgttggagccttgagctggcgccccccacagggccctgttagcttcccaggaggagctgcctttagcaccgcaaccagtctcccttcgtcacccgcagctgccgcatgtgctcccctggactccggcgcatccgaaaattcacgaaaacctccttctgccagctcagctccagccctggcgagagaatgcgtggtctgcgctgaaggtgaggtgatggccgccctcgttccttgcggtcacaacctcttttgtatggactgtgccgtgcggatttgtggaaaatctgagcccgaatgtcctgcctgccggactccagcaacccaggctattcacattttctcctag

SEQ ID NO: 124219 - DNA, 966 bp, Artificial Sequence
  Description of Artificial Sequence: Synthetic coding sequence
atgcagtgccgattgccgcggggcctcgcgggcgctttactgacactgctatgcatgggtctgctatgcttgaggtaccatctgaatttaagcccacaacgggtccagggaacgcccgaactgtcccagcctaaccctggccctcctaaacttcagctgcacgatgtgttcatcgccgtgaaaactactagggccttccatcggcttcgcttggagctgctgcttgacacctgggtgtcccgcacacgggaacagacctttgtattcaccgactctcccgacaaagggctccaggagcggctgggcagccatcttgtcgtcactaactgctctgctgagcactcccatcctgcattgtcctgcaaaatggccgcagagttcgacacctttctggcatcagggctacgatggttctgccacgtagacgatgacaactatgtcaatcctcgggccctgcttcagctgctgcgggctttccctctggctcgggacgtgtatgtcggacggccgagtttgaaccgacccattcatgcatctgagccccaaccacacaacaggacccggctcgtccagttctggtttgctaccggcggcgcaggtttttgcattaatcggaaattggcactgaagatggccccctgggcctcaggttctaggtttatggacacttcagcacttattcggctgccagatgactgtacgatgggatatatcatagagtgcaaactcggcggccgccttcagccctctcccctttttcattctcacctcgagacattgcaactactacgtactgctcagcttcccgaacaggtcactttgtcatatggcgtctttgaggggaagttaaatgttatcaagctgcaaggacctttttcccccgaagaagatccaagcaggttcagaagcttacactgtctcttgtatcctgataccccctggtgtccgcagttgggcgcccgctag

SEQ ID NO: 124220 - DNA, 924 bp, Artificial Sequence
  Description of Artificial Sequence: Synthetic coding sequence
atgcagtgtcgccttccaaggggcctcgcaggtgccctcttgactctgctgtgtatggggctgttgtgcttgaggtatcatcttaatcttagcccacagcgagtccagggaactcccgagctgtcacagcctaaccctgggccccccaaactgcagctccacgacgtgtttattgcagtgaaaaccaccagggccttccaccgtctcaggctggagctcctcctggatacttgggtgtcgcggacaagagagcaggttactcggtcacatcttgtagtgaccaactgttctgctgagcactcacaccccgcacttagctgtaaaatggcagccgagttcgatacctttcttgcttccgggctcaggtggttttgccatgtcgacgacgataattacgtgaatccgcgcgctctgttgcaactgctccgagcattcccactggccagagatgtgtatgtcggtcgaccttccctgaacagacccattcacgcttctgagccacagccccataacaggacaagactggtgcaattttggttcgctaccggaggcgctggattctgtatcaacagaaaacttgcacttaaaatggcgccatgggcttcgggaagtaggtttatggacacttctgctcttatcagattgccagacgattgcaccatgggatacattatagaatgtaagctcgggggacgtcttcagccttcccctttattccacagccatctggaaacattacagttacttcggaccgcccagttaccagaacaggtgacgctgtcatacggggttttcgaaggaaagcttaacgtaatcaagctgcagggaccctttagccccgaagaagatccatcgcggttcaggtccctccactgcctgctgtacccagacacaccttggtgtcctcaactcggggctcggtag

SEQ ID NO: 124221 - DNA, 357 bp, Artificial Sequence
  Description of Artificial Sequence: Synthetic coding sequence
atgcagtgtcgtttacccagggggctagcaggggcactcctgacattgctttgtatgggattactttgccttcgttatcacctgaacctgtccccccagcgcgttcaaggcaccccggagctgtcccaacctaaccctggtccacctaagttgcagctccacgacgtcttcatcgctgtaaaaactacccgtgcatttcaccggctgagactcgagctgctgctagacacctgggtttctcgaaccagagaacaaacgtttgtctttacagattcccctgacaaggggctccaggagcgcctcggttccccagatagcagctctctacttcaagggccaaccttatggtcaccctag

SEQ ID NO: 124222 - DNA, 399 bp, Artificial Sequence
  Description of Artificial Sequence: Synthetic coding sequence
atggcagcggagtttgacacattcctggccagcggactgaggtggttctgccatgtggacgatgacaattacgtgaatccgagggcactgctgcagttattgagggccttccctctggcacgcgacgtttacgtaggacgcccctctctcaataggcctatacatgccagcgagcctcaacctcataacaggacgaggctcgttcagttttggtttgcaacggggggggctggcttttgtatcaataggaaactggcactcaagatggctccctgggctagtggctcacgcttcatggatacctcggcactgattcgcctgcctgatgattgcacgatggggtatattattgagtgcaagcttggcgggcgattacaaccgtcacccctctttcactag

SEQ ID NO: 124223 - DNA, 132 bp, Artificial Sequence
  Description of Artificial Sequence: Synthetic coding sequence
atggcagctgaatttgacacgttcctggcaagcggcctacgatggttttgccacgtcgatgacgacaactatgtgaatccccgcgccctgctgcagttgctcagggcattcccactggcccgcgatgtctag

SEQ ID NO: 124224 - DNA, 264 bp, Artificial Sequence
  Description of Artificial Sequence: Synthetic coding sequence
taaagccatctggagaccttgcaactgctccggacagctcagctccctgagcaaatctccctaccacctctgtccgctctgtcacgctacacattagtgtccccggctgggtgcccgatgaatcccgaactgctgggaaaggggtgggctgaaacgagtgggtgcgcgctcgccccaaaggtcgccttgtgggtgcctggtaagtgtctagtgattggcagtccctggcagggattgcgggtggtggggaagcctcgtatttag

SEQ ID NO: 124225 - DNA, 999 bp, Artificial Sequence
  Description of Artificial Sequence: Synthetic coding sequence
atgggactaggaccggtattcctgctcctggcgggcattttcccatttgcgcccccaggcgccgcggccgagcctcactctcttaggtacaatttgacagttctctcttgggacggatccgttcagagcggattccttgcagaagtgcatctcgacggacaacctttcctgcgctatgaccgtcagaaatgcagggctaaaccacaaggccagtgggccgaggacgttttggggaacaaaacttgggacagggaaaccagagacctgactgggaacgggaaggatcttcggatgactctggcacacattaaagatcagaaggaaggcctgcattccttacaggaaattcgcgtttgtgagatccatgaagacaattcaaccagaagcagtcagcatttctattacgatggggaactctttctgtcacagaaccttgagactgaagaatggaccgtgccgcaatcatcccgagcccaaaccttggccatgaacgttcgcaactttttgaaggaagatgccatgaaaacgaagacccactaccacgctatgcacgcagattgccttcaggaattgcggaggtaccttgaatcaggtgtcgtattaagacggaccgttccgccaatggtgaacgtgaccagaagtgaggcttccgaggggaacattacagtcacctgcagagcgtcaagcttctatcctagaaatataatcctgacctggcggcaggacggtgttagcctttctcatgatacacagcagtggggagacgtactacctgatggcaacggtacctaccagacctgggtagccacccgcatctgcaggggagaggaacaacgctttacgtgttatatggagcattcaggcaatcattctacgcacccagtgcccagcggcaaagtcctagtgctccaaagtcactggcagaccttccacgtgagcgcggtagctgccggatgctgttacttctgttattattatttcctttgcccgcttctctag

SEQ ID NO: 124226 - DNA, 585 bp, Artificial Sequence
  Description of Artificial Sequence: Synthetic coding sequence
atgggccagagggaccaaggactggatagagagagaaagggcccccaggacgatcctggatcttaccagggacccgagcgccggaacttcctgaaggaagacgccatgaaaaccaaaacacactaccacgcaatgcatgccgattgtcttcaggaattgaggcgatatttggaatccggagtcgtgctgcgcagaacggtgccacctatggtgaatgtcacccggagcgaagcctctgaaggtaatatcacggtaacatgccgagccagctccttttatccccgaaacatcatcctaacatggaggcaggacggcgtaagtttaagccacgatacacagcagtggggggacgtcctgccagacggcaacggtacctaccagacctgggtggccacaagaatctgcagaggcgaggagcaacgctttacgtgttacatggaacatagcggaaaccacagcactcaccctgtgccatccggcaaggtgcttgtcttgcagtctcattggcagacctttcatgtctccgcggtcgccgccggatgctgctacttttgttactactacttcttatgccctctgttatag

SEQ ID NO: 124227 - DNA, 870 bp, Artificial Sequence
  Description of Artificial Sequence: Synthetic coding sequence
atgggcctcggaccagtattccttttattagctgggattttccctttcgcccctccaggcgcagctgctgaacctcattcgctgcggtacaatctaaccgtgctgagctgggatggatccgttcagagcgggtttctggccgaggtgcacctggatggccagccgtttttaaggtacgaccgacaaaaatgccgggcgaagcctcaggggcaatgggctgaggacgtcttgggaaataagacatgggaccgagagacccgcgatctgacaggcaacggaaaggatctccgcatgaccctcgcccacatcaaggaccagaaagaagtgccccagtcatctcgggcacagaccctggccatgaatgtacggaactttttgaaggaagatgcaatgaaaacaaagactcactaccacgcgatgcacgccgattgtctgcaagagctgaggcgctacctggaatccggggtggtgctgcgtcgaaccgtgccaccgatggtgaatgtgaccagatcagaggcttcagaaggtaacatcaccgtcacttgtcgggcttccagtttttatccccgtaatattatcttaacctggagacaggacggcgtgagcctgagccacgacacccaacagtggggagatgtgctgccagatgggaatgggacttaccaaacatgggtagcaacacggatctgccggggagaagaacaacggtttacctgctatatggaacattctggcaaccacagcactcatccggttccatccggtaaggtcctcgtgcttcagtctcattggcagactttccacgtgtccgccgtcgcagcaggttgttgctatttctgttactactacttcctttgccctctcctctag

SEQ ID NO: 124228 - DNA, 738 bp, Artificial Sequence
  Description of Artificial Sequence: Synthetic coding sequence
atgggtcagcgtgatcagagactcgatcgggaacggaagggcccacaggacgatcccggcagctatcagggccctgagaggcgaaatttccttaaagaagatgccatgaagacgaagacacactaccatgcaatgcacgccgattgcctgcaggaattgaggcggtatcttaaaagtggagtggttttgcgccgcacagttccccccatggtgaatgtaacacggtccgaggcatccgaggggaatataacagtcacgtgtcgcgcatctggtttctatccatggaatatcaccctctcgtggcggcaagatggggtatctctctcccacgacactcagcagtggggcgacgtcctgccagacggaaacggaacttaccaaacgtgggtggctactcgaatatgccagggtgaggagcagcggttcacatgctatatggagcacagcggcaatcatagtacacaccccgtgccatctgggaaggtactggtgctgcaatcccattggcagacattccacgtgtcagctgttgccgccgccgccatcttcgtgattatcatcttctacgtgcggtgttgcaaaaaaaagacctcagctgcagagggtcctgagcttgtgtccctccaggtgttagatcagcatcccgttggtactagtgaccacagagacgctacccagcttggcttccaacctcttatgtcggatttaggcagtaccggaagcaccgagggagcctag

SEQ ID NO: 124229 - DNA, 1152 bp, Artificial Sequence
  Description of Artificial Sequence: Synthetic coding sequence
atgggcctgggccccgtgtttctattactagccggcatctttccttttgcacctcctggagctgccgccgaaccccattccctgcggtacaacctgaccgtgctaagctgggacggcagcgtgcaatctgggttcctgaccgaggtgcaccttgatggtcagcccttcctgcggtgcgatcggcaaaagtgcagggcgaagccccagggacaatgggccgaggatgtgctgggaaataaaacttgggaccgtgagacaagggacctgacaggcaacggtaaggacctgcgcatgacccttgcacacatcaaggatcaaaaagaggggcttcactctctgcaggaaataagagtatgcgagatacacgaagacaattctaccaggtcctcccaacacttttattacgatggcgagttgttcctgagccagaatttggagacaaaggaatggaccatgccccagagctcacgcgctcaaacccttgcgatgaacgtgcgtaactttctgaaggaggatgccatgaagactaagacacactaccacgcgatgcacgccgactgcctccaggaactcaggcgataccttaaaagcggagtggtcctgcggcggacagttcctccaatggtcaatgttactagatctgaagcttcagagggcaacataacagtcacttgcagggccagcggtttttatccctggaacatcaccttgagctggaggcaagatggagtcagcctgtctcatgatactcagcagtggggggacgtgctccccgatggcaacgggacctatcaaacttgggtggccactcggatttgccaaggagaggaacagagattcacctgctatatggagcatagcggaaaccactccacccatccagtgccgtctggaaaggttctggtgttacagtcacactggcaaaccttccatgtgagcgccgtggcagccgcggccatcttcgtgatcatcatcttctatgtccggtgttgcaagaagaaaacgagcgcagcagagggccccgaacttgtctctctgcaggtgctggaccagcacccagtcggaacaagtgatcaccgcgatgcaactcagcttgggttccagcccttaatgagcgacctgggatccacaggcagcacggaaggagcttag

SEQ ID NO: 124230 - DNA, 870 bp, Artificial Sequence
  Description of Artificial Sequence: Synthetic coding sequence
atggggctcgggcccgtattcctcctgctagccggtatttttccctttgcacctcctggagcagccgcggagccccatagtctgaggtacaatctgaccgtgctgagttgggacgggtcagtccagtcaggcttcctggccgaagtccacctggacggccagccctttttgcgctacgatcgccaaaagtgcagggccaagcctcaaggacagtgggcagaggacgtattgggtaacaagacctgggacagggaaactcgggacctcacaggcaacggaaaagacttacggatgaccctagcgcacattaaagatcagaaggaagtgccccagagttctcgtgctcagactcttgctatgaatgtgcggaacttcctgaaggaggatgcaatgaaaaccaagacacactaccacgcgatgcatgctgactgtcttcaagagttacgcaggtatcttgaatcaggcgtcgttctgcggcggactgtgccgccaatggtcaacgtcactcggagtgaagcgagtgagggcaacataaccgtgacctgccgcgcctcttccttctaccccaggaatatcatcctaacttggagacaagacggcgtgagcctcagccacgacacccagcagtggggtgatgtcctccccgatggaaacgggacttaccagacctgggtagccactcggatatgccgaggagaggaacagcgcttcacctgttatatggagcattctggcaaccacagtactcaccccgtcccctctggtaaggtcctggtcctgcaatcgcattggcaaacatttcatgtgtctgcggttgctgctgggtgctgctatttctgttattattatttcctctgccccctcctgtag

SEQ ID NO: 124231 - DNA, 999 bp, Artificial Sequence
  Description of Artificial Sequence: Synthetic coding sequence
atggggctgggacctgtatttctcctgctcgcagggatctttccatttgcaccacctggagcagctgctgagccacatagccttagatacaacctgacagtcctgtcctgggacggtagcgtgcagtccggtttcctggccgaggtgcacctcgacggtcaacccttccttcgctacgacaggcagaagtgcagagccaaaccccagggccagtgggccgaggatgtgctaggtaataagacatgggatagggagaccagagatcttaccggcaatggcaaagatctccggatgacactggcacacattaaagatcagaaagaagggctgcacagtctgcaggagatccgcgtctgcgagattcacgaagataactcaaccaggagctcacagcacttctactacgatggcgagctgtttctgagtcagaatctggagactgaggagtggaccgtcccccagtcatccagggcccagacactggccatgaacgtacggaactttctaaaggaggatgccatgaaaacaaaaactcattaccatgccatgcacgctgattgcctgcaggaacttcgcagatacttggagtcgggggtggtgcttaggagaactgtgccaccaatggtcaacgtaacccgaagcgaggcctccgaaggtaatataaccgtgacatgccgcgcatcctcgttctacccccgcaacattattttaacctggcggcaggacggggtctccttatcacatgacacacagcaatggggcgatgtgctccccgacggcaacggaacctaccagacatgggtagcgacacgaatatgccgcggtgaggagcagcgctttacttgctacatggagcactcaggaaaccacagcacacatcctgttccttctggtaaagttctcgttctgcagtctcattggcagactttccacgtgagtgcagttgcagctggttgctgttatttttgctactattacttcctgtgtcccttgctgtag

SEQ ID NO: 124232 - DNA, 585 bp, Artificial Sequence
  Description of Artificial Sequence: Synthetic coding sequence
atgggacagagggatcagggtctggacagagaacggaagggtccccaagacgaccccggaagttaccaggggcccgaacgcaggaacttcctgaaggaggatgccatgaagacaaagacccactaccacgccatgcatgccgattgcctccaggagctgcggcgatatttggagtccggcgtagtgttaagacgcactgtgcctcccatggtaaatgtgactcgtagtgaagccagcgaagggaatattaccgtcacatgccgggcatctagcttttatccccgaaacattatcctcacctggcggcaggatggagtgagtctgtcacacgacacccagcagtggggggacgtgttgccagacggtaatgggacataccagacatgggtcgcaacaaggatttgccgaggagaggaacagcgcttcacatgttatatggagcatagtgggaatcacagtacccatccagtaccttcgggaaaggtgctggttttgcaaagtcattggcagacctttcatgtatctgctgttgccgcaggctgctgttacttctgctattactattttctctgtcccttactgtag

SEQ ID NO: 124233 - DNA, 831 bp, Artificial Sequence
  Description of Artificial Sequence: Synthetic coding sequence
ttcccttttgctccacccggagccgctgcggagccccactccctgaggtataatctgaccgtcctgagttgggacggctctgtccagtcagggtttcttgcagaggtccacttggacggtcaaccgtttttgagatatgacaggcagaaatgtagagctaaaccccaagggcagtgggccgaggatgtgctcggcaacaaaacatgggatcgcgaaacacgcgatctaaccggaaatgggaaggatctccgaatgaccctcgctcatatcaaggatcaaaaggaagtacctcctatggttaacgtgactcggtctgaggcctccgagggcaacatcacggtcacatgcagggctagtagcttctacccacgcaacattactttgacatggcgacaggatggggtgagtcttagccacgacacacaacagtggggagatgtccttcccgatggtaacggcacatatcagacatgggtagccacacgcatctgtcagggagaggaacagcggttcacctgctacatggagcactctgggaaccatagcactcaccctgtgccgtcgggcaaggttctggtgttgcaatctcactggcagacttttcacgtgtcagcagtggccgccgccgctgccgcaatcttcgtcattattattttctacgtgaggtgttgtaagaaaaagacctctgcagccgaaggacccgagttggtttctttacaggtgcttgatcagcaccccgttggcacttctgatcacagagacgcaacccagttgggattccagccactgatgtctgcactaggatcaacgggcagtaccgagggtgcatag

SEQ ID NO: 124234 - DNA, 1158 bp, Artificial Sequence
  Description of Artificial Sequence: Synthetic coding sequence
atggggctcggtccagtgtttttgttactcgcagggatcttcccttttgctccgccaggcgccgcagccgaaccacactctctgcgttataatttaacagtgctgtcctgggacggctccgtgcagagtgggttcctggccgaggtgcacctggacggacaaccttttctacgctacgatcgccagaaatgtcgtgcaaaaccccaaggtcagtgggcggaagacgtgctggggaacaaaacctgggacagggagacacgtgatctgaccggcaatggaaaggatctgcggatgactctggcacacatcaaggatcagaaagaggggctgcactctctgcaagaaataagagtctgtgaaattcacgaggataacagcactcgcagctctcagcacttctactacgacggcgagctgtttctatcacaaaacgtggagacggaggagtggacagttcctcaatctagcagagcacagactttagcaatgaacgtgagaaattttctgaaggaagatgcaatgaaaacaaagacccattaccacgccatgcatgccgattgtctgcaggagttgcggcgctaccttgagtccagtgttgtcctcaggaggcgagtaccacccatggtgaacgtgacgaggagtgaagcttcagagggcaatataaccgtgacatgtagggctagctcgttctacccaaggaacatcacattaacatggcggcaggacggcgtctccctaagtcacgacacccagcagtggggagacgttttgcccgacggcaacggcacctaccagacatgggtcgccactagaatctgtcagggggaagagcaaagatttacgtgttacatggagcactctggcaaccatagtacccacccggtgccttcagggaaggtgcttgtcctgcagagtcactggcagactttccatgtcagcgccgtggcagctgccgccgccgccatctttgttatcatcatcttctacgtgaggtgctgtaaaaaaaaaacttctgccgcagagggacccgagttggtgtcactacaggtactggaccagcaccctgtgggaacttccgaccacagggatgcaacgcagctgggctttcaacccctcatgtcagctttggggagcaccgggtcaaccgaaggcgcgtag

SEQ ID NO: 124235 - DNA, 744 bp, Artificial Sequence
  Description of Artificial Sequence: Synthetic coding sequence
atgggacagcgcgatcagggcctagaccgggagagaaagggaccacaggatgatccaggcagttatcagggcccagagagaaggaatttcttgaaggaggatgcaatgaagacaaagactcactaccacgctatgcacgcggactgcctgcaggagctcagaagatatctggagagcagcgttgtcttgcggaggagagttcctccgatggtcaatgtcacccgctccgaggccagcgagggcaacattaccgtgacttgccgagcaagctcattttatccacgcaatatcacccttacttggagacaggacggcgtgtctctatcccacgatactcagcagtggggggacgtcctgcctgacggcaatggcacataccagacgtgggtcgcaacccggatctgccagggcgaggagcaacgcttcacctgctacatggagcattccggaaaccactcaactcatcctgtccccagtggcaaggtgttagttctccagagccactggcaaacgttccatgtgtccgctgtcgccgcagctgcggccgctatattcgtgattataatcttttatgttcgctgttgtaagaagaaaacttcagccgccgaaggtccggaacttgtcagtctgcaggttttggatcagcacccagtcggcacctctgatcaccgcgatgccactcagttggggttccaacccctgatgtctgcccttggcagtacaggatctaccgagggggcctag

SEQ ID NO: 124236 - DNA, 672 bp, Artificial Sequence
  Description of Artificial Sequence: Synthetic coding sequence
ttccctttcgccccgccaggggcagccgcagaaccccactccctccgctacaacctaacagtcctgtcctgggatggctccgtgcaatctggctttttagccgaagtccacctagatggacagccttttctgcgctacgataggcagaaatgtcgagctaagccacaaggccagtgggccgaggacgtactaggaaacaagacatgggatagggaaacacgtgatctgaccggaaacggaaaggatctcaggatgactctagctcacatcaaggaccagaaggaagtgccgcccatggttaacgtcacccggtctgaggcgtccgagggtaatatcactgtgacctgccgcgcgagctccttttatccccggaacatcatcctgacctggcgccaggacggtgtgagcttgtctcatgatacacaacagtggggagacgtgctacccgatggtaatggcacataccagacatgggtggctacacgcatttgcaggggagaagagcagaggtttacttgttacatggaacactccggcaaccactccactcaccccgtgccatcggggaaggtgcttgtacttcagtcacattggcagactttccacgtctccgcggttgcagctgggtgctgctatttctgttactattacttcctttgcccccttctgtag

SEQ ID NO: 124237 - DNA, 672 bp, Artificial Sequence
  Description of Artificial Sequence: Synthetic coding sequence
ttcccatttgctccacccggtgccgctgcagaaccccattccttacgatacaacttgaccgtcctgtcatgggacggatcagtgcaatccggctttctcgcagaggtgcacctagacgggcaaccattcctgcgctatgaccgtcagaagtgcagagctaagccacaggggcaatgggcagaagatgtactcgggaacaagacatgggaccgagaaactcgggacctgacagggaacggcaaagacttgaggatgacgctcgctcatattaaagatcaaaaggaggtccctcccatggttaacgtgacacggtctgaagcttccgagggaaacatcaccgtcacttgtagggcgtccagcttttatccccgcaatattattttgacctggagacaagatggtgtgtccctttcacatgacacacagcagtggggggatgttcttccagacggcaacggaacatatcaaacgtgggtagctacccggatatgccgaggcgaggagcagcggtttacatgctatatggaacatagcggaaatcacagcactcatcccgtgccaagcggcaaagtgttagtgctccaaagccattggcagacctttcatgtatcagccgtggccgctggatgctgttacttctgctactactactttctttgcccccttctgtag

SEQ ID NO: 124238 - DNA, 672 bp, Artificial Sequence
  Description of Artificial Sequence: Synthetic coding sequence
tttccattcgcacctcctggcgctgccgccgaaccccattccttgcgatacaatctcacggtgctctcctgggacgggagcgtgcagagcggttttttagccgaagtccacttggatggtcaaccctttcttagatacgatcgccagaagtgtcgcgctaaacctcaaggccaatgggctgaagatgtactcggcaacaaaacttgggacagggagactcgggacctaacgggaaacgggaaggacctacggatgaccctcgcccatatcaaggaccaaaaagaggttcctcctatggtgaatgttacccggtccgaggcatccgaaggcaatatcacagttacatgtagggcctcatcattctacccacgcaatatcattctgacctggcggcaggacggagtgtccctatcacacgacacacagcagtggggagacgtgctcccagacgggaatgggacctaccagacatgggtggctacccgcatctgcaggggggaggagcaacggttcacctgttatatggaacacagtggaaatcattctactcatcccgtgcctagcggaaaggtcctggttcttcagagtcactggcagacgtttcacgttagcgctgtcgcagctggttgttgctatttctgttattattatttcctctgtccactgctctag

SEQ ID NO: 124239 - DNA, 999 bp, Artificial Sequence
  Description of Artificial Sequence: Synthetic coding sequence
atgggtcttgggccggtgttcttgctgctggcgggaatcttcccattcgctccccccggagcagccgccgagccccatagcctccgctataacctaacagtgctgtcgtgggacggttctgtgcaaagcgggttcctcgccgaggtgcacctggacgggcaacccttcctgcggtacgatagacagaagtgccgcgccaagccccagggacagtgggctgaggacgttttaggaaacaagacatgggatagagagaccagggatctgaccggaaacggcaaggatcttcgtatgacactcgcgcacatcaaggaccaaaaggaaggattgcattccctgcaggagatcagggtttgcgaaatacacgaggacaactctactagaagcagtcagcatttttactacgacggagaactgttcttgtcccagaatctcgaaactgaggagtggactgtgcctcagtcctctcgtgctcagacgctggctatgaatgtcagaaacttcctcaaggaagacgccatgaagacaaagacgcactatcacgctatgcatgccgactgtctgcaggagttgcggaggtatctggagtccggtgtagtcttacggagaacagttccccctatggtgaatgtgactcgatcagaggccagcgaagggaatattacagttacctgccgcgccagcagcttctatcctaggaacatcatactgacatggcggcaggacggagttagtctgtctcatgatacccagcagtggggcgacgtgcttccggacggcaacgggacctatcaaacgtgggttgctacaagaatttgccgcggagaggaacagagatttacgtgctacatggaacactctgggaaccacagtacccatcccgtgccatctggcaaagtgctggtgttgcagtcccactggcagacatttcacgtctcggcagttgccgcgggctgctgttatttctgctactactattttctctgccctctgctgtag

SEQ ID NO: 124240 - DNA, 1029 bp, Artificial Sequence
  Description of Artificial Sequence: Synthetic coding sequence
atgggactcggccccgtctttctactgctcgccggcatttttccatttgccccaccaggagcagctgcggagccacatagcctaagatataacctgacggtgctgtcttgggacggatctgtgcagtcaggttttctcgctgaagttcacctagacggacagccctttctgaggtatgaccggcagaagtgccgggccaagcctcaaggccaatgggctgaggacgtcttgggcaacaaaacttgggaccgggaaacgagggatcttaccggcaacgggaaagatcttaggatgaccttggcccatattaaggaccagaaagaggttccccaatctagcagagcacaaaccctcgcgatgaacgtgagaaattttcttaaggaagacgcgatgaaaactaagactcattaccacgctatgcacgcggattgtctgcaagaactgcgacgctaccttgaatcttcagtcgtactgaggaggcgcgtgccccccatggtgaatgtgactaggtccgaggcaagcgaaggcaatatcaccgtgacttgtagagccagctcgttctaccctcgcaatattacacttacctggaggcaggatggggttagcctctctcacgacacacaacagtggggggatgtcctgcctgacggtaatggaacatatcagacttgggtggcaactagaatctgtcagggtgaggaacagcggtttacttgctatatggagcacagcggaaaccatagcactcatccagtgccctccggaaaagtgctggtgctgcaaagtcactggcagacgttccatgtctccgctgtggctgccgctgccgctgccattttcgtgatcatcattttctacgtgcgctgctgcaaaaaaaaaaccagcgccgcggagggaccagaactagtgtcactgcaggtcctggaccagcatcccgtggggaccagtgatcaccgcgatgctacgcagctcggatttcaacctctgatgagtgccctcgggagcactggctctacagagggcgcatag

SEQ ID NO: 124241 - DNA, 825 bp, Artificial Sequence
  Description of Artificial Sequence: Synthetic coding sequence
ttcccttttgccccgcctggggccgcggccgagccacatagccttagatacaacctcactgtactgagttgggatggcagcgttcagtctggatttttaactgaggtacatttggacgggcagccgttcttgaggtgcgatcggcaaaagtgcagggcgaagcctcagggccaatgggccgaagacgttctcggcaacaagacttgggaccgggaaactagagatctcactggcaatgggaaggacctgaggatgacgttggctcatattaaagatcagaaggaagtccctcctatggtcaacgtaactcggtctgaggcctctgagggaaacattacagttacatgcagggcatctggcttttacccgtggaatatcaccttgagctggaggcaggacggcgtttccctgagccacgatacacagcaatggggggacgtccttcccgacgggaacggcacctaccagacttgggtggcaactagaatttgccaaggggaagaacagcgattcacgtgttatatggagcatagtgggaaccactctacacatcccgttccctctggcaaagtgctggtcttgcagagtcactggcagacttttcacgtatcagccgtggccgccgcggccatcttcgtgattatcattttttacgtcaggtgttgcaaaaagaagacatctgcggccgaggggcccgagctagtcagcctgcaagtgctggaccagcatccggtcggaacaagcgaccatcgggacgcaacacagctgggcttccagcccctgatgagcgacctggggagcaccggctctaccgaaggagcatag

SEQ ID NO: 124242 - DNA, 585 bp, Artificial Sequence
  Description of Artificial Sequence: Synthetic coding sequence
atgggacaaagggatcaagggttagaccgggaacggaagggaccccaggatgaccccggcagctaccaaggccccgagcggcggaactttctgaaagaagacgctatgaaaaccaagacccactaccacgcaatgcacgctgattgcctgcaggaactgcggcgttacctagagtcaggggtcgttctgcggagaactgtgcctcctatggttaacgtgacccgatccgaggcgagcgaggggaatataacagtgacgtgtcgcgcttccagcttttatccaaggaatataatactgacatggaggcaggatggagtgagcctctcccatgatactcaacagtggggcgacgtgctgcccgatggtaatgggacctatcagacatgggtcgccacaaggatctgtaggggtgaggagcaaaggttcacctgttatatggagcacagcggcaatcacagcacacaccccgttcccagcggaaaggtgctagtgttgcagtctcactggcagacttttcacgtgagcgctgttgcagccgggtgttgttacttttgttactactattttctctgtccactgttgtag

SEQ ID NO: 124243 - DNA, 870 bp, Artificial Sequence
  Description of Artificial Sequence: Synthetic coding sequence
atggggctcggtccggtgttcctgctactggccggtatctttccgttcgctccaccgggtgccgccgctgagcctcattccctgcggtataaccttaccgtgctttcatgggacggctctgtgcagagcggctttctggctgaggtccacctcgatgggcagccattcttgaggtatgatcggcaaaaatgccgagcaaagcctcagggtcagtgggctgaggatgtgctgggcaataaaacttgggatagagagacacgagacctgactggtaacggcaaagatttgcgcatgacgctggcgcatattaaggatcagaaggaagtgccccaaagcagccgagctcagacattagcaatgaatgtccggaatttcctgaaagaggacgctatgaaaaccaagacacattaccacgctatgcatgctgattgtttacaggagctccgacggtatctggaatctggggtcgtcttgcggaggactgtgccacccatggttaacgtgacccgcagtgaagcatcagaaggaaatattaccgttacttgtcgagcgtccagcttctatcctcgcaacatcatactgacatggcgccaggacggggtgtcactgtcccatgacacccagcagtggggcgacgtactgccggatggaaatgggacataccaaacttgggttgcgacccgtatctgccggggggaggagcaacgatttacatgttacatggagcactctggcaaccatagcactcatcctgtcccctctgggaaagtgctggtgctccagtcccactggcaaaccttccacgtgagcgcggtagctgcaggctgctgctacttttgttactattactttctgtgtccattactgtag

SEQ ID NO: 124244 - DNA, 999 bp, Artificial Sequence
  Description of Artificial Sequence: Synthetic coding sequence
atgggcctcgggcccgtgttcctgctcctcgccggtatcttcccctttgcaccgcctggcgccgctgccgagccgcatagcctgcgctacaatctgactgtcctgagctgggacggttcagtacaaagcggctttctggccgaagtgcacctggacggacaacccttcttaaggtacgacaggcagaaatgtcgagcaaagcctcaggggcagtgggccgaggacgtgttaggcaacaagacttgggatcgggagacaagggacctcactgggaatggaaaggatctgaggatgaccctcgcccatattaaagaccagaaagaaggcctccactccctgcaggaaatacgagtgtgtgaaatccacgaagacaactctacgcggtccagtcagcacttctattatgacggcgagctgttcctgagtcagaatctggagactgaagaatggactgtgccacagagcagcagagcacagaccttagccatgaatgtaaggaatttcctgaaggaggatgcgatgaagacaaaaacacattaccacgcaatgcacgcagactgcctgcaggagctccgccgatacctcgagtccggcgtcgtgctgagaaggacggtgccccccatggtaaacgtgactcgatctgaggcctccgagggaaacattaccgtaacctgccgagcaagttctttttatcccagaaatattatcctgacctggaggcaagatggagtgtccctttcccacgatacacaacagtggggtgacgtcctgcctgatggtaatggtacgtaccagacctgggtcgctaccagaatatgtcgcggagaagaacagaggttcacctgctacatggagcacagtgggaatcatagcactcatcctgttccgtctggaaaggtgcttgtcctgcagagccattggcagaccttccacgtgtcagccgtcgccgccggctgctgttatttctgttattactacttcctctgccccttactctag

SEQ ID NO: 124245 - DNA, 999 bp, Artificial Sequence
  Description of Artificial Sequence: Synthetic coding sequence
atgggcctagggcctgttttccttttactcgctggcatttttccgtttgctccgcccggggcagctgcggagccccatagcctgcggtataatctgacggtgctgtcttgggatggatctgttcagagcggatttctggctgaggtccacctggacggtcagcctttcttaagatatgaccgccagaagtgtcgcgcaaagccccagggacagtgggctgaggacgtgctcggcaataagacctgggatagagaaacccgggacctcacaggaaacgggaaagatttgagaatgactttggcacacatcaaggaccagaaggagggcctgcactccctgcaggaaatcagggtttgcgaaatccatgaggacaattccactcggagctcccagcatttctattacgacggagagctgttcctctctcagaatctagagacagaggaatggacagtaccacagtcctcacgggcgcaaacactcgctatgaatgtgcgcaacttcctgaaagaggatgccatgaagaccaagacccactaccacgcaatgcacgctgactgtcttcaggagctgcgccgctatctggagtcaggggtggtgctgagacggactgttcccccaatggtaaatgttaccaggtcagaagcctccgaaggcaatatcactgtcacttgtagagcatcctctttctacccaagaaatattattcttacctggcgccaagatggcgtttccctttcacacgacactcagcaatggggggatgtcttgcctgatgggaacggaacatatcaaacatgggtagccacaagaatttgccgaggcgaagaacagaggttcacctgttacatggaacattccggcaatcattccacccatccagtcccctccggaaaagttctggtcctccagtctcactggcaaaccttccatgtatcggccgtcgccgccggatgttgctacttctgctactattacttcctatgccctctgctctag

SEQ ID NO: 124246 - DNA, 1152 bp, Artificial Sequence
  Description of Artificial Sequence: Synthetic coding sequence
atgggtttggggccagtgttcctcctgctggccggcatcttcccattcgcaccgcccggggccgctgccgagccacattcccttcggtataacttgacggtgctgtcttgggatggatccgtccagtccgggttcctgacagaagttcacttagacggacagcccttcttacgctgcgaccgccagaagtgcagagccaaacctcagggacagtgggctgaagatgtactagggaacaaaacctgggaccgagagacccgcgatctgaccggcaacgggaaggacctccgcatgacgctggcacacatcaaggatcagaaagagggtctgcacagtctccaggaaattagagtgtgtgagattcacgaagacaactctactagatctagtcagcatttttattacgatggagaactgttcctgtctcagaacctagagacgaaagaatggacaatgccgcagtcctcaagagcgcagaccttagccatgaacgtgcgaaactttttgaaggaggatgcaatgaagacgaagacccactatcacgccatgcacgccgactgtctgcaggagcttcggcgatacctgaaatccggagtagtgctcagaagaactgtgccgcctatggtaaacgtgaccaggagcgaggcttctgaaggaaacatcacggtcacttgtcgcgccagtggcttttacccatggaacattaccctgtcctggcgacaggatggggtgtccctttcacatgacacacaacagtggggggacgtcttgccggacgggaatggaacgtatcagacctgggtcgcaaccaggatttgccagggggaggagcaacgattcacctgttacatggagcattctggtaatcattcaactcaccccgtgccgtccggtaaggtcctggtcctgcagagtcactggcagacgttccacgtctccgccgtggctgcagctgccattttcgtgattatcatattctacgtgcgctgctgtaagaagaagacaagcgctgcggaagggccagaactcgtatcactccaagtgctggatcagcaccccgtcggcacatctgaccatcgtgatgcaacacagctaggtttccagccgctgatgtctgacctcgggagcactgggagcacggagggagcttag

SEQ ID NO: 124247 - DNA, 999 bp, Artificial Sequence
  Description of Artificial Sequence: Synthetic coding sequence
atgggattaggccctgtcttcctccttctcgccggcattttccccttcgcacccccaggtgcagccgcagagccgcacagcttgagatataacttgaccgtcctgtcttgggacggctctgtgcaatccggcttcttggccgaggtccatctggacggacagcccttcctccgctatgatcgccagaaatgccgggccaagccacaggggcaatgggctgaggatgtgctgggaaacaagacctgggatagggaaacaagggacttgactggcaacggtaaggaccttaggatgaccctggctcatatcaaggaccaaaaggaggggctgcactccctgcaggagattcgcgtgtgtgaaattcacgaggacaatagcacccgttcaagccagcacttctactacgacggggagctcttcctgtcccaaaacctggagacagaggagtggaccgtgccccagtcttcccgtgctcagaccctcgctatgaatgttcggaattttctgaaggaagatgcaatgaaaaccaagacacactaccatgctatgcacgcagattgtttgcaggaactgagaagatacctcgaatcaggcgtggtgttgagaagaaccgtaccccccatggtgaatgtcacaaggtccgaggcgtcggaagggaacatcaccgtgacctgccgcgcatcatccttttaccctaggaatattatccttacttggcgacaggatggagtctctctgtcccacgatactcaacagtggggcgatgttctgcccgacggcaacggaacctaccaaacctgggtggccacgagaatttgccggggggaggagcagagatttacttgctacatggaacacagcgggaaccacagcactcaccccgtgccatcaggcaaagtgttggtcttacagagccactggcagaccttccacgtgtccgctgtcgcggccggatgttgctatttctgctactattattttctttgccccctgctgtag

SEQ ID NO: 124248 - DNA, 999 bp, Artificial Sequence
  Description of Artificial Sequence: Synthetic coding sequence
atgggtttggggcccgtatttcttctgttagcgggcattttcccattcgccccccctggcgctgccgcagaaccccactccctccgatataacctgaccgtcctgagttgggatggaagcgttcagagcggtttccttgctgaagtccacttggacgggcagcccttcctgagatatgatcggcaaaaatgccgtgccaagcctcagggtcagtgggctgaggatgtactgggcaataaaacttgggacagagaaaccagagacctcacaggcaatgggaaggatctgagaatgacgctcgcccatataaaggaccagaaagaggggcttcactcactccaggaaatccgagtatgcgaaattcatgaggataactccacccggagtagtcagcacttttactacgacggtgaactgtttctaagtcagaatgtggaaacggaagagtggaccgtgccccagtcgtccagagctcagactctggcaatgaacgtgaggaacttcttgaaggaagacgccatgaaaaccaaaacacactatcacgcgatgcacgcagactgcctgcaggagctcagaagatatctggaaagtagtgtggtactaagacggcgtgtgcccccaatggtgaacgtgacaaggtctgaggctagtgaaggcaacatcacagtgacgtgtcgggcatcttccttctatccccgcaacattaccctcacctggcgccaggatggagtttcactctcccatgatacccagcaatggggcgatgtgctgcctgatggtaatggaacctatcagacctgggtggctacacgcatttgtcaaggagaagaacagcgctttacatgctacatggaacattctggcaatcactccacccacccggttccatctgggaaagtactggtactgcagtcacactggcagacattccacgtttcagcggtcgcggcatgttgctgttatttttgctactactatttcttatgtcctctcttgtag

SEQ ID NO: 124249 - DNA, 1152 bp, Artificial Sequence
  Description of Artificial Sequence: Synthetic coding sequence
atggggcttggcagagttttgctttttcttgccgtcgctttcccctttgcacccccagccgcagctgcagaacctcatagcttgaggtacaacctgatggttttgtcccaggatgggtccgtacaatcaggctttcttgctgaaggccacctggatggccagcctttcctgagatatgacaggcaaaagaggagagctaagcctcagggccagtgggctgagaacgtcctgggtgcaaagacttgggatacagaaaccgaagatctgaccgagaacggtcaggatctacgccgaacactgactcacatcaaagaccagaagggcggactgcattccctccaggagatcagagtctgtgaaatccatgaggacagcagcacccgcgggagtcgtcacttctactacgacggcgagcttttcctgagccaaaatctagaaacccaggagtctacagttccacagagttccagagctcagacactggcaatgaacgtcactaacttctggaaggaggacgccatgaaaaccaagacacactatcgggcaatgcaggctgattgcctccaaaagctgcagcggtacttaaaatcgggagtggccattaggcgcacggtgcctccaatggtcaacgtcacctgtagtgaggtgtctgagggaaacatcaccgtcacatgtcgggcttcatccttttatccccggaacatcaccttgacgtggcggcaggacggagtgtcccttagccacaacacccagcagtggggggacgttctgcccgatgggaatggtacataccaaacctgggtcgctacacgcattcgccagggcgaagagcagaggttcacctgttacatggaacacagcggaaaccacggcacacaccccgtaccatcagggaaagcattggtactccagtcacaacgtaccgattttccatatgtgtccgcagctatgccgtgcttcgtcatcattattattttgtgcgtgccctgttgcaaaaaaaagactagcgcagctgagggacctgagctagtgtcactccaggtcctggatcagcatccggtgggaacaggagaccacagagacgccgcccagctgggctttcagccactcatgtccgctacaggctccaccggcagcactgaagggacttag

SEQ ID NO: 124250 - DNA, 1152 bp, Artificial Sequence
  Description of Artificial Sequence: Synthetic coding sequence
atgggcctcggacgtgtcctgctcttcctggcagtggcattcccatttgcccctcccgctgcggccgccgagcctcacagtcttcgttacaatttgatggtactgtctcaggatgggagtgtacagtcaggtttcctggccgaaggccatcttgacggtcagccatttctgaggtatgacaggcagaaacgtcgagctaaacctcagggtcagtgggctgaagacgtgttgggcgcgaagacttgggacactgaaactgaggatctaactgaaaatggtcaggaccttaggagaaccctgacacacattaaagatcagaagggggggctccacagtctgcaggagattcgagtttgcgagatacatgaggactcatctactcgagggagccgccacttctactacgatggcgagctgttcctgagtcaaaacctcgaaacccaagagagtaccgttccccagagtagcagagcacagactttggcgatgaatgtcacaaatttctggaaagaggacgccatgaaaacgaagacacactaccgggctatgcaagctgattgcctgcagaagctccaacgctaccttaaatccggcgtagccatcaggcgaaccgtgccccccatggttaatgtgatttgctcagaagtgagtgaggggaatattaccgtcacgtgtagggccagctctttctaccctcgcaacatcaccttgacctggcgccaggacggtgtgagcttgtcccacaatacccagcagtggggagatgtcctgcccgacggtaacgggacatatcaaacgtgggtggcaacaaggattcggcagggggaagagcaacggttcacttgttacatggaacattcgggaaatcacggaacccatcctgtgccctctggcaaggccctggttttgcaatcccagaggacagacttcccttacgtgagcgccgctatgccttgtttcgtaataataatcattctgtgcgtcccgtgttgtaaaaagaaaactagcgccgccgagggtccagagctagtgtcattgcaggtgttagaccaacatcctgtgggtactggcgatcatcgtgacgctgcacagctgggatttcaacccttgatgagcgctactggctccacaggttctactgaagggacttag

SEQ ID NO: 124251 - DNA, 1023 bp, Artificial Sequence
  Description of Artificial Sequence: Synthetic coding sequence
atgggtctcggaagagtgctcttattccttgctgttgctttccctttcgctcccccggcagcggctgccgagcctcatagtctgcgttacaatttaatggtgctctctcaggacggttctgtccagagtggctttctcgccgagggccatctagatggccagccgtttctgcgttatgatcggcagaagaggagggccaagccgcagggacagtgggccgagaacgtgctgggtgccaagacttgggacaccgaaaccgaggacctcacagagaacggccaggatctccgccggaccttgacacacatcaaggatcagaaaggagttcctcagtctagtcgggctcagaccctagcaatgaatgtgacaaacttctggaaggaagacgccatgaagacaaagactcattaccgggccatgcaggcggattgcttgcagaagctgcaacggtacttaaaatccggtgtagccatccgccggactgtgcctcccatggtgaatgtaacctgctccgaggtgtcagagggaaatatcacagtgacttgtagggcatcaagcttctaccccagaaacatcacactgacctggaggcaggacggagtcagtctttcacacaacactcagcaatggggggatgtcctcccagatggtaacggtacttaccagacatgggtggcaacaagaattagacaaggggaagaacagcggttcacctgctacatggaacacagtggcaaccacggaacgcaccccgtgccctctgggaaagcattggtgttacagagccagagaacagactttccatacgtatcagctgcgatgccgtgtttcgttattatcatcatcttatgtgtcccatgttgtaagaagaaaactagcgcagccgaaggtccagaactcgttagcctccaagtcctcgaccagcacccagtgggcaccggagatcacagggatgctgcacagctgggatttcagcctctgatgtcagccactggatccacggggtccacggaagggacctag

SEQ ID NO: 124252 - DNA, 1023 bp, Artificial Sequence
  Description of Artificial Sequence: Synthetic coding sequence
atgggactgggccgggttctgctcttcctagccgtcgccttcccgtttgcacctccagctgctgccgcagagcctcactctctcagatacaatctgatggttctgtcccaggatgggtcagtccagtctggattcctggcggaggggcacctggatggtcagccttttctgagatacgacaggcagaagcgaagggccaagccccagggccagtgggctgaggatgttctcggagctaagacttgggatacagagacagaggatttgactgaaaacggtcaagacctgagacgtacgctgacccacattaaagaccagaagggagtccctcagtcgtctagagctcagaccctcgcaatgaacgtaacaaatttctggaaagaggatgcaatgaaaacaaagactcactaccgggccatgcaggccgactgtctgcagaaactccagcgatacttgaagagcggagtcgcaattcgccgtactgtaccccctatggtgaatgtaacctgttccgaagtctcggaagggaatattaccgtgacatgccgggcttcttctttttaccctcgaaacattacattaacatggcgccaggatggggtgagtctgtcgcataatacccagcagtggggggacgtcctgcctgacggcaacggaacctaccagacctgggtagcaactaggatcagacagggggaggagcagcgcttcacctgttacatggaacactccggaaaccatggtacacaccctgtgccttctggcaaagcacttgtcttgcaaagtcaaaggaccgattttccctacgtttcagctgctatgccatgtttcgtgatcattatcatcctgtgtgtgccctgttgtaagaagaagaccagcgccgccgagggtcctgagctggtgagcctacaggtcctggatcagcatcccgttgggaccggagatcatagggacgcagcacagctgggttttcagcctcttatgtcagctaccggttctaccgggtccacagagggtgcctag

SEQ ID NO: 124253 - DNA, 126 bp, Artificial Sequence
  Description of Artificial Sequence: Synthetic coding sequence
atgggtctgggacgcgtcctgctctttttggcagtggccttcccctttgcccccccggccgcagcagctgtcgagatgggcttccacagagtgagccaggacggtctggacttgctgaccagctag

SEQ ID NO: 124254 - DNA, 1083 bp, Artificial Sequence
  Description of Artificial Sequence: Synthetic coding sequence
tgaccacattctctccgatacaatctcatggtcttgtcgcaggatggctccgtgcagagcggctttctggctgaaggacacctcgatggccagccctttctcagatacgataggcagaagcgccgggctaaaccgcaggggcagtgggcggaagatgttctcggggcaaaaacttgggacactgagacggaggacctgacggaaaatggccaggacctcagacggacactaacacatatcaaggaccaaaagggggggcttcacagtttgcaggaaatccgcgtctgcgagatacacgaggattcaagcactcgggggtctcgccatttttactacgacggagaactatttctcagccaaaatctggagacgcaagagtcaaccgtgccgcaatcaagcagggctcaaactcttgccatgaatgtgaccaacttttggaaggaagatgctatgaaaacaaagacccactatagggccatgcaggctgattgcctgcagaaacttcagcgttacctaaaaagcggcgtggctattcgccggactgtgccccccatggtgaatgttacttgcagcgaggtgagcgaaggtaacattaccgtgacatgccgggcgagctctttttaccctagaaacatcacattgacctggaggcaagacggcgtgtccctctcccacaacacccaacagtggggcgacgtcttgccagacggtaatgggacttaccagacttgggtggccaccagaatcagacagggcgaagaacagaggttcacttgttacatggaacactccggcaaccatggcacccatccagtcccatccggcaaggctttggtgctgcagagccaacgaactgacttcccttatgtgagcgccgcaatgccctgtttcgtgattattatcatcttatgtgtcccttgctgtaagaagaaaactagcgcagcagaaggcccagaactggtatctctgcaggtgttagaccaacaccctgtagggaccggcgaccaccgcgacgctgcccaactgggttttcaaccgctgatgagtgctactgggtccaccggttcaaccgagggagcctag

SEQ ID NO: 124255 - DNA, 1152 bp, Artificial Sequence
  Description of Artificial Sequence: Synthetic coding sequence
atgggactgggacgcgtgttgcttttcctggctgtggcctttccttttgccccgcccgcagccgctgcagaaccccactccctacgttataatctgatggtcttatcccaggacggctctgtacagagtggatttctcgcggagggacatctcgacggccagccattcctgaggtatgacagacagaaacgcagagccaagccccaggggcagtgggcagaggacgtcctaggcgcaaagacatgggataccgagactgaggatttgacagaaaacggtcaggacctgcgccggacacttacccatataaaggatcagaaaggagggttacatagtctgcaagaaattcgtgtctgtgagattcatgaggattcaagcacacgcggttctcgacacttctattatgatggggaattgttcctctcccagaacctggagacacaggagagtacagtgcctcagagcagtcgagcgcaaactcttgccatgaatgtgaccaacttctggaaggaggatgccatgaaaaccaaaacacactaccgtgctatgcaagctgattgccttcagaagctccaacggtaccttaagagcggggtcgctatccggcgcacagtcccccctatggtgaacgtgacctgtagtgaagtctcggagggcaacatcacagtgacatgccgagctagctccttttacccccgaaacatcaccttgacatggaggcaggatggagtgtccctctctcacaacactcagcagtggggagacgtcctcccagatggtaacggaacctatcagacgtgggtcgctacacggatcagacagggtgaggagcagcggtttacatgctatatggaacactccggtaaccatggcacccatcctgtgccatctggcaaggcgctagtcctgcaatcacagagaactgattttccttatgtcagcgccgctatgccctgctttgtgatcattatcattctgtgcgtgccctgttgcaagaaaaagacgagcgcagctgaaggtcctgagctggtaagcctgcaagtgctagaccagcaccccgtgggaaccggtgatcacagagacgctgcccagttgggctttcagcctcttatgagtgcaacaggttcaacagggtctacggagggtgcatag

SEQ ID NO: 124256 - DNA, 1023 bp, Artificial Sequence
  Description of Artificial Sequence: Synthetic coding sequence
atggggcttgggagggtgcttctctttcttgctgtcgctttcccctttgctccgccggccgcagcggcagaaccacactctctgcgctacaatctgatggtgctctcacaagacggttccgtacagtcagggttcctggctgaaggacacctggacggtcaaccttttcttcggtatgatagacagaaacggcgcgctaagccacagggccagtgggctgaggatgtgttgggcgcagagacctgggatactgagacagaggacttaacagagaacggtcaggatctgcgaaggactttgactcacatcaaggaccaaaaaggcgtaccacagtccagccgtgctcagacattagctatgaacgtaacgaacttttggaaagaagacgcaatgaagactaagacccactaccgagcaatgcaggctgattgcctccagaaacttcagcgctacttgaaaagtggagtggcaatcagacgcacagtgcccccaatggtcaatgtgacatgctcagaggtgagcgagggaaacattaccgtgacttgcagagcgagttcgttctacccaagaaacataactctcacctggaggcaggatggggtatctctctcacacaacacccagcagtggggcgacgtcctccccgacggcaacggaacctaccaaacatgggttgctacccggataaggcagggcgaggagcagagattcacatgctacatggaacacagcgggaatcacggtacacatcctgtaccctctggcaaagctctcgtgctgcagagccagaggaccgattttccgtatgtttcggccgcgatgccttgttttgtcataatcataatcctgtgcgtcccctgttgcaaaaagaaaacctcggcggccgagggacctgagttggtgtcactccaggtgctcgaccagcacccagtcggaacaggggatcacagggatgccgcccagctaggctttcagccgctgatgagtgcaacaggcagtaccggtagcaccgaaggcgcttag

SEQ ID NO: 124257 - DNA, 1152 bp, Artificial Sequence
  Description of Artificial Sequence: Synthetic coding sequence
atgggactcggaagggtgctcctgtttctggccgtggcattcccattcgccccacccgccgcagccgccgagcctcactccctgcgctacaacctgatggtgttgagccaggacggctcagtgcagtcagggtttctggctgaaggacatctcgacggacaaccctttttgaggtatgacaggcagaagcgtcgcgcaaaacctcagggccagtgggctgaagatgtgttaggtgcagagacatgggacacagagaccgaggatttgaccgagaatgggcaggacctgcgaagaaccctgacgcacattaaagatcagaaaggcgggctgcactcattacaagagatacgagtttgcgagattcacgaggactcctccacacggggcagcaggcacttttattataacggggagttgtttctttcacaaaacctggaaacgcaggagtcgactgttcctcagtcttcaagggcacagactctagccatgaatgttacgaacttttggaaggaagacgcgatgaaaacaaagacacactaccgagcgatgcaggctgactgtctccaaaagctccaaagatatcttaagtcaggtgttgctattagaaggacggtcccaccaatggtaaacgtgacatgcagtgaggtgtcagagggcaacatcactgtgacctgtcgggcatcctctttctacccaaggaacattaccctcacttggcggcaggatggagtaagtctttctcacaacacgcagcagtggggggatgtgcttcccgatggcaatggtacctatcagacgtgggtggccactcgtattaggcaaggcgaagagcagaggttcacctgctatatggagcatagtggtaatcacggaacccatcccgtcccctcaggcaaggccctggtgctgcagagtcagcggacggactttccttacgtttccgcggccatgccatgcttcgtgataattatcatcctgtgcgtgccttgttgcaaaaaaaaaacctccgcagcggaaggcccagagttagtgagcctacaagttctggaccagcaccccgttgggacaggggatcaccgggatgctgcccagctgggctttcagcccctgatgtccgctacgggcagtacaggaagtactgagggcgcatag

SEQ ID NO: 124258 - DNA, 1023 bp, Artificial Sequence
  Description of Artificial Sequence: Synthetic coding sequence
atgggactgggtagagtgctgctattcctggctgtcgcctttcccttcgcccctcctgcggccgccgcagaacctcattcactaagatacaatttaatggttctctcacaggacggtagcgtgcagagcggatttctagccgaaggccacctagatggtcagccttttctcagatacgataggcaaaaacgccgtgctaaaccccagggccaatgggctgaggatgttttaggagcaaaaacctgggacacagagacagaagatttgacagagaacggacaggatctaagaaggactctgacacacattaaagaccagaaaggcgtgccccagtctagtagagctcagaccctcgcgatgaacgtgaccaatttctggaaggaagacgctatgaaaaccaagacacactatcgggctatgcaggccgactgcctgcagaagctacaacgatacctgaaatctggtgttgcaattaggagaacagtaccacctatggtgaatgtcatctgctccgaggtgagcgagggaaatattactgtcacctgccgcgcctcttccttttacccgcgcaacatcacactaacgtggaggcaagacggggtgtcactttcacacaacacccagcagtggggtgatgtactcccagacgggaacggcacataccagacatgggtggctacacgtattcggcagggggaggagcagaggtttacatgctatatggagcactctggcaaccacggtacccaccctgtaccctctggtaaagctttggtgctccaatcgcagcgcacagatttcccttacgtctcagctgccatgccttgtttcgtgattataatcatcttatgtgtcccctgttgcaagaagaagacttctgcggctgaggggcccgagctggtgtccctgcaggtcctagatcagcaccccgtgggaacaggtgaccaccgggatgccgcacagttgggattccaacccctcatgagtgctaccggcagcacgggcagtaccgagggcacatag

SEQ ID NO: 124259 - DNA, 1023 bp, Artificial Sequence
  Description of Artificial Sequence: Synthetic coding sequence
atgggtctgggccgcgtgctcctttttctggcggtggcctttcccttcgcacccccggctgccgccgccgagccacactccttacgatataacctcatggtgctgtcgcaagacgggagcgtgcagagcgggtttctggctgaggggcacctggacggccagccatttctgcgttacgatcgacagaagcggagggccaagccccagggccaatgggccgaagatgtgctgggcgccgaaacgtgggataccgagactgaagacctaaccgaaaacggccaggatctcagacgcactctcacccacattaaagaccagaaaggcgtgcctcagtcaagtagggcccagacattagccatgaatgttactaacttttggaaagaggatgcaatgaaaacgaagacccattatagagctatgcaggccgattgtttgcagaaactgcaaaggtacctgaaatctggagtggccatacgtcgcaccgtgccacccatggtaaatgtcacctgttcagaggtctccgaaggcaatatcaccgtgacctgtcgcgctagtagcttctatccgcgaaatattaccctcacttggagacaggatggagtgtctttgtcccacaatacgcaacagtggggtgatgttttaccggatggaaacggcacataccagacctgggtggcaacgcggatccgacagggtgaggaacaaagatttacctgctatatggagcactctgggaaccacggcacccaccctgtccccagtggtaaggccctggttctgcagtcccagcgcaccgatttcccctacgtgagtgcagccatgccctgtttcgtcataatcataattttgtgtgtgccttgttgcaagaagaaaactagcgccgccgagggaccggagctggtgagtctgcaggtgcttgatcaacacccagttggcacgggcgaccaccgcgacgcagcccaacttgggttccagcctctgatgagtgcaaccggcagcactggcagcacagagggcgcctag

SEQ ID NO: 124260 - DNA, 1023 bp, Artificial Sequence
  Description of Artificial Sequence: Synthetic coding sequence
atggggctcggccgtgtcctactttttctggccgtggcattccctttcgcccccccggccgctgccgccgaaccacactcactccgctacaatttaatggtgttgagccaggatggctctgttcagagcggttttttagccgaaggacacctcgatgggcagcccttcctgcgttacgaccgacagaaacgccgcgcgaagccccagggtcagtgggccgaaaacgtcttgggtgccaagacttgggacacagagactgaagacctgactgagaatggccaggacttgcggcggaccctgacacatattaaagatcagaaaggcgtccctcaatctagtagagctcaaaccttggccatgaacgtcaccaacttttggaaagaggatgcaatgaagactaagactcactatagagcgatgcaggccgattgtctgcagaaactccagagataccttaagtccggcgttgctatccggcggacggtgcccccaatggttaatgttacctgtagcgaggtctccgaaggaaacatcacagtgacgtgccgtgcctccagtttctacccaagaaatataactctgacatggcgccaagatggtgtaagcttgagtcataacactcaacaatggggcgacgtccttcctgatggtaatggaacctatcagacatgggtagccacccggatccggcagggcgaagagcagaggtttacatgctacatggaacatagtggtaaccacggtacacatcctgtgccaagcggtaaagcactcgttttgcagagccagcggactgattttccttacgtgagcgcagccatgccttgttttgtcatcattatcattctctgcgttccttgctgcaaaaaaaagacatcagcggccgaaggtcccgaattggttagcttgcaggtgctggaccagcatcctgttggaaccggagaccaccgcgatgccgcccagctcggctttcagccactgatgtcagcgacagggagtaccggaagcaccgaaggaacgtag

SEQ ID NO: 124261 - DNA, 1152 bp, Artificial Sequence
  Description of Artificial Sequence: Synthetic coding sequence
atgggtctcggcagagttcttctgttcctggcagtggccttcccatttgcaccccccgcagctgccgcagagccacattcattgcgttacaacctgatggtcctgagccaggatggatccgtacagagcggctttcttgctgagggtcacttggacgggcagcctttccttagatatgaccgacagaaacggagggccaaaccacaggggcagtgggcagaggacgtgcttggggcaaagacttgggatacagaaaccgaggatttaacagagaacgggcaagacctgcgaaggactctcacccatatcaaggaccagaaggggggcttgcactccctgcaggagatcagggtttgcgaaatccacgaggatagcagcactaggggctcaaggcacttctactacgacggtgaactgtttctttcacaaaacctggaaacacaggagtctacagttcctcagtcaagccgcgcccagacattggctatgaacgtgactaacttttggaaagaggatgccatgaaaacgaagactcattacagagccatgcaggccgactgtttacagaagcttcagcgttacctaaaatcaggagtcgcgatccgcagaaccgtcccacccatggtcaacgtgacatgcagcgaggtatcagaaggtaatataacagtcacttgtcgagcctcctccttctaccccaggaatatcactcttacttggagacaggatggagtcagcctgagtcacaatacccagcagtggggcgacgtgttgccagacggaaatggaacataccagacatgggtggccacccggatccgccagggcgaagaacagagatttacctgctacatggaacactcagggaaccatggcactcatccggttccgtccggaaaggccttggtgttgcaatctcagcggactgacttcccttatgtctcggccgccatgccctgctttgtcattatcattatactgtgtgtgccatgttgtaagaagaaaacctctgccgcagagggcccagagcttgtgtcactgcaagtcctcgaccagcatcctgtcgggactggggatcaccgggatgcggctcagctgggtttccagccccttatgagcgctacaggtagcaccggatctaccgagggcgcttag

SEQ ID NO: 124262 - DNA, 1152 bp, Artificial Sequence
  Description of Artificial Sequence: Synthetic coding sequence
atgggactgggccgtgtactgctgttcctggccgtggcgttccctttcgcgccccctgccgcagcagccgagccccactctctgcgttacaatctcatggtcttgtcacaagatgggtctgtacaatccggatttctggctgaaggacatctggacggacagcctttcctccgctatgatagacagaagcgccgcgctaagccgcaaggacaatgggccgagaatgttttgggggcgaaaacatgggacacagagacggaagacctgacagagaacgggcaggatcttcgacgcaccctgacccacatcaaagatcagaaaggaggcctacattctctccaagagataagggtctgcgagatacacgaagactcaagtacccggggctctaggcacttctactatgatggcgaactcttcttgtcacagaacttggagacacaggaaagcacagtcccacagtctagcagggctcaaactctggccatgaacgtgactaacttctggaaagaggacgcaatgaaaaccaagacccattatcgcgccatgcaagccgactgtttgcagaagctgcagcggtatctgaaaagtggtgtggctataaggcggactgttccgcctatggtgaacgtgacatgtagcgaggtgagtgagggtaatatcaccgttacatgccgggccagcagcttttacccaagaaacatcaccttaacttggcggcaggatggcgtaagcctaagccataacacgcagcaatggggcgatgtactgcccgatggcaatggaacataccagacgtgggtggccaccagaatacgccagggcgaggagcagcgctttacgtgctacatggagcacagtggaaatcatggcactcacccagtcccctcgggaaaggcccttgtcctgcagagccaacggacagatttcccatacgtttccgccgcgatgccctgtttcgtgataataatcatactctgtgttccgtgttgcaagaaaaaaacctccgctgccgaaggccctgaactggtttcccttcaggtgttggaccagcaccccgtggggaccggcgaccatcgtgatgcggcgcaactgggcttccagcccctgatgagcgccactggttcaacgggctctacagagggtacttag

SEQ ID NO: 124263 - DNA, 1023 bp, Artificial Sequence
  Description of Artificial Sequence: Synthetic coding sequence
atgggcctggggcgagtgctcctctttcttgctgtcgcatttcctttcgctcctccggctgcagctgcggaaccacatagcctgcggtataatctaatggtgttatcccaagatggctcagtgcagtctggatttttggcagagggccatctggacggccaaccatttctgaggtacgacaggcagaaacgaagggctaagccccagggccaatgggctgaggacgtcctgggtgcgaaaacatgggataccgaaactgaggatctgacagaaaacggacaagacctacgacgcactcttacgcatatcaaagaccagaaaggggttccccaaagtagtagggcacagacgctggccatgaatgtcaccaatttctggaaggaggatgctatgaagacaaaaacccattaccgagctatgcaagcggactgcctacagaaactccagcgttatctgaagagtggcgtggcgatccggcgcactgttccccccatggtgaacgtcacgtgttcggaggtctcggaggggaatatcacagttacttgccgtgccagcagtttctatcctaggaatatcaccctaacttggagacaggatggagtgtctttatctcacaatacacagcagtggggagatgtattacccgatggtaatggtacctaccagacctgggtggctacccggatccgccagggcgaagagcaacgtttcacctgttatatggagcatagtggcaatcacggtactcatcctgtgccttctggaaaggctctggttctccaatctcaacgcaccgattttccctacgtttctgctgccatgccctgctttgtcataattatcattctctgcgtgccatgttgcaagaagaagacgtccgccgctgagggccctgagctggtgagtctccaggtgcttgatcaacacccggtaggtaccggggatcaccgggacgcagctcagctaggctttcagcccctgatgagtgcaacaggttcaactggatctactgaaggggcatag

SEQ ID NO: 124264 - DNA, 954 bp, Artificial Sequence
  Description of Artificial Sequence: Synthetic coding sequence
taaccacactcacttcggtacaacctcatggtgctgtcgcaggacgggtccgtgcagagcgggtttctcgccgaaggacacctggatgggcagccctttctgcggtacgatcgacaaaagagacgggccaaaccccaaggacagtgggcagaggacgtcctgggagctaagacttgggacaccgaaacggaagaccttacagagaatgggcaggacctcaggagaacgctaacccacataaaagaccaaaaaggggtgccacagtccagcagggcacagacgctcgccatgaacgtcacgaatttttggaaagaggacgcgatgaaaacgaaaacacattaccgagcaatgcaggctgactgcctgcaaaagttgcagcggtacctcaagtctggcgttgcaatcagacgtacggttcctcccatggtaaacgtgacctgttctgaagtctccgagggtaatatcacagtcacttgcagggccagctcattttatccgaggaatataaccttgacctggcgtcaagacggagtgtccctgtctcataacacacagcagtggggggacgtgctgccggacggcaatggaacatatcagacttgggtagctacaagaattagacaaggggaggaacagagatttacctgttatatggagcactctggtaatcatggaactcacccagtcccatcaggcaaggccctagttctgcagtcgcaaagaaccgatttcccttatgtgtctgcagccatgccctgtttcgtgatcattattattctgtgcgttccttgctgcaaaaagaaaacatccgccgctgaaggccctgaactggtctcgctccaggtcctggatcagcaccccgtgggaacaggagatcatcgagatgcagcgcagctggggttccagccactgatgtcagcaacagggtctaccgggagcaccgagggagcttag

SEQ ID NO: 124265 - DNA, 1152 bp, Artificial Sequence
  Description of Artificial Sequence: Synthetic coding sequence
atggggttgggacgggttttgctgttcctggccgtcgcctttccgtttgctccccccgctgctgctgcagaacctcattctttgaggtataatctgatggtgctgagccaagatggctctgtgcagtcaggttttttagctgagggccatttggatggacaacctttcttgcggtacgacaggcaaaaacgaagagcaaagccgcaggggcagtgggccgaagatgttctgggcgccgagacctgggacaccgaaaccgaagacctaaccgaaaacggacaggacctccgacgtactctgacccacattaaagatcagaagggcggcctccatagcctgcaggaaattagagtttgcgagatgcacgaggattcttcaacccgggggtccaggcacttttattataacggcgagctttttctgagtcagaacctcgagacccaggagtccaccgtgcctcagtcttccagggcgcaaacgcttgctatgaatgtcacaaacttctggaaggaggacgcaatgaaaacaaaaacgcactatcgcgctatgcaagcagactgcctgcagaaactacagaggtacctgaagtcaggcgtggctattagaagaacagtgcctccgatggtcaacgttacctgttcagaggtgagcgaaggcaacatcaccgtgacatgccgcgcctctagcttttatccaagaaacatcacattaacctggcgacaagacggggtgagcctttctcataacacacaacagtggggcgatgtgctgccagatgggaacggaacctaccagacatgggttgctacacgcatccgccaaggcgaggagcagaggtttacttgctatatggaacacagtggtaaccacggaacccaccctgtgccatcaggtaaagcactggtcctgcagagccagcggaccgacttcccctatgtgtctgctgcgatgccttgcttcgtgattattattattctgtgcgtgccatgttgcaagaagaaaactagtgccgctgaaggaccagaactcgtaagcctgcaggtgctcgaccaacaccccgttggcaccggagaccaccgagatgccgcccagttaggattccagccgttgatgtcagcaaccgggtcgactggaagtacagagggtgcttag

SEQ ID NO: 124266 - DNA, 1056 bp, Artificial Sequence
  Description of Artificial Sequence: Synthetic coding sequence
atggttctgtcacaggacgggagcgtgcagagtggatttctggcagaggggcatctggacggccagcccttcctgagatatgaccggcagaagcgccgggctaaaccccaggggcagtgggccgagaatgttctgggcgctaagacatgggacaccgagaccgaggacctgactgaaaacggtcaggatctgcgacgcaccctgactcacatcaaggaccagaaggggggactacattccctgcaggaaatcagagtgtgtgagatccatgaggatagcagcactcggggtagcagacacttctattacgatggagaactctttttaagccaaaatcttgagacgcaggaatccacagtgccacagtcctcccgggcccaaactcttgctatgaatgtgaccaatttttggaaagaagatgccatgaaaacaaaaactcattatagggctatgcaagccgattgcttacagaaactccagcgatacttgaagtccggtgtggctataagaaggacggtccctccaatggtgaacgttacttgttccgaggtcagcgaaggtaatatcacagtgacgtgtagggcaagctccttctatccccgcaatatcacgctgacgtggaggcaggacggcgttagcctctcccacaatacccaacaatggggcgacgttctccccgacggaaacggcacctaccagacttgggtagcgacaaggattcggcagggtgaggaacagaggtttacatgttatatggaacactcagggaaccatggcactcaccccgtgcctagcggcaaagccctggtcctgcaatctcagaggactgactttccctatgtgtccgctgccatgccctgtttcgtcatcatcatcatcttatgcgtgccatgctgcaaaaagaaaactagcgcagctgaaggtccggagctggtgagcctccaggtgctggatcaacaccctgtcggtacaggggatcaccgagatgcggctcagctgggatttcagcccctgatgagcgccaccggtagtaccggatccaccgagggtacatag

SEQ ID NO: 124267 - DNA, 126 bp, Artificial Sequence
  Description of Artificial Sequence: Synthetic coding sequence
atgggcctagggcgggtgctgctgttcctcgccgtggcttttcctttcgccccgccggcggcggccgcagtggagatgggcttccaccgggtaagccaggatggtttggacttgcttactagttag

SEQ ID NO: 124268 - DNA, 126 bp, Artificial Sequence
  Description of Artificial Sequence: Synthetic coding sequence
atgggacttgggagggttcttcttttccttgcagtcgcatttccctttgctccaccagcagcagcggccgttgagatggggtttcacagagtttctcaagacggcctcgatctgttaacctcctag

SEQ ID NO: 124269 - DNA, 1056 bp, Artificial Sequence
  Description of Artificial Sequence: Synthetic coding sequence
atggtgttatcccaggacggaagcgtgcaatcagggttcttggccgagggccacctggacggtcaaccatttctccgctatgaccggcagaagcgacgggccaagccccagggtcaatgggccgaagacgtgttgggtgcagagacctgggatactgaaacagaggacctcacggagaatggacaggacctgcgacgcaccctgacccacatcaaagatcaaaaaggcgggctacactctctccaagagatccgggtttgtgagatgcacgaagatagctcaacgagagggtcaagacacttctactataacggcgaattgtttctctcccagaacctcgagactcaggaatctacagtgcctcagtctagcagggcccaaacgttggctatgaacgttaccaacttttggaaggaagatgcaatgaagactaagactcattaccgggccatgcaagccgattgcctgcaaaagctccagcgatatttgaaatcaggggtggccattcgccggacggtgccgcccatggtcaatgtcacatgttccgaagtaagtgaaggaaacattacagtcacctgccgtgccagctctttctacccaaggaatattaccctaacctggcgccaggacggcgtgtccttgtctcacaacactcagcaatggggtgacgtgttaccggacggcaacggcacctaccagacctgggtagctacaagaatcagacagggagaggaacagcggtttacttgctacatggagcactccgggaatcacggaactcatcccgttccttccgggaaggcgctggtcctacagagccagcgtaccgactttccgtacgtatccgccgcaatgccctgttttgtgatcataataatcctgtgtgtgccctgttgtaaaaaaaaaaccagcgctgctgagggacccgagctggtgtccctgcaagtgttggaccagcacccagtcgggacaggggaccacagggatgctgcccagctcgggtttcagcctctgatgagcgccaccggatctactggaagcaccgagggagcctag

SEQ ID NO: 124270 - DNA, 1056 bp, Artificial Sequence
  Description of Artificial Sequence: Synthetic coding sequence
atggtgctcagccaggatggcagcgtgcaatccgggttcctggccgaaggccatttggatggccaacctttcctgcgttatgatcgccagaaacgccgggccaagccccagggccaatgggccgaggacgtactcggggccaaaacatgggacacagagacagaagatctgacagagaacggccaggacctccgtcgaacactaacccacattaaggatcagaagggaggcctgcactccctgcaggaaattcgtgtctgtgagatccatgaggattcatccacccggggctccagacatttctattacgatggtgaactcttcctgtcccagaacctagagacccaagaaagtaccgtcccgcaatccagtagggcacagactttggccatgaatgtgactaacttctggaaggaagacgcgatgaagaccaaaactcattaccgcgcaatgcaggccgattgcctccagaaactgcagagatacctgaaatcgggcgtcgccatcaggagaactgtgccgccgatggttaacgtcatatgctctgaagtgtctgagggcaatattactgtcacatgcagggcttcttccttctaccctagaaatattacactgacatggcggcaggatggcgtgagtctttcacacaatacccagcagtggggtgacgtccttcccgatggcaacggcacctaccagacgtgggtcgccaccagaatcaggcaaggagaggagcagagattcacctgctacatggagcatagtggaaaccacggcacgcatccggtaccctcagggaaggccctcgttcttcagagccagaggacagactttccgtacgtgtccgccgccatgccctgtttcgtcataattattattctgtgtgtgccttgttgtaaaaagaaaactagcgcggccgaggggccagaactggtgtctctccaggtcttagatcagcaccccgtcggcacaggagaccacagagacgctgcacaactcggattccagcctctgatgtctgcaacgggctccacaggctctacagagggcacctag

SEQ ID NO: 124271 - DNA, 126 bp, Artificial Sequence
  Description of Artificial Sequence: Synthetic coding sequence
atgggtctgggacgtgtgctgctgttcctagcagtggcttttccattcgccccccccgcggccgccgcagtggagatgggattccaccgggtgtcacaggacggactcgacctgctgactagctag

SEQ ID NO: 124272 - DNA, 126 bp, Artificial Sequence
  Description of Artificial Sequence: Synthetic coding sequence
atgggcttgggtcgcgtgttgttgttcctagcggtggccttccctttcgcccctccagctgcggccgctgtggagatggggttccacagagtgtctcaggatggcttggacctgctgacaagctag

SEQ ID NO: 124273 - DNA, 1056 bp, Artificial Sequence
  Description of Artificial Sequence: Synthetic coding sequence
atggtcttgtctcaggacggaagcgtgcagtccggttttctcgccgaaggtcacctggacggccagccgttcctgcgctacgataggcagaagcgccgagccaaaccgcagggacagtgggcagagaatgtccttggcgcgaaaacatgggatacagagacagaggatctcacagaaaacggccaagacctgcgtagaacactaacacacatcaaagaccagaagggtggactgcattcattgcaggaaattcgagtgtgcgaaattcacgaggactcgtctaccagaggctcccggcacttctattacgacggcgagttatttttatcccagaatcttgagacacaggaatccaccgttccccagtcttccagggcccagacactggccatgaacgtgactaacttctggaaggaggacgccatgaaaacaaaaacacactacagagctatgcaagccgattgtttgcagaaattgcagagatatttgaagagtggtgtggccatacgccgtacggttccccccatggtcaacgtaacctgttctgaggtgagcgaaggtaatatcactgttacctgtagggcttcctctttttaccctagaaatattactttaacatggcgacaggatggagtttctctgtctcacaatacacaacaatggggggacgtgctccccgacggtaatggaacataccagacctgggtggctaccagaattcggcagggagaggaacagcgttttacctgctacatggagcactccggcaaccacggaacccatcccgtcccaagtggtaaagctcttgtgttgcagtctcagcggacagattttccttatgtgagcgccgcgatgccatgcttcgtgatcatcattattctctgtgttccttgttgtaagaaaaagactagcgctgccgagggtcccgaactggttagcctgcaggtactggatcaacatcctgtggggaccggagaccacagggatgctgcccaactaggcttccagcccctgatgtctgctacagggtctactgggtcaacagaggggacctag

SEQ ID NO: 124274 - DNA, 126 bp, Artificial Sequence
  Description of Artificial Sequence: Synthetic coding sequence
atgggcctgggacgagtgctcctattcctggccgtagcttttccttttgcccctcctgcagccgcggccgttgaaatggggttccatcgcgttagtcaagatggcctcgacctgctgacatcgtag

SEQ ID NO: 124275 - DNA, 126 bp, Artificial Sequence
  Description of Artificial Sequence: Synthetic coding sequence
atgggcctagggcgagtgctgcttttcctggctgtagctttcccctttgccccgcctgcagcagccgctgtggagatgggctttcacagggtgtcacaggatgggctggatctgttgacgtcctag

SEQ ID NO: 124276 - DNA, 1056 bp, Artificial Sequence
  Description of Artificial Sequence: Synthetic coding sequence
atggtgctcagccaggacggtagcgtgcagtcagggttcctggccgaaggacacctagatggacagcccttcctcagatatgaccgacagaagcgacgcgcaaagccacaaggccagtgggcggaggacgtgctgggagcggagacatgggataccgaaacagaagatctaaccgagaatgggcaggatctgcggcgtaccttaacacacataaaggaccagaagggaggcctgcattcgctgcaggaaatccgtgtctgtgagatacatgaagacagctctactcgaggaagtcgacatttctactacaacggggagctgtttctctctcagaatcttgagacacaagaatccaccgtgcctcagagtagtcgggcccagactctggcaatgaatgtgactaatttttggaaggaggacgcaatgaaaaccaagacgcactacagggctatgcaggccgactgcctccagaagctccagcggtatctcaaatccggagtggcaatacgacggaccgtgccacctatggtcaacgttacatgcagcgaagtctccgagggcaatatcactgtgacgtgccgggcctcttcattctaccctcggaacattaccctgacttggcggcaggacggcgtgagcctaagtcataatacacagcagtggggggacgtgctcccagatgggaacggcacttatcagacttgggtggcgacgagaattcgccaaggagaagagcagcgcttcacctgctacatggaacatagtggaaatcacggcacacatccagtgccgtctgggaaggcactggtgctgcagtcacaacggaccgattttccttatgtgtccgcggcaatgccatgcttcgtgattatcattatcctgtgcgttccatgttgcaagaaaaagacgtctgctgcagagggacctgaactggtctcgttgcaagtgttggatcaacatcctgtggggacgggggatcacagagatgcagcacaactggggttccagccactcatgtcagccaccggcagcacaggcagcactgagggcgcttag

SEQ ID NO: 124277 - DNA, 2088 bp, Artificial Sequence
  Description of Artificial Sequence: Synthetic coding sequence
atgagcccaccgaaggaccccagcccctcacttcctctcccaagctctagctctcattccagcagtccccccagcagctcgagcactagcgtaagcggcaacgcgcctgatggttcatctccaccacaaatgaccgcttccgaaccgctgagccaggtgtcaagaggccacccctctcctcccacacccaacttccgccgtagagctgttgcccagggcgcaccccgagagattccactctacttaccacatcatcctaaacccgaatgggccgagtactgcctagtgtccccaggggaggacggattgtcagacccagccgagatgactagtgatgagtgccagcccgcagaggcacccctcggggacatcggctctaaccatagggatccgcatcccatctggggcaaggataggtcgtggaccggtcaggagctgtcccccctcgcaggcgaggaccgcgaaaaaggtagcaccggcgccaggaaagaggaggaaggcggtcccgtactggtcaaggagaaactgggtctgaaaaaactggtgctaacacaggagcaaaaaacgatgcttctcgactggaacgactctattcctgagagtgtgcacctaaaagccggtgagaggattagtcagaagtccgcagagaacgggcgagggggccgcgtcctgaagcctgtcaggccactcctgctgccgcgcgccgctggggaaccactcccaactcagaggggtgcccaagaaaagatgggcacccctgcagaacaagctcagggggaaagaaatgttcccccccctaagagccccctgcgtctcatcgccaatgccattcgccgctcactcgagccactactttctaatagtgagggtgggaaaaaggcgtgggccaagcaggagtccaagactctccctgctcaggcttgcacccgttcttttagcttgaggaaaacaaatagcaacaaggacggggaccaacactccccaggtcgcaaccagtcttctgcttttagtccccccgatccagctctcaggacccactctctgccaaatcggccttctaaagtgtttcctgccttacggtcccctccttgttctaagattgaagacgtgccaaccctcctagagaaagtcagcctgcaagagaatttccctgatgcatccaagccccccaagaagagaatttctctattctcgtcgctgagactgaaagacaagtcttttgagtcctttctacaggaatcccgccagcggaaggacatcagggaccttttcggttcccccaaaaggaaagtgctgccagaagattccgcacaggctctcgaaaagctgcttcagccattcaaaagtacttccttgaggcaggccgcgcctcccccgcccccaccgccccctccccctccccccccccccacagccggcggagcagatagcaagaattttccactccgggcgcaagtcacagaggcaagctctagcgctagctccactagtagctcctcggcagacgaggaatttgaccctcaactttccctacagttgaaagagaaaaagacgctccgtcgacgcaagaagctggagaaagccatgaaacagctcgtgaaacaagaggagcttaagaggttgtacaaggcccaggctattcagagacaactcgaagaagtagaggagagacagcgcgcctcagaaattcagggcgtacgcctggagaaagccttaagaggcgaagcagactctggaacccaggatgaggcgcaacttctgcaagagtggtttaagctggtgctggagaaaaacaagcttatgaggtatgagagtgaactgctgatcatggcccaagaactcgagctggaagaccatcagtccagattagagcagaaactacgagagaagatgctgaaggaagaatcacagaaggatgaaaaggatcttaacgaggaacaggaagtctttaccgagcttatgcaagtcatcgagcagcgggacaaattggtcgactctcttgaagaacagcgcataagggagaaagctgaggaccagcatttcgaatcattcgttttttcacgcggctgtcaactctcgcgcacttag

SEQ ID NO: 124278 - DNA, 90 bp, Artificial Sequence
  Description of Artificial Sequence: Synthetic coding sequence
atgagccctcctaaggatccctctccgtccctgccgctccccagttcctcatctcactctagctcccccccatcaagcagctcgacttag

SEQ ID NO: 124279 - DNA, 522 bp, Artificial Sequence
  Description of Artificial Sequence: Synthetic coding sequence
atgagcctgttggggcctaaggtgctgctgttcttggccgcgttcattattacaagcgactggatccccctgggtgtgaacagtcagcggggcgatgacgtcacgcaagccactcctgaaactttcaccgaagaccccaacctcgttaatgatcccgccactgacgaaacagtgttggccgtacttgccgatatcgccccatcaacagacgacctggcaagcttgtctgaaaagaataccacggcagaatgttgggatgagaagttcacttgcacgcggttatacagcgttcaccgaccagttaagcagtgcatccaccagctgtgcttcacgtcactacgtcggatgtacatcgttaacaaggagatttgctctaggttggtgtgtaaagagcatgaggcaatgaaagacgaactctgcaggcagatggccgggctcccccctagaaggctacgacgctcaaactactttcgactccctccttgcgaaaatgttgatctgcaacgaccgaacggtctgtag

SEQ ID NO: 124280 - DNA, 492 bp, Artificial Sequence
  Description of Artificial Sequence: Synthetic coding sequence
atgtctctgcttggccccaaagtgctgctgttcctggcagcctttatcataacctccgattggatcccgctcggggtcaactcccagagaggcgacgacgtaacccaagcgaccccagaaacattcaccgaagatcccaacttggtgaatgaccccgcaacagatgaaaccgtgctggccgtgctcgcagatattgcaccatctactgatgacttagaatgctgggatgagaagtttacttgtacccgattatacagcgtgcaccgcccagttaaacaatgcatccaccagctgtgtttcaccagcctaaggaggatgtatatcgtgaataaggaaatctgtagccgtttggtgtgcaaggaacacgaggccatgaaggatgagctatgtcgccaaatggccggcctaccccccagaagactgcgccggagtaattactttagactgcctccctgcgaaaacgtggaccttcagcgacctaatggactgtag

SEQ ID NO: 124281 - DNA, 447 bp, Artificial Sequence
  Description of Artificial Sequence: Synthetic coding sequence
atgagtcttctgggccccaaggtgctcttgtttctcgcagcttttattattacctccgactggatcccattgggggtgaatagccagaggggggacgacgtaacacaggcaacacccgaaacattcactgaagatccaaatctggtgaatgaccctgccacagacgagacagaatgctgggacgaaaagttcacctgtaccaggctttactctgtccacagacctgtgaaacagtgcatccatcagctgtgttttacgagcctgcgacgtatgtacatcgtcaacaaggagatctgctcaagactggtgtgcaaagagcatgaggccatgaaggacgagctgtgcaggcagatggcgggccttcctcctagaagactgagacgatccaactatttcagattgcccccatgcgagaatgtcgatttgcaacgtccaaacggactgtag

SEQ ID NO: 124282 - DNA, 492 bp, Artificial Sequence
  Description of Artificial Sequence: Synthetic coding sequence
atgagcctgctaggaccaaaagtgctgctgttcctcgccgcctttatcataacatcggactggatcccactgggagtgaactcccagaggggcgacgacgtcactcaggcgactcccgagactttcactgaagatcctaatcttgtcaacgaccctgccactgatgagaccgtattggctgtccttgcagacatcgctccaagtaccgacgatttggagtgttgggacgagaaattcacatgcactcgactttactctgttcatagacccgtcaagcagtgtattcatcaactgtgctttacctctcttagacgcatgtacatcgtcaacaaggagatctgttcaagactggtctgcaaggagcacgaggccatgaaagatgaactttgccgccaaatggccggtctgccacccagacgcttacgcagatctaattacttcaggctacctccttgtgagaatgtggatcttcaaaggccaaatggactgtag

SEQ ID NO: 124283 - DNA, 276 bp, Artificial Sequence
  Description of Artificial Sequence: Synthetic coding sequence
atgtctctgctgggaccgaaggtcttactcttcctcgccgcctttatcatcacatccgattggatacctctcggtgtgaactcccagcggggcgacgatgtaacccaggcaacacctgagacattcactgaagaccccaatctggtgaacgatccggcaacggatgaaacagttctcgcagtcttggctgatattgcccccagcaccgatgatttggcctcactttcagaaaagaacacgaccgcggagtgttgggatgagaagttcacatgctag

SEQ ID NO: 124284 - DNA, 1320 bp, Artificial Sequence
  Description of Artificial Sequence: Synthetic coding sequence
atgtctgtaccgtccgctctcatgaagcaacctcctattcagagcacagcaggtgccgttccggttagaaatgagaagggagagatttctatggagaaggtgaaagttaagcgctacgtgagtgggaaaaggcccgactacgcccccatggagagcagcgatgaagaagacgaggagtttcagttcatcaagaaggctaaagagcaggaggccgaacccgaggaacaagaagaggattcttcatccgatccgcggctgcgtaggctccagaatcgtatttctgaggacgtggaggaaaggctggcccggcatcgcaagatcgtcgaaccagaagtggtgggcgaatccgacagcgaggtcgaaggggacgcgtggcggatggagcgtgaagattcgtctgaggaagaggaagaagaaattgatgatgaggagatagagcgtcgcaggggtatgatgcgccagagagctcaggaacgcaagaatgaggagatggaagtgatggaggtggaagatgaagggagatccggcgaagagtctgaatctgagagcgagtacgaggagtataccgacagcgaggacgagatggaacctaggctcaaacccgtgtttatccggaagaaggatcgggtcacggtgcaagaacgggaggctgaggcactgaaacaaaaagagcttgagcaagaagctaaaaggatggccgaagaacgcagaaaatacaccctcaagatcgtggaagaagagaccaaaaaagagctggaagagaataaacgttctcttgctgcactggatgcccttaacacagatgatgaaaatgacgaggaggagtatgaggcctggaaggtgagggagttgaagaggatcaaaagggaccgggaggaccgggaagctctagaaaaggagaaggcagaaattgagagaatgagaaacctcacagaggaagagcggagggcagagcttcgggcgaatggcaaagtaatcactaataaggccgtcaagggcaaatacaagtttcttcagaaatactaccaccgtggcgcctttttcatggacgaagatgaggaggtatacaagcgggacttcagcgcacccacactggaggaccacttcaacaagaccatactgcccaaagtaatgcaggtgaagaactttggaagaagcgggagaaccaaatacacccacttggtggatcaggacacgacctcttttgactccgcgtggggccaggaaagtgcacagaacacaaagttcttcaagcaaaaggcagccggggttagagatgtgtttgaaaggcctagtgcgaagaagcgaaagaccacttag

SEQ ID NO: 124285 - DNA, 549 bp, Artificial Sequence
  Description of Artificial Sequence: Synthetic coding sequence
atgagggcggcgtatctgttcttgctttttctgccaggcttactggcccagggccagtacgatctggaccccctccccccatttcctgatcatgttcaatatacccattacagcgaccagattgacaatcctgattactacgactaccaagaggtgacccctaggcctagtgaggaacaattccagttccagtctcaacagcaggtgcagcaggaggtgattccggctccgacacccgagcccggcaatgctgagctagaaccaacggagcccgggcctctcgattgccgagaggagcagtacccatgcactcgcctttacagcattcaccgtccatgcaaacagtgtctgaatgaggtgtgtttttattccctgcgtagggtgtacgttataaataaagaaatctgcgtcaggactgtctgtgcccacgaggagctccttcgggcagatctctgtagggacaagtttagcaaatgtggggtcatggcctccagcggcttatgtcagagcgtcgcagcttcctgcgcacggtcttgcggctcttgctag

SEQ ID NO: 124286 - DNA, 552 bp, Artificial Sequence
  Description of Artificial Sequence: Synthetic coding sequence
atgcgcgccgcctatctatttctattattcttacccgcgggacttctggctcagggacaatacgatttagacccactcccaccgttcccagaccacgtccagtatacacattattccgaccaaatcgacaatcccgactactatgactaccaggaagtgacaccccggccatcggaggagcagttccagtttcagtcgcagcaacaggttcagcaggaggtgatccctgcccctacccccgaaccgggcaatgcggagctggagccaacggaacccgggcctctggattgtcgcgaggagcagtacccctgcaccagactgtattcaatccatcgcccatgcaagcagtgtctgaatgaggtgtgcttctattccctccgtcgcgtttatgtcatcaataaagagatttgtgtcaggactgtctgcgcccacgaagagttactgcgagccgatttgtgcagggacaagttctcaaaatgcggggtcatggcctcatcaggactctgccagtcagtggctgcttcttgtgcgcgctcctgtgggagttgctag

SEQ ID NO: 124287 - DNA, 549 bp, Artificial Sequence
  Description of Artificial Sequence: Synthetic coding sequence
atgagggcagcctacttgtttctgctgtttctgccaggcctactggcccagggccagtacgacttggatccactgcctccctttcccgaccatgtgcagtacacccactactccgaccagatcgacaacccagattattacgattaccaggaagtgacccctcggccttctgaggagcagttccaattccagtctcagcaacaagtgcagcaggaggtaatcccggcccccacaccggagcccggtaacgccgagctggaacctacggaaccaggacctctggactgtcgggaagagcagtatccctgcacacgactttacagcatccatagaccatgcaaacagtgcttgaatgaagtctgtttctactccctgcgcagggtctacgttattaacaaggaaatctgcgtccgaactgtctgcgcccatgaggagctgctgcgggcggatctgtgccgcgataagttttcaaaatgcggcgtgatggcttcctcaggcctatgtcagtcagtggctgcatcgtgtgcaaggtcctgcggctcttgttag

SEQ ID NO: 124288 - DNA, 1089 bp, Artificial Sequence
  Description of Artificial Sequence: Synthetic coding sequence
atgaagctacactgctgccttttcacactggtggcctccatcatcgtaccagcagccttcgtcctggaggatgtcgactttgaccaaatggttagtctcgaagccaaccgaagttcgtataatgcaagctttccatcaagcttcgagttgtccgcttcctcacactccgacgacgacgtgattatcgccaaagaaggtacgtccgtctcgatcgaatgcctactcacggcaagccactacgaggacgtccattggcacaactccaagggccagcaattggacgggcggtctaggggaggaaaatggctggtgtctgacaattttttaaatattactaacgtggcctttgacgaccgtggactgtatacctgttttgtaacttcccctattagggcctcctactcagtcactttacgagtgattttcaccagcggtgacatgagtgtctattacatgattgtgtgtctgatagccttcacaatcaccctgatcctgaacgtgaccagactgtgtatgatgagctcacatcttagaaaaactgaaaaggcgattaacgagtttttccgtacggagggagctgaaaagttacagaaggcgttcgagatcgcgaagcggatacctatcatcaccagtgccaagactctggagttggctaaggtgacacagttcaagacgatggaattcgcccgatatattgaagagctcgcccgcagtgtgcctctcccccctctgatcctcaattgtcgagccttcgtcgaggagatgttcgaggcagtccgggtcgacgacccagacgacctgggggagcgtataaaagagagaccagccctgaacgcacagggggggatatatgtaatcaatccggagatggggaggtccaactcccccggcggagattccgacgacggcagcttgaatgaacagggccaggaaattgccgtacaggtcagcgtccatctccagtcagagacaaaatcgatagatacagaaagccaagggagttcccacttttccccccctgatgatattggctctgcagagtccaattgtaattacaaggacggcgcctacgaaaattgccagctatag

SEQ ID NO: 124289 - DNA, 1089 bp, Artificial Sequence
  Description of Artificial Sequence: Synthetic coding sequence
atgaagctccattgttgtctgttcaccctggtggccagcattatcgttcctgcagcgttcgtgttagaggatgtcgattttgaccaaatggtgtcgctcgaagccaataggtcctcatataatgcttccttcccctcatctttcgagcttagcgcatcatctcacagcgacgacgatgtgattatcgctaaagaggggacgagtgtttccatcgagtgcttgcttaccgcctctcattatgaggatgtacattggcacaatagcaagggacagcaactcgacggtcggtctcgaggcggaaagtggctcgttagcgacaatttcctcaatattaccaacgtggccttcgatgatcgggggctgtacacatgtttcgtgacctcccccatccgagcctcctattcggttaccctgagggtgatctttacaagcggtgacatgagcgtctactatatgattgtgtgtctgattgcctttaccattactcttatccttaacgtgacaaggctgtgcatgatgtcttcccacctgagaaagaccgagaaggcgattaacgagttcttcaggactgagggcgctgagaagctacagaaggcattcgaaatcgcaaaaaggattccaattatcacatcagccaagacacttgagctggctaaagtaacccaatttaagacaatggaattcgcacggtatattgaggaattggcccgcagcgttcctttacccccgctcatattaaactgtagggccttcgtcgaagaaatgtttgaggcggtcagggtcgacgacccagatgacctcggagaaaggataaaggagagacctgccctaaacgcacagggcggcatttacgtcattaatccagaaatgggccgcagcaactcccctggcggggattctgatgacggctctctgaacgagcaaggccaagaaatcgccgtccaggtgtccgtgcatcttcaaagtgagaccaagtcaatcgacactgagagccagggttcttcacacttcagtccacctgacgacataggtagcgcagagtcgaactgtaactataaagacggcgcctacgaaaactgccagctgtag

SEQ ID NO: 124290 - DNA, 651 bp, Artificial Sequence
  Description of Artificial Sequence: Synthetic coding sequence
atgtccgtgtattatatgatcgtgtgccttattgcattcacaatcaccttaattttgaacgtgactcgcctctgtatgatgtcttctcatctgagaaagacagagaaggcaatcaatgagttctttcggacagaaggggctgagaagttgcagaaggcttttgaaatcgccaagcgaatcccaatcattacaagcgcgaagaccttggagcttgctaaagtgacacagtttaagacaatggagttcgccagatatattgaagagcttgccaggtctgtgcccctacctccgctgattctgaattgccgggcttttgtcgaggagatgtttgaagccgtgagggtggacgacccagacgatctcggcgaacggataaaagagcgccccgcccttaacgctcaggggggcatctacgtgattaatcctgaaatgggcagatccaatagtccaggcggcgattcggacgacggaagtttaaatgaacagggccaagaaatcgctgtgcaggtctctgtgcacctgcagtctgagaccaagagtattgacacggagtctcaagggtcaagccacttcagcccacccgatgacatcgggagcgcagaaagcaactgcaattataaggacggagcctacgagaactgtcagctgtag

SEQ ID NO: 124291 - DNA, 54 bp, Artificial Sequence
  Description of Artificial Sequence: Synthetic coding sequence
atgaaactgcactgttgcctttttactctcgttgcaagcatcattgtgccctag

SEQ ID NO: 124292 - DNA, 330 bp, Artificial Sequence
  Description of Artificial Sequence: Synthetic coding sequence
atgaagctgcattgttgtcttttcacgctcgttgcctcgatcatagtaccagcagcctttgtcctcgaggacgttgactttgaccagatggtctctctggaggcgaacagatcatcgtacaacgcctccttccctagttcttttgagcttagcgcttcttcccactccgatgatgatgttatcatagccaaggaaggcacatccgtgtctatagaatgtttactgaccgcgtctcactatgaggatgttcactggcacaacagcaagggccagcagctggatggaaggtcccgcggtggcaagtggctggtcagcgataactttctgtag

SEQ ID NO: 124293 - DNA, 372 bp, Artificial Sequence
  Description of Artificial Sequence: Synthetic coding sequence
atgaagctgcactgctgtctatttaccctggtggctagcataatcgtgcccgctgctttcgtattagaagatgtggattttgatcaaatggtctcactggaggcgaataggagttcttacaatgcttcctttccatctagtttcgagctgtccgcaagttcacattctgatgatgacgttattattgccaaagaggggaccagcgtctctattgagtgcctgctcactgctagccattacgaggacgttcattggcacaacagcaagggtcagcagctagatggacggtctagaggtggcaagtggctggttagcgacaattttctaaacattacaaacgtcgccttcgatgacagaggcctctatacatag

SEQ ID NO: 124294 - DNA, 768 bp, Artificial Sequence
  Description of Artificial Sequence: Synthetic coding sequence
atgaaggcgctgttagctctgcctctactgctcctgctgagtactcctccatgtgctcctcaggtcagcggcataaggggcgacgccctcgaacgcttttgcctccaacagcccctcgattgcgacgatatctacgcccaagggtatcagtccgatggtgtatacctgatctacccgtctggaccgtccgtccccgttcctgttttctgtgacatgaccacagaaggaggaaagtggacagtgtttcagaaaagattcaacggaagcgtcagcttttttagaggctggaatgactacaagctgggcttcggacgagccgatggcgaatactggcttgggctgcagaatatgcaccttcttacacttaagcagaagtacgagctgcgcgtggacttggaagatttcgagaataacaccgcatatgctaaatacgctgacttctcaatttcaccaaatgcagtttcagctgaagaagacgggtatacgctattcgtggcaggctttgaggacggcggcgctggggactccctcagttaccattcaggccagaagttctcgaccttcgatagagatcaagatttgtttgtccagaattgtgcagccctcagcagcggcgcgttctggttcaggagctgtcattttgcaaacctgaatggcttctacctgggcggcagccatttatcctatgccaacggcatcaactgggcccaatggaaaggcttttattatagcctcaagcgcactgagatgaagatacggagagcatag

SEQ ID NO: 124295 - DNA, 840 bp, Artificial Sequence
  Description of Artificial Sequence: Synthetic coding sequence
atgggagagctctcccctctccagaggcctctggccactgaaggaaccatgaaagctcagggagtgctactcaagctggcactacttgccttacccttactcctgctcctttcaacacctccgtgtgccccccaagttagcggcatccgcggggacgcccttgaacggttttgcttacagcagcccctggactgcgatgatatttacgctcaggggtaccagtcagacggggtgtacttgatttatccctcagggccctccgtgcctgtgcccgtattctgtgacatgaccactgaaggtgggaagtggaccgtgtttcaaaaacgttttaatggctctgtgagcttctttaggggatggaatgactataaactaggttttgggagagccgatggcgagtattggctgggactgcagaatatgcatttactgaccttaaaacagaaatatgagctcagagtggacctggaggatttcgagaataataccgcctacgccaaatacgcagacttctctatatctcccaacgccgtgagtgctgaggaagacggttatacgctattcgtggcaggatttgaggatggcggtgccggcgatagcctttcataccactccgggcagaaattttctacattcgatagggaccaggacctgttcgtgcagaactgtgcagcacttagctctggggcattttggttccgttcctgtcattttgcaaatctaaacggattctacctggggggctctcacctgtcctatgcaaacggaataaattgggcccaatggaaagggttttactactccctaaagagaactgaaatgaaaatcaggagggcgtag

SEQ ID NO: 124296 - DNA, 468 bp, Artificial Sequence
  Description of Artificial Sequence: Synthetic coding sequence
atggtagacctcactcaggtcatggatgatgaggtatttatggcttttgccagttatgccacaattattttgtctaagatgatgctcatgagtaccgccaccgcattttatcggctgactcgtaaagtgtttgccaaccccgaggactgcgtggctttcggaaagggcgagaacgcaaagaaatacttgaggaccgacgacagagtggaacgggtcaggcgagcacacctgaatgacttagagaatataataccgtttctgggtatagggttgctgtactccttgagcggccccgacccgtcgacagcaatcctgcactttcggctgttcgtgggggctcgcatctaccatacaatcgcgtacctcaccccgctgccgcagccaaatcgggctctttccttttttgtaggttatggcgttactctgtcaatggcctataggctactgaaaagtaaactgtatctatag

SEQ ID NO: 124297 - DNA, 468 bp, Artificial Sequence
  Description of Artificial Sequence: Synthetic coding sequence
atggtcgatcttacccaggtgatggacgatgaagtttttatggccttcgcaagttatgccacgatcattctgtctaagatgatgttaatgagcaccgcaaccgcattttacaggttgacacgcaaggtttttgccaatcccgaagattgtgtggcatttggaaaaggcgagaacgcaaaaaaataccttagaactgacgatcgagtggagagggtccgacgggcccatctgaacgacttggagaatatcatacctttcctgggcatcgggttgctgtattctctgagtggaccagatcccagtacggccattctccacttcagattgttcgttggcgctcgaatttatcacacgatcgcatacctcacgcccctaccccagcccaatagagcccttagcttctttgtcgggtatggggtaacacttagtatggcctacaggctcctcaagtcgaagttatacctatag

SEQ ID NO: 124298 - DNA, 468 bp, Artificial Sequence
  Description of Artificial Sequence: Synthetic coding sequence
atggtggacctgactcaggtgatggacgacgaagtttttatggctttcgctagctacgcaactattatcctctccaaaatgatgttgatgagtaccgcaactgctttctaccggctcacacggaaggtctttgctaatcctgaagactgcgtggcctttggaaagggggagaacgccaagaagtacctgagaaccgatgatcgagtggagcgggtgagaagagcacatcttaatgatctcgaaaacattatcccctttctgggaatcgggttgctgtactcactttctggcccagatccgagtacagccatactccactttcgcctgtttgttggcgcgagaatctaccatactattgcctacctgacgcccctcccccagccaaaccgagcactcagtttcttcgtaggttatggcgtcacactcagtatggcctatagactgttgaagagcaagctgtatctttag

SEQ ID NO: 124299 - DNA, 468 bp, Artificial Sequence
  Description of Artificial Sequence: Synthetic coding sequence
atggtggacctgactcaagttatggatgacgaggtcttcatggccttcgcctcatacgccaccattatcctgtcaaaaatgatgctgatgagcactgctacggcattctatcggttgactagaaaggtgttcgctaatcccgaggactgtgtagcattcggaaagggtgagaatgccaagaaatacctgcgaacagatgatagagttgagagggtcaggagagcccacctcaacgatttagaaaacatcattccctttctgggcatcgggctcctatatagcttgagcggaccagacccaagtacggctatactgcacttccgcctcttcgtcggcgcaaggatctaccacacaattgcctacttaacccctttaccccaaccaaatcgagcactcagctttttcgtgggctacggcgttaccctctcgatggcttaccgccttctgaagagcaaactgtatctatag

SEQ ID NO: 124300 - DNA, 234 bp, Artificial Sequence
  Description of Artificial Sequence: Synthetic coding sequence
atggtggatctgacgcaggtgatggacgatgaggtgttcatggccttcgctagttatgccaccatcatcttgtcgaaaatgatgctgatgagcactgccacagctttctaccggctgacccgcaaggtgttcgcgaatcccgaagattgtgtcgcattcgggaagggcgaaaatgccaagaagtatttgcgaacggacgacagggtcgaaagggtgagaagagctcacctctag

SEQ ID NO: 124301 - DNA, 129 bp, Artificial Sequence
  Description of Artificial Sequence: Synthetic coding sequence
atggtcgatctgacacaggtcatggatgacgaggtgttcatggcttttgccagttacgccactattattctgtctaaaatgatgctgatgtccacagcaacagcattttatcggctgacgcgaaagtag

SEQ ID NO: 124302 - DNA, 243 bp, Artificial Sequence
  Description of Artificial Sequence: Synthetic coding sequence
atggtggacttaacacaggtcatggacgacgaagtcttcatggcctttgcttcctacgccactatcattctctcaaaaatgatgctcatgagcacggccacggcgttttacagactcaccagaaaggtgttcgctaaccccgaggattgtgtcgcgtttggaaaaggggaaaacgcaaaaaaatacttgagaaccgacgatcgcgtcgagcgtgtccgccgagcccacctgaatgatttatag

SEQ ID NO: 124303 - DNA, 264 bp, Artificial Sequence
  Description of Artificial Sequence: Synthetic coding sequence
atggttgacctgacccaagtcatggatgatgaggtgttcatggctttcgcttcttatgccactattatcctctccaaaatgatgctgatgtcaaccgcaaccgcattttatagactcacgagaaaggtgttcgcaaatccagaagattgcgtagccttcgggaaaggggagaatgcaaagaaatatctgaggaccgatgatcgagttgagcgagtaaggcggataaaacagactctctccatttacctggcttcaagcatctag

SEQ ID NO: 124304 - DNA, 444 bp, Artificial Sequence
  Description of Artificial Sequence: Synthetic coding sequence
atggcagggaactctattctgctagctgcagtctcgatcctaagtgcctgccagcagagctattttgcactccaggttgggaaagccaggctcaaatacaaagtcacaccgccagccgttactggtagccctgagttcgagagggtgttcagggctcaacagaattgcgtggagttttaccctatattcatcattaccctgtggatggctggatggtattttaaccaggtcttcgcaacatgccttgggcttgtatacatttatggtcggcacttgtatttttgggggtacagcgaagcagcaaaaaagcgaatcacaggatttagattgagtctgggaattcttgctttactgaccctactgggcgcactgggcatagccaactcctttttggacgagtacctagatctcaatattgccaaaaaactcagacggcagttctag

SEQ ID NO: 124305 - DNA, 444 bp, Artificial Sequence
  Description of Artificial Sequence: Synthetic coding sequence
atggctgggaatagtatcctcctggcagcggtatctattctgtcagcctgtcagcaatcttactttgcccttcaggtcgggaaggctaggcttaagtataaagtgactcctccagctgtcaccggtagccctgagtttgagcgagttttcagggctcagcagaactgtgtcgaattctaccctatctttattattaccctgtggatggccggatggtacttcaatcaggttttcgcgacctgcctcggcttggtatatatttacggacgacacctgtatttttggggatatagcgaggctgcaaagaagcggatcactggatttaggctgtcactgggaatcttagccctgctgaccctgctcggagccctaggcattgccaattcatttcttgatgagtacctggatcttaatatcgcaaaaaagctgcgccggcaattctag

SEQ ID NO: 124306 - DNA, 234 bp, Artificial Sequence
  Description of Artificial Sequence: Synthetic coding sequence
atggcaggaaattcgatccttttggccgccgtgagcatactaagcgcgtgccaacagtcctactttgccctccaggtcgggaaagctcggttaaagtacaaggtgacccctcctgccgtgaccggaagtccagaattcgaaagggtatttcgagcacacttctgttacctcagtggcagtggcgtccacatctggcccagtcctattctgctaggaattttcaggtcttgctag

SEQ ID NO: 124307 - DNA, 501 bp, Artificial Sequence
  Description of Artificial Sequence: Synthetic coding sequence
atgccttggcgtggcaggcgcttcaggctctgtaggcggaaaatggctgtgctttcgaaggaatacggctttgtactcctgacaggcgccgcctcttttatcatggtggcccacttggcaattaatgtgtcaaaggcacggaaaaaatacaaggtggagtatcccatcatgtatagtactgatccagaaaatggacacatattcaactgcatccagagggcacaccagaacaccctggaggtgtaccccccatttcttttttttttagctgtgggtggcgtgtatcacccaaggatagcttcagggttagggctggcgtggatagtaggccgcgtactttatgcatatggctattacactggggaacctagtaaacgaagtaggggggcactcgggtctatcgctttgctcgggcttgttggcacaaccgtgtgcagtgcgttccagcatctcgggtgggtcaagagtggcctggggtctgggcccaaatgctgccactag

SEQ ID NO: 124308 - DNA, 459 bp, Artificial Sequence
  Description of Artificial Sequence: Synthetic coding sequence
atggccgtgctgagcaaggaatacggatttgttctactcaccggggcagcgagctttattatggtggcacacttggcaatcaatgtctccaaagcacgaaagaagtataaggttgagtaccctattatgtactcaaccgatccagaaaacgggcacatttttaattgtatccagcgggctcatcagaataccctggaagtgtatccgccctttctgtttttcctggccgttggcggcgtgtatcacccgcggatcgccagcggattaggactggcctggattgtcggacgcgtgctttacgcctacggttactacactggcgaaccatctaagcgcagccgcggcgcactcggctccattgctctgctcgggttggtggggaccactgtatgttctgcattccaacatttaggctgggtgaagtcgggcctggggtccggccctaaatgttgccattag

SEQ ID NO: 124309 - DNA, 501 bp, Artificial Sequence
  Description of Artificial Sequence: Synthetic coding sequence
atgccttggcgaggccgccggtttagactatgccggagaaaaatggcggttctcagcaaagagtatggcttcgtgcttttgacaggcgctgcctctttcatcatggtagctcatctcgcaatcaatgtctctaaagccagaaaaaagtacaaggtagaatatcctatcatgtacagcacagatcctgaaaatgggcatatttttaattgcattcagcgtgcccatcaaaatacattggaggtctatcctcccttcttgttttttcttgccgtgggtggagtgtaccatccccgcatcgcatcgggtttaggtctcgcgtggatcgtaggaagagtcttgtatgcttatggttactatacgggagaaccttccaagcgatctcggggcgctctgggcagtattgccctcttgggcttagtgggcactacagtgtgctctgctttccagcacttaggctgggtgaagagcggattaggatccggtcctaaatgttgtcactag

SEQ ID NO: 124310 - DNA, 501 bp, Artificial Sequence
  Description of Artificial Sequence: Synthetic coding sequence
atgccatggcgcggccggcggttccgactgtgccgacgaaaaatggcggtcctgagcaaggaatatgggtttgtccttttgaccggcgcagccagttttattatggttgcccacctcgccatcaatgtaagtaaagcacgaaagaaatataaggttgagtacccaataatgtactctaccgaccctgaaaatggtcacattttcaactgtattcagagagctcaccaaaataccctcgaggtgtacccgccctttctgtttttcctggctgtcggcggggtgtaccacccgagaatcgcttccgggctcggccttgcatggatcgtcggccgcgtgctatatgcatatggatattatactggggagcccagtaagcggtcgaggggagccctgggatcgattgcattactgggtctggtcggcactacggtgtgtagtgccttccaacaccttggttgggtgaaaagcggactcgggtccggtcctaaatgctgccattag

SEQ ID NO: 124311 - DNA, 459 bp, Artificial Sequence
  Description of Artificial Sequence: Synthetic coding sequence
atggccgtgctgtctaaggaatatgggtttgtacttttaactggggcagctagctttatcatggtcgcccacttggctattaatgtgagcaaggcaagaaagaaatataaggttgagtaccccattatgtattcgaccgaccccgagaatggacacattttcaactgcatacaacgggctcaccagaacaccttggaagtgtatccaccctttctgttctttcttgcagtggggggagtgtatcacccccgtattgcttcagggctgggcttggcctggattgtgggaagagtgctgtacgcttatgggtactatactggtgagcccagtaagaggagcagaggtgccctgggatcaattgctttactcgggctcgtgggcaccaccgtttgctctgcttttcagcacctgggttgggtcaaatcaggcctgggatctggccctaaatgctgtcactag

SEQ ID NO: 124312 - DNA, 501 bp, Artificial Sequence
  Description of Artificial Sequence: Synthetic coding sequence
atgccgtggagaggccgccgctttagattatgcagacggaagatggctgtactcagcaaagagtatggcttcgtgctgttgactggtgccgctagcttcatcatggtagcccacttagctattaacgtttccaaggccaggaagaaatataaagtcgaatacccaatcatgtacagtactgatccagagaatgggcacatctttaactgcatccaacgggctcatcaaaataccttggaggtgtatccacctttcctgttcttccttgccgtggggggtgtgtatcacccccgcatcgcgagcggtcttggtttggcctggattgtggggagagtgctctatgcctacggctattataccggtgagccttccaaaagatcccgcggcgccctcgggtctattgctctgcttggcctggtgggcactactgtctgcagtgcatttcaacacctgggatgggtgaaatccggtcttggctccggccccaaatgttgtcactag

SEQ ID NO: 124313 - DNA, 972 bp, Artificial Sequence
  Description of Artificial Sequence: Synthetic coding sequence
atgcctcggctgacctttgcgcccaaagggtggccccatccccccacctcccttcattggtggctctttcaagagctgccaactcccagtgaaaactccatgcctcctgggctatcgacgcctaccgctagtcaggaaggcgctggtccagtcccagatccttctcaaccaacgaggcgacaaatccggttatcctctcctgagcgacaaaggctgagctcccttaatctgacacccgacccggaaatggaaccccccccgaaacccccgagatcatgtagtgccctcgcacgccatgctctggaatctagtttcgtgggctggggtctaccagtccagtctccccaggcactagttgcaatggaaaaagaagagaaagagtcccccttcagttcagaagaggaagaagaagacgtgccccttgactctgatgtggagcaggccctccagaccttcgcaaaaaccagcggtaccatgaataattacccgacctggagacgtacacttctgcggagagccaaagaggaagagatgaaacgattttgcaaggcccagacaatccagcgccgcctgaacgaaatcgaagccgcattgagggagctagaggcggagggggtcaagctggagctggcccttaggcggcagagctcaagcccagagcagcaaaagaagctctgggtgggtcaattgctgcagctggtggacaaaaaaaacagcctcgtggctgaagaggcagaactaatgatcaccgtgcaggaactaaatctggaagaaaaacaatggcaacttgaccaggaactaaggggttacatgaatagagaagagaatcttaagaccgctgcggaccggcaagctgaggatcaagtgctacggaagcttgtcgatctcgtcaaccaacgggatgccctgatccgcttccaggaggaacgccgcctcagtgaactggcgctgggcactggggctcaaggatag

SEQ ID NO: 124314 - DNA, 2946 bp, Artificial Sequence
  Description of Artificial Sequence: Synthetic coding sequence
atggcaagtccgaccagtaccaatccagcccatgcccacttcgagtcatttttgcaagcacaactatgtcaagatgtgctatccagcttccaggaattatgcggggcgctaggactggagccaggcggtgggttgccccagtaccataaaatcaaagatcagctgaactactggtctgccaagtcactgtggaccaaattggacaagcgggctggacaacctgtctatcagcagggccgggcgtgtacatccacaaagtgcctggtagtcggagctggaccctgcgggctccgtgttgctgtcgaattagccctgctcggtgcccgcgtcgtcttggtggaaaagcgaacaaagttcagcaggcataacgttctacatctgtggcctttcaccattcatgatctcagagccctgggcgccaagaagttttatgggagattttgtacaggcaccctggatcacatctccataaggcagcttcagctactgctgttgaaagtcgcgctactgctgggcgtggagatacattggggcgtgacatttactgggttgcaaccacctccaaggaaaggttccgggtggagagcgcagttgcagcccaatccccccgctcagctggcgaactatgagttcgacgtcctgataagcgcagccgggggcaagtttgtgcctgagggcttcaaagtgcgggagatgaggggtaaattggctattggcatcacagccaacttcgtgaacggcagaactgtagaggaaactcaagtgccggagatttctggagtggccagaatatacaaccagtctttctttcagagtctcctgaaggccacaggcatcgacttagaaaacatagtgtattacaaagatgacacccattatttcgtcatgactgcaaagaagcagtgcttacttaggctgggcgtcttgaggcagcccttctggcccctcggtactggcgtggcacgcgggttccttgcggctttcgacgcagcctggatggttaagcggtgggctgaaggcgcagagtcgctggaagtgcttgcggagagggagagcttgtaccagctgttgtctcaaacatcgcctgaaaacatgcaccggaatgttgcccagtacgggttggaccccgcaacccggtatcctaacttaaacctgagagcagtcacgcctaatcaggtccgcgacctgtacgatgttctggcgaaggaacccgtccagcgcaataatgataagacagatactggaatgcctgccaccggctcagccggcacacaggaggagctcctgcgatggtgccaggaacaaacagctggatatcctggggtgcacgtgagcgatttgagttctagttgggcagatggtttagctctctgtgccctggtttacaggttacagcccggtcttttggagccaagtgagctgcagggcctgggcgctttagaagcaactgcgtgggccttgaaggtggctgaaaacgagctgggcataacccccgtggtttcagcgcaggctgtcgtggctggctctgacccgctgggcctgattgcctatctgtctcacttccacagtgcctttaagtcgatggcccatagccctggacctgtgagccaagcttccccaggcacttcttcagcagttttgtttctgtccaagctgcagcgtaccctgcagcgatcaagagccaaggagaatgctgaggatgccggaggtaaaaagctgcggctggagatggaagccgaaacaccctcaacagaggtgccgcctgatccggagcctggcgttccactgacccctcctagtcagcaccaggaggcgggagctggggatttgtgcgctttgtgtggagagcacctgtatgtcctcgaaaggctctgcgttaatggtcacttttttcaccgttcatgcttccgctgccatacttgtgaggcgactctgtggccgggggggtacgagcagcatcccggcgatggacacttctactgtctccagcatcttcctcagaccgatcataaggctgaaggttccgatagaggcccagagagtcctgagttacctacacctagcgagaactctatgccacctggactttccacaccaaccgctagccaagagggggctgggcctgtcccagatcccagtcagccaaccaggagacagattagactgagctctcccgagagacagcgactttctagtctgaacctgacaccagatcccgaaatggagcctcctcctaaaccccctaggagctgttctgctttagcccgccatgccttggaatcttccttcgtcgggtggggtcttccagtccagtccccacaggccttggtcgccatggagaaggaagagaaggaaagtccctttagtagcgaagaggaagaggaggacgtacctcttgactctgatgttgaacaggccctccagacctttgcgaagacttccggaaccatgaataattatcccacgtggcgtcgtactcttctccgacgcgctaaggaagaagaaatgaagagattttgtaaggcccaaactattcagcgccgcctgaatgagatcgaagccgccctgcgggaactcgaggccgaaggagtgaagctagaactagcgctgcgacggcagtcctcaagtccagaacagcagaagaagctctgggttgggcaactgctccagctcgtggacaagaaaaactccctggtggccgaagaggcagaactaatgatcacagtccaggaactcaaccttgaagaaaagcagtggcaattggaccaggagctgcgcgggtatatgaacagggaggaaaatcttaagaccgcagccgatagacaagctgaggatcaggtcctgagaaagttggttgacctcgtgaaccagcgggatgccctgatccgctttcaggaggagcgaagactttcggagcttgctttgggtacgggggcgcagggttag

SEQ ID NO: 124315 - DNA, 3204 bp, Artificial Sequence
  Description of Artificial Sequence: Synthetic coding sequence
atggcctcccctaccagtaccaacccggctcatgcccacttcgagtctttccttcaggcacagctgtgccaggacgttctgtcatcctttcaggagctctgtggcgccctggggctggagcccggcggtggccttccacagtatcataagatcaaggaccaactaaactactggtctgcaaaatcactgtggaccaagctcgacaagagggcggggcagcctgtgtaccagcaaggccgtgcttgtacatctactaagtgtttggtggtcggtgccggtccctgtggcctccgcgtggccgtggaactggctctgctgggcgctagggtagtattggttgaaaagaggactaagttctctaggcacaacgttctgcacctttggccattcaccattcatgatcttcgcgctctgggtgccaaaaaattctatggccggttttgcactggcacactcgaccacatctccattaggcagttgcagctcctcctgttgaaggtcgcactgcttctgggggtggagatacattggggagtgactttcactggcctccaacctccacctcgcaaaggctcaggttggagggcacagctgcagcccaacccaccagcccagctggccaactatgagttcgacgtcctgattagtgccgccggtggcaaattcgtgccggagggcttcaaggtgcgcgagatgagaggcaagctcgcgataggtataacagctaacttcgtgaatggccgtacagtagaggaaacacaggtacccgagatctctggtgtcgccagaatttacaaccagagttttttccaatccctgctgaaagccacaggcattgacctagaaaacatcgtgtattataaggatgacacacattactttgtgatgaccgcgaaaaagcagtgcctccttcggctgggagtgctgcgtcaggattggcctgataccaataggcttttaggaagtgctaacgtagttcctgaggcgctgcagcgattcacccgcgccgcggcagatttcgccacccatggcaagctggggaaattggaattcgcacaggacgctcacggacagccagacgtttctgcttttgatttcactagtatgatgcgtgcagaaagctcagcccgggttcaggagaaacacggggcgagactgcttcttgggctggttggcgattgtttagtggaacctttctggcccctcggtaccggggtcgccaggggctttctcgctgccttcgacgcagcttggatggtcaagcgctgggcggaaggcgcagagagcttagaggtgttagcggaaagggaaagcctctatcagctgttgagccagaccagccccgaaaatatgcatcggaatgtagcacaatacggactggaccccgcaactaggtatcccaatctgaatttacgcgctgtcacccccaaccaagtgagggatttgtacgatgtcctagctaaggaacccgttcagagaaataatgataagactgatactgggatgcccgcaactggaagtgctggtacacaggaggaactgctgagatggtgtcaggagcaaacagctggctatcccggagttcacgtctctgacctttcatcaagctgggccgatggcctcgctttgtgcgcactggtgtatcgactgcagccaggactgcttgaaccaagtgagctgcaggggctcggcgcactggaggctacagcgtgggccctgaaggtggcagagaatgaactaggaattacaccggtggtgtctgctcaggccgtggtcgccggaagtgacccgttggggttgatcgcctatctgagtcatttccactctgcgtttaagtctatggctcactcacccgggccagtaagtcaggctagccctggtacctcatcagctgtcctgtttctgtcaaagctgcagcggacgttgcagcgaagtcgcgcaaaagaaaacgccgaggacgccggcgggaagaaactcaggctcgagatggaagccgaaacgccatccacagaggtgccacctgatccagagcccggggtccctttaactcctcccagccagcaccaggaagcgggtgccggcgatctctgtgcactgtgcggtgaacatttgtacgtgctggagcggctgtgcgtgaacggtcacttctttcatcggagttgttttcgctgccacacctgtgaggccaccttgtggcctggaggctacgaacagcatcctggcgatggacatttttactgtctgcagcacctgccgcaaacggaccacaaagctgagggcagcgatcgaggacctgagagcccagagctgcctacgccatcagagaactctatgccccccggactctctacaccaaccgcatctcaggagggggctggtccagtgcctgatccctcccagccaacaagacggcagatccgcctgtcctctcctgaacggcagcgcctgtcatccttgaacctcaccccggatcctgagatggaacctccacctaaaccaccaagatcgtgttcagcactagccaggcatgctctggagtcctcttttgtcggctgggggcttccagtccagtcccctcaggcccttgtggcgatggagaaagaggagaaggagtccccgtttagcagcgaggaggaagaggaagatgtgcccctggactccgatgtggaacaggctcttcagacctttgcaaagactagcggcactatgaacaattacccaacttggcggagaacgttgctgcggagagctaaggaggaggagatgaaacggttttgcaaagctcagactatccagagaaggctgaacgaaattgaggcagccctaagggagctggaggcggaaggggttaagcttgagcttgccctgaggcgccagagctccagtccagaacagcagaagaaattgtgggtgggacagcttcttcaactggtcgacaaaaaaaattccctcgtggccgaagaggccgaactcatgataacagtccaggaactgaatctcgaggagaagcagtggcaacttgatcaagagctgagagggtacatgaatagagaggaaaaccttaagactgccgccgaccgccaagccgaggatcaggttttacgcaagcttgtggacttggttaaccagagggacgccctcatccgatttcaggaagaacggcggttgagcgaactggctctcggtacaggggcgcagggctag

SEQ ID NO: 124316 - DNA, 3261 bp, Artificial Sequence
  Description of Artificial Sequence: Synthetic coding sequence
atgtcctgcctgagccattcatcacttccttcatgctgcccccctcaggaggcctccatggcaagtcccacttccactaatcccgcccatgcacactttgagtctttcctccaggctcagttgtgtcaggatgttctcagtagcttccaggagctctgtggggcgctgggactggaacccggcggcggactgccgcagtatcataagataaaagatcagctgaactattggagtgcaaaaagcctctggaccaagctagataaacgcgccgggcagcccgtgtaccaacaagggcgggcgtgcacatccaccaagtgcctggtagttggcgccggaccctgcggtctgcgggtcgccgtagagctggcactcctgggcgcacgggtggtgctagtggaaaagcgcacgaaattttcccgtcataatgtcctccatctgtggcctttcacaattcacgacctgcgggcactgggagccaaaaagttttacggcagattctgtactggcactctcgaccatattagcataagacaactgcaactgcttctgctgaaggtagctcttctgctgggcgtggagattcactggggtgtgacgttcactggtctgcagccaccgccccgcaaaggaagtgggtggagggcccaattacagcctaatcccccggcccagctggcaaattacgaattcgatgtgctcatcagcgccgccggagggaagttcgtccctgagggatttaaggtaagagagatgagagggaaattagctataggcatcacagccaacttcgtgaacggtcggaccgtggaggaaacccaggtcccggaaattagtggcgtggctcggatttacaatcagagtttttttcagtcattgcttaaggcgaccgggatcgacttggagaacatagtttactacaaggacgacacccactacttcgttatgaccgccaaaaagcaatgcctactgagactgggcgtacttcgccaggactggccagacaccaaccgtctcttaggttcggcaaacgtggtacctgaggcactgcagagatttaccagagccgctgcagatttcgcaacccacggaaagttgggcaaattagaatttgcccaggacgctcacggccaacccgacgtaagtgcattcgacttcacatccatgatgagagcagagtcatccgcacgtgtccaagaaaaacacggggcgcgtctgctgttggggttagttggtgactgtctggttgagccattttggcctttaggtactggggtggccagaggctttttagctgccttcgacgccgcgtggatggtcaaacggtgggcagagggcgcagagtccttggaagtgctggcagagagggagtctctttaccagctcttgagccagacttctcctgagaacatgcacaggaacgttgctcaatacggactggacccagccacccgatatcctaatttgaacctgcgagctgttactccaaaccaggtacgtgatttgtacgacgtgctcgccaaagaaccagtgcagcgtaacaacgataaaacagacactggcatgccagctacaggaagcgcaggcacccaagaggagcttcttagatggtgccaggagcagactgccgggtacccaggagtgcacgtgtctgatttgtccagttcttgggccgacggtctcgccctctgtgccctggtgtataggttgcagcccggactcctggagccttcagagctgcaggggctgggcgcactagaagcgacagcctgggccctgaaggttgctgagaacgagctcggcattactcccgtggtgtccgctcaggccgtcgtagccggatctgacccactcggcctaatcgcctacctgtctcacttccactccgcatttaaatccatggcccacagtccagggccagtgtctcaggcctctccaggcacatcttccgctgtgctgtttctctctaaactgcagcgcaccctgcaaagaagccgagcaaaagaaaacgccgaggatgcaggtggaaaaaagctacggctagagatggaagcagagacaccttctaccgaggtgcctccagatcccgaaccaggggtgcccctgacgccaccatcccagcaccaggaagcgggtgccggagacctatgtgccctgtgcggtgagcacctgtacgtgctggaaagactgtgtgtgaacggacacttctttcaccgctcttgctttcgctgtcatacgtgcgaggccaccctgtggccggggggctacgaacagcatcctggcgacggacacttttattgtttacagcatctcccacagacagaccataaggcagaaggcagcgaccggggaccagaaagccctgaactgcccacacccagcgaaaactccatgccgcccgggctgtccacgccaacagcttctcaagaaggagccggacctgtacctgatcccagccagccaactagaaggcaaatacgcttgtcatcccccgagaggcaacgactctcatctctgaatctcaccccagaccccgaaatggaaccgccacctaaaccccctaggagttgtagtgcactggctaggcacgccctcgaatctagttttgtgggctggggcctgccagtccagagtccccaggccctggtggccatggaaaaggaggaaaaggagtccccctttagctccgaggaagaagaggaggacgtgcccctagattctgacgtcgagcaggctttgcagacctttgccaagaccagcggtactatgaataattaccctacctggagacgcaccctactgaggcgggccaaagaagaagagatgaaacgtttctgcaaggctcaaaccattcaacggcgcctcaacgagatcgaggctgccctaagggaactggaagcagagggagtgaagctggaattagcacttcgtcgccagagttcatcccctgagcagcagaagaagctttgggtggggcaactgctgcagctggtggataagaaaaattccctggtagctgaggaggctgagctgatgattacagtgcaggaattgaacttggaagagaagcagtggcaacttgaccaggagttacgcggctacatgaacagagaggaaaacttgaagactgcagctgacagacaggcagaggaccaggtgttgaggaagctggtggatctcgtgaatcagcgggacgccctgattcggttccaagaggaaaggaggctgagcgagttggctctgggtaccggagcccaggggtag

SEQ ID NO: 124317 - DNA, 1776 bp, Artificial Sequence
  Description of Artificial Sequence: Synthetic coding sequence
ccaaagtatgtacttccgtcggaggcccaggtggtgccagccaagcagttgcaacctcaagaccggagttctgttcccgaacacagcctgttggctggaactcaggaggagctgctcaggtggtgtcaggagcagacagctggctacccaggggtgcatgtatctgacttaagttctagttgggccgacggccttgccctgtgcgcactcgtctatagactccaaccgggtttgctggagccctctgaactccagggccttggagcactggaggccactgcctgggcccttaaggtagcggagaacgaacttggaataacccctgtcgtcagcgcccaagccgtggtggccgggtcggatccgctgggactgatagcctatctttcacactttcactccgctttcaagtctatggcccattctccaggcccggtatctcaggcctctcccgggacttcctccgccgtgcttttcctgagtaaactccagcggaccctgcagcggtctcgggccaaagagaatgccgaggacgccgggggcaagaagctcagacttgagatggaggctgagacgccaagcaccgaggtgccacccgatcccgaaccgggagtgccactaacccccccaagccagcaccaggaagccggcgccggcgatctctgcgctctgtgtggcgagcacttatacgtgttggaacgactctgcgtaaatggacattttttccatcgcagttgcttcaggtgccatacctgtgaggccactttatggcctggtggctatgagcagcacccaggggatgggcatttttattgcttgcagcacctgccacagactgaccacaaagctgagggttcagatcggggccctgagtcacccgagctgccaacaccgagcgagaactctatgccacctggtctgagcactcccacagcatcccaagaaggggccggtcctgtcccagatcctagccagccgaccaggaggcaaatcaggctaagttccccagagcggcagcgcctctctagtctcaaccttacacctgacccagaaatggagcccccacccaaaccgccgagaagttgcagtgcactagctagacacgccctagagtcgagttttgttggctggggtttgcccgtccagtcaccacaggccttagtcgccatggaaaaagaagagaaggaatcaccttttagctctgaagaggaggaagaggatgttccgctcgattccgacgtcgagcaggcactacaaacatttgctaaaacatctggtacgatgaataattatccaacatggaggaggactctccttagacgggcgaaagaggaagagatgaaacggttctgcaaagcccagaccatccagagacggctcaacgaaatcgaagcggctctgcgcgaactggaggccgaaggcgttaaacttgagttggccctgaggcgccagagttcaagcccagaacagcaaaagaaactatgggtcggacagctgctgcagctggttgacaagaagaactctttggttgctgaggaggccgaactgatgatcactgtccaggagctgaacctggaggagaaacagtggcagctcgaccaagaattacgggggtatatgaatagagaggagaacctgaagactgccgccgacaggcaggccgaagatcaggtgctgcgcaagctggtggacctcgttaatcagagagatgcgctgattaggttccaggaggaaaggagacttagtgagttggcgctggggaccggggcccaggggtag

SEQ ID NO: 124318 - DNA, 735 bp, Artificial Sequence
  Description of Artificial Sequence: Synthetic coding sequence
atggcaagccccaccagcacgaatcccgctcacgcgcatttcgagtccttcctacaggctcagctgtgccaggacgtgctgtcttcctttcaagaattgtgcggtgcgcttgggctcgagcctgggggcggcctaccacagtatcacaagattaaagatcaactgaattattggagtgccaagtctttgtggacaaagctggacaagcgtgccggacagcctgtgtatcaacagggccgcgcctgcactagtaccaagtgcctggtagtgggagccgggccttgtggtctaagggtcgcagttgagctagctttactcggggctagagtcgtcttagtggaaaagcgcactaaatttagtcgacataatgtgctgcacttatggcccttcactattcacgacttacgcgcgctaggcgcaaaaaaattctacgggcgtttctgtacaggaaccctagaccatatttctattaggcagttacagttgttgctcctcaaggtcgctctgctccttggcgtggaaatacactggggggtaacttttaccggactgcaacccccacctcggaaggggtccggctggagagctcagctgcagccaaatccacctgcccagctggctaactatgagtttgatgtactgatttcggctgccggcggaaagttcgtacccgaaggctttaaagtgcgtgaaatgaggggcaagctagcgatcggcataaccgctaacttttag

SEQ ID NO: 124319 - DNA, 3375 bp, Artificial Sequence
  Description of Artificial Sequence: Synthetic coding sequence
atgggagagaatgaggatgagaaacaggcccaggctggccaggtcttcgaaaacttcgtgcaggcctctacttgcaaaggaacactgcaggcgtttaacatcttaacccggcacctcgatttggatcctctggaccacaggaacttttatagtaaacttaagtctaaagttaccacatggaaagccaaagcactgtggtacaagctggacaaacgtggcagtcataaggagtataagcggggcaagagttgtacaaacacaaaatgcctgatcgtcggcggaggtccctgcggcctccgcacggccatcgagctcgcttatctgggggcaaaagtggtggttgtggagaagagggactccttctctagaaacaatgtgttgcatctttggccctttacaattcatgatctcagaggccttggcgcaaaaaaattctatggtaagttctgtgccggatccatcgatcacatttcaatcaggcaactccagctgatattattcaaggtggcactaatgttaggtgtggaaatccacgtgaatgttgagtttgtaaaagtgttagagcctccagaagaccaggaaaaccagaagattgggtggcgagcggaattcttgcctacagaccacagtttatcagaatttgagtttgatgtgatcattggcgccgacggccggaggaacacactcgagggtttccggcgaaaggagttccgaggtaagctggccattgccattacagccaatttcatcaataggaactcaacggcagaggctaaggtggaagagattagtggagtggcgtttatctttaatcagaagttctttcaagacctgaaggaggaaactgggattgacttggaaaatatcgtctactataaggattgcacacattattttgtgatgaccgcgaaaaagcagtcactcctcgataagggcgtcatcatcaatgattacattgacactgagatgctcttgtgtgccgagaatgtgaaccaggacaacctactctcatacgccagagaagccgctgatttcgccaccaattaccagcttccctccctggactttgccatgaatcattacggccaaccagatgtagctatgtttgactttacttgtatgtatgcctctgaaaatgctgctttagtaagagaaagacaagctcaccaactgctggtcgctctggtaggagactcactgttggaacccttttggcccatgggcacgggctgtgccagggggtttctggccgccttcgacacagcttggatggtgaaatcatggaatcaaggtactccgccccttgaactcctcgcagagagggaatcgctatacagacttctgccgcagacaactcccgagaacatcaacaagaacttcgagcaatataccctcgatcctggcacccggtatcccaacctgaatagccattgcgtccgcccccaccaggtaaagcatttgtatataaccaaagagctggaacactatccactggaacgccttgggtcagtacgcaggtccgtcaacctgtcacggaaagagtctgacatcagaccatccaaacttctgacttggtgccagcagcagaccgaagggtatcagcacgtcaacgtgaccgacctgaccacaagttggcggagtgggctggccctgtgtgcaatcattcaccgattcagacccgaactgattaacttcgactctttgaacgaagacgacgcagtggagaacaatcaactggcttttgacgtggcggaaagagagttcggcatcccgcccgtgactaccggtaaagagatggcctccgcgcaagagcccgataagctgtctatggtcatgtatctctccaagttctacgagctgtttagaggcaccccactcagacctgtcgactcttggagaaagaattatggcgagaacgccgacttaagtctggcgaagagctcaatctccaacaattatctcaaccttaccttccctcgtaaaaggaccccaagagtggatggccagactggtgagaatgatatgaacaaaagaaggagaaaggggttcacgaatttggatgagccttccaacttttcatcgcggtctctggggtctaatcaggaatgcgggagtagcaaagaaggaggtaaccagaacaaggtaaagtcaatggctaaccaattactggctaaatttgaggaatcaacgcgcaatcccagcctcatgaagcaagagaggcgtgtgtctggcatcggaaagcctgtgttgtgttcatcctccggaccccccgtacattcatgttgccccaaaccagaagaggccaccccttcgcccagtccacccctcaaacgccagttcccgtcagtggtagttacaggccatgttctccgcgagcttaagcaggtgtccgccggatctgagtgcctctcaagaccgtggagagctagggccaagtctgatctgcaactgggcggtaccgagaacttcgccactctgccttctacacgaccacgcgcccaggccctctccggggtgttgtggcggctgcagcaggtggaggagaagatccttcagaagcgtgcccagaacctagcaaacagagaatttcatacgaagaacattaaggagaaagccgcccatctggccagtatgttcggccacggcgactttccgcaaaataagttgctgtcgaagggcctgtcacatacccaccccccgagtccaccttcacggctgccctcacctgatccagccgctagtagctcgcccagcaccgtggattccgcctcccctgccagaaaagagaagaagagtcctagtggcttccacttccatccttcccatctccgcactgttcacccgcagcttaccgtgggaaaagttagctctggaattggggccgctgccgaggtgctggtgaatctttatatgaacgaccataggccgaaggcgcaggcaacaagccctgacctggaatctatgaggaagtccttcccactgaaccttggcggaagcgacacctgttacttttgcaagaaaagagtgtacgtgatggagcggttgtctgccgaggggcactttttccatagggagtgcttcaggtgtagtatatgcgctaccactttaaggctggccgcctatacctttgactgcgacgaaggcaagttctactgtaaaccccacttcatacactgcaaaacaaactctaagcagagaaaaagaagagctgaactcaagcaacagagagaggaggaggctacctggcaagaacaggaagctccacggcgggacacaccaaccgaatcgagttgcgcagttgccgccataggcacattggagggtagtccccctgttcacttctcactcccggtactacatccgctcctcgggtag

SEQ ID NO: 124320 - DNA, 3312 bp, Artificial Sequence
  Description of Artificial Sequence: Synthetic coding sequence
atgggagaaaatgaagacgaaaaacaggcacaggccggacaggtcttcgagaactttgttcaggcaagtacttgcaagggaaccctccaggcatttaatattttgaccaggcaccttgatctggacccgttagatcaccgaaatttctacagcaaactgaagtcaaaggtgacaacctggaaagctaaagcgctgtggtataaacttgacaaaaggggttcgcacaaagaatacaaacgcggcaagagttgtacgaatactaagtgcctcatcgtagggggtggcccttgcggtctgcgtacggccattgagttagcatatctgggtgcaaaggtggtggtagtggaaaaacgcgattcattttcacggaataatgtcctgcacttgtggccctttaccatacacgaccttcgaggtttgggggcaaaaaaattctatggtaagttctgtgcaggatccattgaccacatctcaattcgacagctgcagttaatcctgtttaaggtcgccttgatgctgggcgtagagatccacgtcaacgtagagttcgtgaaggtcttggaaccacccgaggaccaggaaaaccagaagattggatggcgcgcagagtttctgcccaccgatcactcactgtctgaatttgaattcgacgttattatcggcgcagacggccgcagaaatacgttggagggttttagacgaaaggagttccgcggaaagctggccattgcaatcactgcgaatttcatcaacaggaacagtaccgccgaggctaaagtggaagaaatctctggagttgcttttattttcaatcaaaaatttttccaagatttaaaagaggagaccggcattgatctggaaaacattgtctactataaggattgcactcactacttcgttatgaccgcaaagaaacaaagcctcctggataagggggtgataatcaacgactatatagataccgaaatgctcctgtgcgccgaaaacgtgaatcaggataacctgctcagctacgcaagagaggctgccgatttcgccaccaactatcagctaccatctctcgatttcgccatgaatcattatggacagcctgacgtagccatgtttgacttcacatgtatgtatgccagcgagaacgctgccctggtccgcgaacgccaggcccaccagttgctggtggcgctggttggcgattcactgcttgagcccttttggcccatgggaaccgggtgcgctcgcggcttcctcgcagcattcgatactgcctggatggtgaagtcctggaatcagggtacccccccccttgagctgctggctgagcgcgagtcactgtacaggttacttccacagaccactcccgagaatatcaataaaaattttgagcagtatactctggaccccggaacccgataccctaatctcaactctcactgtgtccggccacatcaggtcaaacacctctatattaccaaagagctggagcattacccgttggagagactgggctctgtgcggcggtcagtaaatctgtcacgaaaggaaagcgacatacggccatctaaacttctcacctggtgtcagcaacagacagagggatatcagcatgtgaatgttactgatttaaccacctcctggcgctccgggctggcattgtgtgccattatccataggttcaggcctgagctcatcaacttcgatagcctcaatgaggacgatgccgtagagaacaatcagttggcttttgacgtggcagagcgggaatttggcatcccccccgtgaccaccggcaaagaaatggcttcggctcaggagccggataagctgtcaatggttatgtatctgagcaaattttatgagctcttccgcgggacgcccctgcgccccgtggacagctggcgaaagaattatggtgagaacgctgacctttctctggccaagtcgtcaatatctaacaactacctcaatctcactttcccgcgaaagcgtacccctcgcgtagacggtcagactggagaaaatgacatgaacaagcgaagaaggaaggggttcactaatctggatgagccatccaacttctccagcaggtctcttggctcgaatcaggagtgcggctctagcaaagagggaggaaatcagaataaagtgaagtcaatggccaaccagctactggctaaatttgaagagtcaactaggaatccctccctcatgaagcaggagaggagggttagcggaatcggcaagcccgtcttgtgttcttcatcaggcccgccagttcactcctgttgccccaagccagaagaagccactcctagtccctctccaccccttaaaagacagttccccagtgttgtcgtgacagggcacgtgctgagagagttaaaacaggtctccgcagggagcgaatgcctgagtcggccttggcgggctcgagctaagtcagatctccagttggggggcaccgagaacttcgctactctcccttcaacgagacccagagcccaggctctgtctggagtgctgtggcgcctacagcaggttgaagagaaaatattgcagaagagggcacagaatctggctaatagagagttccacaccaaaaacatcaaggaaaaagccgcccatctggcctcaatgtttggacatggagatttcccccagaataaactgcttagtaaaggactgtcacatactcatccaccatctcctccaagccggctgccctctccagacccagccgcatcatcgagcccttctacagtagacagtgcttccccagctagaaagctcactgtgggaaaagttagctccggcataggggctgcagcagaagtcctggtgaacctgtatatgaatgaccacagacctaaagcgcaggcgacttcccctgacctcgagtctatgaggaaatcctttcctctgaaccttggagggagtgacacatgttacttctgtaagaagagggtgtatgtaatggaacggcttagtgccgaaggacacttctttcacagagaatgtttccgctgctccatttgtgctacaactctccgcttggcagcgtatacctttgactgcgacgaaggcaaattttactgtaaaccccattttatccactgcaagactaacagcaagcaacgaaagcgccgcgctgagctcaagcagcagcgcgaggaagaggccacctggcaggagcaggaggcccccaggagggacactcccacagagagctcatgcgccgtggctgctatcggtaccctggaaggctcgcccccggtgcacttttctctgcctgtgctccatccactgctgggctag

SEQ ID NO: 124321 - DNA, 2931 bp, Artificial Sequence
  Description of Artificial Sequence: Synthetic coding sequence
atgggggaaaatgaagacgagaagcaggcccaggccgggcaggtgttcgagaactttgtccaggcatctacctgcaagggcactttacaggctttcaatatcctcacgcgccatctggatctagatccgctggatcacaggaacttctatagcaaattgaagtctaaagtgacaacttggaaggcaaaggccctttggtataaattggacaaacgcggctctcataaggagtataagaggggaaagagctgcactaacaccaagtgcttgatcgtgggcggcggaccgtgcgggctccggacagccatagaactcgcttacttgggcgccaaagtggtggtggtcgaaaagcgggattctttctctcggaacaacgtgttgcatctgtggccattcacaattcacgatctcagagggctgggtgccaaaaagttttacggcaaattctgcgctgggtcgatcgatcacattagcatccgacagcttcaactgattttgttcaaagtcgccctgatgttaggtgtggagatccacgtaaacgtcgagtttgtcaaagtcctggagccacctgaggatcaggagaatcagaagatcggctggcgggcagaattcctgccgaccgaccactctctgtccgagttcgagtttgacgttataattggggcagacgggcgacggaatactttggaaggtttcaggcggaaggagttccgagggaagctggctattgccataaccgcgaatttcatcaacaggaactccactgccgaagccaaagtagaggagatttctggtgtcgccttcatctttaatcagaagttcttccaggatctgaaggaagaaacagggattgatctagagaatattgtgtactacaaggactgtacacactacttcgtcatgactgcaaaaaaacagtctctcctcgacaagggggtgatcattaatgactatatcgacactgagatgttactgtgcgccgaaaatgtgaaccaggacaacctgctgagttatgctcgagaagctgccgactttgctaccaactaccaactgccctctttggacttcgccatgaaccattatggccaaccagacgtcgctatgtttgactttacctgcatgtacgcttcagagaacgccgctctggttagagaacgacaggcccaccagttgctcgttgccctcgtaggagattctctgctcgaacctttctggcccatgggaacgggatgcgccaggggtttccttgctgctttcgataccgcctggatggtgaaaagctggaatcagggaacaccccccctggaactgctggcggagcgggagagcttgtacaggctgcttccgcagacgaccccagaaaacataaataagaacttcgaacaatacactctggatcccggcacccggtaccccaacctgaactcccactgcgtccggccacatcaggtcaagcatctgtacatcacaaaagaactggaacactatcctcttgaacggctgggaagtgtcagacggtccgtgaatctcagcaggaaggagagtgatattcgaccatcaaagctactaacatggtgccaacagcagacggagggataccagcatgtgaacgtgacggacctgacaactagctggagaagtggcttagccctatgtgccattatccaccgattcaggccagagctcattaactttgattccctgaacgaagacgacgcggtcgagaataatcaattggccttcgacgtggctgaaagggagtttggaataccgcctgtgactactgggaaggaaatggccagcgcccaagaaccggacaaactgtcaatggtcatgtacctttccaagttctatgagctctttcgcggtaccccactccgtcccgttgattcttggcgcaagaattatggcgagaacgccgatctgtctctcgccaagtctagcataagcaacaactatcttaacctgacatttccgagaaagcgtacccctagagttgatggacaaaccggtgagaacgatatgaataagcgtcgccgcaaggggtttactaacttagacgaaccaagcaatttctccagccgctccctggggtctaaccaggaatgtggctccagtaaggaagggggaaaccagaataaggtgaagagcatggcaaaccagctgctggctaagttcgaagagtccaccaggaatccttctctgatgaaacaagagaagaagagtcctagtgggttccattttcatccaagccatctacgcaccgtccacccacaggaaagcatgagaaagtcatttcccttgaatctaggtggaagcgatacctgttacttttgcaagaagagggtttacgtaatggagcgtctgagcgctgaaggacactttttccacagagagtgcttccgctgttccatttgcgccaccacactgaggttggccgcttatacgtttgattgcgacgaaggaaaattctactgtaagccacactttatccactgtaagaccaattctaagcagcggaaaagacgagctgaactgaaacagcaacgggaggaggaggccacctggcaggaacaagaggcccctcggagagatacccctaccgagagttcctgcgccgtggctgcaattggaactctggagggttcaccccctggtatcagtaccagcttttttcgcaaagtgttaggctggccgctgcgactcccaagagacttgtgcaactggatgcagggactcctgcaggctgcaggcttgcatattcgggataatgcttataattattgctatatgtacgagctgctcagtcttgggctgcctctcctgtgggcgtttagcgaggtgctggctgctatgtaccgggaatcagagggctccctggaatccatctgcaactgggtgttgcgctgtttccctgtaaaacttaggtag

SEQ ID NO: 124322 - DNA, 363 bp, Artificial Sequence
  Description of Artificial Sequence: Synthetic coding sequence
atgggggagaatgaggacgagaaacaagcccaagctggacaggtcttcgagaattttgttcaggcgtccacctgcaaaggcaccctgcaggcctttaatatattgacaaggcatttagatctggaccccctagaccaccgtaatttctactccaagctgaagagtaaggtcacaacgtggaaggcaaaagctctgtggtacaagctcgacaagagaggctctcataaagagtacaagcgggggaagtcctgcaccaacactaaatgtctcatcgtgggaggaggaccttgcggcctcaggacagccatcgagctggcctacctgggcgcaaaagtggtcgtggttgaaaaacgtgatagttag

SEQ ID NO: 124323 - DNA, 405 bp, Artificial Sequence
  Description of Artificial Sequence: Synthetic coding sequence
atgggagagaatgaggatgaaaagcaggcccaggccgggcaggttttcgagaacttcgtccaagctagcacatgcaaagggacactacaggcattcaatatcctcaccaggcacctggacttggatccccttgaccataggaatttctactcaaaactcaagtctaaagttactacctggaaggcaaaggctttgtggtacaagctggacaagagagggagtcacaaagagtataaacgtggaaagtcgtgtaccaataccaagtgccttattgtgggcgggggcccctgtggactgcgcaccgctatagagctggcttacctcggtgctaaagttgtcgtcgtggaaaagcgcgattcgttcagtcgtaataatgtgctgcacctttggccttttaccatttag

SEQ ID NO: 124324 - DNA, 267 bp, Artificial Sequence
  Description of Artificial Sequence: Synthetic coding sequence
atgggcgagaatgaggacgagaagcaggcacaggcggggcaagtttttgaaaattttgtgcaggctagtacctgcaaagggacactgcaagcatttaatatcctgactcggcatctggacctagaccccctggatcatcgcaacttctactctaaactgaagagtaaggtgaccacatggaaggccaaggcgctctggtacaagcttgacaaacgcggatcacacaaagaatacaagagaggaaagtcctgcaccaatacaaagtag

SEQ ID NO: 124325 - DNA, 12 bp, Artificial Sequence
  Description of Artificial Sequence: Synthetic coding sequence
atgggtgaatag

SEQ ID NO: 124326 - DNA, 297 bp, Artificial Sequence
  Description of Artificial Sequence: Synthetic coding sequence
atgggcgaaaacgaagatgaaaagcaggcacaggccggccaggtgtttgaaaacttcgtacaagctagcacatgcaaggggactctgcaggcttttaacatcttgacaaggcaccttgatctcgatccacttgaccatcggaacttttactcaaagttgaagtccaaggtgacgacctggaaagctaaggctctctggtacaagttggacaaacgaggctcacataaggaatataaaagaggtaagtcatgtaccaacaccaaatgcctcattgtcggtggagggccctgcggatag

SEQ ID NO: 124327 - DNA, 267 bp, Artificial Sequence
  Description of Artificial Sequence: Synthetic coding sequence
atgggcgagaacgaagacgagaagcaagcacaagcaggccaggtgtttgagaattttgtccaggcttcgacgtgtaaagggaccctccaagctttcaacattttgacaaggcacctagatttggacccactggaccatcgcaatttctattctaaactcaaatctaaagtaacaacgtggaaagcaaaagctctatggtacaaattggacaaacgaggctcccacaaggagtataagcgagggaaatcttgcacaaataccaaatag

SEQ ID NO: 124328 - DNA, 309 bp, Artificial Sequence
  Description of Artificial Sequence: Synthetic coding sequence
atgggtgaaaacgaggatgagaaacaagcccaagctggccaggtcttcgagaatttcgtccaagccagcacatgcaaagggaccctgcaggccttcaatatactcacccggcatcttgatctggacccacttgatcaccggaatttctacagcaagttgaagtccaaggtcacgacctggaaggccaaagctctatggtataagctggataagaggggatcccataaggagtacaagcgggggaaatcatgtaccaatacaaagtgcctgatcgtgggcggagggccatgcggcctgcgcacagcatag

SEQ ID NO: 124329 - DNA, 2805 bp, Artificial Sequence
  Description of Artificial Sequence: Synthetic coding sequence
atgggagagaacgaggatgagaagcaggcccaggctggtcaagttttcgagaactttgtgcaggctagcacgtgcaagggcactcttcaggcctttaacatcctcacacggcatctggatctcgatcccttagaccaccggaacttctatagtaaactaaagagcaaggtgaccacctggaaggcaaaagctctctggtataaactggataagagaggcagccataaagaatacaagcgcggtaaatcgtgtacaaacacaaaatgcctgatagttggagggggaccttgcggcttgcgtacagcgatcgagttggcttatttaggcgcaaaagtcgtcgtggtggaaaaacgggatagcttttcacgcaacaacgtcctgcacctctggccgttcacaatacacgacctgcgggggctgggtgctaagaaattctacgggaaattttgcgccggctccattgaccacatatcaattagacagttacagctgattttatttaaagttgccctcatgttaggggtggaaattcacgtgaacgttgagttcgtgaaagttttggagccccccgaagatcaagagaatcaaaagatcgggtggagggctgaattcttgcccaccgaccatagtctgagtgagttcgaattcgacgtgattatcggcgccgacggccgcagaaatacccttgagggctttagacggaaagagtttcgagggaaactggccatcgcaattacagccaatttcatcaatagaaatagtaccgcggaggcaaaggtggaggagatttctggggtggcctttatatttaaccagaaattcttccaggatctgaaagaggaaacaggaattgatttggaaaacatcgtatattacaaagattgcacccattactttgtgatgaccgcaaagaagcagtctctgcttgataagggggttatcattaacgactatatcgatacagagatgctgctgtgcgctgaaaacgttaatcaggataatctgctgagctacgccagggaggcggctgactttgccactaattatcaactcccaagtttggacttcgcaatgaatcattacggacagcctgacgtggcaatgtttgacttcacctgtatgtacgcttcggaaaacgcagccctggtgcgcgagcgacaggctcaccaactcctggtggctctggtgggtgactctcttttagagccattttggcccatgggtacagggtgcgctcgggggtttctggccgccttcgacaccgcctggatggtgaagtcttggaaccagggcacaccccctctcgaattgctggctgaaagagagtcactgtacaggctactcccacagacaactcccgagaatatcaataaaaacttcgagcagtacacactcgacccaggcacccggtaccccaatttgaactcccactgtgtgcgaccccaccaggtgaagcatctgtacattacaaaagaactagagcactatcctctggaacgattgggttcagtgcggaggtccgtgaatctgagccggaaggaatccgacatcaggcccagcaaactgctgacttggtgtcagcagcagactgaaggctatcagcatgtgaatgtaacggaccttactaccagttggagatctggcctagccctttgtgccataattcatagattccgtcccgagctgatcaacttcgatagtttgaacgaggacgatgcggtggagaacaaccaactggcttttgatgtcgcagagcgcgaatttggtatcccccctgtgacaaccggtaaagagatggctagcgcacaggaacccgacaagctgtctatggtgatgtacctgtcgaagttttacgagctgttccgtggtaccccactaagacctgtggattcgtggaggaagaactatggcgagaatgctgatctgtccctggcaaaaagcagtatttccaacaactacctgaatcttacatttccccggaaacggacaccccgagttgacggccagaccggagaaaacgatatgaataagcgcaggagaaagggattcacaaatctggacgagccttcaaatttcagctcacgctccctcgggtcaaatcaagagtgtggatccagcaaggaaggcggaaatcaaaacaaggtgaaaagcatggctaatcagctcttagcaaaatttgaggagtccacacggaacccctcactgatgaaacaggaaaagaagagcccatctggctttcatttccatccttctcatcttcgcacggtacatccccagctaacagttgggaaagtgtcaagcggcatcggcgccgccgcagaggtgctagtcaatctgtacatgaacgatcaccgacccaaggcccaggccacatccccagacctcgaatccatgcgcaaatcgttcccccttaacttgggaggttcagacacctgttacttctgtaagaagcgtgtgtatgtgatggaacgcctctctgcagaagggcacttttttcacagggaatgttttaggtgttcaatctgtgctacaaccctccggctggcagcttacaccttcgattgcgacgaagggaagttttattgtaaaccgcactttattcattgcaaaacaaatagcaaacagcgaaagagaagagccgagctgaaacagcagcgcgaagaggaggcaacttggcaggaacaggaggcgcctcggcgggacactcctactgagtcttcatgtgcggtcgcggcaattggtacactggaggggtctcctcctgtccacttctccttgcccgttttacacccactgttgggatag

SEQ ID NO: 124330 - DNA, 1638 bp, Artificial Sequence
  Description of Artificial Sequence: Synthetic coding sequence
atgaggtccagccccgacctgaatagccactgtgtccggccgcaccaagtcaagcacctgtatatcacgaaagagctcgagcactatcctctcgagaggctgggatctgttaggcgttctgtcaacctgagtagaaaagaatctgacatccggccgtctaaactcctgacttggtgtcagcagcaaaccgaaggctaccaacacgtgaatgttaccgacttaacgacatcctggcgctccggactggccctatgcgcaattatccaccgcttccggcccgagcttatcaacttcgactctttaaatgaggacgacgcagtcgaaaataaccagctggcattcgatgtggctgaacgggagtttggcatccctcccgtgacgacaggaaaagaaatggcatcggctcaggaaccggacaagctcagcatggtcatgtacctgtccaagttttatgagctgtttcgggggacacctcttagaccagtcgactcgtggagaaaaaattacggagaaaacgccgatctgtcccttgctaaaagcagcatcagtaataactacctgaatctcacctttccacgcaaacgtacccctagggtggacggccagaccggagagaatgacatgaacaaaagaagacggaaaggctttacaaacctcgacgagccttccaactttagttccagaagtctcggatcaaaccaagagtgtgggagtagtaaagagggtggcaatcagaataaggttaagtctatggccaatcagctcttagccaagttcgaagaatctactcgcaatccatccctgatgaagcaggaaaagaaaagcccatccgggtttcacttccaccccagccacctgaggactgttcacccacagcttacggtaggaaaagtaagctccggcatcggcgcagcagcagaagtgctcgttaatctctatatgaatgaccaccgcccaaaggcccaagccacctctcctgatctggaatcaatgcggaagtctttcccactcaaccttggtggctcagatacatgttacttttgcaagaagcgagtctacgtcatggagcgtttgtccgcggagggtcacttcttccaccgcgagtgcttcaggtgttcaatttgtgccactaccttgcgtttggccgcatacactttcgattgcgacgagggcaagttctactgtaaaccccacttcatccactgtaagaccaatagcaagcagaggaagaggagggccgaacttaaacagcagagggaagaggaagccacctggcaggaacaggaggccccacgtcgtgatacacctactgagtcatcgtgcgcggtcgccgccataggcactctcgaagggagcccacctgggatttctaccagcttcttccgcaaggttctgggctggcctttacggttgccgcgggacctctgcaattggatgcagggtcttctgcaggctgccggcctgcatatccgagacaacgcctataactattgctatatgtatgaacttctttcactcggtctaccactgctctgggctttctcagaagtcctcgccgcaatgtaccgagaatctgaaggatcgcttgaaagcatttgcaattgggtcttgcgatgttttcctgtgaagctgcggtag

SEQ ID NO: 124331 - DNA, 3273 bp, Artificial Sequence
  Description of Artificial Sequence: Synthetic coding sequence
atggccaccctactaagccatcctcagcagaggccccctttccttcggcaggctattaagatccggagacgaagggttagggatctgcaggaccctccccctcagatggcccctgaaatacagccaccatctcatcacttttcacccgaacaaagggccctgctgtatgaagacgccttatacactgttctgcaccgactggggcacccagaaccaaatcacgtgacggaggcatctgaactgctacgctacctgcaggaggccttccatgtagaaccagaggaacatcagcaaaccttacaacgggtgagagagctggagaagccgattttttgcctcaaagcgaccgtgaaacaggccaagggcatcctgggaaaagatgtatctgggttttcagacccgtactgtctcctggggattgagcagggagtgggggtccccggcggcagcccagggtctcgccatcggcaaaaagctgtagttcggcacactatcccagaagaggagacccaccgaacacaggtcataacccagaccctgaaccccgtctgggacgagacattcatcttagagttcgaggacattaccaacgcgagtttccacctggatatgtgggacctcgacaccgtggaatccgtgcgccagaagctcggcgaattaactgacttacacggtctccggcgaatctttaaggaggcacggaaggacaagggacaggacgacttcttgggcaatgtggtcctgcggttacaagacttaaggtgccgagaggatcagtggtatccactggagcctaggacggagacttacccagacaggggacagtgtcatctgcagtttcaactcatccataagcgtcgcgcgaccagtgcttcaagatcacagcctagctatacagtacatctgcaccttctgcagcagctggtttctcacgaagtgacacagcacgaagccgggtctaccagttgggacggatctctaagcccacaggcggcaaccgtgttattcttacatgccacccagaaggatctgagtgattttcatcagtcaatggcccagtggctggcatactcacgcctttatcaatcccttgagtttccttcttcatgcctgttacaccccatcacatcaattgagtatcagtggatacaggggcgcctcaaagccgagcagcaggaagagctagctgcttccttttcttccttgctaacgtacggtctgtctttaataaggcgattccgctccgtgtttcctctctcagtgtcagatagccctgcccgcctgcagtctctgttgagggtgctggttcagatgtgtaaaatgaaagccttcggagagctgtgtcctaacactgctcccctaccacagctggtcaccgaggctctgcagaccggcacaactgaatggtttcatctgaagcagcagcatcatcagcccatggtgcaggggattccagaggcaggaaaggcccttttgggtcttgtgcaagacgtgataggagatctccaccaatgccagagaacctgggataaaatcttccacaatacactgaaaattcacttgtttagcatggcctttagggaactgcaatggctcgtggcgaaaagagttcaggaccacactaccgtggtgggcgatgttgtaagccccgaaatgggagagagcctgttccagctctatatatctctgaaggaactgtgccagctccgcatgtcatcctccgagagggatggcgttctggcactggacaacttccatagatggttccagccagccattcctagctggcttcaaaaaacatataatgaagccctggccagagtgcagagagctgtccagatggacgagctagttcctttaggagagctcacaaagcacagcacctccgccgtggatctgtccacatgctttgcccagatttcccacaccgcacgccagctggattggcccgacccagaggaggcattcatgatcacggtcaagttcgttgaagatacttgtaggttggcactggtctattgttcattgatcaaagcccgggctcgcgagcttagttcgggacagaaagaccagggacaggctgctaatatgctttgcgtggtagtcaatgatatggaacagctgcgccttgtgatcgggaaattacccgcgcagctggcttgggaggccctggaacagcgggtaggcgccgtattggagcagggacaacttcagaacacgctgcatgctcaacttcaaagcgcacttgccggcctggggcacgaaatcaggaccggggtccggactctcgctgagcagttagaggtaggaatagcaaagcacattcagaagctggtgggggtgagagagtcggtccttcccgaagacgcaatcttgccactaatgaagtttctcgaagtagagttatgctatatgaacaccaacctggtgcaggaaaatttctcttccctgctgacactcctgtggacacatactttgactgtgctggtagaggctgcggcctcccagagatcgtcatcacttgcctctaatagactcaaaatagcactgcagaatttagaaatttgctttcacgccgagggctgcggtctccccccaaaagcactgcacactgccactttccaggcccttcagagggatctggagttgcaggcggcatcctccagagagttgatccgtaaatacttctgttccagaatccagcagcaagctgaaactacatcggaagagctcggggcagtcacagtgaaggcctcttaccgcgcctctgagcaaaaattgcgggttgagctcctctccgctagctcattactgcctctggattccaatggaagttctgatccctttgtgcagctaaccctcgagcctcggcacgagtttcccgagctcgccgctagggaaacccagaagcacaagaaggatttgcaccctctgttcgacgaaacattcgagttcctggtcccggctgaaccctgtcgaaaggctggggcctgtctgctcctaaccgttctggactacgataccctcggggccgatgatttggagggagaagcctttctgccactgagggaggtgccgggcctgagcggaagtgaagagccgggtgaggtgccacagacccgcctgccgctgacttatcctgcgcccaacggcgacccgattcttcagctcctggagggcaggaaaggagacagggaagcccaggtcttcgtgcgcttgcgccggcaccgcgcaaagcaggccagccaacatgccttaagaccagctccttag

SEQ ID NO: 124332 - DNA, 2847 bp, Artificial Sequence
  Description of Artificial Sequence: Synthetic coding sequence
atggaggagagaaagcatgagacaatgaaccctgctcatgtgctttttgatcgttttgtgcaggccaccacatgcaagggaaccttgaaggcttttcaagagctgtgtgaccaccttgaactcaaaccaaaggattacaggtcgttctatcacaagctgaagagtaagctgaactattggaaagccaaagccctgtgggcaaaactcgataagaggggatcgcataaggattacaaaaagggtaaagcttgtaccaacacgaagtgtctgatcattggtgcaggaccatgcggactcaggacagccatcgacctgagcctgctaggtgcaaaggtggtggtgatcgaaaagcgagacgccttttctcgtaataacgtactgcatctttggcctttcacaatccacgatttacgggggttgggtgccaagaaattttacggtaagttctgcgccggtgccattgaccacatttccataaggcagctgcagctgatcctactaaaagtagctctcatcctcggtatagagattcatgtgaacgtcgagtttcagggcctcatccagcctcctgaagatcaggaaaatgagagaatcgggtggcgggctttagtgcacccaaagacgcacccagtatcagagtacgaattcgaggttataataggcggtgatggacgacggaatacattagagggcttcagacggaaggagtttcgaggaaagttagccatcgcaatcacggcgaacttcattaacagaaacacaacagcagaggcgaaggttgaagaaatctccggcgtcgcttttatctttaatcaaaagttctttcaagaactccgcgaggcaacaggcatcgacctggagaatattgtctactacaaggatgatactcattatttcgtgatgaccgccaaaaaacagagcctcctggataagggtgtgatcctgcacgattatgccgataccgagctcctgttgtctagagagaatgtagatcaggaagcattgttgtcttatgctcgcgaggctgctgacttctccactcagcaacagctgccctcgctggatttcgcaatcaaccattacgggcagccagacgtagcaatgtttgacttcacctgcatgtacgcctcagaaaacgccgcgctggtccgtgagcaaaatggccatcagctattggtggcactggtaggggatagccttctcgaacctttttggcccatgggtactggcatagcccgaggcttcctcgccgccatggactcagcctggatggtgaggtcctggagccttggtaccagccccttggaggtgctcgccgagcgcgagtccatttaccgtctcttaccgcagacaacccccgagaacgtgtcaaaaaacttttcacagtattctattgatcccgttacacggtatcccaacattaatgtcaactttctcagaccgtctcaagtgcgccacctctacgacactggcgagactaaagacattcatctggaaatggagtccttagtgaactcccggaccacaccaaagcttacccgtaacgaaagcgtggcgaggagctctaagctgcttgggtggtgccagagacaaacagacggctatgccggagtgaacgtaacagacctgaccatgagctggaagagcgggctggccctttgcgccattatccacagatatcggcccgacctaatagactttgactctctcgacgagcagaatgtggagaaaaataatcaactggccttcgacatcgccgagaaagaactcggtatcagtcctatcatgacgggaaaggaaatggcttccgttggagaaccagacaagctctccatggtgatgtacctgacacagttttatgagatgtttaaagactccttgcccagttctgacactctagacctgaacgcggaagagaaagccgtgctcatcgcctccacacgctccccaatttcttttctgtcaaaacttggtcagacaatttcacgcaaacggagtcccaaggacaaaaaggaaaaggatttggacggcgccggaaaaagacgaaaaacatcccagagtgaagaagaggaggcaccccgcggtcataggggagagcggcccaccctcgtgtcaacgctcactgatcggagaatggacgtggctgtgggaaaccagaataaagtgaagtacatggctacgcagctactggccaagttcgaggaaaacgccccagctcaatcaatcggaatccgccggcagggctccatgaaaaaagaatttcctcagaatcttggcggatctgatacttgttacttttgtcagaaaagagtgtacgtgatggagagactgagcgcggagggcaaattcttccacagaagctgctttaaatgcgaatactgcgctacgactctgcgcctgtctgcttatgcctatgacatcgaggatggcaaattctactgtaaacctcactactgctaccggctctctgggtacgcccagaggaagcgtccagctgtggctcccctgagcggtaaggaggctaagggccctttgcaggatggtgcaaccacagatgctaatggccgggccaacgcagtggccagttctaccgaacggacacctggaagtggcgtgaacgggttagaagagccaagcattgccaagcgactgagaggaacaccggagcgaatcgaattggaaaactatcgactgagtctgagacaggccgaggcactacaggaagtgcctgaggagacccaggctgagcacaatctgtcttccgtgctcgacactggcgccgaagaggatgtagcctctaggtctgctaggcgtgccgctggtagacccccggccacacggccatag

SEQ ID NO: 124333 - DNA, 2901 bp, Artificial Sequence
  Description of Artificial Sequence: Synthetic coding sequence
atggaggagcgcaagcacgagactatgaaccccgctcacgttttgtttgacagatttgtacaagcaaccacatgtaagggtaccctgaaggccttccaggaactttgcgaccatttggagctgaagcctaaagattaccgtagcttctaccacaagctcaaatccaagctgaactattggaaagcaaaagccctgtgggccaagctggacaagagaggatcgcacaaagactacaagaaaggcaaagcctgtacaaacacaaaatgcctgatcatcggagctggcccttgcggtctgagaacagcgatagacttgtcgctgttaggcgcaaaggtcgtcgttattgaaaaaagggacgccttctcacggaataacgtcctccacctgtggcccttcaccatccacgatctgcgcgggctaggagcaaaaaagttttacgggaaattttgtgctggagcaattgaccacatatccatcaggcagctgcagcttatcctgcttaaagtggcactgattctgggcattgagatccatgtgaacgtcgagtttcagggactgatccaacctccagaagatcaagaaaacgaacgcatcggttggcgagccctggtccaccccaaaacacaccctgtttccgagtatgaatttgaagtgatcatcggaggagacggtaggcgcaacaccctagagggcttcagacgcaaagagttccgcgggaaacttgcgattgccatcactgcaaatttcatcaataggaatactacagccgaagctaaggtcgaggaaatttcgggagttgcattcatcttcaaccagaagttcttccaagagctgcgcgaagcaacggggatcgacttggagaacattgtgtattacaaagatgacacacattacttcgtgatgaccgccaaaaagcagtctcttctcgacaagggcgtcatcttgcatgattacgccgacaccgagctcctgctctcacgggaaaacgtagatcaggaggccctactcagttatgctcgggaggcagctgatttttcaactcaacaacagctgccatccttagatttcgcaatcaaccactatgggcagcctgacgtggctatgtttgacttcacttgtatgtacgcctccgaaaatgcggcactagtgcgggagcagaatggacatcagttactggtggctctggtgggcgatagcctgctcgaacctttttggcctatgggaaccgggattgcccgaggcttcctcgcagccatggactcagcctggatggtcagaagctggagtctgggcacgtctccgctagaggttctcgccgagagggagagcatctaccgcttactgcctcagaccaccccagaaaatgtgtctaaaaacttctcgcagtactccatcgatcccgttacgcggtatcctaacatcaacgtcaactttctaaggccatcacaggtgcgacatttatatgataccggcgagaccaaggatatccatttagaaatggagtctttagtgaatagccgcactacaccaaaactgacgagaaacgagagtgtcgcaaggtcctccaaactcctggggtggtgccagcgacaaaccgacgggtacgccggggttaacgtgaccgacctgacaatgagctggaagtccgggttggccctctgtgccatcatccacaggtatcggcccgatctcatagacttcgacagtctcgatgaacaaaatgtcgaaaagaataaccagctcgcgtttgacattgccgagaaagagcttggaatctctccaatcatgacgggaaaggagatggctagtgttggcgaacctgacaaactgagtatggtcatgtacctgacccagttctatgagatgtttaaggactccctaccaagcagcgatacactggacttgaatgctgaggagaaggccgtgctgatagcgtctaccaggtcacccatctcatttctgtctaaactcggccagactattagtcgcaaacgctccccgaaggataagaaagagaaggacttagatggggccggcaaaagacgcaaaacctctcagagcgaagaggaagaagcaccacgcggacataggggcgagcggcccacactggtaagcaccctaaccgatcgacgcatggatgttgcagttggcaaccagaataaagttaagtatatggccacccagctgctggcaaaattcgaagagaacgcccccgcacagtcaatcggaatcaggagacaaggcagcatgaaaaaagaattcccacagaacctggggggtagcgacacatgttatttctgccagaaaagggtttatgtaatggaacggttaagtgccgaaggcaagttttttcaccgctcctgtttcaagtgtgagtactgcgccactacactcagactgtccgcctatgcctacgatattgaggacggtaagttttactgtaaaccacactattgttatagactaagcggctacgcccagaggaagagaccagcggtggctccactatcgggtaaggaagccaagggccctctgcaggacggtgccaccaccgacgccaatgggagagctaatgcagttgcctcgagcacagagcgcacgccagggtctggagttaacgggctcgaagaaccatctatagccaagaggctaagaggcactcctgaaaggatagagcttgaaaactaccgcctttctctcagacaagcagaggccctgcaggaggtgcctgaggagacgcaagccgagcacaaccttagcagcgtcctggatactggggcagaggaagacgtggcctcacgagattgggtgtcgccctggctccctaggatggttagcaactcttgggcccaaatgattcaccccccacagccaccaacagtgctgggaagccagatgtag

SEQ ID NO: 124334 - DNA, 4713 bp, Artificial Sequence
  Description of Artificial Sequence: Synthetic coding sequence
atgtctgactccctgtggacggccctgtccaactttagcatgcctagcttcccgggaggctccatgtttcggaggacaaaatcttgccgtacctccaatcgaaaatcgttgatcttgacatctacgtcaccaactctgcctaggccgcacagtcccttgccgggccacctgggctcaagcccgctagacagtcctagaaacttctctccaaatacacccgcacatttcagcttcgcgtcttcaagacgtgcagatggacgacgatggtccctggccagcctaccatccagcggttacggaactaacacgccttcaagcactgtctcgagctcttgctcttcccaagagaggctgcaccagctcccttaccaacctaccgtggacgaactgcacttcctgagcaaacacttcggctctactgagtccatcaccgatgaagatggaggccgaaggtcacctgccgtgcgtcccaggagcagaagcctgtcccctggaagatccccatccagctacgacaacgagatcgtgatgatgaatcacgtgtacaaggaaagatttcccaaggccacggcccagatggaggaaaaacttagagatttcactcgtgcatatgagcccgactctgtcttgccactggccgatggagtcctaagtttcattcatcaccagataattgagttggcccgggattgtctaactaaaagcagagatggcttgatcaccaccgtttacttctatgagcttcaggagaacctggagaaactattgcaggacgcgtatgagaggagtgagtctctagaagtcgccttcgtgactcagttagtgaaaaagttactcatcatcatttcaagaccagctcgcctgttagaatgcctcgaattcaatcctgaagagttctaccaccttctggaggccgccgaaggccacgctaaggaaggacacctggttaagacggacattccacggtatatcattaggcagctcgggttaactcgcgacccttttccagatgttgttcacctggaggagcaggattcaggtggctccaatactcctgagcaggatgacctgagtgagggaagatcttcaaaggccaagaagccccccggagagaatgactttgacaccattaaattgattagcaacggcgcatatggcgcagtctacttggtgagacacagagataccaggcaacgctttgcaatgaagaagatcaacaaacagaacttaatcttacgtaaccagattcagcaagcctttgtggagagagacattctaaccttcgcagagaacccctttgtggtaggaatgttctgtagctttgaaacaagacgccacttgtgtatggttatggaatatgtggaaggtggagattgcgctaccctgctgaaaaacattggcgcactgccagtggagatggcgcggatgtattttgcggaaaccgtgcttgccctagagtatttgcataattacgggatcgtccacagagacctcaagccagacaaccttcttatcactagcatgggacacatcaaactgactgattttggcctcagcaagatgggactcatgagcctcacaacaaacctgtacgaaggtcacatcgagaaggacgcacgggaatttctcgataagcaggtttgcggcacccctgagtatatcgctcctgaggtgatactccgccagggttatggaaagcccgtggattggtgggctatgggcattatactgtacgagttcctggtgggatgcgtgcccttctttggcgatacccctgaggaactctttggccaggtgatcagtgatgacatcctttggcccgaaggcgacgaggccctccccaccgaagcacagcttctcattagctccctgcttcagaccaaccctctcgtgaggctcggtgcgggcggcgcctttgaggtgaagcaacatagtttctttagggacctggactggactgggcttcttcgccagaaggctgaattcattccacatctggagtcagaagatgatacctcttacttcgatacacgttctgaccggtaccatcatgtcaatagctatgacgaagatgatactaccgaggaggagccagttgaaatccggcagtttagcagctgttccccacggttttctaaagtttactcctctatggagcaactgtcgcagcatgaacccaagacaccggtggctgctgctggttcctccaagcgagagccgtcaactaagggccctgaagagaaagtcgcaggaaaacgcgagggactgggcggcttgaccctgcgggaaaagacatggagaggcggctctcctgaaatcaagagattcagcgcaagcgaggccagctttctcgagggcgaagcctcccccccattgggtgcccgtagacggtttagtgcgcttctcgagccttcaaggtttagtgccccccaggaagatgaagatgaggcccggttgagaagacctcccagaccgtcatccgatccagccggctcattagacgcaagagccccaaaggaagaaacacaaggcgagggcacctctagcgcaggcgattctgaggcaaccgaccgccctcgtcccggggatctgtgtcccccatcaaaagatggcgacgcaagcggccccagggccacgaacgatttggtcctgcggcgtgctcgccaccagcaaatgtccggagacgttgccgtagagaagcgaccttcgcgcactggtggcaaggtgataaaatctgcatccgccactgcgctctccgtcatgatcccagcagtggacccacacggttcgtcccccctggccagccccatgagtcctcggagcctgagctcgaacccatccagtagggactccagcccttctagggattacagccctgcagtgagtggcctgaggtcccccataaccatccagaggagtggaaagaaatacggatttaccctccgggcaatcagagtgtacatgggcgatactgacgtatattctgtgcaccacatcgtctggcatgtggaggaagggggcccagcccaggaagctgggctctgcgcgggcgacctaattactcacgtgaacggcgaacctgtacatgggatggtccacccagaggtcgtcgaattgattctgaagagtgggaataaggttgccgtgacgactaccccatttgagaatacttcaatacgtatagggcccgcacgtagaagcagctacaaggctaagatggcgcgtaggaacaagagaccatcagcaaaggaaggacaggaaagcaagaaacgtagcagtctgtttcgaaagataacaaaacaatctaacctattacatacaagtagaagcctgtcgagtttaaaccgcagtttgtcctcttctgattcactgccgggatcgcccacacacggcctccctgctcgatcacccacacacagttatcgctccactccagactccgcctacctgggcgctagctcacaatcctctagtcctgctagcagtacccccaactcaccagccagtagtgcctcccatcacattcggccttctaccctccacggactgtcacctaaactgcaccgccagtatcggtctgcacgatgtaagtctgccgggaatatccccctcagccccctcgcgcacactcccagcccgacccaggcctctccgcccccactccccggccataccgtcggtagcagtcacacaacacagagtttccccgctaagctccacagttcgccaccagtggttcgaccccggcctaagtccgcagaaccacccaggtctccattgctgaagagagtgcagtccgctgagaaactgggagcatccctttctgccgacaagaagggagcactgcggaaacattctctcgaagtcgggcatcctgatttcagaaaagattttcatggcgagctggccctgcattctctggcagagagtgatggcgagaccccacctgttgaggggcttggtgctccgagacaagtggctgtgcgccgcttagggagacaggagtcaccactctccttgggggcggatccattgcttcccgaaggcgcatcccgacctccagtttccagcaaggagaaggaaagccctgggggggctgaggcatgcactcctccgcgcgccacgacccccggtgggcgaacgctggagagggatgtgggatgtactcgacaccaatccgtccaaactgaagatggtaccggggggatggcaagggcagtcgcgaaggccgccttgtcccccgtgcaagaacacgaaacaggtcggaggtcaagctccggggaagcaggcactcccctggtccctatcgtcgtggaacctgctcggccgggcgctaaagccgtggtcccccagccattaggcgcagactcgaagggacttcaggagcctgcgccgctggccccctcggtgcccgaggcccccagaggaagggagcggtgggttttggaggtggtggaggaaaggaccaccttgtccggcccaagaagcaagccagcctcaccaaagttgagccctgaaccccagacgccaagcttggctccagcgaaatgctccgcgccatcgtccgctgtcacaccggtgccccccgctagccttctcggtagcggaactaagccacaggtggggctgacatccagatgcccagccgaagccgtgccccctgcaggactgacaaagaaaggcgtgtcctctccggctccgcccggaccttag

SEQ ID NO: 124335 - DNA, 2178 bp, Artificial Sequence
  Description of Artificial Sequence: Synthetic coding sequence
atgtcggattccctctggaccgcattatcaaacttttccatgcccagtttccccggggggtccatgttcaggcgaactaagagttgtcggaccagtaaccggaaatcattaattctcaccagcacttcccctacactgcctagaccacactcacccctcccgggccacctggggtctagtcccctggatagcccaaggaatttctccccaaataccccagcccatttcagcttcgcctctagcaggcgtgcagatggaaggagatggtccttagccagccttccttcatcaggatacgggactaatacaccatcctcgactgtctcatcaagttgttcatctcaggagcgcctgcaccagttgccctatcagcctactgtcgacgagctacacttcctgtccaaacacttcggatctaccgagtccatcactgatgaggatggcggccgtcgatcccctgccgtgcggcctcgttcccgttcactgtctcctggacgctctccaagcagttacgataacgagattgtcatgatgaatcacgtgtacaaagaacggttccctaaagccacggcacagatggaggagaaattgcgggacttcactcgggcctacgaaccagatagcgttctgcctctggcagatggagttttaagtttcattcaccaccaaattatcgagcttgcacgagattgcttaaccaagtcaagggatggcctaattaccaccgtgtatttttatgagctgcaggagaacctcgagaagttgctgcaggatgcatatgagaggagcgagagcctggaggtagcattcgtgactcaactcgtgaagaaactactgattatcatttcacggcccgctcgccttctggagtgcctcgaattcaaccccgaggagttctatcatttgcttgaagctgcggaagggcacgcaaaggagggtcatcttgttaagacggacattcccagatacatcatcaggcagctagggcttacgagagacccattccccgatgtcgtgcatctcgaggaacaggactcaggcggatcaaacacccccgaacaggatgatcttagcgaggggagaagctccaaggccaagaagcctccaggtgaaaacgattttgacactatcaagctaatttctaatggcgcctacggtgcagtctacctagttcgccatagggataccagacagaggttcgctatgaagaaaatcaataaacagaacttgatcttgaggaatcagatccagcaggcgttcgtcgaacgtgatattctaacgtttgctgagaatcctttcgtagtgggaatgttttgttctttcgagaccaggcgacatctttgcatggtcatggaatatgttgagggcggcgattgcgcaactttgttgaagaatatcggagccctcccagttgagatggccaggatgtatttcgcagaaacagtacttgcactggaatatctgcataattacggtatcgtccatagggacctcaaaccagataacctgctgatcacgtcaatgggacacattaagctaactgactttggcctatcaaagatgggactgatgagtttgacaaccaatctttatgaaggacacatcgagaaagacgctcgcgagttcctggataaacaggtctgcggaactcctgaatacattgctcctgaagtgatactccggcaggggtatggtaaacctgtggactggtgggccatgggaataatcctgtacgagtttctggttggctgcgtgccttttttcggggacactccggaggagttatttggccaggttatatccgacgatatcttatggccagaaggagatgaagctttgcccaccgaagctcagctgttaatttcctccctgttgcagaccaatcctttggtgcgcctcggcgccggcggcgcctttgaggtgaagcagcacagttttttcagagacctggattggactgggctactgagacagaaggcagagttcatcccgcacctggagtccgaagacgacaccagctattttgataccaggagtgacaggtaccatcatgtgaattcctatgatgaggacgacaccaccgaagaggaacctgttgaaatccgccaattcagcagctgttctccacgttttagtaaggtttattccctccggatccatatgtatacttataagtag

SEQ ID NO: 124336 - DNA, 5397 bp, Artificial Sequence
  Description of Artificial Sequence: Synthetic coding sequence
atgaaacgcagccggtgccgagatagaccacaaccccccccaccagataggcgcgaagatggcgtgcagcgcgctgctgagctgagtcagagtctgccaccgcgccgacgggcccctcctgggaggcagcgcctagaggaacgcaccggccccgccgggccagaaggaaaagaacaggacgtcgtgactggggtgtctccgttgctgtttaggaagctgtccaaccctgatatcttctctagcacgggtaaggtgaaactgcagcgtcagttatctcaagatgattgtaagttgtggcgcggtaacctggcatctagcttgtcagggaaacagttgttgccactgtcatcctccgttcacagtagcgtgggccaggtgacgtggcagagctccggcgaggcctcaaatctggttcggatgcgaaaccagtctcttgggcagtctgccccctcccttaccgctggactgaaagagttgtccctgccacggcggggtagcttctgcaggacttccaatcgaaagtccctaattgtaacatcaagtactagccccaccctgccccgaccccactccccactgcacggtcatacggggaactcacctctggatagtccccgtaatttctctcccaatgcccctgcccacttttcctttgttccagcacgccgaaccgatggacggcgatggtcgctcgcctctttgcccagctcgggttacggaacaaatacccccagctccactgtctcatcttcttgttccagccaggagaagctccatcagttaccctttcagccaaccgccgacgagctgcactttctaactaaacacttttctactgagtcggttcctgacgaggagggacggcaatccccagccatgcgacctaggtccaggagcctgtcacccggccgctcacctgtgagcttcgactcagaaattataatgatgaatcatgtctataaggagcgattcccgaaggccacagctcagatggaggaacgtcttgctgaatttataagctccaacaccccggattccgtactgccccttgcagacggagccctgtcgttcattcatcatcaggtgattgagatggcgcgggactgcttggacaagtccaggtcgggattgatcactagccagtacttttacgaattacaagacaatctggagaaactgctgcaggacgcccacgagagatcagaatcaagtgaagttgcttttgtcatgcaacttgtcaaaaaactaatgattataattgccagaccagctagactgctggagtgccttgagttcgacccggaagagttttatcacttattggaagccgccgaaggccacgccaaggaaggtcagggaattaaatgcgatatcccccgatatatcgtgtctcagctggggcttactagagacccgttggaggaaatggctcagctttcttcctgcgactcccctgataccccagagaccgacgactcaatcgagggacacggcgcaagtctgcccagtaagaagacccctagcgaggaggacttcgagaccatcaagttaataagcaacggcgcctacggagccgtcttcctagtgcgccacaagagcacacgacagagatttgccatgaagaaaattaataagcagaacctgatcctgaggaatcaaatccagcaagcctttgttgaacgtgacatcctcacatttgcagagaatccttttgtggtgagcatgttctgtagctttgacacgaaacgccatctatgcatggtgatggagtacgtggaagggggagactgcgcaacattgctgaaaaacattggggcactgcctgtagatatggtgagactttactttgccgagacagtcctggcgcttgaatatttgcacaactatggcattgtccatcgggacctgaaaccagacaacctcctgataacaagtatgggtcacatcaaactgaccgattttgggctgagtaaaattggactcatgagtctcacgaccaatctttacgaaggccacattgagaaggacgcccgcgaatttctggataaacaagtctgtggaacgcccgagtatatcgcgccggaggtaatcttacgtcagggatacgggaagcccgtcgactggtgggccatgggcatcatattatatgagtttctggtgggatgtgttccattttttggggacacaccggaagagctttttggtcaggttatttcggatgagatcgtctggcctgagggtgatgaggctcttccccccgatgcgcaagatctaacctccaaactgcttcaccagaaccctctggaaaggctgggcactgggtctgcttacgaagttaaacagcacccatttttcactggcttggattggacgggtctgctgcgacagaaggccgagtttattcctcagctggagtctgaagacgataccagctacttcgatactcgatcagaacggtatcatcatatggatagtgaggatgaagaggaagtgagcgaggatggatgcctggagatccggcagttcagctcctgttcgccacgatttaacaaggtgtacagtagcatggaacgcctgagccttttagaggagcgccgcacacccccaccaacgaagcggagcctgagcgaggaaaaggaagaccattcagatggtctcgctggtctgaagggcagggacaggagttgggttattgggagcccagagattctgagaaagcgcctaagcgtttccgagagcagccacactgagagcgactcctcccctccgatgactgtaagacgcagatgtagtgggctgttggatgccccccgttttcccgaaggccccgaggaggcgagtagcactctgcgaagacaacctcaagaggggatttgggtgttaactccaccaagtggtgagggagtctccggtccagtcacggagcactccggggaacaaaggccaaaattggatgaagaagctgtggggcgttctagtgggtcctctcctgctatggaaacacgcggacggggtacaagtcagctcgccgagggcgcaactgccaaggcaataagcgatctggcagttaggcgggcccgccataggctcttatcaggagactccaccgagaaaaggacagctcgtccagtgaataaggtgattaagagcgcaagcgccacggcacttagtcttctcattccatcagaacaccatacttgctcccctttggcaagtcccatgagtccacactcccaaagcagcaacccctcctctcgggatagtagcccttccagggactttctacccgccttgggctcaatgcggccgcccatcattatacacagggcagggaagaaatatgggttcacgctcagggctatcagagtatatatgggagacagcgacgtgtacactgtgcaccatatggtgtggcacgtcgaggacggcgggcctgcttccgaggccggattgcgacagggcgatctgatcacccacgtgaatggagaaccggtgcatggactggtccatacggaagtcgtagagctgatcttaaagtctggcaacaaggtggctatctcaaccacccctttggagaatacatcgataaaagtcggcccagcaaggaagggcagctacaaggccaagatggctaggcgcagcaagcgaagcagagggaaggacggacaagagagccgcaaaaggagcagcctatttaggaagatcacgaagcaggccagcctcctccacacctcaaggtcattgtccagtttgaataggagcctctcaagtggtgagtcaggccctggatctccaacccactcacacagcttaagcccacggtccccaactcaagggtaccgggtcaccccagatgccgttcacagcgtgggcggcaattccagccagagctctagccctagcagttccgttccaagtagtcccgccggctccggccatacacggccatccagcctccacggtttagctcctaagcttcagaggcagtacaggtctcctcgtcggaaatctgctggtagcatacccttgtccccactggcccacacaccatcaccacctccccccacggcctccccccaacggagcccttcccctctgagtggtcatgtcgctcaggcctttcctacaaaactgcatttatcaccacccctgggacgccaactaagccggcctaaaagcgctgagccaccccggagccccctattgaaacgcgttcagagcgctgagaagctcgctgccgccctggccgcatctgaaaagaagctcgctactagccgcaaacatagcctcgatctgccccacagcgagcttaagaaggaactgcctccaagggaggtttccccattggaggtggtcggcgccaggtcagtcttatccggaaaaggtgccctgcctggaaagggtgttttacagcctgccccaagccgagccctgggcacgcttcggcaagaccgagcagagagaagggagagtttacagaaacaggaggccatccgggaggtggatagctctgaagacgatacggaggagggcccagagaattcccagggtgcccaggagctcagtctggcaccacacccagaggtttctcagagcgtggctccaaagggggcgggtgagagcggtgaggaagacccgttcccatctagagatcctcggtcgctgggccccatggttcccagtctccttaccggtatcacactcggcccgccacggatggaaagccccagcggtccacacaggcgattaggcagcccccaagcgatcgaagaggccgcctcatcttcaagcgcgggaccgaatctggggcagagcggggccactgaccccattccacctgaaggatgttggaaagcacagcacctccacacacaggcgctgacagcattgtctccttcaacgtctggtctcacacccacatcatcgtgctctcccccttcatccacctctggcaaactgagcatgtggtcttggaaaagcctgattgaaggccctgaccgggccagcccttcaagaaaagcgaccatggctggcggattggcaaatttgcaggaccttgaaaacaccaccccagcgcagcccaaaaatctgtcaccaagagagcagggcaagacacaacctccgagtgcgccgcggttggcccacccgtcatatgaggacccctcgcagggatggctgtgggaaagcgaatgtgctcaggccgttaaagaggatcccgcattatcaattacccaggttccagatgccagcggagacaggaggcaggatgttccctgccgggggtgccccttaacacagaaatcagagccttccctccgacgaggtcaggaaccaggcggacatcaaaaacaccgtgacctagccctggtgcccgatgaactcctcaaacagacttag

SEQ ID NO: 124337 - DNA, 2379 bp, Artificial Sequence
  Description of Artificial Sequence: Synthetic coding sequence
atgttttcccctacatcagctcccgcattgtttcttacaaaggtacccttttccgcagattgcgctctggcaactagcccacttgctatcttcctcaacccccgagcccatagttccccgggaaccccatgttcctcaagacctcttccttggtcatgtcgaacgtctaatcgaaaatcgctcatagtgacatctagcaccagcccaaccttgccaaggccgcactctcctctacatggtcataccggcaatagccctctggacagtcccagaaacttcagcccgaatgcccccgcacactttagcttcgtgcccgctcgacgtacggatgggcgacggtggtcactcgcatccttgccttccagcggttatggcaccaatacaccatcatcaaccgtgagttctagttgttcttctcaggagaaattgcatcagctgcccttccagcctacagcggacgagttgcattttctgacaaagcacttttctacagagtctgtcccagacgaggaaggccggcagagtccagccatgcgaccaagatcacggtcactctctccagggaggtccccagtctccttcgattccgagatcataatgatgaatcacgtttacaaggaaagatttcctaaggcgaccgcccagatggaggagagactggccgagtttatttcctcaaatacaccggatagcgtcctccccctcgccgacggggctctttcattcattcatcaccaggtcatcgagatggctagggactgcctagacaagtcaagatcaggtctcattacctcacaatacttctatgagctgcaggacaatctggaaaagctgttgcaagacgcccacgagcggtcagagtcaagtgaagtagccttcgtgatgcagctggtgaagaagttgatgattataatcgcaaggcctgcccggttgcttgaatgtctagagttcgaccctgaggagttttatcacttactcgaggccgctgagggtcacgcaaaagagggccagggcatcaaatgcgacatcccccgatacattgtcagtcagctcggcttaactcgcgaccccctagaagaaatggctcagctcagctcctgcgatagcccagacactccagaaacagatgactcaatcgaagggcacggagcctctttacccagtaaaaaaacaccgtcagaagaggacttcgagacaattaagctgatctcaaatggggcctatggagccgtgttcttggttagacacaaatctaccaggcaaaggttcgctatgaagaagattaacaaacagaaccttatcttacgcaatcaaatacagcaggcatttgtggagagagatatcttaacatttgcagaaaatccattcgttgtttcaatgttctgcagcttcgatacgaaacggcacctgtgtatggtgatggaatacgttgagggtggggactgcgccactttactcaagaatattggagccctgcctgttgacatggtgcggctttacttcgccgaaactgtcttggccctggaatacttacataactacgggatcgtacacagagacctcaagccagataatctcctgattacttctatgggccatatcaaattaaccgatttcgggctgtctaaaatcggtcttatgagtttgacaacaaatttgtacgagggccatatagagaaggatgccagggaattcttggataaacaggtgtgtggcacacccgagtacattgcaccagaagtcatcctaaggcagggatacggtaaacctgtggactggtgggctatgggaatcatactgtacgagtttctggtgggctgcgttcccttttttggagatacaccagaggagttgttcggccaggtcatcagcgatgagatagtctggcccgaaggcgatgaggcactgccccccgatgcgcaggacttgactagcaaactgttgcatcagaatcctcttgaaagactgggtacaggctctgcatacgaggtgaaacagcatcccttttttacgggactggactggaccggactgttgcgccagaaggctgaatttattcctcagttggaaagcgaagacgacaccagttatttcgacacaaggtccgagcgctaccatcatatggacagtgaggatgaggaggaggtttcagaggatggatgcttggagatccgtcaatttagctcttgcagtccaagatttaacaaggtttactcatcaatggaacgcctctcactactcgaggagcggaggactcctccacccacgaagagatctctgtcagaggaaaaagaggaccattctgacggcttggccggcttgaaaggaagggaccggtcctgggtgattggaagtcccgaacatcacccctcagcctag

SEQ ID NO: 124338 - DNA, 4827 bp, Artificial Sequence
  Description of Artificial Sequence: Synthetic coding sequence
atgaaacggtcacggtgcagggatcggccacagcccccaccccctgataggagggaagatggcgttcagcgcgccgcagagttgtctcagagtctccccccacggagaagggcccctcctgggcgccagcgccttgaggagcgaacaggaccagcaggtccagaaggcaaggaacaggatgtggtaacaggcgtgagtccactgttattccgaaaattgtctaatccggacatcttttcctccaccgggaaagtgaaactgcagcgccaactcagtcaggacgattgcaaattgtggagagggaatctggcatcatcattgagtggtaagcagctgctgccattgtcatctagtgtgcattcctccgtgggccaggtaacatggcagagctctggggaggcaagcaatttggtcagaatgaggaaccagtccctgggacagtctgcgccatctctcacagcggggctgaaggaattgtcgctacctaggcgtggcagcttctgtcggacaagtaaccgaaaaagtcttatcgtgacatctagtaccagtcctaccctgcctcggccacacagtcctctgcacggccacaccggcaacagccctctggacagtccccggaacttctctccaaatgccccagcccacttctcattcgtgcccgctaggcggactgacggtcgccggtggtcactggcttcccttccttcctctggatacggtaccaacaccccctcgtccactgtttcttcctcttgctccagtcaggaaaagctgcatcagcttccattccagcctactgccgatgagctccacttcctgaccaagcacttctcaaccgagagcgttccagacgaagaaggacggcaatcccctgcaatgcgacccaggtctagatcactctcaccaggccggtccccagtatccttcgacagtgaaatcatcatgatgaaccatgtgtataaggagcgattccccaaagcccacgaacgcagtgaatcaagcgaggtggcatttgtgatgcagctggtcaagaaactcatgatcattattgcgaggccagcccggttactggaatgcctggagttcgaccctgaggagttctatcatcttctggaagcagcggagggacatgcaaaagaagggcaagggatcaaatgtgatatcccacggtatattgtgtctcagctcggactcacgcgcgacccgctggaagaaatggctcaacttagttcctgcgactcacctgacacccccgagacagatgatagtatcgagggccatggcgcgagccttccctcaaagaagacaccatccgaagaggactttgaaacaatcaagctcatatctaatggcgcctacggggcagtttttcttgtgcggcacaagagtacaagacagcggtttgctatgaagaagattaataagcagaatttaattctgaggaatcagatccagcaggcctttgtcgagcgagatattcttacctttgctgagaaccccttcgtggtgtccatgttttgttcctttgataccaaaagacacctgtgtatggtaatggagtacgtggaggggggtgactgcgcaaccctgttgaagaatatcggtgcattacccgtcgacatggtgcggttgtacttcgcagaaaccgtccttgcattggagtacttgcataattatggcatagtgcatcgcgacttaaaacctgataacctactaattaccagcatgggccacatcaagctgaccgactttggcctctcaaagattgggttaatgagtctgaccacgaatctgtatgaaggacatattgagaaagatgcacgggaatttctggataaacaagtgtgcgggactccagagtacatcgctcctgaagtcattctgaggcagggttacgggaagcctgttgattggtgggccatggggatcatcttgtacgagtttctcgtggggtgtgtgccattctttggggacacacccgaagagctcttcggtcaagtcatctcagacgaaatcgtgtggccagagggagacgaggctctgcccccagacgcccaggatctgacctcgaagctcctccaccagaacccactggagcggcttgggaccggcagcgcctatgaggtaaaacagcacccctttttcactggcttagattggacaggccttctgaggcagaaagctgaatttatccctcagttagaaagtgaggacgacacatcttatttcgacaccaggtccgaacgctatcatcacatggatagtgaagatgaagaagaagtctctgaggacgggtgcttagagatccggcagttctcaagctgctcccctaggttcaataaagtatactctagtatggaacgtctgtcactcctggaagagaggagaactccacctcccaccaaacgatctctgtccgaggaaaaggaagaccattcagatggactggctggtcttaaagggagggaccgaagctgggtcattggttctcccgaaatcctgaggaaacgtctgtccgtttctgagtcatcacacacagagtctgactctagccccccaatgacagtgaggcggcggtgctcggggctgctcgatgctcccagatttccggagggcccagaggaggccagcagtaccctgaggagacaacctcaagaaggcatatgggtattaacaccacctagtggggaaggggtgagcggtcctgtgaccgagcacagtggtgagcagagaccaaagctggacgaagaggccgtagggcggtcttccggctcctctcccgctatggagacacggggaagggggacatctcagctagccgaaggagctacagctaaggccatctcagatcttgctgtgaggcgcgcgcggcaccgcctcctttcaggagactccactgagaagcgcaccgcccgcccagtgaacaaggtaataaagagtgcatccgctactgccctgagcctgttgatccccagcgaacaccacacgtgtagccccctggcttctcctatgagtccacacagccagtcttcgaacccatctagccgtgattcctccccttatggattcactctcagagcaattcgcgtgtatatgggggactctgatgtgtacacagtacaccatatggtatggcatgtagaggacggtggtcctgcttcagaagctggcttgcgtcaaggcgacttaattactcacgtgaacggggagcccgttcatggacttgtgcataccgaggtcgtcgagctaatcctgaagtccggaaataaagtggccataagtacaacaccactcgagaatacctctatcaaggtgggccccgccaggaaaggatcttataaggcaaagatggcaaggcgcagcaaacggagcagaggaaaagatggtcaagaatctcgcaagcggagctccctctttcgtaaaattaccaagcaagcgtctctcctgcatacgagcaggtcactctccagtctcaacagatcactgagctctggtgagagcgggcctggcagccctacccacagtcacagtctttcgccacgatctcccacccagggatatcgggttacccctgatgccgtgcactcggagctgagtagacccaagtcagcagaacctcctagaagccccttgttaaaaagggtccagagtgccgagaaattggccgccgcgctggctgcctctgagaaaaagttggccacgtcacgcaagcactctctggacctgcctcattcggaactgaagaaggagctccctccccgggaggtcagtccgctcgaagtagtgggagcaagatccgtgctctctggaaagggagccctgccaggcaagggcgttctgcagcccgctccaagtagagcacttggcacattgcgacaagaccgtgctgagaggcgagagagccttcagaaacaagaagccattagagaggtcgactcttccgaggacgacacagaggaaggtcccgagaattcccaaggcgcccaggagctgtccctggctccacatcctgaagtgagtcagagtgtggcacccaagggcgcaggcgagtccggggaggaagacccattcccgagtagggatcctagatccttaggccctatggttccgtctctgcttaccgggattacgctaggcccacctcggatggaaagtcccagtggcccacaccgccgactggggagtccacaggccattgaggaggcagctagctcttcttccgccggacccaacctaggacaatccggggccacagaccctattccccctgagggatgttggaaggcacagcacctacacacgcaggcgctcactgccctgtccccttctacatctggactcacgcctacatccagctgtagccctcctagcagcacctctggcaaattgtctatgtggagttggaagtccttgattgaaggcccagatcgggcaagccccagtaggaaggcaactatggcgggggggctcgcaaacttgcaagacttagagaacactacccctgctcagccgaagaacttgtcccctcgggaacagggcaaaacccaacctccaagcgccccacgactggcccacccaagttacgaagatccgtcccaggggtggctgtgggagagtgagtgtgcccaggccgtgaaagaggaccccgcactcagtatcacccaagtgcccgacgcatcgggggaccgccggcaggacgtgccgtgtagaggttgtccactgactcagaaaagcgagccctctctgagaagaggccaagagccagggggccatcaaaaacatagggatctggcactggtacctgacgagctgcttaaacagacttag

SEQ ID NO: 124339 - DNA, 1893 bp, Artificial Sequence
  Description of Artificial Sequence: Synthetic coding sequence
atgagacccagatcacgtagtttgtcaccaggacggagtcccgtaagttttgatagcgaaatcatcatgatgaatcacgtgtataaagaaaggttcccgaaggctacagcccagatggaagaaagattggctgagttcatatccagtaatacccccgactctgtcctgcctctggccgatggcgccttgtcatttattcaccatcaagttatcgaaatggctcgggactgtctggataagagccgatcgggcctgatcacatctcagtacttttacgagcttcaggataacctggagaagctccttcaagatgaattcgatccggaggagttttaccatctcctggaggcagccgaagggcacgccaaggagggacagggcattaaatgtgacatcccgaggtatattgtgtcccaactcggcctgacacgagatcccctcgaagagatggcgcagctgtctagctgtgactccccggatactccagaaactgatgactcaattgaaggacatggtgctagtctgccttctaaaaaaaccccttccgaagaggacttcgaaaccatcaagttgatctctaacggagcctatggcgccgttttcctcgtgaggcataagagcactaggcaacgctttgccatgaaaaagatcaacaagcagaatctcatcctgcgaaatcagatacagcaggctttcgtggagcgggatattctcactttcgccgagaaccccttcgtcgtcagcatgttctgttcattcgacaccaaaagacatctgtgtatggtgatggagtacgtggaaggtggcgattgtgctactctcctgaaaaacatcggcgctctgcccgtcgacatggtgagactctacttcgcagaaaccgtgctagccctggagtatctgcacaattatggtattgtgcacagggacttaaagccagataacctcttgatcacaagcatgggccacatcaagctaacagacttcgggctctctaagatcggtctcatgagcctcactacaaatctgtacgaaggccacatcgaaaaggacgcccgcgaatttttggataagcaggtgtgcggcacaccagagtatatcgcacctgaggttattctgcgccagggctacggaaaacctgtggactggtgggccatgggcattatattgtatgagttcttggtcgggtgcgtaccattcttcggagacactcctgaggaactgttcggccaggtgatcagtgatgagattgtgtggcctgaaggtgatgaagctctaccccctgacgcccaagaccttacatcaaagctgttgcaccagaatccacttgagcgactgggcacgggatcagcctatgaggtcaaacagcatccgttcttcacgggtctagactggactggcctacttaggcagaaggcagaattcattccccagcttgaaagcgaagatgacacatcttactttgatactcgctccgagcgctaccaccatatggacagcgaggatgaggaagaagtttcggaggacgggtgcctcgagatccgtcagttcagcagctgctctccacggtttaataaggtctattccagcatggaaaggctgagtttgctagaagagcgaagaacaccgccccccaccaagagatctttatctgaggagaaagaagaccatagtgacggccttgcagggctgaagggccgtgatcgatcgtgggtcattgggagtccagaaatcctgcggaagagattatccgtatcagagtcaagcctcttgaaggtagcagggcggcccagcaccttcagtcagcatttcgggacacaccctcatcagcagctgctgagctctcagcttcatttgtgggaggctgagcatgtagtgttggaaataccgtactag

SEQ ID NO: 124340 - DNA, 1035 bp, Artificial Sequence
  Description of Artificial Sequence: Synthetic coding sequence
atggacgacagcagcatcctgcggcggaggggactccaaaaagaactgagcctcccacggcgcgggagcttttgccgcaccagtaaccgcaagagccttatcgtgacaagcagcaccagtcccacactacctagacctcattcccccctgcatggccacactggaaatagccccctggacagccctcggaatttctccccaaacgcgcccgcccacttcagttttgttccagcccgatcgcactcccatcgggctgatagaacagacggtaggcggtggtcactcgctagccttccttcttcaggatatgggacaaatactccgagttcgaccgtgtcgtcatcttgttctagtcaggagaagctgcaccagcttccatttcagcctacggcagacgaattacatttcctgactaagcacttcagcaccgagagcgtgccagacgaagagggtcgccagtcccccgccatgcgacccgcaccttcacgcgccctgggtacactgaggcaagatagagccgagcgtcgagaatcattgcagaagcaggaagccatacgagaggtggactcttcagaggatgacacagaagagggccctgaaaacagtcagggcgctcaggagctgtcactggcaccccacccagaggtctctcagtcagtggcacctaagggagctggggaaagtggggaggaagatccctttccatccagagatccccgaagtcttggccccatggtcccgtccttacttacgggtataacccttggtccacctcgcatggagtccccctctgggccccaccgccgactcgggtcaccgcaagctatcgaagaggctgctagttcttctagtgcagggccgaacctaggacagtctggcgccacggaccctataccgcccgaaggatgctggaaagcccagcatctccacacccaagcactgaccgctctgagcccgagcacctccggtttggcacacctgatgcggattccagccagggcgggttatggttctctcagcgtccacaagcaatag

SEQ ID NO: 124341 - DNA, 3930 bp, Artificial Sequence
  Description of Artificial Sequence: Synthetic coding sequence
atggacgaatcttccctcctgagacggagaggcttgcagaaggaactgagtctgccaagaagagggaggggttgccgatccggcaatagaaaaagcctagttgtgggaacaccgtctcctactctctcccgtcccctgagccctctgagtgttcctactgccgggtccagccccttagattcaccgaggaatttctctgccgcctccgcgctcaactttccatttgcccgccgggcggatggaagacgttggtccctagctagcctgccctcttctggttacggaaccaatactccaagcagcaccctgtctagcagtagcagctcccgggagagacttcaccagctgccatttcaaccaactccagacgaactgcacttcctgagcaaacattttcgttcctcagaaaacgtgcttgatgaagagggcgggcggtctcctcgactacggcctcgatccaggtccctgagtcctggccgggccacgggcacttttgataatgaaatcgtgatgatgaaccatgtgtacagagagcgattccccaaagctaccgctcaaatggaagggagactccaggagttcttgacagcatatgctcccggagccaggctggccttagcagacggcgtgctgggcttcatccatcaccagatcgtcgagctggcccgagattgccttgctaagagcggtgaaaatcttgtgactagtcggtatttcctggaaatgcaagagaagctagaaaggctgctccaggatgcacacgagcgcagcgatagtgaagaagtgtccttcatagtgcagctcgtaaggaaattgctgataatcatttctcggcctgcaaggctgctggaatgtctggagtttgaccctgaggaattctatcatcttctcgaagccgccgaggggcacgcccgggagggacaagggatcaaaaccgatctcccacagtatatcataggccagctggggttagccaaagaccctctggaggagatggttcccctttctcatctagaagaggagcagcccccagcccctgagtctcccgaaagcagagccctggtggggcagtcacggcggaaaccctgcgagtctgactttgagaccataaaactcatctccaacggggcttacggtgccgtctacctggtgcgccatagggacacgaggcaacgcttcgctatcaaaaagatcaataaacaaaacttaatcttacgtaatcaaattcagcaggtgtttgtcgagagagatattctcactttcgcagaaaatccattcgttgtctcaatgttctgctcattcgaaactaggcgccacctttgtatggtgatggagtatgtcgagggcggggactgcgctacgttactgaagaacatgggcccgctgcctgtggacatggctcgcctgtacttcgccgagactgtgctcgcactcgaatacttgcacaactacgggattgtgcaccgggatctcaaaccagataatctgcttataacttctcttggccatattaaactaacagatttcgggctgagcaagatcggcctgatgtccatggcaaccaacctttacgaggggcatatagagaaggacgctagagaattcatagacaaacaggtgtgcggcacccccgaatacatcgctcctgaggtgatcttcagacagggctacggcaagcccgtggactggtgggctatgggcgtcgtgttgtatgaattcttagtaggatgcgtcccattctttggtgacacacccgaggaactgtttggtcaggttgtgtccgacgaaattatgtggccagaaggtgacgaggcgcttcccgccgatgcccaggatctgatcactcgactccttaggcagagcccactggatagactgggaaccgggggaacccatgaagtgaagcagcaccccttttttcttgcactcgattgggccggactcttgaggcataaggcagagttcgtgccccagctcgaggccgaagacgatacatcttacttcgatacgagaagcgagcgttacaggcatcttgggagtgaagacgacgagactaacgatgaagagtcatccacggaaataccacagttcagctcctgttcccatcggttcagtaaagtttactcaagttcagagtttctggcagtgcaacccacaccaacgtttgcagaaagatctttcagtgaagaccgtgaggaggggtgggaaaggtccgaagtggattacgggcgaagactcagcgcggacattagactcaggtcgtggacaagtagtggaagctcctgtcaatcctcgagcagccagcccgagcgaggccctagcccctctcttctgaacaccatctcgctggacactatgcccaagttcgctttcagcagtgaagacgagggcgtaggacctgggcctgctggacccaagaggccagtttttatcttgggagaacccgatccaccccctgccgcgacccctgttatgcctaaaccaagtagtctgtccgccgatacagccgccctgtcacacgcacgcctccgctccaacagcatcggagcccggcactccaccccgcgccccctagacgccgggcgtggccgccggctcggggggccacgcgaccccgctcccgagaagtcacgagctagctcctccgggggctctggcggtgggtctggagggagggtaccgaagtccgcaagtgtgagcgctctctccctgattatcaccgctgatgacggttccgggggcccactcatgtcccctctgagtcctcggtccctgtcttctaatccatcctccagggattcctcacctagtcgcgacccatccccagtgtgtggcagcctgcgaccgccgatagtcattcacagcagtggtaagaagtacgggttcagtctgagggccattcgggtctatatgggcgactctgacgtgtatactgtccaccacgtcgtgtggtcagtggaggacggttccccggcccaggaggcaggtctcagagcgggagacctaatcacacatatcaacggcgagagtgttttgggattggtgcacatggatgtggtggaactgcttttgaagtctgggaataagatttctctgagaactacagccttagagaatacatcaattaaggtgggaccggcaagaaagaacgtggcgaaagggcggatggctcgccgctcgaaaaggtccaggcggcgtgaaactcaggatcgcagaaagagcctttttaaaaagatctccaagcagacctcagtacttcacacttccagaagctttagttcaggactgcatcattctttatctagcagcgagagcctccctggctcccccacacactctttaagtccttccccaacaactccttgtcgcagccctgctcccgatgtgcctgccgacacaactgcttcacctcccagcgcttcgccttccagctcttcgccagcctcccctgccgccgccggccatactaggccgagcagtctccacggactggctgccaagctggggccccccaggcccaagaccggcagaaggaaatctacttcttcaatcccaccctccccattggcgtgtccaccaatctcagcacctcccccccgtagcccgagccccctgcctgggcatccccccgccccagctcggtcccccagactgcgtcgagggcaatcggccgataagcttgggaccggtgagagactcgatggggaagcaggacgtagaactcggggaccagaggctgaactcgtcgtgatgcggagattgcacctgtccgaaagaagggattcctttaaaaaacaggaagcagtacaggaagtaagcttcgacgagccccaggaggaggctactggcctgcccacctccgtgccacagatcgccgtcgaaggggaagaggcagtgccagtggctctcggacctaccggtcgggattag

SEQ ID NO: 124342 - DNA, 2523 bp, Artificial Sequence
  Description of Artificial Sequence: Synthetic coding sequence
atggatccgacagccggttcaaaaaaggagcccggcggtggcgccgcaacagaggaaggtgtcaaccgcatcgccgtgcctaagcctccctccatcgaagagttctcaatcgttaaacccattagtagaggagccttcggcaaggtgtacctggggcagaaaggcggcaagctctatgctgtcaaggtcgttaagaaagccgatatgatcaataagaacatgacacaccaggtacaggccgaacgggatgcactcgcgctgtccaagagccctttcatagttcacctgtattactccctccagtccgctaataacgtttacttggtcatggagtatctcattggcggagatgtcaagtcccttctgcatatctatggctactttgacgaggagatggcagttaaatatatttccgaagtggctttggctctggactaccttcacagacacggaattattcacagagatctgaaaccagacaacatgcttatctccaacgagggtcacataaaactgacagactttggcctcagtaaggtgactctgaatcgcgacatcaatatgatggacatacttaccactcccagtatggccaaacctcgccaagattattcaagaacacccggccaagtgcttagcttaatttcttctctgggtttcaataccccaatagcagagaagaatcaggatcccgcgaacatcctgtcagcctgcctttctgaaacctctcagctttcccaggggctcgtgtgtcctatgtctgtggaccaaaaggacactacgccatacagctcaaagcttcttaaaagttgtctagaaactgtggccagcaaccccgggatgccagtgaaatgcctgacatctaatctcctgcaaagccgaaaaagactggctacatcatcagccagcagccagtctcacactttcatttcttccgtggaatcagagtgtcactccagcccgaaatgggagaaggactgccaggagtcggacgaggcacttggccccacaatgatgtcatggaacgcagtcgagaagctgtgtgctaaaagcgccaacgcaatcgaaacaaaggggttcaataaaaaggacttagaattggccctttcacccattcacaatagttccgcactaccgaccacggggcgttcttgtgtgaacctcgcaaaaaagtgtttttctggagaggtatcgtgggaggctgtcgagctggatgtcaacaatatcaacatggacacggacacctcccagctggggttccaccagtccaaccaatgggcagtggacagcgggggaatcagcgaggagcacctcggtaagcgatcacttaaaagaaactttgaacttgtggactcatcaccgtgcaagaaaattatacagaacaagaagacgtgtgttgaatacaagcacaacgaaatgactaactgttataccaaccaaaacactgggctgacggtggaggtccaagatctgaagctttcagttcataagtcccagcagaacgactgcgcaaacaaggaaaacatcgtgaactcctttaccgacaagcagcagacccctgagaagctccccatccccatgatagctaaaaacctcatgtgtgaactcgatgaagattgtgaaaagaacagtaagcgcgattatctgtcgagcagtttcctctgttcagacgatgatcgcgcgagtaaaaacatcagtatgaatagtgactccagctttccgggcatttccatcatggagagtccactcgagagccagcctctagatagcgacagaagcatcaaggagtcaagctttgaggaaagcaacatcgaggacccactgattgtgacccctgactgtcaggaaaagactagcccaaaaggcgtggaaaatcctgctgttcaggagagcaatcagaagatgctgggaccgcctctggaagttcttaaaacactggcttcaaaacgtaatgccgtagccttcagaagctttaatagtcacatcaatgcctccaacaattctgaaccgtcccgcatgaacatgacatccctggatgcgatggacatctcctgtgcatatagtgggagctatccgatggccatcacacctactcagaaacgacgatcctgtatgccacaccaaactccaaaccaaattaagagtggtaccccttatcgcactcctaagagtgtccgacgtggggtagctcctgtcgatgacggcagaattcttggtacacccgactatctcgccccggagttgctactgggtcgggcccacgatatcccatggcccgagggtgaggaaaaactgtccgacaatgcccaaagcgccgtggaaattctccttactattgatgacaccaaacgcgccggaatgaaagagctcaaacgccaccctctgttctctgacgtggattgggagaacctgcaacatcagacaatgccatttattcctcagcccgacgacgagaccgacacttcctatttcgaggcccgtaacactgcccagcacctgacagtgagcggattcagcttgtag

SEQ ID NO: 124343 - DNA, 2640 bp, Artificial Sequence
  Description of Artificial Sequence: Synthetic coding sequence
atggatccaaccgccggttcgaagaaagaacccggcggaggagccgcaaccgaagaaggggtaaaccgcattgcggtacctaagccccccagcattgaggagttcagcatcgttaagccaatctccagaggggcattcggtaaggtctatctgggacagaaggggggaaaactgtatgctgtcaaggttgtcaaaaaagcggacatgatcaacaagaatatgacccaccaagtgcaagccgagcgggacgcactagcactatccaagagcccattcatcgtccacctgtattacagtctacagtctgctaacaatgtttatctcgtcatggagtatctgattggcggcgacgttaagtctttgcttcatatctatggctattttgacgaggagatggcagtaaaatatatctcagaggtggcgttggctctcgattaccttcacaggcatggtattattcatagagacctcaaacccgacaacatgttgatcagcaacgaaggtcacatcaaacttactgatttcggcctgtcgaaagtgacacttaacagagatattaacatgatggatatccttactaccccatctatggccaagccacgacaggattactctagaaccccaggacaggtgctctctctgataagctcactgggtttcaacacccctatcgctgaaaagaatcaagatcctgccaacatcctctccgcctgtctgtctgaaacttcacagttaagccagggtctcgtgtgtcctatgtcagtggatcaaaaagacaccacaccgtattctagcaaacttctgaagtcatgcctggagacagtggctagtaacccaggtatgccagtaaagtgcctcacatcaaatctcttacagagtcggaagcgtctggcgacaagctcagccagtagtcagtcccacacattcataagttccgtggaaagtgagtgccactcaagtccaaagtgggagaaggattgtcaagaaagtgatgaagccttggggcccactatgatgtcttggaacgctgtcgaaaaactttgcgcaaagtctgccaatgccattgaaacaaaagggttcaataagaaagacctcgagttggctctgtcaccgattcataacagctccgccctccctaccactgggcgcagttgcgtcaacctggccaaaaaatgcttttccggggaagtatcttgggaggctgtggagttggatgtaaacaatattaacatggacactgacacgagtcagttgggatttcatcaatcaaaccagtgggctgtcgacagcggcggcatcagcgaagagcacctaggaaagagatccttgaaacggaattttgaattggtcgactcaagcccctgtaaaaagattatacagaacaagaagacgtgcgtggaatataaacataacgagatgactaattgctacactaaccagaatacaggccttaccgtagaggtccaggatttgaagctgagcgtacataaaagccagcaaaacgattgtgctaataaggagaacattgtcaattcgtttacggacaaacagcagacacctgagaaactgcctattcctatgatcgccaagaaccttatgtgcgagctggatgaggactgcgagaagaacagtaaacgagactacctctccagctccttcctctgttctgacgatgatcgggcaagtaagaacatttccatgaacagtgacagttctttccctgggatctccatcatggaatcacccttggaaagccagccactggactcagatcgatccatcaaagagagtagctttgaggagtcgaacatcgaagacccactgatcgtcacccccgactgccaggagaaaacttctcccaaaggtgtggagaatcctgccgtgcaagagagcaaccaaaagatgctcggtccaccacttgaagtgctcaagacgctcgctagcaagcgcaacgccgtggccttcaggtcttttaattcacatattaatgccagcaacaactccgagccttcacgtatgaatatgactagcctggacgcaatggacatttcttgtgcttacagtgggtcatatcccatggcaatcacccctacacaaaagcggagaagctgcatgcctcaccaacagacccccaatcagataaagagcggaactccatatagaacccccaaatccgttaggagaggtgtggcacctgtcgatgacgggcgtattttggggactcctgactacctggcccctgaactcttgcttggaagggcacacgggcccgccgtggactggtgggcgctgggtgtatgcctgtttgagttcctgacaggtattccccctttcaatgacgaaacaccccagcaagtgtttcaaaacatcttaaaaagggacatcccctggcccgagggcgaggaaaagctgtctgacaacgctcagtccgctgtggagatactgctcacaattgacgataccaaacgtgcggggatgaaagaactcaagagacacccgctgttttcagatgtagactgggaaaatctgcagcaccagaccatgccctttattccccaaccagatgatgaaacggatactagttacttcgaagcccgtaacacagcacaacatctaacagtttctgggtttagtttgtag

SEQ ID NO: 124344 - DNA, 2637 bp, Artificial Sequence
  Description of Artificial Sequence: Synthetic coding sequence
atggaccccaccgccggctcaaagaaggaaccaggggggggagcggccactgaggaaggtgtcaatcgaatagcggtaccaaaacccccatctattgaggagttcagcatcgtgaaacctatatcccggggggccttcgggaaagtgtatctgggccagaaaggaggcaagctgtacgctgtgaaggtggttaaaaaggcagacatgataaacaagaatatgactcaccaggtacaggctgaaagggacgctttagcgctgtccaagtctccctttatcgtgcatctctactactccctgcagtcagcaaataacgtatatctggtgatggagtatcttatcggtggggacgtcaagtcacttctgcacatctacggatatttcgatgaggagatggccgtcaagtacataagtgaggttgctctggcactggattacctgcacaggcatggcatcatccatagagatctgaaacccgataacatgctaatctcaaacgaagggcatatcaaattgacagattttgggctgtccaaggtgaccctgaatcgcgacataaacatgatggatatccttaccaccccctcaatggctaaacctagacaggattatagcaggacccccggccaggttctgagtcttatctcaagcctgggctttaatacaccgattgccgaaaaaaaccaggatccggcgaatattctgtccgcttgcttgagtgaaacctcacagctgtcccaaggcctggtgtgtcctatgtctgtcgaccagaaggacacaactccctatagtagcaaactgctgaagtcatgcctcgaaaccgtggcaagtaatcctgggatgcccgtgaagtgtctaacttctaacctgcttcagagtcgaaagcgcctggcaacatcaagcgcgtcttcgcagtcccacaccttcatcagttccgtcgaatccgagtgtcactcttcaccaaaatgggaaaaagattgccaagagtccgatgaggccctaggaccaaccatgatgtcttggaacgcagtggagaagctgtgtgctaagagtgccaacgcaattgagaccaaaggttttaacaagaaggacctggaactggcattgtcccccattcacaatagctcagccttgcccactaccggccgcagttgcgtcaacctggctaagaagtgcttcagcggggaggtgagctgggaagccgttgagctggacgtgaacaatataaacatggatacggatacctcacaattgggttttcaccagtccaatcagtgggccgtggatagtggaggcataagtgaggagcacctggggaaacgaagtctgaaaaggaacttcgagctcgtggacagcagtccctgcaagaagataatacagaataagaagacttgcgtagagtacaaacacaacgaaatgactaactgctacacgaaccaaaacaccggattgactgtcgaggtacaggaccttaaactcagcgtgcacaagagccagcagaatgactgtgccaacaaagagaacatcgtgaactccttcacggataagcaacaaactcccgagaagttgcctatccctatgattgccaaaaacctgatgtgcgagctagacgaggattgtgagaagaacagtaaaagggattacctatcctcatcgtttctttgttctgacgatgacagagccagtaaaaatattagcatgaatagcgattcttcttttccgggcatcagtattatggagtcccccctagaaagccagccactcgactctgaccgcagtattaaggagtctagtttcgaagaatctaatattgaggaccctctgatcgtgacgccggattgtcaggagaagacgtctccaaagggggttgagaatccagctgtgcaggagtctaaccagaaaatgttgggcccacccctggaggtgctgaagacacttgcatccaagaggaatgccgttgcctttcggagctttaatagccatatcaatgcctctaataatagcgagcccagtcgtatgaatatgacctcgctcgatgcaatggacatctcctgcgcctactctggttcctatccaatggccatcaccccgacccaaaaaaggcgctcttgcatgcctcaccagactccaaaccaaataaaatccgggacaccttatcgaacccccaagtcggtccgaagaggggtggcacctgtcgatgatgggcggatcctgggaacaccagactacctagccccggagttgcttctcggtcgcgcacatggccctgctgtggactggtgggcacttggtgtatgtctgttcgaattcctgacagggatccccccctttaacgacgagacgccacagcaagtgttccagaacatcctgaaaagagatatcccatggcctgagggagaagagaagctgagcgacaatgcgcagagcgcggtggaaatcctgctaaccatcgacgacacgaaacgagcaggcatgaaggagctcaaaagacaccctctctttagtgacgtggattgggaaaacctccagcatcagactatgcctttcatacctcagccagatgacgaaacagatacctcttacttcgaggctagaaacacagcacaacacttgacagtgagcggcttctccctgtag

SEQ ID NO: 124345 - DNA, 17817 bp, Artificial Sequence
  Description of Artificial Sequence: Synthetic coding sequence
atgcagaaaggtctcctggaccaagataccggcttagtcttgctggagtctcaggtcattatgtccggtttaattgcccccgaaacaggcgagaacctatctctggaagaggggatcgcccgaaatttgattaacccccagatgtatcagcagctgcgtgaactacaggatgcattggcactcatatctagactgaccgaatcccgcggcccactgtccgtggtggaagccatagaaaaaaggattatcagcgaaactgtggggcttaaaattttggaagctcatctggctacaggaggctttagcttgagcccttccgagaactgcatcaatcttgaggaagcttttcaccagggattgatcagtgcttggttgcatagcgtgctggagtcttacttacgaaccagcaagaacctgattgacccaaataccgccgagaagatcggccttctggacctcatgcagagatgtatcgtccatcaggagagcggctttaagttgctccccgtgaagcagctggccggtgggatggtgagtctcaagtcaggtcgaaaggtgtccatcttcagggcggtccaagagggtctgatcgatcgccaggtaacagtcaggctgcttgaggcccagctcttcgcaggcggaatagtcgacccacgaaccggccacaggctgacggtcgaagaagcagtccgtcacaacctgatcgatcaggacatggcatgtgcgatcctaataaggcaacttcagaccggaggaatcatcgatactgtgactgggcagcgattgacaatcgacgaggccgtgtctaatgatctggtggcagcgaagattgctctggtgattctggagagtctctggagttttatgggactcctctggcccgagagtggcgagatcctgccaatcacagacgcgctcgaacagggcatcgtcagtaccgaactcgctcataagatcctctccaaccgacagcatatcaaagcactctttttgccagcgaccaccgaaatactttcatggaaaaaagctatcgagtcaggaatcctggatagggatttagccaataatctgaagagcatctgcattcctgacgtgatgcctcatatgcaattagccgacagcgccgagcaaaacatcaatcccggagcagccgtcctgccctgcagtaaaagccacccgaaagcaaccgcctcccagtcggaaaatctgctgtttcagttaatgacccactcttacatcaatgtgcagaatggccagcgactcctgctgctcgacaaagagctcatggaaacgctgactagtcgcgacgagtatcagacctctcctcccaaggtcgtagagatcggccatcagcggcaaaagacccccgaggggctccaggaaagtgcaaatgtaaagatatctggaacttttagctcggggtggacagtacgcctgccagaattccagttttcatcacagaataaagagtatcctgaccgggaagattgtaccacagaaaaagggaaaaaaacaactgtagagaccgaagattcctcagtcgagaatcctgaacaggatctgttcgtggagcagaaggaaagaaatcccaatattgatgcactgaaagtgatcaataaagtcaagctggaggtacagagacagttaataggaacgcaacgtgaggaccagacagcagtgtccgtccgagagaatgcctcacgtggccacctgctgaccatacccccagctgaggccgagggcgttcctctggtggtggacaaggatgtgtttagcgtagagactcctaagaaagaacaccagcctctccggaatacctcttttacgtgtcagaatgagcaggcccacactttagaaacagagtatattcacgatgagacaggcggaagtcacatcaaaccccaatccaaaaaactgcaggtgcaggtgaagaaaaccttaggcatcaagttagagttgaagagcgaaacagacgggaatgtgcaccctctggacaaaaaggagatgctcaaaaaaactttcttagctaaggatgaccacaaggaatcacaggaggcacagaacatcgctggcggcagcatgatgatgtcagagaagactgacgaagaggattcggggagggagatctttctcagttgttcccaccctctggagctgttggaggaagcgacactcaacgtgctcagcgctcaattactagacggcgggatatttcacgagcaaactggacaaaagctcctgcttaatgaggcgatcagtcgcggtatcgtcccatcgcacacagccgttaagctgatggagaaacttaacatgttccagggttttttcgactcacagacttgcgagagcctgactacagaggaggttattaacgaggggctgatggatgagaagctgctacataacgtgcttatggccgacaaggccataagcggtgtgctggacccaagaacccaaacactgtgttccgtgaaagacgcagtgacagtcggactgctcgataaggagaccgcgacacgcattctagaaagacaagttgtgactggtggcatcattgacctgaagcgtggcaagaaggtgagtgtcactcttgcttccacgttaggcctagtcgatgttgctgaccagccagagttaattaacctcgagaaagcaagtaaggggagagatgccgagaaaaccgtccgggagcggctcatatccctacaaatggagacaactggactcatcgaccctgacagcaaggcaccattaaccgttgttcaaagcatcgacagaggcctgctcgaacgggaggaagctgtgcggctgctgaccaagcaggtggtggacggcggcatcattcatcacatttcaggcatgaggctatccgtcgacaacgctttccgacacggactcattggcgaggacctggccgaaaagctcaaaagggtggaaaatctgaacattcaccagatctttaaccctgagacaaaagagaatatttcgctcccaaaggcaatcaagttggacctgatcacatccgaccttaagcgtgagattcaggaagtccaggcattcacgggcaacttcgtggatctgattagcggtcaacggttgaccctggctgaggcaaaaaaggagggccttctgactaacgaggccgtactgtcacctgggatgatgcacggcatagtcgaccctgagaattgcaggatcgtaccatactccgagttagtaaagaaatgcaagatcgatattgagtcaggacagagatatcttgaagtgattcccttctccgacataaaggatggggtgtccgacaaggttttaaccctgtcacaggccatccagctgggaaaggttgattttgccagcactttgaaggtgctggaagcccaagccaatacgggcgggataatcgataccgccaccggtaagagactaaccttggctagtgctcttgaggaaaagctggtggatgagaatatggttaggatcattgcaagccaccaggtgctgaacggcgggattgttgatatctttagcgatcaaagagtgacactggtcgaagctatcgagaaaaggctgatctcgcctgaattagctaatatgattcaaatagatagctccgagttttctgatcaccgagcacagattgaaaaacaggagggtatcgaggtctgcgcgctgcagaacgaatttctcggtaaagacatgctgatcgcatgcaatcagaccgcggagatgtcctgtaataaggtggaggagtctgaacgactattccaggtcgagaaccagtccgcccaagagaaagtgaaagttagagttagtgacggcgaacaggcaaagaaatctcgggagatttcacttaaagagtttgggtgtaaagatcagaggaaaccacggatgagctcagacgctaaggagttcatctcaatcattaatccacataaccttaaagggaaaagcctgggacaggtgtccctaacacacccatatagcgagtgtgattttaagctgaaagaggtggcccggaataacatgggcaatgatacgaatgaggagcaggaaaaagcagtcaccaaaatcgaaataattagtcatatgaagcaatctacgagctgcctggattccgaggagattagagagaatcaaggcgaagttatccttgaagttcaggaaacctactgtgaaacctcaggcaaactccctagcgaacaggtgctgcagcagcctatgaatgcccgggtgaaatctaagcgcgaaaagcgtgaagtcattgtagaggaatccattaggacatgcaaacccgcctttctatcggaggaaaaactatatcaggagaccgctatccgcgatgagcatgacagccacatcaaaagccaaccaagggaaatgacctcaagcgagaaaggtaaggaggccgatactgaaatgggattctcaatcacctttaaaattgaagagtcgtctagccaggttgttccacagggaattagtgtgaaacacttagacgccttgacattgttctcttcaaaacaggcaaatgagggcaaagtgaataacctaagtctttgtctcactctgaagccagaagaaaacctgtcgagggagatagcctgcggcgcacagtcggaacctttcccctgtatgacgcctagaccagagggactccactatcaggagtctgatggaaaagcccaagtgacgggcccgtcccaaatttcgaagactgacaaatcctttcaaggcaccaccagacaagaaacgaattatcaggattcatgggtgacctcgaaaacaaaggagaccaaacaccagatctcctctagcaatgagtgtaaggagaagtcttatcaggaggtatctttcgatccagctagaggcttgaaactcgaggagattactgtgtcccgaccagactctaaggaagtccgatacttagaattttctgatcgcaaggacctgcaccaccagggatccaagagtgacgacaagctctgtggtactttaaagtcagaaattgcgacccaggagctaactggcgagaagtttctggagatggcaaaccctaatgtcgcggggctggaagctggctccatcgaagacattgtgacccaaagaggaagtagagttctcgggtcgtttctgcctgagaagctgttcaagggcgtatctcaaaaggaaaacaccgggcaacagaacgctatcatcagccccacagtgctggaaacttccgaagaaaaaacagtctcactgactgtctgcagcgccgtgaagacagagaagaccccacaagaaaaactcagggagagccctggatccgagcagacgcctttcatgacagcccccgagggcaagggcaacgggggtgtgaacccggaaccattccgggcaacacaaaatgtgtttaccagacagctttgtctggaacacgatgagaagctggtctcttacttgtcgctactccgaaatattgagatgaggacaaagcagatccagcccttggagcttaacctcgctgagctccaagatctgctgtgtcaggctaaagtgctggaacgggaactgaaagatttgacgaccttggtttctcaagagctcgaatgcgttaaccagatcataatctcgcaaccccaagaggtgcccgcccagctcctcaaggcccttgagaaggacgccaagaacctgcagaaatcgttgtccagcgtctctgacacctggaacagtcgccttctgcacttccagaacgccgtggagatagagaaaacaaaggtgctgaaccaacatacccagctcgagggtcggctccaggaccttagagcctgggtggggaataaaaatctcatcctgaattcaaaaggttcgaactccgagattgacgtcgattcgctgaatttgtgtctgcagcaatacgaagacttgaaacaacccatggcagagaggaaggcccagctggacgcactggccttcgacatccagttcttcatttccgaacatgcccaggatttgtctccccagcagaatagacagatgctccggctgctcaacgagctacagcggagcttccaagacatactggaacaaacagcagcccaggtcgacgcgctccagggtcacttgcagcagatggagcaggaggcattggttaaaacactccagaagcagcagaatacgtgccatcagcagctggaggacctctgttcctgggtgggtcaggccgagagggcgctggccggtcaccagggaaggacgacacaacaggatttatccgctctgcaaaagaatcagtctgacctgaaagacctacaagacgacattcagaatcgagctacaagttttgccacagtggttaaggacatcgaggggtttatggaggagaaccaaacaaagctttctccaagggaactgacagccctgagagaaaagcttcatcaggccaaagagcagtacgaagcactgcaagaagagacacgcgtggcacaaaaagaactggaagaggccgtaacatccgcactgcagcaggaaacggagaagtccaaggcggctaaagaactcgccgagaataaaaagaagatcgacgctctgttggactgggtcacgtctgtgggcagttctggcggacagctccttacaaaccttcccggtatggagcagctgtccggagcaagcctggagaaaggagcacttgataccactgacggttatatgggagttaatcaggctcccgagaaactggacaagcaatgcgagatgatgaaggcaagacatcaggaacttctgtcccagcagcaaaacttcattctggctacacagtctgctcaggctttcctggaccagcatggtcataacctgaccccggaggaacagcaaatgttacagcaaaagctcggagagttaaaggagcagtactcgacatccttagcccaatctgaagcagaactgaaacaggtgcagaccctgcaggatgaattgcagaagttcctccaggatcataaagaattcgaaagctggctagaacgatctgagaaggagctcgagaacatgcacaagggcggtagctcacccgaaacgttgcctagtctgttgaaacggcaagggagtttcagtgaggacgttatttcacataagggagacctgcggttcgtgacaatctctggccagaaggtgttggacatggaaaattctttcaaggaaggtaaggagccgtccgaaataggaaatcttgtcaaggataagttgaaagatgcaacggagcgatacaccgctctgcactccaagtgtacgagactcggaagccatctgaacatgctgctcggacaataccaccaatttcagaactcagcagatagcttgcaggcatggatgcaggcttgcgaggcgaacgtggaaaagctcctttcggatacagtggcgtcagaccccggggtgctgcaagaacaactcgctactaccaaacagttgcaagaagagctggctgaacatcaggtaccagtggagaagctgcagaaggttgcacgggacatcatggagatagagggggagccagcccctgatcaccgccacgttcaggaaaccactgatagtatattatcacactttcaatctttgagctactcccttgcggaacggtcatcattgctacagaaagctatcgcccagagtcagtcagtgcaggaatccctcgagtcactgctccaatccatcggggaggtcgaacaaaatttagaggggaaacaggtttcctctctgagctcaggcgtgattcaggaggccttggccaccaacatgaagctcaagcaggacatcgccagacagaaaagcagcctcgaggctaccagagagatggtaaccaggttcatggaaactgctgactcaacaacagcagcggtgctgcagggcaaattggcagaagtctctcagcgattcgagcagttatgcctccaacagcaagaaaaagagagcagcctgaaaaaactcctcccccaggccgagatgttcgaacatttatcaggaaagctacagcagtttatggagaataagtcccggatgctggcttccggcaatcagccggaccaagatataacccacttttttcagcagatccaggagctgaatctggagatggaagatcagcaagagaatttggatactcttgaacatctggtcaccgaactgtcttcctgtggattcgcccttgacctgtgccagcatcaggaccgggtgcagaaccttaggaaggactttaccgagctgcagaagacagtcaaggagagggagaaagacgcgtcctcctgccaggagcagctagacgagttccgaaagctggtacgcacctttcaaaagtggcttaaagaaacagaaggctctataccacccacggagactagcatgtccgcaaaggagttggagaagcagattgagcacctcaagagcctattggacgactgggctagcaaaggtacactggtagaagagataaactgcaaagggacatccttggagaatctgatcatggagatcaccgcgccagatagccaaggtaaaaccgggtcaatcctgccatcggtcgggagttcagttggtagcgtgaatggctaccatacctgcaaagacctgacagagatacagtgcgacatgtccgatgtgaaccttaaatacgagaagcttggaggtgtactgcacgaaaggcaggaaagtctgcaggccattcttaataggatggaggaggtccataaagaagccaattctgtgctccaatggctcgaaagcaaggaggaggttctgaagagtatggatgctatgtccagtcctaccaagacggaaacagtcaaagctcaagcagagtccaataaagctttccttgcagagcttgaacaaaattccccaaaaatacaaaaagtcaaagaggctctggctggtctgctggtcacttatccaaacagtcaggaggcagagaactggaaaaaaattcaagaagagctcaattctcgctgggagcgggccaccgaggttaccgtcgcgcgccagcgacaactcgaagaatccgcatcacatttagcctgtttccaagccgccgaatctcagttgcggccctggcttatggagaaagagttaatgatgggagtgcttggcccactgtcgatagaccccaacatgttgaatgcccagaaacagcaagtccaatttatgctgaaagagttcgaggctagaagacagcagcacgaacagctgaacgaggccgcacagggtattttaaccggccccggcgacgtgagtctttcaacctcccaggtgcagaaggagctgcaatcgatcaaccagaagtgggttgagctaaccgacaagctgaattcacgatctagccagatagatcaggcaattgtgaaatcaacacagtaccaggagctccttcaggacctgtcggagaaggtaagagccgtgggccagcgcttgtctgtgcaaagcgcaatttctacgcaacccgaagcagtcaagcagcagctggaggaaacgtcggaaatacgatctgatcttgagcaactcgaccacgaggtgaaggaggcccagactctgtgcgacgagctgagtgtgctgatcggcgaacagtacttgaaagacgagttgaaaaagagactcgagactgtggccctcccgctccaagggctagaagatttagcagcggatcggatcaatcggctgcaggccgctttagctagcacacagcaatttcagcagatgtttgacgagctgagaacatggctagatgataaacagtcccagcaagccaagaactgcccaatttctgcaaagctggagaggctccagagtcagcttcaggaaaacgaagagtttcaaaagtcactaaatcagcactcgggtagctatgaggtgatagtcgctgagggtgaatctctgttactctccgtgcctccaggcgaggagaagcgaacacttcaaaaccagctggtggagttaaagaaccactgggaggaactcagcaaaaagactgccgaccgccagtctagactgaaggactgtatgcagaaggctcaaaaatatcagtggcatgtcgaagacctagtgccatggattgaggactgcaaggctaaaatgtcggagctccgtgttactctcgatcctgtccaactagagtcctctttacttcggagcaaggcgatgctcaacgaggttgagaaaaggcggagtcttctcgagatccttaacagcgctgctgatatcctaattaatagcagtgaagctgatgaggacggcatcagagacgaaaaagctggtattaatcagaatatggacgccgtgacagaagagctacaggccaaaactggtagcctggaggagatgacccagagactccgcgaatttcaggaatcattcaagaacatagaaaagaaggtggaaggagcaaagcaccagctcgagatatttgacgccttaggcagccaagcttgctccaacaagaacctggaaaaactgcgggcccagcaggaagtgctgcaggctctggagccgcaggttgactacctccgaaatttcacacaggggttagtggaggacgccccagacgggagcgatgcctcgcagttattgcatcaggctgaggttgctcaacaagagtttctggaggtgaagcagagagtaaactcaggttgcgtgatgatggaaaacaagctagaagggatcggccagtttcactgtagggtgagggaaatgttttcccagttggctgatcttgatgatgaactggacgggatgggcgccattggtcgcgataccgatagcctccagtcccagatagaagatgtaagactgttcctcaacaagatacacgtgctgaagctcgacatcgaggcttccgaagcagaatgtcgacatatgctggaagaagagggcacactggaccttttgggattaaaacgggaactggaagcattgaataagcagtgcggtaaactgacggagcgcggaaaagctaggcaggaacaattggagctgaccctcgggcgagtagaggacttctatcgaaagcttaaggggttgaacgacgcgaccactgccgctgaagaagctgaagctttgcagtgggttgtcggcactgaggttgagataatcaaccagcaactcgccgactttaagatgtttcagaaggagcaggtggacccacttcagatgaagctgcagcaggtaaacggtctgggccaaggtctgattcaatccgctgggaaggattgcgacgtgcagggcctcgagcatgatatggaggaaattaacgctcggtggaataccctgaacaaaaaggtggctcagcgcattgcccagctacaggaggctcttctccactgcggtaaatttcaggacgcactggaacctctgctatcatggctggcagatacggaagaactgattgccaatcagaaaccacctagcgctgagtacaaagtagtgaaggcacagatccaagaacagaagctacttcagcggctactagacgatagaaaggcgacggtcgatatgctgcaagcagagggaggccgcattgcacaatccgctgagctcgccgacagggagaagatcacagggcagctagaaagcctggaaagtaggtggaccgagctgctgtccaaagccgcagctcgccagaagcagctggaggacattcttgtgcttgccaagcaattccatgaaactgccgagccaattagcgacttcctcagcgtgactgagaaaaaactggccaacagtgagcccgtaggtacacagaccgccaagattcagcaacagataatccgccacaaggccttggaggaggacatcgagaatcacgctaccgacgtccatcaggccgttaaaattggccaaagcctgtcttcactaacgtctccagccgagcagggggtgctgtccgagaagattgactcactgcaggccagatatagcgaaattcaagaccgatgctgcaggaaagcagccctgctggatcaggctctcagcaacgcaaggctctttggggaggacgaagtggaggtcctgaactggctcgctgaagtggaggataaactatcttccgtcttcgtgaaagatttcaagcaagacgtcctacacagacagcatgccgaccatctggccctgaacgaagagatcgttaacagaaaaaagaatgtggatcaggccatcaagaacggccaagccttactgaaacaaacaacgggcgaggaagtattgctcatccaagagaagctggacggaataaaaactcggtacgccgatattacggtgacatcgtctaaagcactacggacgctggagcaagccagacagctggccacgaagttccagtccacatatgaggagttgaccggatggctgagggaagtagaagaggaactggcgaccagcggcgggcagtcacccaccggggagcagattcctcagttccaacaacggcaaaaggaactgaagaaggaggttatggaacatcggttggttttagacaccgtaaacgaagtttcccgcgctctgttggaactcgtgccgtggcgggcaagagaaggcctcgacaagcttgtttctgatgccaacgagcagtacaagcttgtgtcggacacgataggccagagggtggacgagatagacgcggcaatacagaggagtcaacagtacgagcaggccgccgacgctgagttggcgtgggtggccgagaccaagagaaagcttatggccctcggaccaattcgcctggaacaggatcaaaccactgcacagctgcaggtacaaaaggcattctccatagatatcattaggcataaggatagtatggacgaacttttcagccaccgctccgaaatctttgggacatgcggagaagagcagaagactgtgctgcaagagaaaactgaatctctgatccaacagtatgaggcaatttcacttcttaactccgagaggtatgcaaggctagaacgcgcccaggtactggtgaaccaattttgggagacctacgaggagctgagtccttggattgaggagacacgagccctcattgcacagcttccttccccagcgatcgatcacgagcagcttaggcagcagcaagaggaaatgcggcagttgcgcgagagcatcgccgaacacaagccccacatcgacaagctgctaaagatcggtcctcaactgaaagaactcaatcctgaagagggcgagatggtggaggaaaaataccagaaagcagaaaacatgtatgcacaaataaaagaagaggtgagacaaagagccttagccttagatgaagccgtcagtcagtctactcagatcacagaatttcacgataaaattgagcccatgctggaaacattagagaacctgagttctagactccgaatgcctccgcttattcctgctgaggttgacaagatccgcgagtgcattagcgataataagtctgccactgtcgaactcgagaagctgcaaccctctttcgaagccctgaaacgtcggggcgaagagttgattggccgctctcagggagcggacaaggatttggcagcaaaggagattcaggacaaattagatcagatggtcttcttctgggaggatatcaaagctagggccgaggaaagggaaattaagttcctcgacgtgctcgaacttgctgagaaattctggtatgacatggcagcccttctaacaaccatcaaagatacacaagacattgtgcacgacctggagtcgccaggcatagaccccagtattataaagcagcaggtcgaagcagccgaaactataaaagaggagacagatggattgcacgaggaactggagttcataagaatcctgggcgctgacctaatctttgcctgtggagagacagaaaagcctgaggtgaggaagtccattgacgagatgaataacgcttgggaaaacctgaacaaaacctggaaagagagactggaaaagcttgaggacgcgatgcaagcagccgttcagtatcaggacacattgcaggctatgtttgactggctggataacaccgttatcaagctgtgtactatgcctcctgtggggactgatttaaacacagttaaggaccagttaaatgagatgaaggagtttaaggtggaggtgtaccaacaacagattgagatggagaaactgaaccaccagggggaactcatgttaaaaaaggcaaccgacgagacggatagggatattatccgagagcccttgacagagctgaaacatttgtgggagaacctgggggaaaaaattgcacacagacagcacaagcttgagggcgccctgctggccctcggccagtttcaacacgcactggaagagctgatgtcctggttaactcacacagaggagctgctagacgcccagcggccaattagcggggaccctaaagtgatcgaggtggaactggcaaaacaccatgtcctgaagaacgatgtgctggcccaccaggccacagttgagacagtgaacaaggcagggaatgagttgctggagtcatccgccggcgacgatgcctcctctctccgtagccgcctggaagctatgaatcagtgctgggaaagcgtgttacaaaaaaccgaggagcgagagcagcaactccagtcaacactgcagcaggcacaagggttccattcggaaatcgaggattttttattggagctaactcggatggagtcacaactgagtgcgtcaaaacccaccggtggcctgcctgagaccgccagggagcaactggacacgcacatggaactgtatagtcagctgaaggcgaaggaagagacgtacaatcagttgcttgacaagggccggttgatgcttctctccagagacgactctgggtctggctcaaagactgagcagagcgtcgcactcttagagcagaagtggcatgtcgtcagctctaaaatggaggagcgtaagtcgaagctcgaagaggccttgaacctcgcaaccgaatttcagaactcacttcaggagttcatcaactggcttacactggctgagcagagtcttaatatagccagccccccaagtctgatcctgaataccgtactgtctcagatcgaagaacataaagtgttcgccaacgaggttaatgcccacagagatcaaataattgagcttgaccagactggcaaccagcttaagttcctctctcagaaacaggacgtggtgctgattaaaaacctgctagttagcgtgcagtcaagatgggaaaaggttgtacagcgaagtatagagagaggtcggtctctcgacgacgcgagaaaacgcgccaagcagttccacgaagcctggaaaaagctgattgattggcttgaagacgctgagtcacacctggattcagagctggaaatttctaatgaccccgacaagatcaagctccagctgtccaagcacaaggagtttcagaagacattgggaggaaagcagccggtctatgatacaaccattcgaacaggaagggcacttaaggaaaaaactctgctgcccgaagattcacagaaactcgacaattttctgggggaagtgcgtgataagtgggacacagtttgcgggaaaagtgtcgagcgtcagcacaaactcgaggaggctctgctcttctccggtcagtttatggacgcactgcaggctttggtagactggctgtataaagtggaaccccagttagcagaagaccagcccgtacatggggacctagacctcgtgatgaacttaatggacgcccacaaggttttccagaaagaattgggaaaaagaactggtaccgtccaggtcctgaaaaggtcaggtcgggagttaattgagaacagtcgtgacgataccacctgggttaagggccaattacaggagctcagcacccgttgggataccgtctgcaagctttccgtcagtaagcagtcaagactggaacaggctcttaaacaggccgaagtcttcagagacactgtgcacatgttattggagtggttatcggaggccgagcagaccctccggtttaggggtgcactacccgacgacaccgaggctctacagagcctcatcgacacccacaaggaatttatgaagaaggtcgaggagaaaagggtcgatgtgaattccgcagtggcaatgggggaggtcatactggccgtgtgtcatcctgattgcatcacgaccatcaaacactggattacgatcattagagctcgatttgaagaagtgctcacatgggctaagcaacatcagcagcggctcgagaccgcgctctctgagctcgttgcaaatgcagagcttctggaagagctcctggcctggattcagtgggccgagaccaccctaattcagagagaccaagaacccattcctcagaatatagaccgcgtgaaggcccttattgccgagcaccagacattcatggaggagatgactcgaaagcagccggacgtggaccgtgtgacaaagacctataagaggaaaaacatcgaacccacccatgcgcccttcattgaaaaatcaaggtccggaggacggaagtccctgagccagccaacgcctcccccgatgccgatactgagtcagtccgaggctaaaaatccccgcattaatcagctgagtgcccggtggcaacaggtgtggcttttagcgctggagcgacaacggaagctcaatgacgccctcgatagacttgaggaattgaaggaatttgcgaacttcgacttcgacgtgtggcgcaagaagtacatgaggtggatgaaccataagaagagccgcgtgatggacttcttcaggcgaatcgataaggaccaggatggtaaaataacacgacaggagttcattgacggaatccttgcttcaaagttcccgacaaccaaacttgaaatgaccgctgtcgccgacatctttgatcgcgacggtgatggctatatagattactatgagttcgtagcggccctgcaccctaataaggatgcttaccgtccaacaaccgatgccgacaagatagaagacgaggtgacacgtcaggtggcgcaatgcaagtgcgcgaaaagattccaggttgagcagataggtgagaataagtaccgcttcttccttgggaatcaattcggcgattctcagcagctgcgactggtgagaattttgaggtcaactgtgatggtgagagtgggaggcggttggatggcactggatgagtttctggtcaagaatgatccgtgcagagcccgggggcgtacaaatatcgaactgagggagaagtttatccttccagagggcgcatctcaaggaatgaccccttttcggtctcgcgggcgccggtctaagccatcaagtcgtgccgcttcccccacaaggagttcctcaagtgcctcccagtccaatcacagctgtacctctatgcctagctctcctgcgacccctgccagtggtaccaaagtgatacctagcagtggctccaagttaaagcgccctactccaacatttcactctagtcgcaccagtttagccggagatacaagcaattccagcagtcctgccagtacaggcgctaaaaccaaccgggcggaccccaaaaaatcggccagcaggccgggatcaagagctggcagccgggccggctcacgagccagctcccgccgaggcagtgatgcctcagacttcgatttattagaaacgcagtcagcttgctcagatacttccgaatcctctgctgctgggggccagggcaactcgagacgagggctgaataagcccagtaagatcccaaccatgagtaagaaaactactactgccagcccaagaactcctgggccaaagcggtag

SEQ ID NO: 124346 - DNA, 16293 bp, Artificial Sequence
  Description of Artificial Sequence: Synthetic coding sequence
atgagctccagcgatgaagagaccctctccgaaaggtcttgccgatccgagagatcttgccgaagcgaacggtcctacagaagcgagcgttcagggtccctgtcaccatgcccaccaggtgatacattaccatggaatctccccctgcacgagcagaaaaaaagaaagtcacaggacagcgttttagaccccgccgaacgcgcggtcgtgcgcgtggcagatgagagggatagagtgcagaaaaagacattcacaaagtgggtgaataagcaccttatgaaagttcgtaaacacattaatgatctctacgaggacctcagggacgggcacaatctgatcagtctcctggaagtcctatcaggaattaaattgcccagggagaaaggacggatgaggttccaccgccttcagaacgtccagatcgctctggacttcctgaaacagagacaggtcaagcttgtgaatattcgaaacgacgacattactgacggcaatccaaaactgaccctcggcctgatttggacgattatcctgcacttccagatcagtgatatttatatttccggtgaatctggtgacatgagtgcaaaggagaagcttctcttgtggacccaaaaggtgacggcaggatacacgggaattaagtgtaccaatttctctagttgttggagcgacggcaagatgttcaacgcactcatccacaggtatcgacctgacctggttgatatggaaagagttcagatacagtcgaacagagaaaatctcgagcaggcttttgaagtggccgaacggcttggcgtcactcgcttactggatgctgaggatgtcgatgtaccatcacctgacgaaaaatccgttattacctacgtgagctctatctacgatgccttccctaaagtgcctgagggaggtgagggcataagcgcgactgaggtagactcccgctggcaggagtatcagtcaagggtcgactctttgatcccttggataaagcaacatacaattctcatgtcagacaaaacctttccccagaatcccgtcgagctgaaagcactgtataatcagtacatccacttcaaagagacagaaatcctggccaaggagcgcgagaaaggcagaattgaggaactgtacaagttgctggaagtttggatagagttcggtcggattaagcttccccaaggctatcatcctaatgacgtggaagaggagtggggtaaactcatcattgaaatgctggagcgggagaagtccctcaggcccgcggtggagcgccttgaactattgctacaaatagcaaacaagatccagaatggcgcgcttaactgtgaagagaagcttactctggccaagaacactttgcaggccgatgctgcgcaccttgagtcaggacagcctgtgcagtgcgagagtgacgtgattatgtacatacaggagtgcgaaggtcttattcggcaattacaggttgacctgcaaatccttcgagacgagaactactaccagttggaggagctggcgtttcgcgtgatgcgtctgcaggacgaacttgtgacgctccggctggaatgcaccaacctataccgcaaaggccacttcacctcgttggagcttgtgcccccatcaacactcacaacgacccatctgaaagcagagcctctgaccaaggctacacacagtagtagtacaagctggttccggaagcccatgactcgcgccgagcttgtggccatctcctcttcagaagacgaaggcaatctgaggttcgtttatgagttactctcctgggtcgaggagatgcagatgaagctggaaagagctgagtggggcaatgacttgccctccgtggagctccaattggaaacgcagcagcacatacacacaagcgtagaagaactgggcagcagtgttaaggaggcccggttgtatgagggtaagatgtcacagaattttcatacaagttacgcagagacacttggaaaacttgagactcagtactgtaagcttaaagaaacatcgtctttccgcatgagacatctccagtccttgcataagtttgtgagccgagccactgctgaacttatttggcttaacgaaaaggaggaggaagaactcgcgtatgactggtctgacaataatagcaacatttcagccaagcgtaattacttttccgaactcaccatggagctcgaggaaaagcaagacgtattccgtagtcttcaggatacggccgaactgctctcattggaaaatcatcctgctaaacagacggtggaggcctattctgccgcggtgcagagtcagctgcagtggatgaagcagttgtgtctgtgcgtggaacagcacgtgaaggagaacactgcctatttccagttcttttctgacgctcgcgaactggaatccttcctgcgaaacttacaggatagtattaagcgtaaatacagctgcgaccacaacacctcgctcagcagactggaagatcttctgcaggactcaatggacgaaaaggagcagctcattcaatctaaaagctctgttgcaagcttggtgggccggtccaagacaatcgtccagctgaagcccagatcacccgaccacgtcctaaaaaacactatcagcgtaaaggccgtgtgtgattacagacagatcgaaatcacgatctgcaaaaacgacgagtgtgtactagaggataatagccagcgtaccaagtggaaagtaattagtccgaccggcaatgaggccatggtgccctcggtgtgtttccttatccctcccccaaataaggacgctatcgagatggcgtctagagtcgaacagtcataccagaaggttatggcactctggcatcagctccacgtgaacaccaagtctctgataagttggaattatcttagaaaggatctcgatctggtgcagacatggaacctagagaagttacggagcagtgctccgggggagtgtcatcaaatcatgaaaaatctccaggcccattacgaagacttcctgcaagatagcagggattctgtattgttttctgtggccgataggctccgattagaagaggaagtcgaggcctgtaaagcccgttttcaacatttgatgaagtctatggagaatgaagacaaggaagaaaccgtcgccaaaatgtacatttcagaattgaaaaacatccgactacgcttggaggaatatgagcaacgggtggtgaaaaggatccaaagcctcgcgagttctaggactgatagggatgcatggcaagataatgccctccgcatcgccgagcaggagcatacccaggaagatctgcagcagctgagatcagacctggatgcagtgtccatgaaatgcgactcattcctgcaccaaagcccgtcctcgtcatcagttccaacattaagatctgagctgaatctcctggtggaaaaaatggatcatgtgtacggtctgagcaccgtctacctaaataaacttaagacagttgatgtcatagtgcgcagcatccaggatgccgagctgttggttaaaggatacgagattaaactttctcaagaggaagtggtactggccgacttgtccgccctcgaggcacattggtcaacactgcgccactggctttccgacgtgaaagataaaaacagcgtcttttcagtcctggacgaagaaatagcgaaagctaaggtggtagccgagcaaatgtcaaggctaactcctgagcggaacctggacctggagcgctatcaggagaagggatcgcagctgcaggagcgctggcaccgggtaattgcacagctagagattcggcagtcagaactcgaatcaatccaggaagttttgggagattacagggcatgtcacggcacactgataaaatggatcgaggaaaccaccgcccagcaggagatgatgaaacctggacaagctgaggactctcgcgttctctctgagcagctttcacaacaaaccgcactgtttgccgaaatagaacggaatcagactaaactagaccagtgtcagaaatttagccaacagtactcaactattgtgaaggattacgagcttcagctcatgacttataaggcattcgtcgagagtcaacagaagtccccgggaaagcgacgccggatgctgtccagcagtgacgcaattacccaggagtttatggatctccgcaccaggtatacagccctggtaacccttaccacacaacacgtgaagtacatctctgacgctctccgaagactggaagaggaggaaaaagtggttgaggaagagaagcaggagcacgtagaaaaagtgaaggaactcctcggttgggtgtctacattggctaggaacactcagggtaaagcgaccagtagcgagactaaggagtcaaccgacattgagaaggctatcctcgaacagcaggtgttgtcagaggagctgacaacaaagaaggaacaggtgtccgaggctatcaagaccagccaaatcttcttggcaaaacacggtcacaagctctctgaaaaagagaaaaagcaaatctctgagcagctgaacgccctgaataaagcataccatgatctctgtgacgggtcagctaaccagcttcaacagctgcagagccagcttgcacaccaaacagagcagaagactcttcaaaagcaacagaacacttgtcaccagcaactcgaagacctgtgttcttgggtgggtcaagcagaacgcgctctggctggacaccagggaaggactacccagcaagatctttctgccctgcagaagaatcagagtgacttgaaagatctgcaggacgacatacaaaatcgggccaccagtttcgcaactgtggtgaaggatatcgagggctttatggaggaaaatcagactaagctgagcccccgagaactgactgcgctgcgggagaaactgcaccaagcaaaggagcagtatgaggctctacaggaggaaactagagtggctcagaaagagctcgaagaggcagttacaagcgcccttcagcaggagacagagaaaagcaaagcggccaaggagctggctgaaaacaaaaaaaagatcgatgcccttctggactgggtgactagcgtaggcagtagtggaggccagttgttaacaaaccttcccgggatggaacagctctctggggctagtctggaaaaaggtgccctcgacactaccgatggatacatgggcgtaaatcaggcaccagagaagctggataagcagtgcgagatgatgaaagctcgccaccaggagttactgagccaacagcagaactttatcctggctacgcaaagtgcacaggctttcttggaccaacacggtcataacctgacccctgaggaacagcagatgctccagcagaaacttggagagttgaaggagcaatacagtaccagtctggcacagtctgaggccgagcttaagcaagtccagactttacaggatgagctgcagaaattcctccaggatcacaaggagttcgaatcgtggttggagaggtccgaaaaggaactggagaatatgcacaagggcggatccagccccgagaccctgccttcactgctcaaacgacagggctcattctcagaggatgtcatttcccacaagggagacctcagattcgtcacaatttcaggacagaaagttctcgacatggaaaactctttcaaggagggcaaagaaccctctgaaatcggaaacttggtaaaagacaagctcaaggatgcaacagagaggtacacagctctgcatagtaagtgcacaaggctagggagccatctgaatatgcttctcggccagtatcaccagtttcaaaattctgctgatagtctccaggcctggatgcaggcatgcgaggccaacgtggaaaagctactttctgacacagtagcgtccgacccaggtgtactgcaggagcagctcgccaccacgaaacagctgcaggaggagctggccgaacaccaagtcccagtagaaaaattgcagaaggttgctagggatatcatggagatcgaaggcgagccggcgccagaccatcgacatgtccaggagacaaccgatagcatcctctcgcacttccaatcattatcctactcactggcggagcggagctctctcctccaaaaggccatcgcccaatcacaatcggtccaggagagcctggagagcttactccagagtataggggaagtggaacagaacctagaaggcaagcaggtatcaagtttgtcttctggcgttatccaggaggccctggcaacaaacatgaagctgaagcaggacatcgctagacagaagtcgtcgctagaggccacacgggaaatggtgacccgcttcatggaaacagcagactctaccaccgctgccgtgctgcaggggaaattggcggaggtgtcccagcgtttcgagcaactttgtttgcagcagcaggagaaagagtcctccctgaaaaagctgctacctcaagccgaaatgtttgaacatctgtccggcaagctgcaacaattcatggagaataaaagcagaatgctggcttcaggcaaccagccagaccaggacatcacccactttttccagcaaatccaggaactcaatcttgagatggaagatcaacaggaaaacttggacaccctcgagcatctcgtaactgagctaagcagctgtggcttcgccttggacctttgtcagcaccaagaccgcgtccagaatctgagaaaggatttcaccgaattgcaaaaaaccgttaaggagcgcgagaaggacgcaagttcctgtcaggagcagctagatgaatttagaaagctcgtgagaacttttcagaagtggctgaaagagacagaagggagcataccacctacggaaactagcatgtctgctaaagaattggagaagcagatagagcacttgaaaagcctgcttgacgactgggcttctaagggcacactggtcgaggagattaactgtaagggaacatcactagagaatttgattatggagataaccgccccagattcccagggcaaaaccggctccattttaccaagcgtcggctcgtccgtgggctctgtgaacggctatcacacctgtaaagatctgacagaaatccagtgcgacatgagcgacgtgaatttaaagtatgaaaaattgggtggcgtgctgcacgaaagacaggagtctctacaagccatactgaatcggatggaagaggtgcataaggaagccaatagcgtgcttcagtggctcgagtcaaaggaggaagttctcaaatcaatggatgctatgagctcccccacgaagactgaaacagtgaaggcacaggccgagagtaataaagctttcctggccgaactggagcaaaactcacccaagattcagaaagtgaaggaggccctggccggactgctagtgacttaccccaactctcaggaagcagagaactggaaaaagattcaagaggagctaaacagtcgttgggaacgcgctaccgaagtaactgtggcacggcaacgccagctggaggagtccgcgagccacctggcttgcttccaagcagctgagagccagctcaggccctggctgatggagaaagagctcatgatgggggtcctaggccccctatccatcgacccaaacatgcttaatgctcaaaagcagcaggtgcagttcatgctcaaggaattcgaggctagaagacagcagcatgaacagctgaacgaagccgctcagggtattctcactgggcccggtgatgttagtctgagcactagtcaggtacaaaaagagctccagtccattaaccagaagtgggtcgagctgactgacaaacttaatagcagaagctctcagatcgaccaggccatcgtcaaaagcacacagtatcaggagcttttgcaggacctgtccgaaaaggtgcgggctgtcgggcaaagactcagtgtgcagagcgctatcagtactcaaccagaggcggtgaaacagcagctggaagaaacctccgaaattcgatctgaccttgaacaactggatcacgaagtgaaggaagcgcagacgctctgcgacgagctcagcgttctcatcggcgagcaatatctcaaagacgaactcaagaagaggttggaaacagtcgcgctccctctgcagggtctggaggatctggctgccgataggatcaatcggctgcaagccgcacttgcatccacacagcagttccagcagatgttcgatgagttacggacctggctcgatgacaagcagagccagcaagcgaaaaattgtccgatcagtgctaagttggaacgcctacagagtcagcttcaggaaaatgaggagttccagaaatccctgaatcagcactccgggagctacgaagtcattgtcgctgaaggtgaatcactgttgttgtccgttcctccaggggaagagaagcgtactctgcaaaaccagctggtggagcttaaaaaccattgggaggagctgagcaaaaagaccgcggatcgccaatctcgcctgaaggattgcatgcaaaaggctcagaaataccagtggcacgtggaagatctcgtaccctggatagaggattgcaaggccaaaatgagtgagctcagggtcacccttgaccccgtgcagctcgagagctcactgcttaggtcgaaggccatgctgaacgaagttgagaagcggagatctctgcttgagatcttgaatagtgcagccgacattctgattaatagcagtgaagcggacgaagatgggatcagagatgagaaagctggtattaaccagaatatggatgccgtgacagaggaactccaggcgaagacagggtccctggaggagatgacacagcggttaagggagttccaagagtcgtttaagaatatcgagaagaaggtagaaggtgccaagcaccagctcgaaatcttcgacgctcttggatcacaagcttgttcaaacaagaatctcgagaaattacgggctcagcaggaagtgctccaagcactggagcctcaggtcgattacctccgcaactttacacagggcctggtcgaggacgcaccggatggttctgatgcctcccagttgctgcaccaagctgaagtggcccagcaggaattcctggaagtgaagcagcgcgtgaacagcgggtgtgttatgatggagaacaagctggaggggattgggcagttccattgccgggtgcgcgaaatgttctcccagttggccgacctggacgacgaactcgatggaatgggggccatcggcagagatacggattctctccagtctcagatagaggacgtcagactgtttttaaataagatccacgttcttaaattagacatcgaagcaagtgaggcagagtgtcgtcacatgctcgaagaggagggtactctcgacctccttggtctaaaaagagagctggaggccctgaataagcagtgcggcaaactgaccgagagagggaaagctcgccaagagcaacttgagcttacccttggccgggtagaggatttttaccggaagctgaaaggactgaatgacgccactactgctgccgaagaggctgaagccctccaatgggtggtcggcactgaggtagagattatcaatcagcagttggctgacttcaaaatgtttcagaaggagcaggtggatcctttgcaaatgaagctgcagcaagttaacggcctaggacaggggctcatccaatcagccggaaaagactgcgatgtccagggactagagcatgatatggaggagattaacgcaaggtggaacacactgaacaaaaaagtcgctcaaagaattgctcagttgcaggaggccttactgcactgcggcaagttccaggatgcactggagccgctgctgtcttggcttgctgacacagaggagctcatcgccaaccagaagcctccttccgctgagtacaaagtggtgaaggcgcagatccaggagcagaaactactccagcggctgttggacgacaggaaagctacagtcgacatgctgcaggccgagggcggcaggatcgcacaaagcgccgaactcgctgatcgagagaagattacaggtcagctcgaaagccttgagtcacggtggacagagctcctcagcaaggcagcggcccggcagaagcaacttgaagacatcctggtccttgcgaagcagtttcacgagaccgccgagccaatctccgactttttgagtgtgactgagaagaagctcgcaaacagcgaaccggtaggcacacagactgccaagatccagcagcagattattcgtcataaagcgcttgaagaggacatcgaaaaccatgctaccgatgttcaccaagctgtaaaaataggacagtctttatcaagcctgacctccccagctgaacagggagttttgtctgaaaagattgattcactccaggcgagatactcagaaatccaggatcgatgctgcagaaaagcagcactcctggatcaggcattaagcaacgcaaggctgttcggcgaggacgaagtggaagtgcttaattggctggccgaggtggaagataaattgtcatcagtgttcgtaaaagatttcaaacaggatgtcttgcacaggcagcacgcagaccacctggcactgaacgaggagatcgtcaacaggaagaaaaatgttgatcaggctatcaagaatgggcaggcactgctgaagcaaaccaccggtgaggaagtcctgctgattcaagagaaactggacggcatcaagacacggtacgccgacataacggtcacctccagtaaggccctgcgcaccttggaacaagcccgccagcttgcgacaaagttccagtcaacatatgaggaactgacagggtggctgcgcgaggtggaagaggagcttgccaccagtgggggccagagtccaaccggagaacagatcccccagtttcaacagagacagaaagagctgaagaaggaggtgatggagcaccggctggttctggataccgtcaacgaagtgtctagggctctgctggagctcgttccctggagggcacgcgaaggactagataaactggtctccgacgcaaatgagcagtacaaactagtcagcgacacaataggtcaaagggttgatgagattgatgccgctatccaacggtcccagcaatacgaacaggccgctgacgcagaattggcctgggtggctgaaaccaagcggaagctgatggccctagggcccatcagattggagcaggaccagacgaccgcccagttacaggttcaaaaagcgttctccattgacataatccgccataaagactccatggacgaactcttcagccatcgcagcgaaatcttcgggacttgtggtgaagaacagaagacggtgctgcaggagaagactgaatccctcatccaacagtacgaggccatatcgctgctaaactctgagaggtatgcccgtctggagagggcccaagtgcttgtaaaccaattctgggagacgtatgaggagctgtcaccatggatcgaggaaacccgggccttgatcgcccagctgccctctcccgccatcgatcacgagcagttaagacaacagcaggaagagatgcggcaactgcgcgagtctatagccgagcataaaccacacatcgacaaattgctaaagatagggcctcaactaaaagagttaaatcccgaggaaggggaaatggtggaagagaaatatcagaaggctgaaaacatgtacgcccaaattaaggaggaggtgcggcagcgcgccctggcattagatgaggccgttagccaaagcacccaggtcagccagttccatgacaagatcgagccaatgctcgaaaccttggaaaacctctcgtctcgcctcaggatgccacccttaatacctgccgaagtagacaaaattcgcgaatgtataagtgataataagagtgctacagtggagttggaaaagctccagccgagctttgaggcactcaaaaggcggggcgaggagcttataggccggagccagggagctgacaaggacctggccgccaaagaaatacaggacaaactggaccaaatggttttcttctgggaggacatcaaagcacgagcggaagaaagggagataaagtttctcgatgtactggagctcgctgaaaagttctggtacgacatggctgccctgctgacaaccataaaggacacacaggacatcgttcatgacctggagagtcctggaatagatccgagcattatcaaacagcaggtcgaggccgctgagaccataaaggaggagactgacgggctacatgaggagttggagttcatcagaatattgggcgctgatctaatcttcgcttgtggagagacagaaaagcccgaagtgcgtaagtctatcgacgagatgaacaatgcttgggagaacctgaataagacttggaaggaacggcttgagaaactagaagacgcaatgcaggccgctgtgcagtatcaggacacgcttcaggccatgtttgattggctggataacactgtcatcaagctctgcactatgccacctgtcggcactgacctcaacactgttaaggaccagttaaacgaaatgaaagagttcaaagtcgaagtgtatcaacagcagatcgaaatggagaaactcaatcaccagggggagctcatgctcaagaaggcgactgatgaaactgacagagatattatcagagagcctttgacagaactcaaacatctgtgggaaaatcttggagagaaaattgctcatcgacagcacaaactggagggagccctcctagctctgggtcaattccaacacgctctggaagagttgatgtcatggctgacgcatactgaagaacttctggacgctcagaggcccatatccggtgaccccaaggtgattgaggttgagctcgctaagcatcacgtactcaaaaatgacgtgttagcacaccaagcaacagttgagacagttaacaaggctgggaatgagctacttgagtcctctgctggagacgatgcgagctccttacgctctaggctagaagctatgaaccagtgttgggaatccgtcctccagaagacagaagaaagggagcagcagctacagagtaccttgcaacaggcccaaggttttcatagcgagattgaggattttttactggaattaacccgtatggaaagccaactttccgccagtaaaccaactggagggctgcctgaaaccgctcgagagcagctggatacccatatggaactgtactcccagcttaaggcgaaggaagaaacctacaatcagctgctggacaaggggagactgatgttgctcagccgggacgattctggatctggaagtaaaaccgaacagagtgtggcattgctagagcagaagtggcatgttgtctcatctaagatggaagaaaggaagtccaagctcgaggaagccctcaatctggccaccgagttccaaaactccctacaggagtttatcaactggctcactctggccgaacagtctctcaacatagcttccccaccatccctgatcctgaatactgttctgtcccagatcgaagagcataaggtctttgccaatgaggttaatgctcatcgcgatcagattattgagctcgaccaaaccggaaaccaattgaaattcttgtctcagaagcaagatgtcgtcctgataaagaatctgctggtaagcgtgcagagcaggtgggagaaggtggtgcagcggtcaatcgagagagggagatccctggatgacgcccgcaaaagggccaaacagttccacgaggcctggaagaaactgatagactggttagaagatgccgaatcacatctggattccgaattggagattagtaacgacccagataagattaaacttcagctgtccaaacacaaggaatttcagaagaccctgggggggaaacagcccgtgtacgatactacaatccggactggtcgggcgttgaaagaaaaaaccctgctgcccgaggactcccaaaagctggacaatttcctcggcgaggtgcgtgataagtgggataccgtatgtggcaaaagtgtcgaacgccagcacaagctggaagaggccctgttattctcagggcaattcatggatgctctccaggcacttgtggattggctgtataaagttgaacctcagctggccgaggatcaacctgtgcacggtgatctcgaccttgtgatgaatctaatggacgcccacaaagttttccagaaagaactgggcaagcggaccggcaccgtacaggtcctgaaaaggtctggaagggagttgatagaaaattctagggacgacacgacatgggtcaaggggcagctgcaggagctctcgaccaggtgggacacagtgtgcaagctttctgtgtccaaacagtctcgtctggagcaagccctcaaacaagctgaagttttccgggacactgttcacatgctgcttgagtggctgtctgaagccgaacagacactcaggtttcgtggagcgctgccagacgataccgaggcgctgcaatcacttatagatacacataaggagtttatgaaaaaggtggaggagaagagagtggacgtgaactctgctgtcgccatgggcgaagtgatacttgcggtatgtcacccagactgtatcaccaccataaaacactggataactatcatacgcgccaggttcgaagaagttctcacttgggccaagcaacatcagcaacgcctggagacagccctgtctgagttagtggccaatgcggagctcctcgaggaacttctcgcatggatccagtgggccgaaactaccctgatccaaagggatcaggagcctatcccgcaaaacattgatcgagtcaaggctctgatcgccgagcaccagacattcatggaggaaatgacgcggaagcagcccgacgtggatagggtaacaaagacctacaagcggaaaaacattgaaccaactcacgccccttttatcgaaaagtccagaagtggcggtcgcaagagtctttcacagccaacacctccgccaatgcccattttatcacagtctgaagccaaaaacccgagaatcaatcagctgtccgcacggtggcagcaggtgtggttgctagctttggagaggcagcgcaagctgaatgacgcactggaccgcttggaagaactaaaagagttcgcgaacttcgatttcgacgtctggcgcaaaaagtacatgagatggatgaaccacaagaagagtagagtcatggacttttttaggcggattgacaaagatcaagacgggaaaatcactagacaggagttcatcgacggcatccttgctagtaagtttccaacgactaaactcgagatgacagccgtggccgatatctttgaccgggacggagacgggtacatcgattattatgagttcgttgcagctctacatccgaataaagatgcctataggccaactactgatgctgataaaatcgaggacgaggtgacccgtcaggtagctcaatgtaagtgtgcgaagcggtttcaggtcgagcagattggagaaaacaagtaccgctttggcgattctcagcagctccgcctggtgcggatcctgagatcaaccgtaatggtgcgggtgggcgggggttggatggccctcgatgaattcctagtcaaaaacgacccatgtcgtgccagaggacgcaccaacatcgagctgcgcgaaaagtttatcctaccagagggtgcatctcagggaatgactccctttagatctcgaggcagacgtagtaaacctagctcacgtgcagcaagtccaactagatcttccagctctgcctcacaatcaaaccactcttgcactagtatgccatccagccccgcaacgcctgccagcggtactaaagtgatcccttcttccggatcaaaactcaagagacccacgcccacattccacagttcgaggacttctctggccggcgataccagcaattcaagcagcccagcttccactggcgctaagactaatagggctgacccaaagaaatctgctagcagacccggttcgagagcgggcagccgagccggatcgagagcctcatcgaggcgcggatcagacgccagcgacttcgacctgctggaaactcaatctgcttgttcagacacaagtgagtcgagtgccgccgggggtcagggcaattctcggcgggggctgaacaaacctagcaagattcctactatgtcaaagaagacgacaacagcctctcctcgtactcccggccccaagaggtag

SEQ ID NO: 124347 - DNA, 16293 bp, Artificial Sequence
  Description of Artificial Sequence: Synthetic coding sequence
atgtcctctagcgacgaggaaaccctgtctgagcggagttgccgatccgaacgctcttgccgttcggagaggtcctataggtcagaacgttctggttcccttagtccttgcccacctggagacacactgccctggaacctgccacttcacgagcagaaaaagagaaaatcacaggacagtgtactggacccggctgaacgagccgtggtgagagtggctgacgaacgggatcgagtgcaaaaaaaaaccttcactaagtgggtgaacaaacatctgatgaaggtgcggaaacatatcaatgacctgtatgaagacctgagggacggtcataaccttattagcttgctggaagtccttagcgggattaagctgcctcgggagaagggacggatgagattccatcgcttgcagaacgtgcagattgcactggattttttaaaacagaggcaggttaaactcgtaaacatccggaatgacgacatcactgatggaaaccccaaactgacccttgggcttatctggaccatcatcctgcactttcaaatcagtgacatctacatttcaggagagtcaggggacatgtcagcgaaagagaaattactgctgtggacccaaaaagtaaccgctggctataccggcataaagtgtactaatttcagctcttgttggtcagatggtaagatgtttaacgcgcttattcacaggtacaggccggatcttgttgacatggaacgtgtgcagattcagtccaatagggaaaatctggaacaggcctttgaagtggcggaacgtcttggagtgacgcgcctgcttgatgccgaggatgtcgacgttcctagccccgatgagaagagtgtcatcacttacgtgtcaagtatctacgacgcgtttcctaaagttcccgaggggggagagggaatctcagcaaccgaagtcgactctcgatggcaggagtaccagtcaagagtggacagcctcattccctggattaagcagcatactatcctcatgtcagataagaccttcccccagaatccggtcgagttgaaagccctatataatcagtatatacactttaaggagactgagattctcgctaaagagagggaaaagggtagaatcgaggaactctataagctcttagaggtctggatcgaattcggccgcatcaagctgccccagggatatcacccaaacgatgttgaagaggaatggggaaaattgataatcgaaatgttagaaagagaaaaaagcctgaggcctgccgtagagaggctcgaattattgcttcagatcgccaacaagatccagaatggtgccctaaattgcgaagagaaacttaccctcgcaaagaatactctacaggccgacgcggcccacctggagagcggacagcctgttcagtgtgaatccgatgtgatcatgtacatccaggaatgcgaaggactcatcaggcagctacaggtggatctgcaaattttgagggacgagaactattaccaactagaagagctggcattcagagtgatgcggctgcaagacgagctggtgaccttgagactcgagtgcaccaacctatatcgaaaaggacactttacgtctctggagttggttcccccatcaacattgacaaccacccatcttaaagccgaaccactgacaaaggccacccacagtagtagcactagttggtttaggaaaccaatgacccgtgcagaactggtggcaatcagctcgtctgaggacgaaggaaacctgcgcttcgtgtacgaactcctttcctgggtggaggagatgcaaatgaaactggaacgcgccgagtgggggaatgacttgccctccgtggaacttcagttagagactcagcagcatatacatacttctgttgaggaactaggttcgtctgtaaaggaagctaggctgtacgaagggaagatgtcacagaactttcacacctcctatgcagagaccttgggcaagctggaaactcagtattgtaagctcaaggaaacaagcagctttcgcatgcgccatctgcagagcctccataagtttgtttcgcgagccaccgctgaactgatctggcttaatgaaaaggaagaggaagagttggcctacgactggtccgataacaactccaacatctcggcgaagcgaaattatttttctgaactcacaatggaactcgaggagaagcaggacgtgtttcggagcctacaggataccgccgaactacttagtctagagaatcacccagccaagcagactgtagaagcatatagcgccgccgtgcaatcccaattgcaatggatgaaacagttatgcctttgtgtggaacaacatgtgaaagaaaacacggcttatttccagtttttctccgatgcccgtgaactggaaagctttttaaggaacttgcaggacagtatcaagaggaagtactcttgtgatcacaacactagtctctcccgactagaagacctcctgcaggattccatggatgagaaagagcagctaattcagagtaagtcttctgtggccagcttagttgggcggtccaagacgatagtacagctgaagcccaggagtcccgaccacgttctcaagaacacaatttcagtcaaagcagtctgcgactataggcagatagaaatcactatatgcaaaaacgacgaatgcgttctcgaggacaactcccaaaggacaaagtggaaggtcataagtcctactggcaatgaagccatggtgcccagcgtctgctttctaatccctcctcctaacaaggacgccattgagatggcatcaagagtggaacagagctatcagaaagtgatggccttgtggcaccaactgcacgtgaacactaagagtctgataagttggaactatctccggaaagacttggatctggtccagacatggaacttggagaaactgaggtccagcgcgccaggcgagtgtcaccaaatcatgaaaaatttacaagcccactatgaggacttcctgcaggattcccgagattccgtcttattttctgtagccgatcggctgaggctcgaagaggaagtcgaggcttgtaaagcaagatttcagcatctcatgaaatccatggaaaatgaggacaaggaagagaccgtcgccaagatgtacatatctgagctgaagaacatccggctccgcttggaagagtacgaacagagagtcgtgaaaagaatccagtctttggccagcagccggacggaccgcgacgcctggcaggataacgccttacgcatcgcggaacaggagcacacccaggaggatttgcagcagctgcgctccgacctggacgccgtgtccatgaaatgcgactcttttttgcaccagagcccaagctctagctccgtgcccaccctccgctctgaattgaatctcctcgtggaaaaaatggaccatgtgtacgggctctccactgtctatctaaataagctcaagaccgttgatgtcatcgtgcgcagcatccaggacgcggaactactggtgaaggggtatgagatcaagctgagccaggaagaggtagtactggctgacctcagcgccctcgaagcccactggtccacactgcgacactggctaagcgacgttaaggacaagaacagtgtctttagtgtgctagacgaggaaatagccaaagccaaagttgtggcagagcagatgtcacgtctgacacctgagcggaatctggatctagagcggtaccaggagaaaggatcccagcttcaggagcgctggcatagagtcatcgcccagctcgagataagacagtctgaactagagtccatccaggaagtccttggtgattaccgagcttgccatggcaccctaatcaagtggattgaagaaactactgcacaacaggagatgatgaaaccagggcaagctgaagatagcagagtgctcagcgaacagctgtcacagcagaccgccctgttcgctgagattgagagaaatcagactaagctggaccagtgtcagaagttcagtcaacagtattcaacaatcgtgaaggattatgagctgcaactgatgacgtataaggctttcgtggagtcccaacagaaatctcccgggaaacgacgcagaatgctgtcatccagcgacgccattacgcaggagtttatggacctcagaactcgttacactgcactcgtcaccctgactacacagcacgtgaaatacatatccgatgcactgcggcgactggaggaggaggagaaggtggttgaagaagagaaacaagagcatgtcgagaaagttaaagaactcctgggttgggtgtctacactggcgcggaatacccagggaaaagctacctcatccgagaccaaagaaagtacagacatagagaaagccatattagagcaacaggttctgagcgaggagctgacaactaaaaaggagcaggtgagtgaggccataaagacgagccagatattcctggccaaacacggtcacaaactgagtgagaaagaaaaaaaacaaattagcgagcagctcaatgccctgaacaaagcttaccatgatctgtgtgatggaagcgccaaccagctgcagcagctgcagagccagctggcccatcagaccgaacaaaagacactgcagaaacagcagaacacctgccatcagcagctcgaagatttgtgttcttgggtggggcaggccgagcgagcattagcgggccaccagggtcgaaccacccagcaggatctgtccgcacttcagaaaaaccaatccgatcttaaggatctgcaggatgacatccaaaacagagcgacgagctttgctacggtcgtgaaggatattgagggctttatggaagaaaaccagacaaaattgagcccgagggagctcacggctctgcgagaaaagctccatcaggctaaagagcagtacgaagcactgcaggaggaaacccgggttgcacagaaagaactggaggaagccgtcacctcagctcttcagcaggaaaccgagaagagtaaagccgctaaggaactggcagagaataagaaaaagattgatgcacttctggattgggttacaagtgtaggtagctcaggaggccagttgctgaccaaccttccgggaatggaacagctttcaggcgcctcgctggaaaagggcgctttggacactacagacggatacatgggcgtaaaccaagctcccgagaaactggacaagcagtgtgaaatgatgaaggctcggcaccaggagttgctgtcacagcagcagaattttatcctagcaacccagtccgcccaggcatttttagaccagcatggtcacaatttgaccccggaggagcagcagatgcttcagcagaagctaggggagttgaaagaacaatactccaccagcctggcacagtctgaggccgaattaaagcaagtccagaccctccaagacgagctgcagaagtttttacaggatcataaggaatttgaatcctggctggagcgcagtgagaaagagctagagaacatgcataaaggagggtccagtccagaaaccctgccgtctctgctcaaaagacaaggcagctttagcgaagacgtcatttcacataagggcgacctgcggttcgtcaccataagtggccagaaggtgcttgacatggaaaacagttttaaggagggcaaggaaccgtctgagataggcaatctcgtgaaagacaagttaaaggacgccactgaaagatacacagccctgcattctaaatgcacgaggctggggagtcaccttaacatgctcctgggccagtaccaccagttccaaaacagtgccgacagtttacaagcgtggatgcaggcgtgtgaagctaatgtcgaaaaattgctgtcggataccgttgcctctgatcctggagttttgcaggaacagctggccacaactaaacagctgcaagaggaacttgccgagcaccaagtgcccgtggagaaattgcagaaggtggcacgcgacatcatggagatcgaaggcgagcctgccccggaccacagacacgtgcaagaaaccacggacagcatcctttcccactttcagtccctgtcttactccttagctgagcgttctagcttactgcagaaagctatcgctcagtcacagtccgtgcaagaatcactggagtctctgctgcaatcaataggtgaggttgagcagaacctggagggcaagcaggtatcttccctgtcttcaggcgtgattcaggaggcacttgccacaaatatgaaacttaagcaggacattgctcggcagaaaagttcactggaggccacaagggagatggtgacaaggtttatggagactgctgacagcacgaccgccgcagtactgcaaggcaaactcgctgaggtgagtcagaggttcgaacagttgtgtcttcaacagcaggagaaggagtcctcactgaagaaactgctcccccaggctgaaatgtttgaacacctgagtggaaagctccagcaattcatggagaataaaagccgtatgctggcctcagggaatcagcctgaccaggacataacacacttctttcagcagatacaggagctcaatctggaaatggaggaccaacaggaaaacttggacacacttgagcacctcgtgaccgagctctcctcctgtgggttcgccctggatctctgccagcaccaggatcgcgttcagaacctgaggaaagactttactgaactccagaagaccgtgaaggagagggagaaggatgccagcagttgtcaggagcagttggatgaatttcggaagctcgtccgtacattccagaaatggcttaaagaaaccgaaggatctattccccctacggagaccagcatgtccgccaaagaattggaaaagcaaattgagcacctgaaaagcctgctagatgactgggcgagcaaaggaaccctcgtggaggagatcaactgtaaaggaacttccctggagaatttaattatggagatcacagctcccgattcacaagggaagactgggtcaattctgccgagtgtggggagctctgtgggctccgtaaacggttatcacacttgtaaagacttaaccgagatccagtgtgatatgtccgatgtaaatttgaaatatgaaaaattgggtggggttctacatgagaggcaggaaagtctccaagccattctcaaccgaatggaggaggtgcacaaggaggcaaacagtgtgctgcagtggctggagagcaaggaggaagttctgaagtctatggacgcaatgtcttcaccaaccaaaactgaaacggtcaaggcccaagccgagtctaacaaggcctttctggccgaattagaacagaactcacctaagatccaaaaggtgaaggaggctctcgcgggcctgctcgtgacttatccaaattcccaggaggctgaaaattggaagaagattcaagaagaattaaacagcagatgggagagagctacggaggtgactgttgcccgccagaggcagctcgaggaaagcgcctcccacttggcatgtttccaggcagccgaatctcaactgagaccctggttgatggaaaaagaattgatgatgggcgtattggggcccctgtcaatcgacccaaacatgctgaatgcccaaaagcagcaggtacagtttatgctcaaggagtttgaggccaggcggcaacaacatgagcaactgaatgaggcagcccaggggatcctgactgggcccggagatgtttccctgtccactagccaggttcaaaaggaactgcagagcattaatcagaagtgggtggaacttaccgacaagttaaacagtaggtcttcccaaatcgaccaggccattgtgaaatcaacacagtaccaggagctgctccaagacctttccgaaaaggtgagagcggtgggccagcggttatcagttcagtctgccatctctactcagcctgaggcagtgaagcagcaacttgaggagacatctgaaatccggtccgacctggaacagctggaccatgaggtgaaggaagctcaaacactgtgcgacgaactgagcgtccttatcggcgagcaatatctgaaagatgagttgaagaagcggttagagacagtggctttaccgctccagggactcgaggatttggctgcagatcggatcaatcgtctccaagctgccctcgcttcaactcagcaattccagcagatgtttgacgagctcaggacctggttagacgacaagcagtcccaacaagcgaaaaactgccccattagtgctaaactggaacggcttcagtcacagctgcaggaaaatgaagagtttcagaaatcactgaatcagcattctggctcctacgaagtcattgtggcggagggcgagtccctcctgctgtccgtgcctcctggagaggagaagagaacactccagaaccagctggttgagttgaaaaatcactgggaggaactctctaagaagacagcagatcgccagtctcggctgaaagactgtatgcagaaagcacagaagtaccaatggcacgtcgaagacctcgttccatggatcgaagattgtaaggcgaagatgtccgagttgcgcgtaaccctggaccctgttcagctcgaatccagccttctccgctcaaaggctatgttgaacgaagtagagaagcgcagaagtttgttggaaatactgaactcagccgcagacatcctgatcaactcctcagaagctgacgaggacggcatccgcgacgaaaaagccgggattaatcaaaacatggacgcagtgaccgaggagttgcaggccaagacagggtcgctagaagagatgacacagcgcctaagggaattccaggaatccttcaagaacatagaaaagaaagtggagggagccaaacaccagctggagatttttgacgccctaggatcccaggcctgctcaaataaaaaccttgagaagctgcgcgcccagcaggaggtcctccaagcattagaaccgcaggtggactatctccgcaacttcacccaggggctggtggaagatgcccctgatgggtcggacgcaagccaattgctgcaccaggcagaggttgctcagcaggaatttctcgaagtgaagcagagggttaacagcggctgcgtgatgatggaaaacaagctggaggggatcggtcagttccattgtagggtgcgagaaatgttctctcagcttgccgatctggatgatgagctcgacggaatgggggcgattgggcgcgacacggattctctgcagagtcaaatcgaggatgttagactgttccttaacaaaatccatgtcctcaaactggacatagaggcctccgaagccgagtgcagacatatgctggaggaagaaggaaccttagatctactcggactgaagcgggagctcgaggcgttgaataagcagtgcggaaagctcactgaaagagggaaggccaggcaggagcaattagagctgactctgggccgtgttgaggatttctatagaaaacttaagggactgaatgacgcaactacagcagctgaagaggcagaggccctgcagtgggtggtgggcaccgaagtggagatcataaatcagcaactcgccgatttcaagatgttccaaaaagaacaggtagacccccttcagatgaaactgcagcaggtaaatggtctaggccagggactcatacagtccgccgggaaggattgtgatgttcagggactggaacatgacatggaggagatcaatgctaggtggaatactctgaataaaaaggtggcccagaggatcgcccaactgcaggaggcactcctgcattgcgggaaatttcaggacgccttagaaccactgttgtcctggctggccgataccgaagagctcatagccaaccagaaaccccccagtgcagaatacaaagtggtgaaagcccagatccaggaacagaagctgctccagaggttgttggatgaccgaaaggcaactgttgacatgctgcaggcagagggagggagaatcgcacaaagtgctgagctggcggaccgtgagaagattacggggcagctcgaatcattggagtcacggtggaccgagctactgtctaaagccgctgcaaggcaaaaacagcttgaggacatcctggtattagccaaacagtttcacgaaaccgctgaaccaatctctgattttctgtctgtgacagaaaagaagcttgctaatagtgagccagtgggaacccaaaccgcaaagattcagcagcagatcataaggcacaaagcactggaggaggatattgaaaaccacgcaaccgatgtccaccaggccgtcaagatcggacagagtctgagttccctgacaagcccagccgagcagggtgtcctgagtgaaaaaattgactctctccaggccagatactccgagatacaggatagatgctgtcgcaaggccgctctgttggatcaggccctgagtaacgcccgattattcggagaggatgaggttgaggtgctcaattggttagcggaagtcgaggacaagctgtcctccgtcttcgttaaagacttcaaacaggatgtcctccaccgacagcacgcagatcatctggctttgaacgaggaaatcgtcaaccggaaaaagaacgttgaccaggcaatcaaaaatggtcaagctctgctgaaacagaccacaggcgaggaggtattactcatccaggagaagctggatggcattaaaacccgatacgccgatattacagttacctccagtaaggcactaagaaccttagagcaggcccgtcagctggctacaaagtttcagagtacctatgaagagctgaccgggtggctgagggaggtagaagaagagctggctacatccgggggccaatctccaacaggggagcagatcccgcagtttcaacagagacaaaaagaactaaaaaaggaggttatggagcaccggttagtgctggatacagtaaacgaggttagcagggccttgctggaattagtgccttggcgcgcccgtgagggactagacaaattggtctctgatgccaacgaacaatacaagctagtctctgatacaataggacaacgggtggacgaaattgatgcagcgatccagcggtcgcaacagtatgagcaagccgctgatgcagagcttgcctgggtggcagaaaccaagcgaaagctgatggcacttggcccaattcgcctcgaacaagatcagacgactgcccaattacaggtgcagaaagccttctcaatcgacatcatcagacataaggatagcatggacgagcttttttcgcaccggtctgagatttttggcacttgcggcgaggaacagaaaacagtgctgcaggaaaagacagaatccttgatccagcaatatgaggctatctccctattgaattctgaacgctacgccagactggagagggcccaggtcttggtaaaccagttctgggaaacatatgaggaactttccccatggattgaagagacaagggctctaatcgcgcagcttccctctccggcgattgaccacgaacagcttagacagcagcaggaggagatgaggcagttgcgcgaaagcatcgctgagcataaacctcatatcgataagctcctcaagattggtcctcagttaaaggagctcaaccctgaggaaggcgagatggtggaggagaagtaccagaaggccgaaaacatgtatgcccagatcaaggaggaagtaagacagcgggctttggcattggacgaggcggtgtcccagtccacgcagattacagaattccacgacaagatcgaacccatgctcgagactctggaaaatctgagttcgagactccggatgccaccattaattccggctgaggtcgacaaaatcagagaatgcatatccgacaataaatctgccactgtcgagcttgagaaactgcagcctagttttgaggctttaaagaggagaggagaggagctgattggacggagtcagggggcagacaaggacctggctgcaaaagagatccaggataagctggatcagatggtgtttttttgggaagacatcaaagccagggcagaggagcgtgagatcaagttccttgacgttttggaattagctgagaaattctggtatgatatggcggcactcttgaccacaatcaaggatacccaggatattgtacatgacttagaatcccctggaattgacccctccattatcaaacaacaagtagaggccgccgagactatcaaggaagagactgacggcctccatgaggagctggagtttattcgaattttgggagccgacctgattttcgcgtgtggcgagaccgagaagccagaggtccgcaaatcaattgacgaaatgaataacgcctgggaaaacttaaacaagacatggaaggaacggctggaaaaactcgaggatgctatgcaggccgccgtgcaataccaggacaccctgcaagctatgtttgactggttggacaatacagtgatcaaactgtgtacgatgcccccggttgggacagatctaaatactgtgaaggaccagctgaatgaaatgaaagaatttaaggtcgaggtctaccagcaacagattgagatggagaaactgaaccaccagggagagctgatgctcaaaaaggcgacagacgagacagaccgagacattatccgcgaaccactgacagagctcaaacacctgtgggagaacctcggagagaaaattgcccacagacagcacaagctggaaggcgccctattagccctagggcagttccagcacgccctagaagaactcatgtcttggctgacgcacactgaggaattgctggacgcacagcggccaatttcaggagatcctaaagttatcgaggtggagcttgcaaaacaccacgtcctgaagaacgatgtgcttgcacaccaggccaccgtggagaccgttaacaaggcaggtaacgagctcctggaaagtagcgctggtgacgatgcgtcaagcctgcgatcccgcctggaggctatgaatcagtgctgggagtccgtactccagaaaaccgaggaacgggagcagcagctacagtctacccttcagcaggcccagggcttccattctgaaattgaggactttttgttagagctgacccggatggagtcccaattatctgcaagcaaaccaactggtggtttaccagaaaccgcgagggagcagctcgatactcacatggagctgtactctcagctcaaagccaaggaggaaacatataatcagctactggacaaaggacggctcatgcttctttctcgcgacgactcaggtagcgggagtaagacggagcagtccgtggccctgctggagcagaagtggcacgtcgtgagcagtaagatggaagaacgcaagtctaagctagaggaggccttgaatcttgcaaccgagttccagaatagccttcaggaatttattaactggcttacgctggccgagcaatctctcaatatagcctccccccctagcttgatcctcaacacggtgctcagccagatcgaggagcacaaggtgttcgccaacgaggtcaatgcacatcgggaccaaatcattgagttggaccagaccgggaaccaactaaagttcctctcacagaagcaggatgtggttctcattaaaaaccttctggtgtccgtacagagccgctgggagaaggtagtacagcggagcatcgaacgtgggcgctccttagatgatgcgcgtaagagagcgaagcaatttcacgaggcatggaaaaagctcatagattggctggaagacgccgagtctcatctggatagtgaattagagatcagcaatgatccagataaaattaaactccagctctcaaagcataaggagtttcagaagacactgggaggaaaacaacccgtttacgataccactatccgtaccggaagggccttaaaagagaagacgctcttgcctgaggactcacagaaacttgataactttctgggcgaagtgcgggacaagtgggacacagtctgcggcaagtccgtggagcgccaacataagttggaagaggctctgctctttagtggccagttcatggacgcactccaggcccttgtcgactggttgtataaagtcgagccgcagctcgccgaggaccaacctgttcatggcgacctggatctggttatgaatcttatggatgctcataaagtattccagaaggaacttggcaagcggaccggcaccgtgcaggtgcttaaacgttctggtcgtgagctgatagagaactccagagatgataccacttgggtgaagggccagttacaggaactgagtacacgctgggacaccgtgtgtaaattatcagtgtccaagcagtctcgcttggaacaggctttgaagcaggccgaggtcttcagggacacagtacacatgcttctcgaatggctgtctgaggcagaacagacactgagattccgcggagccttaccagatgacactgaggcattgcagtcactgattgatacgcacaaggagttcatgaagaaggtagaggagaaaagggtggacgtgaatagcgcggtcgctatgggggaggtgatattagccgtctgccaccccgattgcattactacaatcaagcattggatcactatcattcgggccagatttgaggaggtgctgacttgggcgaagcaacaccagcaaaggttggaaaccgctctttccgagttggtggccaatgccgagctgttggaggagctactggcgtggatccagtgggccgagacaaccttaatacaacgtgaccaggagcccattccccagaatatagatagggtgaaggctcttatcgctgaacaccagacctttatggaagaaatgacaagaaagcagcccgacgttgaccgcgtgaccaaaacatacaagagaaaaaatatcgaaccgacccacgccccgttcattgagaaatctagaagcgggggacgaaaatctctgtcccagcccactcccccaccaatgcctatcttgtcccagagtgaggccaagaatccacgcattaaccaattatctgctcggtggcaacaggtgtggctccttgccctggaacgacagaggaaactgaatgatgcactagacagattggaagaactgaaggaattcgctaacttcgatttcgacgtatggaggaagaagtacatgcggtggatgaaccacaagaagagcagggtcatggacttcttccgacgtatcgataaagaccaggatggcaagatcacccgacaagaatttatcgatggtattctggcctctaagttccctacgacaaagttagaaatgactgcagtggcagatatcttcgacagagacggcgacggatacatcgactattatgagtttgttgctgctttgcatcctaacaaagacgcatacaggccgaccaccgatgctgataagatcgaggacgaggtaacaaggcaggttgcacagtgcaagtgtgcaaagaggtttcaagtggaacagattggcgaaaacaagtaccgctttggtgactctcaacagctccgcctggtccggatacttcggtctacagtcatggtaagagtagggggcggctggatggccttggacgaattcttagttaagaacgacccatgtcgggctagaggtcgtactaacatagaacttagggaaaagtttatcctccccgagggagcatctcagggaatgacaccttttcgcagtagaggccgacgcagtaaaccctcatcccgagctgcttcaccaaccaggtcctcctctagtgcgtcacagtctaatcactcttgtaccagtatgccaagttccccagcaaccccagcctccggcactaaggtgatccccagctccggaagcaagcttaagagacccacccctacttttcattctagccggaccagcctcgccggagacacaagtaattcttcatccccagcctcaacaggagccaagacgaatcgggccgatccgaaaaaaagtgccagccgacccggatccagagctgggtccagagccgggagccgtgcctctagtcgcagaggctccgacgcatcggactttgaccttctggagacacaatctgcctgtagtgacacctccgaaagtagtgctgccggtggccagggtaactcccgtagaggactgaataagcccagcaagattccaaccatgtctaagaagaccacaactgcctccccccgcaccccaggtcccaagaggtag

SEQ ID NO: 124348 - DNA, 3189 bp, Artificial Sequence
  Description of Artificial Sequence: Synthetic coding sequence
atgggtaatagcctaggctgctttaaggagcctaaagagtccattgcaataccggaaaaggcacccattagccccaagaagcgggtgcgcttcaagaggaggtggcgcggtaaaaagatcccgacaccagaggccagtcaccaggaggaaacttctgagggtaccggggtgattgaagagaccgagacactcaccaagctgacagaatcactacaaaaggaggatggagtcggcggagtagagcacacaccacctgacatactgctcccaggagacagcgcccctaattctagagtggtggaccgcggaatgattgtgcaggtgaaagagcgctttcagggggaggtgcagacagcgcacttgttactcgagaacgagtctagtgtagccgggggcgtgtgggacagcctggaagaggggatgaccgttatcgctcatttgctggacaaccctgctgaaagaaactgtgaaaagagcgtgtcccagctggtcgagtttcccagaactgctagttgtagcagtcgggcagttttgctcccactgcagggcgagactgctgtcgagaaggggaatatccagcgagggttccggagctgcgcactcccccgcactgactaccccacagataaaggcaatcaggagcagttttcagaagggtggtcagtggaggaggggaccaagagcgtgtcaggcgctccgcaaacggcctcctggatcatcgagtgttcagtgtcttccttactccttgatcagcccgggggccagcgccgcactgagccgtcccacgtcgggcaggtccccccgcaggattccaggttgcctacttcccaaagcgacctgtcaatatcaggtgtgaccgtttctatcctcccttcaagcagtggttacggaagcgatgggccccacatccacgggattcagcctaaggacaccgagcctgagaagtctagcaccagcttcagtgaggaagatggtacactctccttggaagccagccacactccctcatggggactcgaggagatttctgacatctatattagcggagagagcggagacatgtctgccaaagagaagctgctcttatggacgcagaaagtcacggccggatatactgggatcaagtgtacgaatttttctagctgttggtcagacggaaagatgttcaatgctttaatccaccggtacaggcccgacctggtggacatggaacgggtgcagatccagagtaaccgcgagaatcttgaacaggcgtttgaagttgcagagaggctcggggtgactagacttctcgacgctgaggacgtcgacgttcccagcccagacgagaagagtgtgatcacctacgtcagttccatctacgacgcgttcccaaaggtgcccgagggcggtgaaggaatttcagcaacagaagttgatagtaggtggcaggaatatcagagtcgagttgacagtctcataccttggattaaacaacacaccatactgatgtccgacaaaacctttcctcagaaccccgtggagttgaaagcactctacaaccagtacatccatttcaaagaaaccgagatcctggccaaggaacgggagaaaggaaggattgaggaactttataagcttctcgaggtgtggatcgagtttggacgcattaagctgccccagggttaccatcctaacgatgtcgaggaagaatgggggaaactcatcattgaaatgttagagagggaaaagtccctacgaccggccgtagagcgtttggagctgctcctgcagattgccaacaaaatccagaacggggcattaaattgtgaagagaagctcaccctcgccaagaatactctacaagctgacgccgcccatctggagtcaggtcagccagttcaatgtgagagcgatgttatcatgtatatccaggagtgcgaggggttgatccgtcagcttcaggttgatttacaaattctgcgtgatgaaaattactaccaacttgaggagctcgcctttagggttatgcgattgcaggatgaactggtcactcttcggctggaatgcaccaacctgtaccgtaaaggccattttacgtcactggaattagtcccgccatcaaccctcactaccactcatctcaaggctgagccgctcaccaaggccacacatagctcttctacctcttggtttcgcaaacccatgacccgagccgaactggtggccatctcctccagtgaggatgagggtaaccttagatttgtgtacgaactcctgagttgggtggaagaaatgcaaatgaagttggagagagccgaatgggggaacgaccttcctagcgtggaactacagctcgaaacgcaacaacatatccatactagcgtcgaagagctgggatcatccgtgaaggaagcccgcttgtatgaggggaagatgtcacagaactttcacacaagttatgcagagacccttggcaaactggaaacccagtactgcaagttgaaggagacatctagctttcggatgcggcacctgcagtctcttcataagtttgtgtctcgggctacagctgaactcatttggctaaatgagaaggaagaagaggagttagcatatgattggtccgataacaattccaacatttcagccaaaaggaattacttttccgagttgacaatggagctcgaggaaaaacaagatgtattcaggtccctccaggataccgcagaactacttagcctggagaaccaccccgctaaacagaccgtggaggcatactccgctgccgtccaaagccagctacagtggatgaagcagctgtgtttatgtgtagagcagcacgtgaaggagaatactgcatattttcagtttttttcggacgcacgggaactggagtcattcctccgcaacttgcaggactccattaaacgtaagtatagctgcgaccataacacatctctgtccaggctcgaggatttgcttcaggattccatgtttcaggacgaaaaagagcaattgatccagagcaagtcatcagtggcctcactggttggacgctctaaaaccattgtacagctcaagcctcgcagtccggatcatgtgttaaaaaatacgattagcgtgaaggcagtgtgtgactatagacaaattgaagggcggaccattttatccgagggatatggtcccttggcgagcgctgcttgttag

SEQ ID NO: 124349 - DNA, 22167 bp, Artificial Sequence
  Description of Artificial Sequence: Synthetic coding sequence
atgtcaagttcggacgaggagacgctgtccgaacgttcctgtcgatcggagcggtcttgtcgtagtgagcgatcataccgtagcgagagatccgggagcctttctccctgcccccccggagataccttaccttggaacctccccttacacgagcagaaaaaacggaagtctcaagactctgtgcttgatcccgctgagcgagcagtggtcagagtggccgacgagagggacagagtgcagaaaaagacttttaccaagtgggttaacaaacatctcatgaaagtgcgtaaacatattaatgacctgtacgaggaccttcgcgacggtcataaccttatctcactcctggaagtcctgtctgggataaagctgccgcgagaaaagggacggatgcggttccacaggctgcagaacgttcaaatcgcccttgattttctaaaacagcgtcaggtgaagctggttaacattcgcaacgatgacattacagatggcaatcctaagttaacactgggcctcatctggactataattctgcacttccaaatctctgatatatacatctcgggcgaatctggggatatgtcagcaaaggaaaagctcctcctgtggactcagaaggtgaccgcgggatacacagggataaagtgtaccaacttctcgtcctgttggagtgatggtaagatgttcaacgccctgattcaccggtaccgaccggacctcgtggatatggagagggtccaaatccagagtaatcgggagaacctggaacaagctttcgaggtggcagagcgactgggagtgacacgtctcttggatgcagaagacgtagatgtgccctctccggacgaaaagtccgtcataacatacgtgtctagtatctatgacgctttcccgaaagtgccggaagggggcgaaggtatcagcgctaccgaggtggacagccggtggcaagaatatcagagtcgggtggattctttgatcccctggataaagcagcacaccatcctgatgtcagacaagacctttcctcagaacccggtggagttaaaagctctctataaccagtacattcacttcaaggagacagagattctggcaaaagaacgcgaaaagggaagaattgaagagctttataagctgcttgaagtatggattgaatttggccgaatcaaactcccgcaaggctatcacccgaacgacgttgaggaggaatggggcaaactgattatcgagatgctggaacgggagaagtccctgaggccagccgtggaaaggctcgagctgctcctgcagattgccaataagatccagaatggtgctctcaactgtgaggagaagttgactctcgccaagaatacattgcaggctgatgctgctcacctcgagtcaggccagcccgtgcagtgtgaatcagatgtcatcatgtacatacaagagtgcgaaggcctgattcggcagcttcaagttgatctgcagatcctgagagacgaaaactattaccaactggaagaacttgccttccgggtgatgcggctccaagacgaattggtcacattgaggctggagtgcacaaatctgtatcgtaagggccacttcacctctctggaattagtgcccccaagcacgttgactaccacccaccttaaggctgagcctctgactaaggcaacacacagcagctcaacatcgtggtttcgtaagcctatgaccagggctgaacttgtcgccatttcgagctctgaggacgaggggaatctaaggttcgtttacgagctcctgagctgggtcgaggaaatgcaaatgaagttggagcgagctgaatggggcaatgacctcccttctgtcgagctgcaattggaaactcagcagcatatccacacctccgtcgaagagctaggtagttccgtcaaagaggccagactgtacgaaggcaagatgtctcaaaattttcatacctcctacgccgagaccctgggtaagttagaaactcagtattgcaagctgaaggaaacttctagcttccgcatgcggcacttgcaaagtctgcacaagttcgtctcaagggcaacggccgagctgatttggctcaatgagaaggaggaggaggaactcgcgtatgactggtctgataacaactctaacattagcgcgaaacgtaactatttttccgagctgaccatggagcttgaggaaaaacaggatgttttccgcagtcttcaggatacggccgaactgctctctttggaaaaccatccagctaagcagactgtggaggcttactcagcggctgtgcaaagccagctgcagtggatgaaacaactgtgtctctgtgttgaacagcacgtgaaagagaacacagcatactttcagttcttctccgatgcccgagaactcgagagttttctccgaaatctccaggattccataaagcgaaagtattcctgcgaccacaacacctcgttgagtaggctagaagatctgctccaggattccatggatgaaaaagagcagctgattcagagcaaaagcagcgtcgctagcctagtgggcagaagcaaaactatcgtgcagctgaagccaaggagtcccgatcatgtgctgaaaaatacaatctctgtcaaggccgtctgtgattatcggcaaatagagattaccatttgcaagaacgacgaatgcgtactggaggataattctcagcgaacgaagtggaaagtgatcagccccactggaaatgaagcaatggttcctagtgtctgcttcctgattccaccccctaataaggatgccatcgagatggccagtagagtagaacaatcctatcagaaggtaatggctttatggcatcagcttcacgtaaataccaagtccctaatctcctggaattatcttaggaaggatctcgacctcgttcagacgtggaacctggaaaaactacgctcctcagctccaggagaatgtcatcagattatgaagaatctgcaggctcattatgaggactttctgcaggattcaagagattctgtgctattctccgtggccgaccggctgcggctggaagaggaggtagaggcctgcaaagctcgctttcaacatctcatgaaatccatggaaaatgaagacaaagaggagacggtggccaaaatgtacatttcagaattaaagaacatccgcttaagactggaggaatacgagcaaagagtggtgaagcgcatccagtctcttgccagtagcagaaccgaccgagacgcttggcaagataatgcactccggattgctgaacaagagcatacacaggaggatctgcaacaactaagatcggatcttgatgccgtctctatgaagtgcgatagttttctccaccagtcacccagctcttcctccgttcccacccttaggtccgagctgaacctgctggtggagaagatggatcacgtttacgggctgtctacggtgtacctcaataagttgaaaacggtggatgtgatcgtgagatcaatccaggatgcggaactgctggtcaaaggatatgaaatcaagctcagccaggaagaagtggtcctggccgacttgtccgctcttgaggcccactggtccacacttcggcactggctctcagacgtgaaagacaagaactccgtgttcagcgtcctggatgaggaaattgctaaggctaaagtcgtcgcagagcagatgagtcggttgactcccgagaggaatctcgacttggaacggtaccaagaaaagggctcccaacttcaggagaggtggcatagggtaatagcccagctggaaatccgtcagtctgaacttgagtccattcaggaagttttgggggattatagagcatgtcacgggaccttaatcaaatggatagaggagaccactgctcagcaggaaatgatgaaacctggccaagccgaagacagtagagtgctctctgaacagcttagtcagcagactgctctgtttgccgagatagaacgcaatcaaacaaaactggatcagtgccagaaattttcacagcagtatagcaccatagtaaaggactatgagttgcaattgatgacttacaaagccttcgtggagtcacagcagaaatctccaggcaagcgccgccgtatgctgagtagcagtgacgccattacccaagagttcatggatctgcgcacccgctatactgcccttgttaccttgacaacacagcatgttaagtacatatcagatgccttgcgaagacttgaggaggaagagaaggtggttgaggaggagaagcaggagcatgtcgaaaaagttaaggaactgttgggttgggtgagcaccctggcccggaacacccagggcaaggcaaccagtagtgaaacaaaagaaagcaccgacatcgagaaggcgatcctcgaacagcaggtgctgagcgaggagttgacaacgaagaaagagcaggtgagtgaggccatcaaaacatcccagatcttcctggccaagcacggccacaagctctctgagaaagagaagaagcaaatttcagaacagttaaacgcattaaataaggcataccatgatctgtgcgacggctctgcaaaccagctacagcagctgcagtctcaattggcacaccagacagagcagaaggagtgccgggcagtcgccggggttatcgatctggggactgtagagattttcccgatcttcaaggctatgcagaagggcctgttggaccaggacacggggcttgttctcctcgagagccaggtcatcatgtccggcctaatcgccccagagactggggagaatctctctctcgaagagggcatcgcacgcaacctgataaatccacaaatgtaccagcagctgagggagcttcaagatgccttggccctgatatccaggctgactgagagccgtggaccactttccgtggttgaggctatcgaaaaaaggattataagtgaaaccgttggtctgaagattctggaggcccatctcgctaccggaggcttctcgctttctcccagcgaaaattgcattaatcttgaggaggccttccatcaggggctcattagcgcatggctgcacagcgtgcttgagtcatatctgcgtacctcgaaaaacctcattgatccgaacactgctgaaaagattgggctgctggatcttatgcaaaggtgtattgttcaccaggagtcagggtttaagctccttccagttaagcagcttgccggggggatggtctctttaaagtccggaaggaaagtcagcatcttcagagccgtgcaggaggggctcatcgacaggcaggtgactgtacgactgttggaggcacagttgtttgcggggggcattgtggacccacggacaggtcatcgactcactgttgaggaggctgtgagacacaaccttatcgatcaggatatggcctgtgccatcttgatccgtcagctgcaaactgggggaattatcgacaccgtcacaggacagcggctgactatcgacgaagccgtgagtaacgacctggtagccgctaagattgctttagtgatccttgaatccctgtggagtttcatgggtctcctctggccagaatcaggggagatccttcccattaccgatgcgctcgaacagggtatcgtttcaacagagttggcccataaaattctttctaatcggcaacacattaaggcattgtttcttccagctaccacagagatcctatcctggaagaaagccatcgagtccgggattttggatagagacttagccaacaacttaaagagtatatgcattccggacgtgatgccgcacatgcaactggcggacagcgccgaacagaacataaatccaggcgccgccgtcctgccttgttccaaatctcaccctaaggccaccgcctctcagtccgagaatctcctgttccagcttatgacccattcctatatcaacgttcagaacgggcagcggcttctgttgttggacaaggagctcatggaaacacttacgagcagagacgaataccaaaccagccccccaaaagttgtggaaatcggtcaccagcggcagaaaacacccgaggggctgcaagaaagtgccaacgtgaaaatctccggcacgttttcatccggatggactgtaagactgcccgagttccaatttagcagccagaataaggagtaccccgatagggaggattgcaccaccgagaaggggaaaaaaaccaccgtcgagacagaggattccagtgtggagaatccggagcaagacctgtttgtcgagcagaaggagaggaatccgaatatcgatgccctcaaagtgattaacaaagtcaaactggaggtccagcgacagctgatcggaactcaacgggaagatcagaccgcggtgagcgtccgagagaacgcatcaagaggacacttactcaccatccctccagccgaagctgagggagtccctttggttgttgacaaagatgtattttccgtcgaaacccctaagaaagagcaccagcctttacgcaacacatcattcacttgtcagaacgagcaagctcatactctggaaaccgagtacattcatgatgagactggagggagtcatattaagccacagagcaaaaagctgcaggtccaggtgaagaaaaccctcggcattaagcttgagctcaagtccgagactgacggcaacgtgcacccacttgataaaaaggagatgctcaagaagacatttctggctaaggacgatcataaggagagccaggaagcgcagaacattgccggcgggtctatgatgatgagtgaaaagacggatgaggaagatagtggcagggagattttcctgagctgcagccaccccctggagctcctcgaggaagccactctgaacgtgctgtccgcccagctactcgacgggggcatattccatgaacagaccggtcagaagctgctgctgaacgaggcaatctctcgtgggatcgtcccgagccacacggctgttaaactcatggaaaagttgaatatgtttcagggtttcttcgactctcaaacatgcgaaagccttaccacagaggaggtgataaacgaagggttgatggatgagaagctgttacataacgtgttgatggctgataaggccatctctggcgtccttgaccccagaacacaaactctgtgttcagtgaaggacgctgtgaccgtcgggctgctcgataaagagactgccacccggatccttgagcgtcaggtggtgacaggagggattattgacttgaagagggggaaaaaagtgtccgtgactttagcgtccaccctgggattggtcgacgttgccgaccagcccgagctcatcaatctcgaaaaggccagcaagggccgcgatgcggagaaaaccgtccgagagaggctcatttcattgcaaatggaaactaccggcctcattgatcctgattcaaaggcccccttaacagtggtacaatctatcgacagggggctcctggagagagaggaagccgtcagactgcttaccaagcaggtggttgatggaggcattattcatcatattagtggcatgcggctgagcgttgataacgcctttcgccatggccttataggcgaggacttggctgaaaagcttaaaagagtggaaaacctgaacatccaccagatttttaacccagaaacaaaggaaaacatcagcctgcctaaggccatcaaactggatctgattacatcagacttaaagcgcgaaatacaggaagttcaggcatttactggcaattttgtggacctgattagtggacagaggttaaccctggctgaggctaaaaaggaaggcctgctgactaacgaagcagtacttagtccaggaatgatgcatggcattgttgatcccgaaaactgtcggatagtgccatactctgaattagttaagaagtgcaaaatagatattgagagcggccagaggtatttggaagtgatcccctttagtgatataaaggatggggtgagcgacaaggtgctgactctaagccaggccatccagcttgggaaagtagactttgcttctactctcaaagtgctggaggcccaggccaatacaggtgggatcattgatactgctacaggaaagaggttgactctggcctctgccctcgaggagaagttggtggatgagaatatggttcggattattgccagccaccaggtcctaaatggcggaatagtagatatatttagcgatcagagagtaacgctcgtggaagccatagagaaacgactgatcagtccagaactagccaacatgattcagattgactcttctgaattcagtgaccatcgtgcccaaatcgaaaaacaggaagggatcgaggtgtgcgccctacaaaatgagtttcttggtaaggacatgttgatcgcctgcaaccagacggctgagatgtcttgtaataaagtggaagaaagtgaacggcttttccaggtggagaatcagagcgcacaggagaaagttaaggttcgagtttcagacggcgagcaggccaaaaagagtcgtgaaattagccttaaggaatttggctgcaaggatcaacggaagcccagaatgagctctgatgccaaagagtttatcagtatcatcaatccccataatcttaaaggcaagtcgctgggacaagtgtctctgactcacccgtacagcgagtgtgacttcaagctcaaagaagttgcccgaaataacatggggaacgataccaacgaagaacaagaaaaggccgtaactaaaatagaaattattagtcacatgaagcagagcaccagctgtttagatagtgaggaaattagagagaaccagggggaggtgattctcgaggtccaggagacatattgtgagactagcggcaagctccccagcgagcaggtcctgcagcagcccatgaatgcccgggtgaagtccaaacgggaaaaacgagaagtgatcgtagaggagtcaattagaacatgcaagccagccttcctcagtgaagagaagctgtatcaggaaaccgctatacgcgacgaacatgattcccacatcaaatcacagccacgagaaatgacatcttctgagaagggaaaagaggccgacactgagatggggttctcaatcacctttaagatcgaagaatccagttcgcaagtcgttccccaggggatcagcgttaagcacctggacgcattgacactctttagctcgaagcaggccaacgagggaaaggtcaataatttgtctctctgcctgactttgaagcccgaggagaatctgtcacgagaaatcgcctgtggcgctcagagtgagccctttccttgtatgacacccagaccggaggggttgcattatcaagagtcagacgggaaggcccaagtgaccggaccaagccaaatttccaaaaccgacaagagcttccagggcaccaccaggcaagaaaccaattaccaggactcttgggttacgtctaaaactaaagagacaaaacaccagatatctagctccaacgagtgcaaagagaagtcctaccaggaagtgtccttcgaccctgctcggggcttgaaactggaggaaatcaccgtgtcgcgtcctgattccaaagaggtacggtatctagaatttagcgatagaaaggacttgcaccatcagggctcaaaatccgatgataaactgtgcggaaccttgaagagcgaaatcgcgactcaagagcttactggcgagaagttccttgaaatggccaaccctaatgtggcagggttggaggcaggatcaatagaagacattgtgacacagaggggcagtcgcgtacttgggtcgtttctcccggagaagcttttcaagggcgtgagtcagaaagaaaacactggtcagcagaatgccattatctcccccacggttttagagacttctgaagaaaagacggtcagcttaacggtgtgctctgcggtgaaaacagaaaaaaccccccaggaaaaactaagagagagtcccggttccgagcaaacgccgttcatgaccgctcccgaggggaaggggaatggcggagtgaaccctgagcccttccgggcaactcagaatgtgtttacgaggcaactatgtctagagcacgacgaaaagctggtttcatatctgtcactgttacggaacatcgaaatgcgcaccaagcagattcagccgctcgagctcaatcttgctgagctgcaagacctcttatgccaagcgaaggtcctggaacgggaactgaaagacttgactacccttgtgtcccaagagcttgagtgtgtgaaccagattattataagtcagccccaggaagtgccagcccagctcctgaaggcgttagagaaagatgccaaaaatctccagaagagcctaagcagcgtctcagacacgtggaattcaaggcttctccactttcagaatgctgtggagatcgagaaaaccaaggtactgaatcagcacacccaactggaagggcggctgcaggatctaagggcttgggtgggcaataagaatctgatcctgaattcaaagggttctaactccgaaattgatgtggattccctgaacctctgcctacagcaatatgaggacctgaagcagccaatggcagaaaggaaggctcaattggatgctttagcctttgacattcagtttttcatctctgaacatgcacaggatctaagtccccagcagaaccgccagatgctgaggctcctgaatgagctgcaaagatcgtttcaagacattctggagcagactgccgctcaggtggacgccctccagggtcatctgcagcagatggagcaggaggctttggtgaagactttgcagaagcagcagaacacctgccatcagcaactcgaagatttgtgtagttgggtggggcaagccgagcgcgccttggctggccatcagggaaggacgacccaacaagatctgagtgcccttcagaaaaaccagagtgacttaaaggacctgcaggatgacattcagaaccgtgcgactagcttcgctacagtggtcaaggacattgagggttttatggaggagaaccagaccaagctcagtcctcgggagctgactgcacttcgtgagaagctccaccaggctaaggaacaatatgaggcgctccaggaagaaactagggttgcgcagaaagagctggaggaggcagtgacgagcgctctgcaacaggagacagaaaagagtaaagctgcaaaggaactagccgaaaataaaaagaagattgacgctttgctggactgggtcacgtctgtgggaagtagcggtgggcagctgctgactaacttgcccgggatggaacagctcagcggggcctcactggaaaaaggcgcattggacactactgatggatacatgggtgtgaatcaggcgcccgaaaagctggataaacagtgcgagatgatgaaagctcgccatcaggagctgctgagtcagcagcagaacttcatactagctacacaatctgcacaagcattcctcgatcagcacggccataacctgacacctgaggagcagcaaatgctgcagcagaaactgggggagttgaaagaacagtattcaacaagcctggcacaatcagaggctgagctgaaacaggtgcagaccctgcaagatgagctccagaagttcctccaggatcacaaggagttcgagagttggctggagcgttccgagaaggagctggaaaatatgcacaaaggcggcagttctccggaaacactgcccagcttacttaaaagacaaggctcattctctgaagacgtgatcagtcacaaaggcgatctgaggtttgtgactatctctgggcagaaggtgttggatatggaaaactcctttaaagagggaaaggaacctagcgagatcgggaatttggtcaaagataagttgaaggacgccactgaacgatacaccgctcttcatagcaagtgtacgcgattaggttcccatctcaacatgcttctgggccagtaccaccaattccagaattcagccgactctttgcaagcttggatgcaggcctgcgaagctaatgtggagaagttgctctctgacactgttgcctcagacccaggtgtactccaggagcagcttgcaacaaccaaacaattacaggaagaactggccgaacaccaggtgccggtcgaaaaactccaaaaggtagccagagatatcatggagatcgagggcgagcctgcccccgatcaccggcacgtgcaggagacaaccgactccattctgtcccattttcagtccttgagttactccctggccgagcgcagctctctgctacagaaggccatcgcccagagtcagtctgtccaggagtcactagaaagtttgctgcaaagtatcggcgaagtcgagcagaatctcgaagggaagcaggtgtcttcgctctcttcaggagtaatacaagaggctctggccaccaacatgaaactaaaacaggatatagctcgccagaagtcctcgttagaggccaccagggaaatggtcaccagatttatggagaccgctgactcaacgaccgccgcagtgctgcaagggaaactggccgaagtctcccagagatttgagcagctatgcctccaacaacaggagaaggaaagttccttgaagaagctgctgcctcaggccgaaatgttcgagcacctgagcgggaaactgcagcagttcatggaaaacaaaagtcggatgctggcaagcggtaaccaaccggaccaagacatcacccacttcttccagcagattcaggagctgaaccttgagatggaagaccaacaggagaacctggacaccttggagcacctcgtaaccgagttgagctcctgcgggttcgccttggatttgtgccaacaccaggatagggtgcagaatctacggaaggattttaccgaactccagaaaaccgtaaaggagcgcgaaaaagacgctagctcctgccaagaacagctggacgagtttagaaaactagtgcgaacctttcagaaatggctgaaggagaccgagggctctattccccccaccgagacgtcaatgagcgctaaggagttagagaaacagattgaacaccttaagagcctcctggatgactgggcctctaaggggactttagtggaagaaatcaactgcaaggggacttctctggaaaatctgataatggagatcacagcgcccgattcacaggggaaaacgggcagcattctaccgagtgttgggtcaagcgtgggatccgttaatggatatcatacatgtaaagatctaaccgaaattcagtgtgacatgagcgacgtgaacctcaagtacgagaaactgggaggagtcctacatgagcgtcaggaatccctgcaggcaatcctaaataggatggaggaggtgcataaagaagccaacagcgtcctgcagtggttagaatctaaggaggaggttttaaaaagtatggatgccatgagtagccctactaagacggaaacagtgaaagcccaagcagaatctaataaggccttcttggccgagttggaacaaaatagccccaagatccagaaagtgaaagaggctctggcggggttgcttgtgacatatcccaactcacaggaagctgaaaactggaagaagattcaagaagagttgaattcacgttgggaaagagctacagaggtcacagtggcaaggcagcggcagctagaagagtcagcctctcacttggcatgcttccaggcagccgagagccagctcaggccctggctgatggagaaagaattgatgatgggcgtgctgggaccattaagtatcgatccaaacatgttaaacgcgcagaagcagcaggtgcagtttatgctcaaagaatttgaagccagaagacagcagcacgaacaactgaacgaggccgcccaaggaattcttaccgggccaggcgatgtctctctgtctacctcacaggtacagaaggagctgcaaagtatcaaccagaaatgggtggagctgaccgacaagctaaactcacgctccagtcagattgatcaagcaatcgtgaaaagcacacagtatcaagaactactgcaggatctgagcgaaaaggtacgtgccgtggggcagcggctgagtgtgcaaagcgcgatcagcacccagcccgaggcagtgaagcaacagctggaggagacgtcagagatacgctcggacctcgagcagctcgaccatgaggtcaaggaggcccagactctgtgcgatgaactctctgtgctgatcggcgagcagtacctgaaagatgagctgaaaaaacgactggagaccgttgccctgccccttcaggggcttgaagatctggcagcagaccgcataaaccggttacaggccgcgttagcctctacacaacaattccagcagatgttcgatgagttaagaacctggctggacgacaaacaaagtcagcaggccaaaaactgcccaatatctgctaagctagagaggctgcagagccaactgcaggaaaacgaggaattccaaaagtcactgaatcagcattcaggcagttatgaagtaattgtggctgaaggggagagcctcctgctgtccgtcccaccaggcgaagagaagcggacccttcaaaatcaattggttgagctaaagaatcactgggaagagctatctaagaagacagcagatcggcagagcagacttaaggactgcatgcagaaggcccagaaatatcaatggcacgtcgaggatctcgtgccttggattgaagattgtaaagccaagatgtccgagcttcgagtgacactcgacccggtgcagcttgaaagcagcctgctgaggtcgaaggctatgctcaatgaagttgagaagcgacggtccctgctggaaattctcaattctgcggctgatattctcatcaatagttctgaagccgacgaagacggcatcagggatgaaaaggcagggattaaccagaacatggacgccgtgactgaggagctccaggcgaagacggggtctctcgaagaaatgactcagcgcctgagggaatttcaggagtcgttcaaaaacattgagaagaaagtggaaggtgcaaaacatcagcttgagatctttgacgcattgggctctcaggcatgttcgaataagaatctcgagaagctgcgggctcagcaagaagtgttgcaggcccttgagccgcaggttgactacctccgaaattttacccagggccttgtagaggatgcccccgacggatcagacgcctctcagctgctccatcaggcggaggtggcccagcaggagttccttgaggttaaacaacgtgtcaattccggatgtgtgatgatggaaaataagctggaaggcatcggtcaatttcactgccgggtgcgtgagatgttcagccagctggccgacttggatgacgaactggatgggatgggggctatcgggcgtgatactgattcattgcaatcccaaatcgaggacgtgaggctgtttcttaataagatccatgtcttgaagctcgacatcgaggcctccgaagccgagtgtaggcacatgttggaggaggaagggaccctggatttgctgggcctgaagcgcgagcttgaggccttgaacaaacagtgtgggaagctaacagaacgtgggaaggcccgccaagaacagttggagttgaccttagggcgggttgaggacttctataggaagcttaagggccttaatgatgccaccaccgcagcagaggaagctgaagcactccagtgggtcgttgggacggaggtagagatcatcaaccagcagctcgctgactttaagatgttccaaaaggaacaggtggacccactacagatgaagctgcagcaggtaaatgggttaggacaggggctcatccagagcgctggcaaagactgcgatgtccagggattggagcacgacatggaggagatcaacgccaggtggaacactctaaataagaaggtcgctcagcgtatcgcacagctgcaagaagcacttctccactgtgggaagtttcaggatgccttagagcctctactctcgtggctagctgacacagaggaactgatagcaaaccagaagcctccttctgctgagtacaaagtggtcaaggcacaaatccaggagcagaagttactgcagagactgctagatgatcggaaagccaccgtggacatgcttcaggcggaaggaggtcgcatcgcccagagcgcggaactcgctgaccgcgagaagattacaggtcaactggagagcttggaatcccggtggacagagctgctgagtaaagccgctgctcgccagaagcagctggaggatattctggtccttgcaaagcagtttcacgagaccgctgagcccataagcgatttcctgtctgtcaccgagaaaaaactcgccaactcggagcctgtaggaactcaaactgccaaaatccaacagcagattatccgccataaggccctgaatgaggaaatagttaatcgcaaaaagaatgtcgatcaggctatcaagaacggacaggccctcctcaaacagactaccggtgaagaagttctcctcattcaggagaaactggatgggatcaagaccaggtacgcagacattacagttacttctagcaaggccctgaggacgctcgaacaagcgcggcagctggccacgaaatttcaatctacatacgaagagctcacgggctggctcagggaggttgaagaagagttagccacgtctggcgggcagtcgccaaccggagagcagattccacagtttcaacagcggcagaaagagttaaaaaaagaagttatggaacatagacttgtgctggacacagtcaatgaggtgtctcgcgccctcctcgagttggttccctggcgggccagggagggcctcgataaactggtatccgacgcaaatgaacagtacaagctggttagtgacacaattggccaaagagtcgatgaaatcgacgcggctatacagaggagccagcaatacgagcaagccgcagatgctgaactggcctgggtagctgaaacaaaaaggaagctgatggcattaggacctatcaggctggagcaggaccagacaacagcccagctgcaagtgcagaaggccttttccatcgatatcatcaggcacaaagactcgatggatgagttgttcagccaccgttcggagatttttggcacttgcggagaagagcagaaaacggtcctgcaggagaagacagagtctctcattcaacagtacgaagccatttcactcctgaacagcgaacgatacgctagactggagcgggcccaggttctggtgaatcagttttgggagacatacgaggaactttccccctggatcgaggagacaagggccctgatcgctcaactcccaagccctgctatcgaccatgaacaactaaggcagcagcaagaagaaatgaggcagctccgggagtctatagccgagcacaagcctcacattgacaagttactgaagattggcccacagctgaaagaactcaaccccgaggaaggcgagatggtggaagagaagtatcaaaaggccgaaaacatgtatgcccaaataaaggaagaggtcaggcagagagctttagctctggatgaggccgtgagtcaatcgactcagattacagagtttcacgacaaaatcgagcccatgctggagaccctggaaaatctaagcagcagactaaggatgcctccactcatccccgctgaggtggacaagatcagagaatgcatctctgataacaagtcagcaacagtcgaactcgagaagttacagccctcttttgaagctcttaaacgtcgcggagaggaactcatcggacgcagccagggagcagacaaggacctcgccgcaaaagaaatccaggataaactagaccagatggtttttttttgggaggacatcaaggcacgggcagaggagagagaaattaagttcctagacgttctggaactggccgaaaaattctggtacgacatggccgcactactcactacaatcaaagacacacaagacatcgtgcacgacctagagagtcctggtatagacccttcaatcattaagcagcaggtagaagctgctgaaactattaaggaggaaacagacgggttgcacgaggagctggaattcattagaatactcggagccgacctgatcttcgcctgcggtgagacagaaaagccagaggttcgcaagtccattgacgaaatgaacaacgcctgggaaaacttgaacaaaacttggaaggaacgcctggagaaattagaagatgccatgcaggccgccgtgcagtaccaggataccctccaggcgatgtttgactggctggacaacaccgtgatcaaactatgtaccatgcctccagtagggaccgacttgaacacggtgaaggatcagcttaacgaaatgaaggagtttaaggtggaggtataccagcagcagatcgaaatggaaaagctcaaccaccaaggcgagctgatgctgaaaaaagctacagacgaaaccgaccgggacattattcgggagccactcaccgagctcaagcacctgtgggagaatctcggcgaaaaaattgcccatagacagcataagttggagggcgcactgctggctctcggccagttccaacatgctttggaagaactcatgtcatggttaacgcatactgaagagcttcttgatgcccagcggcctatttcaggtgatcctaaggtgatagaagtggagttggccaagcatcatgtgttgaagaatgatgtgctggcccatcaagccaccgttgagactgtcaataaagcaggcaacgagctgctcgagtcttccgcgggagacgacgccagtagcttgcgctcccggcttgaggccatgaaccagtgttgggaaagtgtgctccaaaaaacagaggagcgagaacaacagctgcagagtaccttgcaacaagctcagggttttcactccgaaatcgaagatttcctgctggaactgacccggatggaatctcagttgtcggcttcgaaacctaccggcgggcttccagaaacagccagagaacaattagacacccatatggagctgtattctcagctgaaagcaaaggaggagacttacaaccagctgctggataaggggcgtctcatgttgctgtctagagatgactcaggatcaggctcgaaaaccgaacagagtgtggccctgctcgaacagaaatggcatgtggtgtcgtctaagatggaggaaaggaagtctaaactcgaagaagctttgaatcttgccactgaattccagaactcattacaagagttcatcaattggctgaccttggcggagcagagccttaatatcgcaagccctcccagtctcattctgaacaccgtcctgagccagatagaggagcataaggtgtttgccaatgaggtcaacgcccatcgagatcagataatcgagctggaccagactgggaatcagctcaagttcctgagtcagaagcaagacgtagtcctgattaaaaatctgctcgtttccgtccagtcccgatgggagaaggtagtgcaacggtccatcgaacggggccgctctctggatgatgcccgcaaacgcgcaaaacaattccacgaggcctggaagaaacttatcgactggctagaagacgccgaatcccacttggactccgaactggaaatctccaacgatcccgacaagatcaaactacagctttcaaaacacaaggaatttcagaaaaccctcggcggaaaacagcctgtatatgataccacgatccgcaccggcagagcccttaaagagaagacacttctcccagaggacagccaaaagctcgacaactttcttggagaggtccgagataagtgggataccgtgtgcggaaaatctgtggaaaggcaacataaattggaagaagcgctcctctttagtggacagttcatggacgccttacaggctctggtggattggctctacaaggttgaaccacagctggcggaagatcagcctgtgcatggagatttggacctggtgatgaatctgatggacgctcataaggtgttccagaaggagctcggtaaaaggaccggtacagtgcaggtgctgaagcgttccggacgcgagttaatcgagaacagcagggacgatacaacctgggtgaagggacaactgcaggagctctccactcgctgggatactgtgtgcaagttatcagtcagcaaacagtcacgccttgagcaggctcttaaacaagctgaagtttttagggacactgtccacatgttactggagtggttatcggaagccgagcagacactgcggtttaggggcgcactgccagacgatacagaggccttgcagagcctgattgacacacacaaagaatttatgaagaaagtagaggagaagagagtggatgttaattccgctgtggcgatgggggaagtgattctcgccgtgtgtcacccagattgcatcactactatcaaacattggatcacgattatccgcgctagatttgaggaagtcctgacgtgggcaaagcagcaccagcagcggctcgaaacagctttgagcgaactggttgccaacgcagagcttctcgaagaactgctggcttggatccaatgggcagagactaccctaatacaaagggaccaagagccaatcccccagaacatagacagggtgaaggccctcatagccgagcatcagaccttcatggaggaaatgaccagaaagcaacctgacgtggatagggtgactaagacctacaaaaggaaaaatatcgaacccacccacgcccccttcatcgagaagagccggagcgggggccggaaaagtctgtcacaaccgacccctcccccaatgcctattctatcccagagtgaggccaaaaatcctcgcattaaccagctatctgcccgttggcagcaagtgtggctattggctctagaaagacaacggaagctaaacgatgctctcgatcgcctggaggagctgaaggagttcgctaacttcgactttgacgtgtggaggaaaaagtacatgcgttggatgaaccacaaaaaatcaagagtgatggacttctttcgtagaattgacaaggatcaggatgggaagataacgaggcaagagtttatcgatggcattttagcttccaagttcccaacaaccaaactggagatgaccgcagtggccgatatattcgacagagatggtgacggctatattgattactatgaatttgtggctgcgttgcacccaaacaaagatgcctacaggcctactacggatgccgacaagatagaggacgaagtgacccgccaggtagcccagtgtaaatgtgctaaaaggttccaggtcgagcagatcggcgaaaacaaataccgatttggcgacagccagcagctacggctagtgcggattctgaggtcgaccgtcatggtgagagtgggaggtggttggatggcactcgatgagtttctggtcaagaacgatccatgccgagcccggggtcggaccaacattgaactgcgcgagaagttcatcctccctgagggcgcctcacagggaatgacacctttcagatctaggggaagaaggtctaagccgtccagtagggcggccagccccaccagatcatccagtagtgccagccagagcaaccacagctgtacctcaatgccaagctctcccgctaccccagccagcgggactaaggtgatccctagctctggctcaaaactgaagcgtcctaccccaacattccatagctctcgtacctccctagcaggtgatacctcaaattcctcgagtcctgcctcaaccggagctaaaactaaccgagcagatcccaaaaagtcagcctcccggcccggtagccgtgcgggctctagggcaggatctagggcctcttcaagacgtggatcagatgcgtccgacttcgatctcctcgaaacgcaaagcgcctgttcagatacttctgagtcctccgccgcaggcggtcaggggaatagcaggcggggcttgaataaaccaagtaagattcccaccatgtctaagaaaacaacaaccgcatcaccaagaacccctggaccaaagcggtag

SEQ ID NO: 124350 - DNA, 1155 bp, Artificial Sequence
  Description of Artificial Sequence: Synthetic coding sequence
atcacatctccctgggcccctcgtcctagctgttcttcaccatgggccatgtcaagcagcgacgaggagactctgagtgagcgttcttgtcgctctgaaagatcctgccgctcagagagatcctatcggtctgagcggagcggaagcctctccccatgtcccccaggagacacactgccttggaatcttcctctgcatgaacagaagaagcggaaaagtcaggattccgtcctggatccggccgagagagctgttgtgagggtagcagatgagagggatagggtccagaaaaagacattcaccaaatgggtgaacaagcacctcatgaaggtacgcaagcacatcaacgacctgtacgaggacttgagggacggccacaacttgatttccctcctcgaggtgctttccgggatcaaactgccaagagaaaaaggtagaatgcggtttcacagactacagaacgtgcagattgcattggactttctgaagcagaggcaggtgaaacttgtcaatattcggaacgacgacatcactgatggaaacccaaaactgaccctcggactgatctggaccattatcctacattttcagatttcagatatttatatctccggggagtccggcgacatgtccgccaaggagaagctgcttttgtggacccagaaggtgactgctggttacacaggcattaagtgcacgaatttctctagctgttggtctgatggaaagatgttcaatgcccttatacaccggtacagacccgatctcgtggatatggagcgagtgcagattcaatccaaccgggaaaatctcgagcaggccttcgaagtggccgagaggctcggagtgacccggctgctggacgccgaagatgtggacgtgcccagcccagatgagaaatctgtaattacctacgtgtcatccatttatgacgcatttcccaaagtgcccgagggcggagagggaatctcggctaccgaggtcgactctcggtggcaggagtatcagtcccgggtggactctctgatcccttggatcaaacagcacaccattttgatgtctgataagacttttccccaaaacccagttgaattaaaagcactctacaaccagtacatacatttcaaggagacagaaattttggccaaggagtag

SEQ ID NO: 124351 - DNA, 603 bp, Artificial Sequence
  Description of Artificial Sequence: Synthetic coding sequence
atgcctctcctcgactcctcctacttgccacccaccatctttattctcacacacgtgctgggagtggccggcgtgctgtactggaagcggcatgcccgggggagggcagacgagagggatcgggtccagaagaaaacgtttactaaatgggtcaacaagcacctcatgaaggtgcgtaagcatatcaatgatctatatgaagatctgagggatggccacaacctcatttccctgctggaggtcctgtctggcattaagctgccaagagaaaagggccggatgagatttcacaggcttcaaaacgtgcagattgccctggattttttaaaacagagacaagttaagcttgtcaacattcgcaatgatgatattactgatggaaaccctaaactgaccctgggattaatctggaccattatactgcattttcaaatcagcgatatctatatttccggtgagagtggagatatgtctgcaaaggaaaagttgctgctgtggacacagaaggtcacagcgggatacactggcattaaatgcaccaacttcagtagttgctggtctgatgggaagatgttcaacgccttgatacaccggtatagatag

SEQ ID NO: 124352 - DNA, 15903 bp, Artificial Sequence
  Description of Artificial Sequence: Synthetic coding sequence
atgtcaagcagcgacgaagaaaccctcagtgagagatcttgcagaagtgagaggagctgtcgtagcgagaggtcctaccgctccgagcgttccggtagcttaagtccatgtccaccaggagataccctgccttggaacctgccgctgcacgagcagaaaaagagaaaatctcaggactctgtgttggatcctgccgaacgcgcggtcgtgagggtagccgacgaaagagatcgggtgcagaagaagacgtttaccaaatgggtcaataagcacctgatgaaagtccggaaacatatcaacgatctgtatgaggaccttcgcgacggacacaatctcatctccttgctggaggtcctatctggaattaaacttcctcgcgaaaagggaagaatgcgattccacaggctccaaaacgtgcagatcgccctggactttctaaaacagagacaggtcaagctcgtgaatattcgcaacgatgacatcaccgacggcaaccccaaattgactctgggcctcatatggaccataatactgcactttcagatatctgacatctatatctcgggagaaagcggagatatgagtgcaaaagagaagcttctcttatggacgcagaaagtaactgcgggctatactggaatcaaatgcaccaatttcagttcgtgttggtctgatggaaagatgtttaacgcgctgatacaccggtaccggcccgatctggttgacatggaacgtgtgcagatccagagcaatcgggagaacctggagcaggcgttcgaagtggctgagcgcctcggagttacacgactgctggacgctgaagatgtggacgtacccagccctgatgagaaaagcgtgatcacatatgtcagctcaatttatgatgcctttccgaaagtgcccgaaggcggagaaggcattagcgcaaccgaggtggatagtcggtggcaggagtaccaatccagagtggattctctgattccgtggattaagcaacacaccatcctgatgtctgacaaaacgttcccccagaatcccgttgagctcaaggccctgtataaccagtacatccacttcaaagaaacagaaatcctcgcaaaggaaagggagaaaggcagaatagaagaattgtacaagttactggaagtctggattgaatttggaaggatcaagctgcctcagggatatcaccctaacgacgtcgaggaagaatggggcaagctgatcatcgaaatgctagaacgcgaaaaatccttacgaccagctgtagagagactggaattgctgctgcaaatcgccaataagattcaaaacggcgctcttaactgtgaagagaagctgaccttggcaaaaaacacattacaggccgacgcggcacacctcgaaagcggccagcccgtgcagtgcgagtctgacgttattatgtatatacaggagtgtgagggcctgatccgacagctccaggttgacctgcagatcctgcgtgatgagaactactatcagttggaggagctggcattccgagtcatgcggcttcaggatgagctagtgaccctgcggttggagtgtacaaatctctataggaagggacactttaccagtctcgagctggtcccaccgtctacactaacaactacccatcttaaggccgagccactcaccaaggccacccattcttcaagcacctcgtggttcagaaagcctatgacccgcgccgagctcgtggccatttcatcctctgaggacgaaggaaacttgagattcgtctatgaacttctaagctgggtggaggagatgcaaatgaagcttgagcgtgctgagtggggcaatgatctcccgtcagtggaattgcagcttgagactcaacagcatatccatacgagtgtggaggaattagggtccagcgtgaaagaagccagactctatgagggcaaaatgagccaaaacttccacacctcctatgccgagacactggggaaactagagacccaatattgcaagttgaaagaaacttcttcattcaggatgcgacatttacagagtttgcacaaatttgtgtcacgcgcaacggctgagctcatttggctcaatgaaaaggaagaggaggaactggcttacgactggtccgataacaacagcaacatcagcgctaagcgaaattatttctctgagctgacaatggagttagaagaaaaacaggacgtgttccgctctctccaggacacagcagagctcctgagtctggagaatcatccagcgaagcagactgttgaagcatactcagcggctgtgcagagtcaacttcaatggatgaagcagctctgtctgtgtgtcgagcagcacgtgaaggaaaatacggcttatttccaatttttctcggacgctcgagaactcgaatcttttctacggaaccttcaggactctatcaagcgaaagtactcatgcgatcataacacctctctgtcacgactggaggatctcctgcaggactctatggatgagaaggagcagctaatacagagtaagagttcggtagcgagcttggtgggccgaagcaaaaccatcgtccagctgaagccacgctccccagatcatgttctgaaaaataccattagtgttaaagccgtctgcgactacaggcaaattgaaattactatctgtaaaaacgatgagtgcgttctagaggataacagtcagcgcacaaagtggaaggtgatatctccaaccggaaatgaggccatggttcctagtgtgtgtttcttgatcccgccgccgaataaagatgccatcgagatggcatcacgagtagaacagtcctatcagaaggtgatggctctgtggcatcagttgcacgtaaatacgaagagcttaatttcctggaactatctgcgaaaggatctggatctggtccagacatggaatttggagaagctgaggtcctcagccccgggagaatgccaccaaattatgaaaaatctgcaagcccattacgaggattttcttcaggattcccgggacagcgtcctgttctccgtggcagatcgcttaaggctggaggaggaggttgaagcctgcaaagccaggttccagcacctaatgaaatcaatggaaaatgaggacaaggaggaaaccgtggctaaaatgtatatctcagaactaaagaatattcgcctgagacttgaagagtacgagcagcgcgttgttaagaggatccagagcctcgcctccagccggactgatcgcgacgcctggcaggacaacgcactgcgaatcgctgagcaagagcacactcaggaagatttacagcaacttcgaagtgatctcgatgccgtaagcatgaagtgcgactccttcctgcatcagagcccgtcttcgtcaagtgtccctactttacgaagtgaattaaatcttctggtcgaaaagatggaccacgtgtatggactttcgacagtctatctgaacaagcttaaaactgtggacgtcatcgttagaagcatacaggatgcggaactcctggtcaaaggatatgagattaaattgtcccaggaggaggtggtactggcggatctgagtgccctcgaagctcactggtcgactctgcgtcactggctctctgacgtcaaagacaagaattccgtgttcagtgtgctcgacgaggagattgccaaggctaaagtggtggccgagcagatgtcaaggctgacacccgaaagaaacctagacctcgagcggtaccaggaaaaagggtctcagctccaggaaaggtggcatcgagtcattgcccagctggagatacgtcagtcagaactggagtcaatccaggaggtgctgggggactaccgcgcctgccatggtacattaataaaatggattgaggaaactacagcccagcaggaaatgatgaagccaggacaggccgaagatagtcgcgtgctgtctgagcaactctcacaacaaaccgctcttttcgccgagattgaaagaaaccagactaaactggaccagtgtcagaagttcagtcaacaatattctacgatcgtgaaagactacgaattgcagctgatgacttataaggcgtttgttgagagtcagcagaaaagccccggtaagaggcgaaggatgcttagtagcagtgacgccatcacacaggagttcatggacttgaggactcgttatacggctctggtgactctgactacgcagcatgtgaaatacatttccgatgcattacgccgcttagaagaggaggaaaaggttgtcgaagaggagaagcaggagcatgtggagaaggtgaaagagctattaggatgggtttccacacttgcgagaaatacacaagggaaagctacatcctcagaaaccaaagagagcacagacatagagaaagctatactcgagcaacaggtgctgtcggaggaattgactacgaaaaaggagcaggtgtctgaggccattaagacctctcagatcttcctagccaagcacggacacaaactctccgagaaggagaagaagcaaatcagtgaacaacttaacgctttaaataaggcttatcacgacttgtgtgacggtagcgccaaccagctgcagcaactccagagccagttagctcaccagactgaacagaagaccctgcaaaagcaacagaatacttgtcaccagcagctcgaagacttgtgtagttgggtgggtcaggcagagagagcgctggccggccaccagggtcggaccacacaacaggacctgagtgctctccaaaagaaccaatccgatctgaaggacctgcaggatgatatccaaaacagggccacgtctttcgctaccgtcgtcaaagacatcgaaggtttcatggaggaaaatcagactaagctctcccctcgggaactgaccgctctccgcgaaaaactgcaccaggctaaggagcagtacgaggcccttcaggaagagacaagggtggctcagaaggagctggaagaagccgtcactagcgcccttcagcaagagactgagaaaagcaaggcggccaaggagcttgccgaaaataagaaaaagattgacgctcttctggattgggtcacctccgtcgggagcagcggcggtcaactgctcaccaacttgcctggaatggagcagcttagcggtgcaagtcttgagaagggcgccttagacaccaccgatggctatatgggtgtaaaccaggcccccgaaaaactcgataagcagtgcgaaatgatgaaagcccggcatcaggagctactctcccagcagcagaatttcatccttgccacgcagagtgcccaggctttcctggatcagcacggccataacctgacaccagaggaacaacagatgcttcaacaaaaactgggcgaactgaaggagcagtatagtactagtctagcacaaagcgaggcggagctgaagcaggttcagaccctgcaagatgaattgcaaaagtttcttcaggaccataaggagttcgagtcatggctggagcgatccgagaaagagctagagaatatgcataagggcggctcctcgcctgagacactgccaagcctattaaagaggcagggctctttttccgaggacgttatatcccacaagggagacctccggtttgtgacaatatccggccagaaagttctggacatggaaaactcattcaaagagggcaaggaaccctctgagatcgggaacctggtcaaggacaagttgaaagatgctaccgagcgctacaccgcactgcattccaaatgtacaaggcttggtagccacctgaacatgcttctgggtcaataccaccagtttcagaacagcgctgacagcctgcaggcgtggatgcaggcatgtgaagcgaacgtcgaaaaactcctgtcagacaccgtggcaagtgaccctggcgttcttcaggaacagctggcgaccacaaaacagctacaggaagagttggctgagcaccaggtgccagtcgagaaactccaaaaggtggcacgtgatattatggagatcgaaggtgaacccgctcccgatcaccgacatgttcaggagaccactgacagcattttgagtcattttcagtcattaagctactctttagctgaacgctcttccctcctgcagaaagcgattgcccaaagccaatctgtgcaggagagcttagaatcactactgcaatcaattggagaggtcgaacagaatctggaaggcaagcaagtctcatctctttcttccggggtcatacaggaggccctcgctactaacatgaagctgaagcaggatattgcacggcagaagtctagtctggaggcaacgcgcgagatggtgacaagatttatggagactgcagacagtacgacagcagctgtcctgcaaggaaagctggccgaggtcagccaaaggtttgagcagttatgcctgcagcagcaggagaaggagtcctcgctcaagaaactactgccccaggccgagatgttcgagcatctgtccgggaaactccagcagtttatggaaaataaaagtcgcatgttggcaagtggaaaccaaccggaccaggacatcactcacttcttccagcagattcaagagttgaatctcgagatggaggaccagcaggagaatcttgataccctggagcatctggtcactgaattgtcatcctgcgggtttgcactggacctgtgccagcaccaggatagggttcaaaacctgaggaaggacttcacggagctgcaaaaaacagtcaaagagagggaaaaagacgcctcctcttgtcaagaacagctagacgagtttcgcaaactcgtgcgcaccttccaaaaatggctgaaggaaacagaaggctcaattccaccaaccgagaccagcatgtctgccaaagaactggaaaaacagatcgagcatcttaaatcccttctcgatgattgggcctccaagggcaccctggtggaggaaatcaactgtaagggcacatccttagaaaatttgatcatggagataactgcccccgattcccaaggcaagaccgacctgacagaaatccagtgtgatatgagcgatgtgaacttgaaatatgaaaagcttgggggggtccttcacgaaagacaggagtcgttgcaggccattctcaatcgtatggaggaggtccacaaagaggccaacagcgtgctgcaatggttggaatctaaggaagaggtactcaagtccatggacgccatgagttcccctaccaaaactgagacggtgaaagcccaggctgaatcaaacaaggcattcttggctgagcttgaacaaaacagtcctaagatccaaaaggtgaaggaggccctcgcaggtctcctggtgacctaccccaatagtcaagaagctgagaactggaaaaagatccaagaagagttgaactctaggtgggagagagccacagaagtgacagtcgcgcggcaaaggcaactcgaggaatccgccagccacctcgcatgttttcaggccgcagagagccagctcagaccttggctcatggaaaaagagcttatgatgggggttctggggccactgtccattgacccaaacatgttgaatgcacagaagcagcaggtccagttcatgctcaaagagttcgaggccagaaggcaacagcatgagcaactgaacgaagctgcccagggcatcctcactgggccaggggatgtttctctcagcaccagtcaagtacagaaggagttacagtcaatcaatcagaagtgggtggaattaacagacaaactcaactctcgcagttcccagatagaccaagctatcgtgaaaagcactcaatatcaggagctgttgcaagacctctcagagaaagttagagcggtgggacaaaggctgagcgtgcaatctgccatatcaacccagcccgaagccgtgaagcagcagctcgaggagacatccgagatacgttccgatctcgagcaacttgaccacgaagttaaagaagcccagacactatgtgacgagctgtctgtactgataggagaacaatatctgaaggacgagttaaagaaaaggctggaaacggtcgcactacctctgcaagggctggaagatcttgcagccgaccgaataaatagactacaagcagcactggccagcactcaacagttccaacagatgtttgacgagttgagaacttggctcgatgataagcagtctcagcaggcgaaaaactgccctatctcagccaagctagagcgcctgcagtcccaactgcaagagaacgaagagttccagaaatctctgaaccagcacagcggcagttacgaggtgattgtggcagagggagaatccctactgctgagtgttcctcccggggaggaaaaaaggacacttcagaaccagctggtggagctgaagaatcactgggaagaactgagcaagaagactgccgacagacagagccgactgaaagactgcatgcagaaggcccagaagtatcaatggcacgtggaggatcttgtgccttggatcgaagattgcaaagctaaaatgtctgagctgcgcgttactctggaccccgttcagctggagtcgtcactcctgcgcagcaaggctatgctgaatgaagtagagaaacggaggtccctgctggaaatcctgaattctgcggccgacattctgataaattctagtgaagctgatgaagatggtattcgcgatgagaaggcaggtataaaccagaatatggatgccgtcacagaagaactgcaggccaagacaggctctttggaggagatgacacaaaggctgcgcgagttccaagagagtttcaagaatatagagaagaaagtggagggcgccaagcaccagctggagatttttgatgctcttggatctcaggcgtgttcaaataagaaccttgagaagctacgcgcacagcaggaagtgctgcaggccctcgagccacaggtggactaccttcgcaactttacacaggggctcgtggaggatgctcccgacgggtcagacgcttcccagctgttgcatcaggccgaggtggcacagcaagaattcctggaggttaagcagcgagtgaattctggctgtgtgatgatggagaataaactggagggcattgggcagttccactgccgggttagggaaatgttttctcaactcgcagacttagacgacgagcttgacggtatgggggctatcggcagggacaccgattcactgcagagccagattgaggacgttcggctctttctgaataaaatccacgttttaaagctagacattgaggcttctgaggctgagtgcagacacatgctggaggaagagggaactttggatctcctgggcctgaagagagaactggaagccctcaacaaacaatgcggtaagcttacggaacgggggaaagcccgccaggagcagttggagctgaccctgggtcgggtggaagacttttaccgcaagcttaagggactcaacgacgctacgacagcagcggaagaggccgaagctctgcagtgggtggtaggaactgaagtggaaattatcaatcaacagctggccgacttcaagatgtttcagaaagagcaggttgaccctctgcagatgaagctgcagcaggtcaatgggttaggccagggactcattcagtccgcaggaaaggactgcgatgttcaggggctagagcatgacatggaagaaataaatgctcgatggaacacgctaaacaaaaaggtggcccagcgcatcgcccagctgcaggaggcccttctgcattgcggcaaatttcaagacgctcttgaacctttgctgtcctggctggcagacaccgaggaactcattgctaatcagaagccccctagcgccgagtacaaagttgtaaaagcccaaatccaagagcagaaactgttacaacgactcctcgatgatcgcaaggccaccgtggacatgctacaggcggaaggcggccggattgctcagtccgccgaacttgcagatagggaaaaaattaccggacagttggaatctctggagtcccggtggaccgagctgctgtctaaagctgctgccaggcaaaagcaactcgaagacatacttgttctggccaagcagttccacgagaccgccgaaccaatctcagattttctctcggtgacggagaagaagctcgcaaatagtgagccggtcgggacacagaccgcgaagatccaacagcaaataatccggcacaaggccctgaatgaggaaatcgttaaccgtaagaaaaacgtggatcaggctattaaaaatgggcaggcccttctcaaacagactacaggtgaagaggtgttgctgatacaggaaaagctcgatggcatcaaaactagatatgctgatattaccgtcacctcttccaaagctctgaggaccttggagcaggcccgccagctcgctaccaagttccagtcaacttacgaggagctgaccggatggctaagggaagtggaggaggagctggcgacaagcggcggacagagtcccaccggtgagcagatcccccagttccagcagcgacagaaggagctaaagaaagaggtaatggagcaccgactagtgctcgacacggtaaacgaagtgtcacgggcactgttagagctggttccatggcgcgcacgtgaggggttagacaagctggtctctgacgcaaacgagcagtacaagttggtgtccgacacaattggacagagggtggacgagatcgatgcagcgatccaacgctctcaacagtacgaacaggcagccgacgccgagctagcctgggttgctgaaactaagcgcaaactcatggccctcggtccaattagactcgagcaggaccaaaccacagctcaattgcaggtccagaaggccttctcgattgacattatacgacataaagacagcatggacgagttgttttctcacaggtcagagatcttcgggacctgcggggaggagcagaagaccgtgctgcaggaaaagaccgagtccctaattcagcagtacgaggccatctccctgctgaactcggagaggtatgcccgactcgagcgcgcccaggtcctcgttaaccaattttgggaaacatatgaagaattgtcgccttggatcgaggagacaagagccctgattgcccagctgccctcaccggctattgatcacgagcagctgcgccagcaacaggaggagatgcgacagctgcgtgagtctatcgccgagcataaaccccatatagacaagttgctgaaaattggcccccaactaaaggagttgaaccccgaggaaggggagatggtggaagagaaatatcagaaggctgaaaacatgtatgctcaaatcaaggaagaggtgcgccagcgcgctctggccttggatgaagccgtgtcccagagcactcaagtttcccagttccacgacaaaatcgaacccatgcttgagacacttgaaaatctgtcaagcagactgcggatgccgcctctgattcctgcggaagtggacaagatcagagagtgtatttctgataataagtccgcgaccgttgaactggagaagttacagccaagcttcgaagctctgaaacggagaggagaggagctaatcggcagatcccagggagcagacaaagatttggccgccaaagagatccaggacaaattggatcagatggtctttttctgggaggatattaaagccagggccgaagaacgggagattaagtttcttgatgttctggaactcgccgaaaaattctggtacgacatggccgccctccttacaaccattaaagacacacaggacattgtgcacgacttggaatcaccaggcattgatccttctattattaagcagcaagtggaagctgcggaaacaattaaggaagaaaccgacggccttcatgaggagctggagttcataaggatcttgggggcagacctcatcttcgcttgcggagaaacagagaagcccgaggtgaggaagtccatcgatgaaatgaacaatgcatgggaaaacctcaacaagacttggaaagagcggttggagaagctggaagacgcgatgcaggctgctgtgcagtatcaagatacacttcaagccatgttcgactggttggacaacaccgtcattaaactgtgcactatgcccccagtgggtacagaccttaacaccgtgaaggaccaactgaatgagatgaaagagttcaaagtggaagtgtatcaacagcagatcgagatggagaagttgaatcaccagggagagctgatgctgaaaaaggccacagatgaaacagacagagacataattagggaacccttaacggagctcaaacatctgtgggaaaacctcggtgaaaagatcgcccacaggcagcataaactggagggtgcactgctggccctagggcagttccagcacgcccttgaagagctgatgagctggctgacccatactgaggaactactggacgctcagcgcccgataagcggggaccccaaagttatcgaggtcgaacttgctaagcatcacgtcttgaaaaatgatgtgctcgcgcaccaagccaccgtcgaaaccgtgaacaaggccgggaacgaattgctggagagctcagccggtgacgacgccagctccctgagatctcggctagaagctatgaatcagtgctgggagagcgtcctccagaaaactgaagaacgggagcagcagctccaatcaacactgcagcaagcccagggcttccactctgagatagaggatttcctcctggagttaacccgcatggagtctcaactgtcagcgtctaaacctacaggaggactgccagaaacagcaagagaacaactggatacgcacatggagctgtacagccagcttaaggctaaagaggagacttacaatcagttgttagataagggccgcctcatgttactgagcagggacgattctgggtctgggtcaaaaacagaacagtcagtggcgctgctggagcagaagtggcacgtggtgtccagcaagatggaggaacggaagtccaagctcgaggaggcactcaacctcgctaccgaattccaaaacagcctgcaggaattcatcaactggctgacccttgctgaacagtctctcaatatcgcctccccaccaagtctcatactgaatacagtgctgtcccagattgaggaacacaaggtgtttgctaatgaggtcaacgctcaccgcgaccagatcatcgagctggaccagaccgggaaccaattgaagttcttaagccagaagcaggacgtcgtcctgatcaagaatctgctggtcagcgtacagtcccgctgggagaaagtagtacagcggtccattgaacggggacgcagtttggacgatgcacggaaacgagccaaacagttccatgaggcctggaaaaaactgattgattggctcgaggatgctgagagtcatctagacagtgagctcgaaatttcgaatgatccagataagataaagctgcaattaagcaagcacaaggaattccagaagacacttgggggaaagcagccggtctacgataccacaattcgaacaggcagagcccttaaggagaagaccttacttccagaagattcgcagaaattggataacttcttaggggaagttcgcgataaatgggataccgtgtgcggaaagagcgtagagaggcaacacaagctggaggaagcccttcttttttccggccaattcatggatgcgctccaggctctcgtagactggctatacaaggtcgaaccacagttagctgaagatcagcccgtccatggtgacttggacctggttatgaacctgatggacgcacacaaagtgtttcagaaggaactcggcaaaaggaccggcacagtacaggtcctgaaacgctccgggcgtgaactcattgagaatagcagagacgacacaacatgggtcaagggacagctacaagagctctctactcggtgggataccgtttgcaagctctccgtttctaagcagtcccgcttagaacaggcgttgaaacaagccgaagtgtttcgagacacagtgcacatgttgctcgaatggctctctgaggccgaacaaacattacgctttcggggagccctgccggacgataccgaagctctgcagtccctgattgacacccacaaggaattcatgaaaaaggtggaggaaaagagagtggacgtgaatagcgccgttgcaatgggcgaagttattttggcagtgtgccaccccgattgtatcacaaccatcaaacattggatcacgattattcgagctcgcttcgaggaagtgctcacatgggccaaacagcatcagcagagattagaaactgctctcagcgagcttgttgcgaacgcagagctacttgaggagttgcttgcctggattcaatgggcagaaaccacactcatccagcgagaccaggaaccaattcctcaaaacatagacagggtgaaggccctgatcgccgaacatcagacttttatggaagaaatgactaggaagcagccggatgtggatcgcgtgaccaaaacatataagcgtaaaaatatcgagcccacgcatgctcccttcattgaaaagagtagaagtggaggtcgaaagagcctcagccagccaactcccccaccgatgcctatcttgtctcaaagcgaggccaaaaatcctcggattaaccagttgagcgcccgatggcagcaggtttggttgcttgccctggagcgccagcggaagcttaatgatgctcttgacagactggaagagctaaaagaattcgccaattttgattttgacgtctggcgaaaaaagtacatgcgatggatgaatcacaaaaaatcgcgcgttatggattttttcaggcgaatcgataaggatcaggatgggaaaataacaaggcaggaatttatcgatggtattttagcgagtaaatttcctaccaccaagcttgaaatgactgctgtggcagacatattcgatagggacggagacgggtacattgactattatgagttcgtagctgcactgcaccccaacaaagatgcctatcggccaaccactgacgcagacaaaatcgaggacgaggtaactaggcaggtagcccagtgtaagtgtgcaaagagatttcaggtggagcagatcggtgagaataaatatagattcggcgattctcaacagttgaggctcgtccgaatacttaggagcacagttatggtaagagtgggaggcggctggatggccctggatgagttccttgttaaaaacgacccatgcagggcccggggacgcactaacatagaactgagggagaaatttattctccctgagggcgcctctcaaggcatgacccctttccgtagccgtggtcgccggtcgaaacccagttctcgagcagcaagcccaacgaggtcttccagcagcgcgtctcaaagtaatcactcctgcacttccatgcctagtagtcccgctacacctgcctctgggacgaaggtcataccttcatctggctcaaaactcaagcgccctacaccaacattccacagtagcaggaccagcttggccggtgatacaagtaattcttcctcgccagcctcaacgggcgccaaaacaaatcgcgcagaccccaagaaatccgcctcccggcccggctctagggcagggtctagagccggctctcgtgctagcagtcgtcgcggcagcgacgcatccgacttcgacctcctggaaacccagagtgcttgctccgatacttccgaaagttcagccgctggggggcagggaaattcccggcggggtttaaataaaccatcaaagatcccaaccatgagcaaaaagaccaccaccgcgagcccgagaacccccggcccaaaaaggtag

SEQ ID NO: 124353 - DNA, 1035 bp, Artificial Sequence
  Description of Artificial Sequence: Synthetic coding sequence
atgacagccgtcgcagacatttttgatagggacggcgacggctacatcgactactacgagttcgtcgctgccctccaccccaacaaggacgcctacaggccaacgacggatgctgataagatcgaagatgaagtcacccgacaagtcgctcagtgcaaatgtgcaaagcgattccaggtagagcaaatcggggagaataagtatagattcggggatagccagcagttgagactggttagaatactgcggtcaaccgtgatggtgagagtggggggagggtggatggcactcgacgagtttctggtgaagaatgatccttgtagggcacgaggcaggaccaacattgagctcagggagaaatttattttacccgaaggggcttctcaggggatgaccccatttagaagcagagggcggcgcagcaagcctagtagtcgcgctgctagccccaccagatcaagtagttcggcttctcagtctaaccatagctgtacatccatgccaagcagtccagccacgcccgcatccgggaccaaaacttcactgcagttctctcggtgctatgataaaccctggttagtcaactcaaaagcagggacccctatccgcgactctcacagtcccgatctacagctgcccaccccagaggtcatcccaagcagcggcagtaagctgaagcggcccaccccgacatttcacagctccagaaccagcttggcaggggatacgagcaatagctcatcgcctgcctcaactggcgccaaaactaatcgcgccgatcccaaaaaatcggccagccggcctggtagccgcgcagggtcccgagccggttcgcgtgcatcatctcggagagggagcgacgcgagcgatttcgatctgctggaaacccaatcagcttgcagcgataccagcgaaagctcggccgcgggcggacagggtaacagtagacgggggctgaataaaccatctaaaattcccacaatgagcaaaaaaacaaccaccgcctcccccagaactcccggccccaagcgatag

SEQ ID NO: 124354 - DNA, 16293 bp, Artificial Sequence
  Description of Artificial Sequence: Synthetic coding sequence
atgagttctagcgatgaggaaaccctgagtgaacggagttgccgaagcgaacgctcctgccgctccgagcggtcataccgatcagagcgttctggctcattgtccccctgtcccccgggcgatacactcccatggaatttacccctgcatgagcagaaaaaaaggaagagtcaggactccgttctcgatcctgcagagcgggccgtagttagagtcgccgacgaaagagatcgggtgcagaagaagacattcaccaagtgggtcaataagcatctgatgaaggtaagaaagcatataaatgatttgtacgaggacctgagggatggacataacctcattagcctgctggaggttcttagcggcattaaactgcctcgggaaaagggcaggatgcggttccacaggctccagaacgtacagattgcccttgattttctcaaacagagacaggtaaaactggtcaatataaggaatgacgacattaccgacggcaatccaaagctcacactcggcctgatttggaccatcatccttcatttccaaataagtgacatctacatctccggcgagagcggcgacatgagcgccaaggaaaaactattgttatggactcagaaagtcactgcaggttacaccggaatcaaatgtactaacttcagttcttgctggtccgacggaaaaatgtttaacgcactcatacaccgatacagacccgaccttgtcgacatggagagggtgcagattcagtctaaccgggaaaatctggaacaggcctttgaagtcgctgagcggctcggggtcactcgtttactcgatgctgaggacgtggacgtgccatccccagacgaaaaaagcgttatcacttacgttagtagcatctatgacgcttttccgaaagtccccgagggcggcgagggcatctccgccacagaggtcgactcacgctggcaggagtaccagtcgcgagtagattccctgatcccatggatcaagcagcacacaatactgatgagtgacaagaccttcccccaaaatcccgtcgagctgaaggccctctataatcaatatatacactttaaggaaaccgaaatacttgctaaggagcgcgaaaaaggacgcattgaggagctgtataaattactcgaggtatggatcgaatttggacggatcaagttgccccaggggtaccatccaaacgatgtggaagaggaatggggaaaattgatcatagaaatgctcgaacgtgaaaaaagcctgagaccggctgttgaacgccttgaattgctccttcagatcgccaacaaaatccagaacggagccctgaactgcgaggaaaaactgaccttggccaagaacaccctccaggccgatgccgcccacttggagtccggacagccagttcagtgcgagagcgatgtcattatgtacatacaggagtgcgaggggctcattcggcagctccaggtggatcttcagattctgagggacgagaattactatcaactagaggaactggcatttcgggtaatgagacttcaggatgaactcgtgaccctgaggctcgagtgcacaaacctgtaccgcaaggggcatttcacatctctggagttagttccaccatctacccttacgacaacacatctgaaagctgagcccctaactaaggctacccattctagttcgacttcttggtttcgcaaaccgatgacacgggccgaactcgtggctatctctagctccgaggacgagggcaacttgagatttgtctacgaactattgtcatgggtggaagaaatgcagatgaagctggaacgcgcagagtggggcaatgatctcccgagtgtggaactgcagctggagacccagcaacacatccacactagtgtagaagaactgggaagttccgtaaaggaggcccggctctacgagggcaagatgtcccagaacttccacacctcttacgccgagacacttgggaaactggagactcagtattgcaagctcaaggaaacatcgagctttcggatgcgccacttacagagcctgcacaagttcgtcagtcgtgcgaccgccgagttgatttggctcaacgagaaagaagaggaggaactggcgtatgattggagcgataacaactcgaatatttccgcaaagcgtaactacttttctgaacttaccatggaactggaagagaaacaagacgtttttcggagcctgcaggacactgccgagctactgagccttgagaatcaccccgcgaagcagacagttgaggcatactccgcagctgttcagagccagctgcagtggatgaagcaactgtgtttgtgcgttgagcagcacgtgaaagagaacacagcttactttcagttcttctccgatgcgagagaactggaatccttcttgcgcaatttgcaggactcgattaaacggaagtactcctgtgaccacaacacctcgctctcccgcttagaggatctattacaggatagcatggacgaaaaagaacagctgattcaatccaagtcatcagttgcatctctggtgggccgcagcaagacaatagtgcaacttaagccacgcagccccgatcacgtcttgaaaaacacaattagcgtgaaggcagtttgcgactatagacagatcgaaataaccatctgtaaaaacgatgaatgcgtcctggaagacaatagccagaggaccaaatggaaggtgatcagcccaacaggtaatgaggccatggtcccaagtgtgtgcttcctgatcccgcccccgaacaaggatgctattgaaatggcatcccgggtcgagcagtcataccagaaggtgatggctttatggcaccaactgcacgtgaatactaagagtctgatttcctggaactacttgaggaaggatctggatttagtgcaaacatggaatttggaaaagttgcgcagcagcgccccaggagaatgtcaccagattatgaaaaacctgcaagcgcactatgaggactttctccaggactcccgagattcagttctcttctcggttgcagataggcttagactggaggaggaggttgaggcctgtaaggccaggttccaacatctcatgaagtccatggagaatgaggacaaggaggagaccgtggcaaaaatgtacataagcgaactgaagaatatccggctccggctggaagaatacgagcagagggtggtcaagcggatccaaagtctggctagctcaagaacagatcgggatgcctggcaggataacgcactgaggattgccgagcaagaacacacccaggaagacctgcagcagctcagatcggacttagacgctgtgtctatgaaatgcgattcctttctgcaccagagtcctagtagctcttcggtgcccacccttcggtcagaattgaatttgctggtggaaaaaatggaccacgtgtacgggttgtcgaccgtgtacctcaataaactgaagaccgtagacgtgatcgtccgaagtatccaggacgccgagctgctggtgaaggggtatgaaatcaaactgtctcaggaagaagtcgtgctggccgatttatcagccctggaagcccactggagtacactgcggcactggcttagtgatgtgaaagacaagaattctgtgttctctgttctggatgaagagatagctaaggctaaggttgttgccgaacaaatgagccggttaacacctgagagaaacctggatctcgagcggtatcaggaaaaggggagccagctacaggagaggtggcatcgagtgattgcccagctcgagatcagacagagtgagctggagtcaatccaggaagttctgggcgactatagagcctgtcacggtaccttaattaagtggatagaggaaacaaccgctcagcaggagatgatgaaaccaggtcaggccgaggattccagggtgctgtctgagcagctaagccagcagacagccctgttcgctgagattgagaggaatcagacaaaactggatcaatgccagaaattctcgcaacaatacagtacaatcgtgaaagattatgagctgcagctgatgacatataaggccttcgtggaatcccagcagaagagcccgggcaaaaggagacggatgctgtcttcttcagacgctatcacacaggagtttatggacttgaggacaaggtatacagctctggtgactttaaccacccagcacgtgaaatacatctctgatgccctgaggagattggaggaagaggaaaaagtggtcgaagaggagaagcaggaacacgtggaaaaagtaaaggagctgttgggttgggtgtccacactggcacgcaatacccaaggcaaggcaaccagttctgagactaaagaaagcacagacatcgagaaagccatcctagaacagcaagtgctgagtgaggagcttacaactaagaaagagcaagtgtctgaggctattaagaccagtcagatctttctcgccaaacacggacataagctgagcgaaaaagagaagaagcagatctccgagcagctgaatgccctgaacaaggcgtaccacgacctgtgcgacggctccgcaaatcagctgcagcaactacagtcgcaactcgcccaccaaactgaacagaaaacactgcaaaaacagcaaaacacatgccatcagcagctcgaagatctttgctcatgggtgggacaggccgagagagcattggcgggacaccagggcagaaccacccagcaggacctgtccgccttgcaaaagaaccagagtgacctgaaagatctgcaggatgacattcagaatagagccacctccttcgccacagtggtcaaggatatagaaggcttcatggaggagaaccaaacaaaactttcgcccagagagctgacagcccttcgggagaaactgcatcaggcaaaagagcaatatgaggcccttcaggaggagacccgagtcgcacagaaggagctggaagaggctgttacatctgcccttcagcaggagactgagaaaagtaaggcagctaaggagctggctgaaaataaaaaaaaaatcgacgcattgctggattgggtcacaagcgtggggagttcaggggggcagctcctgacaaatctgccagggatggaacagctttccggggcctccttagagaaaggcgctctggatacgactgatggctacatgggtgtcaatcaggcacctgaaaagctcgataaacagtgtgagatgatgaaggccagacaccaagagctgttgagtcaacagcagaattttatcctggccacgcaatccgctcaggctttcctggatcagcatggacacaatttaacacctgaggagcaacaaatgctgcagcagaagttaggtgaactaaaggaacagtatagtacaagtcttgcccagagcgaggccgagcttaaacaagtgcagaccttgcaggatgagctccaaaagttcttgcaggatcataaggaattcgaatcctggctcgagagaagcgagaaggagctcgagaacatgcataaaggcggaagtagccctgaaaccttgccctccttgctcaaacggcaaggatcattctcggaggatgtgatcagccacaagggagacctgaggttcgttacaatcagtggtcaaaaagtgctggacatggaaaatagttttaaagaggggaaggaacccagcgaaattggtaatttagtcaaagacaagctgaaggacgctaccgagagatatacagcactccactccaagtgcaccaggctaggttctcacctgaatatgctgttgggccaatatcaccagtttcagaattccgctgactccctgcaggcctggatgcaggcgtgtgaggcaaacgtcgagaagttgctgagcgatacagtggcgtccgaccctggcgtgctccaggagcagctggctaccacaaaacagctgcaggaggagctggccgagcatcaggtgccggtggaaaaactccagaaggtggcaagagacatcatggaaatcgagggtgagcctgcccccgaccaccggcacgtacaggaaaccaccgactcaattctgtcccactttcagtcactgagctactcattggccgaaagatcttccctgctgcaaaaggccattgcacagagtcaaagcgttcaagagtccctggagtcccttttgcagtccattggtgaagtcgaacagaatctagaagggaaacaagtgtcgtctcttagttccggcgttattcaggaggccttggctaccaacatgaaactgaaacaggatatcgcccgccagaagagctcactcgaggctacacgcgaaatggtcactcgctttatggagaccgccgactctactaccgccgcagtgctgcaaggaaaactcgctgaggtcagccaaagatttgagcagctttgtctccagcagcaggaaaaagaatcctcacttaagaaactgctgccccaggccgagatgttcgaacacctgagcggcaaattacagcagttcatggagaataaaagccgcatgcttgcctctggaaaccagcctgaccaggatatcacacacttcttccagcagatccaggagcttaacttagagatggaagaccagcaggaaaatctggatacgctggaacacctcgtcacggaactgtccagttgtggctttgctttggatttatgccagcatcaggatagagtgcagaacttgagaaaggactttacagagctgcagaagacagtaaaggagcgcgaaaaagatgcttcctcctgtcaggagcagctggacgaattcaggaagctggttcgaacctttcagaagtggctgaaagagactgaagggagcattcctcccactgagactagcatgtcagccaaagagctcgagaagcaaatcgaacatctcaaaagtctcctagatgactgggcttccaaagggacactggtcgaagaaataaactgtaaaggcacatccctcgagaacttgataatggagatcacggcccccgattctcaggggaaaacaggctccatactccctagtgttggaagtagcgtgggaagcgtgaatggatatcacacctgcaaggatctgaccgaaatccaatgcgacatgtcagatgtgaatcttaagtacgaaaagctaggcggcgtgttgcacgaacgccaggagagccttcaggccatcctgaacagaatggaagaagttcacaaggaggctaattcagtgttacagtggctggaatccaaagaggaggttttaaagtccatggacgccatgtctagtcccaccaaaactgaaaccgtcaaagcccaggcagaatccaataaggccttcctggccgaactcgaacaaaactcgcctaagatccagaaagtgaaagaagcactagccgggctccttgtaacttacccgaatagtcaggaggctgaaaactggaaaaagattcaggaagagttaaacagcagatgggaaagggctacagaggtgaccgttgcccgccagagacaattggaagaaagtgcatctcacttggcctgtttccaagcagcagagagtcagctgcggccatggttaatggaaaaagaattgatgatgggcgttctaggaccattgtcaatagacccaaacatgctgaacgcacagaaacagcaggtccagttcatgttgaaggaatttgaggcaagacgtcagcaacatgaacagctcaacgaggctgctcaagggatcctgacgggaccaggggacgtctccctgtctacatcgcaggtgcaaaaggaactccagagtatcaatcagaaatgggtagagctcactgataagttaaactcccggtcatcccagattgaccaggccatcgtgaagtccacccagtaccaagaactgctccaagatctctccgaaaaggttagggccgttgggcagcgcctctctgtgcagtccgcaattagtactcagcctgaagccgtcaagcagcaactagaagaaactagcgagatccggtcagatctagagcagctggaccatgaggtaaaggaggcccagacgctgtgcgacgaactttcagtcctaattggggaacaatatctcaaagacgagctcaaaaaaaggttagagaccgtggctctcccattgcagggtttagaagatctggccgccgaccgtataaatcgcctgcaagcagctctcgcctctacccaacaatttcagcagatgttcgatgagttgcggacatggttagatgacaagcagtcccagcaggccaaaaactgccctatctctgctaagctagaaaggctccaaagccaactgcaggagaacgaggagttccagaaaagtctgaaccagcatagcggctcctatgaggtgatcgtggcagagggagagagcctcttgctaagcgtgccgcctggcgaagagaaaagaaccctgcagaaccagctggtggagctgaagaatcactgggaagaactgagcaagaaaaccgcggaccgccagtcaaggttaaaggactgtatgcagaaagcccagaaatatcaatggcacgtcgaggatttagtgccctggattgaggactgtaaggcaaagatgagcgaactgagagttacactggatccggtccagctggaaagctccttgctgcggagtaaggcaatgttgaacgaggtggagaagaggagatctctgctggaaattctgaacagcgcggctgatattctgattaacagtagcgaggctgacgaggatggaattagggatgaaaaagctggcattaatcagaacatggacgccgtcactgaagaattgcaagccaagacaggcagcctggaggaaatgacacagcggctgcgcgagttccaggaaagcttcaaaaacatcgagaaaaaggttgagggcgcaaaacatcagctcgagatatttgacgcactgggtagtcaggcatgctctaacaagaatctggagaaactgagagctcagcaggaagttttacaggctctggaaccccaggttgactatctccgtaattttacccagggcttggtggaggatgccccagacgggtctgacgcgtcccaactgttacatcaggcggaggtggcgcagcaggagtttctcgaagtgaagcagcgagtgaatagcggatgtgtgatgatggagaacaaactggagggcataggacaatttcactgcagggtccgggagatgttctcacagttagctgatcttgatgatgagctagacgggatgggggcgattggccgggacacagacagtctgcagagtcagatagaggacgtacgactgttcttgaataagatccatgtcctgaaacttgacatagaggcttccgaggccgagtgtcggcacatgctggaggaggagggaactctggacttattagggctgaagcgagagctggaggccctgaacaaacagtgcggaaaactcacggaacgcggtaaggctcggcaggagcagctggagctgactctaggcagggtagaggacttctaccgcaagcttaaaggtctgaacgacgctaccacagccgctgaagaagccgaggctctacagtgggtggtgggcaccgaagtggagataattaaccagcagctggcagacttcaagatgtttcaaaaggaacaggtggaccctctacaaatgaagttgcagcaggtgaacggcctgggccaaggactcattcagagcgccggaaaagactgtgacgtgcaggggctggagcatgacatggaggagataaacgctcggtggaatacgcttaataaaaaagtcgctcagaggatcgcacagttgcaagaggccttgctccactgcgggaagtttcaggatgcactcgaacccttacttagctggctcgctgacaccgaggagctcatcgcgaaccaaaaaccacctagcgccgagtacaaggtggtgaaggctcagattcaggagcaaaagcttctgcaaaggcttttggacgatcgaaaagcgacggttgacatgctccaggctgaaggtggccgcatagcccagtctgccgagttggccgaccgcgaaaaaattaccggtcagctcgaatctctggaatcccggtggacagagctgttgagtaaggcagctgccagacagaagcagctggaagacatactcgtgttggccaagcaattccatgagactgccgagcctatctcggattttctatcagtgacagaaaagaagctggccaactcagaaccagtgggtacccagaccgcgaagattcagcaacagatcattagacacaaggccttggaagaggacatcgaaaaccatgccaccgacgtacaccaggcggttaaaattggccagtccctgtcctcactgaccagcccagccgaacagggagtgctctctgagaaaatcgactctctgcaggcccgctattccgaaattcaggaccggtgctgcaggaaggccgccttactggaccaagctctgtctaatgcccgattattcggggaggacgaggtggaagtgctcaattggctggccgaagttgaggacaagctctcctctgtgtttgttaaagacttcaagcaggacgtgttacaccgacagcatgccgatcacctcgcgctgaacgaagagatcgttaaccgcaagaagaacgtagatcaggcaatcaagaatggccaggccctcctcaagcagacaacaggggaagaggtgctactgatacaggagaagctggacgggattaaaacccggtacgcagatattacagtgacaagttccaaagctctgagaactcttgagcaggccaggcaattggcgaccaagttccagtccacttacgaggaattgacaggatggcttagagaagtggaggaagagctggccacctcaggaggccagagccccacaggggagcagattccacagttccagcagcgtcagaaagagctgaaaaaagaggtgatggaacatagactggtcctggataccgttaatgaagtctcaagggccctcctggagctggtgccttggcgcgcaagggagggactggacaaactcgtgtccgacgcaaacgaacaatacaaattagtaagtgatacaataggccagcgggtcgacgaaattgatgccgctattcagcgttcacagcagtacgagcaggccgcggatgccgaactggcctgggttgctgaaactaagcggaaactgatggctctgggcccaatccggctggaacaggaccaaaccactgctcagctgcaggttcaaaaggcctttagtattgatataattaggcacaaagacagtatggatgagctgttttcacatagatccgaaatctttgggacgtgtggagaggagcagaagactgtgctccaggaaaagacagaatcactgattcaacaatatgaggctatttctctgctgaacagtgagcggtacgcacgcctcgagagagcccaggtactggtcaatcagttttgggagacctatgaggaactctccccatggatcgaggaaacacgggcactgatcgcccagttgccctcccccgccatcgaccacgaacagctcagacagcaacaggaggagatgagacagctgagagaatcaatcgccgagcataagcctcatattgacaaattgttgaagatcggccctcaactgaaggagttgaacccagaggaaggggaaatggttgaggagaagtatcaaaaagccgagaatatgtacgcacaaatcaaagaggaggttcgacagcgcgcattggctcttgacgaagccgtatctcagtctacccagatcaccgaattccacgacaagatcgaaccaatgctggagactcttgaaaatctgagctcccgtctccgtatgcctccgctcatccctgcggaggttgataagattcgcgaatgcatcagcgataacaagtctgcaaccgtggagcttgaaaaacttcagccaagctttgaggccttgaagaggcgaggggaggagctgatcggccgctctcaaggggccgataaggatctggctgccaaggaaatccaagacaagcttgatcagatggtcttcttctgggaggacataaaagctcgggcagaagaaagagaaataaaattcctggacgtgttggagctggcagagaaattctggtatgacatggcagccttgctcaccactatcaaggatacacaggacatcgtacacgatctggaatcccccggtattgaccccagtatcattaaacagcaggtagaagccgctgaaaccattaaggaagaaactgatggtcttcatgaagagctggaattcatcagaatcctgggagcagacctcatctttgcatgcggggagacagagaagccagaggtgaggaagtctatcgatgaaatgaataacgcttgggaaaatctaaataagacgtggaaggaaaggctcgaaaaattggaagacgccatgcaggctgccgtacaatatcaggatacgctgcaagcaatgtttgattggctggacaacaccgttatcaagttatgcaccatgcccccagtgggtaccgatttaaacacagtgaaggaccaactaaacgagatgaaagagttcaaagtggaagtttatcagcagcagatcgaaatggagaagcttaaccaccaaggggagctgatgttgaagaaggctaccgacgaaactgatagggatatcattcgtgagccccttaccgagttaaagcacctttgggaaaatctgggcgaaaaaattgcccatcgccaacataaactcgagggagcactgttggcgctcggtcagttccagcatgcactggaggagttgatgagctggctaactcacacagaagagctgttggacgcccaaaggcctatatctggcgatcccaaagtgattgaagtagagctggcaaagcatcacgtcctgaaaaacgatgttttggctcatcaagccacagtggaaactgtgaacaaagctgggaatgagctgctggaatccagtgccggtgacgacgcctcctcactgaggtcaaggcttgaggccatgaaccaatgttgggaatcagttcttcagaagaccgaagagcgtgagcagcagctgcaatccacactccaacaggcccagggcttccattctgagatcgaagacttcctgttggaactgacacggatggagtcacaactatcagccagtaaaccaaccgggggccttcctgaaacagcccgagagcagttggatacccatatggagctatactcccagctgaaagccaaagaggagacctataatcagctacttgacaagggcagattgatgctcctctcaagggacgactctggatctggcagtaagaccgagcagtccgtggcactcctggagcagaagtggcacgtcgtctcctctaagatggaggagcggaaatccaaactcgaagaggcactgaatctggccactgaatttcagaactcattacaagaattcatcaactggctgacgttggctgaacagtcgctcaatattgcttcacccccaagcctgatcctgaatactgtgttgtctcagattgaggaacacaaggtattcgcaaacgaggtaaatgcacaccgggatcaaatcattgagttagaccagactggcaatcaacttaaatttctgagccaaaagcaagatgtcgtgttgatcaaaaacctgctagtctccgtgcagagtagatgggagaaggtggtgcagcgtagcattgagagaggccgctccttagatgacgctaggaaaagggcaaagcagttccatgaagcatggaaaaagctgattgattggctggaggatgccgagagccaccttgactccgagctggagatttcaaacgatccggacaagatcaagctgcagctgagcaagcacaaggagtttcaaaaaactttgggggggaaacagccagtgtacgatacgactatccgaacggggagggctctaaaagagaaaaccctgctcccagaggacagtcagaagctagacaatttcctaggcgaagtgcgcgataagtgggacacagtttgtggcaaatccgtcgaacgccagcacaaactcgaggaggctctgcttttctctgggcagtttatggatgcgctgcaggccctcgtcgactggctgtataaggtcgaacctcagttagcagaggatcaaccagtacacggcgatttagatctagtcatgaacctaatggacgctcacaaagtgttccaaaaggagctgggcaaaaggactggcactgtgcaggtgttaaagcgcagcggccgcgagcttatcgagaacagtagggatgacaccacgtgggtcaagggccagctgcaggagctgagtactcgctgggacaccgtgtgcaagctgtcagtgtcaaagcaatctaggttggagcaggcactgaaacaggcggaggtgtttagggacaccgttcatatgctgctggaatggttgagcgaggccgaacagaccctcaggttcagaggtgccctgcctgatgacacagaagcactccaaagtctgatcgatacgcacaaagagttcatgaagaaggtggaagagaaaagggtggacgtcaattctgcagttgccatgggggaggttatcctggcagtgtgtcatcccgactgtatcacaactatcaagcactggatcactatcatacgtgctagattcgaagaagtgttgacctgggccaagcagcaccagcaacgcctggaaacggctctgagcgaattggtcgctaatgcggaactcctcgaggagctcctggcctggatccagtgggctgaaacaactttgatccaacgggaccaggagcctatcccccagaacatcgatagagtcaaggctcttatcgcagagcaccagacctttatggaggaaatgacgcggaagcagcccgatgttgatcgcgtgacaaagacctacaagagaaagaacatcgagcctacgcatgccccatttattgagaagagcagaagtggtgggaggaagagcctgtctcagcccaccccaccgccaatgcccatcctcagccagtccgaggcaaagaatcctaggatcaatcagctctctgctcggtggcagcaagtgtggttgctcgccctcgaaaggcagcggaaactgaacgacgcgctcgatcgactcgaagaactgaaggagtttgcaaactttgatttcgacgtgtggcgcaagaaatatatgcgctggatgaaccacaaaaagagtagagtgatggacttctttagaaggatagacaaggaccaggatggtaagataactcgacaagaattcatcgacggtatcctggcaagcaagttccccactacaaaactggagatgaccgccgtcgccgacattttcgatcgagatggggacggatacatagattactatgagtttgtggctgcactccacccaaacaaggacgcctaccggccgactactgacgcggacaagatcgaagacgaagtgacgcgacaggttgcacagtgtaaatgcgccaagcgcttccaagtggaacagattggggagaacaagtacagatttggggacagtcagcagttgcgtctcgttcgcattcttcggtccactgtcatggtgagagtgggagggggctggatggcattagacgagtttctggtgaaaaacgacccgtgtcgcgccaggggtcggacaaatatcgagctccgagagaagttcatactcccagaaggagcctctcagggcatgaccccttttcggtctcgaggccgccgctctaagccatcttctcgggcggcttcaccgactcggagcagttccagcgcatcacaatctaatcatagttgtacttccatgccatctagcccggcaactcctgcctccgggactaaagtcatccccagttcaggatctaagctgaaacgcccaacacctacctttcactccagccgaaccagtttggccggcgataccagcaacagttcatcccctgcttccactggcgccaagacgaatagagctgacccaaaaaagagtgcttctaggccgggaagcagggcaggctcgcgggccgggagtcgggcttctagcaggcgtggcagtgacgccagtgattttgatctgttggaaactcagtctgcctgctctgatacatcagagtcatctgcagccggcggccagggaaacagtagaagagggcttaacaaacccagcaagattccaaccatgtcgaaaaaaacgacaactgcatctccacggacccccggccctaagagatag

SEQ ID NO: 124355 - DNA, 8412 bp, Artificial Sequence
  Description of Artificial Sequence: Synthetic coding sequence
atggacggcgtggcagagttctctgaatacgttagcgaaactgtggacgtaccttcacccttcgatctgctcgagcctcccacaagcgggggatttctgaaactttctaagccatgctgctatattttccctggaggacgtggggacagtgccctttttgcagtgaatggcttcaatatattagtggatggaggctcggaccgcaaatcgtgtttctggaaactggtaaggcacttagatcggattgactccgtcctgctgactcatatcggagccgataacctgcccggaataaatgggctgctgcaaaggaaagtggcagagctggaagaggagcaatctcaggggagctcttcctacagcgattgggtgaaaaacctgatcagccccgaacttggggtagtattcttcaacgtgcccgagaagctccggctccctgatgcctctcggaaggctaagagatcgatcgaggaagcatgcctgacactccagcaccttaacaggttgggcatccaggccgagccattgtacagggtggtgtccaataccatcgagcccttgaccctatttcacaagatgggagtcggccggctagatatgtatgtgctgaaccctgtcaaggacagtaaggaaatgcagtttttaatgcagaaatgggccgggaattccaaggccaagactggaatcgtccttccaaacggcaaggaagctgaaattagcgtcccctatcttacaagtattactgccctggtcgtctggctgcctgcaaacccaacagagaagatagtacgtgtgctgttccctggaaacgcccctcagaacaagatccttgagggactcgaaaagctgcggcatctggactttctgagataccccgtggcgactcagaaagatctcgccagtggggctgtccccaccaatttgaaaccttccaagataaaacagcgggccgactcaaaagagtccctgaaagcaacgaccaaaacggcagtctccaagctggcaaaaagagaggaggtggtggaggagggcgctaaggaggccaggtctgaactggccaaagagctggctaaaacagagaagaaagccaaagaatcttctgagaaaccaccggagaagccagcaaagcctgaacgcgtcaagaccgagtcgtcagaggccctgaaagccgagaagcggaagctcataaaggacaaggttgggaaaaagcacttgaaggaaaagatcagcaagctggaggaaaagaaagataaagagaaaaaggagatcaagaaagagaggaaggagctgaagaaagacgagggacggaaggaggaaaaaaaggatgctaagaaagaagagaaacgcaaagatacaaagcccgagcttaagaagatcagcaaacctgatctaaagccattcacacctgaggtaagaaagactctttacaaggctaaagtcccgggcagggtgaaaatcgacaggagcagggccattcgtggggagaaggagctgagttccgagccccagactcctccagcccagaaagggaccgtccctctgccaacaatctcaggacacagagagctagtgctctccagtcccgaggatctcacccaggatttcgaggagatgaagcgggaggagcgggcgctcctggccgagcagcgtgacactgggctcggcgacaaacctttcccacttgatacggcagaagaggggccccccagcaccgccattcagggaactcctccctcagttccaggacttggtcaagaagagcacgtcatgaaagaaaaagaactcgtccctgaagtgcctgaagagcaggggagtaaagaccgaggactagattcaggggccgaaacagaggaagaaaaggacacatgggaggaaaagaagcagcgggaggccgagaggctgcccgataggacagaagccagagaggagagcgagcctgaggtcaaggaagatgtaattgagaaggcagagctggaggaaatggaggaggtccacccatcagacgaggaggaagaggacgcaaccaaagcggaaggcttttatcagaaacacatgcaagaacctctcaaggtgacacccaggagcagggaggcattcggtggacgagagcttgggcttcaggggaaggcaccagagaaggagacttctctattcctctcgagcctcactactcctgcaggagccacagaacacgtatcatatatccaggacgagacaattccaggatatagtgagacggaacagaccataagcgatgaagagattcacgatgagcccgaggagaggccagcccctccacgctttcacactagcacatacgatctacccggcccagagggggctggcccctttgaggcaagtcaaccagccgatagtgccgtgccagccaccagcggtaaagtgtatggcacgcctgagaccgagctcacttacccgaccaacatagtcgctgctccactggccgaggaagagcacgtttcatcagccacttccatcactgagtgcgataagctcagctctttcgctacttccgtagccgaagaccagtcagtggccagtcttactgccccccagacagaagagactggcaagtcatcactgctccttgacacggtgacgagtattccatcttcacggactgaggctactcagggcctggattacgtccccagtgcaggcacgatcagtcctacatcctcactcgaggaagataaaggttttaagagtcccccctgcgaggatttctctgtgacaggcgaatccgagaaaagaggcgagattatagggaagggacttagtggagaacgtgccgtcgaagaggaggaggaagagaccgccaacgtggaaatgtcagagaagttatgttcacagtatgggaccccggttttttccgccccaggacatgctctgcaccccggcgaaccggcattgggtgaagcggaggagagatgtttgagcccggatgatagcacggtgaaaatggcatcaccacccccctccggcccaccctcagcaacacacaccccattccaccagtctccggtggaggaaaagtccgaaccgcaggactttcaggaggccgacagctggggggatacgaaaagaactcctggtgttggaaaagaagacgccgcggaagagaccgtcaagcctggccctgaagagggtacactagaaaaggaggaaaaggtgccacctccgcggagcccacaggcgcaggaggcccccgtgaacatcgacgaaggattgaccgggtgcactatccaactgttgccggcccaagacaaagcaatcgtgttcgaaattatggaggctggcgagcctacaggaccaattcttggcgcggaagctctgccggggggcctgcggactctgccccaggaacctggtaagccgcaaaaagacgaagtcctgcgatatcccgaccggtccttatcccccgaagacgccgagtccctgtctgtgctttccgtgccaagcccagacactgccaaccaggagccaaccccaaaatccccttgtggactgacagaacagtacttgcacaaggacagatggccagaggtcagtcctgaggatacacagagccttagcttgagcgaggagagtcctagcaaagagaccagcctagacgtaagcagcaaacagctctcaccagaaagtctaggcactctgcaattcggcgagctgaatctgggaaaggaggaaatgggtcacctcatgcaggccgaagacacgagtcaccacactgcgccaatgtctgtgccagagccccacgctgctacagctagccccccaaccgatggtaccacaaggtattctgcccagacagatatcaccgatgattccttggataggaagtcaccagccagcagtttctcccattccaccccatctggcaatgggaagtacctccccggagctatcaccagccctgacgagcacattttgactcctgactccagctttagcaagagcccggaatccttaccaggcccagcacttgaggacattgccatcaagtgggaggacaaggttcccggactaaaggatagaacctcggagcagaagaaggagcctgagcctaaagacgaagtgcttcaacagaaggacaagacccttgaacataaggaggtggtggaaccaaaagataccgctatctaccagaaggatgaagccctgcatgtaaagaatgaagctgtgaaacagcaagacaaagccctggaacagaaaggtagagatcttgagcagaaggataccgccctggaacaaaaagataaggcactggaacccaaggacaaggatctagaggagaaagacaaggcactcgagcagaaagacaagattccagaagagaaggacaaggccctggaacagaaagatacggcactcgagcagaaagataaagccctggaaccaaaagataaagacctggagcagaaagaccgtgtgttagaacagaaagaaaagatccctgaagagaaagataaggccctcgaccagaaggtaaggagtgtggagcataaggctcccgaggacactgttgccgagatgaaagatcgagacctggaacagaccgataaagcccctgagcagaagcaccaagcacaggaacagaaggataaagtctccgagaagaaggaccaagctcttgagcagaagtactgggcgctgggtcaaaaagatgaggcattggaacaaaacatccaggcattggaggaaaaccaccagacccaggaacaggagagcctggtccaggaggacaaaactagaaaacctaagatgctggaggagaaaagtcccgaaaaagtcaaagcaatggaggagaaactggaggccttattggagaaaaccaaggcactcggtttggaagagtccctcgtgcaggaggggagagccagggagcaagaggagaagtactggcgcggccaggatgtggtacaagaatggcaggaaacgagccctacacgagaagaacctgcaggcgagcagaaggaattggcccctgcctgggaggacacttctcccgaacaggataatcgttactggcggggacgagaagacgttgcactggagcaggacacctactggcgggaactgtcttgcgaaaggaaggtttggtttccgcatgagctggacggccaaggcgcccgcccacattacactgaggaacgagagtctacttttctggacgaagggcccgatgatgaacaagaagtcccactacgggagcatgcaacacggtcaccttgggcgagcgatttcaaggattttcaggaatcctccccacagaagggactggaggtggaacggtggttagctgagtcgcccgtggggctgccccctgaggaagaggataagctcactagaagcccttttgagataatttcccctcccgcatcgccccccgagatggtgggacaacgcgtgcctagcgcgcctggacaggagtccccaattccagatcctaaactgatgccccatatgaagaatgagccgacaacaccatcctggctggcggacatacccccctgggtaccaaaggaccggccactgccccctgcgcctctgagccccgcccctgggccccctaccccggcacccgaaagtcacacacccgcaccttttagttggggtacggcagagtacgactcagtggtggccgccgtgcaggagggggctgccgaattggaaggtggaccctattctcctctgggaaaggactacagaaaggctgaaggggagagggaggaagaaggtagggccgaggcacccgacaagtctagtcatagtagcaaggtcccagaggctagcaaatctcacgctactaccgaacccgaacagacggagcccgagcagagggaacccaccccttaccctgacgaacggtccttccaatatgcagacatatacgagcagatgatgctaacaggactgggacctgcctgtcctacaagggaaccacccctcggcgctgccggcgactggccgccctgcttgagcactaaagaggctgcggctggtcgcaacacaagcgccgagaaagagctctcctctcccatttcacctaaaagcctccagtcagacacacctacctttagttacgcagccctcgccgggccaaccgttccaccccggcctgaacctggccctagtatggagcccagccttacacctcccgctgtcccccccagggctcctatcctttctaaaggccctagtccaccacttaacggcaacatactttcttgttcaccagatcgacggagtccctcacctaaagaaagtggcagatcacattgggacgactccacatccgattctgaattggaaaaaggtgcaagagaacagcctgaaaaagaggcccagtctcccagcccaccacatccaatacccatgggcagcccgactttgtggcccgaaactgaggcacacgtgagccctccgttggactcccatctgggacccgcccgcccctccttggatttccctgctagcgccttcggcttctcctctttacagcccgcccctccccagttacctagtcctgccgagccccgctctgcgccctgcggttcattagcctttagcggggaccgggcattggcccttgcacccgggcctccaactcgtactcgccatgacgagtacctggaggtcaccaaggcaccctcccttgactcctctctgccccagctgccctctcctagctctcccggggctccactgctcagcaacctgcccagaccagctagccctgctctgtccgagggctctagctcagaggccactacccctgttatatcctcagtggccgagcggttctcccctagtcttgaggccgccgagcaggagagtggagagctcgatcccggtatggaacctgcggcccattccctgtgggacctcacacccctgtcacccgctccacccgccagtctggacctggcacttgccccagccccttccttacccggcgacatgggcgacgggattctaccgtgccatctggaatgctcggaagccgctacagagaagccatctcctttccaggtgccatccgaagactgcgctgccaatgggcctacagaaaccagccccaacccccccggcccagcccccgctaaggctgagaacgaggaggccgccgcctgtccagcgtgggagagaggggcatggcctgagggggcagagcgttcttcgaggccagacacactgctatcccctgagcagccagtgtgccctgccggcgggagtggcggccctccttcaagcgcctcacccgaggtagaggctggccctcagggttgcgcgaccgaacctcggcctcacaggggcgaactttcaccgagtttcctgaaccctccactgccaccctccatcgatgaccgagacctgagcaccgaagaggtccgactggtggggcgaggaggacgacgacgagtcggcgggccgggaacaaccgggggcccctgccccgtgaccgacgagacaccccctacttcggcgagtgatagcggttctagtcagtccgactctgatgttcctcccgagactgaggagtgtccttcaattacagccgaggcagctctagactcggacgaggacggtgattttttacctgtcgacaaagccgggggcgtcagtggcactcaccatcctcgccctgggcacgacccaccccccctgccccagccagatccccggccatctccaccgcgcccagatgtgtgcatggctgacccagagggtctgagctctgaaagtggtcgggtcgaacgactgagagagaaggaaaaagtccaaggccgggttggccggcgggcaccaggtaaggcaaaacccgcttccccggctcgcaggctggatcttcggggcaaacgcagccccactcccgggaaaggcccagccgatagggccagccgggcgcctccccggcccagatccactacgtctcaggtgaccccagctgaggagaaagacggacatagcccaatgtcgaaaggcctggtgaacgggttgaaggctggccccatggcgctctcctctaagggcagcagtggggcccctgtgtacgtcgatctggcttatattccaaaccattgcagcggcaagaccgccgatctggatttctttcgtcgagtccgcgctagttactatgtggtcagcggtaacgaccccgcaaacggcgagccctcaagggctgttttagacgccctgctggaagggaaggcccagtggggcgagaatctgcaagttacactgattccaactcacgacacagaagtcacaagagagtggtaccagcagactcacgaacagcagcagcagctcaatgttctagttttggcctccagttcgactgtggtcatgcaggatgaaagcttccctgcctgtaaaatcgaattttag

SEQ ID NO: 124356 - DNA, 9126 bp, Artificial Sequence
  Description of Artificial Sequence: Synthetic coding sequence
atggagacagaggcggagcctgctcgaccgcatggcgtggcgatggaaacgacgccaggtctgggtcttcgctcacccggtgcccccctggcccagaatcctgcagaactgctgtgtgaagcgggcgccgcagtggctgctgctagatgggatctccagaaacacagtctcttgattgtgatcggtgacataggcaccgagtcccagttacgggccgttcgggctcacctggagcaaggaatactcagctggaacatcgatttgtcttccttcgacctcaaccagcagctgagactgttcatcactcggcatttggctcacttcagctcagaggtgaaggggcagaggacgctatgtcaccagagtgaaattctagagaccatcatcctggtaaacccatctgctgattcaatttcctccgaagtgcatcatctcctttcctcttccagcgcctataagctcctcattctttctggtcaaagccttgagccaggaggagacctgatcctgcagtccggtacctactcctacgaaaactttgcacaggtgctgcataaccctgaaataagtcaactgctaagcaaccgtgaccctgggatacaggcctttctgacagtgtcatgcctcggcgagggcgattggagccacctgggtctctcctcgagccaggaaaccttgcacttaagactcaaccccgagccaacacttcccaccatggacggagtggccgagttctctgagtatgtgtctgaaacagtggacgtgcccagtcctttcgatttactagaaccccctacatcaggtggattcttaaagctaagcaaaccttgctgctacattttcccaggggggagaggggactctgccttgtttgccgtgaacggctttaacattctcgtggatgggggctccgatcggaagtcttgtttttggaaacttgtcaggcaccttgacaggattgactctgtcttactgactcacattggagccgacaaccttcccggcattaacggattgctgcaacgcaaggtggcagagttggaggaagagcagtcgcagggcagtagctcctacagtgattgggtgaaaaatctcataagtccggagcttggcgtcgtttttttcaacgtgcccgagaagcttcgactgccagacgcttcaagaaaagccaaacgcagtattgaagaagcctgcttaaccctgcagcaccttaaccggttgggcatccaggccgagcccttgtacagggttgtatctaatacaattgaaccactaacattgttccacaaaatgggggtgggtaggctcgacatgtacgttttgaacccagttaaggattccaaggaaatgcagttcttgatgcaaaagtgggccggaaatagcaaagccaagacaggaatcgtacttcccaacggcaaggaagcagagatttcagtgccctacctcacatccattacagccctcgtggtctggctgccggcaaatccaactgaaaaaattgtgagggtactgttcccagggaatgcaccccagaataaaatattggagggcttggaaaaattaaggcacctggacttccttaggtatcccgtggctacccagaaggaccttgcctccggcgctgttcccacaaacctcaagccgtctaagattaaacaaagagcagatagcaaagaatcccttaaagcaaccaccaagacagccgtttccaagctggcgaaacgcgaagaggtggtggaggaaggtgccaaggaggctagaagcgaactggcaaaggaacttgctaagaccgaaaaaaaggcaaaggagtcctcagagaagccccctgagaagcccgctaagcccgaaagggtcaagaccgaatcctctgaggcgctcaaggctgaaaaacgaaagctgatcaaggacaaagtcggcaagaaacatctcaaggaaaagattagcaagctggaagaaaaaaaagataaggagaagaaagagatcaagaaggagcgcaaggaattgaagaaagatgaaggcaggaaagaagagaagaaggatgctaaaaaggaggagaagaggaaagacaccaaacctgaactaaaaaagatcagcaagccggacctaaagcctttcacccccgaggtgcgcaaaaccttgtacaaagcaaaggttcccggccgagtgaagattgatagatcacgcgccatcaggggggaaaaagaactgagtagtgagccccagacccctccagctcagaaaggcaccgtcccattgccgaccatcagtggccaccgcgaactcgtcctgtcttctcccgaagacctcacccaggacttcgaggaaatgaagcgagaggaacgggctctcctggctgaacagcgggatacaggcctgggcgataagcccttcccactggatacagcagaagagggccctccaagtaccgccattcaggggacgccaccatccgttccaggattgggccaggaggagcacgtaatgaaggagaaagagctcgtgccagaggtgcccgaagagcagggtagcaaggacaggggactggactccggtgccgaaaccgaggaggaaaaagatacttgggaggagaagaagcagagagaggccgagaggcttccggatcggaccgaggctcgcgaagaaagcgaacccgaggtgaaggaggacgtgatcgaaaaggccgaactggaggagatggaagaagtccacccatccgacgaagaggaggaggacgcaaccaaagcggaggggttttatcagaagcatatgcaggagccactgaaggtcacacccaggtccagggaagcatttgggggacgagagctgggcttgcagggtaaggccccggagaaagagacttctctgttcctcagctccctgacaacccccgccggcgccaccgagcacgtgagctacatccaggacgagacaattcccgggtactcagagacggagcagacgattagcgatgaggagattcatgatgagccggaggagcgtccagctccccctagattccacactagtacctatgatctgccaggtccagagggggccggtcccttcgaggcgagccaacccgccgatagtgcggttccggccaccagcggaaaggtgtacgggaccccagagacggagctcacttaccctacaaacatcgttgcagccccactggcggaagaggaacatgttagcagcgcgacttccattactgaatgtgataaactcagctcgttcgcaacttcggttgctgaggaccagtcggtggcaagtcttactgcaccgcagaccgaagagacgggtaagtctagcctgctattggatacagtcacgagcatcccgagcagtcggacggaggccactcaaggactggattacgtaccaagtgccggtacaatcagcccaaccagcagcctcgaggaggacaagggctttaagtccccaccctgcgaggacttctctgtcacgggggagtccgaaaagaggggggagatcattggcaagggcctctccggagaacgcgccgtggaggaggaggaagaagagacagctaacgttgagatgagcgaaaagctctgctctcaatacggaacccctgtgttcagcgcccccggccatgccctgcatccaggagagcccgccctcggcgaagcggaagaacgatgcctgtccccagacgattcgacagtcaagatggcatctcctcccccctccggccccccttctgccacgcacaccccttttcatcagtcacccgttgaagagaaatccgaaccccaagatttccaggaagccgactcatggggtgatacgaagcggaccccaggagtcggcaaggaggacgccgcagaggagaccgttaaaccaggacccgaggaaggtaccctggagaaagaagagaaagtgcccccgccaagatcaccccaggcccaggaggctccggtcaacatagacgagggactgacgggctgtacaatacagctcctgcccgcgcaggacaaagccattgtgtttgaaattatggaggcaggtgaacctactgggccaattctgggagcagaggccctacccggggggttgagaacactgccccaggagccaggcaagccccagaaagacgaggtactgcgctacccagatcgaagcttatctcccgaagacgcggagagcctttcggtgctgtcagtgccaagtccggatacagcaaaccaggaaccaacacctaagtctccatgtggactgacagagcagtatttacacaaagaccggtggcctgaggtgtcgcctgaagacacacagtcactgtctctgagcgaggagagcccgtctaaagagaccagccttgacgtaagtagtaaacagctgtctccagagtccctgggaaccttacagttcggagaactgaacctgggcaaggaggagatgggccatctgatgcaggccgaagacacctcccatcatactgccccaatgtcagtgccagaaccacatgccgccaccgcatcccccccaaccgacggaacaactagatactctgctcagacagacatcacggatgactctctggatcgaaagtcacctgcctcctccttttcccacagcacgccaagtggtaacggcaagtatcttcctggggctatcactagcccagatgaacatattctgactcctgattcctccttttcgaaaagtcctgagtccctacccgggcccgctttagaggatatcgccatcaaatgggaagataaagtgcccgggctgaaggacaggacctcagagcagaagaaggagcctgagcccaaagacgaggtgctgcagcaaaaagataaaacacttgagcataaggaagtagttgagcccaaagacaccgcgatctatcaaaaagacgaggccttgcacgtcaagaacgaggccgtgaaacagcaagataaagccctcgagcagaaggggagggacttagaacaaaaggataccgccctggaacagaaagataaggccctcgagcccaaggataaggacctggaagaaaaggataaagccctcgaacagaaagacaaaatcccagaggagaaggacaaggcccttgaacaaaaagatacagcgctggaacagaaggacaaagcccttgagcccaaagataaagatctcgagcagaaagatagagtactggagcagaaagaaaaaatccccgaggaaaaagataaggcattggaccagaaagtgcgctcagtcgaacataaggcaccagaggataccgtggcggaaatgaaagaccgggaccttgagcaaaccgacaaggcaccagagcaaaaacaccaggcacaggagcagaaggacaaggttagcgaaaagaaagatcaagcacttgaacagaagtattgggccctgggacagaaggatgaggcccttgaacaaaatattcaggcgctggaggagaaccatcagacgcaggagcaagaatctctagtgcaagaagacaagacgaggaagcctaagatgctggaggagaaaagccctgaaaaggtcaaggctatggaggaaaaattagaggccctcctggaaaagactaaggctttaggcctcgaggagagtcttgtccaggagggccgggcaagggagcaggaagagaagtactggcggggtcaggacgttgtccaagaatggcaggaaacttcacctactcgcgaagaaccagcaggtgagcagaaagagctcgcaccagcctgggaggatacgtctcccgaacaagacaatcgttattggagaggccgggaggacgtcgccttggaacaggacacatattggagggagctcagctgtgaaagaaaagtgtggttcccccacgagcttgatggacagggagctcggccccattacacagaggaaagagagagcacttttttggatgagggccctgatgacgagcaggaagttcctctcagagagcacgccacgcgcagcccctgggcttctgatttcaaggatttccaggagagcagcccacagaaagggctcgaggtggaacggtggctggctgaatcccccgttggcttgccccctgaggaagaagataagcttacgaggagtccttttgaaattatcagtccccccgcctcccctcccgagatggtgggccaacgggtgccctctgccccaggccaggagtctcccataccagacccaaaactgatgccacatatgaaaaacgagccaaccactccttcttggctggccgatataccgccatgggtacctaaagaccgccctcttccccccgcccctctaagcccggctccaggcccccctacacccgcccctgagtcccatacccctgcgccatttagttggggcaccgccgagtacgactcagtggttgcagctgtacaggagggagccgccgaactggagggcgggccttattcccctctcgggaaagactacagaaaggccgagggggaaagagaggaagaaggccgtgctgaagcccctgacaaatcctcccacagcagcaaggtgccggaagccagtaagtcacatgccaccaccgaaccagaacaaactgagcctgagcaacgggagccgactccttaccccgacgaacgatcatttcagtatgcggatatttacgaacagatgatgctaacagggctgggcccagcctgtcctaccagggaaccgcccctcggcgccgccggcgactggcccccatgcctctctacaaaggaggccgctgcaggccgcaacactagtgctgagaaagaactgagctcccctatttcccctaaaagcctgcaaagtgacactccaacgtttagttacgcagcactggctggaccaactgtgccccctagacccgagccaggaccctctatggaaccctcactgacaccacccgctgttccccctagggctcctatcctctctaaaggccccagccctcccttgaacggaaatattctcagttgtagtccagatagaagatccccctcaccgaaagaatcgggaagatctcattgggacgactcaacttctgacagcgaactggagaagggagcccgtgagcagcccgagaaagaggctcaatctccttctccaccacaccctatccctatgggcagccctactctgtggccagagacagaggcacatgtgtctccccctctagattctcatcttggacctgccaggcccagcttagatttccctgcctccgcttttgggttctctagtctgcaacctgcccctcctcagttacctagccccgctgagcctaggagtgctccctgcggcagccttgctttttccggtgatcgggccttggcgctggcaccaggaccccctacccggacacgccacgacgagtacctcgaagttacaaaagcaccctctctggatagcagcctcccgcagctcccttccccttcttcacccggagctccactgctttccaatctcccacgccctgctagcccggctctctcagagggcagcagctccgaggccacaacacctgtcatatcttctgtcgccgaaaggttctcgccaagtctggaagctgcagaacaggaatccggagaactggatcccggtatggagccagcagctcattctttatgggatctaacacctctcagcccggccccgcccgcatcccttgatctcgccctggcccctgccccctctttgcccggggacatgggcgacggtatcttaccttgccatctggagtgctccgaggcagctacagagaagccatcccccttccaggttccaagtgaggattgtgctgccaatgggcccaccgagacctccccaaaccctcccgggcctgccccagccaaggccgagaacgaagaagctgccgcgtgccctgcatgggaaaggggagcttggccagaaggcgccgagcggagctcccgtcctgataccctcctcagcccggagcagccagtatgccctgcaggaggatctggggggccaccctcgtcagccagccccgaggtggaagccggaccccaaggttgtgcaaccgaacccagacctcaccgcggagagctgtccccaagctttctcaaccctccactgcccccctcaatcgatgatagggatctctctacagaggaagtgcggctcgtgggtagaggcgggcgcagaagggtgggcggtcccggaactaccgggggcccttgtccagttaccgacgagacacccccgacctcagccagcgattccggctcctcccagtcagacagcgatgtccctcctgaaacagaggagtgtccctccattacagctgaagctgccctagactcagatgaagacggcgactttctcccagttgataaagcagggggagtgagcgggactcaccatccgcgcccaggtcatgatccaccaccccttccccagcccgacccaaggccatcaccccctaggccagatgtgtgtatggcagaccccgaggggctatcttccgagtctggccgcgttgaaaggctcagagagaaagagaaagtgcagggacgcgttggccgcagagccccaggtaaagcaaagccagccagcccagccaggaggcttgatttgcgcggtaagagaagccccacacccggaaagggtccagctgatcgcgcgagtcgcgcacccccacgcccacgttctaccacctcccaagtgacaccggccgaagagaaggatggacactcaccaatgtccaagggcctggtgaacgggttgaaggccgggccaatggcactgagctcaaaaggatcctcaggtgctcctgtatatgtcgacctagcttatatccctaaccactgtagcggcaagacagctgacttggattttttcaggcgtgtgcgggcatcatactacgttgtaagcggcaacgatccagcaaacggcgagcctagccgtgcggttttagacgcccttctggaaggcaaggcacagtggggcgagaatctgcaagtaacactcattcctacgcatgacaccgaagtgacccgagaatggtaccaacaaacgcatgagcaacagcaacaacttaatgtgctcgtgcttgcaagtagctctacagttgtcatgcaggacgaatcttttccagcatgtaagatcgagttttag

SEQ ID NO: 124357 - DNA, 8418 bp, Artificial Sequence
  Description of Artificial Sequence: Synthetic coding sequence
atggacggcgtcgccgaattctctgaatatgttagtgaaacggtcgacgttccaagtcctttcgatcttctggagccgcccacatctgggggttttctgaaactgagcaaaccgtgctgctatattttccccggaggtagaggcgattccgcgctgttcgccgtgaacggatttaatattctagtggatggcgggagcgatcggaagtcttgtttttggaaactcgtccggcacctcgaccggatcgattccgtcttgctcacccacatcggagcagacaatctccccggtattaacggattgctgcagcgtaaagtggccgaattggaagaagaacagtcacaggggtcttcctcttacagtgactgggttaaaaatctcatttccccggaactgggagtggtcttcttcaatgtacccgagaagcttagactgccagatgcaagccgcaaggctaagagaagcatcgaggaggcgtgcttgacactccaacacctgaaccgtttgggcatacaagcagagcctttgtatcgtgtagtgtccaacacgattgagcccttaactctgtttcacaagatgggcgtggggaggctcgatatgtacgtactcaacccagtgaaggattcaaaggagatgcagttcctaatgcagaaatgggcgggcaattctaaggctaaaaccgggattgtgctgcccaatgggaaagaagccgagatttctgtaccctacctaacatctattacggcactggtcgtctggcttcccgctaatccaaccgagaagatcgtccgggtgctctttccaggcaacgcgccccagaacaagatactagagggtctggagaagctccgacacttagattttctgcgttatccagtggccactcagaaagacctcgccagcggggccgtgcctactaatctcaagcccagcaagatcaagcagagggcggactcaaaggaatctctgaaggcaacaaccaagaccgccgtgagcaagctcgccaagagagaggaagtcgtggaagagggcgctaaagaagccaggtctgagcttgctaaagaactcgccaaaacagaaaaaaaggcgaaagaatcttctgagaaaccccccgaaaagccagctaaacctgagagagttaagacggaatcttcagaggccctgaaagctgagaaaagaaagctcatcaaagacaaagtgggaaaaaaacacctgaaagagaaaatctccaaacttgaggagaaaaaggataaggagaaaaaggaaattaagaaagagcggaaagaactgaagaaggacgaaggcaggaaagaagagaagaaagacgcaaaaaaggaagaaaagcgtaaggacaccaaacccgagcttaagaagataagcaagccggacttgaaaccattcacaccagaggttagaaaaaccctttataaggccaaggttccgggcagggtcaaaattgataggagcagagccatccgtggggagaaagagttgagcagtgagccacaaacaccccctgctcaaaagggaacagttcccctgcctactatcagtggtcatcgcgaactggtgctttcctctcctgaggacctgacccaggactttgaggagatgaaaagagaggagagggcactcttggccgagcagcgtgataccggtttgggagacaaacccttcccacttgacactgccgaagagggacctccaagtacggccattcaggggactcccccgagcgtgcccggcctcggccaggaagaacatgtgatgaaagagaaggagctcgtgcctgaggttccggaagagcagggaagcaaggacaggggcctggacagtggagccgaaaccgaggaggaaaaggacacctgggaagagaaaaagcagagggaagcagagcgacttccagaccggacagaggcccgggaggagtctgagcccgaggttaaggaggatgttatagagaaagctgagctggaggagatggaagaggtacacccgtccgacgaggaggaggaggacgcaaccaaagcggagggtttttatcaaaaacacatgcaggagccactgaaggtgactccgcgaagtagagaggcattcgggggaagggagttgggacttcagggcaaagctccagagaaggagacgtctctctttctgtcttccctgactactcccgccggagccactgaacatgtctcctacatccaggatgagacgatccctggctacagtgaaacggagcaaacaatttccgatgaggagatccacgatgagccagaagagcgtcctgccccccctaggtttcacacctctacctacgacctgccgggccctgaaggggcaggccctttcgaggcctcccaacccgccgatagtgccgtccccgccactagtggtaaggtctacggcacgcccgagacagagctgacttacccgacaaatatcgtggccgccccactggcggaagaggaacatgtttcttctgctactagtattaccgagtgcgataagctgagtagttttgcaacttccgtggctgaggatcaatcggtagccagtctaaccgcccctcagacagaagagacaggcaaaagttctctgcttcttgataccgtgaccagcattccctccagcaggaccgaagcaacacaaggcctggattatgtccccagcgccgggactatttcaccgacctctagtctggaggaggataagggcttcaaatctcccccctgcgaagacttcagtgtgactggcgagtccgaaaagcgaggcgaaataataggcaaaggtctgtccggcgaacgcgctgtggaggaggaggaggaagagacggcgaacgtggaaatgtcagagaaactgtgtagccagtatggcactcctgttttttctgctcctggacacgcccttcatccaggtgagcctgcgctgggcgaggctgaggagagatgtctgtctcccgacgattccaccgttaagatggccagtcctccaccctctggtcctccctcggccacccacaccccattccaccagtcaccagtagaggagaaaagcgagccccaagatttccaagaggccgactcatggggggacacaaagcggaccccaggggtaggcaaggaagacgcagccgaagaaaccgttaaacccgggcccgaggagggtaccctcgagaaggaagagaaggtgcccccacctagatctccacaggctcaagaagctccagttaacatagacgaggggctcacgggctgtacgattcagctgctacctgctcaggacaaagcaatcgtgtttgagattatggaagctggggaacctacaggtcccatactgggggcggaggccctgcccggcggcctgaggaccctccctcaggaaccggggaagccccagaaggacgaggtcctgcggtaccccgacagatctctctctcccgaagacgccgagtccctgtctgttctctcagttccctcccctgatacagccaaccaggagcctacccccaagtcaccgtgtggcttgacagagcagtatttgcacaaagaccgatggcctgaggtgtctcccgaggatactcagtctttgtctctctctgaggaaagcccttccaaagagacatctttggacgtaagctccaaacagttatctccagagagcctgggcactctgcagtttggggaattaaacctgggtaaagaagagatggggcacctgatgcaggctgaagacacaagtcaccacacagctcccatgagcgttcctgagcctcatgcggccaccgctagcccacctaccgacgggaccacaaggtattcagctcagacagacattactgacgacagcctggatcgcaaatcccccgcctcttccttcagtcatagcactccgtcaggcaacggcaagtatctccccggggcaatcacatctcccgatgagcatatactgaccccagatagctccttttctaagagccctgagtccctccccggcccagcccttgaagatattgcaatcaagtgggaggataaggtgcctggcttgaaggacagaactagcgagcagaaaaaagagcccgagccaaaagatgaagtcctgcagcagaaagacaagacattggagcataaagaagtggtcgagccaaaagatacagccatttaccaaaaggatgaagcactgcatgtgaagaatgaagccgtgaaacagcaggacaaagcattggagcagaaaggccgggatctcgagcagaaagacacagctctggaacaaaaggataaagctctcgagcccaaggataaggacctcgaggaaaaggacaaagctctggagcagaaagataaaatcccagaggaaaaagacaaagcccttgaacagaaggacacagccctcgaacaaaaggacaaagctctcgagcccaaggacaaagacctggaacagaaggatagggttcttgagcagaaggaaaaaatccctgaagagaaagacaaggcgttggatcagaaagttagaagcgtggagcacaaggcgcctgaggacacagttgccgagatgaaggatcgcgatcttgaacagactgacaaagcccctgaacaaaaacaccaagcacaagagcagaaagataaggtgtccgagaaaaaagaccaggcacttgagcagaaatactgggcactgggccagaaagacgaggccctggagcaaaacatccaggcgttggaagagaatcatcagacacaggagcaagagagcctcgttcaggaagataagacccgcaagcccaagatgctggaggaaaaaagccctgaaaaagttaaagcaatggaggagaaacttgaggctctgctggagaagacaaaagcactgggccttgaggaaagtctggtccaggagggtcgggctcgggagcaggaagaaaaatattggcgcggtcaggatgtggtccaggagtggcaggagacctcacctacgcgggaagaacccgcaggggaacaaaaagagctggcacccgcctgggaggacacctctcctgaacaagataacaggtactggcgggggagggaggacgtggcactcgaacaggacacttactggagagagttatcctgtgagagaaaagtttggtttccacatgaactcgatgggcagggggcaagaccccactacaccgaagagcgagagagcacgttcctcgacgagggccccgatgacgagcaggaagtcccattgagagagcacgccaccaggagcccgtgggcctcagactttaaggatttccaggagtctagtccccaaaaggggttggaagtagagaggtggctcgctgaaagcccggtgggattgccccctgaggaggaggataaactcacaagatcgccgtttgaaattatctccccacctgcctccccgcctgagatggttgggcagcgcgttcctagcgcacctgggcaggaatccccgatacccgatcccaagctgatgccccatatgaagaacgagccaaccactccatcctggctcgctgacatcccaccttgggtgccaaaggacagacccctcccccctgccccattgtcgcccgcaccaggaccacccacccctgcgccagaatctcatacaccggcgcccttctcatggggcactgcagaatatgatagtgtcgtcgctgcagtccaagaaggagccgcagagctggagggtggcccatactctccgttaggaaaggactacaggaaagccgaaggagagagggaggaggagggtcgcgccgaagcacctgacaagtcaagccacagttcaaaggtgccagaggcttctaagagtcatgctaccacagagccagaacagacagagcccgaacagcgcgaacctacaccataccctgacgaacggagctttcagtatgccgacatctacgaacaaatgatgctgaccgggctgggtcctgcgtgtcctaccagagaacctccgttgggcgccgccggggattggccaccgtgtctatctacaaaagaggcagccgctggcagaaatacttctgcagagaaagaactctcttcccctatatcaccaaaaagccttcagagcgatacacccacattcagctatgcggcactggccggacctactgtgcctccaaggcctgagcctggaccttccatggagccctccctgacccctccagccgtcccaccacgcgcccctatcctatctaagggaccaagcccgcccctgaacggaaacattctttcatgctcccccgacagacgaagtccttcgccgaaagagagcgggcgctctcattgggacgatagcacgtccgactctgaactggaaaaaggcgcccgcgagcagcctgagaaggaggctcagagtccttcacccccacatccaattccaatgggaagtcccaccctttggccagagacggaagcacatgtcagcccccctctcgactcacacctcggaccggctagacccagcctagacttccccgcatcagctttcggcttctcctctctgcagcccgcgcctccacagcttccgtcgcccgccgagcctagaagcgccccttgcggctcactggcatttagcggggacagagcattggctctggctccaggaccacccacccgtacccggcacgatgagtaccttgaggtgacaaaggccccgagcttggacagtagtctgcctcaactccccagccccagcagcccgggcgccccactattgagcaacctgccacgccccgctagtcccgcccttagcgaaggaagctctagcgaagcaacaacccctgtgatcagctccgtggccgagagattttccccatcactcgaggcggcagagcaagaatccggggaacttgatcctggaatggagcctgccgctcactccctttgggatttaaccccactttcccctgcgccccctgcctctttagacctcgcactcgcccctgcacctagcctgcctggcgatatgggggatggcatcctgccatgtcatttagagtgcagtgaggctgcaaccgagaagccttctccatttcaagtgcccagcgaggactgcgcggctaatggtcccactgaaacctcacctaaccctcccgggcctgctcctgccaaggccgaaaacgaggaggcagcggcttgtcctgcatgggagcggggggcctggcctgaaggtgctgagcgttcttcacgtccagacacacttctgtctccggagcagccagtgtgcccagccggagggtccggcggccccccatcgtctgcatcccccgaagtggaggctggtccacagggttgcgctacagagcccagaccccatcgcggcgagctcagccccagcttcttaaacccacctctacctcccagtattgacgatcgggacctctctactgaagaagtgcgcttggtcgggcggggcggcagaaggagagtgggtggacccgggacaacaggcggaccgtgccctgttactgacgaaacaccacccacctccgcatccgatagcggttcttctcagagtgattccgacgtcccacctgaaactgaagaatgcccttccatcactgcagaggctgcccttgacagtgatgaggatggagactttcttccggtggacaaagcaggtggagtcagtggtacccatcatccgagaccgggtcatgatccccctccattaccccaaccagacccgcgcccttcccccccccggccagatgtctgcatggccgatccagaaggtctgtcatcagaatccggcagagtggagcgcttaagggagaaggagaaggtccagggcagagttggaagacgtgcgcccgggaaggcaaagcctgcatccccagcccggaggctcgatctacgggggaaacgctcccccacacctgggaaaggaccagccgacagggcaagcagagccccccctcgtcctagatcaaccacgagccaggtaacgcctgccgaggagaaggacggacactccccgatgtcgaagggacttgttaatggactcaaggctggacctatggcactgtccagcaagggaagttccggcgccccagtttacgtggaccttgcatatatccccaaccattgcagcggcaaaacggctgacctggattttttcaggagggtccgggcatcctactatgtggtaagtggcaatgatcccgccaacggagaaccttcaagggccgttctagatgcattgcttgagggaaaagcacaatggggcgaaaacctgcaagttagcgtcacactgatcccaactcacgatacagaggtgaccagggaatggtatcagcagacgcacgaacagcagcaacaactgaatgtgctagttcttgcttcgtcctccactgtggtcatgcaagatgagagctttccagcctgcaagatcgagttttag

SEQ ID NO: 124358 - DNA, 1884 bp, Artificial Sequence
  Description of Artificial Sequence: Synthetic coding sequence
atggatggcgtcgcggaattcagtgaatatgtgtctgagactgtagatgtccctagcccctttgacttgcttgagcctcccacctccggcggattcctcaagctctctaagccgtgttgttacattttcccgggcggacgcggggactccgctctgttcgcggtgaacggctttaacattctcgtagacggggggagcgataggaaaagctgtttttggaaactcgtcagacacctcgataggatcgattctgtcctgttgactcatatcggcgcagataatctccctggcattaatggactgctgcagcggaaagtcgctgagctggaggaagaacaaagccagggttcttcttcttacagcgattgggtgaaaaatctgataagcccagagctgggggttgtgttctttaacgttccggagaaattaagactgcctgatgccagccgcaaggctaagcgctccattgaagaggcctgcctgacattgcagcaccttaaccgactggggatccaggcagagcctctctacagagtcgtgtccaacacaattgagccactgacgctgttccacaagatgggggttgggcggcttgatatgtacgtgctaaaccctgtgaaggactcaaaggaaatgcagtttttgatgcaaaagtgggccggcaactctaaggcaaaaacaggaattgtcctgcctaacggcaaagaagccgagatttcggttccctaccttacctccataaccgcattagttgtttggcttccagctaacccgactgagaaaatcgtgagagtgttgtttcctggcaatgctccacaaaacaaaatcctcgaaggactggaaaagttacgccacctggactttctgcgctatccagtggccacgcaaaaagatctggcaagtggtgccgtgcccacgaacctgaagccatccaaaatcaagcagcgcgctgattctaaagaatctttgaaggcgaccactaagacagcagtgagcaagttggctaagcgggaagaagtggttgaggagggcgcaaaggaagctaggtcagagctagccaaggagctcgcgaaaacggaaaagaaggctaaggaaagttcagagaagccccccgaaaagccggccaagcctgaaagggtgaaaaccgagtcgtccgaggctttaaaggctgaaaagcgaaaactgattaaggacaaggtcggaaaaaaacatctcaaggaaaagataagcaaattggaggaaaaaaaagataaggagaaaaaagagatcaagaaagaacggaaggagctgaaaaaggatgagggcagaaaagaagagaagaaagatgctaagaaggaggaaaaacgcaaggacacaaagcctgaactcaagaagattagcaaaccagatctaaagcctttcacccccgaagtgcggaaaaccctatataaggctaaggtgcccggcagggtgaaaatcgatcggagcagagctataagaggagagaaagagctttcatctgaaccccagacccctcctgcccagaagggcacagtgcccctcccaacaatctctgggcacagagagctggttctgagctcccccgaagatctgacgcaagattttgaggagatgaagcgagaagagagagcattactggcagagcagagggacaccgggctgggggataagcccttccccttggacacggcagaggaaggacccccttcgacagcgattcagggtacccctccttcagtaccaggcctgggacaggaagagcacgtaatgaaagaaaaggagctcgtccccgaggtgccagaagaacaaggaagtaaagatcgtgggctcgacagcggagccgaaacagaggagaagaagaagaaaaagaaaaaaaaaaagtag

SEQ ID NO: 124359 - DNA, 1680 bp, Artificial Sequence
  Description of Artificial Sequence: Synthetic coding sequence
atggcagacgaacgaaaagatgaagctaaggcccctcattggacttctgcccctctgaccgaggcctctgcacacagccatccccccgagatcaaggatcaaggaggagctggagagggtctggtcagatctgcgaatggctttccatatagagaagacgaggagggggcatttggcgagcacgggagccagggcacctatagcaatactaaagagaatggaataaacggcgaattaacgagtgccgatagggagaccgccgaagaggtcagcgcgaggattgtccaggtcgtcacagccgaggcagtggcagtacttaaaggcgagcaggagaaagaggcccagcataaagatcagaccgctgccttgcccctggccgctgaggagacagccaatctcccaccgtctcctcctccgtcccccgcatccgagcagacggttacagtggaagaagcggctggaggcgaatccgccttggcccccagcgttttcaagcaggccaaagacaaagtaagtaactctaccttatctaagatccctgcccttcagggatcaaccaaatccccacgttattccagcgcatgccctagtactacaaagcgggccacatttagcgactcccttcttattcagccgacatctgccggttcgacagacagactgccttactccaaatctggaaacaaggacggtgtcactaagtccccagaaaaacgtagctcgctgcccaggccctcctccattctgcccccaagacgaggagtgtctggagacagagatgaaaattcgttttccctcaacagtagcatctcaagcagcgcccgacgcaccacacggagcgaacccatccgacgcgctggcaagagcggaacttccacccccacaactcccggtagcaccgccattaccccgggaacaccaccttcttactcgtcaaggacacctgggacaccagggactccaagctatccccgcacaccccacaccccggggaccccgaagtctgcaatcttggtgccaagtgaaaagaaggttgctatcatccgcacacctccgaagagccccgcaacacccaaacagttgaggctgataaaccagcctctgcctgatctgaaaaacgtcaagtcaaagattggcagtaccgacaacataaaataccagcccaagggcggacaggtccggatcctcaacaagaagatcgacttttctaaggtccagagccgctgcggatccaaagacaatatcaagcactctgctggcggggggaacgtgcagatcgtgaccaaaaagattgacctatcacatgttaccagcaagtgcggaagtctgaagaacatccgacatcggcccgggggcggtagggtgaagatcgagtcggtcaaattggacttcaaggagaaagcccaagccaaggtaggcagtctcgacaatgcacaccacgtgcccggtggcggaaacgtgaagatcgactcgcagaagctgaactttagggagcacgccaaggcacgggtggatcatggcgcagaaattatcactcaatcccctggccgtagctccgtcgctagccctaggaggctgtccaacgtcagctcatcaggatcgatcaacttgctggagtccccacaactcgccacccttgcagaagacgttacagctgcccttgccaaacagggcttatag

SEQ ID NO: 124360 - DNA, 5484 bp, Artificial Sequence
  Description of Artificial Sequence: Synthetic coding sequence
atggcggacgaacgcaaggatgaggcaaaagccccccattggacctccgcccccctcactgaggcctctgcccactctcacccacccgagattaaggatcagggcggagctggggaagggctcgtgcgtagcgccaacggcttcccctatagggaggatgaagaaggggccttcggtgagcatggttcccaggggacatattctaatacaaaggaaaacggcattaacggggaacttacctctgccgaccgcgaaaccgcagaagaggtctcagcccgcattgtgcaagtcgtcacggcagaagccgtggccgtgttgaagggggaacaagagaaggaagcccagcataaagatcagactgccgcgctgcctctggcagccgaggagaccgcaaatctgcctccgagcccccccccatctcctgccagcgagcagacagttaccgttgaggaagacttgctcaccgccagtaagatggagttccacgaccagcaggagctgaccccctccacagctgaaccaagtgatcagaaagaaaaggagtctgagaagcagtccaagccaggcgaggatctgaagcacgctgcgttggtgagccagccagaaacaactaaaacctaccctgacaaaaaagatatgcagggtaccgaagaagaaaaggctcctttggcactctttggccacacgctcgtagcctctctggaggacatgaaacagaagacagagccatctctggtggtacctggtatagaccttcccaaagaacctcccacgcccaaggaacagaaggattggtttatcgagatgcctacagaagcaaagaaggacgaatggggtcttgtagctcctatttcgcctggtccattaacccccatgagagaaaaggatgtgttcgatgatattccaaagtgggaaggaaagcagttcgattcacccatgccttctccatttcagggcgggtcctttacccttcctctcgatgttatgaaaaatgagattgtgaccgaaacttctcccttcgcacctgcattcttacagccagacgacaagaaatcactccagcagaccagcgggcctgcgacggcaaaggacagctttaaaattgaagaaccccatgaggctaagccggacaaaatggccgaggccccgcctagtgaagcaatgaccctgccaaaggacgcgcatataccagtggtcgaggagcatgtcatgggcaaggttctggaagaggaaaaagaagcaatcaatcaagagactgtacagcagcgggacactttcactccttctgggcaggaacccatcttgactgagaaggagaccgaactgaaactggaggagaagacgacaatttccgataaagaggccgttccaaaagaatctaagcccccaaaacccgccgacgaagagatcgggatcattcaaacctcgacagaacacaccttttccgaacagaaagaccaggaaccaaccactgacatgttaaagcaggatagctttccagtgtcactcgagcaggctgtcacagattccgccatgacatctaagacgttagagaaagccatgaccgagccttcggccctgattgaaaaatcttcaatccaggagctcttcgaaatgagggtcgatgataaagacaaaattgaaggtgtcggagccgctactagcgcggaactcgacatgcccttttatgaggataagtccggcatgagcaagtacttcgagacatctgctttgaaggaggaggcaacaaaatccatcgaaccgggtagcgactactatgagctctcggatacaagggagtctgtacacgagtcgatcgatacaatgagccctatgcacaaaaacggagataaggaattccagaccggaaaggagagtcagccctcaccacctgcacaagaggctggctactctacacttgcacagagctacccttcagatctaccagaagaaccaagctctccccaggagcgtatgttcaccattgaccccaaggtctacggcgagaagcgtgacctccattccaagaacaaggacgacctaacgttatctaggtccctgggattgggcgggcgtagcgctattgagcaacgctcgatgagcataaatctcccgatgagctgcctcgactcgatcgccctgggcttcaacttcggccgcggacacgatctctcacctcttgcaagcgatatcctgacaaacacctctgggagtatggatgaaggagacgactatctgccagccacaacaccagcactggagaaggctccatgtttcccggtggaatctaaggaagaggagcagatagagaaggttaaggctaccggcgaagagagtacgcaagccgagatttcctgcgagtcccccttcttggcaaaagacttctataagaatggcaccgtgatggctcccgatctcccagagatgctagacctagcgggcactcggtccagattagcctcagtctccgctgatgcagaggtggcccggaggaaatcagttccgtctgaaaccgtggttgaggattctcggaccggtctgccacccgtgacagatgagaaccatgtcattgtcaaaactgactcacaactagaagatctggggtactgtgttttcaacaagtacaccgtccccctcccaagcccagtacaggattctgagaatctgagtggtgagagcggaacattttatgagggcacagacgacaaggtgcggagggatctcgccaccgacctttctcttatcgaggtgaagcttgcagccgccggtcgagttaaagatgaattttcagtagacaaagaggcatccgcccacattagcggagacaaatcaggcctgagtaaagaatttgatcaggaaaagaaggcaaacgacaggttggacaccgtcttggagaagtctgaagaacacgccgactcaaaagagcatgctaaaaagacggaagaggctggagacgaaatcgaaacgttcgggcttggggtgacctacgaacaggcccttgccaaggatctgagcatcccaactgatgcaagctcagagaaggcagagaagggtctcagttccgttcccgaaattgccgaagtcgagccttctaaaaaggtggagcagggattagatttcgccgtgcagggccagctagatgtgaagatcagcgattttgggcagatggctagtggtctcaatatagatgacagaagagctaccgagctgaagttagaggctacccaggacatgaccccgtcaagcaaggctccacaggaggctgatgcctttatgggcgtggaatctggacatatgaaggagggcacgaaagtctccgaaactgaggtaaaagagaaggtggcaaagccagatttggtccatcaggaagccgtggataaggaggaatcctacgaatctagtggagagcacgagagtctgacaatggagtcacttaaggcagacgagggtaagaaggagacgtctcccgaaagttccttgattcaagatgagatagccgtgaagctttcagtcgagattccctgtccaccagccgtctctgaggccgatctggccacggacgaaagggcagatgtacagatggagttcattcagggccctaaggaggagagtaaggagacacctgatatttctattacccccagtgacgtagcagaaccgctacacgagacaatcgtgagcgagcccgctgagatccagagcgaagaagaggagatcgaggcacaaggcgagtatgacaagctgctgttcaggtctgatacacttcagatcaccgatctgggcgttagcggcgctagggaagagttcgtggaaacgtgtccttccgaacacaagggggtgattgagtctgttgtcacgatcgaagacgatttcatcaccgtggtgcaaacaaccacagatgagggagaaagtggatcacattcagttaggttcgccgccctcgaacagcccgaagtcgaaagaaggcccagtccacatgacgaggaagaattcgaagtagaggaggctgccgaggctcaggccgaacccaaggatggttcacctgaagcaccagcttcccccgagagagaggaagtcgcactaagtgagtacaagaccgagacgtacgatgattacaaagatgagacaaccatcgatgacagcattatggacgccgactccctctgggtggacacacaggatgacgatagatccatcatgaccgagcaactcgaaactattcctaaagaagagaaagcggaaaaggaagctagaagatcgagtctagagaagcataggaaggagaagccttttaaaacaggaagagggcggatcagcactcctgagcgtaaggttgctaaaaaggaacccagcaccgtgtcaagagacgaagtgcgccgcaaaaaagccgtttataagaaagccgaactcgccaaaaaaacagaagtgcaggctcacagcccatctaggaaattcatattgaaacctgcaattaagtacaccaggcctacacatctcagctgcgtgaagaggaaaacaactgcagcgggcggtgagtccgccttagctcccagcgttttcaaacaggctaaggacaaggtgagcgacggggtaaccaagtcaccggagaagcgcagctccctgccacgccccagttccattctgccacccaggaggggagtttcaggcgatcgggacgaaaattctttttccctgaactccagtattagttccagtgcaagacggaccacccggtctgagcctatccgcagagcaggcaagtctggaacctctactcctaccactcctggatccacggccataacccccggcactcctccttcatattctagccgaacacccgggacgcctgggacaccttcataccccagaaccccccatacccctgggacccctaagtctgccatactagtgcctagtgagaaaaaggtggctatcattcgcacacctcctaagagtcctgccacccccaagcaactccgcctgatcaaccagccactgcctgaccttaaaaatgttaagagtaagatcgggtccacagataatattaagtaccagcctaaggggggccaagtgcagatcgtgactaaaaagatagatttgtcacatgtgacttcaaagtgcggtagcctgaaaaacatccgccatagacccggaggtgggcgcgtaaagatcgagtctgtgaagctcgatttcaaagaaaaggcccaggccaaggtgggcagcctcgacaatgcccatcacgtgcccggcggcggaaatgtcaagattgatagccagaaactcaactttcgtgaacacgcaaaggcccgcgttgaccatggtgccgagatcatcacccagtccccgggtaggtcctccgtggcttcaccccgtcgcctgagtaacgtctctagttcaggctccatcaatctcctcgaatccccacagctcgctaccctagctgaagatgtcacagctgctttggctaagcaggggctttag

SEQ ID NO: 124361 - DNA, 1416 bp, Artificial Sequence
  Description of Artificial Sequence: Synthetic coding sequence
atggctgacgagcgcaaggacgaggcaaaggcacctcactggacctccgctcccctgaccgaggcctcggcccacagccaccctccagaaataaaggatcagggtggagccggagaagggcttgtccgctcagcaaacggctttccctatcgggaagatgaggagggggctttcggcgaacatggcagccaggggacttactctaacacaaaggagaatggcataaacggcgagctgacttcggcagatcgcgaaacagccgaagaggtgtcagctaggatagtacaggtcgtgaccgcagaggccgtggccgtactaaaaggagaacaggagaaggaggctcagcacaaggatcagacggctgccctgccattggccgccgaggaaacggctaacttgcccccaagccctccaccaagccctgcaagtgagcaaactgtgacagtcgaggaggccgctgggggcgaatcagcgctggcaccctctgtgtttaagcaggctaaagacaaggttagcgacggggtgactaagagccccgagaaacggagctcccttccacgcccctcctcaattctgcccccaagacggggagtgtctggggaccgagacgaaaactccttctccctgaatagcagcattagttcgtctgcgcggcggaccactagaagtgaaccaatccggagggcagggaagtcgggcacctctacgcccactactcccggctctaccgccatcactcctggcactccccccagttacagctctcgcacgcctgggacaccaggaacaccatcttatccacggactccacatacccccgggactccaaagtcagccatcttagttccctccgagaagaaggtcgcaatcatccggacgccccccaagagcccagcaacgcccaaacaacttcggcttattaaccagcctttaccagatttgaagaacgtgaaatctaaaattggatccacagataacattaagtaccaacccaagggcggtcaggtccagatcgtcacaaagaaaatcgacctgagccatgttacaagcaagtgtgggtccctcaaaaatatcagacaccgaccagggggcgggcgtgttaaaattgaatcggtgaaactggactttaaggagaaggctcaggctaaagtcggcagcctagacaacgctcaccacgtccccgggggcggcaatgtgaagattgattctcagaagctgaattttcgagaacacgctaaggcccgcgtagatcacggcgcggaaattatcacccagtcacccgggcgcagctccgtggcctcccccagaagactatccaacgtctccagctctggatccatcaatctgctggaatctcctcaactcgctacattggccgaggatgttacagcggctcttgctaaacaggggctttag

SEQ ID NO: 124362 - DNA, 321 bp, Artificial Sequence
  Description of Artificial Sequence: Synthetic coding sequence
atggctgacgaacgtaaagacgaagccaaggctcctcattggacgagcgcccctttgaccgaggccagtgcgcattcccacccaccggagattaaagaccaggggggcgctggcgaaggactcgtgcggagtgccaatggtttcccgtaccgcgaggacgaggagggggcatttggcgagcatggctctcaaggcacatacagtaacaccaaggagaacggtattaatggcgagctgacttccgctgaccgggagaccgccgaggaagtgtccgcgaggatcgtgcaagtggtgaccgcagaagctgttgccgtgctgtag

SEQ ID NO: 124363 - DNA, 1416 bp, Artificial Sequence
  Description of Artificial Sequence: Synthetic coding sequence
atggctgacgagaggaaagatgaggcgaaggcgcctcactggacgagcgcccccctcacagaggctagcgcgcattcgcaccccccagagatcaaggaccaaggcggggctggcgaggggctcgtaaggagtgccaatggtttcccataccgtgaggacgaagagggggctttcggagagcatgggagtcagggcacctacagcaacacaaaggagaatggcattaacggagaactgaccagcgctgaccgtgagactgcagaggaggtgagtgcccggattgtgcaagtggtgacagcggaagctgtggcggtgttaaagggcgaacaggaaaaggaagcgcaacataaggaccaaaccgcagcacttccccttgccgcagaggagaccgctaacttgccaccaagtccacctccctcacctgccagcgaacagacagtcaccgtcgaggaggccgctggcggagaaagcgccctggccccgtccgtgttcaagcaagccaaggacaaagtttcggatggggtgacaaagagcccagagaagcgtagcagcctccctcgccccagttcaattctcccgcctagaaggggcgtgagcggagatcgggatgaaaactccttctcactcaactccagcatctcatcgtcagcccggagaacaacacgatctgaacccatcaggcgagcaggtaagagtggcaccagtacccctacaacacctgggtctactgccatcactcctggcacccctccctcctactcatctcggacacctgggacccccggcaccccaagttacccacgtacccctcacacacctggaacacctaagagcgccattcttgtccccagcgagaaaaaggtagccattataaggacgcccccaaaaagccctgccactcctaaacagctgagacttatcaatcagccattgcccgaccttaaaaatgtaaaatcaaaaataggcagtaccgacaatatcaaataccagcctaaaggaggccaggttcaaatcgtgacaaaaaagatagatctttctcatgtgaccagcaagtgcggctctttaaagaacattcggcaccgacccggcggcggccgcgtgaagattgaatctgttaagctcgacttcaaagaaaaagctcaggccaaagtcggaagtctcgataatgctcatcacgtgccaggcggagggaacgtgaagatagatagccagaaactgaattttcgggaacacgccaaggcccgggtcgaccacggagcagagattatcactcagtctccaggcagaagctctgttgcctccccgaggaggctttctaatgtttcatcatctgggagtatcaatctgctggagagccctcagttggccacgctcgccgaggacgtcaccgccgcgctagctaagcaagggttgtag

SEQ ID NO: 124364 - DNA, 5472 bp, Artificial Sequence
  Description of Artificial Sequence: Synthetic coding sequence
atggctgacgaacgaaaggacgaggctaaggccccacattggaccagtgcgccgttgactgaggcctcagctcactctcaccccccagaaattaaagatcagggcggcgcgggtgagggcctggttaggtccgcgaatggatttccgtacagggaagacgaggagggggcatttggagagcatgggtcacagggcacatattcgaatacaaaggagaacggcatcaacggggagctcacctccgccgatagggaaaccgcagaagaggtatccgctcgcattgtccaggtagttacagctgaagccgtggcagtgctcaagggcgaacaagagaaagaagcccaacacaaggatcagaccgctgccctgccactagctgccgaggagactgctaacctgcccccctctccacctccaagtcctgcctcagaacaaaccgttactgtcgaagaggcttccaagatggagttccacgaccagcaggaactcacaccctcaacggctgagcctagcgaccaaaaggagaaggaatcagagaaacagagtaagcccggagaagatttgaaacacgccgcattagtgtcccagccggagacaaccaagacgtaccccgataagaaagacatgcaaggcacggaggaggaaaaggcccctctcgccttgtttggccacacactggtggcaagtctggaagacatgaagcagaaaaccgagcccagcctggtcgtgccaggcatcgacttacccaaagagcctcctacccccaaagaacagaaagactggtttatcgagatgcccactgaagctaaaaaggatgaatggggccttgtggccccaatctcccccggacctctgacgcctatgcgagagaaagacgtatttgacgatatcccgaaatgggagggaaagcagttcgatagtccaatgccttccccattccaaggtggcagtttcacgctgccgctggacgtaatgaaaaacgagatagtcaccgaaacatcccccttcgcccccgcgtttctgcagcccgatgacaaaaaatccctgcaacagacgagcgggccagctactgctaaggacagctttaaaatcgaggagcctcatgaggcaaagcccgacaaaatggctgaggcccctccctctgaagcgatgactctccctaaggacgcacatatccctgttgtggaagaacacgtcatgggcaaggtgctggaagaggaaaaagaagctattaaccaggaaaccgtgcagcagagggacacgtttacccctagcggacaagagcctatcctgactgaaaaagagactgaactgaagctcgaggaaaaaacaacgatctctgacaaggaggcagtgcccaaggagagcaagcctccgaaaccagccgatgaggagattggaattattcaaacttccacagaacacactttctcggagcaaaaagatcaggaacccacaactgatatgttaaaacaagattcatttcccgtgagcctcgaacaggccgtcacagactccgccatgacatcgaagaccctcgagaaagcaatgactgaaccaagcgcactgatcgagaagagttccatccaggagctattcgagatgcgggtcgatgacaaggacaaaatcgaaggtgtcggggccgctacaagcgccgaactcgatatgcccttctatgaagataaatcaggaatgtccaaatacttcgagacctctgcacttaaagaagaagccacaaagagcattgaacccggctccgactattacgagctttccgacacacgcgagtctgttcatgaatctatcgatacaatgagtccaatgcacaagaacggagacaaggagtttcagaccggtaaggaaagtcagccttcgccaccagctcaagaggctggttattctacccttgctcagagctatccctcggatcttcccgaagagccttcctccccacaggaacgcatgttcacaattgacccaaaggtatacggagaaaagagagatctgcatagcaaaaacaaggatgatttgactctctcgcgctcgttgggcctgggggggagatccgccatcgaacagagaagtatgagcatcaatcttcctatgtcgtgtctggattccatcgccttgggttttaacttcgggaggggccacgatcttagtcccctcgcctccgatatcctgaccaataccagtggaagtatggacgagggcgatgattatctgccagccactactcccgcactggagaaagctccgtgttttccagtcgagagcaaagaggaagagcagattgagaaagtcaaggccacgggtgaagagagcacccaagccgagatctcatgcgagagtccctttctggccaaagacttctacaagaatggcacagtaatggcgcctgacctgccggagatgttggatctggcggggacccggtcccgtctcgcttcagtaagcgccgatgccgaggttgcacgcagaaagtcagtgccaagcgaaaccgtggtagaagattcccgcaccggcctgccaccggtgaccgatgaaaaccatgtgatcgtgaaaacggactcccaacttgaagacctcggttattgtgtctttaataaatacaccgtcccactgcctagtcccgttcaggatagcgagaatctgtcaggtgaatccggaacattctacgaaggaactgatgacaaggtccggagggacttggcaacagacctatctcttattgaagtaaagctagccgctgctggccgcgtgaaggacgaattctccgtagacaaggaggcatccgcacatatttctggcgacaaaagcggtctgagcaaggagttcgaccaggagaaaaaggccaatgaccggctggacactgtcctagagaagtcggaagagcacgcagactctaaggaacatgctaaaaagaccgaagaagcaggcgacgagattgagacttttgggctcggagtaacctacgagcaggcattagccaaagatctctccatccccacggacgcaagttcggagaaggctgagaagggactcagcagcgtccccgagattgccgaggtggagccaagtaagaaagtggagcaaggcttagactttgctgtgcagggacagcttgacgttaagatatcagacttcggccagatggcatctggactgaatattgatgatagaagagcgacagaactgaagctggaggctactcaggacatgacacctagcagcaaagctcctcaggaagccgacgcattcatgggagtagaatccggacacatgaaagaagggaccaaggtatccgagaccgaggtcaaagagaaggtagcgaagcctgatctggtgcaccaggaagcggtggacaaggaagagtcatatgagtcttccggtgagcatgagagtctgacaatggagtctctgaaagcggatgaggggaagaaagagacatcacccgaatcatctctgatccaagacgaaatcgccgtgaaactgtctgttgaaatcccgtgcccccctgcagtgtccgaggctgaccttgctacagacgagcgcgccgacgtgcagatggagtttatccagggccccaaggaggagtctaaggagactccggatatctctatcaccccctctgacgtggctgaaccacttcacgaaacgatcgtaagcgaaccagcggagattcagtctgaggaagaagagatagaagctcaaggggagtacgacaaattactgtttcgttctgatactctgcagataactgacctgggagtcagcggtgcccgggaggagttcgtggaaacatgtcccagtgaacacaagggggtaatcgagtcagtcgtgaccattgaggacgatttcattacagtcgtgcagacaactactgatgaaggggagtccggaagccactccgtgagatttgcggcccttgagcaacctgaagtggaaaggagaccctccccccatgacgaagaggaatttgaagtcgaagaagcagcggaagcacaggcagaaccaaaggacggttctcctgaggcccccgcgtctcctgaacgcgaggaggtggccttgtccgagtacaagactgagacttacgatgattataaggacgagacgaccatagacgactcaatcatggatgcagacagtctctgggtcgatactcaggacgacgaccgcagcatcatgaccgaacagttggaaacaatccctaaggaagaaaaagccgaaaaggaggccaggcgtagctccttagagaaacaccgcaaggagaagccattcaagactgggcgaggccggatttcaacacctgaaaggaaagtggctaaaaaagagccctcgacggtctcacgggacgaagtgcggaggaaaaaggcagtatataaaaaagcggagctcgccaaaaagactgaagtgcaggcccattcaccctctcgcaaattcattctgaagccggctatcaaatacacaaggcccacccatttatcttgcgtgaaacgcaaaacaactgccgcaggaggggaaagcgctcttgccccatccgtattcaaacaggctaaggataaagtttctgacggagtcacaaagtctcctgagaagaggtccagtctgcctcgtcccagctctattctgcccccacgacggggtgtcagcggagacagggacgaaaactccttctctttgaactcttccattagcagctctgctcgcagaacaacaagatctgagccgatacggagggctggtaaatccggtacaagtacaccaaccacaccaggctctaccgcgataacaccaggcacaccaccatcgtactcttcacgaacaccaggaacgcctggcactccctcctaccctaggacccctcatacaccaggaacccccaagtccgccatcctggtaccatccgagaaaaaagtggcgattatacggactcctcctaaatctccagccacacccaagcagctcagattaatcaaccagccactgccagacctgaagaatgtaaaatctaagatcgggtcgaccgacaacatcaagtatcaacccaagggcggccaagtgcagattgtgacaaaaaaaatagatttgtctcatgtgaccagtaaatgtggatctcttaagaatattcgtcatcggccaggcggcggacgggtgaagattgaatctgtgaagctcgactttaaggagaaggctcaggccaaggttgggtcactggacaacgcgcaccatgtacctgggggcgggaatgtcaagattgattctcaaaaactaaacttccgcgagcatgccaaagccagagtggaccatggcgctgaaattattacacagtctcccggccggtcatctgtggcttctcctagacgactgtcgaacgtgagttcctcaggttccatcaacctgctcgagtccccacagctggccactctcgcggaggatgtaaccgctgccctggctaaacaaggcttgtag

SEQ ID NO: 124365 - DNA, 2664 bp, Artificial Sequence
  Description of Artificial Sequence: Synthetic coding sequence
atggagactactggtgaccaggggatcgaggggatggcatacatggacgaaaaccggaacatcaccttcacttgtcctagaacaccatctgagttgattaataagtcctctcctttagaggtcttggagtctgctgcctgtgagaagttgccaactcccactccacaagtcgttaaggaaggagacagctttcccgatactctggcaaagaatgggcaggaaattgctccagcgcagatatccaaaagtctaatggttgacaactacacgaaggatggggtgcccggtcaggaaaggcctaaaggcccttccgcagtggtgccaagtaccagcacgggaggtgtagcgctgccaattaccaccgcgatcgaaacagtgaacatacacggtgatcactcccttaagaataaggctgagcttgccgacagtatgaaaaatgaggccggcattgatgagggccacgttattggagaaagtgaaagcgtccactcaggcgcaagtaagcactcagtggaaaaagtcaccgaactggccaagggccacttgctgcctggggtccccgtcgaagaccagagtctgccaggggaagcacgggcactagaagggtatgccgacagagggaattttcctgcccatcctgtcaatgaggaaaaagagaccaaggaagggagcgtagccgtgcagatccctgatctgttagaggataaagcacagaaactgtccttctgcgaagatcaaaacgcacaagatcggaatagtaaagggagcgactctctgaataagaaagtggacctcacgctattgtctcctaagagcgagaatgacaagctcaaagagatttcattagcatgcaagattacggagctggagtcagtctcgctcccgacgccagagatacaatctgactttttgcatagtaaggttgaggccccaccaagcgaggtggccgatactctggttattatgacagcctccaaaggcgttcgcctgccagagccgaaagacaagattctcgaaactccccagaagatgaccgaaaagtccgagtctaagactcctggggaagggaagaaggaagataagtcccgaatggcggagccaatgaagggatacatgcggcccacaaagagtagaggcctgacaccattgttacccaagtctaccatccaggagcaggaaaggcacaagcagttgaagtcagccgggattgcacggcccgaagaagggaggcctgtcgtaagcggtacggggaatgacatcactacccctccaaacaaggagcttcccccttcaccggagaagaagaccaaacccttggcgacaactcagccagctaagactagcacatccaaggcaaaaacccagcccactagcctccctaagcagcccgcccccaccacgatcggtgggcttaataagaagcctatgtctctggcgtctggtctggttcccgctgctcctccaaagcggccggccgtggcgtcagctaggccatctatcctgccatcaaaagacgtcaagcctaaacccatcgcagatgccaaagcccccgagaagcgcgcatcaccatcaaaaccagcttctgctcccgccagccgcagcggaagcaaatctactcagaccgtcgcaaaaacaaccacggctgcggccgtcgcttctacggggccatcctcgcggtccccatctaccctgctgcccaaaaagcccacagctatcaaaactgaaggcaagccagccgaggtgaagaaaatgactgctaaatctgtccccgccgatctgtcaaggcctaagagtaccagcacaagtagcatgaagaagacaacgactctgagcggtactgctcccgccgccggcgttgtcccatccagagtaaaggctacccccatgccctccaggcctagtaccactcctttcattgataaaaagcctacaagcgcgaaacccagcagtacaacaccacggctgtctcgcctagcgaccaacaccagcgctccggatctgaagaatgtccgtagtaaagtggggtctacagagaatatcaaacatcagcctggcggaggacgagccaaggtcgaaaagaagacagaggctgctgcaaccactaggaaaccagagagcaacgccgttaccaaaactgcaggcccaatagcctctgcccagaagcagccagcaggcaaagttcagatagtttccaaaaaagtgtcttacagccacattcaatctaaatgcggttctaaggacaatattaaacacgtgcctgggggtggcaatgtgcagatacaaaacaaaaaggtagatatcagtaaagtttcttctaagtgcggcagtaaggccaacattaaacataagccagggggtggcgacgtcaaaatcgaatcccaaaagctaaattttaaagagaaagctcaggccaaggtgggctctttagacaatgtaggccatctcccagccgggggggcggtgaaaactgagggcggaggtagtgaagctccactatgccccggcccacctgcgggggaggagccagccatatctgaggccgcaccagaggcaggcgctccaacgtccgcgagcggcttaaatgggcaccctacactgagcgggggtggcgatcagcgcgaggcccagaccctggacagccagattcaggagacttccatatag

SEQ ID NO: 124366 - DNA, 1392 bp, Artificial Sequence
  Description of Artificial Sequence: Synthetic coding sequence
atatgtgaggaaccagtggccaaaaagagggaagagttagcacacttctctaattccagctcgaattccggaaagaaagaactggggacggccggcttatatcttcacagtaagctcgaacaaatcccagaaggttcaagtaaagagaaaggacaagaagatttttcggagaccaggatagatagttgctcacaggtgtgccagcggggggagaagcagcccggccagaccgccctggctggcaaaaaagagattgaagtaactgcaactcagagcacaccgtcttttcttttcgagaaacccccccgagacgggatcgcacgaccagaggaggggaggcctgtggtcagtggcaccggtaatgacattactacgcctcccaacaaagagctgcctcccagccctgaaaagaaaacaaaacccatcgcggatgcgaaggcaccagaaaagcgggcaagcccatccaagccagcctcagctcctgccagcaggagcggctctaaatcaacacagaccgtcgccaaaacgacaacggccgctgcagtcgcgtctaccggaccttcgtcaaggagcccgtctacacttctgcccaagaaacctaccgccatcaaaacggaaggcaagcccgctgaggtcaagaaaatgaccgctaagtccgtcccagccgacctaagccggccgaagagcacctcaacgagttctatgaaaaagacaacaacccttagtggaaccgccccagccgctggagtcgtcccttccagagtcaaagcaactcccatgcctagtcgccctagtaccaccccttttatcgataagaagccgacgtctgccaaaccaagcagtacaacaccgcgattatctcgactggcaaccaacacgtctgctccagacctgaaaaacgtgagaagtaaggtggggtccaccgaaaacatcaaacatcagcctgggggcgggcgggtccaaatcgtctccaagaaggtcagctacagtcatatccagtctaaatgcggcagcaaagataacatcaaacacgtgccgggtggcgggaacgtgcagattcagaacaaaaaggtggatattagtaaagtttctagcaagtgcggaagcaaggctaatattaaacacaaacccggcggaggtgatgtgaagatagaatctcagaagctaaacttcaaagagaaggcccaagccaaagtgggaagtctcgataacgtgggtcacctcccggccggcggagccgttaagatagagacgtaccggctcacatttagggccaatgctcgagctcgcacagatcacggcgcggacattgtctctagacctcctcacttccccgggggaccaaattcagggtcacgagtgttgggaccattgtctcgggccgtacattag

SEQ ID NO: 124367 - DNA, 3459 bp, Artificial Sequence
  Description of Artificial Sequence: Synthetic coding sequence
atggcagacctgtctctcgctgatgcccttacagaaccttcgcccgatatcgaaggcgagatcaaacgggacttcattgcaacactggaagcagaagcttttgatgacgtggtaggagagaccgttggaaagacagattacattcctctgcttgacgtggacgaaaaaacagggaatagtgaaagcaaaaagaagccgtgctcagaaacctcccagattgaagacaccccgtcttcaaagcccacgctgctggccaacgggggccatggggtcgaaggatcagatacaacaggttcacccactgagttcctggaagaaaagatggcttatcaagagtatcccaactcccagaactggcctgaagacacaaatttctgctttcagccagaacaggtggttgatcccatccagaccgacccattcaagatgtatcacgacgatgatctggccgacctggtctttccaagctcggccactgccgatacgagcatattcgcggggcagaacgatccactgaaggattcttacggcatgtccccctgcaacaccgcggtggtgcctcaagggtggtctgtggaggcactgaactcccctcatagtgaatctttcgtctcaccagaggcagtcgccgaaccgcctcagccaacagctgtaccactggagttggcgaaggaaatcgagatggcatccgaggagcgaccgccggcacaagcgctggaaattatgatgggcttgaagacaactgacatggctccttcaaaggaaaccgaaatggctctagcgaaggacatggcattagctacaaagactgaagtggcattagccaaggatatggagtcccccacaaagctagatgtcacgctggccaaggacatgcagccgtcaatggagtctgacatggctctagtcaaagatatggagctccctaccgagaaggaggtggcccttgttaaggacgtgaggtggcctaccgaaaccgacgtcagctctgccaagaacgttgtcctaccgacggaaaccgaagtggctcctgcaaaggatgtgaccctcctgaaggagactgagcgcgctagtcctattaaaatggatctggcaccttctaaagacatgggaccgcccaaggagaacaagaaggagaccgagcgggcctctcccattaagatggatttggctccatccaaagatatgggacccccaaaggagaacaagatcgtgcccgccaaggacctcgtgttgctttccgaaatcgaagttgctcaggcaaacgacataatctctagcacagagatttctagcgcagaaaaagtggccctgtcgagtgagactgaagtggccctggcgagagatatgacactgcccccagaaactaatgtgatcttgaccaaggacaaggccctcccactggaggctgaagtcgccccagttaaagacatggcgcagctgccagagacggagatcgctcccgccaaagatgttgccccctctaccgtgaaggaggtaggccttctgaaagacatgtccccactgtccgaaaccgaaatggcgctcggcaaggacgtcactcctccgcccgaaacggaggtggtactgatcaagaacgtgtgtctgcccccagagatggaagtggctctgactgaagaccaggtccccgcactgaaaacagaagcaccacttgcaaaggacggtgtgttgactttggccaacaatgtgaccccagccaaggatgtgccccccctgtcagagaccgaagctacccctgtacccattaaggatatggagatcgcgcagacccagaaaggaattagtgaagattctcacctcgaatcgttacaagatgtagggcagagtgctgccccgaccttcatgatctctcctgagactgttacgggaactggaaagaagtgtagtctgccggctgaggaagacagcgttttagagaagttgggcgagcgtaagccctgcaactcccagccatcggagctgtcatccgaaacttcagggatcgcacggcctgaggaaggacgtcctgtggtgagtggaaccggcaatgatatcactactcctccaaacaaggaactccccccttcaccagagaagaagacaaagcccctcgctacaacgcagcccgcaaagacttccacaagcaaagctaaaacgcaaccgacaagccttccaaagcagcccgcccctacgactataggaggacttaacaaaaagcccatgtctctggccagcggcctggttcccgctgcaccacccaagagaccggcagtcgcttctgccagaccatctatccttccttcgaaggatgtcaaacctaaacccatagcagatgcaaaggctcccgagaagagagcttctccgtccaagcccgccagcgcaccagcctccaggtccgggtcgaagagcacacaaaccgtcgcaaagacgactacagctgcagctgtcgcctcaacgggcccaagcagcaggtctcctagtaccctgctgcccaagaagcccacagcaataaaaactgaggggaagccagcagaggttaagaaaatgaccgccaagtccgtgcccgccgacctttcgcgtcccaagtccacctctacctcgtccatgaaaaaaaccacgactctgtcaggcacagcgcctgctgccggggtagtgccttctagagtgaaagctacccctatgccctctcgaccatctactacaccatttatagataaaaagcctacatccgctaaaccttcgtcaacgacccctaggctcagccgcttggccacaaatacttctgcaccagatctgaagaacgtccgctctaaggtgggctccaccgaaaacataaagcaccagcctggaggcggacgtgctaaggttgaaaagaagaccgaggccgcagcaacaaccaggaagccggaatcgaatgctgtgaccaagacagccggaccgatcgcctcagcccagaagcagccagccggcaaagtgcagattgtttccaagaaagtgagttattcgcatatccagagtaaatgtgggtctaaagacaacatcaagcatgtgccagggggaggtaacgtgcagattcagaacaaaaaggtggacatctcaaaggtgagcagcaagtgtggttccaaagcgaatatcaagcataagcccgggggcggcgatgtgaagatcgaatctcagaaactgaattttaaggaaaaagcccaagcaaaggtcggaagcctggataatgtcgggcatctgcccgctggtggagccgttaagaccgaaggggggggaagtgaggcacctctgtgccccggccctccagctggcgaggaaccagccatctccgaggcggctcccgaagcgggggccccaacttctgccagcggactgaacggacatccaacactgagcggaggaggcgatcaaagggaggcgcagacactggacagccagattcaggaaacatctatttag

SEQ ID NO: 124368 - DNA, 2139 bp, Artificial Sequence
  Description of Artificial Sequence: Synthetic coding sequence
atggagactaccggagaccaaggaatcgagggaatggcttacatggatgaaaataggaacatcacatttacttgcccccgaaccccatctgaattgatcaataagtcatctcctctggaagtactggagagcgcagcttgtgagaaactgcccaccccaacccctcaggtcgttaaggagggagattctttcccagatacccttgccaagaacggacaagaaattgctcctgcccagatctcaaagtccttgatggttgacaattacaccaaggacggggtgccaggccaggaaagacctaagggcccatcggcagtcgtcccgagtacttcaactggcggggtggcactgcctattacgaccgcaattgagactgttaatatccatggggatcattctttaaaaaacaaggctgagctcgccgattccatgaagaacgaggctggaatcgacgagggtcatgtgattggagaaagcgagtcagtccattcaggggctagtaaacattccgtggagaaagtcaccgagctggccaagggccatctccttccgggcgtgccagtggaggatcagtctctgccaggagaggctagggctttagaaggttacgctgaccgcggaaacttccccgcccacccagtgaacgaagaaaaggagacaaaggagggttccgtcgcagtgcagatccccgatctgctcgaggataaggcacagaagcttagcttctgtgaggaccaaaatgcccaggacagaaactcaaaaggatctgattcgttgaataagaaggtggatttgactctgctctcccctaaatccgagaatgacaagcttaaggagatctcgctggcctgcaagatcaccgaactggaatccgttagtctaccaaccccagagattcaaagcgactttctgcactcaaaagtcgaggcccctccaagtgaagttgcagataccctggtgatcatgaccgctagcaagggggtgagactaccggaaccaaaagacaagattctagagacccctcagaaaatgaccgagaagtccgaatccaaaaccccaggcgaaggaaaaaaagaggataagagtagaatggccgaaccaatgaagggttatatgaggcccaccaaatcacgtggcctgactcctcttctacctaagagcactatccaggagcaagaacgtcacaaacagctaaaaagcgctgggatagcacggcctgaggaaggccgccccgtggtcagcgggacaggaaacgatattaccaccccccccaataaggaattaccccctagtccagagaagaagaccaaacccttggctaccactcaacccgctaagacctccacctctaaggccaagactcagcctaccagccttcccaagcagccagccccaactacaattggtggtctcaataaaaagccaatgtcactggcctcagggcttgttccagcagctccccctaaacggccagcggtagcttccgcccgccctagtatactcccttctaaggacgttaaaccaaaacccattgctgatgcgaaggcacccgagaaaagggcatcgccgagcaaacccgcatcagctcctgccagccgaagtggatccaagtccacccagacagtggcaaagacaactacggccgctgccgtcgcttccacaggcccctcctcaaggtccccatctactctgttgccaaagaagccaaccgctatcaagacagaaggcaagccagcggaagtgaaaaagatgacagctaaaagcgtgccagcagatctgagccgacctaagtccacttctacatctagtatgaaaaagaccacgacattatccggcacagcccctgccgccggtgttgtaccctcccgcgttaaggctacaccgatgccatctcggccttcaaccactccctttattgataaaaaaccaacgtctgccaaacccagcagcacaactccacgtctgtcacgcttggcaaccaatacgagcgcgcccgatcttaagaatgtccgtagtaaggcaaaagtagaaaagaagactgaggccgccgccacaacaaggaagccagagagtaatgcagtgacaaagacagctggccccatcgcatcagcccagaagcaacctgcgggaaaagtctag

SEQ ID NO: 124369 - DNA, 2436 bp, Artificial Sequence
  Description of Artificial Sequence: Synthetic coding sequence
atggcagacctcagcttggccgatgcattgaccgaaccaagtcctgacatcgagggtgaaatcaaacgcgacttcatcgcaacactggaggccgaagcatttgacgatgtggtgggagaaactgtcgggaagaccgattatatccctctgcttgacgttgatgagaagactggaaactcggagtccaaaaaaaaaccctgttcagagacttcccagattgaggatacaccaagttcaaagcccactttgctggccaacggaggccacggggtggagggctcagatacaaccgggtcacccaccgaattcctggaagagaagatggcatatcaggaataccccaattcccagaactggcccgaagatacgaatttttgttttcagcctgaacaggtggttgatccgatacaaacagacccgtttaaaatgtatcacgacgacgacttggccgatctggtatttccctcctctgccactgctgacacctctatcttcgccggccagaatgatcctctgaaggacagctatggaatgtctccttgtaatactgcagtggttccacagggatggtccgttgaggccttgaattcaccccacagtgagagcttcgtatctcctgaagctgtggctgagcccccacaacccactgccgtgcctctggaattggccaaggaaatagagatggcgagcgaagaacggcctccagcgcaggccctggagattatgatggggctaaaaaccaccgacatggccccttccaaagaaacagagatggccctggccaaagacatggcgttagcaacgaagacagaggtagccctggccaaagatatggagagccccaccaagttggacgtgacccttgccaaggatatgcagccaagcatggaatcagacatggcactggtaaaagacatggagctgcctaccgaaaaagaagttgccctagtgaaagacggggtgcgtttgccagaacctaaggacaagatcctcgagaccccacaaaagatgaccgagaagagtgagtctaaaaccccaggcgaggggaagaaagaagacaaatctcggatggccgagcctatgaaagggtatatgcgtccgacgaagtcccgaggtctgacaccactgctccctaagagtacgatccaggagcaagagcggcacaagcagctcaagagcgctggaatcgctcggcccgaagaaggccggccggttgtgagcggtacagggaatgatattactaccccacccaataaggagctgcctcctagtcccgagaaaaagactaagccacttgcgactactcagccagccaagacgtccacctcgaaagccaagactcagcctacctccttgccaaagcagcccgctcccaccacaatcggaggcctgaataaaaaaccaatgtcccttgcaagcggcctggtccccgccgcgcccccaaagcgacctgccgtcgcttcagcaagaccatccattctcccatccaaggatgtgaagcctaaaccgatcgctgacgctaaggcccccgagaagagggcctcaccaagcaagccggccagtgctcccgcgagtcgcagcggcagcaaatccactcagaccgtagccaagactactaccgctgcagctgtggcttccaccggaccttcgtctcgcagtcctagcactctgctgcccaaaaagccaacagctattaaaactgaagggaaaccagccgaagtgaaaaagatgacagctaaatctgtgccagctgacctgagccgtcctaaaagtactagtacttcctcaatgaaaaaaacaaccacgcttagcggtaccgcccctgcggctggggttgtaccaagtagggtgaaggctacacctatgccatctagaccatcaactactcccttcattgacaagaagccgacatcagctaaaccgtccagcactacccctcgactctcccggctggccacaaacaccagcgcaccagacctgaagaacgtgcggtccaaggtgggctctaccgagaacattaagcaccagcctggaggcggccgggtccagatccaaaataaaaaagtcgacatatcaaaagtctccagtaaatgcggcagtaaggccaacataaagcacaagcctggcggcggagacgtgaagatcgagagtcagaaattaaacttcaaggaaaaagcacaagctaaagtgggctctctcgataacgtgggacacctgcccgctggcggagcagtaaagaccgagggtggagggagcgaggccccactgtgccccggcccacccgccggggaagagcccgcgatcagcgaagccgcacccgaggccggtgctccaactagcgcatcggggctgaacggacaccctacgctgagcggcggtggtgaccaacgggaagcacagaccctggacagtcagatccaggagacgagtatttag

SEQ ID NO: 124370 - DNA, 3408 bp, Artificial Sequence
  Description of Artificial Sequence: Synthetic coding sequence
atggccgacttgtcgctggctgatgcgttgaccgagccctcccctgacatcgagggggaaattaagagagattttatcgcaacactcgaggctgaggctttcgatgatgtggtcggggagaccgtcggaaagaccgactatatcccccttcttgatgtggatgaaaaaacaggaaacagcgagtctaaaaagaagccatgctcagaaacaagccagatagaagacacacccagctccaagccaaccctcctcgccaacggtgggcatggagtggagggctcggacacaaccgggtccccaacagagtttctagaggaaaagatggcatatcaagaataccctaatagtcagaactggccagaagatactaatttttgctttcaacccgagcaagtggtcgatcctatccaaaccgacccctttaaaatgtatcatgacgacgacctggcagacctcgtgtttcctagttcagcgacggctgacacctccatcttcgcgggccaaaacgacccactaaaagactcttacggcatgtcaccttgcaacactgccgtggtgccacagggttggtcggtcgaagctttgaattctcctcacagcgaatcctttgtgtcacccgaggccgtggccgagcccccgcagccgactgcagtaccactggagctggctaaagaaatcgagatggccagcgaagagcgcccaccggcacaggctctcgaaataatgatgggtcttaagacaactgatatggctccttccaaggaaaccgagatggccctggccaaagatatggccttagccactaaaacggaagtggcccttgcaaaagatatggaatctcccactaagttggacgtgacgctggccaaggatatgcagccatccatggagtctgacatggcacttgtgaaggatatggagttgcccacagaaaaggaggtcgcgctggtgaaggatgtacgctggcccacagaaactgatgtctccagcgccaagaacgtggtacttccaactgagaccgaagtggcccctgctaaggatgtgactcttcttaaggagaccgagcgagcttctcccattaagatggacctggccccctcaaaggacatggggccccctaaggagaacaaaaaagagaccgagcgtgccagcccaatcaaaatggaccttgcacccagtaaagacatggggccccccaaggagaataagatcgtgccagcaaaagacctcgttctgttgtctgaaatcgaagtggcacaagcaaatgacattattagcagtaccgaaataagctctgcagagaaggttgccctgagctctgagacagaagtggcactggctagggacatgaccttgccacccgaaactaatgtgatcctgaccaaagacaaagctttgccgctcgaggcagaggtcgctcctgtcaaggacatggcccagttgccagagaccgagattgccccggccaaggatgttgcgccttcaactgttaaggaggtcgggctgctgaaagacatgtccccattgtcagagacagagatggccttaggaaaggacgtgaccccaccaccagagaccgaggtagttttaattaagaatgtgtgccttccacccgaaatggaggtggctcttacagaggatcaggtaccggctctgaagaccgaggcgcctctggccaaagatggtgtgcttaccctggcaaataatgtgacgccagcgaaggatgtccctccactttcagagacagaagctaccccagtgcctataaaggacatggaaatcgcccaaacccaaaagggcatttcggaggactcacatctagaatcacttcaggatgtgggccagagcgcagcgccaacctttatgatctcaccagaaaccgtgaccggaacgggcaaaaaatgctcactccctgccgaggaggatagtgtcttggagaaactgggagagagaaaaccttgtaattcacagccaagtgaactgagttctgagacttccggaatcgcccggcccgaagaaggccgaccagtcgtatctggaaccggtaatgatattacgacacctcccaataaggaactcccacctagccccgagaagaaaaccaagcccctggccaccacccagcccgcaaaaacgtctacgtctaaggccaagactcagccgacgtcactgcctaagcagccagctcctaccaccatagggggcctcaacaagaaacccatgtcgctggcttccggacttgtccccgcggccccccctaagaggcctgcagtggcaagcgccaggcctagtatcctgccctcaaaggatgtgaaacccaaacccatcgcggatgcaaaggcgccggaaaagcgagccagtccttcaaaacccgcgtcagctccggcctcacgctctggaagcaaaagtacccagacggtggccaagaccacaaccgcggcagctgtcgctagcaccggccccagctcgagaagcccatccacattactccccaagaagcctaccgccattaaaactgaaggtaagcctgcggaagtgaaaaagatgacagccaagtccgtgccagctgatctcagtagacccaagagcacttccactagttccatgaagaagacaaccacactgtccggcactgctccggctgccggagtcgtcccatccagagtgaaagctactcctatgccctcccgcccgagtacaacgccatttattgataaaaagcccacctctgcaaaacccagcagtactacacctaggctgtcgagactggccactaatacctctgctccagacctaaaaaacgtgcgctcaaaggtggggtccactgaaaacatcaagcatcagcctggaggcgggcgtgctaaggtggagaagaaaaccgaggccgccgccacaactcggaagcccgaatcaaacgcagttaccaagacagccgggcctatcgcatcagcgcagaaacagccagccggcaaggttcagatcgtgagtaaaaaagttagctatagccacattcaaagcaagtgcggctcaaaggataatattaaacatgttcctgggggcggaaacgtgcaaattcagaacaagaaggtcgacatctcgaaggtgagttcaaagtgtggctctaaagctaacatcaagcacaaacctggaggaggcgatgttaaaattgaatctcagaagctgaacttcaaagaaaaggcccaggcgaaagtcggcagcttagacaatgtgggacaccttcctgcggggggtgctgtgaagatcgagacgtaccgcttgaccttccgggcaaatgcgcgggcaaggacggatcacggcgccgacatagtcagcaggcctcctcactttcctggcggccccaacagtgggtcccgagtgctgggtcccctttcccgagccgtacactag

SEQ ID NO: 124371 - DNA, 2487 bp, Artificial Sequence
  Description of Artificial Sequence: Synthetic coding sequence
atgtcactgagcgacaaacagactgcgagcctgacagctgcttatgggcaactatcgaaggggaagcccgctgagtgtcgtatggactccccgaaggagattagtcaggccggcttcgagtggcagcggaccgaaggaaaactgaatgaaatcggtctcaatgttagcatggatggccagccaaaagacggcctggtgaagaacgcctcattcctggagcaaaacaagttatgcttctttgaggggaaattggataaagagctttccattgagatgcaagacaaggactgccaggaggccagcggacacctggagtctaggtacgtgatcagcgagacttgtcaccctcttgagggtaacagcgtccatcagaagacgtctgagttccatctaggccttattgaaggaccagataagaataagaccatcccagtccagggcaaagtggccggtaagaatggcctggagacaaaaagtcagagtgacttggattttccgggagctgcggacatccctaccaggtacgtgaaagagcaagaaacatcggtgtggaaccctagctttcaccccgttgctcaagggagcctcggtagcagggaagcaacacccggtgagatggaaaatagcattacacccggatgcccggtgattggcgtggtgaatgataactcagagcagctcaaatgcgaaagtcccctacttgtgtccttggcccacccagcccctatcattgaacactctcctacaacaatccctcccataactatggtgtttacacaggagcacctgaatgcttcatgtcacatcagggaccatgacaaagagctggaaaagctgagttctacagaggaggccgtacttaaccaggccccccagcaaaagaaggctgtgagacgagctctgagtgaatgcagccacctgagcgtgccacccgcggtaaatttggccgataagtaccctgaactgcctgccagggaagagcctagctctgggctgctgcctccgccaagctcacctatgcccagtcctacccccgggaaactgggagcacccgccatgaaaaggtctatgaccgtgggggaagaacaaactgcctcttataagctgtcacctggaaagctaccaatcctgagcaccaaagagatccctcccttcatctgcgaggaaccagttgctaagaaaagagaggaattagcacatttttcaaattcttcctctaatagcgggaaaaaagagctgggtacagctggcttgtatctgcactcaaagctggagcagatcccggagggatcatctaaagagaagggacaggaggatttttctgaaaccaggattgattcgtgcagccaggtatgtcaacgtggcgaaaaacagccgggccaaacagctttggccggtaagaaggagattgaggtgacggcgacacagtcaacgccatccttcttgtttgaaaaaccgccccgagacggaatcgccagacctgaggagggacgacccgttgtgtcaggaacagggaatgatatcacaaccccacccaataaggagttacccccgagccccgagaagaagaccaagccaatcgccgacgccaaggccccagaaaagagagcctcgcccagcaagcccgccagcgctccggcctcccgttccggaagcaaatctactcagaccgtggctaaaaccacaacagcggcagctgttgcctcaacaggaccatcttctcggtcaccgagtaccttattgccaaagaagccaaccgccgatctctcccggcctaaaagcacaagcacatcctcaatgaaaaaaactacgacactgtcgggaactgcgccagctgccggtgtggtccctagtcgcgtgaaagcgaccccaatgccctctaggccctcaacaaccccattcattgataaaaagccaacaagcgctaaaccatccagcacaacaccacggctctccagactcgctaccaacacatctgctcccgatctgaaaaacgtgcgcagcaaggttgggtccactgagaatattaagcaccagccaggcggcggtagggtgcagattgtgagcaagaaggtgagctattcccacattcaatcaaaatgcggatccaaggacaacatcaaacatgtgcccgggggtgggaatgtacaaatccagaataagaaggttgatatttcaaaggtctcctcaaagtgtggcagtaaggccaatatcaaacacaagccaggtggcggagacgtgaagatcgagagccagaaattgaattttaaagaaaaggcccaagccaaagtaggcagcttggacaacgttggacatctgcccgccggaggcgccgtgaaaatagagacctatcgcttgacattccgagccaacgctagggctagaaccgatcatggggccgacattgtgtcaaggcccccccattttccgggaggacctaactctgggtcacgggtcctcggacctttgtcacgtgctgtgcattag

SEQ ID NO: 124372 - DNA, 6894 bp, Artificial Sequence
  Description of Artificial Sequence: Synthetic coding sequence
atggctgaccttagtcttgcggatgcattgaccgagccatcgcccgatattgagggggagataaagagagacttcatcgccaccctggaggccgaggcgttcgacgatgtggttggtgagactgtagggaaaaccgactacatcccactcctggacgttgacgaaaaaactggtaacagcgaatcaaaaaaaaagccatgctccgagaccagccaaatcgaagacctgccgttgcccccacacccagcatccctgtctttccatctgcccttggacacaccctcctctaaacctactcttctggccaatggggggcatggcgtggagggctccgatacaacaggctcccccaccgagtttctcgaggagaagatggcgtatcaggagtaccctaattctcagaattggcccgaggacaccaacttttgtttccaaccagagcaggtggtggatcctatccaaaccgacccattcaaaatgtaccacgacgatgacctcgctgacttggtgttcccgtcttccgctacagctgacacatcgatattcgctggacagaatgaccccttaaaggatagttacggtatgtcaccttgcaacacagccgtggtcccacaggggtggagcgtagaagctctgaactcaccgcactcagagagttttgtttccccagaagctgtcgccgagcccccccaacccactgctgttccactggaactggcaaaagagatcgagatggcctcagaggaaagacccccggcccaagctttggaaatcatgatgggcctgaaaacaacagatatggccccaagtaaagagacagagatggccttggccaaagacatggccctagcgaccaagaccgaagtcgccctggccaaggacatggaatctcccaccaaactggatgtaactctggctaaagatatgcagcctagtatggaaagcgacatggccctggtaaaggacatggagctaccgaccgaaaaagaggttgcgctggtaaaggatgtcagatggccaactgagactgacgtcagtagcgcaaagaacgtggtgctaccaaccgaaaccgaggtggctcccgcaaaagacgtgacattactgaaggagacagagagagcgtctccaataaagatggacctggcgccttctaaggacatgggtccaccaaaagaaaataaaaaggagaccgagagagcttcaccgatcaaaatggacctggcccctagcaaagacatggggccacccaaggagaacaaaatagtgccagccaaagatctggttttgctttccgaaatcgaagtcgcccaggccaacgacatcatctccagtacagagatttcttccgcagaaaaggtggctttgagctccgagaccgaggtggcactggcccgggatatgaccctcccacccgaaaccaacgttatactgacaaaggataaggccctgcccctggaggctgaggtcgcacccgtgaaagacatggcccaactgcctgagaccgaaattgcccccgcgaaggatgtcgcacccagcactgtcaaggaagttgggttgttgaaagacatgagcccactatctgagaccgagatggccttggggaaggatgttactcctccaccggaaacagaagtcgtgctgattaagaacgtgtgccttcctccagagatggaggtggctctcacggaggaccaagtgccagccttgaagaccgaggccccactcgctaaggacggcgtcctgaccctggccaacaatgtgacccccgcgaaagatgtaccacccctgtcagagaccgaagcaactcccgtgcctatcaaggatatggagattgcacagacccagaaaggaatctccgaagactcccacttggagagcctccaggacgtcgggcaatcggcagctccaacttttatgatctctcctgagactgtcacagggacaggcaaaaagtgctcacttccggccgaagaagactcagttttggaaaaactcggggaacgtaaaccatgcaattcccagccatctgaactgagctcggaaacatcagcaaatttcatgtactgcggcacccctcccacacaggctaagcaggtctgtcggccctcggatcgccggtctacccgcccaaagccggcccgcgttcctcccgagctgctagggggctcccccccatggaaaacgctcgaccaccggttgggtcattgctccttgtccgagtcagggtgggtctcgggtagctccagttgtggaggcccaggcaaccagcggaagagcattcatgtggactcactggagccgcaacgcgatctcggacgtgaggcctgggatattgaaagcacccctattatgatgaaaaagaaaaaaaaaaaacccaagcagaagcggtactcacaaccccgggctggcggcccttcagacgacgataacgctgataagcccaagggacacccatttgctgcagatacccagaagagcggtgtcctgccctcccagcccaccacgatgggcacggagtacggtttagttagcggagagaaccttaaaagggaatgtctggttaactcctccgccgcaagacttgtggccgagaactttgtgtccgagagcctgcggattcctctgtaccccagcgaggaggctcctaaaacagccatttctagccagagtaaactgcgtgttgaagaggaaagcaagagtaataaatctgtcctccagaaccaggacaaaaagctgctcaagcagcacgagtacaagccccagccagcgccacatctaaagacaccagttgataagtctcagtcagtgggccccctgaacctgaaaggcccacttgcagaggtgagcgcctacaatgtcgagacacccctagatattaggctgaaagaaggctgctctccttttcttgaccaggaagtgatgggagtggtgagtaaacctacggccgctaaagagattccgaacctcgtgccaaccttgattgcaagcaatccactcgagtgtaacttgaaggaggggaataacgaaagtaaaatgaccaaactgcaaaacgtaaagctaaaggagttcccggagggggctgaggaggataaggagttaaagaaggaggcatttccaaatgaacgccaggagatcagtatattcactagcgagcagttgcaaggtcaggtccttgttcaggtgccaggggtggagaacgaaccattcaaacgcatggccggggatgggaagtcccgaaaaggccgtggtagcagcgggaaaatgcggacagattcgggcaaagtcaaggcaaagtcagagctcccattcctgctggactcacagaaggatggcagagccgttttgatacctagtgagcctgtatccaagacagaggggatgactactcaagataaatctgaagaattgggacttaacagttcaaaacagccaggtacaaaagccgacctcacagaagcagtcgtgatgggagaacctaaggagatgacccagcccaaagtggccggcactatgcaagctctgatccctctggagtccggaagtggaatgacgcagacatctggcgtaagtacggagactggggatgtcgtcaaggatatgggagtgaacaatcaaagcaaagagggccggtgcccttggaaggatcacgaggctgccccctggatctctgaaaagcccaaaaaacggggaaatgagggaaagagtaaaaaatttaagaacaactacagcactcagccagcacgaatggagcgcaaggaggaaatcctgaatcctcccttcgagggcaaggacggagacaccggcagcattccacacaaatcgaaagaaatcgggttcacattcccgaaaatgcacgactctagtttttcgcacaccccagatacacctacagtggaggccgtcgatcggaaagggggcaattttcaggtgaactttgtcgaactgggcaccctaggtgagaacaagatatcaaccgtgaaggcctctactgtgactgagcctcctgctaaggtcaccgacgtaagttgccaggagcagattcagggcgcaggctttgtgccatctgtggtgtcagaagagaataagacagacgcagccaatagatacacggccgtcgcagacaaacctagtaaacgctccaacgacggtaagtccaagaaggtcaagaattcttcacccgaaaagcacattcttgaaaacaaaatcgacgccaccaagatacacgtgcccatggaaaccactggcgaccaggggattgagggtatggcctacatggacgagaaccgaaacatcacattcacatgcccccgaaccccaagcgaactcatcaataaatcatcacccctggaggtgctcgaatctgcggcatgtgagaaactgccaacgcccactccccaagtcgttaaagaaggggattcttttccagacacgctggctaagaacgggcaagagatagctccagcgcagattagcaagtccctcatggtggataattataccaaagacggggtccccggacaggaacgccctaagggcccctcagctgtagtgcccagcaccagtactggtggggtggcattgcctattaccaccgccatcgagactgtcaacattcatggggaccacagtctgaaaaacaaggcagagctagcagactccatgaagaatgaagctgggatcgatgaggggcacgtcattggcgaatccgagtccgtgcactcaggggcttcaaaacacagtgttgagaaagtcaccgaactggcaaaaggccacctgctgcctggggtccccgtagaggaccagagcctccccggcgaagccagggccctcgaggggtatgccgacaggggcaatttccctgcccatccggttaacgaggagaaagaaaccaaagagggcagcgttgccgtccaaatcccggatcttttagaggataaagcccagaaactatccttctgtgaggaccagaacgcacaggaccggaatagtaaaggaagcgacagcttgaataagaaggtggacctcaccctgctgtctcccaagagcgaaaacgacaaactgaaagaaatatctctcgcttgtaagattaccgaacttgaatcagtgtctctccctactccagagattcagtcagatttcttgcatagcaaggttgaggctcccccctcggaggttgccgacacgctggtaataatgaccgctagcaagggcgtacgcctgccagagcccaaggacaaaattttggagacgccccaaaagatgaccgagaagagtgagtctaagacaccgggcgagggtaaaaaggaggataagtcgcgtatggccgaacctatgaaagggtacatgcgtccgacgaaatctagaggactcacccccctcctcccaaagtccacgatccaggagcaggaacgccacaaacagctgaaatcagcgggcatcgctcgcccggaggaaggccgccctgtggtttccggtactgggaatgacattaccacgcctccaaacaaggagcttccaccctctcctgaaaagaaaactaagcctttagcgaccacgcagcccgccaagacctcaaccagtaaggcaaaaacccaacccacttctttacctaagcagcccgcaccgaccacaatcgggggcttaaacaagaaaccaatgtccttggcctctgggctggtcccggccgcgccccctaagaggcccgcggttgcctctgctaggccctctatcttgccaagtaaggatgtgaaaccaaaacctattgctgacgcgaaggccccagagaaacgagcgtccccgtccaagccagcgagtgctccggcatcacgctcagggtctaaatccacccaaacggttgctaagacaaccaccgctgctgctgtggcctcaaccggtccgagttctaggagcccctcaaccttactccctaagaagcccacagcgattaagactgaaggaaaacccgcagaggttaaaaagatgaccgctaagtctgttcctgctgatctgtcccggcccaaaagcaccagcactagctctatgaagaagaccacaacactcagcggaaccgcgcctgccgcaggcgtcgtgcccagcagggtcaaagccactcctatgcccagtcgtccttcaaccacacctttcattgacaagaagcccacttccgcgaagccaagcagcactacacctcgtctctcaagattggccaccaacacctccgctcctgacttaaagaacgtcagatctaaagtaggttctactgaaaacatcaagcatcagcccggtgggggaagagctaaagttgagaaaaagacagaggctgctgctacaactcgaaaaccagagtccaacgcagtaacaaagactgccgggcctatagcatctgcccagaaacagcctgctggaaaggtgcagatcgtgagtaagaaggtcagctatagtcacattcagtctaaatgcggctccaaggataacattaagcatgttcctggggggggtaatgtccagatccagaataaaaaagttgacataagtaaggtgagctcaaagtgtgggagcaaggcaaatatcaagcataaaccaggtggtggcgacgtaaagatcgagagtcaaaaactgaatttcaaagagaaggcacaagccaaagtggggtcgctggataatgttggccatttgcccgccggcggggcggtgaagacagaaggcgggggatcggaggcgcccctctgccctggcccgcctgctggcgaggagccagcaatctcagaagctgctccagaggccggcgccccaacaagcgcttccggtctgaacgggcatccaaccctgagtggaggcggggatcaacgcgaagcacaaaccctcgacagtcagattcaggagacaagcatctag

SEQ ID NO: 124373 - DNA, 750 bp, Artificial Sequence
  Description of Artificial Sequence: Synthetic coding sequence
atgacagcgaaatccgtgcccgctgacttatcccgacctaagtcgaccagcacaagttctatgaaaaaaaccaccaccctatcagggacagcacctgcagcaggagtggtcccctctagggtgaaggcaacacctatgcctagtcgaccttctactactccatttattgataaaaagccaacgagtgcaaagcccagtagcaccacacccaggctctctcggcttgccacgaacacttcggcccccgacctgaagaacgtccgaagcaaagtggggagtactgaaaatatcaaacaccaacccggcggcggacgagtgcaaatcgtgtctaaaaaagtctcctacagccatattcagtcaaagtgtggcagtaaggataacattaagcatgtccccgggggcgggaatgttcaaatccaaaataaaaaagtggatatatctaaggtcagcagcaagtgtggttcaaaagctaacatcaagcacaaacctggtggtggcgatgttaagatcgagagccagaagctcaacttcaaagaaaaggctcaggctaaggtgggctcactggacaacgtgggacatcttcccgccggaggagccgttaaaatcgaaacatatagactgacctttagagcgaacgcccgcgcgaggaccgatcacggcgctgatattgtgagcaggccgccacatttcccaggaggcccgaactctggcagccgtgtgctgggcccgctgtctcgagcagtccactag

SEQ ID NO: 124374 - DNA, 300 bp, Artificial Sequence
  Description of Artificial Sequence: Synthetic coding sequence
atggcggaccttagcttagcagacgccctgaccgaacccagccctgacattgaaggtgagattaagagggactttattgccactctggaggccgaagcctttgacgacgtggtgggcgagactgtgggcaagacggattatataccattgttggatgtcgatgagaaaaccggcaactcggagtccaaaaagaagccatgttcagagacgagccagatagaagacactccctcaagcaagcccaccctcctggccaatgggggccacggagtggaaggatccgatactactgaggcatag

SEQ ID NO: 124375 - DNA, 2277 bp, Artificial Sequence
  Description of Artificial Sequence: Synthetic coding sequence
atggcagagccccggcaggagtttgaagtgatggaggatcatgctggcacctacggcctgggggataggaaggatcagggcggctacacaatgcaccaggaccaggagggcgacacagatgccgggctcaaggagtcccctctccagactccaacagaagacgggagtgaggagcccgggtcagaaacttctgacgctaaatccacacccactgcggaggacgtgacagcccccctggtcgatgaaggagcccccggcaaacaggccgctgctcagccgcacaccgaaatccccgaggggaccacagccgaggaagccggcatcggcgataccccttccctggaagatgaggctgcaggccacgtaacgcaggagcctgagtctgggaaggtggtgcaggagggtttcttaagagagcccgggccacccgggctctcccatcagctgatgtcaggcatgccaggcgctcccctgctacctgagggaccacgcgaggccaccagacagcctagcggcaccgggcccgaagatacagagggagggcggcacgctcctgagctcctgaagcatcagctcctaggggacctccaccaggaggggcctcccctcaagggagccggaggaaaagagcgaccagggagcaaagaggaggtggacgaagacagagatgttgatgaaagctcgcctcaggactccccgccctctaaggctagcccagctcaagatggaaggccaccccaaacagccgcacgagaagcgacaagcatccctggtttcccagccgagggtgcaatacccctcccagttgattttctgagcaaagtcagcacagagattcccgcttcagagcccgacgggccgagcgtcgggcgcgctaagggacaagatgcccccctggaattcacatttcatgtcgagattacccccaacgtgcaaaaggagcaggcgcatagcgaggagcaccttggcagagccgcgttcccaggcgctccgggagagggccccgaagcaaggggtccatcgctgggcgaggatacaaaagaggctgatctccccgagccatctgagaaacagcccgctgccgcacctaggggaaagccagtgagccgagtcccccaattgaaagctcgaatggtaagcaaaagtaaagatgggacaggtagcgatgataagaaggccaagacaagcactcggagctccgctaagacactgaagaatagaccgtgtctgtctcctaagcatccaacaccagggtccagtgatccgttgatacagcctagcagccccgccgtgtgcccagagccaccgtcatccccgaagtatgtgtccagcgttacctcccgtactgggtcatctggtgccaaggaaatgaagttgaagggcgcagatggtaaaaccaaaatagccaccccacgaggagccgctccaccaggccagaagggccaggccaatgctacccgcattccagcaaagactccccccgccccaaaaacaccaccatcttccggcgaaccccctaagagcggggaccggtcgggctacagttctccaggcagccccggaacccccgggtctagaagtaggacacccagtctgcctaccccacctacacgggagcctaagaaggtcgctgtggtcagaacaccgcctaaaagccctagcagtgccaagagtcggctccagaccgcacccgtgcctatgcctgatctaaagaacgtcaagtctaaaattgggagcaccgagaatcttaagcatcagcctggaggagggaaggttcagataattaataagaagctcgatctgtcaaacgtacaaagcaagtgcggctctaaggataacatcaagcacgtgcctggaggtggcagcgtgcagatagtttacaaacctgtcgacctgagtaaggtgacctctaaatgtggatcactgggcaacatccaccataaacccgggggtggccaggtcgaggtgaagtccgaaaagctagattttaaagaccgcgtgcaatcaaaaattgggagcctggataacattacacacgttccagggggaggcaataaaaagatagaaacacacaagctcacgtttcgcgagaatgcgaaagccaagaccgaccacggggctgagattgtgtacaagagccctgtggtttctggggatacttccccccgacatttgtcaaatgtttcctcaacaggtagcatcgacatggtagacagtcctcagctggctactctggctgatgaggtgtccgctagcttggcaaagcaggggctttag

SEQ ID NO: 124376 - DNA, 1152 bp, Artificial Sequence
  Description of Artificial Sequence: Synthetic coding sequence
atggctgagccaaggcaggagtttgaggtcatggaggatcatgcgggcacatatggattgggggatcgaaaggatcaagggggatatacaatgcaccaggatcaagagggcgataccgacgccgggcttaaagctgaagaagccggcattggggatacgccgtctctggaggacgaagctgccggacacgtgactcaagcgagaatggtgtctaaatccaaggatggcactggcagtgacgataagaaggcgaaaggagcagacggcaaaaccaaaatagctacaccccgaggtgcggctccacccggccagaaggggcaggccaatgccactcggatacccgctaaaacgcctcctgccccgaaaactccacccagttcaggggaaccaccaaaatccggagaccgttctgggtattcttcgccaggaagccctggcacaccagggtcaagatctagaacgccgtctctccccaccccacccactagggaaccaaaaaaagtcgctgtggtccggactccccccaaatcaccttcctctgctaagtctcggttgcagactgctcctgtccccatgcccgatctgaaaaatgtgaagagcaaaatcggttctaccgaaaaccttaaacaccagcccggcggtgggaaggtccagattatcaacaagaagctggacctgtcaaacgtccagtctaagtgcggcagcaaagacaacataaagcatgtgccgggcggcggctctgtgcaaattgtttataagcctgtggacttgagcaaggtcacttccaagtgcggaagccttggaaacatacaccacaaacccggaggcggccaggtggaagtgaagtccgaaaagctggatttcaaagatagagttcagagcaaaatagggtctttggacaacattacccacgtgcccggaggcggaaataaaaagatcgaaacccacaagctcacatttcgcgagaacgccaaggccaaaactgatcacggcgcagagattgtgtacaaatccccagtcgtttctggtgacacctcacctcgccacctctccaacgtgtcctcgacaggctctatcgatatggtggattcgccgcagctggctacgctcgcagacgaagtatccgcctcactggctaagcagggcctgtag

SEQ ID NO: 124377 - DNA, 1239 bp, Artificial Sequence
  Description of Artificial Sequence: Synthetic coding sequence
atggctgagcctcgacaggaattcgaagttatggaagaccacgccggaacctacggcctgggcgatcgcaaggaccaggggggttacacaatgcatcaggatcaggagggcgacaccgatgcggggttgaaggagtcgcccctgcagacccctacagaagacggctcagaggaacccggatcagagacaagcgatgcaaagagtactccaaccgctgaagccgaggaggcaggaataggtgacacccctagcctcgaggacgaagctgctggccacgtcactcaagccaggatggtctcaaagagcaaggacggaaccgggtccgacgataaaaaggccaagggagcagatggaaagacaaagattgcaacccctagaggcgccgctccacccggacagaaagggcaggccaacgccactcgcatcccagctaagaccccaccggccccgaagacaccgccttcctcaggggaaccaccaaagtcgggcgaccggagcggctactcgtctcctggcagtcccgggacaccaggttctaggtcccgaacaccttctctccctacccccccaacacgcgagccaaaaaaggtcgccgtagtgagaacccctcctaaatctcctagctctgccaaatccagattacagacagcccccgtaccaatgcccgatctgaaaaacgtcaagtcaaaaatagggtcaaccgaaaacttgaagcaccaacccggcggaggcaaagtgcagattatcaataagaagctggacttgagtaatgtacagagtaagtgtggctcgaaggacaacattaagcatgtacctggaggggggagcgtgcaaattgtgtataaaccggtggacctttccaaagtgacctctaaatgcggatctctgggaaatatacaccacaagcccgggggcggacaggtagaagtcaagtccgaaaaactcgacttcaaggaccgggttcagtctaaaatcgggtccctggacaatattacacacgttcccggcgggggcaacaaaaaaattgaaacacacaaactcacattccgagagaatgccaaggcaaagaccgaccatggcgcagaaatagtctataagtctccggtggtgagcggcgacacttccccacggcacctttctaacgtatccagcacagggtctattgacatggtcgacagtcctcagctggccacccttgctgacgaggtatcagcaagcctcgccaaacaggggttgtag

SEQ ID NO: 124378 - DNA, 2331 bp, Artificial Sequence
  Description of Artificial Sequence: Synthetic coding sequence
atggctgaaccacggcaggaatttgaagtgatggaagaccatgcaggaacctatggcctgggggaccgcaaagaccaaggcggatatacaatgcaccaggaccaagaaggtgacacagatgcaggccttaaggagagtcccctgcagacacccacagaggatgggtctgaagaacccggctctgagacatcagatgctaagtccacaccgaccgctgaagacgtaactgcacctctcgtggacgagggagccccggggaaacaggcagctgctcagcctcacactgagatacccgagggtacaacagccgaggaagcgggaattggcgacacgccaagcttggaggatgaagccgcaggccatgtgacgcaggaaccggagtccggcaaggtggtgcaggagggcttcctgcgggaacctggcccccctggcctgagtcaccaacttatgagtgggatgccaggagccccgctcctccctgagggcccacgggaggctacccgccagccctctggaacaggcccggaagacaccgaaggggggagacacgcgccggagctcctcaaacaccagctgctgggagacctgcaccaggagggccctcctctgaaaggtgctggaggtaaagagcgtccaggtagcaaggaagaggttgatgaagatcgggacgttgacgagtccagtcctcaggactccccaccctccaaggcctcacccgcccaggacggcagaccaccacagactgcagcacgggaggcgacatcaatccctgggttcccagctgagggagcgattcctctgcctgtcgactttctgtcaaaagtttcaacggagatacccgcgtctgaaccggacgggccctcagtaggccgagccaagggtcaggatgcaccacttgaatttacctttcatgtcgaaatcacccctaatgtgcagaaggagcaggcccactccgaggaacatcttggccgcgccgcctttcccggcgcacccggagaaggacctgaggcgcgaggccctagcctcggagaggatacgaaagaagcggaccttcctgaaccttccgaaaagcagccagccgccgccccccgtggcaagcccgtgagcagagtaccacagctcaaagctaggatggtgagtaagagtaaagatggcacaggcagcgatgataagaaggccaagaccagtacaagaagcagcgctaagacgctgaaaaatcggccctgtttgagccccaaacaccctacgccagggagcagtgaccctctcatccagccatctagccccgccgtctgccctgaaccacccagcagtccaaaatacgtgtccagcgtaacaagcaggactggctcatcaggggcaaaggagatgaaactcaaaggagccgacggcaagaccaaaatcgctactcctcggggagccgcccccccaggacagaagggccaggcgaatgcaaccaggattccagcaaaaacaccccccgctcccaaaacccctccatctagtgctaccaagcaagtacaaagacgccctccgcctgcaggccccagaagcgagagaggagagcctccaaaatcaggggatcgatctggctatagtagcccaggctcgcctggcaccccgggatcccgttccaggactccgtccctcccgactcctcctacaagagaaccaaagaaggttgcggttgtgagaactccgcctaaatctccatcatctgcgaagagcagactacaaacagctcccgtgcccatgcccgacttgaagaacgtcaaatctaagataggctccaccgagaatcttaagcaccagccagggggtggcaaagtccaaatcatcaacaaaaaactggacttgagcaacgtacagtccaaatgcggcagcaaggataacattaagcacgttcctggcgggggaagcgtgcagatcgtgtacaagcctgtcgacctgtccaaagtgaccagcaagtgtggcagcttagggaacattcaccataaacctggcgggggtcaggttgaagtcaagtcagaaaaactggatttcaaagatcgggtgcagagcaagatcggaagcctcgacaacatcacccatgtacccggtggtggaaataagaagatcgagacccacaagctcacgtttagggaaaacgccaaggctaaaacagatcacggagcagagatcgtatacaaaagccctgtagtatccggtgatacgtcaccccggcatctctcaaatgtttcttcgaccggttccatcgacatggtggactcgccccagctcgcaacactcgccgacgaggtctcagctagccttgctaagcaagggctttag

SEQ ID NO: 124379 - DNA, 951 bp, Artificial Sequence
  Description of Artificial Sequence: Synthetic coding sequence
atgctgagagccttgcagcagcgcaaaagggaggctggtatcggggacaccccatccctggaggacgaggccgctgggcacgtgacccaagcccgaatggtgagtaagtcaaaggacggtaccggatccgacgataagaaggcgaaaggggccgatggtaagacaaagattgccacgcctcggggagccgcccctcccggccagaaaggtcaggcaaatgctactagaatccccgctaaaactcctcccgcacctaagaccccgccaagcagcggagagcctcccaaaagcggcgaccgttccggctactctagtccaggcagccctgggacaccaggctctcgtagcagaacgccaagcctgccaaccccaccaactagagagccaaagaaagtcgctgttgtgaggacacccccgaagtctccttcctccgccaagtcacgactgcagaccgctccagttcctatgccagatctcaagaacgttaaaagcaaaatcggttccactgagaacctgaagcaccagcccggtggcggtaaggttcagattgtctataagcccgttgatctctccaaggtgacgagcaagtgcggatccctggggaatatacaccataagccaggtgggggacaggtggaggtaaagagcgagaagctggactttaaagatagagtccagagtaaaatcggctcactcgacaacattactcatgtccctggaggcggcaataaaaagatcgagactcacaaacttacctttcgggagaatgccaaagccaaaacagatcatggcgctgagattgtgtacaaatccccagtcgtatccggcgacacatctcctaggcacctgagcaatgtgtcatcaactggctcaattgacatggtggattctccccagctggccacactggccgacgaggtgagcgccagtttagcaaaacaggggctgtag

SEQ ID NO: 124380 - DNA, 1326 bp, Artificial Sequence
  Description of Artificial Sequence: Synthetic coding sequence
atggcggagccccgccaggagtttgaggttatggaagaccacgcaggtacttacggcttgggcgatcgcaaggatcaggggggttatacaatgcatcaggaccaggagggcgacactgacgctgggctgaaagagagtcccttgcaaacacctactgaagatgggtccgaggagcccggcagcgagacctccgacgcgaagtccacccccactgcagaagacgtcacagcccccctggttgatgaaggtgccccaggaaagcaggccgctgcccagccgcataccgagatcccagagggcaccaccgccgaggaagctggcatcggcgacactccttccctggaggacgaggcagcaggccacgtcacacaggcgagaatggttagcaaaagtaaggatggaactggtagcgacgacaagaaggcaaagggggctgatggcaagacaaagattgcaacccccaggggcgcagcccccccaggccagaagggacaggccaacgcaacgcgcatccctgcaaaaacccctcctgctccaaagacccccccctcatcgggcgagccccccaagtctggagaccgctctggctattctagcccaggtagccccggaactccgggcagccgaagccggactccaagtctgcccaccccacctacaagggagcccaagaaagtggccgttgttcgcacaccgccgaaatcaccatcttctgcgaagtcgagattgcagaccgccccggtccccatgcctgatctcaagaacgtcaaatctaaaattggttctaccgagaacctgaaacaccaacctggcggagggaaagttcagattattaacaagaagcttgacctgagcaacgtccaatctaaatgcggtagcaaagacaatattaaacacgtgccaggtggtggaagcgtgcaaatagtgtacaagccagtcgacctcagtaaggtcacttccaaatgcggcagcctggggaatatccaccacaagccaggtggtggacaggtcgaagtgaaatctgaaaagctcgacttcaaggacagagtgcagagcaaaataggatcattggataatatcactcacgtaccaggcggggggaataaaaagatagaaacacacaaacttacattccgggagaatgctaaggctaaaactgatcatggcgccgagatagtgtacaagtccccagttgtaagtggggacacatcaccacggcacttaagtaacgtgagttctaccgggagtattgatatggtagattcccctcagcttgccacactggcagacgaggtaagcgctagcctggcgaagcagggactatag

SEQ ID NO: 124381 - DNA, 1080 bp, Artificial Sequence
  Description of Artificial Sequence: Synthetic coding sequence
atggccgaacccaggcaggaattcgaggtaatggaggaccacgccgggacctatggactcggcgaccggaaggatcagggaggctacactatgcatcaagatcaagaaggtgacaccgatgccggcttgaaggagagccccctacagactcccactgaggatggctccgaggagcctggctcggaaacgtctgacgcaaagtccacacccaccgcagaagcccgtatggtctcaaaatctaaagatggcacaggcagcgatgacaaaaaggccaagggtgctgatggcaaaactaaaatcgccactcctcgaggcgctgctccgccagggcaaaaggggcaagctaatgctactaggattcctgccaaaacaccacccgcccctaagaccccaccaagctcaggggagcccccaaagagcggagatcgctctggttactcctcccccgggagtcctggtacacctggcagtcggtctcgcaccccaagtttacccaccccccctacacgggaaccaaaaaaggttgcagtggtacggaccccccccaagtctccttcatcagcaaaatcaagactgcagaccgctccggtgcccatgcctgatctgaagaacgtgaaaagtaagatcggaagcacagaaaaccttaagcatcaaccaggcgggggcaaggtgcagattgtctataaacctgtagacttgtctaaggtcaccagcaaatgcggcagtctgggcaatatccatcacaagcccggaggtgggcaagtggaggttaaatcggaaaaactggatttcaaagaccgggtacaaagcaaaataggctcactggataacatcacccatgtcccagggggcgggaataagaaaatcgagacccacaaactgactttccgtgagaacgctaaagccaaaaccgaccatggagccgaaattgtgtataagtctcctgtcgtctccggcgatacctcccccagacacctgtccaacgtgagctcaacgggcagtatcgacatggtcgatagcccccagctggcaaccttggcagacgaggtgtccgccagcctcgctaagcaggggctttag

SEQ ID NO: 124382 - DNA, 2331 bp, Artificial Sequence
  Description of Artificial Sequence: Synthetic coding sequence
atggcagagccccggcaggaatttgaagtgatggaagatcacgcggggacctacggattgggagacagaaaggatcaggggggatacactatgcaccaggaccaagagggcgatacagatgcaggtttaaaagagtctccgcttcagaccccaactgaagacggatccgaggagccaggctcagagacatctgacgctaaatcaacaccgacagctgaggacgttacagctccactggtggacgaaggagcacctgggaagcaggccgctgcacagccgcacaccgagatccctgaaggcacaaccgctgaagaggctgggatcggggacacaccttccctggaagatgaggccgcagggcacgtcacccaggagccagagagcggaaaagtcgttcaggaaggattccttagagagcctggcccacccggcctgtctcaccaactcatgtcaggtatgcccggggcaccacttctccctgagggccctcgcgaagcaacacgacagccatcgggtaccgggccggaggacactgaggggggccggcacgctccagaacttctcaaacaccagctgctgggagatctgcatcaggaggggcccccactgaaaggggctggaggaaaagaaaggccgggcagcaaggaggaggtagacgaggacagggacgttgatgagagcagcccacaggatagcccccccagtaaggcttcccccgctcaagacggcagacctccccagaccgcagcacgtgaagccacatctatcccaggttttccagctgagggtgccatccccttgcccgtggacttcttgtccaaagtgtccacagagattcccgccagtgagcctgacggcccatccgtcggccgcgccaagggacaagacgcacctttggagttcacttttcacgtggagatcactcccaacgtgcagaaggagcaggcacactcggaggagcaccttggccgagcggcattccccggcgcccccggtgaaggtcctgaggccagaggtccatcccttggcgaagacactaaagaggctgacctgcccgaaccttccgagaaacaacccgcagctgcgcccagaggaaaaccagtcagcagggtgcctcagcttaaggcacgaatggtcagtaagtcaaaagatggtacagggagtgatgataagaaggcgaaaaccagcacccggtcgagcgctaaaactctgaaaaatcgcccatgcctcagtcccaagcatcccacacccgggagttctgatccactgatccagccctcaagccccgcggtctgtcctgagccccctagtagccctaagtacgtgagctctgtgacaagccggactggttcttctggtgcaaaagaaatgaagttaaaaggagcagatggaaagactaaaattgctacgccccgaggcgccgccccaccaggacaaaaaggacaagctaacgcaacacgcattcctgctaaaacccctcctgctcctaagactccgccaagttctgctacaaagcaggtacaacgacgcccccctccagcaggacccaggagtgagagaggggagcctccaaaatccggagatcgttcaggctatagctcaccaggatcacccgggacccccgggagcagaagccgcaccccgagcctgccaactccaccaactagagaaccaaaaaaggtagctgtcgtccggaccccccctaagtcaccctccagcgcgaagtcacggctgcaaacagcgccagtgccgatgccagaccttaaaaacgtgaagagtaagatcggatccacagagaacctcaagcaccagccaggagggggcaaggttcagatcatcaacaagaagctggacctgtctaacgtgcagtcaaagtgtgggagcaaggacaacatcaagcatgtccccggtggtggaagtgttcaaatcgtctataagcccgtcgatctctctaaagtcacaagcaaatgcggtagcttaggcaacatccaccataagccaggaggcggccaggtagaggtgaagagcgagaagctcgatttcaaggacagggtgcaatctaagattggctctctggataatattacccatgtaccaggtggcggcaataagaagatcgagacacataaattaacttttagggaaaatgctaaagcaaagaccgaccatggcgcggaaattgtatataagtcgccagtcgtttcgggcgacacctcacctaggcacctctcaaatgtgagctccacagggtccatcgatatggtagactctccacaactggccactctcgctgatgaagtgtctgcaagcctggcaaaacagggactctag

SEQ ID NO: 124383 - DNA, 1239 bp, Artificial Sequence
  Description of Artificial Sequence: Synthetic coding sequence
atggcagagccccggcaggagtttgaggtgatggaagaccacgcaggcacctacggcttgggcgaccgaaaagaccaaggtggctatacaatgcaccaggaccaggaaggcgatacggacgccgggctcaaggagagccccttgcaaactcccacagaggacggatccgaggaacctggctcagagacctccgatgccaagtcaaccccaactgcagaggcagaagaggctggcattggagacacccctagtctggaggatgaggccgcaggccatgtgactcaggctaggatggtgagcaaaagcaaagacggtactggcagtgatgacaagaaagccaagggcgcagatgggaagactaagatcgccaccccacgcggagctgcccccccaggccagaaaggtcaggccaacgctaccaggatccctgcaaagacccctccggccccaaagacccctccaagttcaggagagccaccaaagagcggagatagaagcgggtatagtagtccaggcagccctggaactccggggtcacgctcacgcactccttcattaccaaccccccccactagggagccgaaaaaagtcgccgttgtgagaactccacctaagtctccatcttcggccaagtcccggttacagacggccccagtgccaatgcctgaccttaagaacgtcaaatcaaaaatcggaagtactgaaaatctgaagcatcagccgggcggcgggaaagttcaaattattaataagaaactcgacttgagcaacgtgcagtctaagtgtggctctaaagataatataaagcatgtgcctggcggaggttctgtccagatagtctataagcccgtggacctgtcaaaagtgacctctaaatgcggaagcctgggaaacatccatcacaaacccggggggggccaggtcgaagtaaagagtgagaagctggatttcaaagatagagtgcagagtaagatagggtcattagacaacataacccacgtgccaggaggtgggaataaaaagatcgagacccacaaactaactttccgggaaaacgctaaggccaagactgaccacggggcagaaatagtgtacaaatctcctgtcgtctccggtgatacaagtccccgtcacttgagtaacgtctcaagtacgggctctatcgatatggttgacagccctcagcttgccacattggcagatgaagttagtgcctccctagccaagcagggcttgtag

SEQ ID NO: 124384 - DNA, 795 bp, Artificial Sequence
  Description of Artificial Sequence: Synthetic coding sequence
actagagaggccgaaggcgctgacggcaaaactaaaattgccacgcctaaaggccaggcaaacgcgacccgaatccctgctaaaacccccccggcacctaagacgccgcccagtagcggggagccacccaaatccggcgaccgcagcggctactcctcccccggcagcccaggtactcccggatctcgctcacggacaccctccctgccaaccccaccaacaagggaaccaaagaaggtggccgttgtccggacccctcccaaatccccatcatctgctaagtcaaggctgcagaccgccccggtccccatgcctgacctgaagaacgtgaaatctaaaatcggctctaccgagaacctaaaacaccagccgggaggcgggaaagtgcaaatcgtgtacaagcccgtggacctttccaaagtcaccagtaagtgtggatctctcggaaacatccaccacaaacctgggggaggccaggtcgaggtgaagtcagagaagctcgactttaaagatagggttcagagtaagattgggagcctggacaacattactcatgttccaggaggaggaaacaagaaaatcgaaacacataagctcactttccgtgagaacgctaaggctaagaccgatcacggtgcagaaattgtctataagtctcctgtggtttccggagatacttcaccgaggcatctgtcgaatgtctcttctactggctctatcgatatggtggactccccccagttagccaccctagcagacgaggtgagcgccagtcttgctaagcagggtttgtag

SEQ ID NO: 124385 - DNA, 1059 bp, Artificial Sequence
  Description of Artificial Sequence: Synthetic coding sequence
atggctgagcctcgccaggagtttgaagtaatggaggatcacgccggtacctacggtttgggcgaccgcaaggaccagggcgggtacactatgcaccaggatcaggagggcgatacagacgctggactcaaagcagaggaagcagggataggtgatacaccatcactcgaagacgaggcggcaggacatgtgactcaggcacgtatggtcagcaagagtaaggatggcaccggtagcgatgataagaaagccaagggcgccgacgggaagaccaagatcgccaccccacgtggagcagctcctcctggacagaaggggcaggccaatgctaccagaatcccagccaaaaccccccccgctcctaagacccctccttcctctggtgaaccgcctaagagcggagatcggagtgggtactcatcacctggatcaccggggacaccaggctctaggtctaggaccccgagtctccctacccctcccaccagagagcccaaaaaagttgcggtggtgcgcacccccccaaagagcccttctagtgccaagtcgcggttgcagactgcgcctgtccccatgccggatcttaagaacgttaaaagcaaaatcggttccacagagaatctcaagcaccaaccaggtggggggaaggtgcaaatcgtatacaagcctgtggatctgtctaaggttacatctaagtgcggctccctggggaacatccaccataagcccgggggaggtcaggtcgaggtcaagtcagaaaagttggactttaaagacagggttcaatctaaaataggtagccttgacaacatcacacacgttcccggcggcgggaacaaaaagatcgaaactcacaaactgacttttcgggaaaatgcaaaagccaagactgatcatggcgccgaaatagtgtataagtcccccgtggtctcaggcgatactagtccaagacacctctccaacgtgtcaagcaccggttccatagacatggtggactcacctcagctggcgactctggccgacgaggtgagcgcatctctcgccaaacagggtctctag

SEQ ID NO: 124386 - DNA, 1233 bp, Artificial Sequence
  Description of Artificial Sequence: Synthetic coding sequence
atggcagaaccaaggcaggaattcgaagttatggaagatcacgctggaacatacggactgggcgaccgcaaagatcagggcggctacacaatgcatcaggatcaggaaggcgatactgatgcagggttgaaagagtctcccctgcagactcccacagaggacggttccgaagaaccaggctcagagaccagcgatgcaaagagtacaccaactgccgaggatgtgacggcaccgctggtggatgaaggtgcaccaggaaaacaagctgccgctcagccccataccgagatccccgaggggactactgccgaggaggcaggcattggcgacacgcctagtctcgaagacgaggccgccgggcatgtgacccaggcaaggatggtgtcaaaatcaaaggatggcaccggctccgacgacaaaaaggctaaaggcgccgatggaaagacgaagattgctacacctcgtggtgccgctcccccaggtcaaaaagggcaagcaaatgcaaccaggatccccgccaagactccgcccgcaccaaagacgcctccctcaagcggagagcctcctaaatctggagacagaagcggttacagcagccctgggtcacctggcacgcctggatcccgttctcggacccctagcctgccgacccctcctactagagagccaaaaaaggtggctgttgtgcgcacaccaccaaagagccccagtagcgcgaagagtcgtctgcagacagctcccgttcccatgcctgacctgaagaacgtcaagtcaaaaattgggagcactgaaaatctgaaacatcagccagggggcgggaaggtgcaaatagtctacaagcccgtggacctgtccaaggtgacatccaaatgcggcagtctgggaaatatccatcataagcctggagggggtcaggtcgaagtgaagtcggaaaaactagacttcaaggatagggtccagtctaagatcggctccttagataatatcacccatgtccctgggggcggcaataaaaagattgagacacacaaattaaccttcagagagaacgccaaagctaaaacagatcacggtgcagaaatagtctataaatcaccagtcgtgagtggggacacgtctcctcgtcacctgtccaatgttagctctaccggaagcattgacatggtcgattctcctcagctcgcgactcttgccgatgaggtgagtgccagcctagccaagcaaggcctgtag

SEQ ID NO: 124387 - DNA, 807 bp, Artificial Sequence
  Description of Artificial Sequence: Synthetic coding sequence
atggcagtgaatgtttatagcacatcagtgacctccgataatttatctcggcatgacatgctggcatggattaatgagtctctgcagttgaatctgaccaaaattgaacagctgtgttcgggcgccgcctattgccagtttatggatatgttgttcccgggctctatcgcactcaagaaggtcaagtttcaagctaaactggagcatgagtatatccagaatttcaagatcctgcaagccgggtttaagcgtatgggcgtcgataaaattattccagttgataaactggtgaaaggcaagttccaggacaattttgaatttgtgcagtggttcaaaaagttcttcgacgccaactatgacgggaaggactacgatcctgtcgccgctcgccagggccaagaaaccgcagtcgctcctagtcttgtggcacccgcgctgaacaagcctaagaaaccgctcaccagcagcagcgcggccccacaaagacccatctcaacgcagcggacagccgccgctccaaaagctgggcctggcgtggtgcggaaaaatccaggtgttgggaatggtgatgatgaggctgctgaactgatgcaacaggtcaacgtcctaaagctgaccgtcgaagacctcgagaaggagagggatttctacttcggcaagctccgcaacattgagttaatctgccaggagaacgaaggagagaatgatccagttctgcagaggattgtcgatatcctttatgcaaccgatgaaggattcgtgataccagatgagggaggtcctcaggaggaacaggaggagtactag

SEQ ID NO: 124388 - DNA, 984 bp, Artificial Sequence
  Description of Artificial Sequence: Synthetic coding sequence
atgccagggcctacacagaccctgagccccaatggggagaacaataatgatatcattcaagacaacaatggaaccattattccatttcgcaaacacaccgtgcgaggagaacgaagttacagctggggcatggccgttaacgtgtattccacaagcataacacaggaaacgatgtctcggcatgatatcatcgcctgggtgaatgacatagtttccttaaactacacaaaagtagaacagctgtgctctggggcagcttactgtcaattcatggacatgctttttccaggctgtatcagcctgaagaaagtcaaattccaggcaaaacttgaacatgagtatattcataatttcaagctcctgcaggcctccttcaagcggatgaatgtagataaggttattcccgtggagaagctggtgaaggggcgtttccaggataatctcgacttcattcagtggttcaagaaattctacgatgccaactacgatggtaaagagtacgaccccgtggaggcacgccaggggcaggacgcaattcccccccccgacccaggagaacagatcttcaatctgcccaaaaagtcacaccacgccaacagtcctactgcgggggcggctaagtcaagccccgcagcaaagcccggatcaacaccatcaagaccttcttcagcaaagcgagctagcagtagtgggtccgcctctaagagcgataaagacctagaaacccaggtgatacagttgaacgagcaggttcactccctaaagctggccctcgagggggtcgaaaaagagcgtgacttttatttcggtaagctgagggagatcgagctgctgtgccaggagcacggccaggagaatgatgatctcgttcagcgtctgatggatattttgtacgcctcagaagaacacgagggacacaccgaggagcctgaggccgaagaacaagcgcatgagcagcagcccccccagcaggaagagtactag

SEQ ID NO: 124389 - DNA, 855 bp, Artificial Sequence
  Description of Artificial Sequence: Synthetic coding sequence
atggccgtgaatgtctactcaacttcaattacccaagagaccatgtctagacacgatattatcgcatgggtaaacgatatcgtcagcctcaactacacgaaggtggaacagctgtgcagcggggccgcgtattgtcaattcatggacatgctgttccccgggtgtatctcattaaagaaggtgaaatttcaggctaaactagagcacgagtacattcataactttaagctgctgcaggcatcctttaagcgaatgaacgtcgacaaggtgattccagtcgaaaaactcgtaaaggggcgctttcaggataatctcgacttcatccagtggttcaaaaaattctatgacgccaactacgatgggaaggagtacgatcctgtcgaggctaggcagggccaggatgcaatcccccccccagacccaggcgagcagatttttaacctgccaaagaagtcgcaccacgctaactcgcccacggccggcgcagctaaatcctccccagcggcaaagcctggctcaactcctagtcgaccctcttcggccaaacgggcttcttcctcgggttctgcatcaaaatctgataaagatctggagactcaggttatccaacttaatgagcaagtgcacagtctgaaactcgcccttgagggcgtcgaaaaagaacgagatttctactttgggaaactgcgcgagatcgagctattgtgccaggagcatggacaggaaaacgacgacctggttcagagattgatggacattttatacgcttctgaggagcatgaggggcacacagaggagcccgaagcagaagaacaggcccacgagcaacaacctccgcagcaggaggaatactag

SEQ ID NO: 124390 - DNA, 948 bp, Artificial Sequence
  Description of Artificial Sequence: Synthetic coding sequence
atgaagcagaatcgggatcagaagtgccctgtgtctcaacggaactcttctttccaacagcccggcaggaagccaggttgttccagctggggcatggcggtaaacgtgtactctacttccatcacccaggaaacaatgtcgagacacgatatcatcgcgtgggtgaatgatatagtgtctctgaattacaccaaagtggaacaattatgcagcggagctgcctactgtcagttcatggacatgctctttcccggttgtatctcactgaagaaggtgaaattccaggcaaaactagaacatgagtacatccacaacttcaagctacttcaggccagcttcaagcgcatgaatgtagacaaagtgattccagtggagaaactcgtcaaaggccgattccaggataacttggatttcatacaatggtttaagaagttctatgatgcgaactacgatggaaaggagtacgacccggttgaggctcgccagggtcaggatgctatccctccccccgatcctggcgaacaaatattcaacttgccaaaaaagtcccaccacgcaaatagccccacagctggcgccgcaaagtcttctcctgctgccaaaccaggtagcacaccgagccgcccctctagtgccaagcgtgcctcgagctccggcagcgctagcaaatccgacaaggatctggagacccaggtgatccagctgaatgagcaggttcactccttgaagctggcgctggagggagtcgagaaagagcgggatttttacttcggtaagcttcgcgagatcgaactcctctgtcaggagcacggacaggaaaatgatgacttggttcagaggcttatggacattttgtacgcctccgaggagcacgaaggccatacggaagagcctgaggccgaggagcaggctcatgagcagcagcctccacagcaggaagaatattag

SEQ ID NO: 124391 - DNA, 825 bp, Artificial Sequence
  Description of Artificial Sequence: Synthetic coding sequence
atggcgcgcactactaccacatcatcccggattataacagggccctccttcctatccggaagtacacagtgcgcgggttcggtgcccactggagcagcatactgtcagtttatggacatgctgtttccgggttgtattagcttaaaaaaggtgaagttccaggccaagctagagcacgagtacatccacaactttaagcttctacaggctagcttcaagaggatgaacgtcgataaggtgatacctgtcgagaagttagttaagggccgatttcaagacaacctagattttatccagtggttcaaaaaattttatgatgccaactatgacggcaaggagtacgacccggtcgaagcgaggcagggacaggatgctatcccgccgcctgatccaggagagcagatttttaacctgcccaaaaagagccaccatgccaactcacctacagcaggcgcagccaaaagctctcctgccgccaaacccggatccacaccttcccggccaagcagcgccaaaagagcaagtagctctggcagcgcttctaaaagtgacaaggatctggaaacacaggtcattcagttaaacgaacaggtacactctctaaaactggcactcgagggtgtcgaaaaagagagagacttttatttcggaaagctccgggaaatagagttactctgccaagaacatggacaggaaaacgacgacctggtccaaaggcttatggatatcctgtatgcttctgaagagcacgagggtcatactgaagagcctgaggcagaagagcaggctcacgagcaacagccgcctcaacaggaagagtactag

SEQ ID NO: 124392 - DNA, 1005 bp, Artificial Sequence
  Description of Artificial Sequence: Synthetic coding sequence
atgtccgaacctatccgcgtcctagttacgggcgccgccggtcagatagcgtacagtctgctttacagtattgggaatggctccgtgtttggcaaggatcagccaatcattttggtgctgctggatattactcccatgatgggggtgctggacggggtgctgatggagctccaagattgcgccctacctcttctcaaagatgtaattgccactgacaaggaagatgtggccttcaaagacttggacgtggctattcttgtggggagcatgccccgtagggagggcatggaaagaaaggacctactgaaggcaaacgtgaaaatcttcaagagccaaggggctgccttggataagtacgccaaaaagtctgtaaaggtgatagtggtgggaaacccagctaacaccaattgcctcactgcatctaagagcgcgccctctatccccaaagagaatttctcatgtcttactagactggaccacaacagggccaaagctcagatagctctgaaattgggtgtaactgccaatgacgtaaagaacgtaatcatttggggaaatcattccagcacacaataccccgacgtcaatcacgccaaagtgaagctccagggcaaagaagtcggagtgtatgaggccttaaaggatgactcctggctgaaaggtgagttcgtaaccactgtccagcagaggggtgccgctgttatcaaggctagaaagttgtcaagcgctatgtccgccgccaaagcgatatgtgaccacgtgcgagacatctggtttgggactccagagggtgagttcgtgtcaatgggcgtcattagtgacggaaatagttacggggtacctgatgatttgctgtatagtttcccagtagtgatcaagaacaaaacatggaagttcgttgagggcttacctattaatgatttctcccgagagaaaatggacctgaccgccaaggaattgaccgaagaaaaagaaagtgcttttgaattcctgtcatccgcttag

SEQ ID NO: 124393 - DNA, 801 bp, Artificial Sequence
  Description of Artificial Sequence: Synthetic coding sequence
atggctgtgaacgtctactcgaccagcgtcacatcggagaacttgtcgagacacgacatgctcgcttgggtgaacgactccttgcacttgaattatacaaagattgagcagctctgcagtggcgcagcatactgtcaattcatggatatgttgtttccaggctgtgtgcatctgagaaaggttaaatttcaggcaaaactggaacacgagtatatccacaattttaaggtgttacaggctgcgtttaagaaaatgggcgtcgataagatcattccagtggagaagttggtcaagggaaagtttcaggacaatttcgaattcatccagtggttcaagaaattcttcgatgcgaactacgatggcaaggattacaaccccctgctggccaggcagggccaggacgtggccccacctcctaaccctgtcccacaacggacctcacccacgggccccaaaaatatgcaaacatcgggccgtctctcaaatgtggcccccccttgcatcctgcgcaaaaacccaccatctgcgcgcaacggaggccacgaaacagatgctcagatactggagcttaatcagcagctggtcgatttgaagcttacagttgatgggttagagaaagaacgcgacttttacttctctaaactgcgagatattgagctcatatgccaagagcacgagagtgagaacagtcctgtcataagcggtatcatcgggatcctgtatgcaactgaggagggctttgctcccccagaggatgacgagatcgaggaacaccaacaggaagatcaagacgagtattag

SEQ ID NO: 124394 - DNA, 801 bp, Artificial Sequence
  Description of Artificial Sequence: Synthetic coding sequence
atggccgttaatgtctactctacatccgtaacatccgagaacctctcccgacatgacatgctggcctgggtgaatgattccctccatttgaactatacaaaaattgagcagctgtgtagcggggccgcttactgtcagtttatggatatgctatttcccggatgcgtccaccttcggaaagtgaaattccaagccaagctcgaacacgaatacatccacaacttcaaggtgcttcaggctgcatttaaaaaaatgggagttgataaaattataccagttgagaagctagtcaaggggaagtttcaggacaatttcgagtttatacagtggtttaaaaaattctttgacgcaaattatgacggcaaagactataacccattactggctaggcagggccaggatgtggcccccccacccaaccctgtcccacagcgcacgtctcccacaggtcctaaaaatatgcagaccagtggaaggctcagcaacgtcgcaccaccctgcatcctgaggaagaacccgcccagcgcccgcaatggaggacacgagactgatgcccaaatcctagaattaaaccagcagttagtggatctcaagttgactgtggacgggcttgagaaagaacgtgatttctactttagtaaactgagggacatagagctcatctgtcaagagcatgaaagtgagaactccccagtgatatcaggcattataggcattttgtacgctactgaagagggtttcgccccacctgaagatgacgaaatcgaggagcaccagcaggaggatcaggatgaatactag

SEQ ID NO: 124395 - DNA, 657 bp, Artificial Sequence
  Description of Artificial Sequence: Synthetic coding sequence
atggctgtcaatgtttactcgacctccgtcaccagtgagaacctatcacgacacgacatgcttgcctgggtcaacgatagccttcaccttaactataccaagatcgaacagctgtgtagcggagcagcatattgccagttcatggacatgttgtttccaggctgtgtacacctgcggaaagtcaagtttcaggctaagttagagcacgagtacatccacaactttaaggtgttgcaggctgcttttaagaagatgggcgtagacaagattatccctgttgagaagttggttaagggtaagtttcaggacaattttgagttcatccagtggtttaaaaaattctttgatgctaactacgatggaaaggactacaatcctcttctggcacgccagggtcaggacgtcgctcctccgccaaaccccggagaccagatcttcaataaaagcaagaaactgattggaacagcagttccccagcggactagtccaacaggcccgaagaatatgcagacatcaggtaggctaagcaatgttgcaccaccctgcatccttagaaagaatcccccatcggccagaaatggcggtcatgagactgacgctcaaattcttgagctgaatcagcagctggtggatctaaagctgactgtggatggctag

SEQ ID NO: 124396 - DNA, 2004 bp, Artificial Sequence
  Description of Artificial Sequence: Synthetic coding sequence
atggagacattggaatctgagctcacttgtcccatctgcctggagctgttcgaagaccccttgcttctcccttgcgctcattccctctgtttcaattgtgcccatcggattctggttagccactgtgccactaacgaatcggttgaaagcattaccgccttccagtgtccaacatgtagacacgtgattaccctatcacaaagaggtctggacgggctgaagaggaacgtcacactgcaaaatatcatagataggtttcaaaaggcctccgtatctgggccaaattcaccgtcagaaacaagacgtgagagagcctttgacgctaacaccatgacaagtgcagagaaggtcctgtgccagttttgcgatcaagatccagctcaagatgctgtgaagacctgcgtgacttgtgaggtcagctactgcgacgaatgtctgaaggccacccaccccaacaagaagccattcaccgggcacagattgatcgagcccattcctgactcccatattcgcggcctgatgtgtctggagcacgaagatgagaaggtgaacatgtactgcgtaacagacgaccagctgatctgcgctttgtgtaagttagttggaaggcacagagatcaccaggtcgcagccctttcagaacgatatgataagcttaaacagaacttggaatccaacctgactaacctaattaagaggaacactgaacttgagactttgctcgccaaattaatacagacttgccaacatgtcgaggttaacgcaagccgacaagaggccaagctgacagaagagtgcgatcttcttattgaaattatccagcagcggcgtcagatcattggtacaaagattaaggaaggtaaagtgatgagattgcgcaaactggcccagcagattgcaaattgcaaacagtgcattgagcgctcagcgagcctaattagccaagcggaacactctttgaaagaaaatgaccacgcccgatttctgcaaacagcaaagaacatcacggaaagggtgtccatggcaactgcatcctcgcaggtactgatcccggaaattaatttgaacgacacgttcgacaccttcgccctggatttcagtagagagaagaaacttttagaatgtttggattacctgaccgcacccaacccacctacgattagggaggagctatgcacagccagttacgacacaatcaccgtccattggacaagtgatgatgagttctctgtggttagttatgagctgcagtatacaatttttaccggacaagccaacgtggtctcactctgtaatagcgcagactcctggatgatagttccaaacatcaaacagaatcactacacagtgcacggcctgcagagcgggactaaatatatctttatggtcaaagccatcaatcaggcagggagtcgttcatccgagccggggaagctaaagactaattcgcagccattcaaacttgacccaaaaagtgctcataggaaactgaaagtgagccacgataatcttacagtggagcgagacgagagctcgtctaagaagtcccacacacccgaacgtttcacaagtcagggatcatatggggtggccggaaatgtgtttatcgatagcggccgacattattgggaggtggtcattagcggtagcacgtggtacgctatcgggctggcttacaagagcgcacccaaacacgaatggattggcaagaactcagcgtcttgggcactgtgtcggtgtaacaataattgggtggtgagacacaattcaaaagagattcccatcgagccggccccgcacttgcgtcgagtgggcattttgcttgactacgacaatggaagcatcgcattctacgacgctcttaattctatccacctgtatacgttcgatgtggccttcgcacagccagtgtgtccgacatttaccgtatggaacaagtgtctaacaatcatcaccggcctgcccatcccggatcacctcgattgcactgagcaattgccgtag

SEQ ID NO: 124397 - DNA, 2004 bp, Artificial Sequence
  Description of Artificial Sequence: Synthetic coding sequence
atggaaactctcgagtccgagctaacctgtccaatctgtctggagctcttcgaggaccccctcttactcccatgcgctcattccctgtgcttcaactgcgcgcataggatcctggtcagccactgcgccaccaatgagtcagtcgagtccatcactgcctttcaatgtcccacctgtagacacgtgatcacactctcccaaagaggtctggatggcttgaaacgcaacgtgactctgcagaacataatcgatcgttttcagaaggcaagcgtgagcgggccaaactctccatccgaaacacgtcgtgagagggcttttgacgctaataccatgacctcagcggaaaaggtgctttgccagttctgcgaccaggatcccgctcaagacgccgtgaaaacatgcgtgacatgtgaggtgtcctattgtgatgagtgtctgaaggctacacatccgaataagaaaccatttaccggtcataggcttattgaacctatccctgactcccacatcaggggactgatgtgccttgagcacgaagatgagaaggtcaatatgtactgtgtgaccgacgatcaactgatctgcgctctctgcaaactggtgggacgtcaccgagatcaccaggtggctgcactctctgagcgctatgataaacttaagcagaatctggaaagcaatctcacaaatctgatcaaacgaaacaccgagctggagacactgctggcaaagctgatccagacatgccagcacgtggaggtaaacgcgtcacggcaagaagccaagctgacggaggagtgcgatctccttatagagattattcagcagcggagacagatcatcggtaccaaaatcaaggagggcaaggttatgcggctgcgcaaactggcccagcagattgcgaactgcaagcagtgtatcgagagaagcgcaagcctgattagccaggccgaacatagtcttaaggaaaacgaccatgcccggttcctacagaccgccaagaatatcacagaaagagtgagcatggcgaccgcaagctcacaagtcctcattccagagataaatttgaatgacaccttcgacactttcgccctggatttcagccgggaaaagaaattgttggaatgtttagattacttgaccgcacctaacccaccaacgatccgcgaagagctgtgcactgcctcttatgacacaataacagtccattggaccagcgatgatgaatttagcgtcgtatcttacgagcttcagtatactatttttacaggacaggcgaacgttgtctctctgtgtaacagtgctgattcttggatgatcgttcctaatatcaagcaaaaccactacactgttcatggccttcagagcgggaccaaatacatctttatggtaaaggctattaatcaggcagggagcagaagttcggagcccgggaagctcaagacaaactcacagcccttcaaactagacccgaagagtgctcacagaaagcttaaagtttcgcatgataacctgaccgtggagcgcgatgagtcatccagcaaaaagtcacatactcccgaacgattcacttcgcagggtagttacggcgttgccggaaacgtgttcattgatagcggtcggcactactgggaagtggtgatttctggctctacctggtacgcaattggtttggcatataaaagcgcaccaaaacacgaatggattggaaagaactctgcctcctgggcactttgccgatgcaataataattgggtggtccgccacaatagcaaagaaatccccattgagcccgccccccatctgagaagagtggggattcttctcgactacgacaacgggagtattgctttctacgatgcattgaactctatccacttatacacgttcgatgtcgccttcgcccaacccgtgtgtccaactttcactgtgtggaacaagtgccttaccataattaccggtctgcctattcccgatcatcttgattgtaccgagcagctcccctag

SEQ ID NO: 124398 - DNA, 2004 bp, Artificial Sequence
  Description of Artificial Sequence: Synthetic coding sequence
atggagaccctggagagtgaactgacttgccccatttgccttgagcttttcgaggatcctctgctgcttccatgcgctcactcactttgttttaactgcgctcaccgaatcctggtctctcattgtgccacaaacgaatcggtagaaagcattacagctttccaatgccctacatgccgtcatgtcataacactgtcccagcgcggcctagatggattgaaacgcaatgtcacgctgcagaacattatcgacaggtttcagaaggcgtctgttagcggcccaaacagccctagcgagaccaggcgggaaagagcattcgacgctaacactatgacatctgccgagaaggtactctgccagttctgcgatcaggatcctgcacaggacgccgttaaaacctgtgttacttgtgaggtctcgtattgcgacgaatgcctgaaggcaactcacccaaacaaaaagccctttacaggacaccggctgattgagccaataccagactcacacattcggggtctgatgtgtctggaacacgaagacgagaaggttaacatgtattgcgtgacggatgaccaactgatctgtgccctctgcaaacttgtggggaggcatcgagatcatcaggtggcagctctcagcgagcggtatgataagcttaagcagaatcttgaatccaatctgactaatcttattaagagaaacacagaactggagacactactggcgaaacttatccaaacatgccaacatgtggaggtcaatgctagccgccaggaagcgaagctcactgaggagtgtgacttactcattgaaatcatccagcagcggcggcagataattgggactaaaataaaggaaggaaaggtgatgcgactgaggaaacttgcgcaacagatcgctaattgtaagcagtgtatcgaacgcagtgctagcctgatcagtcaggcagagcattcgttgaaggagaacgaccatgctaggttcttgcagaccgccaagaatatcaccgagcgcgttagcatggccacagcttcaagccaggtcctcattcccgaaattaatctcaatgacacatttgataccttcgcacttgatttttccagggagaagaaactgctggagtgcctcgactacttaaccgctccgaatccgcccaccatccgtgaggagctctgcaccgcctcttacgatactattacggttcattggacctccgacgacgagttctccgttgtctcatacgagctgcaatacaccatttttaccggacaggctaatgttgtgagtctctgcaattctgccgatagttggatgatcgtgccgaacatcaagcagaaccattatacggtgcatgggctgcagagcggaaccaaatacattttcatggtcaaggccatcaaccaggcggggtctaggtcttctgaaccaggaaaactgaagaccaacagccagcccttcaagcttgacccaaaaagcgctcaccggaagctgaaagtgtctcacgacaatctcactgtggaaagggatgaatccagctctaagaagtctcatacgccagaaagattcactagtcagggcagctatggagttgcaggcaatgtgtttattgattcaggccggcattactgggaagtggtcattagcgggagcacatggtacgccatcgggttggcctataaaagcgctcctaaacacgaatggatagggaagaacagtgcttcatgggcattgtgtaggtgtaacaataattgggtggtgagacataactccaaggagatcccaattgagcctgcaccccatttgcgacgagtaggaatcctgctggattacgataatggtagtatcgcattttacgatgcactgaacagcatccacctgtataccttcgacgtagcttttgcccagccagtgtgtccaacgttcactgtgtggaataagtgcctaacgattatcaccggcctgcccatccccgaccacttagattgcacggagcagcttccatag

SEQ ID NO: 124399 - DNA, 1659 bp, Artificial Sequence
  Description of Artificial Sequence: Synthetic coding sequence
atggagaccctagaatccgaactgacctgccctatttgtctggaactcttcgaggaccccctgttactcccctgtgcacactctctttgctttaactgcgctcatcgtattctggtctcacactgcgccaccaacgagtccgtcgaaagcattaccgcatttcaatgccctacttgccgccatgtcataacactgtcccaaagaggcctggacggtctcaagcggaatgtgacacttcagaatattattgatagattccagaaggcatccgtgtccggaccaaactccccttccgagacccgcagggagcgagccttcgacgccaacacaatgaccagcgccgagaaggtgctgtgtcagttttgcgatcaggacccagcccaggacgccgtaaagacttgcgtaacctgcgaagtgtcctactgcgatgagtgccttaaagccacccacccaaataaaaagccatttaccggtcacagactgatcgaaccaatcccagattcgcacatccggggcctgatgtgtttagagcatgaggatgaaaaggtcaacatgtactgtgttacagacgatcagctgatctgtgctctatgtaagctggtcggaaggcacagggatcaccaggtggccgccttatctgagcgctacgataaactgaagcagaacctggagagtaatcttactaacctcatcaaaagaaatacagaactagaaaccctactcgcaaagctgatccagacgtgccaacacgtggaggtgaatgcctcgagacaggaagcaaaactgacggaagaatgtgacctcctgatcgaaatcatccagcaaagacggcaaatcattggtaccaagatcaaggaggggaaggtcatgcgcctgcgcaaactggcacagcaaattgcaaattgtaagcagtgcatcgagcggtctgcatcactgatttcacaggctgagcacagcctaaaggagaatgaccatgcccgattcctgcagaccgcaaaaaacataactgaaagggtcagcatggccactgcttcatcacaggtgctgatacccgagattaacctgaacgatacattcgatacttttgcactcgatttcagccgagaaaagaaattgctggaatgcttagactacctaactgctcccaatcctccgaccatcagagaagagctttgtacagcctcctacgacacaataactgtccactggacctcagatgatgaattcagcgttgtttcctatgagttacagtacacaatatttaccggacaggcaaatgtggtatcactgtgcaacagcgcagacagttggatgatcgtccccaacatcaaacagaaccattatacggtgcacggtctccagagtggcactaaatacatattcatggtgaaggcaattaaccaggccggaagccggagctcagaacccggcaaactaaaaaccaacagtcagccatttaaactggatcctaaatctgcgcaccgcaagctgaaggtatctcacgataacctcaccgtagaacgcgacgagagcagctccaagaagagccacacgccagaaagatttacgtcccaggggagctatggtgtggctggaaacgtctttattgactctgggcggcattattgggaagtggtaatcagtggctccacctggtag

SEQ ID NO: 124400 - DNA, 2004 bp, Artificial Sequence
  Description of Artificial Sequence: Synthetic coding sequence
atggaaacactggaatccgagcttacctgccccatctgcctggaactgtttgaagatccactgctgttgccctgcgcacactctctgtgcttcaattgtgctcatagaatactcgtgagtcattgcgctactaacgaatccgtcgaatctatcactgcctttcagtgtcctacctgccgccatgtgattacactatcacaacggggactggacggtcttaaacgcaacgtgacattacagaacatcattgataggtttcaaaaagctagcgtaagtggccctaactcgcccagcgaaactcgccgcgagagagcctttgatgctaacacgatgacctccgctgagaaggtgctctgtcaattttgtgaccaggacccggcgcaggatgcggtgaaaacctgtgttacctgcgaagtgagttattgtgatgagtgtctcaaggccacccaccctaacaagaagcccttcactggccatcgcttgattgaacccattccagacagtcacatccgcggattgatgtgtcttgaacatgaggacgagaaagtcaacatgtactgcgtaacagacgatcagttgatttgtgcgctgtgcaaactggtgggccgccacagagatcatcaggtggcagcactcagcgaacggtacgacaagttaaagcagaatttggagtctaacctgactaacctgattaaaaggaacacagagctggagactctgttggccaagctgatccagacctgtcagcatgtcgaggtgaatgcttctagacaggaggccaaactgacagaggagtgcgacctcctcattgaaataatccagcaacgcaggcagataatcggcaccaagatcaaggaaggcaaagtaatgcggctgaggaaactcgcacagcagatagccaattgcaaacaatgcatcgagcgaagcgctagccttatcagtcaggctgagcatagcctgaaagaaaatgatcacgctagattccttcaaaccgccaagaatatcactgagcgcgtgagcatggccacagcttccagccaggttctcatacccgagataaatctcaacgatacattcgacacattcgccctggacttctcaagggaaaaaaagctactggaatgcctcgattacctgacagccccgaaccctcccaccatccgcgaggaactgtgtacggcctcctacgatacaatcactgtgcactggaccagcgatgatgaattcagcgtcgttagttatgaacttcagtacacaattttcaccggccaggcaaatgtggtgagcctgtgcaactccgcagattcttggatgattgtgcctaatatcaaacagaaccactatacagtacatggcctgcagtccggcaccaagtatatatttatggtgaaagctataaaccaggccggcagtcgctcgtctgaaccaggaaagctgaagactaattctcagccctttaagttggatccgaaatccgctcaccgtaagctgaaggtgtcgcatgacaacttgaccgtcgagcgcgacgaaagcagctcgaagaaaagccatacacccgagagatttacttcccagggcagctatggcgtggccggcaatgtgttcattgactctggccggcattactgggaggtagtcatctcaggcagtacatggtatgccattggattggcatataaatccgcgcctaagcatgaatggattggaaaaaactcggccagctgggccctgtgccgttgtaataataattgggtagtgaggcacaatagtaaagaaatccccattgagccagcccctcacttgcggagggtgggtattttactcgattacgacaacgggagcattgccttctacgatgccctcaactctattcacctctatacattcgatgtggccttcgcccagccggtctgcccaacgtttaccgtatggaataagtgtttgacaatcataacaggtctccctatcccagaccatctggactgcaccgagcagttgccctag

SEQ ID NO: 124401 - DNA, 2004 bp, Artificial Sequence
  Description of Artificial Sequence: Synthetic coding sequence
atggagactctcgagtccgagctcacatgccctatatgccttgaactgttcgaagacccgttgctgctgccttgcgctcactccctgtgttttaactgcgcccaccggattctggtttcacattgcgcaacaaacgagtctgttgaatccattacagcttttcagtgccctacttgtcgccatgttattacactctcccagagaggactggatgggctgaagaggaatgtgaccctgcagaatatcattgaccgatttcagaaagcaagtgtgtcaggccccaacagcccgtcagagacacggcgcgagcgagcttttgacgccaacaccatgactagtgcagaaaaggtgctgtgccagttctgcgatcaagaccctgcccaggatgccgttaagacatgtgtaacatgtgaggtgtcatactgcgacgagtgcctgaaggctacacatcctaacaagaagccatttacaggccaccggctcattgagccaattcctgactctcatatacgtggcctgatgtgtttagagcatgaagacgaaaaagtgaacatgtattgtgtcactgacgatcagctcatctgcgccttatgcaagttggttggccgccatcgagaccatcaggttgccgcattatcagagaggtacgataaactcaaacagaatttggaaagcaacttgaccaatctgatcaaacgcaataccgaactcgagactctcctcgctaagctgattcagacatgccagcacgtagaggttaatgcctcgcggcaggaggctaaacttactgaggagtgtgatctgctcatcgagatcatccagcagagaaggcagatcatagggaccaagattaaagagggcaaggtaatgaggctccggaaactggcccagcagattgccaactgtaaacaatgcattgagagatccgcctctttaattagtcaggccgaacactccttgaaagagaatgaccacgctcgctttctccagaccgccaagaacatcacagaacgggtgtcgatggccacagcttcatcgcaggtgttgatacccgagataaatctgaacgatacatttgacacatttgctttggatttttcgagagaaaaaaagcttctggagtgcctggactacctgaccgcacctaatcctccgaccatacgagaggagctgtgcacagcctcctatgataccattacagtgcattggacatctgacgatgagttctccgtggtgagctacgagttgcagtacaccatatttacggggcaggccaacgtggtgtctctctgtaattctgccgatagttggatgatagtccccaatattaagcagaaccactataccgtgcacggacttcagtccggcacgaagtatatttttatggtgaaggcaatcaatcaggccgggagcagatcctcagagcctggcaagctgaaaacaaactcccagccctttaagttagatcccaagagtgcccaccggaaactgaaagtttcccacgataacctgacagtagagcgcgacgaatcgtctagtaaaaagtcccacacccccgagcgctttacgagtcaggggagttacggcgtggcagggaacgtgttcatcgactctggacgacattactgggaggtagtgatatctggaagcacttggtacgccattggactcgcttacaagtcggctccaaaacacgaatggatcggaaagaattcagcttcgtgggcgctgtgtaggtgcaataacaactgggtagtgcggcataattccaaggagatacccattgaacccgcacctcatctccggcgggttggaattttgctggattatgacaacggctcaattgctttctatgacgccttgaatagtatacacctctatactttcgacgtcgccttcgcacagcccgtttgcccaacgtttaccgtatggaataaatgtctcacaataatcaccggattaccgatcccagaccatctcgactgcactgagcagctgccctag

SEQ ID NO: 124402 - DNA, 1452 bp, Artificial Sequence
  Description of Artificial Sequence: Synthetic coding sequence
atggaaaccctggagtccgaactgacctgtcccatctgtctcgaacttttcgaagatccactcttgttgccatgtgcacactctttgtgttttaactgcgcgcatagaattctggtgagtcattgcgccaccaacgagtccgtggagagtatcaccgctttccagtgtcctacatgtcggcatgttataacactcagtcagcgggggcttgacggccttaaacggaacgtcactctgcagaacatcatcgaccggttccaaaaggcctccgtgtctggtcctaactcaccctctgagacccgccgggagcgggcttttgatgctaataccatgacgagcgcagaaaaggtactgtgccagttttgtgaccaggacccagcccaagacgcagttaagacatgcgtcacctgcgaggtgagctactgcgacgagtgcctgaaggctacccaccctaataagaagcccttcacggggcaccggctcatagaacccatcccggactcacacatcaggggactgatgtgtctggaacacgaggatgaaaaggtgaatatgtactgtgtaactgatgaccagctcatctgtgccctgtgtaagctcgtggggaggcacagggaccaccaggttgctgcgttatctgagaggtacgataagctcaaacagaatttggagtccaatctgacaaatctgataaagaggaacactgaactggagacactcttagccaagcttatacagacctgccaacatgtggaagtgaacgcgagtcggcaggaggctaaacttaccgaagaatgcgatctgctgattgagattatccagcagcggagacagattatcggtaccaaaattaaggaaggaaaggtgatgcgactgcgcaaattggcgcagcagattgccaactgtaagcagtgtatcgaaaggtcggcgtccctgatatcccaggctgaacattcattgaaggaaaacgaccacgctcggttcctgcagacagccaaaaacatcacagaaagggttagcatggcgacagccagctcgcaggtgctgatcccagaaataaatcttaatgacacatttgacactttcgctctggacttttcccgagaaaaaaagctgctggaatgcctggactatctgacggctcccaatcctcctacgatccgcgaggaactttgtacggccagctatgacaccattacagtccattggaccagcgatgatgagttctccgtggtgagttacgaattgcaatatacgatatttacagggcaggcaaacgtcgtgtcactatgcaactctgcggactcctggatgattgtccccaatatcaaacagaaccactacaccgttcacggcctgcaatccgggaccaagtacatcttcatggttaaagccattaaccaggccgggagccgtagctccgaacccggcaagttgaagaccaactcctag

SEQ ID NO: 124403 - DNA, 594 bp, Artificial Sequence
  Description of Artificial Sequence: Synthetic coding sequence
atggaaacgctcgagtcagagttgacatgcccgatttgcctggagctctttgaggatccacttctcctgccatgcgcgcactcactgtgttttaactgcgctcatcgcatcctcgtgagtcattgcgcaactaatgaaagcgtcgagagcattacagccttccagtgtccgacctgtcgccatgtcataacactgagccagcggggcctagacggactgaaaagaaatgtgactctacagaacattattgatcgctttcagaaggccagtgtcagcggaccaaacagccctagtgagacacgcagagagcgcgccttcgacgccaacacaatgacctctgctgaaaaggtactgtgtcaattttgtgaccaggatcccgcacaagacgctgtgaaaacatgcgtaacatgcgaggttagctattgcgacgaatgcttaaaggcgactcaccctaataagaagccctttaccgggcacagactgatcgaacccatccctgattctcacatacgtggcctgatgtgcctggaacatgaggacgagaaggtgaacatgtattgcgtgactgatgatcagttgatctgtgcactgtag

SEQ ID NO: 124404 - DNA, 2004 bp, Artificial Sequence
  Description of Artificial Sequence: Synthetic coding sequence
atggaaactctggagtccgaactgacatgcccaatatgccttgagctcttcgaggaccctcttctgctgccctgtgcccactctttgtgttttaattgtgcccaccggatcctggtttcccactgcgctactaatgaaagcgtggaatcaattacagcatttcagtgcccaacctgtagacacgtaattaccctgagtcagaggggtcttgatggtttgaaacggaatgttacgctccagaatataatcgatcggtttcagaaggcttccgtgagcggacctaattccccctctgaaactagacgtgaaagagcctttgacgctaataccatgacctccgcagaaaaggtcctgtgccagttttgcgaccaggatcctgcccaggatgcggtgaaaacctgtgttacctgcgaggtgagctattgcgacgagtgcctaaaggccactcacccaaacaagaaaccattcaccggccaccgccttatagagcctatcccggactcacatatacgtggtctgatgtgcctcgaacatgaggacgaaaaggtgaatatgtactgcgtgactgacgaccaactgatatgcgctctctgcaagttggtgggcagacaccgggaccaccaggtagccgcgctctccgagcgttacgacaaactcaaacagaatctggaaagtaacctgacaaatctcattaaaagaaacactgaactggagactctgttagccaaactcatacaaacttgccagcacgtcgaagtcaacgcctcacgacaggaggctaagttaactgaagagtgcgacttgctgatcgagatcatccaacaacgaaggcaaatcatcggcaccaagattaaggagggaaaggtgatgagattgcgcaaactcgctcaacaaatcgctaactgcaagcagtgcatcgagcgatcagcttcattgattagccaggcagagcattccctgaaagagaacgatcacgccaggttcctccagaccgccaagaacatcactgagagggtcagtatggccaccgcttcttcgcaggtgctgatcccggaaattaatttgaacgacacatttgacacatttgccctcgatttttctcgggaaaagaaattgctggaatgtttggactatctgactgctccaaaccctcccaccattcgcgaagaactgtgtactgcgtcctatgacactattaccgtacactggacaagtgacgacgagttctccgtagtgtcctacgaactgcaatataccatctttacaggtcaagctaatgtggtctccctgtgtaactctgcagactcctggatgatcgtccccaatataaaacaaaaccattataccgtccacggcctgcagagtggaacgaaatacatatttatggtaaaagccatcaatcaggcgggcagtcggtcaagtgaaccaggcaaactcaaaacaaattcccagccttttaagctggatcccaaatccgcccatcggaagctgaaagtaagccatgacaacctgaccgtggaaagagatgagagttcaagcaaaaagagccatacgcctgagcgatttacttctcaaggatcctacggagtggccggaaacgtgttcattgacagtggccgccattattgggaggtggtgatcagtggaagcacctggtacgctatcggattggcctacaaatctgcccccaagcatgaatggatcgggaaaaactctgcgtcttgggcactgtgtcggtgtaacaacaattgggtagtgcgccacaattcaaaagagattcccatcgagcctgctccccaccttcgaagagttggcatactgcttgactacgacaatggtagcatcgctttctatgatgccttgaactccatacatctctatacctttgatgtcgcctttgcacaaccggtttgcccgacatttaccgtgtggaataagtgtctgactattatcacaggattgcccatcccagaccacttagattgtaccgagcagctgccttag

SEQ ID NO: 124405 - DNA, 1854 bp, Artificial Sequence
  Description of Artificial Sequence: Synthetic coding sequence
atggaaacgctagaatctgaacttacatgccccatctgtttggaactgttcgaagaccctcttttacttccatgcgcccacagtctgtgttttaattgtgcccaccgcatactcgtgtcccattgtgctacaaatgaaagtgttgaatctattacggcattccagtgtcctacttgtcggcatgttattactttaagtcagcgtggactggatggccttaagcggaacgtaactctgcagaacatcattgacagattccagaaggccagtgttagcggcccgaatagcccctcagagaccagcgctgagaaggtcttatgtcagttttgcgaccaggatcccgcgcaagatgccgtgaagacctgcgtaacctgcgaggtgagttattgtgatgaatgcctgaaagctacgcacccaaataaaaaaccattcacaggtcatcggctgatagaacccatccctgactcccatatccggggcctgatgtgcctggagcatgaagatgaaaagcagaacttggagtctaatctgaccaatcttatcaagcggaatactgagctggagacactgcttgccaagctaatccagacttgccaacatgtggaggtgaatgccagtagacaagaggctaaacttacagaagagtgcgatctcttgatagaaataatccagcagaggcgtcaaattattggaacaaagatcaaagagggtaaggtgatgcgacttaggaagttagctcagcaaattgcaaattgtaaacagtgcatcgagcgttccgcgagcctgatttcccaagccgaacacagtctgaaagagaacgatcacgcacgttttctccagacagccaagaacatcacagagagagtgtccatggcgaccgcaagcagccaggttcttatccctgagattaacctcaatgacacatttgatacgtttgccctggatttttctcgtgagaaaaagttgctggagtgcctcgactacctgacagcacccaatcctccaacgatcagggaagaattatgcacagcatcctatgatactattactgtgcattggacgtctgacgacgagttctctgtcgtgtcatatgaacttcaatacactatctttacagggcaggcgaatgtcgtttctctgtgcaactcagccgatagctggatgattgttccgaacatcaagcagaatcactataccgtacacggtctgcagagcgggacaaaatacatttttatggtgaaagctatcaaccaggccgggtcgcggagtagtgagccaggtaaactgaagacgaattcccagccattcaagctagatcccaaatctgcccatcgaaaactgaaagtgtcccacgacaacctcaccgtagagcgagacgaaagctcctctaaaaagagccacacccccgaacgattcacaagccaggggagctacggagtcgctggtaatgtattcatcgattcaggcagacactattgggaagttgtcatctccggatcaacctggtatgccattgggctggcctacaagtccgcaccaaagcacgagtggatagggaaaaactccgcttcctgggccctctgccgctgtaataacaattgggtggtgcgccacaatagtaaggagattcctattgaacccgcaccccacttaagaagagtgggcatccttctggactatgacaacggttcaatagctttttacgatgcactcaacagtatccacctgtacaccttcgatgtcgcttttgcacagcctgtctgtccaacctttaccgtctggaacaagtgcctcacgataatcaccggtctgcctattccagaccacctcgactgcaccgagcagcttccttag

SEQ ID NO: 124406 - DNA, 2208 bp, Artificial Sequence
  Description of Artificial Sequence: Synthetic coding sequence
atgggtgagtcccctgcctcggtcgttctgaacgccagcggcggcctctttagcctcaagatggagaccctggaaagcgagctcacttgtcctatatgcttggaactgtttgaagatcctctgttgctcccttgtgcccatagcttgtgcttttcctgtgcacaccgaatacttgtatcgagctgttcctcaggtgagagtattgagccaatcacagctttccagtgcccaacgtgtcggtatgtcattagtttaaaccaccggggtctggacggtttgaagagaaacgtgactttacagaatattatcgaccgcttccagaaagctagcgtgagtggccctaattctccttcagaatcaaggcgcgagcgtacctaccggcccacgaccgctatgtctagcgaacgcatagcttgccagttctgcgagcaggacccacctagggacgccgtaaaaacatgcattacatgcgaggtttcttactgtgatagatgcctgcgagctacacatccaaacaaaaagccattcacttctcacagactggtggaaccggttccagatacccatctgcgaggcatcacttgcctcgaccatgagaacgaaaaggtaaatatgtactgcgtgtcagacgaccagttgatttgtgctctctgtaaattagtgggccggcatagggaccaccaggtcgcaagcttgaacgatcgattcgagaaattgaaacagactctggaaatgaacctgactaatctcgtcaagcgaaactccgagctggagaatcagatggccaagctgatccaaatttgtcagcaggtggaagtaaatacggcaatgcacgaagctaaacttatggaggagtgtgacgagctggtcgagatcattcagcagcggaaacagatgatagctgtgaaaatcaaagaaaccaaagttatgaaactgagaaagcttgctcagcaggtcgcaaactgccggcaatgccttgaaaggagcacagtgctcatcaaccaggcggagcatatactaaaggagaacgatcaagcaagatttctgcagtctgctaagaatatcgctgagcgggttgcaatggctactgcctctagccaagtactcataccagacatcaacttcaatgatgcattcgaaaattttgcgctcgacttcagccgtgagaagaagctgcttgaaggcctcgattatctcaccgcacctaacccgccaagcatccgcgaggaactctgcacggccagccacgatacaataaccgtccactggatttccgatgacgagttctctatttcaagctacgagctgcagtacactatctttacaggccaggctaatttcatttcgaagtcatggtgctcttggggtctgtggccagagattaggaagtgcaaggaggccgtatcttgttctcgcctcgctggcgcccccaggggtctatacaactccgtcgactcctggatgattgtgccaaatatcaagcagaaccattacacagtacacggcctccagtctggcaccaggtatatctttatcgtgaaggctatcaaccaggctgggagtaggaactcagaaccaactcgacttaaaactaatagccaaccctttaaattggaccctaagatgacccacaagaagctgaagatctcaaatgacgggctccagatggagaaggacgagagtagtctgaagaagtcccatacgccggagagattcagcggtactggctgttacggtgcagccggaaatatcttcattgactcagggtgccattattgggaagtggtgatggggagctccacctggtatgctatagggatcgcctacaagagcgcacctaagaatgaatggatagggaagaatgcatcatcctgggtgttctcgcggtgtaactctaacttcgtggtgcgccataataacaaggagatgctcgtggacgtgccgcctcatctcaagcgtctgggcgtcctcctggactatgacaataatatgctatcgttctatgatccagcaaactcactacatctgcacacttttgacgtcacgttcatactccctgtctgccctaccttcaccatctggaataagtcactgatgatcctgtctgggctccccgcccccgattttatcgactatcccgagcgacaggagtgcaattgcagaccacaagagtccccctatgtgtcaggcatgaagacttgccactag

SEQ ID NO: 124407 - DNA, 2118 bp, Artificial Sequence
  Description of Artificial Sequence: Synthetic coding sequence
atgggcgaatctccagcatccgtggtgttgaatgcctctggaggtctgttctcactgaaaatggaaacccttgaatccgaactgacatgccccatctgtctcgaactatttgaggacccactcctgctgccctgcgctcattcattgtgttttagctgtgctcatcgaatcctggtgagctcctgctcaagtggtgaatctatcgagccaatcacggcctttcaatgtcccacttgccgctatgtaatcagcctcaaccacagagggctcgacggattaaaaaggaacgtgactctgcagaatattatcgaccggtttcagaaagcgagcgttagtggcccaaattcacctagcgaaagtagacgggagagaacatatagacctacaacggcgatgagctctgagcgtatcgcttgccagttttgcgagcaagaccctccccgagatgcagtaaaaacctgtataacttgtgaagtcagctactgcgaccggtgccttcgcgccacccacccgaacaaaaaaccgtttacctcccaccggttggtcgagcccgtgccagacactcacctgcgcggaataacttgtctggatcacgagaacgagaaggtcaacatgtattgtgtgtcagatgaccagctgatttgcgcactttgcaaactcgtgggccggcacagggatcatcaggttgcttcattaaatgatagattcgaaaaactgaagcagacccttgagatgaacttgactaacctagttaagcggaacagcgaattggaaaaccagatggcgaagctgatccagatctgccagcaggtggaggtgaacaccgctatgcacgaagccaaattgatggaggagtgcgacgagctggtagagataattcagcagcggaaacagatgatcgcagtgaaaattaaagagacaaaggtgatgaagctgcgtaagttggcccagcaggtggcaaattgccgtcagtgccttgagcgcagcactgtattaataaaccaagccgagcacatcctgaaagagaacgatcaagcccgctttctacagagcgccaaaaatatcgcagaaagggtggccatggcaactgcctcgagccaagtattaatccccgatatcaattttaatgacgcctttgagaacttcgccctcgacttttcaagagaaaaaaagctactcgaggggctcgattaccttaccgcccccaaccctcccagcatcagggaagaactttgcaccgcgagccacgacactatcacagttcattggatatcagacgacgaattttctattagctcctatgaactgcagtacacaattttcaccgggcaggccaactttataagcctatataactccgtggattcctggatgattgtcccaaatataaaacagaatcattacacagttcacggattacagtccggaactaggtatatctttatcgtgaaagctatcaatcaggcgggctcccggaatagtgagcccacaagactcaagaccaacagtcagccatttaagctcgacccgaaaatgacacataagaagctcaagataagcaacgatggactgcaaatggagaaagatgaatccagtttgaagaaatcacatacaccagagcgattttccggcaccggctgttacggtgctgcaggaaacattttcatcgactcaggttgccactattgggaggtggtcatgggatcaagtacctggtatgccatcggaatagcctataagtctgctcctaagaacgaatggattggaaagaacgccagttcctgggtcttcagccgttgcaacagtaatttcgtggtgagacacaataacaaagaaatgctggtggatgtaccaccccatctaaaacgactgggggtgctgctcgactacgacaacaatatgctgtcattctacgacccagctaattccctgcacttacacacattcgacgtaaccttcattctgccagtgtgccccacctttacaatatggaacaagtccctgatgatcctgtctggccttcctgcgcctgattttatcgattacccagagcgccaggaatgtaactgccggccacaggagtccccctacgtatctggcatgaaaacctgtcattag

SEQ ID NO: 124408 - DNA, 660 bp, Artificial Sequence
  Description of Artificial Sequence: Synthetic coding sequence
atggagacattggaaagcgagttgacatgtcctatctgcctggaactcttcgaggacccgctactcctcccctgtgcccattctttatgtttctcttgtgcccaccgcattctcgtgtcttcctgctcctccggagagtcaatagaacctatcacagctttccagtgtccgacttgcagatacgttatctcactgaatcatcggggccttgacggcctgaagagaaatgttacactgcaaaatatcattgacaggtttcagaaagcctccgtcagcgggccaaacagcccctccgagtcaagacgggagaggacttacaggcccacaacagcgatgagttccgagcgaatagcctgccagttttgcgagcaggatccgccgcgggatgccgtcaaaacttgtatcacatgtgaagttagttactgcgatcgctgcttgcgggctactcaccctaacaaaaaaccttttacatcccatcgattagttgagccagttcctgacacccacctgagggggattacctgcttagatcacgagaatgagaaagtgaacatgtactgcgtctccgacgatcagttgatatgcgccctgtgtaagctggttggtaggcacagggaccatcaggtagccagcctgaatgaccggtttgaaaaactgtag

SEQ ID NO: 124409 - DNA, 1407 bp, Artificial Sequence
  Description of Artificial Sequence: Synthetic coding sequence
atggagccccaaccggggggagctaggtcctgccgaaggggggctcccggtggagcctgtgagctcggacccgccgctgaggccgcacctatgtctctagcgattcatagtacaaccggaacacgctacgatctggccgtgccccctgatgaaactgtggagggccttcgaaagcggctatcccaacgactgaaagtgcctaaggagcgccttgccctcctgcacaaggatacgagattgtcctccggtaagcttcaggagtttggtgtcggggatgggtcgaagctgaccctagtgcctaccgttgaagctggcttaatgagccaggccagcaggccagagcagtctgtgatgcaggccttagaatcactgacagaaacccaagtgtccgactttctgtcggggaggtcccccttaacgctcgctctgcgggtgggagaccatatgatgtttgtgcagctgcagctggctgcccagcatgccccactacaacaccgccatgtgctcgccgccgctgccgcggccgctgcggctcgaggggaccccagcatcgcctctcccgtgtccagtccttgcaggcctgtgtccagcgcagcgcgagtcccacccgttcctacctctccatcgcccgcctctccaagtcctatcacagccgggagctttcgttcacatgcagcatccacgacctgtcctgagcagatggactgtagtcccactgccagcagctcggcttctcccggggcttctaccacgtcaacccctggcgctagccccgcccctcgttcccgaaaaccaggcgccgtaatcgagtcgttcgtgaatcacgcgcctggagtcttctctggaacattctccggtaccctccatcctaattgccaggacagtagtggtcgccccaggcgggacatcggcaccatcctgcagatcctgaatgatctactgtccgctactcgccactatcaaggaatgccccccagcctagcacagctgcgctgccatgcgcagtgttcccccgccagccccgccccagacctggcgccacggaccactagctgcgaaaaattgaccgcagcaccatctgccagtctgctgcaaggtcagagccagatcaggatgtgcaaacctcctggagacaggctgcgccagacagagaaccgggcaacacgatgcaaagttgaaagactccaactgcttctccagcaaaaacgcctgcggcgcaaggcccgcagggatgctcggggcccctaccattggtcaccctctcggaaggccgggcgttcagactccagctcatcagggggtggagggagcccaagtgaggccagtggattgggtctggattttgaggactctgtctggaagcccgaggtcaatccagatatcaagtcagaatttgttgtcgcatag

SEQ ID NO: 124410 - DNA, 771 bp, Artificial Sequence
  Description of Artificial Sequence: Synthetic coding sequence
atgggggagccatcccgggaagaatataaaatccagagtttcgatgcagaaacccagcaacttctgaagaccgccctcaaagtggcctgcttcgaaactgaggatggcgagtatagcgtctgccaacgatcctatagtaactgctccagactgatgcccagtaggtgtaatacccaataccgggatcccggagctgttgacctcgaaaaggtggccaacgtgatagtcgatcactccctccaggactgcgtgttttcaaaagaggctggaagaatgtgctacgcaatcatccaggccgagagcaaacaggctgggcagtccgtctttagaagagggcttctcaaccgcctacagcaggaatatcaggcccgggagcagctcagggcgagatctttacagggttgggtgtgctatgtgacatttatctgcaacatctttgactacctccgcgttaataacatgcccatgatggctttggtgaacccagtgtatgactgtttattcaggttagcccagcccgactcgctgagcaaagaagaggaggtggattgtttggtgctgcagctgcaccgtgtgggagaacagcttgagaagatgaacggtcaaagaatggatgaactgttcgtcctgatccgcgatggctttttgctgcccacaggcttatcttcactcgcccagcttctgctattagagatcatcgagtttcgagctgccggttggaagacaaccccagcagcccataagtactactactccgaggtgtcagattag

SEQ ID NO: 124411 - DNA, 669 bp, Artificial Sequence
  Description of Artificial Sequence: Synthetic coding sequence
atgggagaaccgagcagggaggagtacaagatccaatccttcgacgctgagacacaacagctccttaaaaccgcactcaaagaccctggagctgttgacctggagaaagtggccaacgtgattgtcgaccattcccttcaggactgtgtattcagcaaggaagcaggaagaatgtgctacgctatcatccaggctgaaagtaagcaagctggacagtcagttttcaggcgcggactgctgaaccgcctgcagcaagagtatcaggcccgggaacagttaagagcccgtagtctccaggggtgggtgtgttacgtaacctttatctgtaacatctttgattacctccgtgtaaacaatatgcccatgatggccttagttaatccggtgtatgattgcctgttccgactcgcacagcccgattccctcagtaaggaggaagaggtggattgtttagtgctgcaattacacagggtgggagaacagctggaaaagatgaatggtcaacgtatggacgagctcttcgtactgatccgggatggatttctgcttcccaccggtttatcgtcactcgcccaactacttctgctggaaatcatagagtttagggcagccggatggaagaccaccccagccgcccacaagtactattattctgaggtctcggattag

SEQ ID NO: 124412 - DNA, 792 bp, Artificial Sequence
  Description of Artificial Sequence: Synthetic coding sequence
atgggggagccctcacgtgaggagtataagatccagtccttcgacgccgagacccagcagttgcttaagaccgcccttaaggctccctccttagaatgcacagtcgcctgctttgagacggaggatggcgagtactcagtgtgtcagaggtcctactccaattgctcaaggttaatgccgtcccgctgtaacacccagtaccgcgacccaggagccgtggatctggagaaggtggctaatgtgattgtcgaccacagtttacaagattgcgtgtttagcaaggaagccggtcgaatgtgctacgctatcatccaggccgagagtaaacaggccggacagtcagtgttccgtaggggactgctgaaccgcctgcagcaggaataccaggcaagagaacagctcagggcacgatctctgcagggttgggtgtgctatgtcacctttatctgcaacattttcgactacctgcgcgtgaacaatatgcccatgatggccctcgttaatcctgtttacgactgtttgtttcgcctcgctcagcccgactcactatcaaaagaagaagaggtagattgcctggtgctacagctgcacagggttggggagcagctcgagaaaatgaatggccaacgtatggatgaactgttcgtgctcataagggacggcttcctgttgcccaccggtctctcctccttggcacaactgcttttactcgaaatcatcgagtttcgggctgcaggctggaaaaccacgcccgcagcacacaaatactattattctgaggtatctgactag

SEQ ID NO: 124413 - DNA, 1164 bp, Artificial Sequence
  Description of Artificial Sequence: Synthetic coding sequence
atgcctaggcccagattacttgcggctctatgcggcgccctcttgtgcgcgccctccctgcttgtcgcactcgatatctgttctaagaatccctgccacaatggagggctctgcgaggagatatcacaggaagtgcgcggagacgtctttccgagctatacctgtacttgcctgaagggctacgctggcaatcactgcgagactaaatgtgtggaacctttaggtttggagaacggaaatattgccaattctcaaattgccgcctcttctgtgcgcgtgacctttctgggcctccagcactgggtgcctgagctcgctagactgaaccgggcaggcatggtgaatgcttggaccccctccagcaacgacgacaatccatggatccaagtaaacttgcttcggagaatgtgggtgactggagtggtgacccagggtgcctccaggcttgcatcacatgaatacctcaaggcatttaaagtggcatactcactgaacggacacgagttcgacttcatacacgacgtgaataagaagcacaaagaatttgtgggcaattggaacaaaaacgccgtacatgtaaatctcttcgagacgccggtagaggcgcagtacgtcagactttatcctacgtcttgtcacactgcctgtactttgcgctttgagctgttgggctgtgagctgaatggatgcgcaaacccgctgggcctcaagaataacagtatccccgataaacagataaccgcctcttctagctataagacctggggactgcatctcttttcctggaatccctcatacgcacgtctcgataaacagggcaactttaacgcgtgggtagccgggagttacggaaacgaccagtggttgcaagtggacctcggcagctccaaggaggtaactggcatcatcacgcagggggcacgtaactttggcagtgtgcagttcgtggcatcctataaagtggcttattcaaacgactccgcaaattggacagagtatcaggatcctagaacaggttcctcaaagatttttccaggtaactgggataatcatagccacaagaaaaacttgttcgagacccccattctggcgcgttatgtccgtattctcccagtggcatggcataatcggatcgctctacgccttgaacttttaggctgttag

SEQ ID NO: 124414 - DNA, 1140 bp, Artificial Sequence
  Description of Artificial Sequence: Synthetic coding sequence
atgtggcctttcccggaaggaggtaataccatccccattctgcacaccgacatctgtagtaagaacccatgccacaatggcggcctctgcgaggagattagccaggaagtgcgcggcgacgtgtttccatcctatacatgcacctgcctgaagggatatgctggcaaccactgtgagaccaagtgtgtggagcccctcggcctggaaaatggcaacatagcgaactcccagatcgcagcatcctccgtgcgagtgacattcctgggcctacagcattgggtgcccgagctggcccggctgaatcgcgcagggatggttaacgcctggacgccttctagtaacgacgataatccctggattcaggtgaatctgctgagaagaatgtgggtgaccggcgtcgtgacgcaaggcgcctcccgactcgccagccacgagtatcttaaggcgttcaaggtggcttattcactgaatgggcatgagtttgatttcattcacgatgtgaacaaaaagcacaaggaattcgttggcaactggaataaaaacgctgtgcacgtcaatttgttcgagacacctgttgaggcacagtatgtgagactgtatcccacgagctgtcacaccgcttgtacgctgaggttcgagctgttaggctgtgaactaaatggatgcgcaaacccactgggtttgaagaataactcaattccagacaaacagattaccgcaagctcatcttacaagacttggggtctccacctgttctcatggaacccatcttacgccaggctggacaagcagggcaatttcaacgcctgggtggccgggtcatatggcaacgaccagtggctgcaggttgaccttgggtcctcgaaagaagtgactgggataattacacagggagccaggaacttcgggagtgtacaattcgttgccagttataaagtagcttatagcaacgacagcgctaattggactgaataccaagaccctcgaacaggcagtagtaagatcttcccgggaaattgggacaatcatagtcataaaaagaatctctttgaaacccctattctggcgcgctatgtgcgtatcctgccagtcgcatggcataacaggatagcccttaggctggaactcctggggtgctag

SEQ ID NO: 124415 - DNA, 1008 bp, Artificial Sequence
  Description of Artificial Sequence: Synthetic coding sequence
atgccaaggcctagactcttggccgccctctgtggcgccctgctgtgcgccccatctttgctggtagccttagatatctgctcaaagaatccctgtcacaatggcggcctctgtgaagagattagccaggaagtccgaggggatgtttttccttcttatacctgcacctgcctgaaagggtatgccgggaatcactgtgagacaaagtgtgtcgagcccctcggcttggaaaacgggaacatcgccaattctcaaatagcagcctcctctgtgcgggtgaccttcctcggccttcaacattgggttccggagctggccaggttgaaccgcgctggtatggtcaacgcatggaccccatccagcaacgacgataatccctggatccaggttaatctactgagaagaatgtgggtgactggagtagtgacacaaggggcctcccgcctagcttcacatgaatacctgaaggccttcaaagtggcctactcgctcaatgggcatgaattcgactttattcatgatgttaacaaaaaacacaaggagtttgtgggcaattggaacaaaaatgccgtccatgtgaatctctttgagacccccgtggaggcacagtacgtaagactatacccaacctcctgccacaccgcttgcactctgcgcttcgagctcctgggctgcgagctaaatggatgtgccaatccgctcggccttaagaataatagcatccctgataagcagataactgcttcttcgagttataagacatggggattgcatcttttttcttggaacccatcatatgctaggttggacaagcaggggaacttcaatgcctgggttgctggatcctacggaaacgaccagtggttgcagatcttccctggcaattgggataaccacagtcacaagaaaaacctgttcgagacgccaattctagcccgatatgtgaggatcctgcccgtcgcgtggcacaaccggattgccctgcggttagagttgctgggctgttag

SEQ ID NO: 124416 - DNA, 1929 bp, Artificial Sequence
  Description of Artificial Sequence: Synthetic coding sequence
atgccatgcggcgaggattggttaagtcatcctctcgggatcgtccaaggttttttcgcccagaatggcgtgaaccctgattgggaaaaaaaggtgatcgaatattttaaagaaaaactgaaggagaacaacgcacccaagtgggtgccatcactgaatgaggtccccctgcactatctgaagcctaactcttttgtaaaatttaggtgtatgatccaagacatgttcgaccccgaattttatatgggggtgtatgagaccgtgaaccaaaatactaaggctcatgtgttacacttcggcaaatatcgcgacgttgcagaatgtggcccccagcaagaactggatctcaacagccccaggaacaccacactggaaagacaaacattttattgcgtgcctgtgccgggggagagcacatgggtgaaggaagcttatgtgaacgctaaccaagcacgagtctcccctagtacgtcttatactccaagtcgacacaaacgaagttacgaggacgatgatgacatggacttgcagccaaacaagcagaaagatcagcacgcaggcgcccggcaggctggttctgtggggggccttcaatggtgcggagagcctaagcggctggagactgaggcaagtaccgggcagcagttgaatagcctaaacctttccagcccatttgacttaaacttccccctcccaggtgaaaagggtcccgcctgtctcgttaaggtctatgaggactgggattgtttcaaggtcaatgatatactcgaactatatggtattctgtctgtggaccctgtcctgtcaattctaaataacgatgagagggacgccagtgcactgctggaccccatggaatgtacggacacagccgaggagcaaagagtccatagcccaccagcctctttggttccacgcatccacgttattttggctcaaaagctccaacacatcaatcccctgctgcctgcctgcctgaacaaagaggagagcaaaacttgcaagtttgtcagcagctttatgtctgagctgagcccagtgagggcggagctgcttgggttcttgactcatgccctgctgggcgattccctggcggccgagtatttgatcctccacctgatcagtaccgtctacaccagacgagatgtcctgccactgggtaaattcacagtaaacttgagcggttgtccccggaatagcacctttaccgagcatctgtatcgcataattcaacaccttgtcccggcgagcttccggctgcagatgacaatcgaaaacatgaatcacctgaaattcattccacataaagattacaccgccaacaggctcgtgagtggcctgctccaactgccttctaatacatctctcgttatcgatgagacgctgctggaacaagggcagctcgacacgcctggagtgcacaacgtaaccgccctttccaacctgataacctggcagaaagtagattatgatttctcataccatcagatggagtttccatgcaacataaacgtgtttatcacatcagaggggcgttcactgctgccggccgattgtcagattcatctgcagccccagctcattcctccaaatatggaggagtacatgaatagcctgttgtcagctgtacttccatccgtcctaaacaaattcaggatctatctcaccctgctgcggtttctagagtattctatctctgacgaaatcaccaaggccgtagaggatgacttcgttgagatgagaaaaaacgacccacaatcaattaccgctgatgaccttcatcagttgttggtagtagctaggtgtcttagtctctccgcgggacagaccaccctttcccgcgaacggtggctgcgtgcgaaacagttggagtccctgagaaggacgagactccaacagcaaaagtgcgtgaacggtaacgaactctag

SEQ ID NO: 124417 - DNA, 1923 bp, Artificial Sequence
  Description of Artificial Sequence: Synthetic coding sequence
atgccctgcggggaggattggctgtcacaccccctcggcatcgtgcaagggttcttcgcccagaacggcgtgaaccccgactgggagaaaaaagtaattgaatatttcaaggagaaacttaaggagaataatgcccccaaatgggtgcctagtttgaatgaggtgccacttcattacctgaagcctaactctttcgtcaagtttaggtgtatgattcaggatatgttcgaccccgagttctacatgggcgtgtacgagactgttaatcagaacactaaagcccatgtcctgcacttcggcaaatatcgagacgtggctgagtgcgggccgcagcaggaactagacctgaattccccgagaaacacaacacttgaacggcagactttttactgtgtgcccgtgccgggggagagcacttgggtgaaagaggcatatgtgaacgctaaccaggcacgggtgagtcctagcaccagttataccccgtctcgtcacaaaagatcttatgaagatgatgacgatatggacctccagcctaataaacagaaggaccaacatgccggtgcccggcaggccggctcagttggaggtcttcaatggtgcggcgagcctaagcgtctggaaacagaagcttcaactggtcagcagctaaactcgctcaatttgagttctcctttcgacctcaactttcctctaccgggtgagaaagggccagcctgtttggtgaaagtgtatgaggattgggattgttttaaagtcaacgacattttggaattgtatggaatcctctctgtggaccccgtgttaagtatcctgaataatgacgagagagacgcctctgcacttcttgatccaatggaatgcacagacacggcagaagagcagagagtgcactccccccccgctagtttagtgcctcggattcatgtaatcctcgcccagaagctgcaacatatcaatcctctactgcccgcctgcctgaataaggaagagtcaaagacctttgtgtcctcattcatgtcggagctgagtcccgtgagggcggagctcctcggatttcttacccacgctctgttaggcgattctttggcagcggagtacttgattctgcacttgatatctacagtctacactaggagggacgtcctgcctctaggcaaatttaccgtgaatctatcgggttgccctaggaacagcacatttaccgagcacctgtataggatcatccagcatttagtaccagccagttttcgcctacagatgaccatcgaaaacatgaatcatctcaagttcatccctcacaaggactatacggcgaacaggctcgtgtcaggcctcctccagctgccaagtaatacaagtttagttatcgacgaaaccctcctcgagcagggccagctggatacccccggggtccataatgtaacagcacttagcaacctgattacctggcagaaggtggactacgatttctcctaccaccagatggaattcccttgtaacattaacgtgttcatcacttccgagggcaggagcctgctgcctgccgattgtcagatccatctccaaccgcaactgattcctcctaacatggaagagtacatgaattctctcctgtcagcagtactgccttctgtactgaacaaattccgcatctacctgaccttgctccgatttctagagtattcgatcagcgatgaaatcactaaggccgtcgaggatgacttcgtggaaatgcgaaaaaatgacccgcagagtataactgccgacgacttgcaccaactccttgtggtggcccggtgtctgtctttgtcagccggccaaactacactgagtagagagcgctggctccgggctaaacagctcgagagtctccgccgcactcgtttgcagcagcaaaagtgcgtaaacggaaacgaactctag

SEQ ID NO: 124418 - DNA, 2628 bp, Artificial Sequence
  Description of Artificial Sequence: Synthetic coding sequence
atggatgaggaggaggacaacctgtccttattaaccgctctgttagaggagaatgaatcagcactcgactgcaattctgaagagaacaactttctcacgcgcgaaaatggtgagcccgacgcatttgatgagctgttcgatgcggacggcgacggagagtcctatacagaggaggcagacgatggggaaaccggtgagaccagggatgagaaggaaaacctggctacacttttcggagacatggaagaccttactgacgaggaggaagtgcctgcctcgcagtccacagaaaatagggtgctgcctgcccccgctccgaggagagagaaaaccaatgaggagctccaagaagagttgcgaaatttgcaggagcagatgaaagcgctgcaggagcagcttaaagtgacaaccatcaagcagaccgcatctcctgctcgcctccagaagagccccgtcgagaagtctccgaggccgccactgaaggaacgaagagtgcagcgaatccaagaaagtacctgtttctccgccgagctcgatgttccagctttgccgcgcaccaagagggtggcgagaaccccaaaggcttcacctcccgatccaaagagctcatccagcagaatgacttccgcacccagccagccactgcaaaccatctccagaaataaaccaagtggcatcacgagaggccagatcgttggcacgccaggttcttccggtgagactacccaacccatctgcgtcgaggcgttttctgggcttcgtctgcgaagaccaagggtgtcctcaactgaaatgaataagaagatgactggacggaaactgatccgcctctcccagatcaaagagaagatggctagagagaagctggaggagatcgattgggtcacatttggggtaatcctcaaaaaagtcacaccacagtctgtgaactcaggtaagactttcagtatctggaagctcaacgaccttagggatctgacgcaatgtgtgtccttgttcctgttcggggaagtgcacaaagccctgtggaaaaccgagcagggcaccgttgtgggaatcttaaatgcaaacccaatgaagcccaaagacgggagcgaggaggtatgcctttccatcgaccatccacagaaagtcctgatcatgggtgaggctctcgacctaggtacatgcaaagccaaaaaaaagaatggcgagccttgcacacagaccgtgaacctgcgtgactgtgagtattgccagtaccatgtccaggcccagtacaaaaagttgagtgcaaagagggctgacttgcaatcaactttctccggggggaggatccctaaaaagtttgcgaggaggggcacatctttgaaggagcgcctgtgtcaggatggattctattacggaggagttagctctgcctcttacgccgcatccatagctgctgcagttgcacctaaaaaaaagatacagactactctgtctaatctcgtagtcaaaggaactaacctcatcatccaggagactcgccagaaattgggcatcccccaaaaatctttaagctgcagtgaggaattcaaggagctgatggacctgccaacatgcggggcacggaacctgaaacagcacctggccaaagccactgcctctggaatcatgggcagccccaaacccgccattaagtccatcagcgcctcagcacttttgaagcagcagaaacagaggatgctcgagatgaggcgcaggaagtccgaagaaatccaaaaaaggtttctgcagtcatcaagcgaggtggaatcccccgctgtcccttcgtcttctcggcagccccccgctcagccgcccagaactggcagtgaattcccgcgtcttgaaggtgcgccagcaacaatgaccccaaaacttggacgtggtgtgcttgagggagacgatgtcttgttttacgatgaatctccgcccccccgtcccaaactgagtgcacttgccgaagctaaaaaactggccgccatcacaaagcttcgagctaaaggccaggtcctgactaagaccaatcccaatagcatcaagaagaagcagaaagatcctcaagacattctggaagtaaaggagcgtgtggaaaagaataccatgttttcctctcaggccgaggacgaacttgagcctgcacgcaaaaagcggagagaacagctcgcctatctggaatcagaggaatttcagaagatcctgaaagccaagagcaagcataccggcatcctgaaagaagcagaagcagagatgcaggaacggtactttgaaccactcgttaaaaaagaacagatggaggagaaaatgagaaacatccgggaagttaagtgcagggtggtcacgtgtaaaacatgcgcatatacccactttaagctcctcgagacttgtgtgagtgagcagcacgagtaccactggcacgatggagtcaagagattcttcaaatgcccatgcggcaaccgttctatttccttggataggctgcccaacaagcactgtagcaactgcggcctatacaaatgggagagggatggaatgttgaaggagaaaactgggcccaagatcggcggagaaactctgcttccacggggagaggaacacgccaaattcttgaacagtctgaaatag

SEQ ID NO: 124419 - DNA, 2568 bp, Artificial Sequence
  Description of Artificial Sequence: Synthetic coding sequence
atggacgaagaggaggacaatctgagtcttctgacggccttactagaggaaaacgagtcagcgttggattgcaactcagaagagaacaacttcttgacaagagaaaatggagagccggatgcgtttgacgaactgttcgacgctgacggagacggggaaagctatacagaagaggcggacgatggtgaaacaggggaaacacgagacgaaaaggagaatctggcaactttattcggggatatggaggacctgacagatgaggaagaagtgccggcctcccaatcaacagagaacagggtgttacctgccccagccccacggcgcgaaaagacgaatgaagaactgcaggaagagctccggaacctgcaggagcagatgaaggcattacaagaacaactgaaggtgaccaccattaaacagaccgcctcacccgcaagattgcagaagtcccccgagaaatcaccccgtcctcctctgaaagagagacgagtccaacggatccaagagtccacatgcttttcagccgaactagacgtaccagctctgcccaggacaaagcgagtcgcaagaaccccgaaggcttcaccccccgacccgaagtcgtcgagttctcgcatgacctccgctccctctcagccactgcaaaccatctccaggaataagccctcagggattacaagaggccagatcgtcggcactcccgggagctcaggagagactacccagcccatttgtgtagaagcctttagcggcctccgcttgagacgcccccgcgtgtccagcactgagatgaataagaagatgactggacggaagctcattagactgtcccagatcaaggagaaaatggcaagggagaagcttgaggagatcgactgggtgaccttcggggtcattctaaagaaggttacaccacaaagcgtaaattccggcaagacattctccatctggaagctcaatgacctgcgtgacctgacgcaatgcgtgtccctgttcctgtttggagaagtgcacaaggcgctgtggaagactgagcagggaaccgtggttggaatcctgaacgcaaaccccatgaaacctaaagatggctctgaggaagtctgcctctctatcgaccatccccagaaggttttaattatgggtgaggctctcgatcttggaacgtgcaaggctaaaaaaaaaaatggtgaaccttgtactcagaccgttaatctgagagactgtgagtattgccagtaccacgtgcaggcccaatataagaagctgagcgccaagcgcgccgacctccagagcacctttagcggcggtaggattcccaagaaatttgctaggaggggaacctcactgaaagagaggctgtgccaggatggcttctattacggcggggtgtcttccgcaagttatgctgcaagcattgcagcagctgtcgctccgaagaagaagatccagacaacactcagcaacctcgttgtcaaggggaccaatctgattatccaggaaacaaggcagaaactgggaattcctcagaagtcactcagctgctcagaggaattcaaggaacttatggatctgcccacatgtggggcacgcaatctaaaacagcacctggcaaaggcaacggccagcggaattatggggtctccaaagcctgccattaaatccataagcgcttccgccttgctgaagcagcagaaacagaggatgctggagatgagacgcagaaagtcagaagagattcagaagcgcttccttcagagttctagcgaggtggagtccccagctgtcccatccagctctcggcagcctcctgcccaacctccccgcacagggagcgagttcccccgccttgaaggcgcgcctgctacaatgacaccgaaattggggcgcggcgtactagaaggggatgatgtcttattttacgacgagtccccacctccacggccgaagctcagcgccctggctgaggctaaaaagttggcagctattacaaagctgagggcgaaggggcaagttttgacaaaaaccaacccaaactctataaaaaaaaagcagaaggaccctcaagacatcctagaggtgaaagagcgggtggaaaagaatactatgttcagtagtcaggcagaagatgaactcgaacctgccagaaagaagcgtcgagaacagctcgcgtatctggagtccgaggaattccagaaaattctgaaagcaaagagcaagcacacgggcattcttaaggaggcagaggcagagatgcaagaaaggtactttgagcctctggtaaagaaagagcagatggaggaaaagatgcgtaatatacgggaggtgaagtgtcgcgttgtgacatgtaagacctgcgcatacacccatttcaaattgctcgagacctgcgtaagcgagcaacacgagtaccactggcatgatggtgtgaaaaggttctttaagtgtccgtgtggaaatcgttcaatttctctagaccgccttccaaataaacattgctctaactgcggtctctacaaatgggagagagatggtatgctgaaggtctgccacctgcgaacgaacttttag

SEQ ID NO: 124420 - DNA, 2625 bp, Artificial Sequence
  Description of Artificial Sequence: Synthetic coding sequence
atggacgaggaagaggacaacctcagcctgctgactgccctgctcgaggaaaatgagtccgcactggattgcaattctgaggaaaataactttctaactcgcgagaacggagagcctgacgcttttgacgaactgtttgacgcagatggtgacggagaatcttatacagaagaggccgacgacggcgagaccggggagacccgggacgagaaagaaaatctcgccaccttgttcggggacatggaggaccttacagatgaagaggaggtgccggcaagtcagagcacagagaatcgggtgttgccagcgcctgcaccacgccgagagaagaccaacgaagaattgcaagaggaactcaggaatttgcaggaacaaatgaaggcccttcaggagcagctgaaggtgaccactataaagcagaccgccagtccagcgcgcctacagaaaagtcctgaaaagagcccgcggccacctctgaaggagcgccgcgtgcaaagaatacaagagtccacatgcttttcagccgagctggatgtgccggctttgccccggaccaagagggtcgctagaactccaaaggctagcccccctgaccctaagtcctccagctctaggatgacctcagcccccagccagccacttcagactatttcccgtaataagccttctggcataactagagggcaaatcgtcggtaccccaggttctagtggcgagacaacacaacctatctgcgtggaagcatttagcggcctcaggctcagacgcccccgggtgagttccaccgagatgaacaagaaaatgaccggtaggaagctgatacgtctttctcaaatcaaggaaaaaatggcccgggagaagttagaggaaattgattgggtcacctttggcgtcattctgaagaaggtcacccctcagagcgtaaatagcgggaagacgttctccatttggaaacttaatgacttacgggatctgactcagtgcgtgtccctatttttgtttggagaagtccataaggcactgtggaagactgaacagggcacagtcgtaggcatcctaaatgcgaatccgatgaagccgaaggacgggagtgaagaagtgtgcctctctattgatcacccacagaaagtgctgatcatgggtgaagcactggatttgggcacctgtaaggccaaaaagaagaatggcgagccctgtacacagaccgtcaatctgagggattgcgaatattgtcagtaccatgtccaggctcagtataagaaactgagcgcgaagcgcgctgatctgcagagtactttcagtggcgggcggattcctaaaaagtttgcacggagaggcacctccctgaaagagcggctttgtcaggacggcttctattacggtggcgtcagctcagccagctatgccgccagcattgccgccgccgttgcgccaaaaaagaaaatacagactaccctatcaaatctggttgtgaaggggaccaatctcatcattcaagagacacggcagaagctgggtattccccagaaatcattgtcctgcagcgaggaattcaaagaacttatggatctccccacctgcggagccaggaatttgaagcagcacctggcgaaagcgacagccagtggcattatgggttcaccgaaacctgctatcaagagcatctccgcctcagcactgctgaaacagcagaagcagcgcatgctcgagatgcgaaggcgcaaaagcgaggagattcagaaacgctttctgcagagttcatccgaagtggagagtcccgccgtcccgtccagcagccggcagccccctgcccaacccccaagaactggaagcgagtttccacgactagagggcgccccggcaactatgacacctaagcttggcagaggagtgctcgaaggagatgatgtcctattctacgatgagagccctccaccacggccaaaactaagcgcattggctgaggccaagaaactggccgccataacaaaactccgcgccaaaggccaggtgttaaccaaaaccaatcccaactccattaagaagaaacaaaaggatccccaagacatcctggaggtaaaagagagggtggagaagaataccatgttcagcagccaggccgaagacgaactcgaaccagccaggaagaaacgtcgtgaacagcttgcatacctggaaagcgaagaatttcaaaagattctcaaagccaaatccaaacacaccgggatcctcaaagaggcggaggccgaaatgcaagagcgttacttcgagcctctggtgaaaaaggagcagatggaagagaaaatgcggaacattagagaggtgaagtgtagagtggtgacatgcaaaacgtgtgcttatacccactttaagttgctggaaacctgcgtttcagagcaacacgagtaccattggcacgatggcgtcaagcggttcttcaagtgcccatgtggtaatcgctccatcagcctcgatcgactgcctaataaacattgtagcaattgtgggctctataaatgggaaagagatggaatgttgaaggagaagacagggccaaaaattggtggcgagaccttgctgcccaggggcgaagagcatgcaaaatttcttaattcgctcaaatag

SEQ ID NO: 124421 - DNA, 2628 bp, Artificial Sequence
  Description of Artificial Sequence: Synthetic coding sequence
atggatgaggaagaagataacttaagtctgctgaccgcattgcttgaagagaatgagagcgcgctcgattgtaattcagaggaaaacaacttccttacgcgggagaatggcgaaccagacgcttttgacgaattgtttgatgctgatggtgacggcgaatcctatacagaagaagctgatgacggtgagaccggggagacccgggatgaaaaggagaacctcgccacgctgtttggcgacatggaggacctgactgatgaagaggaagtgcccgcgtctcaatctaccgaaaaccgggtcctccccgctccagcccctcgtcgtgagaagacgaacgaggaactccaagaagaactcaggaaccttcaagaacagatgaaagctctccaggaacagttaaaagtcacgaccatcaagcagacagcatctcccgcccgactgcaaaagtcacccgtagagaagtcaccaagaccaccacttaaggaaagaagggtgcagcggatccaggagagcacctgtttttctgctgagctggatgtccctgccctcccaagaacaaaaagggtggcccgtacccctaaggcatcacccccagatccaaagtcgagctcttcaaggatgacgagcgctccatcccaacccctgcagaccattagtcgcaacaagccatctgggattacacggggccagatcgttgggacacccggaagctcaggcgaaacaacacagccgatctgcgtggaggcgttttctggactgcggctaagacgaccgcgcgtcagttctacagaaatgaacaaaaaaatgactgggcgcaagctaatccgcttgtcccaaattaaagagaaaatggccagggagaaattggaagagattgattgggtcaccttcggtgtcattctgaaaaaagtgaccccccagtctgtgaattccggcaagaccttcagcatttggaaactgaacgacctgcgtgaccttactcagtgtgtctcacttttcttgttcggcgaggtgcacaaagcactgtggaaaaccgagcaggggacagtggtgggcatcctgaatgccaatcctatgaaacctaaagatggcagtgaagaggtctgtttatctatcgatcatcctcagaaggtgctcatcatgggggaagccttggacctggggacctgcaaagccaagaagaagaacggggaaccatgtacacagaccgtgaatttgcgtgactgcgagtattgtcaataccatgttcaagctcaatataaaaaactctccgccaagagagctgacctgcaaagtaccttcagcggcgggcggatcccaaaaaaattcgcccgtcggggcacctctctcaaagaaaggttgtgccaggacggtttttattacggcggcgtaagcagcgcgagctacgctgcctccatcgccgccgcagtcgcccctaagaagaaaattcagactaccctgagcaacctggtcgtcaaaggtactaaccttatcatccaggaaacaagacagaaactaggcattccgcagaaatctcttagttgcagcgaggagttcaaagagctcatggacctcccgacatgcggcgcaaggaaccttaagcagcacctggccaaggcaacagccagtggcattatggggtccccaaaaccagccatcaagagcatttctgcctctgctctattgaagcagcagaaacagcggatgttagaaatgcgccgcagaaagagtgaggagatccagaagaggtttctccaatcttctagtgaggtggagagtcccgccgttcccagctcgtcaagacagccccccgcccagcctcctaggactggcagcgagtttccccgcttggagggcgcccctgccactatgactcctaaattgggaaggggtgtgttagagggcgacgatgtactgttttacgacgagtcaccgcctcctaggccgaaattgtccgcgcttgcagaagccaaaaaattggccgctataaccaagttacgggcaaaaggccaagtgttgacaaagaccaaccccaacagcattaagaagaagcagaaggatccccaagatattctcgaggtgaaggaaagagttgagaagaataccatgttctcttcccaggccgaggatgaactggagcctgccaggaaaaagcgtcgagagcagttggcctatttagagtcagaggagttccaaaaaatcctcaaggccaaatcgaagcatactggcattctgaaggaggccgaagctgagatgcaggagcgctactttgagcctctggtgaaaaaagagcagatggaggaaaaaatgcgcaatattcgggaggtgaagtgtcgagttgtcacatgcaaaacatgcgcgtacacccacttcaagctgttggaaacctgcgtgagcgaacaacacgagtatcactggcatgatggggttaaacgcttcttcaagtgtccatgcggcaaccgcagcatttctttggatagattgccgaataagcattgctcaaattgcggtctgtacaagtgggaacgggatggcatgttgaaggagaaaaccggtcccaaaatcgggggtgagaccctgctgcctagaggcgaagagcacgcgaaattcctcaactccttgaagtag

SEQ ID NO: 124422 - DNA, 2466 bp, Artificial Sequence
  Description of Artificial Sequence: Synthetic coding sequence
atggatttggcagcagctgcagagccgggagcgggtagtcaacatctggaggtgagagatgaggtcgccgagaagtgtcagaaactcttcttggatttcctcgaagagttccaaagtagcgatggcgagataaaatacttgcagctggcagaagagctgattcgtccagagcggaataccctggtcgtgtctttcgttgatctggagcagttcaatcagcagttaagcactacaatccaggaggaattctatcgcgtttacccttacctgtgtagagccctcaagacattcgtgaaagaccgaaaggaaatccctctggccaaggacttttacgtggccttccaggatttgccaacccgacacaagattagggaattgacttcctccaggatcggcctcctgacacggatttctggtcaggtggtgcggacccacccggtgcaccccgagcttgtgtctggcacattcctttgcctggactgccaaacggtgattcgggacgtggagcagcagtttaaatacacccagcccaacatctgtaggaacccagtttgcgctaaccggagaaggttcttgctagatactaataagagtaggttcgtcgacttccagaaagtgagaatccaagagacgcaagcagaactgccccgagggtccataccacggtcattggaggtgattctcagggcagaagcagtcgagtctgcacaggctggagataagtgcgactttactggcacgttaatcgtcgtccccgatgtgagtaaattgtccacacccggtgctagagcagaaacaaattccagggtttcaggcgtggatggatatgagacagagggcattcgtggactgcgcgcattgggcgtgagagacctatcctatcgcctcgtgttcctcgcttgttgcgttgctcctacaaatcctaggttcggcggcaaagagctccgcgatgaggagcagacagccgaatccatcaaaaaccagatgaccgttaaggagtgggaaaaagtgttcgagatgtcccaggacaagaatctttaccataatctgtgtacctcccttttccccaccatccacgggaatgacgaggtcaagcgcggcgtgctgctgatgctcttcggaggcgtccctaaaacaaccggcgagggcacaagcctgcgaggagatattaatgtgtgcatcgtgggggatccatctacagcaaagtcacagtttctgaaacacgttgaggaattcagccctcgcgccgtttacaccagtggcaaggcctccagcgccgcggggttgactgccgccgtggtgagagatgaggaaagccacgaattcgtgatcgaagcaggcgcattgatgctcgcagacaatggcgtgtgttgtatcgatgaatttgacaaaatggacgtgagagaccaggttgccatccatgaggccatggaacagcagactatatccattacaaaggccggagtgaaggcaaccctgaacgcccggaccagcatcctggctgccgccaatcccattagtggacactacgaccggtctaaatcattaaaacagaatataaacctgtccgcacccatcatgtctcggttcgacttatttttcattctggtcgatgaatgcaacgaggtaacagactatgccattgctcgaagaattgtcgacctgcactctcggattgaggaatctattgaccgagtatattcgcttgacgacatcaggcgatatttgctgtttgcaaggcagttcaaaccaaaaatcagcaaggaaagtgaagacttcattgtggaacagtacaaacacctgagacagcgggatggctctggtgtgacaaaatccagctggcgtattacagttcggcagctggaatccatgatccggctctccgaggccatggcccgcatgcactgctgtgacgaagtgcagcctaagcacgtcaaggaggctttccgattattgaacaaaagcattatacgggtggagacccctgatgtgaatcttgatcaggaggaggagatccagatggaagtggacgagggtgccggcgggattaacggacacgccgattccccggctcccgtgaacggtattaatggatacaatgaggacatcaaccaggagagtgcccctaaggctagcctccgactgggcttttccgagtactgtcgaattagcaatctcatagtgctgcatctccggaaagtcgaagaagaagaggacgaaagcgccctgaaacgctctgagctcgtgaattggtatttgaaagagattgaatccgagatagactcagaggaggaactgattaacaagaaaaggatcatagagaaggtgatccatcggcttacacattatgaccatgtactcatcgagctcacccaggcgggcctcaagggatccaccgagggttccgaatcatacgaggaggacccatatctggtagtgaatccgaactacctgcttgaggattag

SEQ ID NO: 124423 - DNA, 2160 bp, Artificial Sequence
  Description of Artificial Sequence: Synthetic coding sequence
atggcactgaaggattacgctctcgaaaaagagaaagttaagaaattcctgcaggaattttaccaggatgacgaactggggaagaagcaattcaagtacggcaaccagctggtgcgactggcacacagggagcaggtagcgctctacgtggatctcgacgacgtcgctgaggacgacccagaactggttgattccatatgtgagaacgcaaggcggtacgccaagctgtttgcagatgctgtccaggaattgcttccccagtacaaggagcgggaggtggtcaataaagacgtacttgacgtgtacatagagcaccgccttatgatggaacaacgctctagggatcctggcatggtcagatcaccccagaaccagtatcccgctgagctaatgcggcgatttgaattatacttccaggggccttcctcgaacaaaccccgggttattagagaagtaagagctgactcggtgggcaaattagtgacagtgcggggtatcgttacacgcgtttccgaggtaaagcctaaaatggtggttgcaacctacacgtgcgaccagtgcggcgccgaaacctatcaacccatccagtcgccaacattcatgcccctaataatgtgccccagtcaggagtgccagacgaacagatcaggagggaggctgtacctccaaacccgcggttcccggtttatcaagttccaggaaatgaaaatgcaggaacattcagatcaggtccccgtcgggaatattccgcgcagcattacggtgttggtggaaggcgagaacacccggatcgcccagcctggcgaccatgtgtctgtgacaggcatcttcctcccgattctaaggacgggctttcgacaagtggtccagggcctcttgtctgagacttatttggaggcacacaggattgttaagatgaataaatccgaagacgatgagtccggcgccggagagctaacacgggaggaactcaggcagatcgcggaggaggacttttacgagaaactggccgcttcgatagctcccgaaatttacggacacgaagacgtgaagaaggctctcctgttgctcctggttggcggggttgaccagagccccagaggaatgaaaataagaggcaatattaacatctgcctcatgggcgacccaggggtcgcaaagagccagctgctgtcatacatcgatcgcctcgcccctcgatctcagtacaccacgggccgagggtctagcggcgtggggctgaccgcagctgtgttgagggacagcgtcagcggagaattgactctcgaagggggagcattggttctggcagatcagggcgtctgttgcatcgatgaatttgacaagatggccgaagcagataggactgccattcacgaggttatggagcagcagaccatctcgatcgctaaggccgggatccttactacactgaacgcccgctgctctatattggcggccgctaatcccgcatatggccgttataacccgaggcgcagcctggagcagaacatccagttgccagcggctttgctgagcagattcgatctgctgtggcttattcaggacagaccagatcgggataacgatttgcgcctggcacagcatataacctatgtgcatcagcacagtcgccagcctcctagtcagttcgaaccgctggatatgaagctaatgcgcagatatatagccatgtgccgtgagaaacaaccaatggttccagagagtctcgctgattatatcacggccgcctacgtggaaatgaggagagaggcttgggctagcaaagatgcgacgtacacgtccgctcgtaccctcttggcaattttgagattgtcgaccgctctagcacggctgcggatggtggatgtcgtggagaaggaagacgttaacgaagcaattaggctgatggagatgtctaaggactccctgctcggcgacaagggacaaacagctcgcacacaacggcccgctgacgtcatctttgctaccgtgagagagttagttagtggtggtcggtccgttagatttagcgaggccgagcagagatgcgtttcgcgggggtttacaccagcgcagttccaggctgctctcgacgaatatgaggaactgaacgtgtggcaggttaatgcgtctcgcacacggattacctttgtatag

SEQ ID NO: 124424 - DNA, 1170 bp, Artificial Sequence
  Description of Artificial Sequence: Synthetic coding sequence
atggcactcaaggattatgctctggagaaggagaaagtcaagaagttcctgcaggaattttaccaggatgacgaactgggcaaaaagcagttcaaatacggcaaccagttggttcgcctcgctcatcgggaacaggtcgccctttacgtcgatttggatgacgttgctgaggacgatcccgaattggtcgatagtatctgcgaaaacgccagaaggtacgctaaactgtttgccgatgcggtccaggaactcctgccacagtataaagaacgagaagttgtcaataaggatgtgctcgacgtgtatatcgagcaccgtctcatgatggaacagcgttccagagaccccggaatggtcagaagtcctcagaatcagtacccagcagagctgatgcggcgcttcgaactctactttcagggccccagcagcaacaagccgcgggtcatccgtgaggtgagagccgactcggtgggcaaacttgtgaccgtgcgggggattgttacccgagttagcgaggttaagccgaagatggtggttgcaacatacacatgcgaccagtgcggcgccgagacctatcagcccatacagtcaccaaccttcatgcccctgatcatgtgccccagccaagagtgccaaaccaaccgcagtggggggcgcttgtacctgcagacccgtggttcacgcttcatcaaattccaagagatgaagatgcaagaacactccgatcaggtgcccgtcggtaacatccctcgctcaatcacagtgctggtggaaggtgagaacaccaggattgcccaacccggcgaccatgtgtccgtgacggggatcttcctcccaatcctgcggacgggctttagacaggtggtacaaggactgttgtctgaaacatacctggaggctcaccgcatagttaagatgaataaatctgaggacgatgaatctggggctggagaactgacgagggaggaactccgccaaattgcggacgtgatctttgcaacagtccgggagctagtatccggtggtcgaagcgtaagattctctgaagctgaacagcgttgtgttagtagaggattcacacctgctcagttccaggcggctcttgacgagtacgaggaactgaatgtatggcaagtgaacgcttctcgcacacgcatcacttttgtctag

SEQ ID NO: 124425 - DNA, 1632 bp, Artificial Sequence
  Description of Artificial Sequence: Synthetic coding sequence
atggtcgttgcaacttacacatgcgaccagtgcggtgccgagacctatcaacccatccagtccccgacgtttatgccactgattatgtgcccatctcaggaatgccagacgaacagatctggcggtcgcctgtacttgcagacaagaggatctaggtttatcaaattccaagagatgaagatgcaggaacactctgatcaggtgcctgtcgggaatataccgagatcaataaccgtcctggttgaaggggagaacacaaggatcgcacagcctggtgaccacgtgagtgtaaccggaatattcttgcctatcttaagaaccgggtttaggcaagtggtgcagggcctcctgagtgagacatatctggaggcccatcgcattgtcaaaatgaataagagcgaggatgacgagagcggcgcgggagaactcactcgcgaggagttgcggcagatcgcagaggaagatttctatgagaagctcgctgccagtatcgccccagagatctatggtcacgaagacgtcaagaaagccctgctgctgctgctcgtcggcggcgtggaccagagtccgcgcgggatgaagattcggggaaacattaatatctgcctgatgggggatcccggggtggcgaaatctcaattactgtcttacattgatcgtctggccccaagatcccagtacaccacggggcgcggttcatcaggcgtaggcctcacggcggccgtgctgcgagatagtgtaagcggtgaactcacacttgagggcggcgccctggtgttggccgaccagggagtgtgttgcattgatgagtttgataaaatggctgaggctgatcgcaccgcaattcacgaggtcatggagcagcaaactattagcatcgccaaagcaggtatccttacaaccttgaatgctaggtgcagcattctggccgcggcgaatccagcttatggtagatacaatccacgccggtcgttagagcaaaacattcagttacccgcagctctcctgtctcgcttcgacttgctctggctgatccaggataggcccgatcgagacaatgatctgagacttgcacagcatatcacgtatgttcaccagcacagtcgtcagccgccatctcagtttgaacctctggacatgaaattgatgagacggtatattgctatgtgcagagaaaagcagcccatggtgccggagtcccttgctgactacataacggccgcctacgtggagatgagaagggaggcttgggccagcaaagacgccacttatacgagcgcacgaacgctgttagcaatcctgcggctgtctacagccctcgcaaggttgagaatggtggatgtggtcgagaaggaggatgtcaatgaagccatccggctgatggaaatgtctaaggattctctgctgggggataaaggacagactgcccgcactcagaggccagccgacgtcatctttgcaaccgtccgggaattggtgtctggtggccggtctgtgcgtttttccgaggcagaacagcggtgtgtttcacgcggcttcactcccgcccagtttcaggccgccctggatgaatatgaggagctcaacgtatggcaagtcaatgcaagccgcaccagaatcaccttcgtgtag

SEQ ID NO: 124426 - DNA, 1839 bp, Artificial Sequence
  Description of Artificial Sequence: Synthetic coding sequence
atgatggagcagagatccagggatcccggaatggtgagatctccccaaaatcaatacccggccgaactgatgcgtcgattcgaactatattttcaaggaccttcttccaataagccccgggtgatcagagaggttagggccgactctgttgggaagctggtgaccgtgaggggtatcgtgacgcgggtgtccgaggtgaaacccaaaatggtagtcgccacctacacctgtgaccaatgtggggccgagacttaccaaccaatccagagtcccacattcatgcctcttatcatgtgtcctagtcaggaatgtcagactaacaggtccggaggaaggctttacctccaaactcgaggcagtcggttcatcaagtttcaggaaatgaaaatgcaggaacactcggatcaagtgcctgtgggcaacatacccagatccattaccgtcctagtggaaggggagaacacccgcattgcccaacctggcgaccatgtgtcagtgacaggaatctttctccctatcctcagaactggcttccgacaggtggttcagggcctgctgtccgagacttatctagaagcgcaccggattgtcaaaatgaacaagtctgaggacgacgagtctggagcgggagaattgactagagaagaactcaggcaaatcgctgaggaagatttctacgagaagctggccgccagcatcgctcccgagatctacgggcacgaggacgtgaagaaagccctgttactcctgttagtgggaggcgttgaccaatcgccccggggcatgaaaataaggggaaacattaatatatgtcttatgggagatcccggggtggcaaagtcccagctactttcatatattgataggctcgctccgcggtcccagtacaccacagggcggggatcttccggggtaggcttgaccgccgcagtcctccgggactcagtcagtggggagctcacattagagggtggcgctctggttttggcggaccagggcgtctgctgtattgatgagttcgacaagatggcggaggcggacaggacagccatacatgaagtcatggagcagcagacaatcagcattgccaaagcaggtatcctgactaccctgaacgctcgatgcagcatcctggccgcggccaaccctgcctacgggagatacaatccgcggcgtagtttggaacaaaacattcagttgccggcagctctgctcagtaggtttgacctgctgtggcttatacaggatcggcctgacagggataatgacctgaggctagcccaacatattacgtatgtgcatcaacactccagacagcctccaagtcagttcgaacctctcgatatgaagctcatgcgtcggtacatcgcaatgtgccgggagaaacagcctatggtacctgagagtctcgcggactacatcactgcagcttacgtggaaatgaggcgcgaggcttgggctagcaaagacgcgacatacacctccgccagaacactccttgcaattctccgcctgtctacggctctcgcacggctccgcatggtagacgtcgttgaaaaggaggatgtgaacgaagccatcagactgatggagatgtcgaaggactcacttctcggggataaaggccagaccgcacggactcagagacctgcggatgtgatcttcgctaccgtccgagagttagtgtctggcgggaggtctgtaaggttcagtgaggccgaacaacgttgtgtatctcgcggatttactcctgcccagtttcaggccgctcttgatgaatacgaagagttaaatgtgtggcaggtcaacgcaagccgcacgcggattacttttgtgtag

SEQ ID NO: 124427 - DNA, 1971 bp, Artificial Sequence
  Description of Artificial Sequence: Synthetic coding sequence
atgactccctcttggtggactcagtttgtgagaatgccaggtgctacgcggagttctcttctgatgccttattacaaagagcgcgaagtcgtgaacaaggacgttctggacgtctatattgaacatagactgatgatggaacagcggtcccgtgaccccggcatggtgaggagcccacagaatcagtaccccgccgaactgatgcgtcgttttgagctctacttccaaggaccctcttccaataagcctcgagtgatcagagaagtgagggctgatagtgtgggtaaactcgtgacagtgcggggaatcgtgacccgcgtcagtgaggtaaaacctaagatggttgtggctacatacacgtgcgatcagtgcggggctgagacttaccagccaatccaatcccccacctttatgcccttgatcatgtgtccttcccaggagtgtcagaccaaccggtcgggcggacggctctatttgcaaacacgggggtcccgcttcattaaatttcaggaaatgaagatgcaggagcacagcgaccaggtccctgtcggaaacattccgcggtcaatcaccgtgctggttgagggtgagaatacaagaatcgcgcaaccgggagatcacgtgtctgttactgggatctttctgccaatacttaggacaggtttccgccaagtagtgcaggggctgctatcagagacttacctggaagctcacagaatcgtcaagatgaataagagcgaagacgatgagtccggcgccggcgaactaacccgggaggagctgcggcagattgccgaagaggacttttacgagaagctggcagcatcaatagcccctgaaatctatggacatgaggacgttaaaaaagctctactcctcctgctcgtcggtggagtggatcagtcacctcggggcatgaaaataaggggaaatatcaatatctgcctcatgggtgaccccggggtggctaagtctcagctcctgtcatacatcgaccggcttgcccctaggagtcagtacactacaggtcgcggctcatcgggcgtcggtctcacagctgcggtgttgcgggattcagtctccggagaattaaccctggaaggtggggccctcgtactagcagaccagggtgtctgctgtatcgatgagtttgataaaatggcagaggctgacagaacagcaatccacgaggttatggaacaacagacaatcagcattgctaaagctggtattctgaccaccttgaacgcgaggtgttctatcctagctgccgccaaccctgcttacgggcgctacaacccccggaggtctctcgagcaaaatattcagctgcctgctgctttactgtcgaggtttgatctgctctggctaatacaagataggcctgaccgtgacaacgacctgcggcttgctcagcacatcacatacgtccaccaacatagtcggcagccccccagccagttcgaaccattggacatgaagttgatgcggcgttacatcgctatgtgtagggagaagcaacctatggtgcctgagtctttggccgattacattaccgctgcctacgtcgaaatgagacgggaggcctgggcctctaaggatgctacatatacatcagcacggaccctgctggcaatcttgcgccttagcacggctctggcaagactgaggatggtagatgtcgtggagaaagaggacgtgaacgaggccatccgccttatggagatgtcgaaagattccctgttgggggataaagggcaaacagctagaacccaacgtccagcagatgtaatttttgctactgtgcgcgagctcgtttccggagggcgaagcgtgaggttctccgaggctgagcaacgttgtgtttccaggggctttacacccgcacagttccaagcagcacttgatgaatacgaagagcttaacgtatggcaggtaaatgcgagtcgtaccaggattaccttcgtatag

SEQ ID NO: 124428 - DNA, 2475 bp, Artificial Sequence
  Description of Artificial Sequence: Synthetic coding sequence
atgaatggagagtataggggaaggggcttcgggagaggcaggttccagtcttggaaacgggggagaggaggcggcaacttttccggcaaatggcgcgagcgggaacatcgcccggatctgtcaaagactaccggaaagaggacctcagagcagacccctcagtttctgctttccacgaaaactccccaatcaatgcagtccacactggaccgtttcatcccctataaagggtggaagctgtacttttccgaggtgtactccgattcctctccactcatcgaaaagattcaggccttcgagaaatttttcacccgccacattgatctctatgataaggatgaaattgaacgaaaggggagtattctggttgacttcaaagaactaaccgagggaggagaagtgacaaacctcatacccgatatagccactgaactgagggacgctcccgagaaaactttagcctgtatgggtctggccatccaccaggtgcttactaaagatctggagagacacgcagctgagctgcaggcacaggaagggctgtccaacgacggagaaacaatggtcaacgtacctcatatccatgcccgcgtctataattacgagccactcacacagcttaagaacgtccgcgcgaactactacggaaaatatatcgccctgagagggactgtggtgcgcgtgtccaatatcaaaccattatgtactaagatggctttcctttgtgcagcatgtggtgagatccagagcttcccgttaccggatggtaaatactcccttcccaccaagtgccctgtgcccgtgtgccgcggccgctccttcaccgccctgcggagctctcccctcactgtaactatggactggcagagcatcaagatccaggagctgatgagcgacgatcagagagaggcaggccgcatccctcgcacaatcgaatgtgaactggtacacgaccttgtggattcatgtgtccccggcgacaccgtgacaataactggcatcgtgaaggtcagcaatgctgaagaagcgaattcgatctctaactccaaagggcagaaaactaaaagctccgaggatggatgtaaacatggtatgctgatggaatttagcttaaaggacctttacgctattcaggaaatccaggctgaggaaaacctgttcaagctaatcgtgaattctctgtgtccagtaatttttggtcacgaattagtcaaagctggattggcactggctttgttcggaggcagtcaaaagtacgcagacgacaaaaataggattcccattaggggagatccccacattctcgtcgttggcgacccaggactgggcaagagtcagatgcttcaggctgcatgcaatgtggccccgcgtggcgtatatgtgtgtggaaataccaccacgacaagcggtttgaccgtcacattgtcaaaagactctagcagcggagacttcgccttggaggcgggggcacttgtgctgggcgatcaaggcatatgcggcattgatgaattcgataaaatgggcaaccagcaccaggcactgctggaggccatggagcaacagagcatctcgctagcgaaggcaggcgtggtgtgcagcctaccagctcggacatcaattatcgccgccgccaatcccgtaggcgggcattataacaaggccaaaaccgtgtccgaaaacctgaaaatgggatcagctctcctcagccgttttgacctcgtctttatccttcttgacaccccaaatgagcatcatgatcatctacttagcgagcacgtaatagctatccgggcaggcaagcagcgcactatctcttcagctacagttgctaggatgaactcccaggattccaacacctccgtactggaagtggtgagcgaaaagcccctcagcgagagactgaaggtggtgcctggcgaaaccattgatcctatcccacaccaactgttgcgcaagtatatcgggtatgctagacagtacgtctacccgcgcttgagcacagaggcagctagagtcctgcaggacttttaccttgagcttcggaagcagtcgcagcgactaaacagctcacctatcacaacccggcagttggagtctctgatacgactcacagaggcacgcgcccgacttgaattacgggaggaggccacaaaagaagacgctgaggacatcgtggagatcatgaaatacagcatgttaggtacctactcagacgaattcggaaatttggacttcgagcgcagtcagcacggttcaggtatgtccaacaggtccacagcaaagcggtttatcagcgctctgaacaatgttgccgaaagaacgtacaacaatatatttcagtttcaccagctgaggcagatcgcgaaagaacttaacattcaagttgcagactttgagaattttattggcagtctgaatgaccagggatatttgctgaaaaaaggtccaaaagtctaccagctgcagaccatgtag

SEQ ID NO: 124429 - DNA, 2382 bp, Artificial Sequence
  Description of Artificial Sequence: Synthetic coding sequence
atgaatggcgagtataggggacgcgggttcggcagagggagatttcagagttggaaaagaggtagaggtgggggtaatttcagcggcaagtggcgcgaacgcgagcaccggcctgacctgagcaaaactactggcaagcgcacatctgaacagactccgcaatttctcctgagtaccaagaccccccagagcatgcagagcacgttggaccgatttatcccctataaaggatggaaactgtacttctccgaagtgtactcagatagttctccgctcatagaaaagattcaagcgttcgagaaattcttcactagacacattgacctgtacgacaaagacgaaattgaacgcaagggatccatattggtggattttaaggagctgactgaaggtggagaggtgaccaatctgatacctgacattgctacagaactgagagacgccccggagaaaacgcttgcctgtatgggcctggctatccaccaggtgctgacaaaggacctcgagagacacgccgccgagctgcaggcacaggaaggccttagtaacgatggagagaccatggtaaacgtgcctcacattcatgcccgcgtctataattatgagccactcactcagctgaaaaacgtcagagctaattattatggaaagtatattgccctcagaggtactgtggtgcgcgtctccaatattaagcctttgtgcaccaagatggcctttctctgcgccgcctgcggcgagatccagtccttccctctgccagatggcaagtacagcctccccaccaagtgccccgtcccagtctgtagagggaggagtttcacagcccttcgctcttcccctctgactgtaaccatggattggcagtcaatcaagatccaggagctgatgtccgacgaccaaagggaagctggtagaattcctaggaccatcgaatgcgagctcgtacacgatctcgttgactcctgcgttcccggagacacggtgaccatcacggggatcgtcaaggttagcaacgcagaggagggttcccggaataaaaacgacaagtgtatgtttctgttgtatattgaagccaacagcatcagcaatagcaaaggtcagaaaacaaagtcttctgaggatggttgcaagcacgggatgctgatggaattctcgctcaaagatctgtacgccattcaggaaattcaggccgaggagaacttgttcaagctgatagtgaatagcctctgcccagtaatttttggccatgaagctgcctgtaacgtcgcaccgaggggcgtgtacgtatgcggaaataccacgaccacctccgggctgacagttactctcagcaaagattcatcctcaggcgattttgccctggaggccggcgcgctggtgcttggcgaccaaggaatttgtggtatcgacgaatttgacaaaatgggcaaccagcaccaagccctccttgaagctatggaacagcagtcgatctcactcgcgaaggccggtgtggtctgctcccttcccgccaggacatctatcattgccgccgcaaatcctgtcggggggcactacaataaggcaaaaactgtctctgaaaacctgaagatggggtccgccttgctgagtcgcttcgatctcgtgttcatcctccttgacacccccaacgagcatcacgatcatctgctgtccgaacacgtgatcgccatccgggcaggcaagcagagaaccatatcaagcgccaccgtggctcgtatgaactcccaagactcaaacacgtccgtgttggaggtcgtgagcgagaaacctttgtccgagcgcttgaaggttgtcccgggagaaacaatcgatccaatcccacatcaactgctgaggaagtatataggctacgccaggcaatatgtgtacccaaggctgtcgaccgaggccgcgagggttctgcaggatttctacctagagctccgcaaacaatcacaacgtctcaatagcagccctatcactacacgccagctggagagtttaattcgccttaccgaagctcgggctcggctggaacttagggaagaggccaccaaagaggacgctgaggacattgtcgagattatgaagtacagcatgctgggaacctattccgacgagtttgggaatttagatttcgagcgttcccagcacgggagcggaatgagcaaccgcagcaccgcaaaacgctttatctccgccctgaacaatgtggcagaacgaacctataacaatattttccagtttcatcaactgcgtcagatcgccaaagaactgaatattcaggttgccgatttcgaaaatttcatcggatccttaaacgaccaaggatatttgttgaaaaaggggcctaaagtttaccaactccagactatgtag

SEQ ID NO: 124430 - DNA, 2643 bp, Artificial Sequence
  Description of Artificial Sequence: Synthetic coding sequence
atgaacggagaataccggggaagaggcttcggaagaggacgctttcagtcttggaagagggggcggggagggggaaacttctctgggaagtggcgagagcgcgaacacagaccagatttgagcaaaaccacagggaagcgcacctctgaacagacaccccaattcctgctatccacaaagactcctcagtccatgcagagcaccctggaccggtttatcccctataaggggtggaagctctatttttcagaggtgtactcggattctagcccccttatcgagaaaatccaggcgtttgaaaagttcttcactagacacatcgatttatatgacaaagatgagatcgagcggaagggtagcatcctcgtagactttaaggaactcaccgagggcggcgaagtaaccaatctgatccctgatatcgccaccgaactccgcgacgccccggagaaaactctagcctgtatgggcttagcaatccatcaggtcctgacgaaagacctcgaaagacacgcggctgagttgcaagcacaggaaggacttagcaacgacggtgagacaatggtgaacgtccctcatatccacgctagagtttataactacgagccactgactcaactgaagaacgtacgggctaactattacggcaagtatattgccttgcgcggtacagtcgtcagagtgtccaacatcaaacctctctgtactaagatggccttcctctgtgccgcatgcggagaaatccagagctttcctttgccagatggtaagtactcccttccaaccaagtgtccggtgcctgtgtgtcgggggagaagcttcacggcactccgatcatcaccactgaccgtcacaatggattggcagagtattaagattcaggagcttatgagcgacgatcagcgggaggcgggtcggatcccacgcaccatcgagtgcgaactcgttcatgacctggttgacagctgcgtgcctggcgatacagttactatcactggcatagttaaagtcagcaacgcagaagaaggctcccgaaacaagaatgataaatgtatgttcctcctttacatagaagccaattccatctctaattccaagggacagaagaccaagtcgagtgaggacggctgtaagcacggcatgctcatggagttctccctcaaagacctgtatgcaatccaggagatccaggcagaagagaacctgttcaaactgattgtcaaatggtcccttgccttgtcaccccgtttggagtactccggagcaatatctgctcattgcaatctgcacctcccgagttcaaactcctcacctacatccgcttgtagggttgctggtacaaccggcatgcgccaccagactcagctcctgctattggtgaaggctggactggccctggccctgtttggaggttcgcaaaaatacgccgacgataagaaccgaatcccgattcggggggatcctcacatccttgttgtaggagatcctggtctggggaagagccagatgctgcaggccgcatgtaatgttgccccaagaggagtgtatgtttgcggaaataccacaactactagtgggctgacagtcaccctgtctaaagatagctccagtggcgactttgcgttagaggctggagctctcgtactcggggatcagggaatctgcggaattgatgagttcgacaagatgggcaaccagcaccaggcactcctggaggccatggagcagcaaagtatttcactagcgaaagcgggagtggtgtgctccctgccagctcgaacgagcatcatcgccgctgcaaatcctgtcggaggtcactataataaggcaaagaccgttagtgaaaacctcaaaatgggcagtgcactactctctagattcgacctagtattcatactgctggatacccccaacgaacaccatgatcatctgcttagcgaacacgtgatcgcaatccgggcagggaagcagcgtactatttcatccgcaacagttgcccgcatgaattcccaggatagcaacactagcgtgctcgaggtggtctccgaaaaacctctttccgagcgtctgaaagtggtccccggagaaacaattgaccccatcccccatcaactactgcggaagtacatcggctacgctagacagtatgtctatccaaggttgtctactgaagctgcacgcgttctccaagatttttacctggaacttcgcaagcaaagccagcgtctcaacagcagcccgattaccaccagacagctcgagtcattgattagactcacagaagctagggcacgcctagaactgcgagaagaggcaacaaaagaagatgccgaggatatcgtggaaataatgaagtactctatgcttgggacctattccgacgagttcggcaatctggacttcgagcgatcccagcatggcagcggaatgagcaacagatccacagctaaacggtttatttccgcgctgaataatgtggcggagaggacatataacaatatatttcagttccatcagttaaggcagattgctaaggagctgaatatacaggtggccgactttgaaaacttcatcgggagtctgaacgaccagggctaccttttgaagaagggaccaaaggtgtaccagcttcaaacaatgtag

SEQ ID NO: 124431 - DNA, 2523 bp, Artificial Sequence
  Description of Artificial Sequence: Synthetic coding sequence
atgaatggggagtatcgcggccggggctttgggagagggcggtttcagtcctggaagaggggacgcgggggcggcaacttcagtggcaagtggagggaaagggagcaccggcctgatcttagtaagaccactggtaagcgcactagtgaacagactccgcagttcctgctgtccacaaaaacgcctcagagcatgcagtccaccctcgataggttcatcccctacaaaggctggaaactgtacttcagcgaggtgtattccgacagtagcccactcatcgaaaagattcaggccttcgagaagtttttcactaggcatatcgatctttacgacaaagatgaaattgagaggaaaggcagcattttggtagattttaaggaactaaccgagggcggggaggtgacgaacctaattccggatatcgcaactgaacttagggatgcccctgagaagactttagcatgtatgggtttggcaattcatcaagttctcaccaaggatctggaaagacacgccgccgaactccaggcccaggaaggcctctcaaacgacggtgagactatggtgaacgtgccgcatattcacgcccgcgtttacaattacgagcctttgacccagctgaaaaatgtgcgggcgaactactatggcaaatatatcgcacttcggggcactgtggtgcgggtgagcaacatcaagccattgtgtactaagatggccttcctctgcgccgcttgtggggagattcagtcatttcctttgcctgatggtaagtacagtctacccacgaagtgcccagtacctgtttgcagaggacggtccttcaccgcattgcggtccagcccgctgaccgtgaccatggattggcagtccatcaaaatacaggagctgatgtcagatgaccagagggaggctgggcgtatccccagaactattgagtgcgagctggtccacgatctcgtggacagctgtgtacctggagacaccgtgacgatcaccggcatcgtcaaagtgagtaacgccgaagaaggcagccgcaataagaatgacaaatgtatgttcctcttgtatatagaggcgaactccataagcaatagcaagggacagaaaacaaaaagcagtgaggacgggtgcaagcacggaatgctgatggagttctcactgaaagacctatacgctatccaggagattcaggccgaggaaaacttatttaagctgatcgtgaacagtctttgccctgttatcttcggccacgagctagttaaggctggcctcgctctggctctcttcggcggttcccagaagtacgctgatgataagaataggattcccatcagaggtgatcctcacatccttgtggtcggtgaccctggcctcggcaagtctcagatgttacaagcagcttgtaacgtcgcccccagaggtgtgtacgtgtgcggcaatactactaccacaagtgggcttacagttacattgtccaaagacagcagctcgggcgattttgccctcgaggcaggggctctagttctgggggaccagggtatctgcggcatagacgaattcgacaaaatggggaaccaacatcaggccctgcttgaggccatggagcagcaaagcatctcactcgcaaaagctggagtcgtgtgcagcttgcctgctaggacaagcattatagcagccgcgaatcctgtaggtggccactataacaaggccaagaccgtgtcggagaacctcaaaatggggtcagctttgctgtctcgtttcgatctcgtttttatactgctagacacgcctaacgagcatcatgaccatctgctgagcgagcatgtgatcgccatcagggccgggaaacagcggactatctcctcggccaccgtagcaagaatgaatagccaagacagtaacacatctgttttagaagtggtttccgagaagccactgagcgagcgcctgaaagtcgtgcccggggagaccattgatcccattccacaccagcttctccggaaatacattggttacgctcgacagtatgtatatcctaggctcagtaccgaagctgccagagtgctgcaggacttctacctcgaattgcgcaaacagagtcaacgcctcaatagctcacctatcacgacgcgccagctggagagcctaatcaggcttactgaggctagggcacgcttagaactgcgggaagaggccactaaggaagatgctgaggacattgtggagatcatgaagtactctatgttaggtacatactccgacgagtttggaaacctggattttgagagatcccagcacggcagcggaatgtcaaacagaagcacagcgaaacggtttatctctgctctgaacaacgtggctgagaggacctataataacattttccagtttcaccaactacgacagattgccaaggagctcaacatccaggttgccgacttcgagaactttatagggtctctgaatgaccagggttaccttttgaagaaaggtcctaaggtctaccagcttcagactatgtag

SEQ ID NO: 124432 - DNA, 612 bp, Artificial Sequence
  Description of Artificial Sequence: Synthetic coding sequence
atgaacggggagtaccggggcaggggctttggtagaggcaggtttcagtcgtggaaacggggtcgcggaggaggcaacttctctggaaaatggagagaacgggagcatcgcccggacctaagtaagaccacaggtaagcggacaagcgaacagactccacaatttctactcagcacaaagacaccccaaagtatgcagtccacactggacaggttcattccttataaggggtggaagctgtatttcagcgaagtctactccgactcttcacccctgatcgaaaagattcaggcatttgaaaaattttttacaagacatattgatttgtacgacaaggacgagattgaacgtaagggatccatactggtggactttaaagagctcaccgaggggggcgaagtgacaaaccttattccagacattgccacagaactgcgagatgcccctgagaaaactttggcgtgtatgggcctggcaatacatcaagttctaactaaagatttagagagacacgccgcggagctgcaagcccaagaagggctgtccaatgacggggagacaatggtgaatgttcctcatattcactttctaaagaagaaaaagaagatctag

SEQ ID NO: 124433 - DNA, 1329 bp, Artificial Sequence
  Description of Artificial Sequence: Synthetic coding sequence
atggaaaattggagcaaagatatcacgcactcctatttggaacaggaaacaaccggaattaataaatccacacagcctgacgaacagctgaccatgaacagcgagaagtccatgcatagaaagtccacagaattggtgaacgaaatcacctgcgagaacacagagtggccaggacagaggtcaaccaattttcagattatctcaagctaccccgacgatgagagcgtgtactgtaccacggagaagtataatgtgatggagcacaggcacaatgacatgcattacgagtgtatgaccccctgccaggttacatctgactctgataaagaaaaaactattgcgtttctgctgaaggaactggatattctgcgcacttctaacaaaaaattacaacagaaactagccaaagaggacaaggaacagcgtaaattgaagttcaaattagagctgcaggagaaagaaactgaagctaagatcgccgagaaaaccgctgccctggtcgaagaggtgtacttcgcccagaaggagagggacgaagccgtcatgagtcggctccagctcgcaatcgaggaacgggatgaagctatcgcacgcgccaagcacatggagatgtcactgaaagtccttgaaaacattaaccctgaggagaatgacatgacactacaggagcttctgaaccgcatcaataatgctgataccggaattgctatacagaagaacggggcaattatagttgaccgcatttataagaccaaggaatgtaaaatgaggattacagctgaagagatgtctgctctcatcgaggaacgggatgccgcactctctaaatgcaagagactcgaacaggagctgcaccacgtgaaagagcagaatcagacatccgccaacaacatgcggcatttaactgctgagaataatcaggaacgcgcgttaaaggctaagctgctgagcatgcaacaggcgagagagacagcagtgcagcagtataagaagctggaggaggagatccagaccttacgggtgtattactccctgcataagagcctatctcaagaagagaacctgaaggatcagtttaactacacattgagcacatatgaagaagccctgaaaaacagggagaacatagtgagtatcacccaacagcagaacgaggagctggcgacccagttgcagcaggccctgaccgagcgcgcaaacatggaactccaattgcaacacgccagggaagcctctcaggttgccaatgagaaggtgcaaaagctggaacggttggtggacgttctcagaaagaaggtgggaaccgggaccatgcgcacggtaatctag

SEQ ID NO: 124434 - DNA, 1329 bp, Artificial Sequence
  Description of Artificial Sequence: Synthetic coding sequence
atggagaactggtcaaaggatattactcactcctatcttgagcaggaaaccacagggataaacaagtctacccagccagatgagcagctgacaatgaacagtgagaaatctatgcaccgcaagtccacggagttggtgaatgaaatcacttgcgagaacacagaatggcccgggcaacgatccaccaatttccagattatctctagctacccggatgacgagtcggtttattgtactacagagaaatataatgtgatggaacacagacacaatgacatgcactatgagtgtatgacaccctgtcaggtgaccagcgatagcgataaagaaaagacaatagccttcctgcttaaggaacttgacatccttcgcacttccaataagaaactacagcaaaagctggccaaagaggataaggaacagaggaagctaaaattcaagctggagttgcaggaaaaagagacggaagcaaagatcgccgagaagacagccgcactagtggaagaagtatactttgcacaaaaagagagagacgaggctgtgatgtcaaggctgcaactggctatcgaggaacgggatgaggccattgcacgcgctaaacacatggaaatgagcctgaaagtgctggaaaatataaatccggaggagaacgacatgacgctgcaggaattgctgaatcggattaacaacgccgacaccggcattgctatccagaaaaatggcgccattatcgtggatagaatttataaaacaaaagagtgcaagatgcgtattaccgctgaggagatgtctgctcttatagaggagcgggacgccgcgttatctaagtgtaaacgacttgagcaggagctgcaccacgtcaaggagcagaaccagacatccgcaaacaacatgcgccacctgaccgccgaaaacaaccaagagcgggcactgaaggcaaaactactgagcatgcagcaagccagagagacggcagtgcaacaatacaaaaagctcgaagaggaaatccagaccttaagggtctactactccctgcacaaatctttgagccaggaagaaaacctcaaagatcagttcaactatactctgtcaacttatgaagaggcactgaagaatagagagaacattgtgagcatcacacagcaacagaacgaggagctggcgactcagctgcagcaggccctcacagagcgcgctaatatggagctgcagctgcagcacgctcgcgaggcgagccaagtggccaacgagaaagtccagaaacttgaaagattggttgatgtgctgcgcaaaaaggttgggacgggaaccatgcgaacagtgatatag

SEQ ID NO: 124435 - DNA, 786 bp, Artificial Sequence
  Description of Artificial Sequence: Synthetic coding sequence
atgtccagactccagcttgctatcgaggaacgggacgaggctatcgccagagcaaaacatatggagatgtcactcaaagtactagaaaacataaaccccgaggagaacgatatgacattacaggaattactcaacaggataaataacgccgatactggcatcgctatacaaaagaatggggccatcattgtggaccgaatctataagactaaggagtgtaagatgcggatcactgcagaggagatgtctgcccttatagaggagcgggatgccgcactgagcaagtgcaaacgcctggagcaagagctgcaccatgttaaagagcaaaaccagacttctgctaacaatatgaggcatctcacagccgagaacaaccaggaaagagccttgaaggccaagctgctgtccatgcaacaggccagggagacagcagttcaacagtataaaaaactggaagaggagatacagactctgagagtctattatagcctgcataaatctctatctcaagaagaaaatctgaaagaccagttcaactacactttgtcaacttacgaggaggctctgaagaatcgcgagaacatagtgtccatcacacaacaacagaatgaggagctggccacccaactgcaacaggccctgacagagcgagcaaatatggaactccagctccagcatgctcgggaggcctcccaggtggctaacgaaaaagtgcaaaagttggagaggctagttgatgtgctacgtaaaaaagtcggtacagggactatgaggacagttatctag

SEQ ID NO: 124436 - DNA, 1329 bp, Artificial Sequence
  Description of Artificial Sequence: Synthetic coding sequence
atggagaattggtcaaaggacataacccatagttacctcgagcaggagaccacagggatcaataaaagcacgcagcccgacgaacagctcaccatgaacagcgagaaaagtatgcatcgcaaatccactgagctggtcaatgagattacctgtgaaaataccgagtggccaggacagcgctcgaccaatttccagattatatcgagctaccctgatgatgaaagcgtctactgcaccaccgaaaaatacaacgtgatggaacaccgtcataatgacatgcactacgagtgcatgaccccgtgtcaggtgacatctgatagcgataaagagaaaactatcgcattcctccttaaggagctcgacatccttcggactagcaacaaaaagctgcagcagaaattggcaaaggaggataaggaacagagaaagctaaaattcaaacttgagctgcaggagaaggaaaccgaggccaagattgctgagaagacggccgccctcgtggaggaggtgtacttcgcccagaaggaaagggatgaggcagtgatgtcaagactgcagttggccattgaagagcgcgatgaagcaattgcgcgagctaaacacatggaaatgtcactgaaggtactggaaaatattaatcctgaagagaacgacatgactctgcaggagttactcaacagaataaacaacgccgatacaggtatcgcgatccaaaaaaatggcgcaatcatcgtagatcggatctacaagactaaagagtgtaaaatgaggataacagctgaagaaatgtcagccctcatcgaggagagagatgcagcactatccaagtgcaaaagacttgaacaggagctccatcacgtcaaggagcagaatcaaacgtccgcaaacaacatgcgccatctaactgcagaaaataaccaggagcgggccctgaaagctaagttgcttagcatgcagcaggcccgcgaaaccgccgtgcagcagtacaagaagctggaggaggaaatccagacgctccgggtatactactcactgcacaagagtttgtcacaagaagagaatctcaaggaccagtttaattacacgctgagtacttacgaagaagcgctcaaaaatagagagaatatcgtgagcataactcagcagcagaacgaagaactggccacacaactacaacaggcactgactgagcgagccaacatggaactgcaattacagcacgcacgtgaggcctcacaggtagcaaatgagaaagtgcagaagctggaaaggctggtggatgtgctccgaaaaaaggtggggacggggactatgcgcacggtgatttag

SEQ ID NO: 124437 - DNA, 1275 bp, Artificial Sequence
  Description of Artificial Sequence: Synthetic coding sequence
atgaacagtgaaaaatcaatgcaccgcaaatcaacagaactagtgaacgaaataacctgtgagaacactgaatggcctggacaacgcagcaccaattttcaaatcatttcttcttatcctgacgacgaatcagtgtactgcaccaccgaaaagtacaatgtgatggagcaccgacataacgatatgcactatgaatgtatgactccatgtcaggtcacttccgactcggacaaggaaaagacgattgcattccttctgaaggaactcgacatactgcggacctctaacaagaagctgcagcagaaactggccaaggaggataaggagcagaggaaactcaaatttaagttggagcttcaagagaaggaaactgaggccaagatcgccgagaagacggcagctctagttgaagaggtatacttcgctcagaaggagcgggacgaggcagttatgtcccgcctccagcttgctattgaagagagggatgaggctatcgctagggcaaaacacatggaaatgtctctgaaagttctagaaaatatcaatccagaggaaaacgatatgaccctgcaggaactcctgaatcggatcaacaatgcagacacaggtattgccattcagaagaatggtgctattatcgtcgataggatctacaagacgaaggaatgcaaaatgcgtattacagccgaggaaatgagtgccctcatagaggagcgagatgccgctctgtctaagtgtaagaggcttgaacaggagctgcatcatgtgaaagaacaaaaccagactagcgctaacaacatgcgtcatctaacagccgaaaacaaccaggaacgtgccctgaaggccaaactgcttagcatgcaacaggcgcgcgagacagccgtgcaacagtacaaaaagctggaagaggagattcagacactccgagtgtactactcactacacaagtctctgtcccaggaggagaatctgaaggatcagttcaattacactctcagtacatacgaggaagcccttaagaaccgcgagaacatcgtgtctataacacagcagcaaaacgaagaactcgccactcagctccagcaggcactcaccgagagagccaatatggagctgcagctacagcacgcacgggaagcgtcacaggtggccaacgagaaagtgcagaagagccagatccaaatctattttatccctaacaagaaggatgaaagagaaaaatttctcatggacaagaggagaaaaattgtggcacactcaaagcagaattcatag

SEQ ID NO: 124438 - DNA, 315 bp, Artificial Sequence
  Description of Artificial Sequence: Synthetic coding sequence
atggagaattggtccaaggatataacccactcttatctcgaacaggaaaccaccgggatcaacaaatctacccagcctgacgagcagctgactatgaattccgaaaagagcatgcatcgaaagtcaacagagcttgtcaacgagatcacatgcgagaatacggaatggccggggcagcggtccactaatttccagatcatcagtagctatcctgatgacgagagtgtgtactgtaccaccgaaaaatataacgtcatggaacaccggcacaacgacatgcactacgagtgtatgacaccttgccaggtaacctag

SEQ ID NO: 124439 - DNA, 387 bp, Artificial Sequence
  Description of Artificial Sequence: Synthetic coding sequence
atggagaactggtcgaaagacatcacccactcctacttggaacaggaaacaaccggaattaataagtccacgcagcccgacgagcagctgaccatgaattcggaaaagtccatgcaccgtaaatctacagagctggtaaacgagatcacatgtgagaacactgaatggcccggacagaggagcacaaatttccaaattatcagtagttatcccgatgatgaatcagtatattgcacaacagagaagtataacgtgatggaacaccgccataatgacatgcactacgagtgcatgactccctgccaggtcacaagcgattccgacaaggaaaagaccatcgcatttctcctgaaagaactggacatcttgcggacatcaaacaagtag

SEQ ID NO: 124440 - DNA, 3912 bp, Artificial Sequence
  Description of Artificial Sequence: Synthetic coding sequence
atgggcgaccccgctccagcacggtctctggatgacattgacctttccgctctcagggatcccgccgggatattcgaactggtggaggtggttggtaatggcacctacgggcaggtgtataaagggcgacacgtcaagaccggccaactggcagctattaaagttatggatgtgacggaagatgaagaagaagaaatcaaacaggagattaacatgctgaagaagtactcccaccatcgcaacatcgcgacatattatggcgccttcattaagaaatctccgcccgggaacgacgaccaattgtggctcgtcatggagttctgcggggcaggcagcgtaaccgatttagtgaagaatacgaagggcaacgcccttaaggaagattgcattgcctacatctgtcgagaaattcttcggggtctggcccacctgcacgctcacaaagtgatacaccgcgacatcaaggggcaaaatgtgcttctaaccgagaacgctgaagtgaagttagtggactttggcgtgagtgcccagctagacaggaccgtgggacgccgcaatacatttatcggaactccctattggatggctccagaagtcatcgcttgtgatgagaacccggatgctacctatgattacaggtcagatatctggtcccttggcatcactgccattgaaatggctgaaggagcgccaccactctgtgacatgcaccctatgcgggccctgtttctcataccccgtaacccaccacctcggttaaagagtaagaagtggagtaagaaatttatagattttattgacacttgtctgattaagacttacttgtccagaccaccaactgaacagctgctcaagttcccattcattagagaccagcctaccgaaagacaagtgcgcatccagcttaaagatcatatagatcgctcacgtaagaagcgaggcgagaaggaggaaaccgaatatgagtatagcgggagcgaggaggaagacgactcacacggcgaagagggtgagccatcttctattatgaacgtgcctggcgagagcaccttgagacgagagtttctcagactgcagcaggagaataaaagtaactccgaggctttaaagcagcagcagcaactgcagcagcagcaacagcgtgatccggaggcccacatcaagcaccttttgcaccaacgccagcgcaggatcgaggaacagaaggaagaacgacgcagagtggaggagcagcagcggcgcgaacgagaacagcggaaactacaagagaaggagcagcagagacgtcttgaagacatgcaagccctcaggagagaagaagagcggcgtcaggctgagcgcgagcaggaatacaagagaaagcagcttgaagagcagcgccagagtgagaggttgcagcgccagttgcagcaggagcacgcctatctgaaaagtttacagcagcagcagcagcagcagcaactgcagaagcagcagcagcaacaacttcttcccggagatagaaaaccgttatatcattatggcaggggaatgaatcctgcggataaaccggcttgggccagagaagttgaggagaggacacggatgaacaagcagcagaactctcccctggccaagagcaaacctggatccacaggacccgagccgcccatcccccaggcttcacctgggccccccgggccgctttcccaaacacccccgatgcagcgccctgttgagcctcaggagggcccacacaagagtctggtcgctcatagggtgcctctgaaaccttatgccgcccccgtcccgcgctcacagtccctgcaggatcagcccacgcgcaatctcgctgcgtttcccgccagtcatgatcctgaccctgcaatacccgcccccacagctacgcccagtgccaggggcgccgttatccggcaaaacagcgaccctactagcgagggtccagggccttctccgaaccctccagcgtgggtgcgcccagataacgaggcaccgccgaaggttcctcagcggaccagctctatcgccaccgcccttaacaccagcggcgccgggggcagcagacccgcgcaggccgtgagagcgtccaatcccgatctccgccgatctgatcccggctgggagcgaagtgattcagttctaccagcgtcccatggtcacctgccgcaggctggaagtctggagagaaatagagtgggtgtctcttccaaacctgactcatcgccagtgttgagtcctggaaacaaggctaagccggatgaccatcgaagccggccgggcaggcctgcgtcatataaaagagccatcggcgaggatttcgttcttcttaaagagaggacactggatgaagcacctcgccctccaaaaaaggctatggactactcttcttcctccgaagaggtggaaagcagtgaggatgatgaggaagaaggcgaaggagggcctgcagagggctcccgggatacaccagggggtcggagcgacggtgatactgattcggtgtctacaatggtggtgcacgatgtggaggaaatcaccggtactcaacctccttatggcggcgggacaatggttgttcagcgcactcctgaggaggagcggaatctcctgcacgcggactccaatggatacacaaatttgcccgacgtcgttcagccttcccattctcctactgagaatagtaaaggacaaagcccaccctcaaaagacggatctggtgactaccagtcaaggggtctcgtgaaagccccaggaaaaagttcatttacaatgttcgttgatctgggaatctaccaaccagggggatctggagatagcattccaatcaccgcgcttgtggggggagagggaacaagattagaccagctccagtatgacgtgcggaaggggtcggtggttaatgtaaaccccaccaataccagggctcattctgaaactccggagatccgcaaatataagaagcgttttaattcggagatcctgtgtgccgcactgtggggagtgaacctactagtgggcactgagaacggcctgatgctcctcgaccgatctggtcaaggcaaggtctacgggctgatcgggaggagacgcttccagcagatggacgttttggagggcctcaatctgctgattacaataagcggaaagagaaataagcttcgcgtatactatctgtcttggctaagaaacaagatcctgcataacgaccccgaggtggagaagaagcaaggttggaccactgtgggcgatatggaaggatgtggccactatcgcgtggtaaagtatgagagaatcaagtttctcgtgattgcactcaagagctccgtcgaggtgtatgcgtgggctccaaaaccgtatcataaatttatggcctttaaaagtttcgccgacctccctcaccggcctcttctggtagacctcactgtggaggaaggccagcgtctgaaagtgatctacggctcctcagctgggtttcacgcagtggacgtggattccggtaatagctatgacatctatataccggtgcacattcagtctcagataaccccacatgcaatcatttttcttccaaacacagacgggatggagatgcttctctgttatgaggacgaaggagtctatgtgaacacctacgggagaattatcaaagacgtggtgctacagtggggggagatgccgacctcagtagcgtacatttgttccaatcagattatgggttggggcgagaaggctattgagattcggtctgttgaaaccggtcaccttgacggggtgttcatgcataaacgggcacaacgactaaaattcctgtgtgagagaaacgacaaggtcttttttgcaagtgtgaggtcagggggaagctctcaagtctactttatgacactcaaccgcaattgcatcatgaactggtag

SEQ ID NO: 124441 - DNA, 3999 bp, Artificial Sequence
  Description of Artificial Sequence: Synthetic coding sequence
atgggagatcccgcccccgctcgaagcctagacgacatcgatttgagtgccttgagggatccagccgggatcttcgaacttgtggaggtggtgggaaatggtacctacggacaggtgtacaagggacgtcacgtgaagacagggcaactggccgcaattaaagtcatggacgtgactgaggacgaggaggaagaaattaagcaggaaatcaatatgctgaaaaagtactctcaccaccgtaacattgcgacatattacggtgcctttatcaaaaaatctcctcctggaaacgacgatcagctttggctcgtgatggaattctgcggcgccggctccgtgacagatcttgtgaaaaataccaaggggaacgccctgaaggaggattgtatagcttacatttgccgagaaatattacggggcctggctcacctgcacgctcataaggtgattcacagggacataaaaggccagaatgtcctgcttacagagaatgcagaagtgaaactggtcgacttcggtgtctcagcccagctggaccgcaccgtgggtagacgaaacacctttattgggacgccatattggatggccccggaagtgatcgcctgtgacgaaaaccctgacgctacatatgattataggtccgatatctggagtctgggtattacagcaattgagatggctgaaggggcccccccactctgcgacatgcatcctatgagagccttgttcctcatcccgagaaacccccccccccgcctgaagtccaaaaagtggagcaagaagttcatagacttcattgatacctgtctcatcaaaacctacctgtctaggccccccacggaacaactgttgaagttcccgtttattcgtgaccagccaaccgaacgccaagtgagaattcaactgaaggaccacattgataggagcagaaaaaagcgtggcgagaaggaggaaacagagtacgagtattccggctctgaggaagaggatgacagtcacggcgaagaaggcgagcccagcagcatcatgaatgtcccaggcgagagtacccttcgacgcgagttcctgcgcctgcagcaggaaaacaagagtaatagcgaggccctcaaacagcaacagcagctgcagcagcagcagcagagagaccctgaggcacatataaaacacctgttgcaccagcgacaaagaagaatagaagagcaaaaagaagagagacggcgcgtggaggagcagcagcgccgagagcgtgaacagcgcaaacttcaggaaaaagagcagcagcgtcgtttagaggacatgcaggctttgaggagggaagaggaaagacggcaggccgaaagggagcaagagtacaaaagaaaacagctcgaagagcagcggcagtcggagcgtctgcaacggcagctgcagcaggaacacgcttacctgaaatcccttcagcagcaacagcagcaacagcagttacagaagcaacagcaacagcagttgctgcctggggaccgcaagccactttatcactatggaagaggtatgaatcctgctgacaaacctgcttgggcgagggaagtcgaagagagaactcgaatgaataagcagcagaacagtcctttggctaagtccaaacccggtagcactggccctgaacctccgattccacaggcttctcctggccctcctggacccctgtcacagaccccccccatgcagcgccccgtggagcctcaagaggggccccacaaatccttggtcgctcatagagtgcctctgaaaccatacgccgctccggtgccccggagccaatctctgcaagaccaacccacgagaaacctcgcggcattccccgcctcgcacgatcccgatcccgctatacctgcccctactgccaccccatcagcccgcggcgccgtcattcggcaaaatagcgaccctacctcggaggggcccggccccagtcctaatcctcccgcctgggtacggcccgataacgaggcacctcccaaagtgccccagcgcacttcaagtattgcaacagccctgaataccagtggggccgggggctcacgccccgcccaggccgtcagggcccggccacgctccaactcagcttggcagatttatttgcaaagacgagccgagcgtggcacccccaaacctcccgggccccctgctcagccaccaggaccacctaacgccagcagcaaccctgacctccggcggtcagaccctgggtgggagaggtccgattcagtcctcccagccagccacggtcatttgccccaggccggaagcctcgagcgcaatcgggtcggtgtgtcttcaaaacccgactccagccccgtgttgagccctgggaataaggctaagccagacgaccatcgaagtaggccgggcaggccagccgactttgtgctcctgaaggagagaaccctggatgaggctcctagaccaccaaaaaaagccatggactacagcagctcaagcgaggaagtggaaagctccgaagatgacgaggaagagggcgaaggcggacctgctgagggatcacgggatacacctggaggaaggtccgatggcgacacggactcggtcagtactatggtagtccacgatgttgaggaaatcaccggaacgcaacctccttatggtggcggcactatggttgtacaacgtactcccgaggaggagcggaacctcctccacgctgacagcaatggatataccaatctacccgacgtggtacaaccttcacattcgccaacagagaattctaaagggcagagccccccaagtaaggatggctcgggtgattatcagtctagaggattggtcaaggcccccggaaaatctagctttactatgttcgtcgaccttggcatatatcagcccgggggcagtggagactcaattccaatcacagctctcgtgggaggtgagggcactcgattagaccagctgcagtatgacgtgcggaagggatccgtggttaacgttaatccaaccaacacaagagctcactctgaaacaccagagatccggaagtataagaagagattcaattccgaaatactctgcgcagccctgtggggcgtgaatctcctggtcggaactgagaatggcctgatgctcctagaccggtccggccaggggaaggtctacggactgatcggcagacgaaggtttcagcagatggatgtgctcgaaggtttaaaccttctgatcaccatcagcggaaaaaggaataagctgcgcgtctactatttatcatggctgcggaataaaatcttacataacgacccggaagtagagaaaaagcagggatggaccacagtgggggacatggaaggctgcggacattacagagtggtgaaatatgaacgaatcaagttcctagtcatcgcattgaagtcatcagtggaggtgtatgcgtgggctccaaaaccctaccataaatttatggcttttaagtcgtttgccgacttgccacacaggccattgctggtggacctaaccgttgaagagggacagcggctaaaggtcatctacgggagctccgccggcttccatgcagtggatgtagacagcggtaactcgtatgacatttatatacccgtgcacatacaatctcagattacaccacacgccatcatttttctgcccaataccgacggaatggaaatgctgctgtgctatgaggatgagggcgtgtacgtaaatacttatggaaggattatcaaggacgtggtgcttcagtggggtgaaatgcctacttccgtggcttatatatgttcaaaccagatcatgggttggggagagaaggccatcgaaatcagatccgtggagaccgggcatctagatggcgtgttcatgcataaaagagcccagcgattgaaatttctgtgcgagcggaatgacaaagtgttctttgcctcagtgcgctcaggaggttctagccaagtttactttatgaccctcaacaggaattgtatcatgaattggtag

SEQ ID NO: 124442 - DNA, 3939 bp, Artificial Sequence
  Description of Artificial Sequence: Synthetic coding sequence
atgggagacccagctcccgcccggtctcttgacgatatagacctgtccgccctgagagacccagcggggatttttgaactggtcgaggttgtcggtaacggaacctatgggcaggtgtataaggggagacatgttaaaacgggtcagctggcagcgataaaagtgatggacgtgactgaggatgaagaagaggagattaagcaagaaattaacatgcttaagaagtactctcatcaccggaatatcgccacatactacggggcattcattaaaaagtcacctcccggaaatgacgatcaactgtggctcgtgatggaattctgcggtgctggaagcgtaaccgaccttgtcaaaaacaccaaggggaacgctcttaaagaagattgtatcgcctacatctgcagagagatcctgcgcgggctggcccacttacacgcgcacaaggtgatccatcgggacattaagggccagaatgtgttgctcaccgagaacgcagaagttaaattggtggactttggggtcagcgcccaactcgacaggactgtgggcagaagaaacaccttcatagggaccccctactggatggcaccagaagtgatagcctgcgacgagaatcctgatgccacgtatgattataggagtgatatctggtcactgggcatcacggctatagagatggctgaaggcgcgccaccactgtgcgatatgcacccgatgcgggctcttttcttgattccacgaaaccctcctcctcggctgaaatcaaagaaatggtccaagaagtttatcgacttcattgacacatgcctgatcaagacctatctgagcaggccccccaccgagcagctgttgaagtttcctttcattcgcgaccaaccgactgaaagacaggtacgtatccagctgaaagaccacatcgaccggtcaaggaagaagcggggggagaaagaggaaacagagtatgaatactctggatcagaggaagaggacgactcgcatggcgaggagggcgaaccctcttcaatcatgaacgtccctggggaaagcacactgcggcgagaattcctgcgtctgcaacaagagaacaagtctaactctgaggctcttaaacagcagcaacaactccaacaacaacagcagcgcgaccctgaagcccacataaaacacttgctccatcaacgtcagaggaggatcgaggaacagaaagaggagcggcggcgagtggaagagcaacagcgcagagaacgagagcagcgcaaactgcaggaaaaagagcagcagcggagactagaggacatgcaggccctgcgccgcgaggaggagcgtaggcaggccgagcgtgaacaagaatacaagcgcaagcaattagaggagcagcgtcagtcagagcgcctacaaaggcagttgcagcaggaacacgcctaccttaaaagtctgcagcagcaacagcagcaacagcagctgcagaaacagcaacagcaacagctgctgcccggtgacaggaaacccctgtatcattatggcaggggcatgaaccctgcagacaagcccgcttgggccagggaagtagaagagcggacaagaatgaataaacaacagaacagccccttggccaagtcaaagccaggatctaccggccccgagccgcccatcccacaagccagtcccggcccaccgggtccactgagccagacccccccaatgcagcggcccgttgagccgcaggaggggccccataaaagcctccaggaccagcctacgagaaatttagccgcattccccgccagtcacgatcccgatcccgcgatccctgcgcctaccgctacaccttccgcacgtggggcagttattagacagaatagcgatcctacctcagaggggcccggcccgtcccccaatccgcccgcctgggtgcgccctgacaacgaggccccacctaaggtgccccaacgcacgagctcaatcgccaccgccctaaatacatccggagccggaggttcacggccagctcaggccgtgagggcaaggcctagatcgaattcagcctggcagatatatctgcaacgaagagctgagcggggtacacctaagcccccgggtccacccgcacagcccccaggaccccccaatgcctctagcaatcccgacttaaggcgatccgatccaggctgggagcggtccgactcagtgttacctgcatctcacggacatctgccccaagctggttcgttggaaagaaacagagtcggcgtcagcagcaaaccagacagcagtcctgtcctgagccctggcaacaaggcgaagccagacgaccaccgcagtcgacccggtagacctgctgacttcgtgttgctgaaagaaagaacactggacgaagcgcctcgacctcccaaaaaagctatggattactccagctcatctgaggaagtggagagtagcgaagacgacgaagaggaaggagaggggggcccagcggaaggttccagggatacgcctggcggacgttccgacggggacaccgactcagtgagcactatggtcgttcacgatgtggaggagataaccggaacccagcctccttatggcggtggcaccatggtggtgcagaggacaccagaggaagaacgcaacctgcttcacgccgactccaacggctacaccaatctgcctgatgtggtacaaccgagccactcccccactgagaactcaaaaggccagagcccgcctagcaaagacggaagcggagactaccagagccgcgggttggtaaaggcacctggcaagagcagtttcacgatgtttgtcgacctcgggatttaccagcccggcgggagcggggatagtatccctataacagccctggtcggcggcgaagggaccaggctagatcagctgcagtacgatgtgcggaagggttcggtagtgaatgtaaaccctactaatactcgggcgcactcagagacccccgagattaggaagtacaaaaagcgctttaatagtgagatactttgtgcagccctgtggggcgtgaaccttttggtcggcacagagaatggactaatgctgctcgacagatccggccagggtaaagtgtatggcttgatcggccgtaggagatttcagcaaatggacgtcttggaaggacttaatctcctgataacaatttcaggcaaacgtaataaattgagggtgtactacctcagctggctccgcaacaagatcctgcacaacgacccagaggtggagaaaaaacagggctggacaacagtgggagatatggagggatgtggtcactaccgggtggtaaaatacgagagaattaaatttcttgtcatcgccttgaaatcttccgtagaggtgtacgcgtgggccccaaagccgtaccacaagttcatggctttcaaatccttcgcggacttaccacataggccccttctcgtcgacctgactgtggaagagggtcagcggcttaaggtgatttacggttcaagcgccggttttcacgctgtggatgtagatagcggcaattcgtacgatatctatattccagtacatatccagtctcagattaccccacacgccatcatttttttgcccaataccgacggtatggagatgctgctttgttacgaggacgagggcgtgtatgttaatacctacggtcgcataatcaaggatgtcgtgctccagtggggcgaaatgcccacatcagtggcctacatctgctctaatcaaataatggggtggggggagaaagcaatcgagatacggagcgtggagactggccatctggatggcgtgttcatgcacaagcgggctcaaaggctgaagttcctctgcgagaggaatgataaagtgttcttcgcatccgtccggagtggcgggtcaagccaagtgtatttcatgaccctgaatcgcaactgtataatgaattggtag

SEQ ID NO: 124443 - DNA, 879 bp, Artificial Sequence
  Description of Artificial Sequence: Synthetic coding sequence
atgctactagatcggtcgggccaagggaaagtgtatgggctcatcggtaggcgaagattccagcagatggatgtactcgagggcctgaatttacttatcaccatctcaggcaaaagaaacaaactgcgcgtgtactatctatcttggctgcgaaataagatcctccacaacgaccctgaggtcgagaaaaagcaggggtggaccactgtgggagatatggaaggttgtggccattacagggtggtgaaatatgagcggattaagtttttggtaattgccttgaaatctagcgtggaggtgtatgcgtgggcaccaaaaccctaccataagttcatggcttttaagagctttgctgatctcccccatcgacccctcctcgtcgaccttacagtcgaggaaggccagagactgaaggtgatttacgggagttccgctggctttcacgccgtggatgttgattccggtaactcttatgacatttatatcccagtgcatatacagtcacagattacgcctcacgcgattatcttcctccccaacaccgacggcatggaaatgctcctgtgttacgaagatgagggtgtgtacgtcaatacttacgggcggatcatcaaagatgtggtgcttcaatggggcgagatgcctacgtctgtcgcctatatctgcagcaaccagataatgggctggggggagaaagcaatcgagattcggtccgtggaaactggccacctcgatggcgtgtttatgcataaaagggctcagcgtctgaagttcttatgcgaaagaaatgacaaagttttcttcgccagtgttcgctccggtggcagctcccaggtgtactttatgaccctcaatcggaactgcattatgaactggtag

SEQ ID NO: 124444 - DNA, 336 bp, Artificial Sequence
  Description of Artificial Sequence: Synthetic coding sequence
atgggcgatccagctcctgcgcggagcttagacgacatcgacttgtcagccctccgcgcactttggttccagtttttttaccactcgggcagctcactcgaatcacctggcatgctaaacggaccctttcagcacaggaattctagaattatgacccataggagtgcagagaaaacgctcctcggcagcttatcgctgtggagatggtcggctatggaacccactgatcggtgcactagggtgggcatgtccaggcgcgggagttggctaccaagtcggtcgtggatgtctcgccggactaggagaaaaaggtccaacaggagatctacttgttag

SEQ ID NO: 124445 - DNA, 1014 bp, Artificial Sequence
  Description of Artificial Sequence: Synthetic coding sequence
atgggggctgcggggagctcagccctcgctagattcgtccttttggcgcagtcccggcccggctggttgggggtagccgccctcgggctcaccgccgtcgctcttggtgccgtggcatggagaagagcatggccaactaggagacgtaggctgctgcagcaggtgggaaccgtcgctcagctgtggatctacccagtcaagagttgcaaaggggtgcctgtcagtgaggctgaatgtacagcgatgggtctgcgttcaggcaacctccgagatagattctggttggtgattaatcaggagggcaatatggtgacagcccgtcaggaaccaaggttggtgcttatatcactcacatgtgacggggatactctgaccttatcggcagcttacaccaaagacctgctcctccccatcaaaacaccgacaactaacgcagttcataagtgcagagtccatgggttggagatcgaagggagggactgcggggaggccaccgcccaatggattacatcctttttaaaatctcaaccttacaggttggtgcattttgaaccccatatgcgccccaggcgtcctcatcagattgcggatctgtttcggcctaaagaccagattgcctactcagatacttcgcctttcctgattcttagcgaggctagtctggctgacctgaatagtcgactggagaagaaggtgaaggcaaccaacttccgtcccaatatagtcatttctggctgcgatgtttacgcagaggatagttgggacgaactgttgattggagatgtggagctcaagcgcgttatggcctgttcccgctgcatacttacaaccgtagatccggacactggggttatgtcacggaaagagccgctggagacccttaaatcttatcgacagtgtgatcctagcgagcgcaaattgtatgggaaatctccgctctttgggcagtacttcgtgcttgaaaaccccggcactataaaagtcggcgaccctgtgtacctgcttggccagtag

SEQ ID NO: 124446 - DNA, 774 bp, Artificial Sequence
  Description of Artificial Sequence: Synthetic coding sequence
atgggggcatcttcttcctctgcactcgccagattgggactgcccgcccggccctggcctagatggctaggggtagccgcactcggcctagccgccgtggccctcgggaccgtggcctggcggagagcgtggcctcgacggcgccgtaggctgcagcaagtgggaacggtcgccaaactgtggatttaccccgtgaaaagttgtaagggagtgccagtctccgaagctgagtgtaccgctatggggcttaggtcagggaatctgcgtgatcgtttctggttggtaataaaagaggacggacatatggtaaccgctaggcaggagcccagattggtactgatatcaatcatttacgagaacaactgcctgatttttcgcgctccagatatggatcagctcgtccttccttccaagcagcccagctcaaataaacttcataactgtagaatctttggactggacattaagggtcgcgactgcggcaacgaagccgcaaaatggttcaccaattttctgaaaaccgaggcatatcgtctggtccagttcgagactaatatgaagggccgtacatcccggaaacttctccccactctcgatcagaacttccaggttgcttatcctgactactgccccctcctgattatgactgacgcttcactggtggatctcaacacacggatggagaaaaaaatgaagatggagaatttccgcccaaacatagttgtcacggggtgtgatgcattcgaggaagcttcggctaccagacgcgactag

SEQ ID NO: 124447 - DNA, 1008 bp, Artificial Sequence
  Description of Artificial Sequence: Synthetic coding sequence
atgggagcatcttctagttcagcactggcgcgcttaggtttgccagcgaggccatggcctcggtggctgggagtcgctgctctggggcttgccgctgttgccttggggactgtggcttggagacgggcttggccccggaggaggaggcgcctgcagcaggtgggtactgtagctaaactttggatctacccagtgaagagctgcaaaggcgtgcccgtttcggaggctgaatgcacagccatgggacttcggtctgggaacttgcgggacaggttttggctcgtgatcaaagaggatgggcacatggtgactgcccgacaggagccccgcctggtgttgatctccatcatatatgagaacaattgtcttatctttagggcgcccgatatggaccagctggtgctcccatcaaaacaacctagctcaaacaaactgcataattgccgaatttttggactcgacattaaaggacgcgactgcgggaacgaggccgctaaatggttcaccaatttcctcaaaaccgaagcctaccgcctggttcagtttgaaacaaacatgaaaggccggacatccagaaaactactccccacactcgatcagaatttccaggtcgcctatccagactattgcccacttctcatcatgactgacgcatcattagttgacctaaacacccgtatggagaagaaaatgaagatggagaactttagacccaacatcgtggtgacgggatgcgacgcctttgaggaggacacctgggacgaattgcttatcggctcggtcgaggtgaagaaagttatggcctgcccacgctgtatactaactacggttgatcccgatacaggcgtcatcgatcgcaagcaaccgcttgacactctgaaatcgtacaggctgtgtgacccctccgaaagggagctgtataaacttagtcctctgttcggaatttattactctgtggagaaaatcggttcccttcgggttggcgaccctgtttatagaatggtgtag

SEQ ID NO: 124448 - DNA, 519 bp, Artificial Sequence
  Description of Artificial Sequence: Synthetic coding sequence
ggtcatatggttactgcccggcaagaaccacgtttggtcttaatatccatcatttatgagaacaattgtctgatcttccgggcgcctgatatggatcaattggtgctgcccagtaaacaaccttccagtaataagctacataactgccgaatttttggtctggatattaagggccgggattgcggaaacgaagcagcgaagtggttcactaacttcctcaaaacagaggcctaccggttagtgcagtttgaaactaacatgaaaggccgcacgtcacgcaagctgttgccgacactggaccagaattttcaagtcgcgtaccctgactattgccctcttctgatcatgactgacgctagtttagttgacctgaacactcggatggaaaaaaaaatgaagatggaaaacttcagaccgaacattgtcgtaacagggtgtgacgcttttgaggaggatacttgggacgagttgctgatcggttctgtagaggtgaagaaggtaatggcatgtccgaggtag

SEQ ID NO: 124449 - DNA, 447 bp, Artificial Sequence
  Description of Artificial Sequence: Synthetic coding sequence
atgcccttcgccgaggataagacctacaaatacatatgtcgcaatttctccaatttctgtaatgtagacgttgttgagatcctcccatacctaccttgcttaactgcccgggaccaggacaggcttcgcgccacatgtaccctgtccggaaatcgtgacactctctggcatttattcaatactcttcagctgccaacctgggctggcgaggaaactcctggtgggcaaagctctggacgcggattagacttcagcagcctcacttcaggtgctgtgtggctgtggcaaatgtcagacttctggtcgtgcttctcaacatggactgtcagcatttggcttatcttgcattgggtgctactgaggctgaatcttcaagtcttcgccaagtgtctcgcccagagtaaatggccccttctcttgcctagtctgtcctgtccaacatggtag

SEQ ID NO: 124450 - DNA, 375 bp, Artificial Sequence
  Description of Artificial Sequence: Synthetic coding sequence
atgcccttcgctgaggataagacgtataagtatatttgccgaaacttcagcaatttttgtaatgtggacgtagttgaaatcttgccttacctgccatgcctgaccgctcgcgaccaggatcgccttagggccacgtgtactttgagcgggaatcgggacaccctttggcatctgttcaacacgcttcaaagacgacctggctgggtagagtacttcattgcggccctccggggttgtgaactcgtcgatctggctgatgaggtagctagcgtttaccagtcctaccagccacagtttagagcttctccagccgacgcacaacctcaaagccaccctaaggaatcacgttggtggccaccaggagtcctcctttag

SEQ ID NO: 124451 - DNA, 1200 bp, Artificial Sequence
  Description of Artificial Sequence: Synthetic coding sequence
atgcctgttcaggagacccaagccccggagagtcctggggagaacagcgaacaagctctgcaaacattgagccctcgcgcaattcccagaaatccggacggtggcccgcttgagtcaagctcagacttggccgccctgtcacccctgacctcatcaggacaccaggaacaggacaccgagctgggtagtacacatacggccggcgcaacaagctccctgaccccttcacggggtccagtcagccccagtgtgtcctttcagcccttagctcggagtacaccacgggcctctaggttgcccgggccgaccgggagcgtcgtgtctaccggcacatccttttcatcctcctcccccggattggcttctgcaggtgccgccgagggaaagcagggggccgagagtgaccaagcggaacctatcatttgttctagcggtgccgaagcccctgccaattctctgcctagcaaagttcctacgactctgatgcctgtcaatactgtggcactaaaggtgcccgccaaccctgcatccgtgtctacagtcccttcaaaactgccaacatcgtctaaaccccccggagctgtgccgagcaacgccctaacaaatcccgccccaagtaagctgcccatcaatagcactcgcgccggcatggtgccaagcaaggtgccaacatccatggtcctcacgaaggtgagtgcaagcaccgttcctaccgatgggtctagcagaaatgaggagaccccagctgcacccaccccagcaggcgcaacaggaggatctagcgcttggctggacagctctagcgagaaccggggactgggttccgaacttagtaaacctggcgtgttggccagtcaggtggattctccctttagtgggtgttttgaggatcttgcgattagtgcaagtacctccctggggatgggaccctgtcatggacccgaagaaaacgagtacaagtcagagggcacctttggcatccacgtggcagagaaccccagcatccaactgctggagggaaacccgggacctcctgccgaccccgacggcggccccagaccgcaggccgacagaaagtttcaggagagagaggtgccatgtcatagacccagtccgggggccctctggttgcaggtggccgtcactggggtgcttgtggtgactctgttggttgttttataccggagacgattgcattag

SEQ ID NO: 124452 - DNA, 1623 bp, Artificial Sequence
  Description of Artificial Sequence: Synthetic coding sequence
atgcccttcgcagaggataaaacttacaagtatatctgtcgcaatttttcaaatttctgcaatgttgacgtggtggagattctgccgtatttgccatgcctgacggccagagaccaggaccggttgagagccacgtgtacactttcggggaacagagatacactttggcacctctttaacacactccagcgtagacccgggtgggtggaatattttatagccgcgctgcggggatgcgagcttgtcgatttagccgacgaagtggccagcgtctaccagtcctatcagccacgtacgagcgacaggccacccgaccccctggagcctccttctttgcctgctgaaaggccaggtcctcctacccccgcagccgcacatagcatcccatataactcctgtcgcgagaaagagccatcatacccaatgccagttcaggaaactcaggcacccgagtctccaggcgagaatagcgagcaagctttgcagactctcagcccacgcgctattccaagaaatccagatggcgggcctcttgagtcatctagcgatctggccgcactgtctcccctgacctcatccgggcaccaggagcaggataccgagctgggcagcactcacaccgcaggagccacttcttctctgactccttcccgggggccagtatccccatcagtgtcattccaacctcttgcgcgcagtacaccccgggcttcccgccttccgggcccaactggatccgtcgtatctaccggaaccagttttagtagttcttcccccgggcttgcaagtgcaggagccgccgaagggaaacagggcgccgagagcgatcaggctgagcccatcatttgctccagcggagctgaagccccagccaatagccttccgagcaaagtgccaaccacattaatgccagtgaacacagtggctttgaaggttcccgcaaatcccgcctccgtctcaaccgtgccatctaaactccctacatcatcaaagcccccaggcgccgttccatctaacgctctgaccaaccccgccccatccaaactgccaatcaattccacccgcgcaggcatggttccctccaaagtacccacaagtatggtgctcaccaaggtgtccgcttcgactgtgccgacggacgggagttcaaggaatgaggaaactccagccgcgccgactccagcaggggccacaggaggctcttccgcttggctggacagcagcagtgagaaccgagggcttggcagcgagctgtcgaagccaggagtcttagcctctcaggtcgattctcctttcagcgggtgtttcgaagatctggcaatttctgccagtacgtctctgggcatgggcccttgccacggacccgaggagaatgagtacaagtccgagggcactttcgggatccacgtggccgagaacccctcaatccaactgctcgaagggaaccccggaccacccgccgacccggacggcggcccaagaccacaggcggaccgtaagtttcaggagagagaggtcccatgccaccgaccaagcccaggggcactgtggctgcaggtagctgtaaccggggttcttgtggtgacactgttagtggtactatacaggagaagactccactag

SEQ ID NO: 124453 - DNA, 993 bp, Artificial Sequence
  Description of Artificial Sequence: Synthetic coding sequence
atggccgccgcagctggcaggagtctgctcctcctgctcagctcaagaggtggaggcggcggcggcgcaggagggtgcggggcactcacagcagggtgctttcccggactgggagtgtctaggcaccgccagcagcagcaccaccgtactgtacatcagcgcattgcttcatggcagaacctgggagcagtatactgctccaccgtagtgccatcggacgatgtgactgtagtgtaccaaaatggactgcccgtaatttctgtgaggctgccaagccgtcgcgagcgttgccagttcaccctgaagccaattagtgatagtgttggcgtctttctgagacagctgcaggaggaggaccgtgggattgaccgagtcgcaatttatagcccggacggcgtacgtgttgccgcatccaccggcatcgatctgctgttgctggatgactttaagctggtcataaatgacctcacatatcatgttcgtcccccaaagagagttgaaatggggttctgccatgttggccagaacggttttgagttacttaccagcagctatctccccgccagtgccagccagtcagctgaaattattgccgtcagaattgaaatcagccgtaaggcagaaaaacggactactctagtgctgtgggggggcctggcatacatggctacccaattcgggatactggccaggctgacttggtgggagtacagctgggatatcatggagccggtcacatacttcattacatatggtagcgcgatggctatgtacgcctatttcgtgatgacacggcaggagtacgtctaccccgaggcacgtgacagacagtatctgctcttttttcacaaaggcgcaaagaagagcaggtttgacctggagaagtataaccaactgaaggacgcgatagcacaggccgagatggatctcaaacggctgcgggatcctttgcaagtccatctgcccctccgccagatcggagaaaaagactag

SEQ ID NO: 124454 - DNA, 1056 bp, Artificial Sequence
  Description of Artificial Sequence: Synthetic coding sequence
atggctgcagccgctggtcggtcgctactgctgctcctcagcagtcgcggcggtggcggcggcggtgccggggggtgtggcgcacttacagcgggctgtttccctgggctgggggtctcaaggcaccgccaacagcagcatcacagaacggttcatcagagaattgccagctggcagaatctgggcgctgtgtattgcagcacagtcgtcccctcagacgatgtaaccgtggtgtatcaaaacggacttccggtgattagcgtgcggctgccttctcggagggaacggtgtcagttcactctgaaacctatctcagattcagttggcgtgtttctgcgccagctgcaggaggaggataggggtatcgaccgggtggcaatctatagccccgacggagtgcgggtagccgcctcgacaggaattgatctgttgttactagatgatttcaagctcgtgataaacgatctgacctaccacgttaggccacccaagcgggatctgctatcacacgaaaacgcagcgacactcaacgatgtcaagacactggtccaacagctgtacacgactctgtgtattgagcaacaccaattaaacaaagagcgggagcttatcgagagactcgaggatttaaaggaacagttggcacctctggaaaaagtccggatagagatatctcgaaaggctgagaaacgcaccacactcgtgctttggggcggactggcctacatggccacacaattcgggattctggctagacttacgtggtgggagtatagctgggacattatggagcccgtgacatacttcatcacatacggatcagccatggctatgtatgcttacttcgtcatgacgcgtcaagaatatgtgtaccctgaggcgcgagacagacaatatctgttattttttcataagggggccaagaagtccagattcgacctggaaaagtacaatcagcttaaggatgcgatcgcgcaggctgaaatggacctgaagagactgcgagatcccctgcaggtgcacctgcccctgcgccagattggcgaaaaggactag

SEQ ID NO: 124455 - DNA, 909 bp, Artificial Sequence
  Description of Artificial Sequence: Synthetic coding sequence
atggtgcaccaacgaattgccagttggcaaaacctgggcgccgtgtattgttccacagttgtcccatctgatgacgtaaccgtcgtgtaccaaaacggcctgccagtcatctccgttaggctgccaagcaggcgtgagcggtgtcagttcacactcaagcccatctcagactctgtaggagtgtttttgcgccagttacaagaagaggataggggcatcgatcgggttgcaatctacagccctgatggcgttcgggtcgcagccagtaccggcattgatctcctgctcctagatgattttaagctcgtcattaacgatctgacttaccatgtccggccccccaaaagagacctgcttagccatgagaatgcagctacactgaacgatgtcaagacactggttcagcagttgtacacaactctttgcatcgagcaacatcagctgaataaagagcgagagctgatagaaagactcgaagaccttaaagaacaactggcacctctggagaaagtgcgtattgaaattagcaggaaagctgagaagcgcactaccctggtcctctggggcggactggcctatatggccacacagttcggcattctcgctaggttgacatggtgggagtattcctgggatatcatggagccagtgacatatttcattacctatggctccgcgatggctatgtacgcctactttgtcatgacgagacaggaatatgtgtaccctgaagcgcgggatagacagtatcttctcttctttcacaaaggtgctaaaaaatctagattcgaccttgagaaatataaccagctgaaggacgccatcgcacaggcagagatggatctgaaaagactgcgggacccactccaagtccaccttcccctgcggcagatcggtgaaaaagactag

SEQ ID NO: 124456 - DNA, 912 bp, Artificial Sequence
  Description of Artificial Sequence: Synthetic coding sequence
atggctgacgctgccagtcaggtccttttggggtctgggctcactatcctgagccaaccgctcatgtatgtcaaggtgcttatccaagtcggctatgagcccctgccaccgacaatcggacgcaacatttttggccggcaagtttgccagttacccggcctgttcagctacgcccaacatatcgcgtctatagatgggcggcggggactcttcacaggcttgacccctcggctctgttcaggtgtactggggaccgtcgtgcatggtaaagttctccagcattatcaagagagtgacaaaggagaggaactcggaccaggtaatgtgcagaaagaagtgtcatcaagtttcgaccacgttattaaggagactactagagagatgattgcaagatcagctgcgaccctcatcacccatccattccatgtgattactttacgtagtatggttcagtttattggccgcgagagcaaatattgcggcctgtgcgactccatcatcactatatatcgggaagagggaattctcggttttttcgcaggactggttcctcggctattgggtgatatcctaagcctgtggctctgtaatagtcttgcgtacttagtcaacacctacgcattggacagcggcgtgtcaaccatgaatgagatgaaatcgtacagccaagcggtcacgggatttttcgcctccatgctgacttacccgtttgttctcgtgagtaatctgatggctgttaataactgtggcttggcagggggttgtccaccttactcaccaatttacacaagttggattgactgctggtgcatgctgcagaaggaggggaatatgagtcgaggcaatagtcttttcttcagaaaggtcccatttggtaaaacatactgttgtgacctgaagatgctgatctag

SEQ ID NO: 124457 - DNA, 468 bp, Artificial Sequence
  Description of Artificial Sequence: Synthetic coding sequence
atggtgcagtttatcggtcgagaatccaagtattgtggactgtgcgattcaattattacaatctaccgtgaggaggggatcctgggattcttcgctggactggtgccacggcttctgggcgacatactgagtctatggctatgcaattcccttgcatacctggtgaatacctatgctcttgattccggcgtcagcaccatgaacgagatgaaaagctacagccaggcggtcactgggttttttgcatctatgttaacgtaccctttcgtgctggtatccaacctgatggccgtaaacaattgcgggctagcaggagggtgccccccctattcgccaatatacacaagttggattgattgttggtgcatgctgcagaaagagggcaacatgtcaagagggaactccctgttctttcgaaaggtgcccttcggcaaaacctactgctgtgacctcaaaatgttgatctag

SEQ ID NO: 124458 - DNA, 360 bp, Artificial Sequence
  Description of Artificial Sequence: Synthetic coding sequence
atggttctgccacttccttggttaagcagataccacttccttcggctgttactgccatcttggagcctcgccccccaggggtctcatggttgttgttcacaaaacccaaaagcctccatggaagaacagacttccagcagaggaaatggcaaaatgactagcccccctcgcgggcccgggacccatcgtacagcagaactagccagagcagaggagcttctcgagcagcagctcgagctctatcaagccctgctcgagggacaggagggcgcctgggaggcccaggcactggtcctgaagatacagaaactaaaggagcagatgagacggcaccaggagagtcttggcggaggggcatag

SEQ ID NO: 124459 - DNA, 360 bp, Artificial Sequence
  Description of Artificial Sequence: Synthetic coding sequence
atggtgttaccacttccttggctgtccagatatcatttcctgagattgcttctccctagctggtctctggcccctcaggggagtcatgggtgttgctcccagaatcccaaggcgagtatggaagaacagacaaactcccgggggaacggtaagatgacctctcctcccaggggaccaggaacccaccgcacggcagaacttgccagagcagaggagcttctggaacaacaactggagctgtatcaggcactgctcgagggccaggagggcgcctgggaggctcaagcactcgtgctgaagatccaaaagctgaaggagcagatgagaaggcaccaagaatctctcggcggaggcgcttag

SEQ ID NO: 124460 - DNA, 360 bp, Artificial Sequence
  Description of Artificial Sequence: Synthetic coding sequence
atggtgctgccactcccttggctgagcaggtaccacttcctcaggcttctgctgccatcttggtctctggcacctcagggaagtcacggctgctgctctcaaaaccctaaagcctccatggaagagcagaccaactccagaggaaatggcaaaatgacttcaccccctcgggggcctgggacacatcggaccgctgaactggcaagagctgaggagttgctggagcagcagcttgaactttatcaggcacttttagagggtcaagaaggtgcctgggaggctcaggctttggtgctaaaaatacagaaactgaaggagcagatgcgacgacatcaagaatccctcggtgggggcgcctag

SEQ ID NO: 124461 - DNA, 360 bp, Artificial Sequence
  Description of Artificial Sequence: Synthetic coding sequence
atggtcctacctctcccctggttgagcagataccactttctgaggctcttattgccatcttggtcacttgctcctcagggctctcatggctgttgctctcaaaatcccaaggccagcatggaggagcagacaagttctaggggaaacggaaagatgacaagtcctccacggggaccaggcacgcaccggaccgcagagctcgccagagcagaggagctgctggaacagcagctcgagttatatcaagccctgcttgagggccaggagggcgcttgggaggcacaagcattagtgctgaaaatccaaaaactgaaggaacagatgagaagacatcaagagtccctcggggggggtgcctag

SEQ ID NO: 124462 - DNA, 360 bp, Artificial Sequence
  Description of Artificial Sequence: Synthetic coding sequence
atggttctgccactcccttggctgagtagataccatttcctccggttgctcctacctagctggtccttggccccacaaggctcccatggctgctgcagccagaaccccaaagctagcatggaagagcaaacctcatctagggggaatggcaagatgacttccccacctcgtggacccgggactcatcgcacggctgagcttgcacgcgcagaggaactgctcgaacagcagctcgaactctatcaggcgctcctggaaggacaggaaggagcctgggaagctcaggctttggtccttaagattcaaaagctcaaggagcagatgcggcgccaccaggagtccttaggagggggagcctag

SEQ ID NO: 124463 - DNA, 360 bp, Artificial Sequence
  Description of Artificial Sequence: Synthetic coding sequence
atggtgctccctctgccctggttaagtagataccactttttgcgcctgctcctgccatcttggtccctagcaccccagggtagccacgggtgttgcagtcagaatcccaaggcaagtatggagaagcagaccaacagtaggggaaatggcaaaatgacatcacccccacgtggtcccggaactcacaggactgcagaattggcacgcgcagaggagttactagaacagcagcttgagctgtaccaggcactgcttgaaggacaagaaggagcctgggaggcacaagctctggtgctgaagatacaaaaattaaaagaacagatgcgcagacatcaagaatcccttggaggaggggcctag

SEQ ID NO: 124464 - DNA, 360 bp, Artificial Sequence
  Description of Artificial Sequence: Synthetic coding sequence
atggtccttcctctcccctggctcagtaggtatcacttcctccgcttgctgttgccaagctggtccctagcaccacaaggcagtcatggatgctgctcacagaatcctaaggcctctatggaagagcagacaaactcaagaggcaatggaaagatgactagtccacctaggggacccggcactcaccgaacagctgaactagctagggcagaggaactgctcgaacagcagctcgagctctaccaggcactgctggaaggccaggagggagcatgggaggctcaggctctggttcttaagattcaaaagttgaaggagcagatgaggcgccaccaggaatctctgggcggtggcgcttag

SEQ ID NO: 124465 - DNA, 360 bp, Artificial Sequence
  Description of Artificial Sequence: Synthetic coding sequence
atggtgctgcccttgccttggttgtcgcggtaccattttctgagactgctgctacctagctggagtctggcaccccagggctctcacgggtgctgtagtcagaatccaaaggcttctatggaggagcagacaaattcccggggtaacggcaagatgacctcgccaccccggggaccaggaacacacagaactgctgagctcgccagggctgaggagttgctggaacagcaactggagttatatcaggccctactggaaggacaggagggggcatgggaggcccaggctctggtgttgaagattcagaaattgaaagaacagatgcgtaggcaccaggaatctctcggaggtggagcttag

SEQ ID NO: 124466 - DNA, 1059 bp, Artificial Sequence
  Description of Artificial Sequence: Synthetic coding sequence
atggagtccggaggaaggccaagcttgtgccagttcattctccttggcacaacctccgtggttacagcggctctgtacagcgtatatcgacaaaaggccagagtttcacaggagctgaaaggcgccaagaaggtgcacctgggtgaggacctgaagtccattctatctgaagccccagggaaatgtgtgccatatgccgtcatcgagggcgccgttcggagcgtgaaggagaccctcaattcacagttcgtggaaaactgtaaaggagtaattcagcgtttgactcttcaagaacacaagatggtttggaacagaaccacccacctttggaacgattgttctaaaattatccatcagaggaccaacacagttccctttgacttggtgccacacgaagatggcgtggacgtggctgtgagagtgctgaagccccttgacagcgtggacctgggccttgagacagtatatgaaaagttccatccctccattcagtcttttacagatgtgattggacactatatctctggagagcgccctaagggtatacaagaaaccgaggagatgcttaaagtcggggcgaccttaactggggtcggggagctggtcttagacaacaacagtgttcgtctccagcctccgaaacagggcatgcaatactatctaagctcccaggatttcgactcgctcttgcagagacaagagtcctcagtccgactctggaaagttctggccttggtctttgggttcgctacctgtgcaacattgttttttatcctcagaaaacagtaccttcagaggcaggagcgactccgactgaaacagatgcaagaagaattccaagagcatgaagcccaactcttgagtcgcgccaagcccgaggatagggagtcgcttaagtctgcctgcgtggtttgccttagctcatttaaaagctgcgtgttccttgagtgtggtcatgtttgttcatgtaccgagtgttaccgcgccttgcccgagccgaagaagtgtcccatctgtaggcaggctattactagagttataccactgtataactcctag

SEQ ID NO: 124467 - DNA, 2142 bp, Artificial Sequence
  Description of Artificial Sequence: Synthetic coding sequence
atgttatgcgtgggccgccttggaggcttaggggcacgcgccgcggcattacccccgagacgggctggccggggatctctggaggccggtattcgagcccggcgggttagcacatcctggagtcctgtcggcgctgcatttaatgtgaagcctcagggcagccggctggatttatttggggagaggcgcggattattcggcgtcccagagctttcagctcccgaagggttccatatcgcacaggaaaaggcgcttagaaaaaccgagctgctcgtagaccgcgcctgctcaacccctcccggcccgcagaccgttctcatctttgatgagctctctgactcactttgcagggttgctgacttggccgatttcgtgaaaattgcacaccctgagccagcatttagagaagcagcagaagaggcttgccgttcaatagggaccatggtggaaaagttgaacacaaacgtggatctttaccagtccctacagaagctgttggcggacaagaagttggtggacagcctagaccccgaaacaaggcgcgtcgccgagttatttatgttcgacttcgagatcagcggcatccacctggataaggagaagcggaaaagagccgtggacctcaacgtgaagatactggacctttctagtacctttctaatgggcacaaactttccaaacaaaatcgagaagcacctccttccggagcacataaggcggaatttcaccagcgcgggtgaccatattatcatcgacggcttacacgccgaaagtcccgacgatctggtgcgtgaagccgcatataagatctttctttatcctaacgctgggcagttgaaatgtctcgaggaactgttgtcctcccgtgacctgctcgctaaactagtcggctattctactttcagccaccgcgcattacagggcacaattgctaagaatcctgagacagtgatgcaatttctggagaagctgtcagacaagttgtcagaacgcaccctcaaggactttgaaatgataaggggcatgaaaatgaagctcaacccccagaattctgaagtcatgccctgggaccctccctattactctggcgtgatcagagcagagcggtacaacatcgagccaagcctgtactgtcctttcttcagcctgggtgcatgtatggaggggctaaatattttactaaaccggctcctgggcatcagcctgtatgctgagcagcctgctaagggcgaggtttggagcgaggacgtgcgcaaactagccgtggtacacgaatctgaggggttgctcggctacatttattgcgacttttttcagcgcgccgataagccgcaccaggattgccattttaccatccggggtggccgactcaaggaagacggagactaccagctgccggtagtggtactgatgttgaatttgcctaggtcctcacggagctcgcccactctgttaacacctagtatgatggaaaacctgttccacgaaatgggtcatgcgatgcactccatgctcggaagaacacgctatcaacatgtgaccggcaccagatgccctacagacttcgcagaagtcccctccatcctaatggaatattttgccaatgactaccgcgtggtgaaccaattcgccaggcactatcaaaccggacaacccctgcctaagaacatggtgtcaagactctgcgagagtaaaaaggtgtgcgcagctgcagacatgcagttacaggtgttttacgctactctcgaccagatctatcacgggaagcaccccctgcgaaacagtacaaccgacatcctgaaggagacccaggagaagttttacggcctgccctacgtccccaatacagcctggcagctcagattctcacacctcgtagggtatggcgcccgatactattcctatcttatgtctcgggcagttgcttcgatggtttggaaggaatgcttcttacaagacccattcaacagggctgccggggagaggtaccgacgggagatgctggcacacgggggtgggcgagaacctatgctcatggtagaaggaatgctgcagaaatgcccatctgtggacgattttgtctctgccctcgtttctgatctggacctggactttgagacgttcctaatggactcggaatag

SEQ ID NO: 124468 - DNA, 1353 bp, Artificial Sequence
  Description of Artificial Sequence: Synthetic coding sequence
atgtccgccatccaagcagcctggccttcaggtaccgagtgtatcgccaagtacaacttccacggaactgccgagcaggacctgccattctgcaagggagacgtgctcacaattgttgctgttactaaggatcccaactggtataaagccaaaaataaggtgggaagagaagggatcatccctgctaactatgtgcagaaaagggagggcgtgaaagccgggaccaagctgtccctgatgccatggtttcacgggaagattaccagggaacaggcagagagattgctgtaccccccggagaccggcttatttttggtacgtgaaagtactaattatccaggcgactacaccctgtgtgtgagttgcgacggtaaggtcgagcactacaggatcatgtatcatgcctctaaactctcaatcgacgaagaagtgtattttgaaaacctgatgcagcttgtggagcactatacgtccgatgcagatgggctgtgtacacggcttatcaagcccaaggtgatggaggggaccgtggccgctcaggacgagttttaccgaagcggatgggctctgaacatgaaggagctgaaactgctccagaccatcgggaagggggaatttggcgacgtcatgttaggagattatagggggaacaaagtggccgtcaagtgtataaagaatgacgctacggcgcaagctttcttggcagaggcgagtgtgatgacacaactgaggcactctaatttagtacagctcctgggggtgattgtagaggagaaaggggggctctatatagtgacggaatatatggccaagggatccctcgtcgactatctgcgttctaggggtcgcagtgttttaggaggagattgtctcctgaagtttagcctggatgtgtgtgaggccatggaatatctggagggcaacaatttcgtgcaccgcgaccttgcagcaaggaatgtactcgtgagcgaggataatgttgccaaggtaagcgactttggtctgacgaaggaagcgtcatctacacaagacacaggcaaactgcctgttaaatggaccgctcctgaggctctgagagaaaagaagttctctacaaaaagtgatgtctggtctttcggaatcctgttgtgggagatttactcttttggtcgcgtgccgtacccccgcatccctctcaaagacgtcgttcctagggttgagaaggggtacaagatggatgctcccgatggctgccccccagcagtctacgaggtcatgaaaaactgttggcatctggacgccgccatgaggcccagttttttacagctgcgagaacaactggagcacattaagacacacgaattacatctgtag

SEQ ID NO: 124469 - DNA, 1170 bp, Artificial Sequence
  Description of Artificial Sequence: Synthetic coding sequence
atgcgcgtacttgtgagaaggtgttggggccctccgctggctcacggagctagaagaggacggccttccccccagtggagggcactggctagactggggtgggaagactgccgggattcccgtgtccgggagaaacctccctggcgggtcctttttttcgggacggaccagttcgcaagagaagccctgagggctttgcacgccgctcgggagaacaaggaagaagaactcatagacaagctggaagtggtcacaatgcccagcccgagcccgaaaggactccctgtgaagcagtacgcggtacagtctcaactgccagtctacgagtggccagacgttggctctggcgagtacgatgtgggagtagttgcatcctttggcaggctactgaacgaagcactaatcctgaagtttccttacggcatcctgaacgtgcacccttcttgtttgccccgctggcggggtcccgcccctgttattcacaccgtactgcatggcgataccgtcaccggggtgaccattatgcagatccgccccaaacggtttgatgtgggccccatcctcaagcaagagacagtccctgttccccccaagtctacagccaaagagctggaagcggtcctgtccaggctaggagcaaatatgttgatttctgtgctgaaaaatcttcccgaaagcctgtctaacggcaggcagcaacccatggaaggggccacgtatgcgcctaaaatctccgccggaacgtcgtgcatcaagtgggaagaacagacatccgagcaaattttcagactgtacagggctatcggcaatatcattcctctgcagaccctatggatggccaataccattaaattgctcgatctcgtcgaagtgaacagctccgtcttggctgacccaaaacttacgggccaggcactcatcccaggatcagtcatctatcataagcagagccagattttgttggtatactgcaaagatgggtggattggagtgcggagtgtcatgctgaagaagagcctcaccgcaactgacttctataacgggtatcttcacccttggtaccagaagaatagccaagcgcaaccgagtcaatgcagattccagacattgagactgcccacaaaaaagaaacaaaagaagactgtggcgatgcagcagtgtatcgaatag

SEQ ID NO: 124470 - DNA, 1749 bp, Artificial Sequence
  Description of Artificial Sequence: Synthetic coding sequence
atggccgtccctggggttggacttctgacccgactgaatttatgtgcacgccggagaacccgtgtgcagagaccgattgttaggctcctctcttgtcccggaacagtggctaaggaccttcgacgagatgagcagccctcaggatcagtggagactggattcgaagataaaatacctaaacggcggttctcagagatgcagaacgaacggcgtgagcaggcgcaacggactgtgctgatccactgcccggagaaaattagtgaaaataagttccttaagtacctatctcagttcggacccatcaataaccacttcttctatgaaagcttcggcctctatgccgtggtggaattttgtcaaaaggagtccatagggtctctgcagaatggcacacacactccttctacggcaatggagactgcaatacctttcaggagccggtttttcaacctaaagctgaagaatcagacctccgagaggagcagagtgagatcctccaaccagttgccacgctccaataaacagctattcgagcttctgtgctatgcagaatccattgatgatcaattgaatactctcctgaaggagtttcagctgacagaggagaatacaaaactcaggtaccttacgtgttctctgattgaagatatggcagcagcttatttcccggattgcatcgtgaggccattcggatcctcagtcaacaccttcgggaagctgggatgcgacttagatatgttcttagaccttgatgaaacgcggaatctgagcgcacacaaaatctcagggaactttcttatggaattccaagtaaagaacgtcccctccgagcggatcgctactcagaaaatactgagcgttctgggggaatgtcttgatcatttcgggcctggatgtgtgggagtccagaagatcttgaatgcacgctgtcccctggtcaggttcagccaccaggcatctggctttcagtgcgatctgactactaataatcgtatcgcactaacatcctccgagctcctgtacatatacggagcattagacagtcgggtgcgagctcttgtgttttcggtgcggtgctgggcccgcgcccactccctcaccagctcgattccaggggcgtggattacaaatttctctctgaccatgatggtcattttcttccttcagcgtagatcccccccgatcctgcctacacttgattctctcaaaacactggctgatgccgaagataagtgtgtcatcgagggcaataactgcactttcgtgcgggatctatcccggatcaaaccatcccagaataccgagacacttgaactgctcctgaaggagttcttcgagtatttcggcaatttcgcatttgacaaaaatagtattaacatcaggcaaggcagggagcagaataaaccagactcatcacctctatacatccagaatccgttcgagaccagcttaaacatcagcaagaacgtttcacagagtcaactccagaaattcgtcgatctggcaagggagtcagcgtggatactccaacaggaggataccgaccgtccgtcaatctctagtaatcgcccctggggcttggtttcattactccttccctccgcaccaaatcggaagtcttttacaaagaagaaatccaacaagtttgcaattgagacagttaaaaatttactggagagcctcaaaggaaaccggactgaaaacttcacgaagactagcggcaagagaacaataagcacacaaacatag

SEQ ID NO: 124471 - DNA, 2139 bp, Artificial Sequence
  Description of Artificial Sequence: Synthetic coding sequence
atggcctgggcgaagaaggttggcgggagagctgggcagggtcgttctttgtcacgatgcgacccaattattctggaccccgaatggctctacggtccacccgaaggggagggagggcccgaaggggtaggaggagaaacccgggcatcaatccatcccccgcttcgcactggaaggcaccaccagaaggtcaatcacaacatcagaggacctgagggaagtgccaaggacgccgctccggggggcggcgggcaccatcaggccggcccaggccaaaggggcgacgaagatggagcactgcaacacctatgtggtggcggcggtggagtcggtgtgtcagtcgggagagggaccggtactagcgtggccgctgagcacccaagcctgcaggtcaagttactggaactacaggagcttgtgctcagactggctggagaccacaacgagggacacgggaagtttctcgccgcagcccagaacccggctgatgaccccgcacccggtgcacccgcccctcaggaacttggcgccgccgacaaacagggcggattcgaggataagatcccaaagaggcggttttccgagatgcagaatgagaggagggaacaggcccagaggaccgttcttatccactgccctgaaaagatcagcgaaaataaattcctgaaatacctatcccaatttgggcctataaacaaccacttcttttatgagtcctttggcctctacgctgtggtcgagttctgtcagaaggagtctatcggcagcctccagaatggaacccatacaccgtccaccgcaatggaaactgccatcccctttcgtagtaggttcttcaacttgaagttgaagaatcaaacttccgaacgttctcgagtccggtcttctaatcagctgccacggtctaataaacagctctttgaattgctttgctacgcggaatcaatcgatgatcagctgaacaccctgcttaaggagttccaactcacagaggagaataccaagctccgctatttaacatgttcattaatcgaagatatggctgccgcttatttcccagactgcatcgtaaggccctttggctccagcgtgaatacctttggcaagctcggatgcgacctggatatgtttttggacctggacgagaccagaaatctgtccgcccataagatctcgggtaatttcttgatggaatttcaggttaagaatgtcccaagcgagaggattgccacccagaagatcctttctgtactcggcgagtgtctggaccattttgggcccggttgtgtgggtgtccagaaaattttgaacgcacgttgtcctctggtgagatttagccatcaagccagcggcttccagtgcgacctcacaaccaacaatcggatcgcactgacttcttcggagctcctttacatttacggtgcgctcgacagtagggtacgggcactggtgtttagcgtgcggtgctgggccagggctcactcactcacatcctctatcccgggcgcctggatcactaatttcagccttaccatgatggtaatattttttctacaaagacggtcccctcctattctacctactctggactctctgaagacactggctgatgcagaggacaaatgcgtgatcgaggggaataactgtacctttgtgagagatctctcacgaatcaaaccatctcaaaacactgaaacccttgagctgcttttaaaggaattcttcgagtatttcggaaactttgcctttgataagaatagcattaacatccgccaaggcagagaacagaacaaacctgattctagtccattgtacattcagaacccttttgaaacctccctcaacatctctaagaacgtctcccagagccagctgcaaaagttcgtggatctggcccgagaatcagcttggattctacagcaagaagataccgatagacctagcatctcttctaatcgcccttggggcctggtctcactgctgctgcctagcgccccgaacaggaaatcctttaccaaaaagaagtccaacaagtttgcgattgagactgtcaagaatttgctggagagcctgaaagggaaccggactgagaactttaccaagacaagtggcaagcggacaatctctacccagacatag

SEQ ID NO: 124472 - DNA, 660 bp, Artificial Sequence
  Description of Artificial Sequence: Synthetic coding sequence
atgcaaaacgaacggcgggagcaggctcagaggactgttcttattcattgtcctgagaagatatcggaaaacaagtttttgaagtatctgagtcagttcggacctattaacaaccacttcttctacgagagctttggcctgtatgcagtcgtcgaattctgtcagaaagagtccatcgggagtcttcagaatggcacccatacgccatctactgctatggaaacggccatcccatttcgaagtcgtttctttaacttaaaattaaaaaatcagaccagcgagcgcagcagggtacgctcctccaatcagttacctcgcagtaataagcagcttttcgagctgctgtgttacgccgagtcaatcgacgaccagctgaatactctgctcaaagaatttcaactgactgaggaaaacacgaaactcagatacttgacatgcagtttgatcgaagacatggcagcggcttacttccctgattgcattgtgcggcctttcggatcctctgtgaacactttcgggaaactggggtgcgacctcgatatgttccttgatctcgatgaaactcgcaacctctctgctcacaagatctcggggaatttcttgatggagtttcaggttaagaacgtaccgagtgagagaatcgccactcagaagatatag

SEQ ID NO: 124473 - DNA, 453 bp, Artificial Sequence
  Description of Artificial Sequence: Synthetic coding sequence
gatctgcggcgggatgaacagccttccgggtccgtggaaacaggctttgaagataagattccaaaacggagattctccgaaatgcagaatgagagaagagagcaggctcagaggaccgtattaatccactgtccagagaaaattagtgagaataaattcttaaaatatctatcacagtttggacccataaataaccactttttttacgagtcctttggcctttatgccgtcgtcgagttctgccaaaaggaaagtatcggttcccttcagaacggaacccacacaccaagcaccgctatggaaactgccataccgtttagatctcggttcttcaatctgaagcttaagaaccagaccagtgaacgtagccgcgtgaggtcttccaaccagctgcctagaagcaacaaacaactattcgagctgttgtgctatgctgagtctgtatccttctag

SEQ ID NO: 124474 - DNA, 309 bp, Artificial Sequence
  Description of Artificial Sequence: Synthetic coding sequence
atgtttttgaccgcgttgctttggcggggacgtatacctgggcggcagtggatcggcaagcataggaggcctcgctttgtatcactcagagcgaagcaaaacatgatcaggcgcttggagatagaagcagaaaaccattattggctcagcatgccatacatgacacgggagcaggagaggggccatgcagccgtccggcgccgagaagctttcgaagccatcaaggcagccgcgacctccaaatttccaccccacaggttcattgccgaccagttggatcatctgaatgtcacgaagaagtggagctag

SEQ ID NO: 124475 - DNA, 978 bp, Artificial Sequence
  Description of Artificial Sequence: Synthetic coding sequence
atggcggccgccgtgaggtgcatggggcgggctctgatccatcatcagcgtcacagtctttctaaaatggtttaccagacttcactctgtagctgctccgtaaacatccgagtacctaatcgccatttcgccgcagcaactaagagcgccaagaagacaaagaagggagccaaggagaaaacgcctgatgagaaaaaggatgagattgagaagataaaggcttacccctacatggaaggcgagcccgaagatgacgtgtatcttaaacgactctacccacgacagatttacgaggtggagaaagctgttcacctgttgaaaaaatttcagatcctggactttactagtcccaaacagtctgtgtacctggatctaaccctcgacatggccctaggcaaaaagaaaaatgtagaaccttttacaagtgtcctgagtctcccttatcccttcgcatcggaaattaacaaggtggcagtctttaccgagaatgcctctgaagtgaagatcgctgaggaaaacggggccgcgtttgcaggtggtacatcgctgatacagaagatttgggacgatgaaatcgtcgctgacttttacgttgccgtaccggagatcatgcctgaactgaacaggctccgaaagaagttaaataagaaataccctaaactcagtcgaaactctattggccgtgatatccccaagatgctggaactgtttaagaacggccacgagataaaggtggacgaggagagagaaaactttctgcagaccaaaattgcaacacttgacatgtcatcagatcaaattgccgcaaacctccaggccgtgattaatgaagtgtgcagacacaggccgcttaatctggggccgttcgtcgtccgggcctttctccggtcttccaccagtgagggacttctgctgaagatcgaccctttactgcccaaggaggtcaagaacgaagaatctgagaaagaggatgcctag

SEQ ID NO: 124476 - DNA, 909 bp, Artificial Sequence
  Description of Artificial Sequence: Synthetic coding sequence
atggtgtatcagactagtctatgcagctgtagtgtgaacatcagagttcccaaccgtcactttgcagccgccacaaaaagtgccaaaaagaccaagaagggcgccaaggagaagacacccgatgaaaaaaaggatgagatagaaaaaattaaggcctacccatatatggaaggggagcccgaggatgatgtgtatcttaagaggctataccccagacagatctacgaggtagaaaaggccgtacatctgttgaaaaagtttcagatcttagactttacctcacccaaacaaagcgtctacctggatctgactctcgatatggctttgggaaaaaaaaagaacgtggaaccttttactagcgtgctctcgctcccttacccgtttgcgagtgagatcaataaggttgctgtgtttaccgaaaatgctagtgaggtaaaaattgctgaagagaatggagctgcgtttgccggagggacgagtctgatccaaaaaatctgggatgacgaaatagtcgccgacttttatgtggctgtcccggaaataatgcccgaactgaacaggctccgcaagaagctgaataaaaagtaccccaaactgtctcggaacagtattgggcgtgacatcccaaaaatgctcgaactgtttaagaacgggcacgagatcaaggtagacgaagaacgtgagaacttcctgcagactaagatagcaactctggatatgagtagcgatcagattgccgccaacttgcaggccgtgattaacgaggtttgccgccaccgccccctgaatctgggaccctttgtggtaagagcttttctgcgctccagtacttctgaaggccttttgttaaagatcgatcccctgttaccaaaggagatcaaatcccagcctaagaaaaagaaaaactag

SEQ ID NO: 124477 - DNA, 816 bp, Artificial Sequence
  Description of Artificial Sequence: Synthetic coding sequence
atgatttcagcacactgcaacctccatttaccaggttcatccgacagccctgccagcgcaagccaggttgctgggatcaccggcaggctcccgacacttcagactgtccggtacggctccaaagctgtcacgcgacacaggagggtgatgcatttccagcgacagaaactgatggctgtgacagaatatatcccacccaaaccagccatacaccccagctgtttacccagcccacccagtcctccacaggaagaaattggtctcatcaggctgttgcgcagggagatagcagcggtgtttcaggataataggatgattgccgtctgtcaaaatgtcgccctgtctgccgaggataaactcctgatgcgccatcagttgcgtaaacataaaatcctgatgaaagtgttcccaaatcaggtgctaaagcccttcttggaagactcgaaatatcaaaacctgctccccttgttcgtgggtcataatatgctactagtctccgaggagcctaaggtcaaggaaatggtgcggatccttagaactgtccccttcctgccgctgctgggcgggtgcatagatgacacaatattatccaggcaaggctttataaactatagcaagctaccttctctccctctagttcagggcgagctcgtgggcggtctgacatgtctaaccgctcagacccatagtctgcttcagcatcaaccgctgcagctcacaaccctgctagaccagtacatccgggagcagcgagaaaaagacagtgttatgagtgcgaatggtaagccggaccctgatacggtcccggactcatag

SEQ ID NO: 124478 - DNA, 786 bp, Artificial Sequence
  Description of Artificial Sequence: Synthetic coding sequence
atggccgctgcagtcgctggcatgcttcgcgggggccttctccctcaggcaggacgcttgccgacactgcaaactgttagatatggttccaaggctgtaacacgtcacaggcgtgtgatgcactttcagcgccagaagctgatggcagtgacagagtatattcctccgaaaccagctattcatccgtcctgtctgccatctcccccgtctccaccacaggaggagatcggcctcatcagactgctacgacgcgagatcgcagccgtctttcaggataatagaatgatagctgtctgtcagaatgtggcactttcagccgaagataaacttctgatgagacaccagcttcgtaaacataagatccttatgaaagttttccccaaccaggttctgaagccattccttgaggattccaaatatcagaatctgttacctttgtttgtcggtcataatatgctcctggtcagcgaagaaccaaaagtcaaggagatggtacgtatactgcgaactgtccctttcctaccccttcttgggggatgtatcgacgatactatactgtcacgccagggattcattaactactccaaacttccatctcttcctcttgttcaaggcgaactggtcgggggcctgacgtgtctgacagcccagactcattctctcctgcagcaccagcctctgcaactcacgaccctactggatcagtacataagagagcagagggagaaagactcagtcatgtccgcgaacggtaagccagacccagacaccgtgccggatagctag

SEQ ID NO: 124479 - DNA, 816 bp, Artificial Sequence
  Description of Artificial Sequence: Synthetic coding sequence
atgatttcagcacattgcaacctgcacctcccggggtcttcagacagccccgcttccgcctcacaggtagccggtatcactggacgcctacccaccctccagaccgttcggtacgggtccaaggctgtgacacgccatagaagggtgatgcactttcagcggcaaaaattgatggcagttactgagtatattcccccaaagccagccattcatccgtcatgtctgcccagtcccccgagtccaccccaggaggaaattggactcattcggttgctgaggagggagatcgcagccgtctttcaggacaacagaatgatcgcagtctgtcaaaatgtggccttgtctgctgaggacaaacttcttatgagacatcagctgcgtaaacacaagatcctgatgaaggtattcccgaatcaagttctgaagccgttcctggaggattcaaagtatcaaaatctgttgcccctcttcgtcgggcataacatgctgctcgttagcgaagagccaaaggtcaaagaaatggtgcgcatcctcaggaccgtgccattcctgccgcttctcggcggctgcatagacgacaccattctctcccgccagggcttcattaattacagcaagctgccctcattgccactcgtccagggagagctagtgggaggcttgacatgcttaactgcgcagacacatagcctccttcagcatcagccactgcagttgacgacactattagatcagtacatccgggagcagagagagaaggatagcgtgatgtctgctaacggaaagccagatccagataccgtcccggactcctag

SEQ ID NO: 124480 - DNA, 579 bp, Artificial Sequence
  Description of Artificial Sequence: Synthetic coding sequence
atgagtaaactgggaagagctgcgcggggtctgcggaagccagaagtcggtggggtgatccgggccattgtcagagcagggcttgctatgccaggcccccctttggggcctgtgctgggccagcggggggtgtccatcaatcaattttgcaaggagttcaatgagaggaccaaggacatcaaagagggcatcccactacctaccaagatcctggtaaaacctgatcgtaccttcgaaattaagattgggcaacccaccgtttcttacttcctgaaagctgccgccgggatagaaaagggcgctaggcagacgggcaaggaagtcgccgggctggtgaccctgaagcacgtctacgaaattgctcgaattaaagcgcaggatgaggctttcgcacttcaggatgtaccattaagctccgtggtgcgctctatcattggttccgccagatccctcggaattagagtggtgaaggatctttcttccgaagaactggccgcttttcagaaagagcgcgcgatttttctggcagcccagaaagaggctgacctggcagcgcaagaggaagccgccaaaaaatag

SEQ ID NO: 124481 - DNA, 546 bp, Artificial Sequence
  Description of Artificial Sequence: Synthetic coding sequence
atgtccaagctggggcgagctgcccgcggcctgcggaagcccgaagttggtggcgtgatcagggctatagtacgagcagggctggcaatgccaggcccgccactgggccccgtcctgggacagcgcggtgttagcattaatcagttctgcaaggagttcaacgaacggaccaaggatattaaagaggggatcccactaccaactaaaattctcgtaaaacccgataggacgttcgagatcaagataggccagccgacagtgtcatactttctgaaagccgcagcagggatcgagaaaggagccagacagacagggaaggaagttgccggcctggtgacgctgaaacatgtctacgagatcgccaggattaaggcacaggacgaggcttttgccttacaggacgtacctctgtcttctgttgtgagaagcatcatcggttccgctcgcagcttgggcattcgcgttgttaaggaacggtgctccgctaatgtactgcgtaacggaaaaatttccatgaaagatccatcaggacggagctctgtgtag

SEQ ID NO: 124482 - DNA, 501 bp, Artificial Sequence
  Description of Artificial Sequence: Synthetic coding sequence
atgtctaaactggggcgggccgcgcgcggactgcgcaagcccgagcggggcgtgagcattaaccaattttgtaaggaattcaatgagcgaacaaaggatattaaagaaggaatccctttaccaactaagatcttagttaagcccgaccggacctttgaaatcaaaattggacagcccactgtcagctatttccttaaagcagcggctggcattgagaagggagcacgacaaacaggaaaggaagtggccggattggtcaccctgaagcatgtatacgagatcgcccgcataaaagctcaggacgaagcttttgcgctccaggacgtccctttgagctccgttgtgaggtcgatcattgggtccgctaggagcttgggtattcgggtggtaaaagacctgagctccgaagagctcgctgcttttcagaaagagagggctatcttcttggctgcgcagaaagaggccgacctggcggctcaagaggaggccgctaaaaagtag

SEQ ID NO: 124483 - DNA, 891 bp, Artificial Sequence
  Description of Artificial Sequence: Synthetic coding sequence
atggcagctgaggcaagagtttcgaggtggtattttggcgggctggcttcctgtggggcagcctgctgcacgcatccactagacctgttgaaggtgcatctgcagacacagcaggaggtgaaactacgcatgacggggatggccctcagagtggttaggactgacggtatcctggcgttatactcgggactgtcagccagcctctgccgacagatgacctatagccttactagatttgcaatctatgagaccgtgcgcgatagggtggccaagggctctcagggccccctgccatttcatgaaaaagtgctcttagggtccgtctccggacttgccggcgggttcgtgggcactccagctgatttggtcaacgtccgcatgcagaacgacgtgaagttgccccagggtcagcgtcgcaattacgcccacgctctggatgggctctatcgtgtggcacgcgaggaggggttgagacgactcttcagcggggctaccatggccagcagccgaggggcactggtcacagtgggccagctctcctgttatgatcaggccaagcaattagtgctatcgacgggctacctgagcgacaacatatttacgcacttcgtcgccagttttatagccgctgcaggcgacgagccgccgccgcagggcggttgtgctaccttcctctgtcagcctctggacgtcttgaaaaccagattgatgaattcaaagggggagtatcagggggtgtttcactgtgcagtggaaactgccaaattgggcccgctggcgttttacaagggcctggtgcctgctggcattcgtctcatcccccatacagttctcacattcgtgtttctggagcagcttagaaagaattttggcattaaggtgccgagttag

SEQ ID NO: 124484 - DNA, 537 bp, Artificial Sequence
  Description of Artificial Sequence: Synthetic coding sequence
atgctcccagcggctgccaggcctttgtggggcccgtgtctcgggctcagagccgcggccttccgtctcgcccggaggcaggtgccatgcgtgtgcgctgtccgacatatgaggagttccggccaccaaaggtgtgaagccttggcaggcgcaccactggataatgctcccaaggagtacccgccaaagatccagcagctcgtgcaggacatcgcttcgctgacgctgctggagattagtgaccttaacgaactccttaaaaagaccctgaagatacaggacgtgggccttgtcccaatgggaggagttatgtccggagccgttcccgccgcggccgcccaggaggccgtcgaagaagatatccccattgcaaaggaacggacacacttcacagtacgtctaaccgaagctaaaccagtcgataaagtgaaactcattaaagaaataaagaattatatcaaagcttccacttcgtcccggcagcgcagctggtggagcccctgtccaggcaatcagtcccaatgccggcagtcctag

SEQ ID NO: 124485 - DNA, 597 bp, Artificial Sequence
  Description of Artificial Sequence: Synthetic coding sequence
atgctgcctgctgctgctaggcctctctggggtccctgtctggggcttcgtgcggctgctttcaggttagcccgacgacaggtgccttgtgtctgcgccgtgaggcatatgcggtcctcagggcatcagaggtgcgaggctttggccggcgctcctctggacaatgcgccaaaagaatacccccctaagatccaacagctggtccaagacatcgctagcttaacactgctggagatttctgatctgaacgagctgcttaagaaaaccctcaaaattcaggacgtggggctggtccccatgggaggagtgatgtccggagctgttcccgcagcggccgctcaggaagccgtagaggaggatatcccaattgctaaagagagaactcattttactgttaggctcaccgaggccaagcctgtcgataaagtgaaactgattaaagaaataaagaattacattcaaggaattaacctcgtgcaggcaaagaaattagtcgagagcctaccacaggaaatcaaagcgaacgtggcaaaggccgaggcggagaaaatcaaggccgcgctcgaggccgttgggggcacagtggtcctagaatag

SEQ ID NO: 124486 - DNA, 864 bp, Artificial Sequence
  Description of Artificial Sequence: Synthetic coding sequence
atggccgctgaggcacgagtcagcagatggtatttcgggggcctggcctcatgtggcgccgcatgctgcacccaccctctggacctactgaaagtgcatttgcagacgcagcaggaggtcaagttgcggatgaccggcatggctcttcgggtcgtgagaactgatggcattctggcgctgtatagcggcctgtctgcaagcctgtgccgccagatgacatattccctgactaggtttgctatttacgagacggtgcgggatagggtggccaagggtagtcaaggaccgctgcctttccatgagaaggtcctgctgggctcagtaagtggcctggctggaggctttgtagggacacccgctgacctagttaacgtgaggatgcagaatgatgtgaaactgccccaggggcaacggaggaactatgcccatgctttagatggcctgtacagagtcgcgcgcgaggaaggtctgaggaggctttttagcggcgcgacgatggcctcctcccgtggtgccctggtgacggtgggacagctgagctgctacgatcaggctaaacagttggtgctgtctactggctatctgtccgacaatatttttacccattttgtggcgtcttttatcgccggaggatgcgcaacttttctttgtcagccactcgacgtcctgaagacacggctgatgaattccaaaggtgaataccaaggcgtctttcactgcgctgtggagacagcgaagttgggacctcttgccttctataagggtctcgtgccggctgggattcggctgatccctcacacagtgctgactttcgtattcctcgagcaactccgaaagaatttcggcatcaaggttccctcatag

SEQ ID NO: 124487 - DNA, 1329 bp, Artificial Sequence
  Description of Artificial Sequence: Synthetic coding sequence
atgctccctgcagcagcccgcccactgtggggaccgtgtctaggcctgcgggcggctgccttcagactggctcgtcgccaagtgccctgcgtttgtgcagtgcgacacatgagatcgagtgggcaccaacgctgtgaggcactggctggcgctcctttggataatgccccgaaggagtacccccccaaaattcagcagcttgtgcaggacatcgccagtcttaccctgctggagatatccgatctgaacgagctgttgaagaaaacccttaagatccaggatgttggcctcgttcctatggggggggtcatgagcggtgcagttcccgcggcagcggcccaagaagccgtagaagaggatattcctatcgcaaaggagcggacccacttcaccgtgcgtctgaccgaggccaagccagttgacaaggtgaagctgataaaggaaatcaaaaactacatccagggaatcaacctggttcaggccaaaaagttagtggagtcattgccacaggaaatcaaagccaatgtggccaaggcggaagccgaaaagatcaaagcagcactggaggcgacacaacaggaagttaagctccgaatgacaggcatggcactgcgcgtcgtccggactgatggcattttggcactgtactcaggtctgtccgccagcctgtgccggcagatgacctactccctcacaagattcgctatttacgagacagtcagggacagggtcgcaaaaggcagccagggaccactgccgttccatgaaaaggtcctgctcgggtcagtcagcggcctggcaggagggtttgtcggcaccccagctgacttggtgaacgtcaggatgcagaatgacgtaaaattgccccagggacagcggcgtaactacgctcacgctcttgacggcctttatcgagttgcaagagaagaagggctgcggcgactgttttctggagccacaatggcaagcagtcgcggtgcactggttacggttggccagctgtcctgctatgaccaggcaaagcagctggtgctgagtacagggtacctgtccgataacatatttactcacttcgtggcctcattcatcgccgggggttgcgctactttcctttgtcagcccctggatgtgctcaagacaaggttgatgaactcaaagggggaatatcagggcgtatttcactgtgccgtggaaacagccaaattaggtcccctggcattttacaagggactggtgcctgctgggattagactgattccccacaccgttctcacgtttgtgtttcttgagcaactgcgcaaaaacttcggcatcaaggtcccctcctag

SEQ ID NO: 124488 - DNA, 735 bp, Artificial Sequence
  Description of Artificial Sequence: Synthetic coding sequence
atgacaggcatggcattgcgggttgtccgaactgatggaattctcgctctgtattctggtctgtctgcctccttatgccgccaaatgacatattccctgacccggttcgccatctacgaaaccgtgcgagatagagtagcgaaaggctctcagggtccattgcccttccacgagaaggtattattgggttcagtgtcaggtctggctgggggatttgtcggtacccctgctgacttagtgaatgtgcggatgcagaacgacgtgaagcttccccagggccagcgaaggaattatgcccatgctctcgatggattatacagagtcgcccgggaagagggcttgagaaggctgttcagtggtgcaaccatggccagcagtcgaggtgccctagtaactgtggggcaattgtcttgctacgaccaagccaagcagttagttctgtctaccggatatttgtccgataatatcttcactcattttgtggccagcttcatcgctggcggctgcgctaccttcctctgtcagccgcttgacgtgctgaagacccgccttatgaacagtaaaggagagtatcagggtgtgtttcattgtgctgtggagaccgccaagctgggtcctctggcattctataagggattggtgccagccggcattcgtctgatcccacacactgtcctaaccttcgtgtttctcgaacagctgagaaagaattttgggattaaagttccatcttag

SEQ ID NO: 124489 - DNA, 438 bp, Artificial Sequence
  Description of Artificial Sequence: Synthetic coding sequence
atggcctttttcacgggcctctggggacctttcacctgcgttagtcgggtgctgtcccaccactgcttttcaaccacgggatctttgtctgctatccagaagatgacccgggtccgggttgtagacaattctgccctgggcaattcgccctaccacagggcccccagatgcattcatgtgtataaaaagaatggggtaggcaaagtgggtgatcagatccttctagctataaagggtcagaaaaagaaggcgctcatcgttggacactgtatgccggggcccagaatgacgcctaggttcgactccaataacgttgtgctcattgaggacaatgggaatcctgtgggcacaagaattaagacacctatcccaactagcctgaggaaacgtgagggggagtactcaaaagtgctggcgattgcccaaaactttgtatag

SEQ ID NO: 124490 - DNA, 891 bp, Artificial Sequence
  Description of Artificial Sequence: Synthetic coding sequence
atggccgggccgctgcaggggggtggcgctcgggccctcgatctacttcgcggcctcccccgcgtgtcgctcgccaaccttaaacccaatcccggaagtaagaaaccagagcggaggcctcggggacggcggcgggggcgcaaatgcgggcgcgggcacaagggggaaagacagaggggcacccgcccccgccttggcttcgagggggggcagactcccttttacattcgcatccctaagtatggctttaatgaggggcattcattcagacggcagtacaagcccctatcactgaaccgactacagtatctcattgatctgggacgcgtcgacccatcacaacccatcgacctgacacagctagtgaatggaaggggggtgacaattcagccactcaaacgcgattatggcgtccagctggtggaggagggcgcggatacatttactgctaaagttaacatagaggttcagctcgcaagcgaattggctattgctgctatcgaaaagaacggaggggtggttaccactgcattctacgacccccgatccctggatattgtctgcaagccagtaccatttttcttgcggggccagcccataccgaaaagaatgctgccaccagaggagctggtgccatattatacagatgccaagaaccgcggataccttgctgaccccgccaagtttccagaggcccggttggaactcgccaggaagtacgggtacatcctgcctgatataaccaaggatgaactgttcaaaatgctgtgtactagaaaagatcctcgccaaatcttttttggactagctcccggttgggtagttaacatggctgacaaaaagatcctcaagcccaccgatgaaaacctgctgaagtattacacatcctag

SEQ ID NO: 124491 - DNA, 756 bp, Artificial Sequence
  Description of Artificial Sequence: Synthetic coding sequence
atgtggagactgctagcaagggcctccgccccactgctgcgcgtcccactgtcagactcatgggcactgctgcccgctagtgccggagtgaaaaccctgctaccagtcccttccttcgaggatgtctcaattccagagaagcctaagctccggttcatcgagagagctccactggttccaaaagtgagacgagaacccaagaacctgagcgacattcgcggtccaagtacggaggcaaccgaattcacagaggggaatttcgccattctggcactgggcgggggctacctgcactggggtcattttgagatgatgcgccttacgattaaccgatccatggaccccaagaatatgtttgctatctggcgggttccggcccccttcaaacccatcacgcgtaagagtgtcggacatagaatgggggggggcaagggggctatagaccattacgtgaccccggtgaaggccgggcgcctggttgtggagatgggcggacggtgtgaatttgaagaagtccaaggttttttggaccaggtagctcataagttgccgttcgcagctaaggccgtcagccgcgggaccttagaaaaaatgcggaaagaccaggaagagcgggagaggaacaaccaaaatccatggacctttgagcggatagccaccgccaatatgctagggatacggaaggtcctgtccccttatgatctcactcataagggaaaatactggggcaagttctatatgcccaaacgtgtgtag

SEQ ID NO: 124492 - DNA, 528 bp, Artificial Sequence
  Description of Artificial Sequence: Synthetic coding sequence
atgaggttaagcgtggccgcggcgattagccatggaagggtgttcaggcgaatggggctcggtccagaatcgcggatacatcttctccgaaacctcctcacgggcctggtgcggcacgagaggattgaggccccttgggctcgcgtggacgagatgagaggttacgctgagaagctgatcgactacggaaaactgggcgacacaaacgaacgcgccatgcgaatggccgacttttggttgaccgagaaagacctgatacccaaacttttccaggtccttgcaccgagatataaggaccagactggcggttacaccagaatgctgcagatcccaaaccggagcctggatcgggccaaaatggccgtgatcgagtataaggggaactgcctgcctcccctaccattacctcgtagagattcgcatttgaccttactcaatcagctgttacagggactgagacaggacctcagacagagccaggaagcaagtaatcattcatcccataccgcccagacccccggaatctag

SEQ ID NO: 124493 - DNA, 543 bp, Artificial Sequence
  Description of Artificial Sequence: Synthetic coding sequence
atggctctacgcagtcggttttggggcctgttttctgtttgcaggaatcctgggtgtcgatttgccgcgttgtcaacaagtagtgaacctgccgccaaaccagaggtcgacccagttgagaatgaagcagtggcacccgagtttaccaaccggaacccccggaacctcgagctcctgagcgttgccaggaaagagcggggatggaggaccgtgtttccaagtagggaattttggcataggctcagggtgattcgaacacaacaccatgtggaggctcttgtcgagcatcaaaatggtaaagtggtggtgtctgccagcaccagagagtgggctataaaaaagcacctatactccaccagaaacgtggtcgcctgcgagtcgatcggtagggtgctcgcccagcgctgcctggaggccggaatcaattttatggtttaccagcccactccatgggaggctgcttctgactcaatgaaaaggttgcagtcggctatgaccgaaggcggcgtagtcctccgtgaaccccagaggatttacgaatag

SEQ ID NO: 124494 - DNA, 879 bp, Artificial Sequence
  Description of Artificial Sequence: Synthetic coding sequence
atggcggcctgtatcgctgctgggcactgggcggccatggggctggggcgaagctttcaggctgcccgcaccttacttcctccacctgcttccatcgcgtgtcgtgtccacgcaggtccagtccgacagcagagtacaggaccttccgagccgggggccttccaaccaccccccaagccagtcattgtcgataaacatcggcccgttgaacctgagcggcgattcctgagtcctgagtttattccccgaaggggccgcactgatcctctgaagttccaaattgagaggaaggatatgctggagagaaggaaagtactgcacattcccgagttttatgtcggatcaatcctgagggtcacaacagctgacccttatgcttcaggcaagatatctcagtttttaggcatttgcatccagaggtcaggaaggggactgggtgccacttttatcctccgaaatgtgatcgaaggtcagggagtggagatctgctttgagctctacaacccccgggttcaggaaatccaggtcgtgaagctcgaaaagagactggacgactctcttctgtatctgcgggatgccttgcccgaatactctacgtttgatgtgaatatgaagccagttgtccaggagccgaatcagaaagttcccgtgaatgaactcaaagtgaaaatgaagcctaagccatggagtaagcgctgggaacgtcccaatttcaatatcaagggcatccggttcgatttgtgcctgactgaacagcagatgaaagaggcacagaagtggaaccagccctggctcgagtttgatatgatgcgggaatacgataccagtaaaattgaagccgcaatctggaaggaaattgaggcctcgaaaagatcatag

SEQ ID NO: 124495 - DNA, 879 bp, Artificial Sequence
  Description of Artificial Sequence: Synthetic coding sequence
atggcagcctgtatcgcggccggccactgggctgccatgggcttgggccgctcttttcaagcagctaggacactgctgccaccacccgcctccatcgcttgccgggttcatgccgggcctgtgcggcagcagtctactggccctagcgagccgggagccttccagccccccccaaagccggtcattgtggataaacatcggcctgtggaacccgaaagacggtttctgtccccggagttcattccccgacgcgggaggacggacccattaaaatttcagatcgagagaaaagatatgctggaacggaggaaggtgttacatatcccggaattctatgtggggagtatcctccgtgtgaccaccgctgacccttacgccagcgggaaaatctcccaattcctggggatttgtatccaacgctcaggaaggggcctgggggcaacgtttatcctcaggaatgttatcgagggacagggggtggaaatctgcttcgaactgtataacccaagagttcaggaaatacaggtggttaagctggaaaaacgcttggatgatagtttgctatacctgcgcgacgctctcccagaatactctaccttcgacgtcaacatgaaacccgtcgtacaagagccaaatcagaaagtgcctgtgaacgagctgaaggtgaagatgaaaccaaagccttggagcaaaaggtgggagaggcccaacttcaatataaaggggatccggttcgatctttgccttacggagcagcagatgaaggaagcacagaagtggaatcaaccctggctcgaatttgatatgatgcgtgaatatgatacaagtaagatcgaagccgcgatctggaaggagatagaggccagcaagagaagctag

SEQ ID NO: 124496 - DNA, 240 bp, Artificial Sequence
  Description of Artificial Sequence: Synthetic coding sequence
aaagtaccagtgaacgaactaaaagttaagatgaaacccaaaccctggtctaaaaggtgggaacgcccgaactttaacataaagggaattcggttcgatttgtgcctaactgagcaacagatgaaggaagcccagaaatggaaccagccctggctggagttcgacatgatgcgtgagtacgacacttctaaaatcgaagccgcaatatggaaggaaattgaagcctccaaaagatcatag

SEQ ID NO: 124497 - DNA, 918 bp, Artificial Sequence
  Description of Artificial Sequence: Synthetic coding sequence
atggcgctgtgcgcactgactagagcccttcgcagcctcaatctcgcgcctcccaccgtggccgctcctgcgccgagtctattccccgccgcacaaatgatgaacaacggccttctgcaacaaccatcagcactgatgctgctgccttgtcgcccagtattaaccagtgtggcgttaaatgccaacttcgtgagctggaagagtcgcacgaaatatactattacacctgttaagatgcgcaagtcagggggtcgcgatcataccggcagaattagagttcacggaattgggggcggccacaaacagcggtaccgaatgattgactttctcagatttaggcccgaagagactaagtctggtccattcgaggagaaggttatccaggtgagatatgatccatgtagatctgcagatattgcactggtagccggaggttcacgaaaaagatggatcatcgccacggagaatatgcaggctggcgatacaatactaaactcaaaccatataggacggatggcagtggccgcccgagagggagacgcccaccctctcggcgctcttccagtgggcacactgatcaacaacgtggaaagcgagcccggacgtggtgctcagtacatccgggctgcaggaacatgtggcgttttgctgagaaaggtaaacggcacagcgatcatccagctgcctagcaaaagacaaatgcaggttctggagacctgcgtggccaccgttgggcgggtgagcaacgtcgaccacaacaaaagagttattggtaaagctggccgcaaccgatggcttgggaaaagaccgaatagtggccgctggcacagaaagggcggctgggcgggacgcaaaatccggccgcttcctccaatgaaaagctatgtgaagttgcctagtgcatccgcccagtcctag

SEQ ID NO: 124498 - DNA, 450 bp, Artificial Sequence
  Description of Artificial Sequence: Synthetic coding sequence
atggtattcctcaccgcacagctgtggttgcggaatcgggtcacagacagatattttagaattcaggaagttctgaagcacgccagacactttcgcggacggaaaaatcgatgctacaggctcgcagtgcggactgtgatcagggctttcgtgaaatgcaccaaggcgcgttatcttaaaaaaaagaatatgcggactctctggatcaatcgcatcaccgccgcatcacaggaacacggtttgaagtaccccgctctgataggaaaccttgttaagtgccaggtggagctgaatagaaaggtgttggctgatctcgccatctacgagcccaagacgtttaagtccctggctgctttggcctctcgacggcgtcacgaagggtttgctgcggctctcggggacggcaaggagcccgaaggtattttcagcagagtggttcagtatcattag

SEQ ID NO: 124499 - DNA, 618 bp, Artificial Sequence
  Description of Artificial Sequence: Synthetic coding sequence
atggccgccagctctctgaccgtgacactgggtcgtctcgcaagcgcttgttctcactccatcctgagaccatcaggaccaggagcagcttctctgtggagcgccagccgaagattcaacagtcaaagcacctcttacttaccaggatatgtccccaagacatccctgagtagcccaccttggcccgaggtcgtcctgccagatcccgtggaggagactagacaccacgccgaggtggtgaagaaagtgaacgaaatgatcgttaccggccagtacgggcggctgttcgccgtggttcacttcgcctcacgacaatggaaggtgacctctgaggatttgattctcattggcaatgagctagatctggcctgtggggaaagaatccggctagaaaaggttctgctagtgggtgccgacaatttcactcttctcggaaagcccctcctgggcaaagacctcgttagggtggaagccacagtgatcgaaaagacagagagctggccaaggatcatcatgcggttccggaagaggaaaaattttaaaaagaagcgtattgtcactacaccccagaccgtcctgaggataaattccattgagatcgctccctgtcttctgtag

SEQ ID NO: 124500 - DNA, 843 bp, Artificial Sequence
  Description of Artificial Sequence: Synthetic coding sequence
atggccgcgtctagcttgactgtgacgctgggaaggctggcatcagcctgctcccactccatactgaggccctctggtcctggtgccgcaagtctgtggtctgcttcccggagattcaatagccagagcacatcttacctccccggttacgtcccaaagactagtttatctagtcccccatggcccgaggtggtcctgcccgacccagtcgaagagacccgccaccacgccgaagtggtgaagaaggtgaacgaaatgatcgtgacagggcagtatgggcgcctttttgccgtcgtgcacttcgcaagcaggcagtggaaagtgacctcagaagatttgatactgatcgggaatgagttggatctggcttgtggggaacggatccggttggagaaagtgctactggtcggagctgataacttcaccctgttaggaaagccgttgctcggtaaagatcttgtgagagtggaggccaccgtgatcgagaaaacagagtcctggccccggatcataatgcgcttcagaaaacgcaagaacttcaagaaaaagcggtctaaattagagaaggttcctttgggccctgtggcgaggtgttggctgccgcggcgcatgagaacggagggcgtgggccatgtggggcttggcactggctcaccaggaaggtcccagcctggatgtcattgcccactggctactcttattctggaaggagcaccgagaggtagcagcctcgctcctttattactgcacgctcccagggtcacaccccctagatctcctagcccccctcgatccgctagggatccaacctccctgcccttttctagcacactccgggcttag

SEQ ID NO: 124501 - DNA, 363 bp, Artificial Sequence
  Description of Artificial Sequence: Synthetic coding sequence
atgattgttactggccagtacggaagactgtttgcagtcgtacatttcgccagccgccagtggaaagtgaccagtgaagacctcatcctgattgggaacgagctggatcttgcctgcggcgaaaggatacggctggagaaggttctgctagtgggcgctgacaactttacactgctgggaaagccactgcttggcaaggatttggtgcgggtcgaggccactgtgattgagaaaaccgagagttggcccaggataattatgagattcagaaaaaggaagaatttcaagaaaaagcgcatcgtgacaaccccacaaaccgtcctgcgcatcaactctattgaaattgccccatgcctgctgtag

SEQ ID NO: 124502 - DNA, 381 bp, Artificial Sequence
  Description of Artificial Sequence: Synthetic coding sequence
atgtggtatcttgccaaactaatccgaggaatgtccatcgaccaggctctggcccaattggagtttaacgacaagaagggtgccaagattatcaaagaagttctccttgaggcacaggacatggcggttcgggaccacaatgtggagttccggagcaatctgtacattgcggaaagcaccagcggtagagggcagtgcctgaaacggatccgctatcatgggcgcggaagatttggcatcatggagaaagtgtactgccactactttgtcaaactcgtcgaaggcccacccccacctcctgaaccccctaagaccgctgttgcccacgccaaggagtatattcaacagctgcggtctcggactatagtgcatacattgtag

SEQ ID NO: 124503 - DNA, 699 bp, Artificial Sequence
  Description of Artificial Sequence: Synthetic coding sequence
atggccgccgccgtcctaggccagcttggtaaagacttcctggtcgttaaaagacaaaaaggcgtggagatggagtccgagctcactgcgtgtgttgatgtggcaggggcactgtggattcacaacctgaggagccgcgggaaactggctctcggcgtcttgccacagtcttatatccacaccagcgcaagcctggatatcagcagaaaatgggaaaagaagaataagatagtgtatcctccccagctcccaggggaacctcggcggcccgccgagatctatcattgcagaagacagatcaaatattcgaaagacaagatgtggtatctcgccaagctcatcagagggatgtctatcgatcaggcactggctcaacttgagtttaatgacaagaagggggcaaaaatcatcaaagaggtgctcctcgaagcgcaggatatggctgttagggaccacaacgtggaattccgctcaaacctgtacatcgccgaatctacgagcggaaggggtcagtgcctgaagagaatacgctatcatggcaggggtcgatttgggattatggagaaggtttactgccactatttcgtgaaacttgttgagggaccccctccgcctccagaacctcctaagacagccgtggcacatgccaaggaatatatacaacaacttcggtcgagaacaatcgtgcacaccctgtag

SEQ ID NO: 124504 - DNA, 639 bp, Artificial Sequence
  Description of Artificial Sequence: Synthetic coding sequence
atggctgcagctgtgctgggccagctcggggccctctggatccataacttgagaagtcgtgggaagctagccctgggactgcttagcttccacagcgtcctgccacaaagctatatacatacctctgcttctctggacatttcccgtaagtgggaaaaaaaaaacaaaatcgtttacccacctcagctgcccggagagccaaggcgccctgccgaaatttatcattgtcgtcggcagatcaagtattctaaagataagatgtggtatcttgccaagctaattaggggaatgtcaattgatcaggctctagcccagctggagttcaacgataaaaaaggcgctaagatcattaaggaggttctgctcgaagcacaggacatggcggtgagagatcacaatgttgagtttcgctccaacttatacattgctgagagtaccagtgggcgtgggcagtgcctcaagaggatccgttaccacggtcgtgggcgttttggaattatggagaaggtctattgccattacttcgtgaagttggtggagggacctcctccccctcccgagccgcctaagaccgcagtcgcccatgctaaagagtatatccagcagctccggtccagaactatcgttcatacactctag

SEQ ID NO: 124505 - DNA, 621 bp, Artificial Sequence
  Description of Artificial Sequence: Synthetic coding sequence
atggctgcggccgtgttaggccagctcggcgccctgtggatccataatctccggagccgcggaaaactagctttgggcgtcctgcctcagtcctacatacacaccagtgcatcccttgacatctcccggaagtgggaaaagaagaacaagatcgtgtaccctcctcaactgccgggtgagcctaggaggcccgcagaaatataccactgtcggagacagatcaagtattcaaaggataagatgtggtaccttgctaagctgatcaggggcatgagcatagatcaagcacttgcgcagctggaatttaatgataagaaaggcgcaaaaatcatcaaagaagtgctattggaagcccaggatatggctgtgagagaccacaatgtagagtttagaagcaacctgtacatcgctgagtcaacaagcggccgtggtcagtgtctcaagcgcatcaggtatcatggccgcggccgttttggaatcatggagaaggtttattgccactactttgtgaaactggttgagggacccccaccaccacctgaacctcctaagacagctgttgcccatgccaaagagtacattcagcaattacgcagccgaactattgttcataccctctag

SEQ ID NO: 124506 - DNA, 462 bp, Artificial Sequence
  Description of Artificial Sequence: Synthetic coding sequence
atggcacggaacgtggtgtatcccctctacagactcggcgggccccagctccgggtttttaggaccaatttcttcattcagctcgtgcggccgggtgtggcacagcctgaggataccgtgcagtttcgaatccccatggaaatgacacgagtagacctgaggaattatctagaaggaatttacaatgttccagtcgccgcagtaagaaccagagttcagcatgggtcgaataagcgacgggaccataggaatgttagaatcaaaaagcctgattataaggtggcatacgtgcaactcgctcatgggcagacattcacattccctgacctgtttcctgaaaaggatgagtccccagaaggcagtgctgctgacgatctgtactcaatgctggaggaggagaggcagcagcgtcaatctagcgacccccggaggggaggtgtgccatcctggttcgggctatag

SEQ ID NO: 124507 - DNA, 462 bp, Artificial Sequence
  Description of Artificial Sequence: Synthetic coding sequence
atggcacgcaatgtggtgtaccccctttacagactgggcggtccacagcttagagtgtttagaaccaactttttcattcagctggttcgacccggagtcgcccagccggaggataccgtccagtttagaatccccatggagatgacccgggtggacctgagaaattaccttgagggcatctacaatgtgcccgtggcagccgtgcgcacccgcgttcaacacggatccaacaagagaagagatcaccgcaatgtgcggatcaaaaagccggattacaaagtcgcatatgtgcagctcgcacacggtcaaacctttacttttcctgatctgtttcccgagaaagatgagagccctgagggctccgcagccgacgatctttattccatgctggaagaggagcgccagcagcgtcagtcatcagatccaagacggggaggtgtgccttcttggtttggattatag

SEQ ID NO: 124508 - DNA, 651 bp, Artificial Sequence
  Description of Artificial Sequence: Synthetic coding sequence
atgcgactgagcgccctgctggcattagcctccaaggtgactttgcccccacattaccggtatgggatgagtccgcccggttctgttgccgataagagaaaaaaccccccatggattcgacgcagaccggtagtcgtcgaaccaatatcagacgaagattggtatcttttctgcggcgatactgtggagatcttagagggcaaggatgctggaaagcagggaaaggtggtccaggtgatccgacagcgaaactgggtggtggttggaggtttgaacacccattataggtatattggcaaaaccatggactatcgaggtacgatgatcccctccgaggctccattgctgcaccggcaggtgaaattggtcgacccaatggaccgcaaacccaccgaaattgagtggagatttaccgaggcgggcgaaagggttcgagtgagtaccaggtccggacgcattatacccaagccagaattcccacgggcagacggcatcgtgcccgagacttggatcgacgggcccaaggacacgagcgtagaggacgccctggagagaacctatgtgccttgcctcaagaccctccaagaggaagtcatggaggccatgggtataaaagagacccgtaaatacaagaaagtttattggtactag

SEQ ID NO: 124509 - DNA, 651 bp, Artificial Sequence
  Description of Artificial Sequence: Synthetic coding sequence
atgcgtctgtccgccctcttggccttggcgtccaaggttaccctaccacctcattatcggtacggaatgtctcctccaggatccgttgccgacaagagaaagaaccctccttggatcaggcggagacccgtggtagttgagccgatctcagatgaggactggtacctgttctgtggtgacacagtggaaatcctggaaggcaaggacgctgggaagcagggcaaggtggttcaggttattagacaacggaattgggtggttgtgggggggctgaatactcattataggtatatcggtaaaactatggattatcgaggaaccatgattccaagcgaagccccacttctgcatcggcaagtaaagttggttgatccaatggatcgcaaacccacagaaatcgaatggaggttcactgaggcgggggagagagtacgtgtctcgaccaggagtggccggattataccaaaaccagagttccccagggcagatggtatcgtgcccgagacttggatcgacggaccaaaagacacatcagttgaagatgcactggagcgaacctacgtgccctgtctgaagacgctgcaggaagaagttatggaggcaatggggatcaaggagacacgtaagtacaagaaagtatactggtactag

SEQ ID NO: 124510 - DNA, 300 bp, Artificial Sequence
  Description of Artificial Sequence: Synthetic coding sequence
atgcggttatctgccttgctggccctggcttctaaagtaactctgcccccccattataggtatggaatgagccctccaggatctgtggctgataagcgaaagaatcctccctggatccgacggaggcccgtggtcgtggaaccaatttcagacgaggattggtacctgttttgcggcgacactgttgagatactggagggaaaagatgccggtaagcagggtaaagtggtgcaagtcatacggcaaagaaactgggtcgttgtcggaggcctgaatacacactacagatatatcggatag

SEQ ID NO: 124511 - DNA, 207 bp, Artificial Sequence
  Description of Artificial Sequence: Synthetic coding sequence
atgcggctttcagcacttctggcccttgctagtaaagtgactctccctccccactatagatatgggatgagccctccaggaagcgtggcagacaagcgcaaaaacccaccctggattagaaggcggccggttgttgttgagccgattagtgatgaagattggtacctgttttgtggggacaccgtggagatactggaaggtaaatag

SEQ ID NO: 124512 - DNA, 522 bp, Artificial Sequence
  Description of Artificial Sequence: Synthetic coding sequence
atgagactgtccgctttgctggcactggcttccaaagttaccctgcccccccattacaggtatggtatgtctccgccaggcagtgtagccgacaagcggaaaaaccccccgtggatcagaagaagaccagtcgtggtggagcctattagcgacgaggattggtacctgttctgcggagacaccgtggaaatcttagagggaaaggatgccggtaagcaaggaaaagtggttcaggttatccgtcagcggaattgggtggtagtcggagggcttaacacccattatcgctatatcggaaagaccatggactacaggggcactatgatcccctctgaggctccgctgcttcatagacaggtgaagcttgtggatcctatggaccggaaacctaccgagatcgagtggaggttcaccgaagctggagaacgagtgcgagtctcaacccgctcgggcaggattatccctaagccagagtttcccagggccgacggaatcgtgcctgaaacctggattgacggctag

SEQ ID NO: 124513 - DNA, 4395 bp, Artificial Sequence
  Description of Artificial Sequence: Synthetic coding sequence
atgttctcgttcgtggaccttcgcctgctcctgcttctggccgctactgccctgctcacacatggacaagaagagggacaggtcgaaggccaggacgaggacatcccgcccatcacctgcgtccagaatggacttaggtaccatgacagagacgtgtggaagcccgaaccctgccggatctgtgtatgtgacaacggcaaagtgctgtgtgatgacgttatttgcgacgaaacaaaaaactgtcctggggcagaggtaccggaaggagagtgctgccccgtctgccccgacgggtcagaaagccctaccgatcaagagacaaccggggtagagggaccgaaaggcgacaccgggcctagggggcctagggggcccgcgggaccccctggacgtgatgggattcccggacagcccggcctgccgggaccacccggtccccccggaccgcccggtcctcccgggttgggaggaaatttcgccccccagctgagttatgggtacgacgaaaaaagcacggggggaatcagtgttcctgggcctatgggcccctccggccctagaggtctgcccgggccccccggggcgccgggaccccagggattccaaggccctccaggcgagcccggcgagcctggggcttctggaccaatgggccctagaggcccacctggaccaccagggaaaaatggggacgacggagaagccggcaagcctggcagacccggcgagaggggccccccagggccccagggcgcccgcggactccccgggactgctgggctgccggggatgaagggacatcggggattttccggtttggatggagccaagggtgacgcaggcccggctgggcccaagggtgagccggggtcacctggcgagaatggggcacccggccaaatgggaccacggggactgcctggggagcgtgggaggcctggcgctcctggacccgctggggcccggggaaatgacggggcaaccggagccgccggacctccgggcccaaccgggcccgccgggccacccggctttcctggagccgttggtgcgaagggggaagcaggacctcaagggccgcgcgggtccgaggggccgcaaggcgtccggggggagcctggaccaccaggccccgccggcgcggctgggcccgctggcaacccaggggctgatgggcagcccggggcaaaaggggccaatggcgcccccggaatcgctggagcaccgggattccctggcgcacgaggcccctcagggccccagggtccaggggggccacccgggcccaaagggaattccggagaaccaggagctccaggctccaaaggtgataccggcgccaaaggtgagcccggaccagttggcgtgcagggcccccccggcccagccggggaagaaggaaagcgcggcgctagaggggaacccggccccacaggcctccctggtccaccaggggaacgcggcggacccggttctcggggattccctggggcagacggtgttgctgggcccaaaggaccagcaggagagcggggctcacctgggcctgccggtcccaagggcagccccggcgaggcagggagacccggtgaggccggtttgcctggggcaaagggattgactggatcacctggctccccagggcctgacgggaaaacagggccacccggacctgctgggcaggatggccgtccgggtccacctggtcctccaggcgcacgcggacaagcgggggtcatggggtttccagggccaaagggcgctgctggcgaacccgggaaggcgggggagaggggcgtgccaggccctcccggcgctgtgggccctgcaggcaaagatggcgaagccggggcccaaggacccccagggccagccgggccagctggagaaaggggagagcaagggccagctggaagtcccggcttccagggcctgcccgggccagctggaccaccaggtgaagctggcaagccgggcgagcagggggtgcctggcgaccttggcgcccctggtccctccggggctaggggcgagcgtggattcccgggtgaacggggagtacaaggaccgcccggtcccgccgggccccgcggggcaaatggagccccgggcaatgacggagccaaaggcgatgccggcgctcccggggcacctggtagccagggggcccctggcctgcaggggatgcccggtgagcgtggggccgctggcttgcctggtcccaagggagatagaggagacgccggaccaaagggcgctgacggatctcccggcaaggacggagtgagagggctgacgggcccaatcggcccacccgggccagctggagctcccggtgataaaggggagtccggtccttcgggaccagcaggtccaaccggcgctcggggagcaccaggggatagaggcgaacccggcccacccggacctgctggctttgctggcccacctggtgccgacggacagcctggagccaaaggggagcctggcgacgctggcgccaagggcgacgcaggtccacccggcccagctgggcctgccggtccaccagggcctatcgggaacgtaggggctccaggagccaagggcgcacggggctcagctgggccgccaggcgccactggattccctggcgccgcaggacgggtaggaccacctggcccctcaggaaatgccggccccccaggcccacctggaccagctgggaaggagggcggcaaaggacctcggggcgaaacaggaccagccgggcgccccggggaggttgggccgccgggtcccccaggacccgcaggcgagaaagggagcccaggcgcggacgggcctgccggcgcacccggaacaccaggccctcaaggcatagctggccaaagaggagtggttggccttcctggacagagaggcgaacgcggattccctggcctgcctggcccctccggtgagcctggaaagcagggaccatctggagcatccggcgagcggggccctccgggtcccatgggtcctccagggctggctggaccgcccggcgagagcggtagggagggggcacccggagctgagggatccccaggaagggacgggagcccaggcgctaaaggcgaccgcggtgaaactggacccgcgggaccaccaggagctccaggagcaccaggggcgcctggacccgttggaccggcggggaagtctggtgataggggcgaaacaggcccagccggccctacaggaccagtgggccctgtgggggcgagggggcctgccgggccccaaggccctcgtggagacaagggcgagacaggcgagcagggcgacaggggcattaaaggccacaggggttttagcggtttgcagggccctccaggcccacccggcagccccggagaacagggccccagcggcgcctccggtccggctggccccaggggaccgcctgggagcgccggcgctcctggaaaggacggcctcaatggtttgccaggcccgattggccctccaggtccccgaggccgtacaggggacgctggccccgtcgggcccccagggcctcctggccctcctggaccgcccggaccacccagtgccggtttcgatttcagttttctaccccaaccaccccaggaaaaggcacatgacggaggccggtactacagggccgatgatgccaatgtggtcagagacagagacctcgaggtggatacgacactcaagagtctgagccaacaaatcgaaaatatccgctcacccgaagggtccagaaagaatcctgcgcgtacctgcagggatttgaagatgtgtcattctgactggaaaagcggggagtactggatcgaccccaatcaaggttgcaacctcgatgcaatcaaggttttttgcaacatggagaccggggagacctgtgtgtacccaactcagcccagtgtggcccagaaaaattggtatatctcaaagaatcccaaggataagaggcatgtgtggtttggcgaatctatgactgacggcttccagttcgagtacgggggacaagggtccgaccccgctgacgtcgcaatccaactgactttcttgcggcttatgtcgaccgaggcatcacaaaacatcacataccattgcaagaattctgtggcttatatggaccagcagaccggtaacttaaagaaggcccttctcctccaaggctcaaacgagatcgaaatcagagctgaaggcaactctcgttttacttatagtgttaccgtggacggttgtactagtcacactggtgcatgggggaagacggtgatagagtataagacgacaaaaaccagtaggttgcccatcatcgatgttgcccccctcgacgtgggagcaccagatcaggagttcggcttcgatgtaggccctgtttgctttctgtag

SEQ ID NO: 124514 - DNA, 285 bp, Artificial Sequence
  Description of Artificial Sequence: Synthetic coding sequence
atggcttcagtggttctggcattgaggactagaactgctgtgacctcactcctctcaccaacaccagccactgctcttgccgtccgatacgcctctaaaaagagcgggggctcaagtaagaacctgggcggaaaatcttccggaaggcgtcagggaattaaaaagatggaaggccattacgtccacgccggaaatatcatcgccacccaacggcattttcgatggcaccccggcgctcatgtgagttgctccgtcgcagctccattgtttccattccttgggtag

SEQ ID NO: 124515 - DNA, 282 bp, Artificial Sequence
  Description of Artificial Sequence: Synthetic coding sequence
atggagggacattacgtccacgccggcaacataattgctacgcaacggcacttcaggtggcaccctggcgcccatgttggcgtcggtaagaacaaatgcctgtacgcgctggaggaggggattgtacgttatactaaggaggtgtacgtgccgcacccacgaaacacagaggctgtggatctgattactcggcttcctaagggggccgtgttatacaagactttcgtgcacgtggtgcctgcaaagcccgaaggcaccttcaagttagtagctatgctgtag

SEQ ID NO: 124516 - DNA, 282 bp, Artificial Sequence
  Description of Artificial Sequence: Synthetic coding sequence
atggaaggccactacgtccacgctggcaacattattgctacacagagacacttcagatggcatccaggagcacacgttggggtcggaaagaacaagtgtctgtatgctctggaagagggaatagtccggtataccaaggaggtgtatgttccccatccacggaatactgaggccgtagacctgattaccaggttacccaaaggggccgtcctttataagacatttgtccatgtagtaccggctaaacctgaggggacgtttaaacttgtggccatgctctag

SEQ ID NO: 124517 - DNA, 771 bp, Artificial Sequence
  Description of Artificial Sequence: Synthetic coding sequence
atgcccctgcataaatatccagtgtggctatggaaacgcctccagcttcgtgagggaatatgttcacgcttgccagggcattatctgcggtctctggaggaagaacggactccgaccccggtccactatcggccgcatggagcaaagttcaaaatcaaccccaaaaacggtcagagggagcgcgtagaggatgtgccaatccctatttattttccccctgaaagccagcggggcctgtgggggggcgagggctggattttgggtcagatttacgccaataacgacaaattaagcaagcggctcaaaaaagtgtggaaaccacaactgtttgagcgggagttttattctgaaatattggacaaaaaatttacagtgacggttacaatgcgcacactcgatctgattgatgaggcctatggcctcgacttttatatcctgaaaaccccgaaggaagatctgtgctctaagttcggcatggatctgaagcgcggtatgctgctccgcctggcccgacaggaccctcagctgcaccctgaagatcccgagaggcgggcagctatttatgacaagtacaaggagtttgccattccagaggaggaagcagagtgggtgggtcttactttagaggaggcaatcgagaaacagcgcctgctggaggaaaaggaccctgtacctctctttaagatctatgtagccgaacttatccagcagttacagcagcaggccctctccgagccagccgttgttcaaaaacgggccagcggacagtag

SEQ ID NO: 124518 - DNA, 771 bp, Artificial Sequence
  Description of Artificial Sequence: Synthetic coding sequence
atgccgctccataaatatccggtctggctgtggaaacggctgcagctcagggagggtatctgctcacgtcttccgggtcattaccttcggtccctcgaagaggaaaggacgcctacaccagtgcactataggcctcacggtgccaaattcaaaattaatcccaagaacggccaacgagagagagtagaggacgtgcccatcccgatttatttccccccagagagccagagggggttatggggtggggagggttggatactggggcagatatatgctaataacgataagctaagtaaaaggctgaaaaaagtgtggaagccacagttattcgaacgggaattctacagcgagatcctcgataaaaagtttaccgtgacagtgacgatgcggacccttgaccttattgatgaggcttacgggctggatttttacatccttaagacgcccaaggaggatctgtgttccaaattcggaatggacctgaagcgcggcatgttactgcggttagcaagacaggacccacagttacatcccgaggaccccgagaggagggccgctatttatgacaaatacaaagagttcgccatccctgaagaggaagctgagtgggttggcctaacgttggaggaggccatagagaaacagcgactactggaggaaaaggacccagtgccgctgtttaaaatatatgtcgccgagctcatccagcagttacagcagcaagcgctgagtgaacctgccgttgtgcagaagcgcgcctctgggcagtag

SEQ ID NO: 124519 - DNA, 771 bp, Artificial Sequence
  Description of Artificial Sequence: Synthetic coding sequence
atgccactgcataagtatcccgtgtggctgtggaaacgcttgcagttacgggagggaatttgcagcaggctccccggacattatctgcgcagcttggaagaagagagaacaccaaccccagtgcattaccggccccacggcgccaagtttaaaataaaccccaagaacgggcaaagagaaagagtggaggatgtccctattcccatctactttcctccggagagccaacgcggactgtggggcggagagggatggatactgggacagatttatgctaataatgataaattatcaaaacggctgaaaaaggtctggaaaccgcagttgttcgagagggagttctactccgagatacttgacaagaaattcacagtgaccgtcactatgcgcaccctcgacctcattgatgaagcttacggcctcgatttttatatcctaaaagcttcaggcgaggacctctgttccaaatttgggatggacctcaagcgcggaatgctgctacggcttgcacgccaggacccacagctgcacccagaggacccggagaggagggccgccatctatgacaagtataaagaatttgcaataccagaagaagaggcggagtgggtcgggctgactctggaggaggcaatcgagaagcagagacttctggaagaaaaggatcctgtccccctgttcaaaatttatgttgccgagctgatccagcaactgcaacagcaagccctttctgagcccgctgttgttcagaagagggcaagtggccagtag

SEQ ID NO: 124520 - DNA, 771 bp, Artificial Sequence
  Description of Artificial Sequence: Synthetic coding sequence
atgcctctgcacaagtatcccgtatggttgtggaaacgcctccaattaagagagggcatatgttctaggctaccagggcattacctgcgtagcctagaagaggaacgtactcccacgcccgtccactataggcctcacggggctaaattcaagattaatcctaaaaatggccaaagggagcgagtggaagatgttccgatccctatctactttccacccgagtcacagcgtggcctttggggtggagagggctggattctgggtcagatttatgccaataacgataagctgtcaaagaggctcaagaaggtatggaagccccagctgtttgagagagaattctacagcgaaatcctggataagaaattcaccgtcaccgttaccatgcgcaccctcgatcttattgacgaggcctacggcctggatttttatattctgaaggcaagtggagaagacctttgttctaaattcgggatggatctgaaacgcggaatgcttttgaggttagccaggcaggatcctcagctgcatcctgaagaccccgagaggagggctgctatctatgataagtataaggagttcgctatccctgaagaggaggcagaatgggtcgggctcactctggaagaagccatcgaaaagcagaggcttttagaagagaaggatccagtaccgctgttcaagatatacgtcgcagagttgattcagcaactgcagcagcaggccctgtcggaacctgcagtcgtgcaaaagagagcctcagggcaatag

SEQ ID NO: 124521 - DNA, 147 bp, Artificial Sequence
  Description of Artificial Sequence: Synthetic coding sequence
atgagccgggctggcggcaggggggagcaaagcagatggggccgcagagccgagctgagggggcttggtaggcctgaagcccctcttaggttggggcccgacgtttgtggtagtgttccctgcgctagaggtgctggctcagaatag

SEQ ID NO: 124522 - DNA, 723 bp, Artificial Sequence
  Description of Artificial Sequence: Synthetic coding sequence
atgccactgcacaagtacccagtgtggctgtggaaacgcctccaactgcgggagggaatctgcagcagactgccgggccactacttgcgtagtctggaggaagagcgcacccctacccccgtacattataggcctcatggggccaagtttaaaattaatcctaaaaacggccagcgcgagagagtagaagacgtcccgatacccatctactttccccctgagagccagcgcggtctgtgggggggggaaggctggatcctgggacaaatctacgccaacaacgacaagctttcaaaacgacttaaaaaggtgtggaagccacaactcttcgagagggagttttacagcgagattctcgacaagaagtttacagtcactgtgacaatgcgcacactggatctaatcgatgaggcgtacggcctcgacttctacatcttgaagacacctaaggaagatctctgctccaaatttggaatggatttgaagaggggaatgctgttacgcctggccagacaggacccccaattgcaccccgaggatcccgagcgaagagctgccatctacgacaagtacaaagagttcgccatacccgaggaagaggccgaatgggtcgggctcaccctcgaagaggctattgaaaagcagaggctcctcgaagagaaggatcctgttcctctgtttaaaatctacgtggcagagctcatccagcaactccagcaatag

SEQ ID NO: 124523 - DNA, 657 bp, Artificial Sequence
  Description of Artificial Sequence: Synthetic coding sequence
atgcctttgcataagtatccggtttggttgtggaagaggctccaactgagagaggggatttgtagcaggctcccaggccattacttacgctccttagaagaggagcggacacccacacccgtccattatcgaccacacggcgccaaatttaagatcaaccctaagaatgggcaacgggaaagagtcgaggacgtgccaattcccatttattttccccccgagagccagagggggctctgggggggggaaggctggattttgggccagatttatgccaataatgataaactgagcaaaagacttaagaaagtctggaagccacagctgtttgagcgagagttctacagcgagattttagacaagaaatttactgtgacagtcacaatgcgcacactggacctcatcgatgaagcctacggactggatttctacattctcaagactccaaaggaggatttatgttctaagtttggaatggacttgaaacgcggaatgctgctgcgtttggccaggcaggacccgcagctccatcccgaagacccagaacgccgcgccgccatttacgataagtataaggaattcgccatcccagaggaggaggctgaatgggtaggtcttacgttggaagaggcgatagaaaagcagaggctgctgtag

SEQ ID NO: 124524 - DNA, 585 bp, Artificial Sequence
  Description of Artificial Sequence: Synthetic coding sequence
atgcccctacacaagtaccccgtttggttgtggaaaagattacagctccgcgaggggatatgttcccgactcccaggccattacctgcggtctctggaggaagagagaacaccaactccggtccactatcggccacacggggctaagtttaaaattaacccgaagaatggtcaacgggaaagagttgaggatgtaccaatccccatttacttccctccagagtctcagagaggcctgtggggaggtgaaggatggatcctgggtcaaatctacgctaacaacgacaagctctctaaaagactgaaaaaggtgtggaaaccgcaactgtttgagcgcgagttctactcggagatactcgacaagaagttcacagtcactgtcactatgagaacattagatctgatcgatgaagcctacggactcgacttttacatcctcaagacccccaaagaagacctctgttctaagttcgggatggaccttaagcgaggaatgttgctacggctcgcccggcaagatccccagctgcacccggaggatccggagagacgggctgccatatatgacaaatataaagagttttag

SEQ ID NO: 124525 - DNA, 1047 bp, Artificial Sequence
  Description of Artificial Sequence: Synthetic coding sequence
atgccaggctggagactgctgacacaggtaggtgcccaggtgctgggcagactgggcgacggactgggtgccgcccttggaccaggaaacaggacccatatctggctttttgtgagaggactacatggcaagagcggcacctggtgggatgaacacttatctgaggagaacgtcccatttattaagcagcttgtgagcgacgaggataaggcgcagcttgcaagtaagctgtgcccacttaaggacgagccatggccaatacacccatgggaacctggcagttttagagtgggcttaatcgcactcaaattggggatgatgcctctgtggacaaaggatgggcagaaacacgtggtcacactgttacaggtccaggactgccacgtcctcaagtataccagtaaagagaactgtaacggcaagatggctacattatctgtaggtggcaaaactgtgagcagatttcggaaggcaacttcgattcttgaattttatagggaactcgggctgccaccaaagcaaactgtgaagatctttaacataacagataatgcggcaatcaaacctggtacaccactatatgcagcacactttcgtccaggacagtacgttgatgtgacagcgaagaccatcggaaaaggatttcaaggcgtgatgaagcgctggggcttcaaaggccaacctgctacacatggacagactaaaacacatagaaggcctggggcagtagctaccggcgatataggacgtgtctggcccggaaccaagatgccagggaagatgggaaatatttatcgaactgagtacgggctgaaagtttggcggataaataccaagcataacattatttatgtgaacggttccgtgcctggacacaaaaactgcctggtgaaagtcaaagattccaagcttcctgcatataaggacctggggaaaaacctgccattccctacatactttccagacggcgacgaagaggagttacctgaagacctctatgacgaaaacgtctgccaacccggagccccttctataacattcgcttag

SEQ ID NO: 124526 - DNA, 1128 bp, Artificial Sequence
  Description of Artificial Sequence: Synthetic coding sequence
atgccagggtggaggttgctgactcaggttggtgctcaagtcctgggacgtctgggagatggtctcggcgccgccctcggacccggtaaccgcgtgacgactaactcgcttaatgtgtctctcattagaaggaacgttggttcggaagagaaagtaggtgatcttaaaaagcgaacacacatttggctatttgtgagggggttgcacggcaagagtggaacttggtgggacgaacatcttagcgaggaaaatgtgcctttcattaagcagctggtgtctgacgaggacaaagctcagctggcttctaagctctgtccacttaaagatgaaccctggcccattcacccttgggagcctgggtcattccgtgtggggcttattgccctcaaactcggcatgatgcccctctggacaaaggatgggcaaaagcatgtagtgacgttgcttcaagttcaggactgccacgtattgaagtatacttcaaaggagaactgcaacggaaaaatggctacactgagtgttggggggaaaactgttagcagattccgcaaggccactagtatccttgagttctatagggagctcggactgccaccgaagcagactgtgaagattttcaacataacagacaatgccgctataaaacctggaacacccctttacgcagcacatttcaggccaggccagtatgtcgacgtgactgcaaaaactataggtaagggttttcaaggagtcatgaagaggtggggcttcaaaggtcagccagctactcacggtcagactaaaacccaccggaggccaggagcagtcgcaacgggtgatatcggacgagtctggccaggaaccaaaatgcccggcaaaatgggcaatatctaccgcacagaatacgggttgaaagtctggagaatcaacacaaagcataatattatctatgtgaacggctcagttccaggccataaaaattgcttggtgaaagtaaaggatagtaagctgccagcctacaaagacttgggcaagaatcttcctttccccacatatttcccagacggcgacgaggaagagttgcctgaggatctatacgatgaaaatgtgtgtcagccgggggctccaagtatcaccttcgcttag

SEQ ID NO: 124527 - DNA, 1092 bp, Artificial Sequence
  Description of Artificial Sequence: Synthetic coding sequence
taattttttccaagtcagagagcctccgctggggacagatcgggagggcactgcgagaactttcccactgctaccgctagtacctggaggtggcgcggagactcactgaaggccgagcgccaaggcgcccgcaagagcactcacatctggctgttcgtcaggggtctgcatggcaagtcgggaacctggtgggacgagcacttgtccgaggagaatgtcccgttcatcaagcagctcgtcagcgacgaagacaaggctcaactagcctctaagctctgtcccttgaaggatgagccctggccaatccatccctgggaacctggcagcttcagagttggcctgatcgcgctgaagctgggcatgatgcccctgtggacaaaggacggccagaagcacgtggttacattgctccaggtccaggattgtcacgtcctcaaatatacctcaaaagaaaactgtaacggtaagatggctacactgtccgttggaggcaaaaccgtgtctcggtttagaaaggccacgtcaatcctggaattttacagggagcttggactgccacctaaacagaccgtcaagatatttaatattaccgacaatgccgccattaaaccaggcactccactctatgcagctcactttcgcccgggccagtacgttgacgtgaccgccaaaacaatcggcaaagggttccagggtgtgatgaaaaggtggggtttcaaaggccagcccgcaactcacggtcagacaaaaacacatagacgcccaggcgcggtggcaacaggtgacatcggaagagtttggcctggcacaaaaatgcccgggaaaatggggaatatttatagaacagagtatgggctgaaggtttggaggatcaacaccaagcacaatattatttacgtgaacggatccgtgcccgggcacaaaaattgcctcgtcaaggttaaggactccaagttgccggcctataaggacctgggaaagaatttgccattccccacttattttcccgatggagacgaggaggaactgcctgaagacctgtatgacgaaaacgtgtgccagccaggtgcaccttcaataacttttgcttag

SEQ ID NO: 124528 - DNA, 486 bp, Artificial Sequence
  Description of Artificial Sequence: Synthetic coding sequence
atggctggcatattgcggctcgttgtccagtggcccccaggcaggctgcagactgtcactaagggagtggaatccttaatttgcacagactggattcggcacaaattcaccaggtcccggatacctgagaaagtgtttcaagcatctcccgaggatcacgagaaatacggaggtgaccctcaaaatccacataaactccacatcgtgacgcggatcaagtctacacgccggagaccttactgggagaaggacatcattaagatgttagggctcgagaaagcacacacaccgcaggtgcataaaaatattccttccgtgaatgccaagctgaaggttgtaaaacacctaatcaggattaagccactgaagttgccccaaggtctccctgcagaggaaaatatgtcaaacacatgtcttaagtctacgggcgagctcgtggtgcagtggcacttaaagcctgtagagcagaaggcacatgaaagttag

SEQ ID NO: 124529 - DNA, 486 bp, Artificial Sequence
  Description of Artificial Sequence: Synthetic coding sequence
atggccgggatcttgagactggttgtgcaatggcctcccgggcgcttgcagactgtcaccaagggtgttgagagtctcatatgcaccgattggattcgtcacaagtttacacgcagtcgaatccctgaaaaggttttccaggccagccctgaagaccatgagaaatacggaggagaccctcagaacccccataagttgcacatagtcactaggattaaatcgaccaggcggcgcccctactgggagaaggatattataaagatgctgggtcttgagaaagcccacaccccacaggtacacaaaaacatcccctccgtgaatgccaagttaaaagtggttaagcaccttatccgaattaaacccctcaagctgccacaggggctacctgcggaggaaaacatgagcaatacctgcctgaaaagcactggagagctcgtagtccagtggcatctcaagcctgtggagcaaaaggcacatgaatcttag

SEQ ID NO: 124530 - DNA, 705 bp, Artificial Sequence
  Description of Artificial Sequence: Synthetic coding sequence
atggccgagcgtggttacagcttcagccttacaacctttagcccatctggtaaactggtccagattgagtatgctctcgcggccgtcgcgggtggggcccccagtgtgggaattaaggcagccaacggtgtggtgctggcgactgagaagaaacaaaaaagcatcctgtacgacgaacgctccgtgcataaagtagagcccatcacgaaacacataggcttggtgtactctggaatgggccctgactacagagtactggtgcatcgggcccgcaagctggctcagcagtattacttggtctatcaggagcccattcctacggcccagctagtccaaagggtggcaagcgtaatgcaggaatatacacagtccggcggtgtgaggcctttcggcgtcagtctgttgatttgcggctggaatgagggcagaccgtacttgtttcagtctgaccctagcggcgcttatttcgcctggaaagccacagcgatggggaaaaactacgtcaatggcaaaacattccttgaaaagagatataacgaggatctggagttagaagatgctatccatactgctatccttacactaaaggaaagctttgagggccagatgactgaggataacattgaggtaggaatttgcaacgaggccggattccggcgccttacacctaccgaagttaaggattacctggccgccatcgcatag

SEQ ID NO: 124531 - DNA, 324 bp, Artificial Sequence
  Description of Artificial Sequence: Synthetic coding sequence
atggcgctcgcaatgctcgtacttgtggtgagcccctggagcgctgctcgcggtgttctgcggaattattgggagaggctcctgcgcaagttaccgcagagccgtcctggcttcccttctcccccctgggggccggccctcgccgtacagggtcccgccatgttcacagaaccagctaacgacacgtctgggtctaaggagaacagttcattgctcgattcaatcttctggatggccgcccccaaaaaccggcggacaatcgaggtcaaccgctgtagaagacgtaatcctcagaaactgataaaagtgaaggtgatgcactag

SEQ ID NO: 124532 - DNA, 279 bp, Artificial Sequence
  Description of Artificial Sequence: Synthetic coding sequence
atggcggttctggccgggtcattgctggggcctacatccaggtctgccgctctgctgggcggaaggtggttgcagcctcgggcttggctggggtttcctgatgcttgggggctgcccaccccccaacaggcccgtgggaaagcgagggggaatgaataccagcctagcaatataaagaggaaaaacaagcacgggtgggtgaggcggctttcaacaccagccggcgtgcaggttatcctgagacgaatgctcaaagggcggaaatctctttcccactag

SEQ ID NO: 124533 - DNA, 513 bp, Artificial Sequence
  Description of Artificial Sequence: Synthetic coding sequence
atggccgcctccgccttcgctggcgctgtacgtgctgccagcggcatcctccgtcccctgaacattctagcctctagcacctatcggaactgtgtaaaaaacgccagtctgataagcgctttgtcaacagggagattttcacatatccagacacccgttgtgtccagtacacctcgactgaccaccagcgaacgcaatctcacttgcggccacacctctgtcatattgaataggatggctcccgtgctgcctagcgttctaaagctgcctgtgagatcccttacttacttctcagcaagaaagggtaaacggaaaacagtcaaagctgtcatagataggtttttaaggctgcattgcgggttatgggttcgacgcaaagccggttacaagaaaaaactgtggaagaagacccctgcccgcaagaagcgcctccgagaatttgtgttctgtaacaagacccagtccaaactgttagacaaaatgacgactagcttctggaaacggagaaactag

SEQ ID NO: 124534 - DNA, 567 bp, Artificial Sequence
  Description of Artificial Sequence: Synthetic coding sequence
atggccgctagcgcgtttgccggtgcagtgcgcgcagcttccggaattcttaggcctttgaacatcctggccagtagcacgtatcgcaattgcgttaaaaacgcaagcttgattagtgctctgtctactggaagattctcacatattcaaactccagttgtgagctctacaccacggctcacaacatcagagagaaatctgacgtgcggacacacctctgtcattctgaaccgcatggctccagtcctcccatcagtgctcaagttacccgtgagatccttaacctacttcagcgccaggaaaggtaaacggaaaactgtgaaagccgtgatcgacaggtttttgaggctgcactgtggactctgggtgaggcggaaggccggttataagaaaaagctgtggaagaaaacacccgcaagaaagaaaagactgagagagttcgtgttttgcaataagacacaatctaagctattggataaaatgaccacgagcttttggaaacgtcgcaattggtatgtagacgatccttaccagaaataccacgaccgcacaaacctcaaagtgtag

SEQ ID NO: 124535 - DNA, 312 bp, Artificial Sequence
  Description of Artificial Sequence: Synthetic coding sequence
atggccaacctctttattcgcaaaatggtaaatcctctgctctacctgagcaggcacactgtgaagccaagggccctttccacttttctctttggcagcatccgaggtgccgctcccgtggccgtggagcctggggccgctgttcgtagtttgctgtcgcccgggctgcttccacacctcctgccagccctcggttttaaaaataagactgtgttaaaaaaacggtgcaaggactgttacctcgtcaaacgcagagggcgatggtacgtgtattgtaagacacatccgaggcacaagcagagacaaatgtag

SEQ ID NO: 124536 - DNA, 312 bp, Artificial Sequence
  Description of Artificial Sequence: Synthetic coding sequence
atggccaatttattcatcagaaagatggttaatcccctgctctatttgtcccgtcacacggtcaaacccagggctttgtccacctttctgttcggctccataagaggcgccgctcctgtggccgtcgaaccaggtgctgctgttcggagcctccttagcccgggacttctgccccacctgctgcccgctttgggattcaaaaacaagacagtgctcaagaagaggtgcaaagattgttatctagtgaagcgtagagggaggtggtacgtatattgcaagacacaccccaggcataaacagaggcagatgtag

SEQ ID NO: 124537 - DNA, 312 bp, Artificial Sequence
  Description of Artificial Sequence: Synthetic coding sequence
atggcgaatctctttattaggaagatggtgaaccccctcctctacttatcccggcacaccgtcaaaccaagggcactgtccactttcttattcggcagcatacgaggggcagccccggtggctgtcgagcccggcgcagccgtgaggtcacttctttcacccggcctcctgccgcacttgttgcccgccttgggattcaagaacaaaaccgtgctgaaaaaacgctgcaaagattgctacctagtaaaaagacgaggccgctggtacgtctactgcaaaacacaccctagacataaacagagacagatgtag

SEQ ID NO: 124538 - DNA, 312 bp, Artificial Sequence
  Description of Artificial Sequence: Synthetic coding sequence
atggcgaacttgtttatccgaaaaatggtgaaccccttgttgtacctatccagacacacagtcaaaccccgcgcgctgagcacgttcctcttcggctctattcgcggcgcagcccctgtggctgtggaacccggggctgcagtaaggtccctcctgagtcctggattgctgcctcacctgcttcccgctctggggttcaagaataagaccgtactgaagaaacgatgtaaggactgctacctggttaaaaggcggggccgctggtacgtttattgcaaaacccatccgagacataaacaacgccagatgtag

SEQ ID NO: 124539 - DNA, 1251 bp, Artificial Sequence
  Description of Artificial Sequence: Synthetic coding sequence
atgcatttcgttccctggctggcccgtcctatctttcccccatgggacaggggctataaggacccacggttctaccgttccccccctttacacgaacaccccctgtataaggatcaggcttgttacatctttcatcaccgatgtcgtttgctggagggcgtgaagcaggctttgtggctcacaaaaactaagctgattgaaggcctcccggagaaagtgctgagcctcgttgacgacccacgtaaccacatcgagaatcaggatgaatgcgtcctgaacgtcatcagtcacgcccggctctggcagacaacagaggagatccccaagcgcgagacatactgccccgtaatcgtcgacaatcttatccaactgtgtaaaagtcagatcctcaagcacccttcccttgccagaagaatatgcgtccagaattctaccttcagtgccacttggaatagggagtccctgcttctacaggtgcgaggaagcggcggagcccgactgtccacaaaagatcctttaccaaccatagcctcccgagaggagatcgaagccacaaagaaccatgtgctcgaaacattttatccaatttcgccaattattgacctccatgaatgcaatatctacgatgtgaaaaacgacacaggttttcaggagggatacccatatccttaccctcacacactttacctacttgacaaggcgaatctccgtcctcatagacttcagcccgaccagctgcgcgccaagatgatattgtttgcctttggaagtgccctggctcaggctagacttctttacgggaacgatgcaaaagtactggagcagccagtcgtagtgcagagcgttggaacagacggtcgcgtgttccatttcctggtgtttcagctaaatactaccgatcttgactgtaacgaaggagttaagaatctggcgtgggttgatagcgaccagttgctgtaccaacacttctggtgtctccccgtaatcaaaaaacgggtggttgttacggggccttgttttagcaagagccagatgtcaaccagtttcgtgctgacaccatcctttaacgctggcgaagaagtgatgcagagaaacctccgcgccagtgcgagtttgcctcctagcaccggatctccggccagtgagctggtcaaggagcaggaacacgccgcaggccgggttctcagaagggtcatgttggactcagaaaccccaagggaagaactccctgctgcagacttctggaagtag

SEQ ID NO: 124540 - DNA, 879 bp, Artificial Sequence
  Description of Artificial Sequence: Synthetic coding sequence
atgtccggggcctgcgctccacgcgggtcgagatctctgctgccctggatcgggtgtactcgctcacttgattggagtccatcccccctaagagggcgttgcaccagctgtcctggctggcggggccgcagttttagaccgggcactgcagcaactcggacccagggatcaactgccaggcccttgtttacctctattcgatgcaccaagacccgacccgccatttcatttactacggtggctgcatttagtcggtcgctcctgctgcaagttcggggcagcggcggcgccagactctcaaccaaggatcccctgccaacaatcgcctctcgggaagaaatcgaagctacaaagaatcatgtactcgagacgttttacccaatctctccgataattgatctgcatgagtgtaacatttatgacgtgaaaaatgataccggttttcaggaaggctatccatatccctatcctcatacactgtatctgctcgacaaggcaaatctccgccctcaccggctgcagcccgaccagcttagagctaaaatgatattatttgcttttgggtctgctctggctcaggcccggctcctgtacggcaatgatgccaaagttcttgagcagcccgtggtagtacaatctgtaggcacagacggtcgagtgttccacttccttgtttttcagctcaacaccacagacctggactgtaatgagggagtgaagaacctggcctgggttgattcggaccagttgctttaccagcatttctggtgtcttccagtgatcaagaagagggttgtagtagaacctgtgggacctgtaggattcaaaccagagacatttaggaagttcctggcactttacttacacggtgccgcatag

SEQ ID NO: 124541 - DNA, 1272 bp, Artificial Sequence
  Description of Artificial Sequence: Synthetic coding sequence
atggcattggctagtgggccagctcgtcgtgctctggccggcagcggtcagctgggtctgggcggatttggcgcaccaaggagaggcgcgtacgagtggggggttaggtcaacccgcaagagtgaacccccccctctggatcgcgtctacgaaatccctggcctggagccaataactttcgctggcaagatgcattttgtgccttggctagccaggccgatctttccaccatgggaccggggatacaaagacccaaggttctacagaagcccacccctgcacgagcatccactgtacaaagaccaggcatgttacattttccaccatagatgcaggctactggagggggtcaagcaggctctttggctgacgaagactaaactcatcgaagggctgcccgagaaggtcttatcactggtcgacgatccccgcaatcacatagagaatcaggacgagtgcgtacttaacgtcatatctcatgccagactgtggcaaaccacggaggagatccctaagcgggagacatattgccccgtgatcgtggataacctcatccaactctgtaagagccagatattaaagcacccatctcttgcaaggcgaatctgcgtccagaatagtacattctcagcaacatggaaccgtgaaagcctgctgctccaagtgcggggaagcggtggagcacgcctgagcaccaaggacccactccctacaatcgccagccgtgaggaaattgaagccaccaagaatcacgtgctggaaacattctatccaatttctcctatcattgatctgcatgaatgcaacatctatgacgtcaagaatgatactggcttccaggaaggatatccgtatccttatcctcacactctttacttgctggacaaggccaatctaagacctcatagactgcagcccgaccagctgagggccaagatgatccttttcgcttttggctctgcccttgcgcaggcacgactgctatatggcaacgatgcgaaggttctcgagcagcctgtggtggtgcaatctgtcggcacggatggcagagtgttccactttctggttttccagctcaacactacagaccttgactgcaacgaaggtgtgaagaatttggcctgggttgattcagaccagctgctgtaccagcacttttggtgtctacccgtgatcaagaagagggtggttgtggaacccgtcggccctgtgggtttcaaacccgaaacattccgaaaattcttggccctgtacctgcatggggcggcctag

SEQ ID NO: 124542 - DNA, 795 bp, Artificial Sequence
  Description of Artificial Sequence: Synthetic coding sequence
taatcgcttcttctgcaagtgcgaggctctgggggagctagattaagcacgaaagatcctcttcccacaatcgctagtcgggaagagatcgaagccacaaaaaatcatgtgctggagactttttatcctatctctcccatcatcgacctgcatgagtgcaacatctatgatgtgaagaatgatacaggtttccaggaggggtacccttatccctaccctcataccttgtatttgttagacaaggccaatctgcgaccacatcgtttacagcccgaccagctccgcgccaagatgattctgtttgccttcgggtccgcactggcccaggctcgactgctgtacggcaacgatgctaaggtgctcgaacagccagtggtggttcagtctgtgggtactgacggccgcgtgtttcatttcctggtttttcagctgaacacaactgatctggattgcaatgagggcgtaaaaaatctggcttgggtggacagcgatcaactactctaccagcacttctggtgcctccctgtgataaagaaaagagtggtggtcaccggaccgtgcttctctaaatcccaaatgagcaccagtttcgtgctgaccccctctttcaacgctggagaggaggtgatgcagagaaacctccgtgcatccgcctcccttcctcctagtactggctctcctgcctccgagctggtgaaggagcaagaacatgcagcagggagagtcctgaggcgcgtgatgctggattcagaaaccccacgcgaggagctgccggccgcggacttctggaagtag

SEQ ID NO: 124543 - DNA, 1143 bp, Artificial Sequence
  Description of Artificial Sequence: Synthetic coding sequence
atggccgctccatggtggcgcgcagccctatgcgagtgtagacggtggagagggttcagcaccagcgctgttctcggtagacggaccccgcccctggggccaatgcctaacagcgatatagatctgagtaatctcgagcggctggagaagtacagatcatttgaccggtatcggcgacgggcggaacaggaagcccaggccccccactggtggaggacatatcgcgaatatttcggtgagaaaacggatcccaaagagaaaatcgatataggactgcccccccctaaggtttcgagaacacaacagcttttggagagaaaacaggcaatccaggaacttcgcgccaatgtggaagaagagcgcgctgcccgtctgcggacggcgtcagtgcccctggacgccgtgagagccgagtgggagcggacttgtggtccctatcacaaacagcgcctagctgagtattacggcctgtatagggatttattccatggagccacgttcgtgccgagggtaccactccacgtcgcatacgctgtcggcgaggacgatttgatgcccgtttactgtggcaacgaggttaccccgaccgaagctgctcaggctcccgaagttacctatgaagctgaagagggctcgctgtggaccctgctgctgacaagcctggacgggcatctcttagaaccagatgcagagtacctgcactggctcctgactaatatccccggaaacagggtggccgagggtcaggtcacttgtccgtacttgccccctttccctgctaggggttctggcatccatcggctcgcgttccttctttttaagcaggaccaacccattgacttctccgaagacgcaagaccaagtccttgctaccagctggcccaaagaaccttccgtacattcgacttctataaaaagcatcaagagaccatgacacctgccggactatcgttcttccagtgtcgatgggatgatagcgtaacctacatctttcaccagctgctggatatgcgcgaacccgtctttgaattcgtgaggcctcccccctatcatcctaagcagaagaggtttccccaccggcagcccttgcggtacttggacaggtatagagactcccacgaaccaacctacggcatctattag

SEQ ID NO: 124544 - DNA, 591 bp, Artificial Sequence
  Description of Artificial Sequence: Synthetic coding sequence
atgcctgtgtactgcggaaacgaagtgactccaaccgaggccgcccaagcccccgaagttacctatgaagccgaagagggtagtttatggactctgctcctaacctccttagacggccacctgttggagcccgacgccgagtatctgcactggctgctgaccaatatcccaggaaatcgggtggcggaaggccaggtgacctgtccttacctgccgccatttcctgcccgtggctccggcatccacaggctggctttccttttgtttaagcaagatcagcccattgacttctccgaggatgcacgcccttcaccttgttaccaacttgcgcagcgcactttccgtacgtttgatttttacaagaaacatcaagagactatgacaccagctggcctctcgttcttccagtgtcgatgggatgacagcgtgacttatatcttccatcagttattggatatgcgggaaccagtgttcgagtttgttaggcccccaccttaccacccgaagcagaaacgcttcccccacagacagccgttgcgatacctggataggtatcgggattctcacgagccaacatacggcatatactag

SEQ ID NO: 124545 - DNA, 1062 bp, Artificial Sequence
  Description of Artificial Sequence: Synthetic coding sequence
atggaggcacttgcgatgggatcaagagccctgaggctgtggttggtagccccaggtggagggattaaatggcgcttcatcgcaacatcatcggccagtcagctttctccaactgaattaaccgagatgcggaatgatctgttcaataaggaaaaggcgaggcagttgtcactgacccctcggaccgagaagattgaggtgaagcacgttggaaagacagaccccggaactgtctttgtgatgaacaagaatatttcaacaccctattcctgcgccatgcacttatctgagtggtattgtcggaaatctatactggcgctggttgatgggcagccctgggacatgtacaaaccgctcactaaaagctgcgagattaaatttctcacttttaaggattgcgacccaggtgaggtgaataaagcttactggagatcttgtgcaatgatgatgggctgcgtcatcgaacgggctttcaaagatgaatacatggtgaacttagtgagagcacccgaagttccagtgatttcaggggcattctgctacgacgtggtgttggactcaaaattggacgaatggatgcccaccaaagaaaacctcaggtccttcactaaggatgcccacgccctgatctacaaagacttgccattcgagaccttggaagtggaagctaaagtcgctctcgagatcttccagcatagcaaatacaaggtggactttattgaagagaaggcctcacagaatccagagcggatcgtgaaacttcacagaatcggagacttcatcgacgtgagtgaagggcctcttatcccaagaacctctatttgctttcagtatgaagtctctgccgttcataaccttcaacctacacaaccaagtctgattcgaaggtttcagggtgtgtccctgcctgtccatctgagagcacacttcaccatctgggataagctgctcgaaaggtcacgaaaaatgacgcctttcccgatactcctgctgttcacaacccagagcttcttcacgacatcgccagagtcatatctgctccacgggacagtttccgaatag

SEQ ID NO: 124546 - DNA, 1017 bp, Artificial Sequence
  Description of Artificial Sequence: Synthetic coding sequence
atggaggcactcgcaatgggatctagagccctgcgactgtggctcgttgcccccggggggggaatcaaatggcgcttcatagccacgtcatccgccagccaactgtctccaacggaactgactgaaatgcggaacgacctcttcaataaagaaaaagcccggcagctgtcgctcacccctagaaccgagaaaattgaggtcaagcatgttgggaagacagaccccggaaccgtgttcgtcatgaacaaaaatatatccacaccctacagctgcgcaatgcacctgagcgagtggtactgccgcaaaagcatacttgcactggtggacggacaaccttgggatatgtataagcccttgactaaatcttgcgagatcaaatttctaacttttaaggactgcgaccctggggaagtgaacaaagcatactggaggagttgtgctatgatgatggggtgtgtcatcgaacgcgccttcaaggacgagtacatggtcaacctggtgcgagcaccagaggtgcctgtgatttcaggggccttttgctatgacgtggtcctggatagcaaattggatgagtggatgccgacgaaggagaacttaagaagctttactaaagacgctcacgccttaatctataaggatctaccattcgagactctcgaggttgaggccaaggtcgctctggaaatctttcaacactcaaagtataaggttgatttcatcgaagagaaagccagccagaaccccgagaggatagtcaagttgcatcggatcggagactttattgatgtctcagaggggccactcatcccacgtacttctatctgttttcagtacgaggtctccgcggtgcacaacctccagcccacccaacccagtcttatcagaaggtttcagggagtctctcttcccgtccaccttagagcacactttacgatttgggacaaactgctagagcgctcacgcaagatggtgactgaagatcagtccaaggccacagaggaatgtacatctacttag

SEQ ID NO: 124547 - DNA, 936 bp, Artificial Sequence
  Description of Artificial Sequence: Synthetic coding sequence
atgttacagtttgtgagggcaggcgcccgcgcatggttgcggcccaccgggtcacaaggactctcttcgctggctgaagaggctgcacgagcgacggaaaatccggaacaagtggcctctgagggactgccagagcctgtgttacgaaaggtggaattgcctgtgcccacacacagaaggccagttcaggcctgggtggagagtctgagagggtttgagcaggagcgggtgggcctggcggatctgcacccggatgtcttcgccacggcccctaggcttgatatcctgcaccaggtagcaatgtggcagaaaaactttaagcggatcagctacgccaaaacgaaaactcgtgcagaggtacgcgggggcggaaggaagccttggccacaaaaaggcacgggccgcgcccgccacgggagtattcgctcgcctttatggagaggaggaggagtcgcacacggccctcggggaccaacgtcatactactatatgctgccgatgaaagtgcgggctttgggcctgaaggtggccttaacggtgaagctggcacaggacgatctgcatatcatggatagcttagaactgccgactggagaccctcagtatctgaccgaattagctcactatcgtcgctggggcgattctgttctcctagtggatttgacacacgaagagatgccccagtctatcgttgaggccacctcgaggctcaagacatttaaccttattccagctgtcggcctcaatgtgcacagcatgttgaaacatcagacccttgtgctaaccttgccaactgtggccttcctcgaggataaactgctctggcaagattcgaggtatcgcccgctgtaccctttcagtctgccatatagtgacttcccgcggccactgcctcacgctacgcagggaccagctgcaactccttatcattgttag

SEQ ID NO: 124548 - DNA, 936 bp, Artificial Sequence
  Description of Artificial Sequence: Synthetic coding sequence
atgttacagttcgtccgggctggagcacgcgcgtggctccggccaaccggctctcaggggctctcctcactggccgaggaggccgcaagggcaacagagaacccagagcaggtggcatcagaaggcctgcccgagcccgtgctcaggaaggtggagctcccagttcctactcacaggcggccagtgcaggcatgggtagaatccctgcgagggttcgagcaagaacgggtcggcctagccgacctacacccagacgtcttcgccacagcaccgaggttggacattctgcaccaggtcgccatgtggcagaagaacttcaaacgaatcagctatgccaagactaagacgcgcgccgaggtgcgaggagggggacgtaagccttggccccagaagggcacagggcgcgcaaggcacggaagtatccgctcgcctctctggaggggcggcggcgtcgcacacgggcctagagggcctacatcctattactacatgttgcctatgaaggtgcgggcactcggtctcaaggtggctctgactgtcaagctcgcccaggacgatctgcatatcatggactccctggagcttcctacaggtgatccgcagtacctgaccgagctggcacattaccgacggtggggcgatagcgtgctcttggtggacttgacgcatgaagagatgccacaatctatcgttgaggccacaagtcgcctgaagacatttaatttgattcctgccgtcggtttgaatgtccacagtatgctgaagcatcagaccctggtcctgactcttccaaccgtggcgttcttagaagacaagctgttgtggcaggactcaaggtaccggccgctgtatcccttcagcctgccttattctgactttccacggccactgccccatgctacccaaggccctgccgcaacaccatatcactgctag

SEQ ID NO: 124549 - DNA, 792 bp, Artificial Sequence
  Description of Artificial Sequence: Synthetic coding sequence
atgctgcagttcgtcagagcaggggcaagagcttggctgcgacccacaggatctcaggggctttcgtccttagccgaggaggctgctcgtgcaacagaaaaccccgaacaggtggcatcggaaggtctgccagaacctgtcctgcggaaagtcgagttaccagtacctactcatcgaaggccagtccaggcgtgggtggagagtctccgggggttcgaacaagagcgcgtaggcttggcagacttgcaccccgacgtttttgcaacagcgccccggcttgatatcctgcatcaggtggcaatgtggcagaagaattttaaaagaatatcttacgcaaaaaccaaaactcgagccgaggtgagagggggcgggcgaaaaccttggccccaaaaagggacaggaagggcaagacatggttccatccggagcccgctttggcgcgggggaggagttgctcacggtccccgtggcccaacgtcgtactactacatgctgcccatgaaagtgcgtgcattgggtctcaaggtggccctcaccgtgaagctcgctcaggacgacttgcacattatggattctctggagctgccaactggcgacccccagtatttgacggaattggcccactaccgacgatggggagatagcgtgttgttagtcgacctaactcacgaggaaatgcctcagtctattgtggaagctacaagccgcctcaaaaccttcaatcttatccccgccgttggggaacagcgcgcccaggcccctcgtgtcaggatgtgtagactacgctgttag

SEQ ID NO: 124550 - DNA, 792 bp, Artificial Sequence
  Description of Artificial Sequence: Synthetic coding sequence
atgctgcaattcgttagagcaggagcaagggcttggctccggcctactggttctcaaggattatctagcctggctgaggaagccgcaagagcaactgagaaccccgagcaggttgctagtgaaggtctaccagagcccgtgttgcgcaaggtcgagcttccagtgcccacacaccgccgaccggtccaggcctgggtggagagccttcgtggttttgaacaggaaagggtaggcctcgctgacctgcaccctgacgttttcgccaccgccccacgtctggacatcctgcaccaggtcgctatgtggcagaagaactttaagcgcattagttatgcgaaaacgaagaccagagccgaggtgcgaggaggtggacggaaaccttggccacagaaaggaaccgggcgggccagacatggtagcatcaggagcccattgtggaggggcgggggtgtggcacatggtccgcgaggcccgacttcctactactacatgctgcctatgaaagtgagagcccttggcctgaaggtagcgctgactgtcaaactggcacaggacgacttgcatatcatggactcgctggagctgcccactggcgatcctcagtacttgacagaactggcccattataggcgctggggtgattctgttctgctggtagacctaacacatgaggaaatgccgcagagtatcgtcgaagctacgtcacgcctcaagaccttcaacttgattcccgctgtgggagaacagcgggcccaggcgcctagagtgcgaatgtgtagactgaggtgctag

SEQ ID NO: 124551 - DNA, 414 bp, Artificial Sequence
  Description of Artificial Sequence: Synthetic coding sequence
atgggggtgctcgcagctgccgctcgctgccttgtgcggggtgcagacaggatgtccaaatggacaagtaagagggggccccggtccttccggggtaggaagggcaggggagccaaaggcattggctttctcacctccggatggcggtttgtgcagataaaagagatggtgcccgaattcgtcgtccctgatctcaccggcttcaaattgaaaccatacgtttcctacttagcccctgagagcgaggagacccccttgaccgccgcccagcttttttctgaggccgtggcccccgcaatagagaaggactttaaagacggtactttcgatcctgacaatctggaaaaatatggtttcgaacctactcaggagggaaaactattccagctgtacccccggaacttcctgcgctag

SEQ ID NO: 124552 - DNA, 429 bp, Artificial Sequence
  Description of Artificial Sequence: Synthetic coding sequence
atgggggatgtaaaagaaaattacttagagacttttatttcctcacccaaattcggacgcacatgtgcggatggcgcattgtattgtgtgtgtcataaatccacctactccccactgcccgatgactataactgcaacgtcgagttggcgctgaccagtgatggtcggacgatcgtgtgttaccacccttctgtcgatattccgtatgagcacaccaagccaatacctcgccctgatcctgtgcacaataacgaagagacacacgaccaagtactgaaaacaaggctggaagagaaggtggaacatctggaagagggcccgatgatcgaacaactgtcaaaaatgtttttcaccactaagcaccggtggtacccccatggccggtatcacaggtgtcgtaagaacctgaatcctcccaaggatagatag

SEQ ID NO: 124553 - DNA, 429 bp, Artificial Sequence
  Description of Artificial Sequence: Synthetic coding sequence
atggccgtcgcggccgtaaagtgggtgatgtctaaacggacgattttaaagcacctattcccggtgcagaacggcgccctctactgcgtgtgccacaagagcacttacagtccgctgcccgatgactacaactgcaacgttgaactggcgttgacctcagatggacgcaccatagtttgctatcacccctccgtggacattccctatgagcacactaaaccaatccctcggccagaccccgtgcataacaatgaggagacacatgaccaagttctgaagacccgcctggaggagaaggtcgaacatctggaagaagggcctatgatcgaacagttaagcaagatgttcttcaccactaagcaccggtggtacccccacggtcgctaccacaggtgcaggaagaacttgaaccccccgaaggatcgatag

SEQ ID NO: 124554 - DNA, 429 bp, Artificial Sequence
  Description of Artificial Sequence: Synthetic coding sequence
atggccgtcgcggcagtcaagtgggtgatgtctaagcgcactatattgaagcatctttttcccgtccaaaacggggccctgtactgcgtttgccacaaaagtacctacagtccgctccccgacgactataactgtaatgtggaactggcccttacttcagacggacggacaatagtatgctatcatccttctgtcgatattccttatgaacatacaaaacccatccccaggcccgatcctgtacacaataatgaggagacacatgaccaagtcttgaagacacgtttagaggagaaggttgaacatctggaagagggtcctatgattgagcaattatccaagatgttttttaccaccaagcaccgctggtacccccacggtagataccaccgatgtcgaaagaacctgaatccccccaaggacagatag

SEQ ID NO: 124555 - DNA, 429 bp, Artificial Sequence
  Description of Artificial Sequence: Synthetic coding sequence
atggccgtggctgccgtgaagtgggtgatgtctaagcgcaccatcctgaagcatctgttccctgtgcagaacggcgccctatattgtgtttgccacaagagtacctattcgcctcttccggatgactataattgcaatgtagaactggccctcacatccgatggtaggaccatcgtgtgctatcaccccagcgttgatatcccttacgagcacaccaaacctatcccccgccctgacccagtacacaacaatgaggagacccacgatcaggttcttaaaacacgcctcgaggagaaggtcgagcatttagaggagggtccaatgatcgagcagctgagcaagatgtttttcaccactaaacacagatggtacccccacggcagataccatcgctgtaggaagaatctgaatcccccaaaagaccggtag

SEQ ID NO: 124556 - DNA, 609 bp, Artificial Sequence
  Description of Artificial Sequence: Synthetic coding sequence
atgacggcacgcggaactccatcacgatttctcgctagcgttctgcataacggcctggggaggtacgtgcaacagctgcagagactcagcttttctgtgtcgagggacggggcttctagccggggcgctagggaatttgtggagagagaggtgatcgatttcgcacggcgaaatcctggcgtcgtcatttatgtgaatagccgcccctgctgcgtgccccgagtggtcgccgagtacctgaatggggcagtgcgcgaggagagtatacactgcaaaagcgttgaagaaatctctactctagtgcagaagttggctgatcagtctggccttgacgttattagaatccgcaaaccctttcataccgataaccctagcatacagggccaatggcatccttttacaaataagccaaccacattccggggcctgcgaccaagggaagtgcaagaccccgcgcctgcacaagacactgggctgcgcttgtctgccgtggctccacaaattctgcttccagggtggcctgacccaatttccgtgcagagcagcgacctgccttggggcaatacccactaccgcccagagccactaagtagcacaacatggctttag

SEQ ID NO: 124557 - DNA, 648 bp, Artificial Sequence
  Description of Artificial Sequence: Synthetic coding sequence
atgactgccagaggaactccaagccggtttctggctagcgtgcttcacaacggactgggtcggtacgtccagcagttgcagcgactttcgttttccgtttccagagatggggcctctagccggggagcgcgggagtttgtggagagggaggtcatagacttcgcccggcgaaatcccggggttgtgatatacgtgaactcaagaccgtgctgtgtcccaagggtggttgccgagtacctgaatggcgctgtgagagaagagagcatccactgtaaatcagtggaagaaataagcacactggtccagaaactggctgatcaatcggggttggacgtcattcgaatccgaaagccatttcataccgacaatcccagcatccagggtcagtggcatccgtttactaacaagcccacaacctttagggggctacggccacgggaagtccaggatccagcacctgctcaggataccggtctacgtttaagtgctgtggcccctcagatcctgcttccggggtggccagaccccccagatctacctaccgtcgaccctataagctcatctctgacatcagcaccagccccaatgctgagcgcagttagttgcctgccaattgtccctgccctgactaccgtgtgttccgcctag

SEQ ID NO: 124558 - DNA, 480 bp, Artificial Sequence
  Description of Artificial Sequence: Synthetic coding sequence
atgacggcacgaggcacaccttcacggttcttggcaagtgtgctgcacaatggccttggccgttacgtccaacaacttcagaggctgtcattctccgtgagtcgcgacggagccagtagccggggagccagagagttcgtcgaaagagaggtcatcgatttcgcaagaagaaatccaggggttgtgatctacgtcaactcgaggccctgttgcgtccccagagtcgtggcagaatatctgaatggcgctgtccgggaggagtcaattcattgcaaatcggtcgaggaaatttccaccctcgtgcaaaaactcgccgaccagagcggattagacgttatcagaatacgcaagcctttccacacagataatccaagcatacaagggcagtggcatccgtttactaataaacctacgacctttaggggactgaggcctcgagaggtgcaggaccccgcgccagctcaggtacaggctcaatag

SEQ ID NO: 124559 - DNA, 708 bp, Artificial Sequence
  Description of Artificial Sequence: Synthetic coding sequence
atgaccgcccgtggcaccccgagtcgcttcctcgcatccgttctgcacaacggcttgggacggtacgtgcagcagctgcaacgtctgtcgttttcagttagtcgggacggggcttcctcccggggcgctcgggaattcgtggagagggaagttatcgactttgctcgtaggaatcctggcgtcgtgatttatgtgaacagccgcccttgttgtgtgcctagggttgtggccgaatacctgaatggggccgtccgggaggaatccatccattgtaagtcagtagaagagatctctactttggttcagaaactcgccgatcagtccggactcgacgtgatccggatccgcaaaccatttcatactgataatccatccatccagggccagtggcatccattcactaataaacccactacctttcgcggtctgaggcctcgcgaagtacaggatcctgctcccgcacaagacgcagctgagtttctgggcgagggggcaggcccatgctggtattctattgtggcgctgccacagaaacacatagcaatcgccatccaccctccacagccagccggccagtgccaccaggccatcggtcactggcctgaaactgtgtgcagttgcaccgctgacccccccgccaggctcgccaggccaaatatttccagtgttattcggtctagtctggggaagtatcctcttccatcgtag

SEQ ID NO: 124560 - DNA, 495 bp, Artificial Sequence
  Description of Artificial Sequence: Synthetic coding sequence
atgaccgctagaggcactcccagccggttcctggcctccgttctccacaacgggttgggccgctacgtgcagcaattacagaggctctcctttagtgtatctcgtgatggcgctagtagtcgcggagcccgggagttcgtcgaacgggaggttattgacttcgcccgccgtaacccaggcgtggtgatctacgtgaacagccggccatgttgtgttccccgagtggtggccgaatacctgaatggggcggtgcgggaggagagtatccattgtaagagcgtggaggaaatatctacattagtgcagaaactcgctgatcagagcggcttggatgttattagaatacgcaagcccttccataccgacaacccatctattcagggccagtggcacccatttacaaataagcctacaacctttaggggtcttcggcccagggaagtgcaggaccctgcccccgcccagtgcctgctcttgggcgccgtcaccctgtag

SEQ ID NO: 124561 - DNA, 480 bp, Artificial Sequence
  Description of Artificial Sequence: Synthetic coding sequence
atgaccgctagagggacacccagcagatttttagcttctgtgctgcataatggcctagggaggtatgtccagcagcttcagagactcagttttagcgttagtagggatggtgcttctagccggggggcccgagagttcgttgagcgggaagttatcgatttcgcccggaggaatcctggcgtcgtcatttacgtgaactcccgcccctgttgtgtgccaagggtcgtggctgaatatttaaatggtgccgtgagggaggagtcaatccactgcaagagtgtcgaagaaattagcaccctggttcagaagttggcagatcaatctgggctcgatgtgatccgcatcaggaaaccattccacaccgacaaccctagcattcagggccagtggcaccccttcactaacaaacccactacatttcgcggactgcgcccacgggaagtacaggaccctgcgccggcccaggtacaagctcagtag

SEQ ID NO: 124562 - DNA, 555 bp, Artificial Sequence
  Description of Artificial Sequence: Synthetic coding sequence
atgacagctcgcggaactccaagtcgttttcttgccagtgtcttgcataatggtctcggccgatacgtgcagcagttgcagcgactttcattttctgtttctcgagatggtgcctcaagcaggggggcccgggaattcgtagagcgggaggtcatcgacttcgccagaagaaaccctggagttgtgatctacgttaacagccggccgtgttgcgtcccccgagtggttgccgaatacctaaacggggccgtccgcgaagaatcaatccactgtaagtctgtggaggaaatttcaacactcgtccagaaactggcagatcaaagcggactggatgtgatccggattcgcaaaccatttcacactgataacccctcaatccagggacagtggcatcccttcacgaataaacccacaaccttccgcgggcttcgacccagggaagttcaagaccccgcccctgcccaagacacgggcttgcgtctgtcagccgtggccccgcagattttgttgccgggttggccagatccaacacgcgcaactcgcgccacccggtag

SEQ ID NO: 124563 - DNA, 786 bp, Artificial Sequence
  Description of Artificial Sequence: Synthetic coding sequence
atgaccgctcggggcacaccttcaagattcctagccagcgttctgcacaacggactcggacgttatgtgcagcagttgcagcgcctgtccttttctgtctcccgagacggcgcaagttcccggggagcccgcgagttcgtagaacgcgaggtgattgatttcgcccggaggaaccccggcgtcgtcatatacgtcaacagtagaccctgttgtgtcccaagagtggtcgcagaatacctgaacggcgctgtgcgcgaggagtcgatccactgcaagtctgtggaggaaatatctactctggtgcagaaattggcagatcaatctggtctcgacgttattaggattcgcaagccctttcacactgacaatccatccattcaaggccaatggcacccatttaccaacaagcccacaacatttagaggactccggcctcgggaagtccaagatcctgctccagcccaagatgccgccgagtttttgggggagggtgccggtccttgctggtacagcattgtggcactgcctcagaaacacatcgctatcgccatccatccacctcagccagccgggcaatgtcaccaggccatcggacactggcctgagactgtctgttcatgtacagccgaccccccggccaggctggctcgcccgacgcgccccccccattccggatcatacctcatcctgatagacttgtgttcttccccatacgcagtaagatcatttctcccccccgactgcccttgtactgatcattgcgtgctgtctgtgaaggctgcttag

SEQ ID NO: 124564 - DNA, 510 bp, Artificial Sequence
  Description of Artificial Sequence: Synthetic coding sequence
taaggcacaccctcccggtttctcgcctctgtgcttcacaatggtctcggacgctatgtccagcaattacagcgcttgagcttttctgtgagtcgggacggagcttccagccgaggggcgagggagttcgttgagagggaggtgatcgattttgcgcgaagaaatcctggcgtggtcatttatgtaaatagccgcccttgctgcgtgcctcgcgtggttgccgagtaccttaacggagcagtgcgggaggagtcgatacattgtaagtccgtcgaggaaatttccacgttagtacaaaagttagccgatcagtccggtctagacgttataagaatcagaaagccttttcatacagataaccctagtatccaaggacaatggcacccgtttacgaacaaaccaacaacattccgaggtctgcgccctcgcgaagtgcaggatccagctcccgcgcaggacgccgccgagttcttaggcgagggagcaggcccctgttggacgctggcctag

SEQ ID NO: 124565 - DNA, 999 bp, Artificial Sequence
  Description of Artificial Sequence: Synthetic coding sequence
atggcctctggattggtccgcctgctgcagcagggccaccgttgcttactcgcccctgtggcccctaagctggtgccccccgtgagaggagtaaagaaaggcttcagagctgcgtttagattccagaaggaactcgaacggcaaaggctactgcgttgtccgccccctcctgtaaggaggtcagaaaagccaaactgggattaccacgccgaaattcaggcatttggccacaggctccaggaaaacttctcattggacctgttgaagacggccttcgttaattcatgttacatcaagtccgaagaagccaaaaggcagcagcttggcatcgaaaaagaagcggtgttgctcaacctcaaaagcaatcaggagttgtccgaacagggtacatcgttttcacagacctgtctgacccagtttctggaggatgagtacccagatatgcctaccgaagggataaaaaatcttgttgacttcttgactggcgaggaagtggtatgtcatgtggcacgcaacctggccgtggagcagctcaccctgagtgaagagtttcccgtcccccctgcagtgctccagcaaactttcttcgctgtcattggcgctctgctacagtctagcggcccagaaaggaccgcactgttcatcagggattttctcatcactcaaatgactggaaaagagttgtttgaaatgtggaaaatcatcaatccaatggggctgttggtggaggagcttaagaaaagaaatgtctccgccccagaaagtcggctgaccagacaatctggtggtactaccgcactgccactatactttgttggcctgtattgcgacaaaaaactcatagcagagggccccggggagacagtcctggtggcagaagaagaagctgcccgggtcgccctgcgtaaattgtatggtttcactgaaaacaggcgtccctggaactattcaaaacccaaggaaacattgcgcgccgaaaagagcatcactgccagctag

SEQ ID NO: 124566 - DNA, 921 bp, Artificial Sequence
  Description of Artificial Sequence: Synthetic coding sequence
atggccgcgccaattccacaggggttcagctgtctctctcgtttcctgggctggtggtttcgccagccggtgttagttactcagtccgctgcaatagtacccgtgagaaccaaaaaacggttcaccccccctatctatcaaccgaaatttaagacagagaaagaattcatgcagcacgcgaggaaggctggcctggttatcccgccagagaagagtgatcgctccattcatttggcctgtaccgccggcatttttgacgcgtacgttccccccgagggggatgctcggatcagctcactcagtaaagaagggttgatcgagagaactgagcggatgaaaaaaactatggcttctcaggtgagtatccggcgaattaaagattacgacgctaatttcaagatcaaggactttccagaaaaagctaaagatattttcattgaggcacatctctgccttaataacagcgatcatgaccgacttcacacacttgtgactgaacattgttttcccgacatgacctgggacattaaatacaaaacggtcaggtggtcattcgtggaatccctggagcccagtcacgtggtgcaggttcgttgcagcagcatgatgaatcagggaaacgtgtatggacaaatcaccgttcgcatgcacacccgtcagactctcgcaatctacgacaggttcggtcgccttatgtacggccaggaagatgtgccaaaggatgttttggagtatgttgttttcgagaagcagctcaccaacccttatgggtcttggaggatgcacactaagattgttcctccatgggccccccccaagcagccaattcttaaaacagttatgatccctggccctcagctgaagcctgaagaagagtacgaagaggcccagggagaggcccagaaaccccagctcgcctag

SEQ ID NO: 124567 - DNA, 693 bp, Artificial Sequence
  Description of Artificial Sequence: Synthetic coding sequence
atggccgccgctggcttggctctgttatgccggcgggtctcctcagcattgaagtcctctaggtccctgattacaccgcaagtgccggcgtgtactggtcttttgcacactacgctttcccgcaaggggttggaagaattttttgatgatccaaaaaattggggacaggaaaaggtgaaaagcggcgctgcttggacctgccagcagctccggaataaatcaaatgaggatctgcataaattatggtatgtgctccttaaagaacgaaacatgctcctgaccctggagcaggaggcaaagcgacaaagactcccaatgccaagcccagaacgcctggacaaggtggtggattctatggacgctctggacaaagtggtgcaggagagggaggatgccctgcgccttctacaaaccggccaagagagagctcggcctggggcctggcgccgtgacatcttcgggagaatcatatggcacaaattcaagcagtgggtgatcccatggcacctcaataaaagatataatcgaaaaagatttttcgcactgccatatgtagaccactttttacgattggagcgcgaaaaacgtgcaaggatcaaggcaaggaaagaaaatctggaacgaaagaaggctaaaattctccttaaaaagttcccgcacttagccgaagcccagaagtcgagtctggtgtag

SEQ ID NO: 124568 - DNA, 423 bp, Artificial Sequence
  Description of Artificial Sequence: Synthetic coding sequence
atgctgcttacattggagcaggaggctaagaggcagagactccctatgcctagtcctgagcggttagataaggtggtggactcaatggacgctctggacaaggtcgtacaggagcgcgaggacgctttgcgactcctccagacaggacaagagagagcgagacctggggcctggcgtcgcgacattttcggtcggattatctggcacaagttcaaacagtgggtgattccgtggcacctcaataagcgatacaacaggaagcggtttttcgcgttgccatacgttgatcacttcctgagactggaacgggaaaagcgagcccggatcaaagctcggaaagagaatcttgaaaggaagaaagccaagattctgctcaaaaaattcccacatttggctgaggctcaaaaatccagcctggtgtag

SEQ ID NO: 124569 - DNA, 753 bp, Artificial Sequence
  Description of Artificial Sequence: Synthetic coding sequence
atggcagcggcaggcctcgcccttctgtgccggagagtctcctcagcccttaaatcatcacgctccctgattacaccacaggtacccgcctgcacaggttttttcctatccctattgccaaagagcactcctaacgtgactagctttcaccagtacaggctcctgcacacaacattgtcccgaaagggactggaagagtttttcgacgaccccaaaaattggggacaggagaaggtgaaaagcggggctgcctggacatgccagcagttaagaaacaagagcaatgaagacctccacaagctgtggtacgtgctcctgaaagaaaggaacatgctactgacgctggaacaagaagctaagcggcagagactccccatgccctcgcctgagagactcgacaaggttgtcgactcaatggatgcactcgacaaagtcgtccaggaaagagaggacgctctgcgccttctccagacaggtcaggagagggctcggcccggcgcctggcgcagggacattttcggccgtattatctggcacaagtttaagcagtgggtgatcccctggcacctcaacaaacggtataatcggaagcgcttcttcgcactgccttatgtggaccacttcctacgactggagagagagaagcgggcccgcatcaaggctagaaaagagaacctggaaaggaagaaagccaagatcctgctgaagaagtttccacacctggcggaagcccaaaagtctagcctggtctag

SEQ ID NO: 124570 - DNA, 639 bp, Artificial Sequence
  Description of Artificial Sequence: Synthetic coding sequence
atgtctggcaccttggagaaagtgctgtgccttcgcaacaataccatctttaagcaagcgttctccttgctacgatttaggacctcgggtgaaaaaccaatttactcggtgggcggaatacttctgagcattagtcgaccttataaaacgaaacccactcatggtatcggcaaatacaaacacctgatcaaggctgaagaacccaaaaaaaaaaaggggaaggtcgaagtgcgtgccattaatttaggcacagactacgaatacggggtgctgaacatccacctgactgcctacgatatgaccctcgctgagagctacgcacagtacgtgcacaatctctgcaactccttaagcatcaaggtggaagagtcttacgctatgccaaccaaaaccatcgaggtcctgcagctacaagaccagggctctaagatgttgttggactctgtcctgactacccatgaacgcgtggtgcaaatcagcggactgtctgcaacttttgctgaaatctttctggaaatcatccagagttcccttcccgagggagtcaggctgagtgtcaaagaacatacagaagaggactttaaaggacgtttcaaggctcgcccggagctggaagaacttttggctaaacttaaatag

SEQ ID NO: 124571 - DNA, 585 bp, Artificial Sequence
  Description of Artificial Sequence: Synthetic coding sequence
atggggctgtcttcctgccgaaagacctcaagtggcctgccacttatccttcattacggtggtatcctcttgagcataagccggccctacaaaacaaagcctactcatggcattggcaagtataagcacctaatcaaggctgaggagccaaagaagaagaaagggaaggtagaagtcagggctataaacctcggcaccgattacgagtatggagtcctgaatatccacctgacggcctacgatatgaccctggctgagtcctatgcacagtacgtgcataacctctgtaattcgctaagcatcaaggtcgaggagtcatatgctatgcctacaaagacaatcgaagtgttacagctgcaggaccagggctctaagatgctgctcgattccgtcctgacaactcacgaacgtgtggtgcagatttccgggctcagcgcaacttttgctgaaatcttcttagagatcatccaaagcagcttgccagaaggcgtgcggctgagcgtcaaggagcatactgaggaggactttaagggtcgctttaaggcccgcccagagctggaggagctgcttgcaaaactgaaatag

SEQ ID NO: 124572 - DNA, 501 bp, Artificial Sequence
  Description of Artificial Sequence: Synthetic coding sequence
atggctgctaccatgttccgggcaacactgaggggatggcgtaccggtgttcagaggggctgcgggctaaggttgctttctcagactcaggggcccccagattatccaaggtttgtggaatctgtagacgaataccagtttgttgaacgtctgctgcccgctactcgcattcccgacccccctaagcacgaacactacccgactccatcaggttggcagcctcctcgggaccccccgcccaacctaccttatttcgtcagaaggtccagaatgcacaacatccccgtgtataaggacataacacacggaaatagacagatgaccgttatccggaaagtggaaggtgacatttgggctttgcagaaggacgttgaggactttctctcacccttgttgggaaagaccccggtcactcaagtcaatgaggtgacaggaacactccggattaagggttattttgatcaagagcttaaggcttggcttctcgagaaaggattttag

SEQ ID NO: 124573 - DNA, 501 bp, Artificial Sequence
  Description of Artificial Sequence: Synthetic coding sequence
atggccgctaccatgttcagggctactctaagggggtggcggacgggagtgcaacgtggctgcggcctccggctgctttctcagacacagggtcctcctgattacccgagatttgtcgaaagtgtggacgagtatcagttcgtcgaacgattgctgcctgcaactcggattccagatcctcccaagcacgagcactaccctacacctagcggctggcagccgccacgcgatccgcccccaaatttgccttatttcgtgagacgcagtagaatgcataacatcccagtctataaggatattacacacggtaatcgtcagatgacggtgatccgcaaagtggagggcgatatatgggccctccaaaaagacgttgaggatttcctaagccctctgcttgggaaaactccggttacacaagtgaacgaggtcaccggcacgctgagaattaaggggtacttcgaccaggagctgaaggcttggttgttagaaaaaggattttag

SEQ ID NO: 124574 - DNA, 477 bp, Artificial Sequence
  Description of Artificial Sequence: Synthetic coding sequence
atggccgcgagaagtgtcagcggtatcacaagacgagtcttcatgtggacagttagtggcaccccctgtcgagagttctggtcccggtttcgaaaagagaaagagccagtagtggtagagaccgtggaggagaaaaaggaacctattttggtctgtccgcccctcaggagtagagcctacaccccacccgaggaccttcagtctagactggaatcttacgtaaaagaggtgttcgggtctagtctgccgagcaactggcaagatatttcccttgaggatagtcgtctgaaattcaacttactggcacatctggcagatgatctgggtcacgtggttcccaattcgcgactgcatcagatgtgcagagtccgggacgtgttagacttctacaacgttcccatacaggatagaagtaagttcgacgaattgagtgcgagcaacctcccccctaatctgaaaatcacatggagctactag

SEQ ID NO: 124575 - DNA, 408 bp, Artificial Sequence
  Description of Artificial Sequence: Synthetic coding sequence
atggctgctagatccgtctctggcatcacgcggagggtttttatgtggacagtctctggcaccccttgtcgcgaattctggtcgaggttccgaaaagagaaagagccagtggtggtcgaaaccgtcgaggaaaaaaaagagcccatactggtatgtcctcccttgaggtctcgggcatacacacctccggaagatctgcagagtcgcctcgagtcctatgttaaggaggtgtttggatccagtctgcctagcaactggcaagacatttccttggaagactctcggctcaaatttaacttacttgcacacctggcagatgacttgggccacgtagtgcctaattcccgcctccaccagatgtgtagggggtactcttttgaagagggcaagatccaattgggaatatag

SEQ ID NO: 124576 - DNA, 1146 bp, Artificial Sequence
  Description of Artificial Sequence: Synthetic coding sequence
atggcaagcccaagcctagagagacccgagaaaggggctgggaagtctgaattcagaaatcagaagcccaaaccagagaatcaggatgagagcgaattacttacggtacctgatggatggaaagagcccgcttttagtaaggaggacaatcccagagggctcctggaggagagtagcttcgccacactcttccccaaataccgggaggcctatctcaaagagtgttggcctctcgtacaaaaggcccttaacgagcaccacgtgaatgccaccctggaccttatcgagggatctatgactgtgtgtacaactaaaaagacattcgacccttatattataattcgggccagggacttgatcaagttgctcgcgaggtctgtgtcctttgagcaggcagttcgaattctccaagacgatgtggcatgtgacatcatcaaaataggctccctagtccggaataaggagcgtttcgtcaagagacgtcagcggcttatcggacctaagggctccacactaaaggccttagaactactcactaactgttacatcatggtacagggcaacaccgtgagcgcaatcgggccctttagtggcttgaaggaggttcggaaagtcgttctggacaccatgaaaaacatacaccccatttacaatatcaagtctctgatgattaagcgcgagctcgctaaagactctgagctaagaagccagagctgggagagattcctgccacagttcaagcataaaaacgtgaataaacggaaagaacccaaaaaaaaaactgtgaagaaggagtataccccctttccaccaccccagcctgagtcccaaatcgacaaggagcttgcttctggggaatattttctgaaagcaaatcaaaaaaagcgacagaaaatggaggctattaaggccaagcaggctgaggcaatctctaagaggcaggaggaaaggaacaaggccttcatccctcccaaggagaagccaatcgtgaaaccaaaggaagcctcaacagagactaaaattgatgtagctagcattaaagaaaaagtaaaaaaggctaagaataagaagctcggtgctctgaccgctgaggagatcgccctgaagatggaggcagatgagaagaagaaaaaaaagaagaagtag

SEQ ID NO: 124577 - DNA, 372 bp, Artificial Sequence
  Description of Artificial Sequence: Synthetic coding sequence
atggcagcattggggaccgtgttattcactggagtgagaaggctacattgttctgtggccgcctgggccgggggccagtggaggctgcaacagggcttagctgccaatccatcaggatacgggccgctaactgaactgcctgattggtcctacgcggatggtagaccagcaccccccatgaaggggcagctccggaggaaagccgagcgggaaacattcgcacgcagggtggtgttgctaagtcaggagatggatgctggcctgcaggcatggcagctccgtcaacaaaagcttcaggaggagcaaaggaaacaggaaaacgctctgaagccaaaaggcgccagtcttaagtccccattgccttcacagtag

SEQ ID NO: 124578 - DNA, 369 bp, Artificial Sequence
  Description of Artificial Sequence: Synthetic coding sequence
atggcggcgctagggacagtgctgttctccgtaaggaggctgcattgttcagttgcagcctgggcaggtggccagtggcgcttacagcaaggactggccgccaacccttccgggtacgggcctctcaccgagctccccgattggtcatacgccgacgggcgtccagcccctcctatgaaaggccagctgcgccgcaaagcggaacgggagacattcgcgcgaagagtggtccttttgagccaagagatggacgctgggctacaggcctggcagctgagacaacagaagctgcaagaggagcagcggaagcaggagaacgctcttaagccaaaaggggcctccttgaaatctccgctccccagtcaatag

SEQ ID NO: 124579 - DNA, 264 bp, Artificial Sequence
  Description of Artificial Sequence: Synthetic coding sequence
atggctgccctcggcactgtgctttttaccggggtgcgcagattgcattgttctgtggcagcatgggctggaggacagtggcgcttgcagcagggcctcgctgcgaacccttccggctatggtcctttgactgagctgcctgactggtcttacgcagaaacgtcatgcacagccgtgaccggaaacggcaggtggatcacttccatggctgcccaggctgccgaggtggccggacgcaccaaagaagccggaaagtgtagttag

SEQ ID NO: 124580 - DNA, 195 bp, Artificial Sequence
  Description of Artificial Sequence: Synthetic coding sequence
atgaagggtcaacttcggcggaaagctgaacgagaaacttttgccaggcgcgtcgttctcctttcacaggagatggatgctggtctccaggcatggcagctacggcagcagaaactgcaagaagagcagagaaagcaggagaatgccctcaagccaaagggtgccagcctgaaaagccctctccctagccagtag

SEQ ID NO: 124581 - DNA, 195 bp, Artificial Sequence
  Description of Artificial Sequence: Synthetic coding sequence
atgaaggggcaactacgccggaaggctgagagggaaacatttgctaggcgggtggtactgctctcccaggagatggacgctgggttgcaggcatggcagctgaggcagcaaaagctacaggaggagcagaggaaacaagagaatgccctcaagcccaaaggggcaagcctaaaatctcccctgcccagtcagtag

SEQ ID NO: 124582 - DNA, 195 bp, Artificial Sequence
  Description of Artificial Sequence: Synthetic coding sequence
atgaaggggcagctccgccggaaggccgaacgggagactttcgctagacgcgtagttctgttatctcaagagatggacgccggcctgcaggcctggcaactgcgtcaacagaagttgcaggaggaacagagaaagcaagagaacgccctgaaaccaaagggcgcatctttgaaatcccccttgcctagccagtag

SEQ ID NO: 124583 - DNA, 339 bp, Artificial Sequence
  Description of Artificial Sequence: Synthetic coding sequence
atggccgccgctctcgccagactgggactgcgtccagtgaaacaggttagggtgcaattttgtccgttcgaaaaaaacgtagaatcaacccggacgtttctgcaaactgtgtcgtcagaaaaggtgagatcgacaaatctgaattgtagcgtcatcgcagatgtgaggcatgacgggagtgagccctgtgtggatgtcttgttcggtgatgggcaccgcctgatcatgagaggtgctcatttaacggccctggaaatgctgaccgcatttgcttcccatattagggcccgagacgcagccggtagtggcgacaaaccgggtgctgacactgggcggtag

SEQ ID NO: 124584 - DNA, 417 bp, Artificial Sequence
  Description of Artificial Sequence: Synthetic coding sequence
atggcaacaaagcgactgttcggagctacccgaacctgggccgggtggggggcgtgggaactccttaaccctgcaacatccggtcggttgctagcaagggactacgcgaagaagccagtgatgaagggagctaaaagcggcaagggcgctgtgacatctgaggccctgaaggatcctgacgtgtgtactgaccccgtgcagctgaccacttatgcgatgggggtgaacatttataaggaggggcaagatgtgccactgaagcctgatgccgagtacccggaatggttatttgaaatgaacctgggacctcctaaaacattagaagagctggacccagagtcacgggagtactggagaagattaaggaagcagaacatctggcggcataatagactgagcaagaacaaacgcctgtag

SEQ ID NO: 124585 - DNA, 387 bp, Artificial Sequence
  Description of Artificial Sequence: Synthetic coding sequence
atggctgctgtagggtcactcctcggcagactgcggcagtcaaccgtcaaggctactggaccagcactgcggagactgcacacatcctcttggcgggctgactcatcgagggcttccctcacaagggtgcaccgccaggcctatgcaaggttgtaccctgtattgttagttaagcaagacggcagtacgattcacatccgctaccgtgagccccgccggatgttagccatgcctatagaccttgacactctctcacctgaggaacgcagggcacgcttgcgtaaacgcgaggctcagctgcaatccagaaaagagtacgaacaggagctctcggacgatctacatgtcgagaggtatcgacaattttggacaaggacgaaaaagtag

SEQ ID NO: 124586 - DNA, 387 bp, Artificial Sequence
  Description of Artificial Sequence: Synthetic coding sequence
atggcagccgtggggtccctgcttggaaggctcaggcagagtacagtgaaagccacaggacctgccctgaggagactgcatacttcctcctggcgggctgattcttcccgggctagccttacgagagtgcacaggcaggcctacgctcgattgtaccctgtccttctcgttaagcaggacggctctacgattcacattaggtatcgcgagcctaggcggatgctggctatgcctattgacttggataccctgtctcccgaagaacgtcgggctaggttaaggaagcgggaggcgcagttgcagagcaggaaggagtatgagcaggagctctctgacgatctccatgtggagaggtatagacagttctggacccggaccaaaaagtag

SEQ ID NO: 124587 - DNA, 387 bp, Artificial Sequence
  Description of Artificial Sequence: Synthetic coding sequence
atggctgcagttggctccttacttggtcgactgcgtcagtctacagtcaaggcaactggaccagctctgaggcggctgcacacgtcctcgtggagagcagactcgtcccgagcctctctgacacgggtgcaccgacaggcgtacgcacggttgtatccagttttgctggtgaagcaggacggcagcactatccatatacgctacagggagcccaggcgaatgcttgccatgcctatcgatctagatacgctgtcaccagaagaacggcgggcgcggttgcgaaaacgagaggcccagctccaatcccgaaaagaatacgagcaggagctcagcgacgacctacatgtggagcgttaccggcaattttggactaggaccaagaagtag

SEQ ID NO: 124588 - DNA, 387 bp, Artificial Sequence
  Description of Artificial Sequence: Synthetic coding sequence
atggctgccgtgggctcccttctaggacgcttgaggcagtccaccgtgaaggcaaccggcccggcgttaaggcgtctgcacactagcagctggagggccgactcttcccgagccagccttacaagggttcatagacaggcatacgccagactgtaccccgtactgctagtgaaacaggatggcagtactattcacataagatatcgagagccacggaggatgctggccatgcccattgacctcgacaccctgtctcccgaggaacggagagcccgcctaagaaagcgcgaggcacagcttcagagcagaaaggagtatgaacaagagttgagtgacgatctccacgtcgaacggtaccgacagttttggacacgcactaagaagtag

SEQ ID NO: 124589 - DNA, 495 bp, Artificial Sequence
  Description of Artificial Sequence: Synthetic coding sequence
atggcagcagtgggcagtctgctgggactggcagcttcatcatggctcggagggcagaatgcatcggaccactctctgtggctgctccgcaagccccgcgggtccagttgtccgggcactggtcaccagttgtgcagattacgacagtccaccgtgaaggcaacggggcctgccttgcggcggttacatacttcaagctggagagctgacagctctcgggcaagcctcactcgtgtccatcggcaggcgtacgcccgcctctatcctgttctgttagtaaagcaggacggaagcactatacacatccgttatagagagcctcggcgcatgttagccatgcccattgacctggacactctttcccccgaggagaggcgcgcccgtctgagaaaaagagaggcgcagctgcagtctcgaaaggagtatgagcaggagctttcagacgatttgcacgtagagcgctatcgccagttctggacaaggaccaagaaatag

SEQ ID NO: 124590 - DNA, 378 bp, Artificial Sequence
  Description of Artificial Sequence: Synthetic coding sequence
atggccgcagtggggtccctgctggggcagtctaccgtgaaggcaaccggccctgcactcagacgtctacatacctcctcatggcgagccgattccagccgcgcatcactaactcgggtacatagacaggcttatgcccgcctatatcctgtgctgcttgtgaagcaggatggaagcacaatccacattcgttaccgggaacccagaaggatgttggcaatgcccatagatcttgacaccctatctcctgaggaacgccgagctagactgcgcaaaagagaggctcaacttcagagcagaaaagagtacgaacaggagttatccgacgatttgcatgtcgaacggtatcgacagttttggactagaacgaaaaaatag

SEQ ID NO: 124591 - DNA, 387 bp, Artificial Sequence
  Description of Artificial Sequence: Synthetic coding sequence
atggcagcagtggggtcgctgttgggacgcctgcgccagtctacagtaaaggctaccggcccagccctccggcggcttcatacaagcagctggcgggccgacagttctcgagcaagtctcactcgggtgcatcgtcaggcctacgccaggctgtaccctgtgttactggtgaagcaggacggttccaccatccacattagataccgggagccgaggagaatgttggctatgcctattgacctggacactctgtcacccgaagaacggcgtgcccgcctcaggaaacgagaagcccagctccagagcaggaaggagtacgagcaggagttatctgatgatctgcacgtggagcgctaccgtcagttctggacaagaaccaagaagtag

SEQ ID NO: 124592 - DNA, 387 bp, Artificial Sequence
  Description of Artificial Sequence: Synthetic coding sequence
atggccgccgtggggagccttctgggccggctgcgtcagtcaaccgtgaaggccacaggtcccgctttgcgacgcctgcatacctcaagctggcgagctgatagctctagagcctcactcacgagggtgcaccgacaagcctacgctcgactctaccccgtgctgttagtcaagcaagacggatcaaccatccatattcgctaccgggagccccgccggatgcttgcaatgcccatagacttagacacactcagtcccgaagagcgcagggcaagactgcggaaacgcgaagcccaacttcagtctcgaaaagagtatgaacaggagctgtctgacgatctccacgtcgaacgttacagacagttctggacccgcaccaagaagtag

SEQ ID NO: 124593 - DNA, 387 bp, Artificial Sequence
  Description of Artificial Sequence: Synthetic coding sequence
atggccgcagtgggatcactcctgggaagacttcgtcaatccaccgtcaaggctacgggacccgccctcaggagactacatactagcagctggagggccgacagctcccgcgcatccctaacacgcgtgcacaggcaggcctatgcccggttatatcccgttctcctagtgaaacaggacgggtcaacaatccatatccggtacagggagccaagacggatgctggccatgccaatcgacttggacaccttatctccggaagaacgccgagcccggctgcgaaagagggaggcacagctccagtctcggaaagaatacgaacaggagttgtctgatgatctgcacgtcgagagatatcgacaattctggaccagaaccaaaaagtag

SEQ ID NO: 124594 - DNA, 387 bp, Artificial Sequence
  Description of Artificial Sequence: Synthetic coding sequence
atggctgcggtcggatcactgttgggccgccttcgacagtccaccgttaaggcaactggcccggccttgcgcaggctgcatacctcttcctggagggccgattctagtcgcgcctcacttaccagagtacataggcaagcctatgctagactgtaccctgtgctcctggtcaagcaggacggctcaacaatacacattagatacagagaaccccgccgaatgctggccatgccaattgatttagacacactcagccctgaagaaagacgagcacgcctgaggaaacgtgaagctcagctgcagtctcggaaagagtacgaacaggagctgtctgacgacctgcacgtcgagcgctaccggcagttctggactcgaaccaaaaaatag

SEQ ID NO: 124595 - DNA, 495 bp, Artificial Sequence
  Description of Artificial Sequence: Synthetic coding sequence
atggccgcagtggggtctctgcttggattagctgcctccagctggttgggcgggcaaaatgccagcgatcacagtctttggctcctgagaaaaccgagggggtcctcatgcccaggcactggtcaccagttgtgccgacttcgtcagtcgacagttaaggcaactggccccgccctaaggcgcctgcacacttctagttggagggctgactcctcccgcgccagcctgaccagggtgcatagacaggcctatgcccgcctctaccctgtgttgctggtgaaacaagatggctccacgatccatattcgctaccgcgagcctaggcggatgctggcgatgccaattgatcttgatactctgtcaccagaggagcgcagggcccgtttgcggaaaagagaggctcaactgcagagtcgtaaggaatacgagcaggaattatccgacgatctgcatgtggaacgataccgtcaattctggactaggaccaaaaagtag

SEQ ID NO: 124596 - DNA, 387 bp, Artificial Sequence
  Description of Artificial Sequence: Synthetic coding sequence
atggccgcagtgggttctctgctgggccggctgaggcagagcactgtgaaagctacgggccctgccttgcgacgtctgcacaccagcagttggagggccgactcatcgcgtgcctctcttacccgggtccaccgtcaggcttacgctagattatacccagtgttgctcgtgaaacaggacggatcaactatccacatccgttaccgtgaacctaggcgcatgctcgcaatgcccattgatctggataccctgagccctgaggagcgccgggctcgattacgaaaaagagaggcccaacttcagtcacgcaaggagtatgaacaggagctgagtgacgacctgcatgtggagcgttacagacaattttggactagaactaagaagtag

SEQ ID NO: 124597 - DNA, 387 bp, Artificial Sequence
  Description of Artificial Sequence: Synthetic coding sequence
atggccgccgtaggaagtctcttgggtcgactcagacagtctaccgtgaaagctacaggcccggcacttaggcggctccacacaagttcctggcgggccgattcttccagggcctcccttacgcgtgtgcatagacaggcctacgcccggctctaccccgttttactcgttaaacaagacggcagcacaattcacattcggtatagagagccccgccgcatgctcgctatgccgattgatctggacacactatcgcctgaagagcgccgtgcccgtcttagaaagcgggaggcccagttgcaaagtcggaaggagtacgagcaggagctctcggatgatctccacgttgaaagatacaggcagttctggacccgcactaagaaatag

SEQ ID NO: 124598 - DNA, 387 bp, Artificial Sequence
  Description of Artificial Sequence: Synthetic coding sequence
atggccgccgttggctccttgcttggacggctgagacaatctacagtcaaagcaaccggccctgctcttcggcgccttcatacaagcagctggagagccgactcctctagagcgtctctgaccagagtgcacaggcaggcctatgctcgtttgtaccccgtgctccttgttaaacaggatggatccactatccatatccggtatcgcgaaccacggcgcatgctcgcaatgccaattgacttggataccctgagcccagaagaacgaagggcacggttaaggaagcgggaggctcagctccaatcaagaaaggaatatgagcaggaactgtcagacgatctccacgttgagcgttaccgacagttctggactcgaaccaagaaatag

SEQ ID NO: 124599 - DNA, 387 bp, Artificial Sequence
  Description of Artificial Sequence: Synthetic coding sequence
atggctgcagttggttctctcctcggacggctaaggcagagtacagtgaaagcaactggcccagctcttaggcgcctgcacacaagcagttggcgggcagactcctcccgggcatctcttactagggttcacaggcaggcatacgcaaggctgtatcctgtactgctcgttaagcaggatggcagcaccattcacatccgataccgggaacccagacgaatgctggccatgcctatcgatctcgacacgctgtctccagaggagcggagagcacggctccggaagagggaggcccagcttcagagcaggaaggagtatgaacaggagttaagcgatgatctgcacgtcgagcgctacaggcaattttggacccgtaccaagaagtag

SEQ ID NO: 124600 - DNA, 387 bp, Artificial Sequence
  Description of Artificial Sequence: Synthetic coding sequence
atggctgctgtgggttctctgctcggtcggttgcggcagagtactgtcaaggcaacgggcccagccttaagaaggctccacaccagctcctggagggctgacagcagtcgggcctctctgacacgcgttcaccgacaggcttacgcgagactctaccctgttctgctagtcaagcaggacggatcaactatccacattagatatagagagccccggcgcatgctagctatgccgatcgacctcgatacactgagcccagaggaacgaagggcgcgactccggaagagggaagcacagctgcagtcacgtaaggagtacgaacaagagctgtcagacgacttacatgtcgaacggtacaggcaattctggactcgcaccaaaaagtag

SEQ ID NO: 124601 - DNA, 387 bp, Artificial Sequence
  Description of Artificial Sequence: Synthetic coding sequence
atggctgccgtgggaagcctcctgggtcgcctccgtcagagcactgtaaaagcaaccggccctgcccttcgacggcttcatacgtcttcttggagggctgattcatcccgggcttctctgacacgtgttcaccgccaggcatacgctaggttgtaccccgtgcttctggtgaagcaggacggaagcactattcatattaggtacagggagccacgtaggatgctggctatgcctattgatctggataccctttcgcctgaggaacgacgggcaagactgcgtaagcgagaagcacagctccaaagtcgcaaggagtatgaacaggagctttcagatgatctgcatgttgagcgctacaggcagttttggacccgtacaaaaaagtag

SEQ ID NO: 124602 - DNA, 387 bp, Artificial Sequence
  Description of Artificial Sequence: Synthetic coding sequence
atggctgctgtcggctctctcctggggcgtctgcggcagtctacagtcaaggcaactggaccggctctaaggcgcctccacactagctcgtggcgggctgatagttcccgagcctcactcactcgagtgcacagacaggcatacgctaggctgtaccctgtccttttagtgaaacaagatggctcaactattcacatccggtatcgcgagccccgccggatgctggcaatgcctattgacctggatactttaagtcccgaggagagacgggccaggctgcgaaagagggaggcacaactccagtccagaaaggagtatgaacaggagctgagcgatgacctacacgtggagagataccgtcaattttggacaaggaccaagaaatag

SEQ ID NO: 124603 - DNA, 387 bp, Artificial Sequence
  Description of Artificial Sequence: Synthetic coding sequence
atggctgctgtgggtagtctgctggggcgcctcagacaaagcactgtaaaagccactgggcctgccctcagacggctccatactagcagctggagagccgatagtagtagagcatctctgacacgggtacaccggcaggcatatgcccgcttataccccgtgcttctggtgaagcaagacgggtccaccatacatattcggtaccgcgaacctcgtagaatgctcgctatgccaattgacctcgacaccttgtctcccgaagagagaagggcccggctaaggaagagggaagcccagctgcagtcaagaaaagagtacgagcaggaactttctgacgacctgcacgtggagcgctataggcagttttggactaggacgaagaagtag

SEQ ID NO: 124604 - DNA, 387 bp, Artificial Sequence
  Description of Artificial Sequence: Synthetic coding sequence
atggccgctgttggaagtctcctgggccgactgagacagtcgacagttaaggccacaggcccggctctgcggagactgcacacatcttcttggcgggccgacagctcgagagccagccttactcgcgtgcacaggcaggcttacgcaagactctaccctgtgctcctggtaaagcaggacggcagtaccatccatatcagatatcgcgaacctagacgaatgctagccatgccaatcgatttggacaccctaagccccgaggaacgccgggcccggctgcgcaaacgcgaagcccaactgcagagtagaaaagaatatgaacaggagttgtctgacgacctacatgtggagaggtaccggcaattctggactaggaccaaaaaatag

SEQ ID NO: 124605 - DNA, 495 bp, Artificial Sequence
  Description of Artificial Sequence: Synthetic coding sequence
atggctgccgttggctccttgctggggctagcagcgagcagctggctgggcggccaaaatgccagcgatcacagcctgtggctgttgaggaagccgaggggcagcagctgcccgggtaccggccaccagctctgccgcctacgccagagtactgtgaaggctacgggacctgctctgcgcaggctgcatacaagtagctggagagcagacagcagccgcgcatccctgacacgagtgcacaggcaggcctacgcccggttgtatcccgtgttactggttaagcaggatggaagtaccattcacattcgatatagggagccaaggagaatgctcgcgatgccaatcgaccttgacactttaagtcccgaagaaaggagggccaggctgcgaaaacgagaggcacagctgcagagccgtaaggaatatgagcaagagctgagtgacgatctgcacgtagaacgatatcgccaattttggacaagaacaaagaagtag

SEQ ID NO: 124606 - DNA, 231 bp, Artificial Sequence
  Description of Artificial Sequence: Synthetic coding sequence
atggctgccgtgggaagtctgcttggcaggctgcggcagtcaacagtgaaagctacaggacccgcccttagacggttacacacctcttcttggcgagctgactcctcaagagcgtctctcacccgcgtgcatcggcaagcctacgctagattatatcccgtcttattagtgaaacaggacggatcaaccatccacattcggtatcgggagcctagaagaatgcttgcatag

SEQ ID NO: 124607 - DNA, 702 bp, Artificial Sequence
  Description of Artificial Sequence: Synthetic coding sequence
atggcagcacctgtggtgactgctcccgggcgggccctccttcgcgctggcgcgggacgcttgcttagggggggagtccaggagctcctccggccgaggcatgaggggaacgcccctgacctggcctgtaacttctctctctctcagaacaggggtaccgttatcgtggaaaggtggtggaaggtgccactggcgggcgaggggcggaagccaagattacaccgccgccaccgtgtgtataagttggtagaggacacaaaacacagaccaaaagagaatctcgagctgatcctcacccagagcgtagagaacgtgggtgttcggggtgatctggtgtccgtgaagaaatcccttgggcgcaataggttgctgccccaggggctcgctgtgtacgcgtcccccgaaaataaaaagctgttcgaggaagagaagttgctgagacaggagggcaagctggagaagatccaaacaaaggccggcgaggctctgggtgtggtggtcgccccccacacactgaaactgccagaagagccaattacgcgctggggcgaatattggtgcgaggtaaccgttaatggcctggacacagtgcgagtgcccatgtctgtggtgaacttcgaaaagcctaaaaccaaacgctacaagtactggctggctcagcaagcagccaaggctatggctccaacatcaccacagatatag

SEQ ID NO: 124608 - DNA, 804 bp, Artificial Sequence
  Description of Artificial Sequence: Synthetic coding sequence
atggccgccccggtggtgacggcccccggaagggccttactgagagcaggcgccggcagactgctaagaggcggagttcaggagcttcttcgccctcgacatgagggaaatgcaccagatctggcttgcaatttttctctgtcgcagaacagagggaccgtgatagtggaacggtggtggaaggttcccttggcaggtgaagggcgcaaacctcggctgcaccggaggcacagggtgtacaagctcgtggaagatactaaacacaggcccaaagagaacctcgagctgatactaacacagtctgtggagaatgttggtgtgcgtggggatcttgtgtcagtgaagaagtccttgggaagaaatcgtcttctgccacaggggttagccgtgtatgcctctcctgagaacaaaaaactgttcgaggaagagaagctacttaggcaagagggaaagctggagaagatccaaaccaaggccggcgaagcaaccgtcaaatttctcaagagctgtcgccttgaggttgggatgaaaaacaatgtcaagtgggagctcaatccagagattgtggccaggcacttcttcaaaaacctcggcgtagtggtagcccctcacactctgaaactgccagaagagcccattacccggtggggcgagtattggtgcgaagtgactgttaacggactggacacagtgcgtgttcctatgtctgtcgtgaactttgagaaaccaaaaactaaaagatataagtattggctggcgcaacaggccgctaaagccatggcccctacatctccacagatttag

SEQ ID NO: 124609 - DNA, 606 bp, Artificial Sequence
  Description of Artificial Sequence: Synthetic coding sequence
atggcagctaggacagctttcggcgctgtgtgccgaaggctctggcaaggattagggaacttcagcgtgaatacgtccaaaggaaacacagccaagaacggaggcctcctgctgtccacaaatatgaagtgggtgcaattttccaatctccatgttgacgtgccgaaagacttgacaaagccagtcgttaccatttcagatgagcctgatatcctctataagaggctgtcagtactggtgaagggccacgataaagctgtgcttgactcctatgaatacttcgccgtgctggctgcaaaggagctgggtattagtattaaagttcacgaaccaccacggaaaatcgaacgctttacactgctgcaatctgtccacatttacaagaagcacagggtgcagtacgagatgcggactctgtacagatgcctcgagctcgagcacctcacggggagcaccgccgatgtgtatctggagtacatccagagaaacttgcccgaaggcgtcgccatggaggttacgaaaacccagctcgagcagttgcctgaacacataaaagagccaatttgggagaccctgtcagaggagaaggaggaatcgaagagctag

SEQ ID NO: 124610 - DNA, 585 bp, Artificial Sequence
  Description of Artificial Sequence: Synthetic coding sequence
atgcaggccgtaagaaacgccggctctagattcctgcggtcttggacgtggcctcagactgcaggccgtgtcgtggctcgcacaccagcaggaaccatatgtaccggagctcggcagctccaggatgctgcagctaagcagaaggtagagcaaaacgctgcccctagccacaccaaattttccatctatcccccaatccccggagaggagtcaagccttagatgggctgggaagaaatttgaggagatacctattgctcatatcaaggcaagccataacaatactcaaatccaagtggtttccgcttctaacgaacccttagccttcgcgagttgtggtactgaaggattccgcaatgctaaaaaagggacgggaatcgccgctcagaccgcaggcatagccgcagcagctagagccaagcagaagggtgtcatccatattcgggtggtggtgaagggacttgggcctggacggctgtccgctatgcatggacttataatgggtggtctggaggtcatctccatcacggacaatactcctataccgcataacgggtgcaggcctaggaaggcaagaaaactttag

SEQ ID NO: 124611 - DNA, 486 bp, Artificial Sequence
  Description of Artificial Sequence: Synthetic coding sequence
atgcaggctgtcaggaatgcagggtcgcggtttttgcgatcctggacctggccacaaacggcaggacgggttgttgcccgcacgccggcgggtacaatttgcaccggagctcgccaactgcaggacgccgcggctaagcagaaggtcgaacagaacgcggctccctctcatacaaagttttccacgcagattcaggtcgtgtccgcaagcaacgagccacttgcctttgcatcgtgcgggacagagggcttccgcaatgccaaaaagggcacaggcatagcggcccagaccgcaggtatcgcagccgctgctagggcgaaacagaagggcgttatacacattagggtggtggtaaaagggttaggtccaggccgtctgtccgcgatgcacgggttgatcatgggtggactggaggtcatttctataaccgataacactcccatacctcacaacggatgcagacccagaaaggcacggaaactctag

SEQ ID NO: 124612 - DNA, 417 bp, Artificial Sequence
  Description of Artificial Sequence: Synthetic coding sequence
atgtcttggagtgggctcctgcacggacttaacaccagccttacttgcggacctgcactggtcccacgcctgtgggcaacctgttcaatggccactttaaaccaaatgcatcgccttggacctcctaagagacctcccagaaagctaggacctacagaaggccgacctcagctaaagggggtagtgctctgcaccttcaccaggaagcccaagaaaccaaactccgcaaaccgtaagtgctgtagggtgcgtcttagcactggccgcgaagctgtgtgctttatccccggggaaggccacactctgcaggaacaccaaatcgtgctggtggagggagggcgcacccaggacctgccgggagtgaaacttaccgtggtgaggggcaagtatgattgcggtcatgtacagaagaaatag

SEQ ID NO: 124613 - DNA, 417 bp, Artificial Sequence
  Description of Artificial Sequence: Synthetic coding sequence
atgagttggtcagggttgctccatggcttgaatactagtttaacttgtgggccagctctagtgccccggctctgggcaacatgtagtatggctacgttaaaccagatgcaccgcctgggacctccaaagcgacctccgcggaagttagggcctacggaaggcaggcctcagctgaaaggggttgtgctgtgtacattcactcggaaacctaagaagccaaatagcgccaacagaaagtgttgccgagtgcgcttatctaccggcagggaggcagtctgcttcattcctggtgagggacacacacttcaagaacatcagatagtgttggttgagggtgggcgtacccaggatctgccaggggtgaaactcacagtcgtgcgaggcaaatacgactgtggtcacgtgcagaagaagtag

SEQ ID NO: 124614 - DNA, 417 bp, Artificial Sequence
  Description of Artificial Sequence: Synthetic coding sequence
atgtcatggagtggtttgcttcacgggttgaacacctcactcacatgtggccccgctctcgtacctcgcctttgggcaacctgttcgatggccaccctgaatcagatgcatagactcggaccccctaaacgacccccccgtaaattaggcccaaccgagggccgtcctcagctgaagggagtcgtgctgtgcacttttactaggaagccaaagaagcctaactctgccaatcggaaatgttgccgggtcaggcttagcacaggccgcgaagctgtttgtttcatcccaggcgagggccacaccttgcaggagcaccagatagtccttgttgaaggcggacgtacacaggacctccccggggtgaaattgacagtggtgcgggggaaatatgattgcgggcacgtgcaaaaaaagtag

SEQ ID NO: 124615 - DNA, 387 bp, Artificial Sequence
  Description of Artificial Sequence: Synthetic coding sequence
atggccgccttcatgctgggaagcctcttacgcacatttaagcagatggtaccttcaagcgcctcgggtcaggtgaggtctcactacgtagattggcgcatgtggagagatgtaaagagacgcaagatggcatatgagtatgcagatgaaaggctgcggataaactccctcagaaagaacaccattttacctaagatcctgcaggatgtggcggacgaggaaattgcagctcttcctagggactcctgccctgtgcgtatcagaaaccgatgcgtcatgacctcaaggccaagaggagtgaagaggcgctggagactttctcgtatagtattccgtcacctggctgaccatggacagttgtctggcattcagcgtgcgacttggtag

SEQ ID NO: 124616 - DNA, 774 bp, Artificial Sequence
  Description of Artificial Sequence: Synthetic coding sequence
atgctgagagtggcttggagaaccttgtcactgatccgaactcgggccgtcacccaggtactggtccccgggctacctgggggtggctcagcaaagttccctttcaaccaatgggggctgcagcctagatccctgttgctgcaagctgcaagaggatatgttgtgcgcaaacccgcccagtccagactggacgatgatccccccccttccactctcctgaaggattaccagaacgtccccggcattgagaaagtggatgatgtagtgaagagactgctgagtcttgaaatggcgaacaaaaaagaaatgcttaagattaaacaggagcagttcatgaagaagatcgtggccaacccagaggacacgcggtcgctggaagctaggataatagctctatcagtcaaaattaggagttacgaagagcatctggagaagcatcgtaaagataaagcacacaagaggtacctactgatgagcatcgatcagaggaaaaaaatgttaaagaacctgagaaacaccaactacgacgtgtttgagaaaatctgctgggggctcggcatcgaatacacgtttccacctctttattatcgcagggcacatcgccgtttcgtgacaaagaaggccctctgtattagagtgtttcaggagacacaaaagcttaaaaaacgcagaagagctctgaaagcggccgccgcggctcagaagcaggccaagcggcgaaacccagacagcccagcaaaggcgattcctaaaactctcaaggacagtcaatag

SEQ ID NO: 124617 - DNA, 300 bp, Artificial Sequence
  Description of Artificial Sequence: Synthetic coding sequence
atggtccaccttacgacactcctgtgcaaagcctaccgcggcgggcacctaaccatccggctcgccctcggtggctgtactaaccgaccgttctatagaatcgttgccgcccataacaagtgtccaagagacgggaggttcgtcgagcagttggggagctacgaccccttgcctaactcacacggcgagaagctggtcgccctaaatctagataggatccgacactggatcggttgcggtgcgcatttatccaagccgatggagaagctcctcggcctgaaatattctcacgtcttctag

SEQ ID NO: 124618 - DNA, 414 bp, Artificial Sequence
  Description of Artificial Sequence: Synthetic coding sequence
atggtccatcttactacacttctctgtaaggcatatcggggcggccacttgacgatcagactggcactggggggttgtacgaatcggcccttttacaggatagtcgccgcccacaataagtgccccagggatggcagatttgtggaacagctgggttcctacgacccgctcccaaattcccacggagaaaaactggttgccttaaatttggatagaattcgccactggattggatgtggagcccatcttagtaaacccatggaaaagctcttaggcctcgccggatttttccctttgcatccaatgatgataactaacgctgaaaggctccgcagaaaaagagcccgtgaggtgttactggcaagccagaagactgacgccgaagctaccgatactgaggctacagagacctag

SEQ ID NO: 124619 - DNA, 372 bp, Artificial Sequence
  Description of Artificial Sequence: Synthetic coding sequence
atggtgcatctcacaaccctcttatgcaaagcgtaccggggtgggcatttgacaatccgactggcactgggcggatgtacaaaccgcccattttatagaattgttgcagctcacaataaatgccccagagatgggcgatttgtggaacaactgggatcatatgaccccctgccaaattcgcacggggagaagctggtggctctgaatctggaccggattaggcattggattggttgtggcgcccacctgagcaagcctatggagaaactgttgggaaaaacggacgcaaggttccccgagcaaggagaggagcgcccagaacagcatcatttcccagaggaccttgctcctgccagaggtcggggcctgtag

SEQ ID NO: 124620 - DNA, 393 bp, Artificial Sequence
  Description of Artificial Sequence: Synthetic coding sequence
atgtcagtcgtgcgcagtagcgtgcacgctcgctggattgtgggcaaggtgattggaacaaaaatgcagaaaactgctaaggtccgcgtgaccagactggtgctcgatccatacttgctgaagtattttaacaagcgaaagacctacttcgcacatgatgccctgcagcagtgtactgtgggggacatcgtgctgctgagagctttaccagtccccagggctaaacatgtgaagcatgaactggcagaaatcgtattcaaagtgggcaaggtgattgatccggtcacaggcaagccctgcgctggtactacctacctcgaaagcccactgagtagcgaaaccacccagcttagtaagaacctggaagaacttaacatcagtagcgctcagtag

SEQ ID NO: 124621 - DNA, 390 bp, Artificial Sequence
  Description of Artificial Sequence: Synthetic coding sequence
atgtctgttgtgcggtctagtgtgcacgctcgctggatcgtggggaaggtgatcgggactaaaatgcagaagacagcaaaagtgagagtgacaaggctagtattggacccttatcttttgaaatactttaataaacgaaaaacttactttgcacacgatgcactgcagcagtgcaccgtaggcgacattgtcctcttgagggcgctgccagtgccacgcgccaagcacgtcaaacatgagctggccgagatagtattcaaagtgggcaaggtaattgatcccgttaccggtaaaccctgtgcagggactacgtacctagagagcccactttcttctgagactacacaattatctaagaacctggaagagcttaacatcagttccgcatag

SEQ ID NO: 124622 - DNA, 384 bp, Artificial Sequence
  Description of Artificial Sequence: Synthetic coding sequence
atggctgctctcaaggccctcgtttccggctgtgggcgcttgctaaggggactcctcgccggcccagctgccacatcttggagcagactacccgcccggggttttcgcgaggtggtggagacacaggagggaaaaaccacaataatagagggacggattacagccacacctaaagagagcccgaatccccctaatcctagtgggcaatgtccaatttgtagatggaacctaaagcataaatataattacgacgacgttctcctgttatcccagtttatccgcccccacggcggaatgctgccacggaagattactggcctgtgtcaggaagagcacaggaaaattgaggagtgtgttaaaatggcacatcgcgccgggacatag

SEQ ID NO: 124623 - DNA, 813 bp, Artificial Sequence
  Description of Artificial Sequence: Synthetic coding sequence
atggcggctctaaaggctctcgtctccggatgcggaaggctactccgagggctcctcgccggacccgcagctacctcatggtctaggctgcctgccagaggatttcgcgaggtggtggagacacaggaaggtaaaactaccattattgaaggtagaattaccgctacccccaaggagagtccgaatccacctaaccctagcggacaatgcccaatttgtaggtggaacttgaagcacaaatacaattatgatgacgttctgctgctgtcgcagtttatccgacctcatggtggaatgttgccacgaaaaatcaccggtctgtgccaagaggagcaccgcaagatagaagaatgtgtgaaaatggcccacagggctggaaggagaccgtggggaccaaggggcgcagagggatgcagacactccttacctactcagctgccccacgtgtctgcaccgcctggcagaaaggttgacatacggtcggtaaactacacgcatcacccgatgcctacctttccactgccctgggctttccccctggctcctagcgagcttcagcgagagctgcagagactctctccgctccctcgccatagtgggctcttaccgaatcacagacctcgccttcccgaaggggtcgtgcccaaatctaaaccccagctcaacagatatcttacgaggtgggcgcccggatctgtgaaacctatttataagaagggtccacgatggaaccgtgttcgcatgccagttggcagtccactactgcgcgataatgtctgctacagtagaacaccctggaaactgtaccactag

SEQ ID NO: 124624 - DNA, 591 bp, Artificial Sequence
  Description of Artificial Sequence: Synthetic coding sequence
atggctgccctgaaagctttagtatctggctgtggccgactgctgcgtggcctgctggccggacccgctgccacatcttggtcaaggctgccagccagaggattcagagaagtggtagaaacacaggagggaaaaactacaatcatcgaagggcgcataaccgcaactcctaaagagtctcccaacccaccaaacccgagcgggcagtgcccaatatgccgttggaacctaaaacacaaatataactatgacgacgtgctgttgctgagccagttcatcaggccacacgggggcatgctcccacgcaagatcaccggcttgtgtcaagaagagcacagaaagatcgaggagtgcgtcaagatggctcaccgcgcaggcctgttgcctaaccacagacctagactgcccgaaggggtggtacctaagagcaagccccaactcaaccggtacctgaccagatgggcgcctggctctgtgaaacccatctataagaagggcccccggtggaatagggtcaggatgccggtaggcagccccctactgcgcgacaacgtgtgttactctcggacaccttggaagctctatcactag

SEQ ID NO: 124625 - DNA, 795 bp, Artificial Sequence
  Description of Artificial Sequence: Synthetic coding sequence
atggccgctctcaaagctctggtcagcgggtgcggtcgcttgttacggggattactcgcggggcctgccgcaacgagctggtcacggctgcctgctcgagggttccgggaggtggttgaaactcaggagggcaaaaccacaatcattgaggggcggatcacagcaactccaaaagagtcccccaatccgccaaatcctagtgggcaatgccccatatgcagatggaatctgaagcacaagtataactatgatgacgttctgttgctgtcacagtttatccgtccccacggagggatgctacctagaaagattactgggctttgtcaagaggagcaccgcaagatcgaggagtgcgtgaagatggcacaccgggccggccgcagaccatggggccctcgtggtgctgagggttgcagacattctctacccacccaactgccccacgtatctgcaccacccggcaggaaggtcgacatccgctccgtgaattacacgcatcatccaatgccaacttttccattgccttgggccttcccactcgcaccaagcgaattacaacgtgaattgcaacgcctatcacctcttccaagacactccggtttattgcccaatcaccggcctaggttgccggagggggtcgtacccaaatccaaaccccagctgaacaggtaccttacccggtgggccccgggaagtgtgaagcccatatataaaaaaggccccaggtggaatagggtccggatgcccgtgggctcccccctattaagggacaacgtgtgctactcccgtacctag

SEQ ID NO: 124626 - DNA, 777 bp, Artificial Sequence
  Description of Artificial Sequence: Synthetic coding sequence
atggccgctagtgtgctgaacacagtgctccgaaggctacctatgctgagtttatttcgtggaagccatcgggttcaggtgccactacagacgctgtgtacaaaagctccgagcgaggaggatagcctgtcatccgtccccatcagtccctataaggacgaaccctggaagtacctcgaatcagaggagtaccaggagaggtatggcagtcggcctgtatgggccgactatagacggaatcataagggcggcgtccctcctcagagaacccgcaaaacgtgcataagaaggaataaggtggttggaaatccgtgccctatttgcagagatcataaattacacgtggactttcgcaacgttaagttgctggagcagttcgtgtgtgcccacacaggcatcatcttttatgctccttataccggagtctgtgtgaaacaacataaaagactaacgcaggccatacagaaggcgagagatcacggccttttgatatatcatattcctcaggtggaaccccgcgatctggactttagcacaagccatggagctgtctccgccactccccccgcccctacactagtatcgggggatccctggtacccatggtacaactggaagcagcctccagaaagagaactgtctcgcttgcgccgcctgtatcagggacacctgcaggaggagagtggaccacctcccgagagtatgcctaagatgccaccccgcacccctgcagaagcaagtagcactggccagaccgggccccaaagtgccctttag

SEQ ID NO: 124627 - DNA, 777 bp, Artificial Sequence
  Description of Artificial Sequence: Synthetic coding sequence
atggccgcaagcgtgctcaacaccgtgctcaggcggctaccaatgctatctctgtttagagggtcccaccgtgtccaggtcccactgcaaacactgtgcactaaggccccgtcggaagaggatagtctttccagcgtaccaatttccccgtacaaagacgagccctggaaatatcttgaaagcgaagaataccaggaacgctacggttctcgaccagtttgggcagattataggcgaaatcacaagggcggtgtccctccacagaggacacgtaaaacatgcatccgcagaaacaaagtggtaggcaacccatgcccaatctgcagggatcacaaactccatgtggattttcgcaacgttaaactcctcgaacagtttgtgtgtgctcacacggggattatcttctacgcgccctacaccggtgtgtgcgtaaagcaacacaagagactgacacaggccatccaaaaggctcgcgaccatggcctgctcatctaccacatcccgcaggtggaaccaagagatcttgatttctccacaagccacggggccgtgtcagccacccccccggctccaactctagtgtccggtgacccctggtatccctggtataactggaaacagccgcccgagagagagttatcccgacttagacggctgtatcagggtcatcttcaagaagagtccgggccccctccagagtcaatgcctaaaatgccgccaaggactccagctgaggcatctagtacaggacagactggccctcagagtgcactgtag

SEQ ID NO: 124628 - DNA, 648 bp, Artificial Sequence
  Description of Artificial Sequence: Synthetic coding sequence
atggccgctagcgttcttaacaccgtcttacgaaggctccccatgctgtcccttttccgtggatcccatagagtacaagtgccactgcagaccttatgcaccaaggccccgagtgaagaggactctctctccagcgtgccaatttccccctacaaggatgagccgtggaagtacctggaatccgaggagtaccaggagcgctacgggagtcggcctgtctgggccgactatcgtcgaaatcacaaaggaggggttcccccacagcgaactagaaagacatgtatcaacgtgaaactgctagaacagttcgtttgtgcgcacaccgggatcattttctatgccccttatactggtctcctaatttatcacattccccaagttgaaccaagggatttggacttttctacgtcccatggcgctgtcagtgctacgccacccgcacctacattagtctccggcgatccatggtacccatggtataactggaagcaacctcccgagagggagctgagtagactgcgccggttgtaccagggtcacctgcaagaagagagtggcccaccccccgagagtatgcctaagatgccaccacgtacccctgcggaggccagcagtaccgggcaaaccggtccacagtctgctctttag

SEQ ID NO: 124629 - DNA, 648 bp, Artificial Sequence
  Description of Artificial Sequence: Synthetic coding sequence
atggcggctagcgtgctcaacacggtactgcggaggctccccatgctatcactgttccgcggcagtcaccgtgtgcaggtgccactacagacgctgtgcaccaaggccccgtctgaggaggatagtctgtccagtgtccctatcagcccatataaggacgagccgtggaaatacctggaatccgaagaataccaagagcgctacggttctaggcccgtgtgggcggattatcgacgcaaccacaaagggggagtgcctccccagcgcacccgtaagacttgtataaacgtaaagctcctcgagcaatttgtatgtgcacataccgggatcatcttctatgctccctatacaggactgctgatctatcacattccacaggtggaacccagggatctggacttcagcacttcccatggcgctgttagcgccactccccctgcgccaacccttgtgagcggcgacccatggtatccatggtacaactggaaacagcctcccgagagggagctctcccggctcagacgcctctaccagggccaccttcaggaggaaagcggaccccctcccgagagtatgccaaaaatgcctccacggactccagcggaggcgagttcaactggccagactggcccgcaaagcgctctctag

SEQ ID NO: 124630 - DNA, 777 bp, Artificial Sequence
  Description of Artificial Sequence: Synthetic coding sequence
atggccgctagtgtattaaatactgttctgcgtcgcctacctatgctatccctctttagagggagccaccgggttcaggtccctttgcagaccctgtgtacaaaggccccgtctgaagaagattcattaagttcagtgcccatttccccatacaaagacgagccctggaagtatttggagtccgaggaataccaggagcggtatggctcacggcccgtctgggccgactatagaaggaaccataaagggggtgtgccacctcagcggactaggaagacctgtattaggcggaacaaggtggtcgggaatccatgtcccatctgtcgcgaccacaaactgcacgtggactttaggaatgtgaagctgcttgagcagttcgtctgtgctcacaccggaatcatcttctacgctccttacactggggtgtgtgtgaaacaacataaacggttaacccaggctattcagaaggctagggaccacgggttgctgatctaccacatcccccaggtggaaccccgtgacctggatttctccaccagccatggggcagttagtgctacacctccagcacctacactggtcagcggcgacccatggtacccctggtataattggaaacaaccccccgagcgcgaactgagccggctgagacgtctttaccagggccacctacaggaagagagcggtcctcctccggagtctatgcctaaaatgcctccgagaaccccggcggaggcctcttcgacaggacagactggcccgcagtctgcactgtag

SEQ ID NO: 124631 - DNA, 648 bp, Artificial Sequence
  Description of Artificial Sequence: Synthetic coding sequence
atggccgcatccgtgttgaacaccgtgttaagacgtctgccaatgctgtccctgtttagaggttcgcatcgcgtacaagtgcctctgcaaacgttgtgcaccaaagcaccctcagaggaagacagcctctcgagtgttcctatctccccctataaggacgagccttggaagtaccttgagagcgaagaataccaggagaggtatggcagtagaccagtttgggctgactataggcgcaaccataagggtggcgtgccacctcagaggactcggaaaacttgcatcaatgtgaagctgctagaacaatttgtatgcgcccacaccgggatcatcttttatgccccatatacgggactgctcatttatcacattccacaagtggagcctagagatttggatttttcaacaagccacggcgccgtctccgctactccccctgcacccaccctcgtctccggagatccgtggtatccctggtataattggaaacagccacctgaaagagagctttcacgtctcagaagactataccagggacacctccaggaggaaagcggtccaccccctgaatccatgccgaagatgccccctaggactccagcagaagcttcctcaaccgggcaaactgggccacaaagtgcgctctag

SEQ ID NO: 124632 - DNA, 648 bp, Artificial Sequence
  Description of Artificial Sequence: Synthetic coding sequence
atggctgcctccgttcttaatactgtcctgagacgcctgcctatgctgtctttgttccgtggatctcaccgggtccaagtcccgctgcagacactctgcaccaaagccccttcagaggaggatagtcttagctctgtgcccatatccccttataaggatgagccctggaaatacctggagtctgaggaataccaggaacggtatggatccaggccagtgtgggctgattaccgacggaaccataaagggggggtacctcctcagagaacacgcaagacctgcattaatgttaaattactggagcagtttgtgtgcgcacacacaggcatcatcttttacgcaccgtataccgggctcctcatatatcatatcccgcaggtggaacccagggatctcgattttagcaccagccacggggccgtgtccgctacgccgccagcccctaccctcgtctcaggagacccgtggtatccttggtacaattggaagcagccccccgaacgagagctgtccaggttgcgacgtttataccaaggtcatctgcaggaagagagcggcccaccaccagagtccatgcctaaaatgccacccaggacacccgccgaagcgtcatctaccggccaaacaggccctcaatcagccctgtag

SEQ ID NO: 124633 - DNA, 777 bp, Artificial Sequence
  Description of Artificial Sequence: Synthetic coding sequence
atggcagcttccgtcctcaacacggtcctgcgacgccttccaatgctgagcctcttcagagggtcgcatagggtgcaggtgcctttgcagacactgtgtactaaagcaccctctgaggaggattctctcagttcagtccccatcagcccgtacaaagatgagccctggaagtacttggaaagcgaggagtaccaggagcgttatggaagtcggcccgtgtgggctgattatagacgaaaccacaagggtggagtgccccctcagcggactaggaaaacgtgtatccgcagaaacaaggtagtcggaaatccgtgccccatctgtagagatcacaagctgcatgttgactttcgaaatgtgaagctcttggagcagtttgtctgcgcgcatacggggatcattttttatgccccctacaccggtgtgtgcgtgaagcagcacaagaggctcacacaggccatccagaaggcacgggaccacggactcttgatctatcacatcccgcaagtagagccccgggacctggacttttctacctcacacggcgctgtttccgcaactccacccgcaccaactctcgtgagtggtgacccatggtatccctggtataattggaaacagccacctgagcgggagctatctcggcttagaaggctgtaccaagggcatctgcaggaggagagtggaccaccacccgagagtatgccaaagatgccaccccgcactccagccgaggcttcttcaactgggcagactggaccccaatccgccctgtag

SEQ ID NO: 124634 - DNA, 648 bp, Artificial Sequence
  Description of Artificial Sequence: Synthetic coding sequence
atggcggcaagtgtgctgaacaccgtgttaagaagactccctatgttatctttattccgcggctctcacagggtccaggtaccacttcaaactctgtgcacaaaggctccatctgaagaggatagcctgtctagcgtgcccatttcgccttacaaggatgaaccttggaaatacctggagtccgaggagtaccaagaacggtatggatcgcggcccgtgtgggcagactataggcgaaaccacaagggtggcgtgccgcctcagcgcactaggaaaacatgcatcaacgtgaagctgctagagcagtttgtgtgtgcacataccgggattattttctatgccccatataccgggctgcttatttaccacattccacaggttgaaccgcgcgatttggatttctccacttcccacggagcggtgtctgccacccctcctgcacctaccttggtctccggcgatccttggtacccgtggtacaattggaaacagccgccagagagggagctaagtcggcttcgcagactgtatcagggccatctccaggaggagtcaggccctccgcccgaaagtatgccaaaaatgcctcccagaactccagccgaagcgtcctctacgggacagaccggcccacagtctgcactgtag

SEQ ID NO: 124635 - DNA, 777 bp, Artificial Sequence
  Description of Artificial Sequence: Synthetic coding sequence
atggccgcctccgtgctgaataccgtgctgcgtcggttgccaatgctgagcttgtttcgcggctcacaccgcgtgcaggtccccctgcagaccctctgcaccaaagctcctagtgaggaggacagcctgtcctctgtacccatttctccctataaagatgaaccctggaaatatctggaaagcgaggaataccaagagaggtacggaagtagacctgtctgggcggactaccgcagaaaccataaggggggtgtgcccccacagcgaacccggaagacttgcattcggcgaaacaaggtggtgggtaatccgtgtccaatttgcagggaccacaaactccacgtcgactttcggaacgtaaagttactggaacaattcgtgtgcgcacacaccggcattatcttctatgctccctacacaggcgtgtgtgtgaaacagcacaagcgtctgactcaagcaatccaaaaggccagagatcacggtcttctcatttatcacattcctcaagtcgaacctagagatttggacttttctacaagccatggggccgttagcgccaccccgcccgctcctacccttgtgagcggtgatccttggtacccttggtacaattggaagcagccaccagagagggaattatcaaggcttcggagactgtatcagggccacctgcaagaggaatccgggccaccacctgaaagtatgccaaaaatgcctcctaggactcctgccgaagcctcatctaccggccagactggacctcagtctgcgctttag

SEQ ID NO: 124636 - DNA, 648 bp, Artificial Sequence
  Description of Artificial Sequence: Synthetic coding sequence
atggctgcctccgtgctcaacaccgtgctgaggcggctgcctatgttgagcctatttcggggctcacatcgcgttcaagtaccgctccagacgctgtgcacgaaagcgccaagtgaggaggactctctttctagcgtccccatttcaccctataaggatgagccttggaaatatctggagtccgaagagtaccaggaaagatatggatctagacctgtgtgggcagattacagacgcaatcacaaaggaggtgtccctcctcagcgcactagaaagacatgcattaacgttaaactcctggagcagttcgtgtgtgctcacaccggcatcattttctacgcgccctatactggccttctgatctaccatataccccaagtggagccaagagatttagatttcagcacatcacacggcgcagtgtcagccacccccccggctccaactctcgtgtccggggacccctggtatccttggtacaactggaagcagccaccagagcgggagctcagtagactccggagattgtatcaaggtcacttgcaggaagagtccggtcccccgcccgaaagcatgcctaagatgcccccacgaactcctgccgaggctagtagcactggccagaccgggccccagtccgccctctag

SEQ ID NO: 124637 - DNA, 648 bp, Artificial Sequence
  Description of Artificial Sequence: Synthetic coding sequence
atggccgcttcggtgttaaacactgtgctccgccggctgcccatgttgtctcttttccgcggtagtcatagagttcaggttccattgcaaactctctgtaccaaagcaccttccgaggaggattcattgagctcagtgccaatctctccatataaagatgagccttggaagtacctcgagtctgaggagtaccaggagcggtatggcagtcgccccgtgtgggctgactatcgcagaaatcacaaagggggcgtgccgccacagcggacgcggaagacctgtatcaacgtcaagctgctcgaacagttcgtctgcgcacataccggcattatattttacgcgccttatactggactgcttatttatcatattccacaggttgaaccacgggatctcgattttagcacgtcacatggagccgtgtcggccacccctcctgcccctaccctggtgtcgggagatccctggtatccgtggtataactggaagcagccccccgagcgggagttgtccagactccgacggctctatcaaggacatctgcaggaggagtctggccccccccccgaatccatgccaaagatgccaccaaggacaccagcagaggccagctctacaggccagacggggcctcagtctgctttatag

SEQ ID NO: 124638 - DNA, 777 bp, Artificial Sequence
  Description of Artificial Sequence: Synthetic coding sequence
atggccgcgagcgttctcaacacggtcctgagacgccttcctatgctgtccttgttccggggctcacatcgggtccaggtgcccttacagactctgtgtactaaagcgccttctgaggaagattcactcagctccgtgccaatctcgccatacaaggacgaaccgtggaaatacctggaaagcgaagagtaccaagaaaggtacggctcgcgaccagtgtgggcggactaccgtcggaatcacaaggggggtgtgcccccgcaaagaaccaggaaaacctgcattaggagaaacaaggtggtaggaaatccatgtcctatctgtcgtgaccataagcttcatgtggatttccgcaacgtcaagcttctggagcagttcgtatgcgcccatacaggaatcatcttctatgcaccctacaccggggtgtgcgtaaagcaacacaaacgccttactcaggccatacagaaagcccgggatcacggcttgctaatataccacatcccgcaggtggagccaagagatcttgacttttcaacttcgcacggcgctgtcagtgcgacgccccccgcacctactcttgtgtccggcgacccgtggtacccatggtacaattggaaacagccccctgagagagaactctctcggctaagacgactgtatcagggccatctccaagaggaaagcggaccccccccggagtctatgcccaaaatgcctcctcgaacaccggccgaggctagcagcaccgggcagacaggtccgcagagcgctctgtag

SEQ ID NO: 124639 - DNA, 777 bp, Artificial Sequence
  Description of Artificial Sequence: Synthetic coding sequence
atggcggcgagtgttcttaacactgttctgagacggctgcctatgctatctctcttcaggggcagccacagggtgcaggtgcctctccagaccctgtgtaccaaggctcctagtgaggaagactcactcagttcagtgcctatttcaccgtacaaagacgagccgtggaagtatctggaatctgaagagtaccaagaaagatacggctctcggcctgtgtgggcagactatcggcgtaaccataaaggtggtgtcccaccacagcgtacccgcaaaacatgcattaggcggaacaaagtcgtgggcaacccttgcccgatctgcagagaccacaagttgcatgtagactttcggaatgtcaaactgttggaacagttcgtttgtgcacacacaggtatcattttttacgcaccatatactggcgtgtgtgtgaagcagcataaaaggttgactcaggctatccagaaagctcgcgatcatggattacttatttaccatatcccccaggtagaaccccgggatctggatttttctacatctcacggggccgtctcggccactcctccagcacctacactcgtgagtggggacccttggtacccttggtataattggaaacaaccgcctgaaagagagctcagccggctacgcaggctctaccagggccacttacaggaggagagtgggccacctccggagagcatgccaaaaatgcctccccggacgcccgcagaggctagtagcacgggccagactggcccccaaagcgccctgtag

SEQ ID NO: 124640 - DNA, 366 bp, Artificial Sequence
  Description of Artificial Sequence: Synthetic coding sequence
atggccgcctcagtactcaatacagtcctgagaaggcttcccatgctcagcttattcagaggatctcacagggtgcaggtccccctccagactctgtgcacaaaggctccttccgaggaggatagcctgagctccgtgcctatttctccttataaagacgaaccatggaagtacctcgaatccgaagagtaccaggagcggtacggcagccgacccgtgtgggcggattatcgtagaaatcataagggaggagttccccctcagaggaccaggaagacctgcataaggcggaataaggttgtgggtaatccgtgccctatttgtagagaccacaagctgcatgtggatttccgagagagcgtgtag

SEQ ID NO: 124641 - DNA, 366 bp, Artificial Sequence
  Description of Artificial Sequence: Synthetic coding sequence
atggccgcatccgtcttgaataccgtcctacgaaggctccctatgctgagcttgttccggggatcccatcgggtccaggtaccgctccagacactctgtacgaaagcacccagcgaagaggattccctgagctctgtgcccatcagcccttataaggacgaaccttggaaatacctagaatccgaggagtaccaagaacgctatggctcacgtcctgtgtgggccgattaccgccggaaccacaaagggggcgttcccccccaacgtacccgcaagacctgtatcaggcgcaacaaagtggtggggaacccgtgcccaatttgcagggatcacaagctacacgtcgactttagggagtcagtgtag

SEQ ID NO: 124642 - DNA, 366 bp, Artificial Sequence
  Description of Artificial Sequence: Synthetic coding sequence
atggctgcttccgtgctgaacaccgtactgagaagactgcctatgctgtccctgttccgcgggtcacaccgagtgcaggtacccctccagaccttgtgtacaaaggcccccagcgaagaggattcactttcttcagtgcccatctcaccttacaaggatgaaccttggaagtatctcgagagcgaggagtatcaggagcgatacgggtcacgacccgtgtgggccgactacaggaggaaccacaaagggggtgtgccaccacagcggacaagaaaaacatgtatcaggagaaacaaggttgtgggcaacccgtgtcctatttgcagggatcacaagctccatgtagatttcagggagtcggtgtag

SEQ ID NO: 124643 - DNA, 366 bp, Artificial Sequence
  Description of Artificial Sequence: Synthetic coding sequence
atggcggcgtcagtcctgaacaccgtcttgcgccggcttcctatgttaagtctgttcagaggaagccacagggttcaggtaccgttgcaaacactttgtactaaggctccttctgaggaagacagcctgtcatctgtccccatatcaccttataaagatgagccctggaaatacctcgaatccgaagagtatcaggaacgatacggaagtcgccccgtgtgggccgactataggcggaaccataaaggcggagtccccccacagcgaactagaaagacctgtatacggcgcaacaaagtggttggtaatccctgtcctatttgccgagaccataaacttcatgtcgacttccgcgagagtgtgtag

SEQ ID NO: 124644 - DNA, 366 bp, Artificial Sequence
  Description of Artificial Sequence: Synthetic coding sequence
atggccgcctccgtgctgaatactgttctgagacggctaccaatgctgagcctgtttcgtggtagtcaccgggtgcaggtgccactccagactctgtgtacaaaagcaccatcagaggaggactccttgtcatcagtgccaatcagtccttataaggatgaaccatggaagtatcttgaatctgaagagtaccaggagagatacggctcgagacctgtgtgggcggactacaggcgcaatcataaaggaggcgtgcccccacagcgaacaagaaagacatgcatcaggagaaacaaggttgtcggtaacccatgcccgatctgtcgggaccacaagctgcatgtggacttccgcgaatctgtatag

SEQ ID NO: 124645 - DNA, 366 bp, Artificial Sequence
  Description of Artificial Sequence: Synthetic coding sequence
atggcggcaagcgttcttaacacggttctacgacggctccctatgctgtctctgtttagggggagccatagagtacaggtgccgttacagacactgtgcactaaagcaccttctgaagaggattccttaagtagcgtgccaatctccccctataaggacgagccctggaaatacttagaatccgaggaataccaggaacgttatgggtcgcgaccggtgtgggcagattacaggcgcaaccataagggcggagtgccacctcaaagaacccgcaagacatgcattcgcagaaacaaagttgtcggcaacccttgtcccatctgccgggatcacaaactgcacgttgattttcgggaatcagtgtag

SEQ ID NO: 124646 - DNA, 366 bp, Artificial Sequence
  Description of Artificial Sequence: Synthetic coding sequence
atggctgcatcagttctcaacacagtgttacgcagactgccaatgctgtcattgttccgagggtctcaccgggtacaagtgcctctccagacactgtgtacaaaggcaccttctgaggaagattccctgagctccgtgcctatcagtccttacaaagatgaaccatggaaatacctcgagtctgaggagtaccaggaacgatacggctccagaccggtgtgggccgactatcgacgcaaccacaaggggggcgtgcccccacagaggactaggaagacctgtatccggagaaacaaagtcgttggcaacccctgcccaatctgccgagaccataaactacacgtcgattttcgcgagagtgtgtag

SEQ ID NO: 124647 - DNA, 429 bp, Artificial Sequence
  Description of Artificial Sequence: Synthetic coding sequence
atggccgctgtggtagctgtctgtggcggtttgggaagaaagaagctgacgcacctggtgaccgccgcggttagccttacacatcctggcacccatacagtactctggcgccggggatgcagtcaacaggtgagttccaatgaggacctcccgatcagcatggaaaatccctacaaagaaccattaaaaaagtgcatcctgtgcggtaagcatgtagattacaagaacgtgcaactactgagccagtttgtctccccattcactggttgtatttacggtcggcatatcaccggactgtgcggtaaaaagcagaaagaaattaccaaagcgatcaagcgggctcagatcatgggcttcatgcctgtcacttacaaggatcctgcctacctaaaagatccgaaggtctgcaacatcaggtaccgggaatag

SEQ ID NO: 124648 - DNA, 345 bp, Artificial Sequence
  Description of Artificial Sequence: Synthetic coding sequence
atggccgctgtggtggcagtttgcgggggactgggtcgtaaaaagctgactcacttagtcactgcagctgtgagcctaacccatcctgggacacacacggtcctgtggcgtcgagggtgcagccaacaggtcagcagcaacgaagacctgctgctgtctcagttcgtgagtcccttcactgggtgcatctatgggcggcacatcaccgggttgtgcggcaaaaaacagaaggagattacaaaggctattaagagggcgcagattatgggcttcatgccggttacatacaaggaccccgcctacttaaaggatcctaaagtttgtaacatcaggtatagggagtag

SEQ ID NO: 124649 - DNA, 891 bp, Artificial Sequence
  Description of Artificial Sequence: Synthetic coding sequence
atggcaacaagtagtgccgccttaccgagaatcttaggggctggagctagagctccatcccgctggctgggctttctagggaaggctacgccacgaccggcaaggccaagtagacgaactctgggctccgccaccgctctaatgatccgagaaagcgaagattctacggattttaatgacaagatcctcaatgaaccactaaaacacagcgatttttttaatgtgaaggagttgttctcagtgcgctcactgtttgacgcccgagttcacctggggcacaaagctgggtgtagacacaggttcatggagccatatattttcggtagtaggttggaccatgatatcatcgatctagagcagactgccacccacctgcagctagctctgaacttcaccgcccatatggcctacagaaagggcattattctgttcatctcccgcaaccggcagttctcctacctcatcgagaacatggcccgcgactgcggcgaatacgcacacacaagatactttagggggggcatgttaactaatgcccgcctgctatttggcccaaccgtgagactacctgatctgattatattccttcatacgttaaataatatcttcgagccccatgtggcagtaagggatgctgccaaaatgaacatccccacagtcgggattgtagacacaaactgtaatccttgcttaattacgtaccctgttccaggcaacgacgattcacccctcgccgtgcacctgtactgcagactctttcagaccgccatcacccgggcaaaggaaaagagacaacaggtggaagccctttataggctgcaaggtcaaaaagagcccggagaccaaggaccggcgcatccacccggcgccgatatgtcccactctctctag

SEQ ID NO: 124650 - DNA, 891 bp, Artificial Sequence
  Description of Artificial Sequence: Synthetic coding sequence
atggccacctcgagcgcggcactgccacgtattctaggggccggcgccagagcacccagcagatggctgggcttcctcgggaaagccactcctcggccggccagaccaagcagacgcaccctggggtccgccactgccctaatgattcgggagtcagaggacagcactgactttaacgataaaattctaaacgaacccctgaagcacagcgacttctttaacgttaaagaactcttcagtgtacggtccctgtttgatgccagagtgcacctaggtcataaagccggttgtaggcaccggtttatggagccatatatatttggctcccggcttgaccacgacattatcgacctggaacagaccgcaacccacctacagctagccctgaattttactgcgcacatggcttaccggaagggcatcatactgttcatctcaaggaaccggcagttcagctacctgatcgaaaacatggctcgtgattgtggggaatacgcacatacaagatattttcgtggtggcatgctgaccaacgccaggctactctttggacccacagtgagactgcctgacctgattatattcctccatacccttaacaacatctttgaacctcatgttgccgttagggatgccgctaagatgaacattcccactgtcggaatagtggatactaactgcaacccttgcctcataacttaccccgtcccaggaaacgacgatagtcccctagctgttcatctttattgtcggcttttccagaccgcgatcactcgggccaaagagaaacgccagcaggtcgaggctctttatcggctgcaaggccagaaagaacctggcgatcaggggcctgcacacccacctggtgccgatatgtcccactccctttag

SEQ ID NO: 124651 - DNA, 813 bp, Artificial Sequence
  Description of Artificial Sequence: Synthetic coding sequence
cgccggggtccgctcggcatgaggtggggtgccggagtagtacactccggactaggcgcacggacgtcaatatatttccccccaggcgcacgggccccttcacggtggcttggcttcctcggcaaggccacccctcgacccgccagaccatccagaagaacgttggggtcggcaacagccttaatgattcgtgaaagtgaggacagcacggatttcaacgataagattttaaatgaaccattgaagcattctgatttcttcaatgtgaaggagctgttcagcgtcagaagtctgttcgacgcacgcgttcatctcggtcacaaagcagggtgccgacaccggttcatggagccgtacatattcggcagcaggttagaccacgatataatcgatctggagcaaacggccacccacctgcagctcgccttgaacttcactgctcacatggcctacagaaaagggatcattctgtttatcagccgaaatagacaatttagttacctcatcgagaatatggctcgtgattgcggggaatacgctcatacacggtacttccgggggggaatgttgacgaacgcaagattactgttcggacctaccgtcaggctccctgatctcattatcttccttcatactctcaataatattttcgagccacacgtggcggttcgagacgctgcaaaaatgaatattcctacggtcgggattgttgacaccaattgcaacccatgtctgatcacttatccagtgccaggcaatgatgacagtccactcgcagtgcacttgtactgcaggctattccagaccgcctag

SEQ ID NO: 124652 - DNA, 264 bp, Artificial Sequence
  Description of Artificial Sequence: Synthetic coding sequence
atggccaagcaccttaagtttatcgcgcggactgtgatggtgcaggagggcaacgttgagtccgcctatcggacacttaaccggattctgaccatggacggtctgatcgaggacatcaaacatcgacgctattacgagaaaccgtgtagacggagacagagagaatcctacgaacgctgtcgtcgtatctataatatggagatggcaaggaaaataaattttctgatgagaaagaatcgcgcagatccatggcagggctgctag

SEQ ID NO: 124653 - DNA, 264 bp, Artificial Sequence
  Description of Artificial Sequence: Synthetic coding sequence
atggctaagcacttgaaattcatcgccagaacagtgatggttcaagaggggaatgtggaatcagcttatagaactctaaaccgcattttgacgatggacggactaattgaggacatcaaacatcggcgttattacgagaagccctgccgccgaaggcagcgggagtcatacgaacgttgcagacgtatctacaatatggagatggctcgcaagataaatttcttaatgcgaaaaaatcgcgctgacccatggcaggggtgttag

SEQ ID NO: 124654 - DNA, 1083 bp, Artificial Sequence
  Description of Artificial Sequence: Synthetic coding sequence
atggccccgttaggcacaacagtcctgctgtggtctctgctgcgctcttcaccaggggtggaacgagtctgttttcgtgccaggattcagccatggcacggcggtctgctacagccccttccatgctcatttgaaatgggactacctagaaggcggtttagctccgaagctgccgaatcaggcagcccagaaacaaaaaagcctaccttcatggatgaggaggtgcaaagcatcctgacaaagatgacaggcctgaacctgcagaaaaccttcaagcctgctatccaggaactgaagccccccacctataaactgatgactcaggctcaactggaggaagccactcgtcaggctgtagaagctgctaaggtgcggctgaaaatgccccctgtgctcgaggagcgggtgcctattaacgacgtgttggcagaggataagatcctggaaggcacagaaactaccaagtatgtttttacagatatttcttactctatcccacatagggaaaggttcatcgttgtccgcgagccgtccggcacccttcggaaggcatcatgggaggaaagagaccgtatgattcaggtgtacttcccaaaggagggcagaaagatcctgaccccgatcattttcaaggaggagaatctaaggaccatgtactctcaggacaggcacgtggacgtgttgaatctgtgttttgcccagtttgagccggattctactgagtacatcaaagtgcaccacaagacttacgaggacattgataaaagggggaagtacgacttattaaggtcgacaaggtactttggaggaatggtgtggtattttgtgaataataagaaaattgacggcctgttaatagaccagatacaacgagatctgattgatgacgccacgaatctggtgcagctgtaccatgtcctccatcccgatggccagtcggcccaaggtgccaaggaccaggccgcggagggcatcaacttgatcaaagtgtttgcgaagaccgaggcccagaagggcgcatatatcgagctgaccttgcagacctatcaagaagctctgtctcggcactctgcagcctcctag

SEQ ID NO: 124655 - DNA, 1080 bp, Artificial Sequence
  Description of Artificial Sequence: Synthetic coding sequence
atggcgcctttaggtaccactgtcctgttatggtccttgctgcggtcaagtccaggtgtggagcgggtatgttttcgggcaagaattcaaccctggcacggtggcctgctgcaacctcttccctgttctttcgaaatgggactccctcgccgtaggttctccagcgaagcagagtcagggagtccggagactaagaagcccacattcatggacgaagaggtgcagagtatcctgacgaaaatgactggcctgaacctgcaaaagacattcaagcccgccatccaggaacttaaaccccctacctataagctaatgacccaagcccagctagaagaagcgacgcgccaggccgtcgaagctgcaaaggtgaggcttaaaatgcccccagtactcgaggagagggtgccaattaatgatgtactggccgaggataagattttggaagggacagaaacgactaagtatgtctttacggatataagttatagcatcccgcacagggaacggtttattgttgttcgtgaacctagcgggactctcagaaaggcctcttgggaagagcgcgatagaatgatccaggtgtactttccaaaggaaggtagaaagattttaacacccataatctttaaggaagaaaatctccgtactatgtattctcaggatagacatgtagacgtgctgaacctctgcttcgcccagtttgagcccgacagcaccgaatatattaaagttcaccacaagacttatgaagacatcgacaaacgcggaaaatatgatcttctacggagtacccggtatttcggtggcatggtgtggtacttcgtcaacaacaaaaaaatcgacggacttctcatagaccaaatccaacgggacctgatcgacgacgctacaaatcttgtgcaactgtaccatgtgctgcaccctgacggacaaagcgcacagggagctaaagaccaagctgcggaggggatcaacctgattaaagtgttcgccaaaactgaagcccagaaaggcgcatacatagaactcactctgcagacataccaagaagccctgtcgagacactcggccgcctcatag

SEQ ID NO: 124656 - DNA, 960 bp, Artificial Sequence
  Description of Artificial Sequence: Synthetic coding sequence
atgtccaggaacgaaaccgagcacagatatctcggcacccacttcggcgctgaaagcggtagccctgaaaccaagaagcctacctttatggatgaggaggtgcagtcaattttaaccaagatgacaggtcttaacctgcagaaaaccttcaaaccagctatacaagagctcaagcctccgacctacaagctgatgactcaggcgcagctcgaggaggctacccgtcaagctgtggaggcagcaaaggtgcgcctgaaaatgcctccagtgctggaggagcgcgtacccataaacgatgtcttggcagaagacaagattctagaaggcacagagactacaaagtacgtatttacggacatctcgtattccataccccaccgtgagaggtttatcgttgtacgcgagccgtccggaactctccgcaaagcctcctgggaggaacgggatcggatgatccaggtatactttcctaaggaaggcagaaagattctcactccaatcatattcaaggaggagaacctccgtacaatgtactcccaggatagacatgtagatgttctcaatctttgcttcgcccagttcgagccagactctaccgaatacatcaaagttcatcataaaacctatgaggacatcgacaagagaggcaagtatgatctcctgcgatcaactagatattttgggggcatggtgtggtactttgtaaataacaaaaagatagacggactcctaatcgatcagatccaaagggaccttatcgacgacgccaccaacctggtgcagttgtaccatgtcctgcatcccgacggacagagcgcccagggtgcaaaagaccaggcagctgaggggattaaccttatcaaagttttcgccaaaacggaagctcagaagggcgcgtatatcgagttaaccctccagacctatcaggaggcgttaagccgccattccgcagcatcctag

SEQ ID NO: 124657 - DNA, 1083 bp, Artificial Sequence
  Description of Artificial Sequence: Synthetic coding sequence
atggctccgctcggtactacagtcctcttatggagcctgctacggagtagccctggcgttgaaagggtgtgctttagggcaagaatacagccttggcatggtggactgctccaaccactcccttgctcctttgagatggggttaccacgtcggagattctcctccgaggcagccgagagtgggtctcccgagaccaagaaacctacgttcatggatgaagaagtacaatccatcctgaccaaaatgaccggacttaatttgcaaaagactttcaagcctgcaatccaggaattgaaacccccaacttacaagttgatgacacaggcacagctagaagaagctacacggcaggcagttgaggccgccaaagtgaggcttaaaatgccccccgtcctagaggagcgagtacctatcaacgacgtgctggcagaagataaaatcctcgagggcaccgagacaacgaagtacgtttttacggatatctcttactcaattcctcatcgcgaacgattcatcgtagtgagagagccgtctgggactctgcggaaagcgtcttgggaggagcgagacagaatgatccaggtctactttcccaaggaaggacggaagattctaacaccaatcatcttcaaggaagagaacctacgaaccatgtactcccaggacagacacgttgatgtgcttaatttgtgctttgcccagtttgagcctgattcaactgagtacatcaaggtgcaccacaaaacctatgaagacatcgataaacggggcaagtatgatttgctgcggtcaactcggtatttcggtggaatggtgtggtatttcgtgaacaataagaagatcgacggcttgctgatcgaccaaatccagagagatcttatcgatgacgcgactaacctcgtgcagttgtaccacgtgctccatcccgacgggcagagcgctcagggcgccaaagaccaagccgccgagggcataaacctgatcaaagtcttcgctaagacagaagcccagaaaggggcctacattgaactaactctgcaaacttaccaggaggctttgtcaagacactcagcagcgagctag

SEQ ID NO: 124658 - DNA, 507 bp, Artificial Sequence
  Description of Artificial Sequence: Synthetic coding sequence
atggctcccttgggtaccaccgtgctattgtggagtctccttcgcagttccccaggcgttgagcgggtgtgttttcgcgcccgcattcaaccttggcatggaggactgctgcagcccctaccctgctcatttgagatgggcttgccaaggcgaaggttctctagcgaggctgagtctggtagtccggagacaaaaaagcccacattcatggacgaagaggtgcagtcgatcttgacgaagatgactggactgaacctgcagaagacatttaagcctgctattcaagaattgaaacccccaacctataaactcatgacgcaggcacagctcgaagaggctactcggcaggctgttgaggcggctaaggtcagattgaaaatgccacccgtgctagaagaacgtgtgcctattaatgacgtgctggctgaggataagatccttgaagggaccgagaccaccaaatacgtgtttaccgatataagctactcgattccccaccgctgctag

SEQ ID NO: 124659 - DNA, 573 bp, Artificial Sequence
  Description of Artificial Sequence: Synthetic coding sequence
atggccggctccagattggagacagtcggcagtatattctcacgcacaagggacctggttcgcgctggtgtgcttaaggaaaaacccctgtggtttgacgtctacgacgcctttcccccactgagggagcctgtcttccagcgcccccgggttaggtacggcaaagccaaagctccaatccaggatatctggtatcacgaggatcgcatccgggctaagttttattcagtgtacggttccgggcaacgggcgtttgacctctttaatccaaattttaagtccacttgccagaggttcgtggagaaatacactgaattacagaagctcggagaaaccgacgaggaaaagctgttcgtggaaaccggaaaggcactgctagccgagggcgtgatcctccggcgggtgggtgaggctcggacccagcacggcgggtcccatgttagtcgaaagtccgaacacctgagcgttcgcccccagacagccctcgaagagaacgaaactcaaaaggaagtgccccaggatcaacacctggaggctccggccgaccagtccaaaggactcttacccccttag

SEQ ID NO: 124660 - DNA, 504 bp, Artificial Sequence
  Description of Artificial Sequence: Synthetic coding sequence
atggccgcttctgtgtgctccggtctactgggaccccgcgtgctaagttggtctcgagagcttccgtgcgcctggcgcgccctgcatacatcaccagtttgtgctaagaatagggctgcgcgcgtccgggtgtcgaagggggacaagcccgtgacttacgaagaagctcatgccccccactacatcgcgcatcggaaagggtggttgagtctgcatactgggaacttggacggagaagaccatgctgctgagagaacagtggaggacgtttttctacgtaaattcatgtggggtaccttcccagggtgcctcgccgaccagttagtgctgaagcggcggggtaatcagctggagatatgtgccgtcgtactgaggcagctttcgccccataaatattatttcctcgttggatattcggagacgctcttgtcatatttttacaaatgccccgtccgcctgcatctgcagacggttccatccaaggttgtgtataagtatctgtag

SEQ ID NO: 124661 - DNA, 522 bp, Artificial Sequence
  Description of Artificial Sequence: Synthetic coding sequence
atgccaatgaaggggcggttccccattaggcgtaccctacagtacttgtcccaaggtaatgtggtattcaaggatagtgtcaaagtgatgaccgtgaactacaacactcatggggaactgggcgaaggggccagaaaattcgtgtttttcaacattcctcagattcagtataagaacccatgggtccaaattatgatgtttaagaacatgaccccctcacctttccttcgattttaccttgatagcggcgagcaggttctggtagacgtagagacaaaaagcaacaaggagattatggaacacattaggaagattctcggcaagaacgaggaaacactcagagaggaggaggaagagaagaaacagcttagccatcccgcaaacttcgggccacgaaagtattgtctgcgcgagtgcatatgcgaggtcgaggggcaggttccatgcccctcactggtgcccctgcctaaagagatgcgtggcaagtacaaagccgcccttaaggccgacgctcaggattag

SEQ ID NO: 124662 - DNA, 333 bp, Artificial Sequence
  Description of Artificial Sequence: Synthetic coding sequence
atgcctatgaaaggcagatttcctattcgtcgtaccttgcaatacctctcccaaggcaacgttgttttcaaggatagcgtcaaggttatgacggttaactacaacacacatggcgagctgggcgagggagcacgaaagttcgtcttctttaacatcccacagattcagtacaaaaacccttgggtgcagatcatgatgtttaagaatatgacaccctccccattcttgaggttctatctggacagcggagagcaggtgctcgtcgacgtcgagaccaagtcaaacaaagaaatcatggagcacatccggaagatattgggaaagaacgagtag

SEQ ID NO: 124663 - DNA, 390 bp, Artificial Sequence
  Description of Artificial Sequence: Synthetic coding sequence
atgcctatgaaaggccgctttcccataagacgcaccctgcagtatctgtcacagggtaatgtggtattcaaggactcggtgaaggttatgactgtcaactacaatactcacggagagctcggagagggtgcgcggaagttcgtgtttttcaatatccctcagattcaatacaagaacccctgggtgcagattatgatgttcaagaacatgacaccatctccttttctgcgattttaccttggtaaacccagtgggaagcggaggcgcagaaaatcttcattcctgacccagccaacctccgcactggagagcacggcctgcggaagtgcaagcgtgaagtggaaggggcgctgccctgcacccgcctggtgtcactaccctaggaggtag

SEQ ID NO: 124664 - DNA, 333 bp, Artificial Sequence
  Description of Artificial Sequence: Synthetic coding sequence
atgccaatgaagggcagattcccgattaggcggacactccagtatctttcacaggggaacgtggtgtttaaggactctgtgaaagttatgaccgtgaattataacactcatggagaactgggcgagggtgcccggaagttcgtatttttcaacattccccaaattcaatacaagaatccctgggtccaaatcatgatgtttaaaaacatgactcctagccctttcctgcggttctacctcgattctggtgagcaagtgctggtagacgtggagaccaagagcaacaaggaaataatggagcacattcggaagatcttgggcaagaatgagtag

SEQ ID NO: 124665 - DNA, 438 bp, Artificial Sequence
  Description of Artificial Sequence: Synthetic coding sequence
atgccaatgaaagggaggttccccattagaaggaccctccagtacttgtcccagggaaacgttgtgtttaaggactccgtaaaagtgatgacggtcaactataatactcacggtgagctaggagagggcgcacggaagttcgtgttttttaatatccctcaaattcaatataagaatccttgggtgcaaatcatgatgtttaaaaatatgaccccctcacccttcctacgtttctacttggactcaggcgaacaggtcctcgtagacgtcgaaaccaaaagcaacaaggaaatcatggagcacatacgcaagatcctgggtaagaacgaacactatctcgctgcacccagcaaacctgtgagtagtgccgtcgttcctgttacacaggaggccgaagccggagggtcactcgagccgaggcggctgagactcgagtag

SEQ ID NO: 124666 - DNA, 618 bp, Artificial Sequence
  Description of Artificial Sequence: Synthetic coding sequence
atgttgagagcgcttagcagattaggcgccggcaccccctgtaggccacgtgccccactggtgcttccagcgcgcgggagaaagaccagacacgatcccctggctaaaagtaaaattgaaagggtgaatatgccgcctgctgttgaccccgctgaatttttcgtcctgatggaacggtaccagcattataggcagactgtccgagctctacgtatggaattcgtgagcgaggtgcagcggaaagtgcatgaggcacgcgcaggggtcctggctgagcgcaaggctttgaaggacgccgctgaacaccgtgaactgatggcttggaaccaggcagagaatcgacggctccacgaactgagaatcgctcgcctgcggcaggaagaacgggagcaagagcagaggcaggctttagagcaggctagaaaggctgaggaagtacaggcttgggcccaacggaaggaaagagaagtgctccagctgcaagaggaagtgaaaaactttatcacacgggaaaatcttgaggctcgcgtggaggctgcgctggatagccgcaaaaattataactgggcaatcactagagaaggcctggtcgtccggccccagcggcgggacagctag

SEQ ID NO: 124667 - DNA, 1245 bp, Artificial Sequence
  Description of Artificial Sequence: Synthetic coding sequence
atggcggcaagtattgtcagaagggggatgcttctcgcccgacaagtagtattacctcagctcagtcctgctggcaaacgatatctcctgtctagcgcctacgtagattcccacaaatgggaggcccgggagaaagagcattactgtctggcagatctggcctctttgatggacaaaactttcgagcgaaaactcccggtctctagtttgacaattagccgtctaatcgataatatctctagtagagaagaaatcgatcacgccgaatattacctttacaaattccgtcactcaccaaattgctggtaccttcggaactggaccatccacacatggatccgccaatgcttaaagtacgatgcccaggataaggctctctacactctggttaacaaggtccagtatgggatcttcccagacaactttaccttcaacttgctcatggactcatttataaagaaagagaactacaaagatgcactgtcagtcgtctttgaggtgatgatgcaagaggctttcgaagttccgtctacacagcttttatcactgtatgtcctatttcattgtctagcaaagaagaccgatttctcctgggaagaggagagaaacttcggagcctccctcctcctgcccgggcttaagcagaagaacagcgtcggtttcagctcccagctgtacggttacgcgcttttggggaaagtagagctgcagcaaggattgagagccgtgtaccacaatatgcccttgatttggaagcccgggtacctagacagagctctgcaggtcatggaaaaagtggccgcttcccctgaagatataaagctatgtcgtgaagctttggacgtgctgggagctgtgttaaaggctctgacttcagcagacggagcctccgaggagcagtcgcagaatgacgaagacaaccaggggtccgagaagcttgtcgagcagctcgacatcgaagaaactgaacagagtaaactgccccagtacctggagaggtttaaggcccttcattctaagctccaggcgctggggaaaatcgaatctgagggtttgttaagtctgaccactcagctggttaaggagaaattgtccacttgcgaggcggaggacattgctacatacgagcaaaacttacagcaatggcatctagatctggttcagttgatccagagagagcaacagcagcgcgagcaggcaaagcaggaataccaggctcagaaggcggcgaaggcctctgcttag

SEQ ID NO: 124668 - DNA, 1077 bp, Artificial Sequence
  Description of Artificial Sequence: Synthetic coding sequence
atggataaaaccttcgaacgcaagttgccggtgagttctcttaccatatcaagacttatcgataatattagtagcagggaggagatcgaccatgccgaatactacctgtacaaatttcggcattctcccaattgctggtaccttaggaactggactatccatacttggatcaggcagtgccttaaatacgacgctcaggacaaggccctctacacactggtcaacaaggtccagtatgggatctttccagataattttactttcaaccttctaatggattcttttattaagaaggagaattacaaggacgcactgtctgtcgtatttgaggtgatgatgcaagaggcctttgaggtgcctagcactcagttgctgtccttgtatgtactcttccactgcctggccaaaaaaaccgacttttcatgggaggaagaaaggaactttggagccagcctcctcctccccggcctaaagcagaagaactccgtaggcttttcctcacaactgtatggttacgcactgctaggtaaagtcgaacttcaacagggattgcgggctgtctaccacaatatgcccctgatctggaaacccggctatcttgaccgagctctgcaggtgatggaaaaggtggccgcttcaccggaggatatcaaactctgcagagaggccctcgatgtgcttggcgcagtgctgaaagctttgacctccgctgatggagcctccgaggagcaaagccaaaacgatgaagataaccagggatcagagaaactggtggagcagcttgatattgaggaaacagagcagagcaaactgccccaatatttggagaggttcaaagccttacattccaaactgcaggccctgggcaaaattgagtccgagggcctcctttccttgactacacagctagtgaaggaaaagctgtctacttgcgaggcggaggacatcgcaacttatgaacagaacctgcagcagtggcacctggatctggtgcaacttatacaacgggaacagcagcagcgggaacaggcgaaacaagaatatcaggcccagaaggcggccaaagcgtctgcatag

SEQ ID NO: 124669 - DNA, 1287 bp, Artificial Sequence
  Description of Artificial Sequence: Synthetic coding sequence
atggcggcatctattgtgcggaggggcatgctgcttgcccggcaagtggtactgccccagctgtcccccgccggaaaaaggtacttgctcagttctgcttacgttgattcacataagtgggaagcccgggaaaaagaacattattgtttagcagacctggcctcattgatggataaaaccttcgagagaaaattacctgtcagcagcctcactatttccagactgatagataatatttcttcgagagaagagatagatcatgcagagtattatctgtacaaaaaaggcgaatgttcttcctctaacccacagaactactctcggttccgtcatagccctaactgttggtacctgcggaattggactatccacacctggataaggcagtgcttgaagtacgacgcgcaggacaaggccctgtacactctagtaaataaggtgcagtatggtatttttccagataactttacgtttaaccttctcatggactctttcatcaaaaaggaaaattacaaggacgcactgagcgtggtgtttgaagtgatgatgcaggaggcgttcgaggtgccttccactcagctactctcactgtatgtcctgttccattgtcttgccaaaaaaacagacttcagctgggaggaggagcgcaattttggagcctccttgttactccctggtctcaaacagaagaatagcgttggcttcagtagccagctctacggctacgcgctgctcggtaaagtggaattgcagcagggcctgcgcgcagtgtatcataatatgcctctgatctggaaacctggctatctagacagagccctgcaggtgatggaaaaggtggcagcaagcccggaggatattaagctgtgccgagaagccttggatgtgctgggtgcagttctaaaagcactcaccagtgctgacggggcctccgaagaacagagtcagaacgacgaggataatcaaggatccgaaaagctcgtcgaacagctcgatatcgaagaaacagaacagtccaagctgcctcagtacctcgaaagattcaaagccctgcatagcaaactccaagcacttgggaagatcgagtcagagggcctcttgtcgctgaccacccaactagtcaaggagaagttgagcacctgtgaggctgaggacatcgcgacctatgagcagaacttacagcagtggcacctggacctggttcagttaatccagagagaacagcagcagagagaacaggctaagcaggaatatcaagctcaaaaggccgctaaagcttccgcttag

SEQ ID NO: 124670 - DNA, 564 bp, Artificial Sequence
  Description of Artificial Sequence: Synthetic coding sequence
atggccgccctctgccgtactagggccgtcgctgctgaatcacactttctgagagtgtttctgtttttcaggccttttaggggggtgggcacggagtccggatccgaaagtggctcttcaaatgcgaaggagcccaagacccgcgcaggcggattcgcatcagccctggaaaggcacagtgagctgctgcagaaggtcgagccactccaaaaggggtccccaaaaaacgtcgagtcttttgcctccatgctgcggcattcccctttgactcagatgggccctgcaaaagataaactagtcattggaagaatcttccatatcgtggagaacgatttgtacattgatttcggcggcaaattccactgcgtctgtcgccggcccgaagtggacggtgagaagtaccagaaagggaccagggtaaggctgcgcctgttagatttagagctgacgtcccgcttcctgggagcaaccacagataccacagttctagaggccaatgctgttctgctgggcatccaggagagcaaggatagtcggagcaaagaggagcaccacgagaaatag

SEQ ID NO: 124671 - DNA, 1320 bp, Artificial Sequence
  Description of Artificial Sequence: Synthetic coding sequence
atggccgccgcaagatgctggaggccgctcttgagaggaccccgactcagtctccacacggcagccaatgcggctgcaaccgctacagagaccacatgtcaggacgtcgctgcgacccccgttgcacgatacccccccatcgttgctagcatgacggccgacagtaaagcagcccgactgaggcgaattgagagatggcaagccacagtgcacgccgcggagtctgtggacgagaaattgcggattttaactaagatgcaattcatgaagtacatggtctatcctcaaactttcgctctcaacgccgacagatggtatcaatacttcaccaagacagttttcctatctggcctccccccgcctccagctgaacctgagcctgagccagagcctgaacctgagcctgcacttgacctggccgcccttagggcagtggcgtgcgactgcttgctccaggagcatttttaccttcgaaggaggcggcgcgtccacaggtacgaggaatcggaggtgatcagcctgccctttctggatcagctggtttcaaccctggtgggcctgttgtctcctcacaaccctgccttggcagcagccgccttagactaccgatgcccggttcacttctactgggtgcggggggaggagatcattccacgcggccatcgccggggacgaattgacgacctccggtatcagattgatgacaaacctaacaatcagatccggatctcgaagcagctggcagagttcgtgccactcgactactctgtgccaatcgagattccaaccattaaatgtaagcctgacaaactgcccctcttcaaaaggcagtacgagaaccatatcttcgtcggaagcaagacggcagatccatgttgctacggacatacccagtttcacctcttgcctgacaagctccggagggagcgtttgctacggcaaaactgtgctgaccagattgaagtggtttttagggccaatgccattgcgtcactttttgcttggactggcgcccaggccatgtatcagggtttctggtccgaggccgacgtaacccgtccattcgttagtcaagccgttattactgacggaaagtacttcagttttttctgctatcagctgaatacgctagcccttacgacacaagccgatcagaacaatccgcgcaagaatatctgctggggtacacagtccaaacccctgtacgagacaatcgaggataacgatgtgaaggggtttaatgatgacgtgctgctgcaaatagtgcactttctgcttaataggcccaaagaagaaaagagccagctgctggagaattag

SEQ ID NO: 124672 - DNA, 1188 bp, Artificial Sequence
  Description of Artificial Sequence: Synthetic coding sequence
atgtttcctcgcgttagcacgttcctcccactgcgtcccctgagtcgccaccctctgagctcaggatcccccgagacctctgccgcggccatcatgctcctcacggtgcggcacggcactgtgcggtacagatccagcgcactgctcgccagaacaaagaataatatacagagatacttcggaacaaatagtgtgatatgcagtaagaaggataagcagtctgtacgcacagaggaaacaagcaaagagacaagtgaaagccaagattccgaaaaagagaatacgaagaaagacctgctcgggattatcaaggggatgaaggtggagctgtcaacggttaacgtgcgcacgactaagcctcccaagcgacgtcctttaaaatcactagaggctaccctggggcgattgcggcgggccaccgagtacgcacctaaaaaaaggatcgagccattgagtccggagctagtcgccgctgctagcgctgttgcagactccttaccttttgataagcaaacaactaagagtgagctgctgtcgcagttacagcagcacgaggaagagagcagagcccagcgggatgccaaacggcctaaaatcagtttttcgaacatcatcagcgacatgaaggtcgccaggtcggccacagctagagtgcgatctagacctgagcttaggattcagttcgacgaagggtacgataattatccaggccaagaaaaaaccgatgatctgaaaaagcggaagaacatctttacaggtaagagactcaacatctttgatatgatggcagtcacgaaggaggcccccgaaactgacacgtccccttctctttgggatgtagagtttgcgaagcagttggcaaccgtaaatgaacaaccccttcagaatgggtttgaggagctgatccaatggacgaaggagggaaagttatgggagtttccaattaataacgaagccggattcgatgacgacgggagcgaatttcacgaacacatcttcctggagaaacacctggaaagcttccccaagcagggtcctatcaggcactttatggaactagtgacttgcggcttgtccaaaaacccatacctgtctgtcaaacaaaaggttgaacacattgaatggttccgaaactactttaatgagaaaaaagacatcctgaaggaatccaatattcagtttaattag

SEQ ID NO: 124673 - DNA, 321 bp, Artificial Sequence
  Description of Artificial Sequence: Synthetic coding sequence
atgagtagtctctcagaatacgcgtttcgcatgtcccgcctcagcgcgaggctgttcggggaagttacacgcccaaccaattcaaagtcaatgaaagtggtcaagctgttctccgaactcccattagctaagaagaaggaaacctacgactggtacccaaatcaccatacctacgccgagctgatgcagaccttacgattcctgggcctgtacagagacgaacatcaagattttatggacgaacagaaaagacttaaaaagttgcgaggaaaagaaaaaccaaaaaagggcgaaggtaagcgggccgctaagagaaaatag

SEQ ID NO: 124674 - DNA, 321 bp, Artificial Sequence
  Description of Artificial Sequence: Synthetic coding sequence
atgtcgtccttaagtgagtatgcgttccgtatgtctaggctgagtgccagactgtttggggaggttactcggccgacaaatagtaaaagcatgaaggttgtcaagttattttctgagcttccactggccaaaaagaaagaaacatatgactggtatcctaatcaccatacatacgccgaactgatgcagaccttaagattcctcggcctttatagagatgaacaccaggacttcatggacgagcagaagagactgaagaaacttcggggaaaggagaaacccaagaaaggggagggtaaacgagccgcaaagcgaaagtag

SEQ ID NO: 124675 - DNA, 321 bp, Artificial Sequence
  Description of Artificial Sequence: Synthetic coding sequence
atgagcagcctatcagagtacgcctttagaatgagcagattgtcagctcggctgttcggcgaggttacccgccccaccaatagcaagtcaatgaaggtagtgaaactctttagcgagttacccctcgcaaaaaagaaagagacttacgattggtaccctaatcaccacacatatgccgagctgatgcagacactcagatttcttggcctgtatcgggacgagcaccaggacttcatggatgaacaaaaacgcctcaagaagctgagggggaaagaaaagccgaagaaaggcgaaggaaaaagagcagctaagcgcaagtag

SEQ ID NO: 124676 - DNA, 321 bp, Artificial Sequence
  Description of Artificial Sequence: Synthetic coding sequence
atgtccagccttagtgaatacgcgtttcgaatgtcccggctttctgcccggctgttcggggaggtcactcggccgactaacagcaagagcatgaaagtggtgaaactttttagtgagttgccactggctaaaaagaaagaaacttatgattggtacccaaaccatcacacttatgccgagctcatgcagacattacgatttttggggttataccgcgatgagcatcaggacttcatggatgagcagaaaaggctgaagaaattgaggggaaaggagaagcctaagaagggcgaaggcaagagagccgcaaagcgcaagtag

SEQ ID NO: 124677 - DNA, 339 bp, Artificial Sequence
  Description of Artificial Sequence: Synthetic coding sequence
atgtcttctctgagcgaatacgccttccgcatgagtaggttgtctgctcgactctttggcgaggtcacccggccaactaatagtaaatctatgaaagtggttaagctcttctccgagctgccactcgctaagaaaaaagagacttatgattggtatcctaaccaccacacgtatgcggagttaatgcagacccttcgtttcctcgggctgtatcgcgacgagcatcaggattttatggacgagcagaagagactcaagaaactgcggggtaaagaaaagcccaaaaaaggcgaaggcaagagagccgctaagagaaaaaaaaagaagaaaaagaggtag

SEQ ID NO: 124678 - DNA, 678 bp, Artificial Sequence
  Description of Artificial Sequence: Synthetic coding sequence
atggcccggaagaaagtccggccccgcctgatcgcagaactcgcccgccgggttagggcgctacgcgaacagctaaatagaccaagggattcccagctgtacgccgtggactatgaaacactaacaaggcctttcagtggccgccggttgccggtgcgagcctgggccgatgtgcggcgggagtctaggcttcttcagctgctcggcagattgccattgtttggactgggcagactggtgacccgcaaaagctggctctggcagcacgacgagccatgctactggcggctcacgcgggtccgccccgactacactgcccagaatttggatcacggtaaagcttggggcatattgaccttcaaggatgcctctttctctagcagtggcaagacagagtcggaggcgagagaaattgagcacgtgatgtatcacgattggaggcttgttccaaaacacgaggaggaagccttcacggcctttactccggccccagaggactctctggcctctgtcccgtatccgccccttttaagggccatgatcatagccgaacggcagaagaacggggacacgtctacagaagaacctatgctaaacgtccagaggatccgcatggaaccctgggattacccagcgaagcaggaagacaaaggacgtgccaaaggcacaccagtgtag

SEQ ID NO: 124679 - DNA, 657 bp, Artificial Sequence
  Description of Artificial Sequence: Synthetic coding sequence
atggctagaaagaaggtacgcccacggctgattgctgaactcgctaggcgtgtgcgcgccctaagggaacagctgaaccgacctcgtgacagccagctctacgctgtcgattacgaaaccctcacgcgacctttttctgggagaagactgcctgtccgcgcctgggccgatgtacgccgggaatcccgcctgctccagctgctggggaggctgccactgtttgggctggggcgacttgtcacacggaagagttggttatggcagcatgacgagccctgctattggcggcttacccgggttcgcccagattacacagcccagaaccttgaccacggcaaagcctggggcattctgacattcaaggggaaaaccgagtctgaggcccgcgagatagaacatgtgatgtaccacgattggcgcctggtgcctaagcacgaagaagaagcttttactgccttcacaccagctcccgaggatagtctcgcctccgtgccctatcccccccttcttagagcaatgataattgccgaacgccagaaaaacggcgacaccagcactgaagagccgatgctgaatgtgcagcgcattcgtatggagccctgggattatccagctaagcaggaggataagggccgggcaaagggaaccccagtgtag

SEQ ID NO: 124680 - DNA, 972 bp, Artificial Sequence
  Description of Artificial Sequence: Synthetic coding sequence
atggccgctgcggcacttccagcttggctctcactgcagtcccgggctagaacactgagagcgttttccaccgccgtgtatagcgccacccccgtccccacaccctccctgcccgaaagaacccccggaaatgagaggcctcccagacggaaggccctccccccgaggaccgagaaaatggccgttgatcaggactggcccagtgtgtatcctgtggctgctccgtttaagccctccgccgtcccacttcccgtccggatggggtaccccgtgaagaaaggcgtgccgatggccaaggagggcaacctggagctcctgaagatccccaactttctgcatctgacccctgttgcgataaaaaaacactgcgaagcactaaaggacttctgtaccgagtggccagcggccctggactcagatgaaaagtgcgaaaagcactttcctattgaaatagatagtaccgactatgtgagcagtggacccagcgtaaggaaccctcgggcccgagtcgtcgtgcttagagttaaattaagctctctgaacctcgacgaccatgccaagaaaaaactgatcaagttagtcggcgaacgatattgcaagaccacggatgtattgaccatcaagacagatcgttgtcccctgcgccggcagaactatgattacgccgtttacctgttgactgtgctctaccacgagtcatggaacactgaagagtgggaaaagagtaagaccgaagccgatatggaggagtatatctgggaaaattcctcctcagaaagaaatatcctggagacactgcttcagatgaaagccgccgaaaagaatatggaaatcaacaaagaggaattactgggcaccaaagaaatcgaagaatacaaaaagagtgtggtcagtctgaaaaacgaagaggaaaacgaaaactctatctcccagtacaaggagagcgtgaagcgtctgttaaacgtaacatag

SEQ ID NO: 124681 - DNA, 864 bp, Artificial Sequence
  Description of Artificial Sequence: Synthetic coding sequence
atggccgccgcagctttgcccgcatggctctccctccagagcagggctcggacactacgagctttctccacggctgtatattcagccactccagtgcccacaccatctctgccagagaggaccccggggaacgagagaccacctcgcagaaaggcgctgcccccgcggacagagaaaatggccgtagaccaggactggcctagcgtatatcccgtggccgcccccttcaaaccttctgctgtccccctgcctgttcgaatgggttatcctgtcaagaagggcgtgcctatggccaaggaagggaatctcgagttgctcaagattcccaatttcctgcatctaacacctgttgcaatcaagaagcactgcgaggctctcaaagatttctgtactgagtggcctgctgcattagactctgacgagaaatgtgagaaacacttcccaattgagatcgattctacagattatgtctccagcggcccttcagtgcgtaacccgagggcccgggttgttgtgttgagaagatgtcccctgcggcggcagaactacgactacgctgtttaccttctgaccgtgctgtaccatgagagctggaatacggaggagtgggagaaatccaagaccgaagccgacatggaggagtatatttgggagaactcatcctcagaacgcaatattctcgagacactcttacagatgaaagccgctgaaaagaacatggagattaacaaggaggaactgctgggcaccaaagagatcgaggaatataagaaatctgttgtgtcgttaaaaaacgaggaagaaaacgaaaactctatcagtcagtacaaggaaagcgtgaaaaggctgctcaacgtaacctag

SEQ ID NO: 124682 - DNA, 585 bp, Artificial Sequence
  Description of Artificial Sequence: Synthetic coding sequence
atggccgctgctgcactgcctgcgtggctgagtctgcagtcccgtgcccggactctgcgagctttttctacagccgtttattctgcaacacccgtccctactccctcactgccagagaggactccaggcaatgaaaggccacctcgcagaaaagctttaccccctcgtacagagaaaatggcggtcgatcaggactggccctcggtgtaccctgtggcggccccattcaagccatcagccgtccccctgccagtgcgaatgggctatccagtgaagaagggggtgcccatggctaaggaggggaatctcgaactcctgaagattcccaactttctccacttgactcccgtcgctattaaaaagcattgcgaggccctgaaggacttctgtactgagtggccggcagctctggattctgatgagaagtgtgagaaacacttcccgatcgaaatcgactcgacagactacgtatcctccggaccttctgtgaggaaccctagagcacgggtcgtggtgttgagagtgcccttcaaagaggccgaactccgtctgtgtagtgtgagcacaaacagcgttattccttag

SEQ ID NO: 124683 - DNA, 312 bp, Artificial Sequence
  Description of Artificial Sequence: Synthetic coding sequence
atgatgggctctaagatggcgagtgctagccgtgtggtacaggtagtaaaaccccatactcccctgattagatttccggataggagagataatcctaagcctaacgttagtgaggcactgcggtccgccggcctgcctagccattcaagcgtcatttctcagcactctaagggaagtaaaagtccagacctgcttatgtaccagggaccacccgatacagcagagatcatcaagacccttcctcagaaataccggcgaaaactcgtgtctcaggaagaaatggagttcatacagagaggtgggcctgagtag

SEQ ID NO: 124684 - DNA, 1293 bp, Artificial Sequence
  Description of Artificial Sequence: Synthetic coding sequence
atggccactgcggtcagagccgtgggttgcttacccgtactgtgtagtgggaccgcaggccaccttttggggcgacagtgtagtctgaacacgcttccggctgcctctatcctcgcttggaagagcgtgctgggaaatggccacttgtccagcctggggactcgggacacccacccttacgcatccctgtctagggcactacagacccagtgctgcatctcctctcctagccacctgatgtctcagcagtacaggccctactccttctttactaaactgacagccgatgaactttggaaaggagcactagctgagactggggccggagcaaaaaagggccggggaaaacgcaccaaaaaaaaaaagcggaaagatctaaataggggccagattatcggcgaaggtaggtatggctttttgtggcctggtctgaacgtccctcttatgaaaaatggcgctgtccaaactatcgctcagcgctctaaggaagagcaggaaaaggtggaggctgatatgattcagcaaagagaggagtgggacaggaaaaaaaagatgaaagttaagcgcgaaaggggatggtccggaaacagctggggtggaatctccctggggcctcctgaccctggtccttgcggagagacttacgaggattttgacacgcgaattctggaagtacgaaacgtgttcactatgacggctaaggaaggcagaaaaaagagcatccgagttcttgtggcggtgggaaacggcaagggagcggcggggttttcgatcggtaaggctactgataggatggacgcttttcggaaggcgaaaaatcgggcagtgcaccatttgcactacatcgagaggtatgaagatcacactatatttcatgacattagcctgagattcaagcggacccacatcaaaatgaagaaacagcctaaaggatacgggcttcgttgtcatcgtgccattattacaatttgcagacttatcggaatcaaggatatgtatgccaaagtctccggtagtataaacatgctgagccttacccagggcctgtttagaggcctctcccgccaggagacgcatcaacaactggccgacaagaaaggactgcacgtcgtggaaattagagaagagtgcggccccctaccaatagtggtggcctcccctaggggtcctctgaggaaagacccggagcctgaggacgaggtgcccgatgtgaagctagactgggaggatgtgaagactgcccaggggatgaaaagaagcgtgtggtccaacctcaagcgcgccgccacatag

SEQ ID NO: 124685 - DNA, 378 bp, Artificial Sequence
  Description of Artificial Sequence: Synthetic coding sequence
atgcctaggtacgaattggctcttatccttaaggcaatgcagcgacctgagactgcggctaccctcaagcgaactatcgaggcattaatggatcgcggggccattgtccgagatctggaaaaccttggcgagcgcgccctcccttataggataagcgcacactcccagcagcacaataggggcggatacttcctggtggacttttacgcccctaccgccgcagttgagagcatggtggaacatctctcacgagacatcgacgtgataagaggaaatattgttaaacatccactcactcaggagctgaaggagtgtgaaggtattgttccagtccctctagcggagaaactgtatagcaccaagaagagaaagaagtag

SEQ ID NO: 124686 - DNA, 729 bp, Artificial Sequence
  Description of Artificial Sequence: Synthetic coding sequence
atggccgccccagccgtcaaggtggcccgtggatggtctggtctggcccttggggtgaggcgagccgtgctgcagctccctggactgacacaagtacgatggtcccgctactccccagaatttaaagaccccttaatagataaggagtattaccgcaagccggtggaagaactgacggaggaggagaagtacgtgcgagaattgaagaagacgcagctcatcaaggccgctcctgcgggaaaaacctcaagtgttttcgaggatccagttatatccaaattcacaaacatgatgatgattgggggcaacaaggtgctcgctcggtccctgatgattcagactctggaagctgtaaagcgaaagcagttcgagaagtatcatgcagccagtgcagaagaacaggccacaatagagagaaacccctacacaatctttcaccaggcccttaagaactgtgagcctatgattggactggtgcctatcctcaagggaggccggttttaccaggtgcctgtccccctacccgacaggaggaggcggttcctcgcaatgaaatggatgattaccgagtgccgggataagaagcatcagaggacactcatgcccgagaagctgagtcataagttgctcgaggccttccacaaccagggacccgtgataaagaggaaacatgacctccataagatggccgaagccaatcgagcgcttgctcattacagatggtggtag

SEQ ID NO: 124687 - DNA, 1191 bp, Artificial Sequence
  Description of Artificial Sequence: Synthetic coding sequence
atggccgcgccatgcgtgtcctatggtggcgctgtgagctatcgactgctgttgtggggaagaggcagtctggctcggaaacaggggctctggaagacagctgcgcccgagttgcagaccaacgtgcgttcacagatcctccggctccgccataccgccttcgtaattcctaagaaaaatgtgcctacgagcaagcgcgaaacctataccgaggatttcatcaaaaagcagatagaggagttcaatattggaaaacggcatctcgcaaatatgatgggagaggacccagagacctttactcaggaggacatcgaccgagccatagcatatctcttccctagcgggctgtttgaaaagagggccaggcccgtgatgaaacaccccgagcagatatttccccgtcagagagcaatccagtggggagaagacgggcgaccattccactatctgttttatactgggaagcagagttactatagtctgatgcacgatgtgtacggaatgctcctgaacctggaaaagcaccagagccatttgcaggcaaaaagcctgctgcccgaaaaaaccgtcacgcgtgacgtcatcgggtcccgttggctgattaaagaggaactggaggagatgctagttgagaagttatccgatctggattacatgcagttcatacgcctgctggagaaactcttaacctctcagtgtggagccgccgaggaggaatttgtgcagagatttcgaagatccgtgacgctagaatccaaaaagcagcttatcgagcccgttcagtacgatgagcagggtatggccttctcaaagagtgaagggaaacggaagaccgcgaaggccgaggccatagtgtataagcacggttccggtcgcatcaaagtgaacggtattgactaccagctgtactttccgatcacgcaagatagggagcagttgatgtttccttttcacttcgtagaccgactgggtaagcatgacgtgacttgtactgtgtcggggggcggtcggtcagcacaggctggcgcgatccggctagccatggcaaaggctctttgttcgttcgtcactgaggatgaggtcgaatggatgcgccaggccggcctgctgaccactgacccccgcgtccgggaaaggaaaaaaccggggcaggagggggccaggagaaagtttacttggaaaaaacggtag

SEQ ID NO: 124688 - DNA, 1122 bp, Artificial Sequence
  Description of Artificial Sequence: Synthetic coding sequence
atgtgggtgtgtagcacactctggcgcgtccgcacaccagccaggcagtggcgcggactgttgccagctagcggctgccacggacctgccgcgtctagttacagcgcgagcgccgaacctgcaagagttagagccctcgtttatggacaccacggggaccctgctaaggtggtggagctaaagaatcttgaactcgccgccgtccgcggtagcgacgtcagagtcaagatgctggccgcccccatcaatccttctgacattaacatgatacagggaaactacggcttcctgcccgagcttccggctgtgggtggaaacgaaggagtcgctcaggtagtggctgtcggctccaatgttacagggctaaaaccgggggattgggtgatacccgcaaatgctgggctcggcacctggaggacagaggctgtgttcagtgaagaggctctgatccaggttccatctgacatcccacttcagagcgcggctaccctcggcgtcaatccctgcaccgcctatcggatgcttatggacttcgagcagcttcaaccaggggactcagtgatccaaaacgctagcaatagtggtgtgggtcaggctgtcatccagatcgccgcagcactcggcctgcgcaccatcaacgtggtgcgcgacaggccagatattcaaaaactgagcgatcggttaaagtccctgggcgcggaacatgtaattaccgaagaagagctcaggcgccccgaaatgaaaaacttctttaaagatatgccgcagcctcggctggccctgaattgcgtcggcggcaaaagttctactgagctgttgcggcagctcgcaagaggaggtaccatggttacttatggcgggatggctaagcaaccggtggtggcttccgtttctctgctcatttttaaggatttgaaactccgcggattttggctgagtcagtggaaaaaggaccacagccccgatcaatttaaagagctcatcctaaccctgtgtgaccttattcggcggggacagctgaccgcccccgcctgctcccaggtgcctctgcaagactaccagtctgcattggaggctagcatgaaaccctttatcagctcaaaacagatcctgacaatgtag

SEQ ID NO: 124689 - DNA, 894 bp, Artificial Sequence
  Description of Artificial Sequence: Synthetic coding sequence
atgctggcagcccccataaacccctctgatatcaatatgatccaaggcaattatggcttcttgccggagctgcccgcagtcggaggcaacgagggggtcgcacaagtagtggccgtgggcagtaatgtgaccgggttgaaacctggggattgggttataccagcaaacgccggattgggcacatggcggactgaagctgtgtttagcgaggaagccttgatccaagtgccatcagatattcccttacaaagcgctgccaccctgggagtcaatccatgtacagcttacagaatgctcatggattttgagcagctacagccaggagattccgttattcagaacgccagtaacagcggcgtcggacaagcggtaatacagattgctgctgcattgggcctgcggacaattaacgtggtcagagaccgtcctgatatccagaagctaagcgaccgccttaaatctctaggggccgaacatgtgatcactgaggaggagctccgaaggccagaaatgaagaatttttttaaagacatgccacagcctagacttgccctgaattgcgtcgggggtaagtcctccaccgagctgttgcgacagctcgcaagggggggtacaatggttacttacgggggtatggccaaacaacccgtcgtcgcttctgtctcactgctgatttttaaagatctcaaattgagggggttctggctatcacagtggaagaaagaccacagccctgaccaatttaaagagcttatcctgaccctatgtgatctgattaggcgcggccagctcaccgccccagcctgtagccaagtgcctctccaggactatcagtctgcgttagaggcgtctatgaaaccattcatctctagcaaacagatcctgaccatgtag

SEQ ID NO: 124690 - DNA, 789 bp, Artificial Sequence
  Description of Artificial Sequence: Synthetic coding sequence
atgattcaaggcaactatggtttcttgccagagctgccagctgtgggcggcaacgaaggggttgctcaggtcgtcgccgtggggtccaatgtcaccggtttgaagcctggggactgggttatacccgccaatgcgggtctgggtacctggcgaacggaagcggtgttcagcgaggaggccttgatccaggtgccctctgatatcccactgcagagtgccgccacactgggtgtcaatccgtgtacagcttacagaatgttgatggatttcgagcagctgcagcctggggatagtgtgatccagaacgccagcaactcaggagttggtcaggcagtgatccagattgcagccgcccttgggctgcgcactattaacgtcgttagggaccgcccagatatccagaaactgtccgaccgattgaagtctctcggtgctgagcatgttatcaccgaggaggagcttcggagacccgaaatgaagaattttttcaaaatacgcaaactcagactcaggaaggaggagatgctgaaccagaatcacatcgtctacaagggcagcagggagtctgagctcgcaagtgtctctccgaactcgaaaccgctcaatctgcccgaaccccctcctcacaacatgccccgtcacgcccctgcgactgcctgcagccagttgtgttggtgggaaaaacttcaccgcgcagctgccgcggtatcagcttggaggaaccacggtaacctatggggggatggtcaggcggctagacgtagtctctgtgagccagcacatttctag

SEQ ID NO: 124691 - DNA, 570 bp, Artificial Sequence
  Description of Artificial Sequence: Synthetic coding sequence
gctaccctcggagtgaatccgtgcacagcatatagaatgctgatggacttcgaacagctgcagcccggggatagcgtcattcagaatgcgtcgaactcaggagtaggccaggccgttattcagatcgcagcagccctcggcctgcggaccatcaatgtggtaagggaccggcctgatatccagaagctgagcgacaggctgaagtccctgggcgcagagcacgtcattacagaggaggagctgcgtcgaccagaaatgaagaatttttttaaaatacgcaagttgcgtctaagaaaggaagagatgctaaatcagaatcatattgtgtataaaggctcgagggagtcagagctggcctcagtgtcacccaactcaaagccactaaaccttcccgagcctcctccccacaatatgcctaggcatgccccagctacagcatgtagtcagctgtgctggtgggaaaagctccacagagcagccgctgcagtgtcagcttggagaaaccacgggaacttatggggcgacggccaggcagcgcgaaggagcctgtgcgagcccgcgcacttttag

SEQ ID NO: 124692 - DNA, 1200 bp, Artificial Sequence
  Description of Artificial Sequence: Synthetic coding sequence
atgcagtccttaagtctgggtcagacaagtatttctaagggcctgaactatctcaccatcatggcccccggtaacctgtggcatatgcgcaacaactttctattcggctcccgctgttggatgacaaggtttagcgctgagaacatctttaaatccgtctcctttcgactgtttggcgtgaaatgtcataacaccgattcagagcctctcaaaaatgaagacctgttgaagaacctgctgacaatgggcgtcgatatagacatggcaagaaagcgccagccgggagtcttccataggatgatcactaacgaacaggacctcaagatgtttttattaagtaagggggcctcgaaggaggttattgcctcaattatcagccggtaccctcgcgcaataacacggactccggagaacttatcgaagcgctgggacctgtggcgtaagatcgtcacttctgaccttgagatagtgaatatcttggagagatcgcccgaaagcttctttcgttcaaataataacttgaaccttgaaaacaatataaagtttctctattcagtgggcctgactaggaaatgtctgtgcaggctgctaacgaacgcccctagaactttctctaatagcctggatctaaacaaacaaatggtggaattcctgcaggcggcaggcctctctctcggccataacgaccccgcagacttcgtgaggaaaattatctttaaaaatcctttcatcttaatccagtccactaaaagggtgaaagcgaatatagaatttctcaggtcgacattcaatcttaactcagaggagctgttggtgcttatatgtggccctggggccgaaatactggacttgtccaatgactatgcgcggaggtcctatgccaatattaaggagaaacttttctcccttgggtgtactgaggaggaggtgcagaaattcgtgctcagttacccagacgtcatttttcttgccgagaaaaagttcaatgataagattgactgcctgatggaggaaaatatctccatcagtcagattatcgaaaaccctcgggtcttggactcctctattagcacccttaagtcacggatcaaagagctcgttaacgctggatgcaacctttccaccctgaacatcaccctgctgtcatggagtaagaaacgctacgaagcaaagttgaagaaactgagcaggtttgcttag

SEQ ID NO: 124693 - DNA, 477 bp, Artificial Sequence
  Description of Artificial Sequence: Synthetic coding sequence
atgcaatcgttgtcattgggccagacatctatctcaaaagggctgaactatctgacaatcatggcccctgggaacctgtggcatatgaggaacaattttctttttgggagccgatgctggatgacaagattttctgctgagaacatctttaaatccgtgtcttttcgactattcggcgtgaagtgccataatactgactccgagccgctgaaaaacgaggatctgctgaaaaatctacttacgatgggtgtagacattgacatggcacggaaaaggcagccgggcgtgttccacaggatgatcaccaacgagcaggatctcaagatgtttttacttagcaagggggccagcaaagaggtaatcgcatcaatcatttccagatacccccgcgctatcacaagaaccccagaaaatctcagtaaacgatgggatctgtggcgcaagattgtaacatcagatctcgaaatcgttaattag

SEQ ID NO: 124694 - DNA, 2184 bp, Artificial Sequence
  Description of Artificial Sequence: Synthetic coding sequence
atgaatcagaagctgttaaagctggagaacctcctgagatttcatactatctaccgccagctgcactccctgtgtcagagacgtgccttgcggcagtggcgccatggcttctcgagcgcgtatccagtgtggacagcacagctttgtgcttggccttggccaactgatgttctgaccggggcggcactctctcagtacagacttttggtcacaaaaaaagaggagggtccctggaagtctcagctcagcagtactaagagcaaaaaggtagtagaggtctggatcggcatgactattgaggagctggcaagagccatggaaaaaaacaccgattatgtatacgaggctctgttgaacaccgacattgacattgacagcttggaagccgatagtcacttagatgaggtttggataaaggaggtgattacaaaagcagggatgaagttgaagtggagtaagctcaagcaggacaaagtgcgcaagaataaggacgcggtcagacggccacaggccgatccagccctcctcaccccacggagcccagtcgtaaccatcatgggacacgtggatcacggaaaaaccaccttgctagataaattccgaaagacgcaggtggctgctgtagagacgggcggcatcacacagcatataggtgctttcctcgtgagccttcctagtggggagaagataacttttctggatactccaggacatgcagccttttcagccatgagagcccgcggcgcacaagtaacagatatcgtcgtgcttgtcgtagccgccgacgacggggtgatgaagcaaactgtggagagcattcagcacgctaaggacgctcaggtcccaatcatactggcagtgaataagtgcgataaggcagaagctgatcccgaaaaagtcaagaaggagttgctcgcctacgatgtagtgtgcgaagattatggaggcgacgtgcaggcagttcctgtaagcgccctgaccggggataacctgatggctttggccgaggcaacagtggctctggctgaaatgttagagcttaaagccgatcccaacggccctgtagaaggaacggtcatcgagtctttcacagacaaaggccgcggactggttaccactgctattattcaacggggaaccctacgcaaaggctctgttctagttgcaggcaagtgttgggcaaaggttcgccttatgttcgacgagaatggtaagactatcgacgaagcgtatccctcaatgcctgtcgggatcaccggatggagggacctgcccagtgctggggaggagatattagaggtggagtcagagcctcgcgcccgagaagtcgtggactggaggaagtacgagcaagagcaggaaaagggacaagaggacttgaagatcatcgaggaaaaaaggaaggagcataaggaggcacatcagaaggctcgggaaaaatatggacatttgctctggaaaaagcgcagtatcctgaggttcctggaacgcaaagagcaaatacccctaaagcccaaagagaaaagagagcgagattctaacgtactgagcgtgattatcaagggagacgtggatggcagcgttgaggctatactgaacattatcgacacatacgacgcatcacacgaatgcgaactggagttagttcactttggcgtaggagatgtgagtgcaaatgacgtgaacttggccgagaccttcgatggcgtcatctatggtttcaacgtcaacgccggtaacgtcatacaacagtctgcagctaaaaagggcgtgaaaattaagttacataaaattatttataggctcgtggaggatctgcaggaggagctcagttcaagactcccatgtgccgtggaggagcatccggtgggcgaggcctccattttggccacatttagcgttacagaaggcaagaaaaaggttcctgtggccggctgtagggtgcagaaggggcagctggagaagcagaagaagttcaagttaacgcggaacggccatgtcatctggaaggggagcttgacatctttgaagcaccacaaagacgacatttctattgtgaaaacagggatggactgcggcctcagtctcgatgaggataacatggaattccaggtgggagatcggatcgtgtgttatgaggagaagcagatccaggccaaaacctcttgggaccccggattttag

SEQ ID NO: 124695 - DNA, 219 bp, Artificial Sequence
  Description of Artificial Sequence: Synthetic coding sequence
atgaatcagaagttgctgaagctggagaacttgctcaggtttcacaccatttatcggcagctccactcgctgtgtcagagaagagcactgcgccagtggaggcacgggtttagtagcgcctacccagtgtggaccgctcagctgtgtgcctggccctggcctaccgatgtgctgactggagccgcgctgagtcagtaccgattactggttacgaagtag

SEQ ID NO: 124696 - DNA, 2184 bp, Artificial Sequence
  Description of Artificial Sequence: Synthetic coding sequence
atgaaccagaagctattaaagctggagaatctgctgcgtttccatacaatctaccgacagctgcacagcctctgtcagcgcagagccctcagacaatggagacacgggttcagtagcgcttaccctgtatggaccgctcagctctgtgcgtggccctggcccaccgatgtgcttacaggcgccgctctgagtcagtaccgcctcctggtgacaaagaaggaggaggggccctggaaatcccagctgtcatccaccaaatctaaaaaagtggtggaagtgtggattggaatgactatcgaagagctggccagagcaatggaaaaaaatacagactatgtctacgaagccctgctgaacacagacattgatatcgatagtctcgaggctgatagtcacctagacgaggtctggatcaaggaagtcattaccaaggcagggatgaagctgaagtggagtaagctcaagcaggataaagtccgtaagaacaaggacgccgttcgaagaccccaggcggacccggccctgttaaccccccggtctccagttgttacaatcatgggccacgtggatcacggaaaaacaaccctgctggataaattcagaaaaacacaagtggccgcagtcgaaaccggcgggatcacacagcatattggcgccttcctcgtgtccctgccctctggtgagaagatcacttttttggatacccccggacacgcagcattctcagccatgagggcacgaggggcccaagtcactgacatcgtcgtgttggttgtcgccgctgacgacggtgttatgaagcagactgttgagagtatccagcacgccaaagacgcacaggtgcccattattctcgccgtcaacaaatgcgataaggccgaggcagacccagagaaggttaaaaaggagctactggcatatgacgtggtctgcgaggactacggcggggatgtgcaggccgtgccagtgtcagcactaacaggcgataatctcatggctttagccgaggctactgttgctctggcagaaatgctggagctgaaggcggaccccaacggcccagttgaaggcactgtcattgaaagtttcaccgataaaggacgaggtttagtgactaccgccatcattcagagggggaccctgagaaagggaagtgtcctggtggccgggaaatgctgggcgaaagtgagactcatgtttgacgaaaatggaaaaacaattgacgaagcctatccaagcatgcctgtcgggatcaccggatggagggatttgccgtccgccggcgaagaaatactcgaagtagagtcggagcccagagccagggaggtcgtggactggcggaagtacgaacaggaacaggagaagggccaagaagacttgaagatcatcgaagagaagcggaaggagcacaaggaagctcaccagaaggctagagaaaagtatgggcacctcctctggaaaaagcgcagtatactaagatttttggaacggaaggagcagatccctttgaaaccaaaagaaaaacgtgagcgagactcgaatgttctgagtgtaatcatcaagggagacgtagacggtagcgtggaagccatcttgaatatcatcgatacctatgacgcttctcacgaatgtgaactcgaattggtacattttggtgtgggggacgtgagtgcaaacgacgtgaatttagctgagacgtttgacggcgtcatctacgggtttaacgtcaatgcaggcaatgtcattcagcagtctgctgcaaagaaaggcgtgaaaatcaaattgcataaaataatctatcgcctagtagaagatctccaggaggaattatctagtaggttaccgtgtgccgtggaagagcaccccgttggtgaagcctctatactggctacgtttagtgtgacagagggaaagaaaaaagtgcctgtggccgggtgccgtgtgcagaagggccagctggaaaaacagaaaaaatttaagttgactcgcaatggacacgtgatttggaaaggttcacttacatccctgaaacaccacaaggacgatatcagcattgtgaagaccggaatggattgcggactgagtctggacgaagacaacatggagtttcaggtcggagaccgcattgtgtgctatgaagagaagcagattcaagctaaaacatcatgggatccgggattttag

SEQ ID NO: 124697 - DNA, 2184 bp, Artificial Sequence
  Description of Artificial Sequence: Synthetic coding sequence
atgaatcagaagctgctgaagctggagaacctgctccggttccacacaatctaccgacaactgcactctttatgccagagacgggcattacggcagtggcggcatgggttctcttccgcctacccggtctggaccgcccagctgtgtgcttggccttggcccaccgacgtacttacgggggctgccttgtcccagtaccgactcctggttaccaagaaggaggaaggaccctggaagtcacaattaagtagcacaaaatcaaagaaggtcgttgaggtttggattggtatgacaatagaggaactggctcgtgcaatggagaagaacaccgattacgtctacgaggctctcctgaacaccgacatcgacatcgacagcctggaggccgactcacatctggacgaggtatggatcaaagaagtgattactaaggccgggatgaaattaaaatggtcaaagctgaagcaggacaaggtaaggaaaaacaaggacgctgtgaggcgaccacaggctgaccccgctttattgacccctagatcccctgtcgtgaccatcatgggacatgtcgaccatggaaagaccacgcttctggacaaattccgtaagacacaggtagctgcagtggagaccggcggaatcacacagcatattggcgctttcttagtgagcttgccctccggtgaaaaaatcaccttcctggacactcctggccatgctgcgtttagtgctatgcgggccaggggcgctcaagtcacagacattgtcgtcctcgtcgtggccgcagatgacggcgtgatgaagcaaaccgttgagtccatccagcacgctaaggacgcccaagtgcctatcattctggccgtgaacaaatgtgacaaagccgaagctgaccctgagaaagttaagaaagaattattagcctacgatgtcgtctgcgaagattacggtggagatgtccaggctgtgcccgtttcagctctcacaggtgacaacctgatggcactggccgaggccacagtggctctagccgagatgctggagctcaaggctgaccccaacggcccagtcgagggtacagtgattgagagcttcacagacaagggcagagggctagtgacaaccgcaatcatccagaggggaacacttaggaagggctcagtgctggttgccggaaaatgttgggccaaagtgcgattaatgttcgatgagaatggaaaaacaatcgatgaggcataccccagcatgcccgtgggcattacagggtggcgggacctcccttcagcgggagaggagatcttggaagttgagagcgagccacgagctcgcgaggtggtggactggcggaaatacgaacaagaacaggaaaaggggcaggaggacttgaaaatcatcgaagagaaaagaaaagagcacaaggaggctcatcagaaagcaagggaaaaatacggtcacctcctttggaagaaaaggagcattctcaggtttttagagcggaaagagcagatccctctcaagcctaaggaaaagcgcgaacgcgacagtaatgtcctctcagtgatcataaaaggcgatgtagacggcagtgtcgaggcgatactaaacatcatcgacacctacgacgctagccatgagtgtgagctggaactcgttcacttcggtgttggggatgtgtcagcaaatgacgttaatctggccgagaccttcgatggagtgatctacggctttaacgtaaatgccggcaacgtcatccagcagtctgcggccaagaagggcgtgaaaattaagctgcacaaaattatctaccggctggtagaggatctgcaggaggaactttctagccgcctgccatgcgcagtggaggagcatccagtgggagaggcttctatcttagcaacattcagcgtcaccgagggaaaaaaaaaagtccccgtggcaggctgtagagtgcaaaaaggtcagcttgagaagcagaagaaattcaaacttactcgtaacgggcacgtcatttggaagggctctctgacttcactcaagcaccataaagacgacataagcatagtaaagacaggcatggactgtgggctgtcacttgatgaagataacatggagttccaggtgggagatcggattgtttgttacgaggagaagcagatccaggcaaagacatcctgggatcccgggttttag

SEQ ID NO: 124698 - DNA, 213 bp, Artificial Sequence
  Description of Artificial Sequence: Synthetic coding sequence
atgaatcagaaactactgaaactggagaatcttttgagatttcatacgatttatagacaattacatagcctctgccagcgccgtgccctacggcagtggcgccacggcttttcgtcggcctatcccgtatggacggctcagctgtgtgcttggccatggcccacagatgttctgacgggcgcagctctctcacagtacagattgctcgtctag

SEQ ID NO: 124699 - DNA, 24 bp, Artificial Sequence
  Description of Artificial Sequence: Synthetic coding sequence
atgaaccagaagctgctcaagtag

SEQ ID NO: 124700 - DNA, 33 bp, Artificial Sequence
  Description of Artificial Sequence: Synthetic coding sequence
atgaatcaaaagctgctgaagcttgagaactag

SEQ ID NO: 124701 - DNA, 81 bp, Artificial Sequence
  Description of Artificial Sequence: Synthetic coding sequence
atgaatcaaaaactgcttaaattagagaatcttcttagattccataccatttatcggcaactgcactccctctgccagtag

SEQ ID NO: 124702 - DNA, 216 bp, Artificial Sequence
  Description of Artificial Sequence: Synthetic coding sequence
atgaaccaaaaattgctaaaactggagaatctccttagattccatacaatttatcgtcagctgcactctctgtgccagcggcgcgcgctccggcaatggcgacacgggttctcttcggcatacccagtgtggactgcacaattgtgtgcctggccttggccaaccgacgtgctgaccggagccgccctgtcacagtatcgcctcctcgtcacatag

SEQ ID NO: 124703 - DNA, 1398 bp, Artificial Sequence
  Description of Artificial Sequence: Synthetic coding sequence
atgaatcagaagctgctgaagctggagaacttactccgctttcacacgatctatagacaactccacagtctctgccagaggcgggccctccgccaatggcggcacggcttttcttcggcctacccagtgtggacagcccaactgtgcgcttggccatggcccaccgacgtgttaaccggcgcagcgttgtctcagtacaggctcttggtgaccaaaaaagaggagggaccctggaaatctcagctgtcttcaacgaagagcaaaaaagtggtggaggtgtggataggcatgacaatcgaagaactcgcgagggctatggagaaaaacaccgattacgtgtatgaggccttactcaatacagatatcgacatcgactctttggaggccgattctcatctcgatgaagtgtggattaaggaggtcataaccaaggccggaatgaagcttaagtggagtaagctgaaacaggataaagtccgaaaaaacaaagacgctgtaagacgcccacaggcggacccagccctcctgactccacgctcacccgtcgtcaccattatgggccacgtcgatcacggcaagacaactctcctggacaagttcagaaagacccaggtggccgccgtggaaaccggcgggattacccaacacattggggcatttttggtgtcacttccttccggagagaaaatcacgtttctggacacacccggacacgctgctttctctgctatgcgtgctaggggggcgcaagtgactgatattgttgtgttagtcgtggccgccgacgacggggtgatgaagcagaccgtggaatctattcagcatgccaaagacgcccaggtccccataattctggcagtcaacaagtgcgataaagccgaagctgacccggagaaagtgaagaaggagctcctggcctacgacgtagtgtgtgaagattatggtggagacgtccaagccgtgccggtgagcgcactgacaggggataatcttatggccctcgctgaggctacagtggccctggccgaaatgctcgaactgaaggcggaccctaatggtccggtggagggtacagtgattgaatctttcactgacaagggccgggggttagtgaccaccgcaattatccaacgggggactctcaggaagggctctgtcttggtcgccggaaaatgctgggctaaggtccgtctaatgttcgacgagaacggcaaaactatcgatgaggcgtacccgagtatgcctgtcggaataacggggtggcgggatctccccagcgcaggagaggaaattttggaagttgagagtgaaccacgagcccgagaggttgtggattggaggaagtatgagcaggaacaggagaagggccaggaggatttgaaaaaggaaaaaaactag

SEQ ID NO: 124704 - DNA, 456 bp, Artificial Sequence
  Description of Artificial Sequence: Synthetic coding sequence
atgaaccgtcatttatgtgtgtggctgttcaggcacccatctctgaatggatatctgcaatgccacattcagctgcatagccaccaatttaggcagatccatcttgacacccgcttgcaggtttttcggcagaatcggaactgtatcctgcatctcctgtctaaaaactggagtaggagatactgccatcaggatacaaaaatgctctggaagcacaaagctctgcaaaaatatatggaaaatttgtcaaaggagtatcagaccctggagcagtgtcttcaacatatccccgtgaatgaggaaaatcgcagatcactgaatcggcgccacgcagagcttgctccactcgccgctatttatcaagaaatacaagaaaccgaacaggctatcgaagagctggagtcaatgtgcaaaaaaactgagtcttgctctgtcgcccaggccgggatgcagtag

SEQ ID NO: 124705 - DNA, 1338 bp, Artificial Sequence
  Description of Artificial Sequence: Synthetic coding sequence
atgaatagacatctctgcgtctggctgttccggcatccgagtctgaacgggtacttgcagtgccacattcaactgcacagccatcagtttcgacagatccacctggatacacggcttcaagtgttccggcaaaatcgtaattgcatactgcacttgctctctaagaactggtctcgtcgatactgccatcaggacactaaaatgctgtggaagcacaaggccctgcaaaagtatatggagaacctgtctaaggagtatcagacactggagcagtgtctgcagcacatccccgtcaatgaagagaatcggcgctcactcaatcgtaggcacgcagagctagcacctttagccgccatttatcaggaaatccaggagactgagcaagcaatcgaggagcttgaaagtatgtgtaagtctctgaacaaacaggatgaaaagcagctacaagaattggcactggaagaaagacagaccattgaccagaagattaacatgttatacaatgaactgttccagagcctggtccccaaagaaaagtacgacaagaacgacgtgatcttggaggtgaccgccggtagaactactgggggcgacatatgtcagcagtttacccgcgagattttcgacatgtatcagaactattcttgttacaaacattggcagttcgagcttctcaactatacccccgccgattatggcggactacaccacgcagccgcgcgaatctctggtgacggagtgtataaacaccttaaatacgaagggggcatacatcgtgtccagagaatcccggaggtaggattgtcaagtagaatgcagcgaattcacaccggtaccatgtcagtaattgtgctcccccagcctgacgaggtagacgtgaagctggatcctaaggatctgagaattgacaccttcagggcaaaaggtgcaggtggtcagcatgtcaacaagactgattccgctgtccgcttggtccacattccaacgggcttagtggtggagtgccagcaagagagaagccagatcaagaataaggagatcgcgttccgggtgctgcgagctcgcttgtatcaacagataattgaaaaagacaagcgacaacagcaaagcgcacgcaagcttcaagtggggacaagggcccagtcggagaggatccgcacatacaatttcacacaagatcgtgttagcgaccacagaatcgcttacgaggtgcgcgatattaaagagttcttgtgcggaggcaagggtctcgaccagcttatacagcgcctgttacagtctgctgacgaggaggcaatagcagaactgctcgacgagcatttgaaatctgcgaagtag

SEQ ID NO: 124706 - DNA, 1338 bp, Artificial Sequence
  Description of Artificial Sequence: Synthetic coding sequence
atgaaccggcatctttgtgtgtggctctttaggcatcccagcctgaacggataccttcagtgccatatccaactgcattcccaccagtttcgacagatacacttggatacacgcctgcaggtgttcagacaaaaccgcaactgcatcctccacctcctttccaagaactggtcccgccggtattgtcatcaggacactaaaatgctgtggaaacacaaagctctccaaaaatacatggagaacttgagtaaggaataccagaccttggagcagtgtctccagcacatccctgtgaatgaggagaatcgtagatcgctgaataggcgacatgctgaactggcgccgttggccgctatttaccaagagattcaggagactgagcaggccatcgaagagctcgagagcatgtgcaagagcctgaataagcaggacgagaagcagctgcaggaactggctctggaagaacggcaaacaatcgaccagaagattaacatgctttataacgagttatttcagagcctggttcccaaggagaagtatgacaagaacgacgtgatactcgaggtcaccgccggtcgaacgacaggaggagacatttgtcagcagttcactcgagagatctttgacatgtaccaaaactactcatgctacaaacactggcagttcgaattacttaattatacaccagctgattatggagggctacaccacgcagccgctcgaatcagcggggacggggtttataaacacctgaagtatgaaggaggcatacatcgggttcagcgcattcccgaggtgggcttgagctcaaggatgcagcgaatacacacaggcacaatgagcgttatcgtccttcctcagcctgacgaggtggacgtgaaactggatcccaaggatctccgtattgacacgtttcgggccaaaggtgccggtggacagcacgtcaacaaaacagattctgctgtcagactcgtccacattccaactggcctggtcgtcgagtgtcagcaggaaagatcccagattaaaaacaaggagatagccttcagggttctgagagccagactgtatcagcaaatcattgaaaaggacaaaagacagcaacaatcagcccgcaaactgcaggtgggcactcgtgctcagagcgagcgaattcgaacttataacttcactcaggatagggtcagtgatcatcgaatcgcatacgaggttcgcgacattaaggaattcttgtgcggaggaaaagggctagaccaactcatacagaggctgctgcagtcagccgacgaggaggctatcgccgaactgcttgatgaacacctcaaaagcgctaagtag

SEQ ID NO: 124707 - DNA, 1407 bp, Artificial Sequence
  Description of Artificial Sequence: Synthetic coding sequence
atgggcaacggtgaggttgtgcttttctcagatgccgagatgaatcgacacttatgcgtttggctcttcaggcacccatcccttaacggatacctgcagtgtcacattcagctacactcgcatcagtttcggcagatacacttagacacaagattacaggtgtttcgccagaaccggaattgtattttgcacctgctgtcgaagaactggtcaagaaggtactgccatcaggacaccaaaatgctctggaagcacaaagcactgcagaagtacatggaaaatctttccaaagaatatcagaccctggagcagtgcctacagcatatccccgtgaatgaggagaatcggcgaagccttaatagacggcacgcagagctggcccccctcgccgcaatatatcaggaaatccaagaaactgaacaggcaatagaggaattggaaagcatgtgtaagtcactgaacaaacaggatgagaagcaattgcaagagctggctctggaggagcgacagacaatcgaccagaagattaatatgctgtataacgaacttttccagagtctggtgcctaaagaaaagtacgataagaatgacgtaattctggaggtgactgccgggcgaactacgggcggcgacatatgtcaacagttcacaagggaaatctttgatatgtatcagaattattcttgctataaacactggcagttcgagctcttaaactataccccagccgattacggagggttgcatcacgcggccgctaggatatcaggggatggggtgtataagcacctcaagtatgagggtggcatacatcgggtgcagagaattcccgaagtgggtctgagtagcaggatgcagagaatccataccggcacaatgtcggtgatagtgctgccgcaacccgacgaggtcgacgtaaagctagatcctaaggatcttaggatcgacacttttcgcgctaagggggcgggaggccagcacgtcaacaaaaccgatagtgctgtccgtctcgtccacattcctactggccttgtggtcgaatgccagcaggagagatcacagatcaagaataaggagatcgccttcagggtgttacgggcgagactctaccaacagatcatcgaaaaagataagcgccagcagcagtccgccaggaagctccaagttggcaccagagctcagtccgaaagaattagaacctacaatttcactcaagacagggtgtctgaccataggatcgcatatgaggtccgggacatcaaggctcaatcacacagcactggaggctctcgagacccggcccattcgacattcctaagcctagattcagtcaggagcccaggtattctgattatgacctcctctgttcgcaacttctacgtcgtgggccgtgcttggatctcatag

SEQ ID NO: 124708 - DNA, 2274 bp, Artificial Sequence
  Description of Artificial Sequence: Synthetic coding sequence
atgagcctacttttcagtcggtgcaatagtattgtaacagttaaaaagaacaaacgacatatggctgaagtcaacgcttccccgctcaaacactttgtgactgccaaaaaaaagatcaatggtatcttcgaacagttgggggcctacatccaagagtcggcaacctttctggaagatacttatagaaatgccgaattggatccagtgacaaccgaggagcaagtattagacgtaaaaggctacctcagcaaggttcggggtatatctgaagtcctggctcgacggcacatgaaagtggcattctttggtcggacatcgaatggcaaaagtactgtgattaatgctatgttatgggataaagttttgccaagtggaatcggccacaccactaattgctttctcagggtcgaggggactgacgggcacgaagccttcctgctgacagaagggtccgaggaaaagaggtctgcgaagaccgtaaaccagcttgctcatgcattgcaccaagataaacagctgcatgccggcagtctggtctcagtgatgtggcctaattccaagtgtccactcttaaaagacgatctcgtactaatggatagccccggcattgatgtgactacggagttagactcctggatcgacaagttttgtctagatgctgacgttttcgttctggtggccaactcagaatccactttaatgcaaacagagaaacacttctttcacaaggtatccgagagactatctcgcccaaacatctttatcctcaacaaccggtgggatgctagcgcgtctgaacctgagtatatggaggaggtaagaagacagcatatggagagatgcacctcattcctggtggatgagctgggcgtggtggacagatctcaggccggcgatcgcatcttctttgtgagtgccaaggaggttcttaacgcccggatacagaaggcccagggcatgccggagggtgggggtgccttagccgaaggttttcaagtgcggatgtttgaatttcagaatttcgaacggagatttgaggaatgtatttctcagtccgccgttaagaccaagtttgaacagcacaccgtcagggccaaacaaatcgccgaggcagtgcgactgatcatggatagccttcatatggccgcgcgcgagcagcaggtgtattgtgaagaaatgcgggaggaaaggcaggacagactgaagttcattgacaaacaactcgagctgctcgcccaggattataaactgcgtataaagcagataacggaggaggttgaaaggcaggtatccactgcaatggctgaggagatccggcgcttgagtgtgctcgtggacgattatcagatggatttccatccaagccctgtggtcctgaaggtgtataagaatgagttgcatcggcatattgaagaagggcttgggcgaaacatgtccgatcgctgttcaacagccatcaccaactcactccagaccatgcagcaagacatgatcgacggactgaaacccttactgcccgtgtccgttcggtctcagattgatatgctggtgccacggcagtgctttagcttgaactatgacctgaattgtgataaactctgcgctgatttccaggaagacattgagtttcatttttccctcgggtggaccatgctcgtgaatcgctttctggggcccaaaaactccaggcgcgctctgatgggatataacgaccaggtgcagcggccaattcccctgaccccagcaaatccctccatgccacccctgccgcagggttcgctgacccaggaagaattcatggtgagcatggtgactgggctagccagtctaacatccaggacatctatgggtattctggtcgtggggggagtggtgtggaaggccgtaggctggcgacttatcgcactctcctttgggctgtacggcctgctgtatgtctacgagcgcctgacttggactactaaggccaaggaacgagccttcaaaaggcagttcgtcgagcacgcatccgagaagttgcagctcgtaatcagctataccggatccaattgtagccatcaagttcagcaggagctgtcgggaacttttgctcacctctgccagcaggtcgatgttacacgggagaatctcgaacaggagattgcagccatgaataagaagatcgaggttctggattctctgcagtcaaaggcgaagctgctccggaacaaggccggatggctggactccgaactgaatatgtttacccaccaatatttgcagccttctcgctag

SEQ ID NO: 124709 - DNA, 1311 bp, Artificial Sequence
  Description of Artificial Sequence: Synthetic coding sequence
atgcacccgcatctgtcaaccctcagtctccctcgcaggaggtctatggcctttctgagttcctggggagcccttgccgagggctttcaggtgcgaatgttcgagttccagaattttgagcgaagattcgaggagtgcataagccagagtgctgttaagacaaagttcgaacaacataccgtccgagcaaagcagatagccgaggctgtcaggctcatcatggattcactgcacatggcggcccgggaacagcaagtatactgtgaggaaatgagagaagagcggcaagataggctgaagtttattgataagcaactcgagctgcttgctcaggattataaactgcgaatcaaacagattactgaggaggtggagcgccaagtatccacagccatggctgaagagattcgacggctgtccgtgcttgtggacgactatcagatggacttccacccctctccagtggttctcaaagtgtataagaacgagctgcatagacatatagaagaaggcctagggagaaacatgagtgacaggtgttctacagctattacaaattcgctgcaaactatgcagcaggatatgatcgatggactgaagcccctgttgcctgttagcgttcgctctcaaattgacatgctcgttcctcgacagtgcttctcgttaaactatgatctgaattgcgataagctctgtgcagacttccaggaggatattgagtttcattttagcctcggttggacaatgctggtgaaccgctttttaggacctaaaaattctcgacgcgccttgatgggctacaacgatcaagttcagcgtccaatcccactaacacctgctaatccgagcatgcccccactgcctcagggcagcctcacccaggaggaatttatggttagtatggtaactgggttagcctcgctgacatccaggacgtctatggggattttagtggtgggaggagtagtatggaaagcagtcgggtggagactgatcgctttgagtttcgggctttacggtctgctatatgtctatgagaggttgacttggactacaaaggctaaagaaagggcattcaaacgtcagttcgttgagcatgcgtcagaaaaactgcagctcgtgatctcatacacaggatctaactgttcccaccaggtgcagcaggaattatctggaacatttgcccacctctgccagcaagtcgatggcgaaaccctgtccgaaaggtcaatggcaaagtcaaccctgatgctgctgaccctcctgtttctgtgttcttttgccggcgcccaggatgtgctgacccaatag

SEQ ID NO: 124710 - DNA, 297 bp, Artificial Sequence
  Description of Artificial Sequence: Synthetic coding sequence
atgagccttctgttcagtcgttgcaattccatagtgactgtgaaaaaaaacaagaggcacatggctgaagtaaatgcttctcccctgaagcactttgtaacagcgaagaagaagatcaatggtatattcgagcagctgggcgcctacattcaagagtccgccacctttctggaggacacttacagaaatgccgagcttgaccccgtgactacggaggaacaggtgctagacgtgaagggatatctctctaaagtccgaggcatctccgaagtccttgcccggcggcatatgaagtag

SEQ ID NO: 124711 - DNA, 2274 bp, Artificial Sequence
  Description of Artificial Sequence: Synthetic coding sequence
atgagcctgctgttcagccgttgtaattctatcgtcacagtgaagaagaataagcgccatatggctgaagtgaatgcatcaccactgaagcatttcgtcaccgccaaaaaaaagataaatgggatcttcgagcagctgggtgcctacatccaggaaagtgccacatttctcgaagacacctaccgaaatgctgaactggatccggttacgacagaagaacaggtgctcgatgtgaaaggttacctgagcaaagtgagaggtatctctgaggtgttggcacggcgccatatgaaggtggcgttttttggacggacatcaaacggtaagagcacagtgataaacgcaatgctttgggataaagtcctcccttctggcatcgggcacacaactaattgtttcttgcgggtggagggcacggacggacacgaggcctttctgctgaccgaaggctccgaagagaagagaagcgcgaagaccgtgaaccaattggctcacgctttacaccaagacaaacagctgcacgctggctctctcgtgagcgtcatgtggccgaatagtaagtgcccgcttctcaaagatgacctggttctgatggacagccctggtatcgacgtaactacagagctcgactcttggatcgacaagttttgcttagatgcggacgtcttcgtactggtcgccaattccgagtctaccctgatgcagacagagaagcattttttccataaggtgtccgagagacttagccgtcctaatatattcatcctgaataaccggtgggatgcctcagctagcgaacccgagtacatggaggaggtccggaggcaacatatggaaagatgtaccagctttctcgttgacgaactgggcgttgttgatagaagccaggccggcgatagaatattctttgtgtcagcaaaagaggtactcaatgctagaatacaaaaagctcagggcatgccggaagggggtggagctctcgcggagggcttccaggtccggatgtttgaattccagaatttcgagaggcggttcgaggagtgcattagccagagtgctgtaaaaacgaagttcgagcagcatacggtgagagccaagcagatagctgaggctgtccgcctgatcatggatagcctgcacatggccgccagagagcaacaggtgtactgcgaagagatgagagaagagaggcaggatcgactaaagtttattgataaacagttggagctgctggctcaggattacaagctgaggatcaaacagattacagaagaggtggaacgccaggtctccaccgctatggcagaggagatccgtaggctgtccgtgctggtggacgattaccagatggattttcaccccagtcctgtggtgctgaaagtctacaagaacgagctgcaccggcatatagaagaggggcttgggcggaacatgtctgataggtgttccaccgctatcactaattccctgcagaccatgcagcaggacatgatcgatggactcaagcctttattgcccgtgtcggttcgtagccaaattgacatgcttgtgccacggcagtgcttcagtcttaactacgatctcaattgcgacaagctgtgtgctgactttcaggaggacatcgaatttcatttctcactaggatggacaatgcttgtgaacaggtttctggggccaaagaattcacgccgagcgcttatgggctacaacgatcaggttcagcgaccaatacctctcactccggcaaatccaagcatgcctcctttacctcagggaagcctcacccaggaagagttcatggtgagcatggttacaggtttggcgtcactcactagcaggacttccatgggcatcttggtggtgggtggcgtggtgtggaaggctgtgggatggaggctcattgccctgtcattcggattgtacggactgctgtacgtgtacgagcggctcacctggaccacaaaggctaaggaaagggctttcaagcgccagtttgttgaacatgcctcagaaaagctgcagctggtgatcagttatacggggtccaattgctcccatcaagtccagcaggaactcagcggaactttcgcccatctgtgccagcaggtcgatgtcactcgggaaaatctcgaacaggagatcgcagccatgaacaagaagatcgaagttctggactctcttcagtctaaggctaaactgctaagaaacaaggcaggttggttggactcagaactgaatatgttcacccaccagtatttacagccatctcgatag

SEQ ID NO: 124712 - DNA, 1395 bp, Artificial Sequence
  Description of Artificial Sequence: Synthetic coding sequence
atgagtctgcattttctgtattattgcagtgaaccaaccctcgatgtaaaaattgccttctgccaaggcttcgataagcaggtggacgtgtcttacatcgccaagcactacaacatgtccaaatccaaggtggataatcagttttactcagtcgaggtgggtgactccacctttacagtgttaaaacgctaccaaaacctcaagccaatcggaagcggagcacaggggatagtttgtgctgcctacgatgctgtgctggacagaaatgtggccatcaaaaaactaagtcgaccattccagaatcagacccacgcaaaaagagcttaccgggaactggtgttgatgaaatgtgtgaatcacaagaatattatttcactgctgaacgtgttcactccccaaaagacgctcgaggaatttcaggacgtatacctggtaatggaacttatggatgcgaacctgtgtcaggtcatccagatggagctggatcacgagcgcatgagctacctgctctaccaaatgctgtgtggaattaaacatttgcactccgcgggcataatacaccgcgatctgaagccgtccaatatagttgtgaagagcgattgtacactaaaaatcctcgattttgggcttgcacgtactgccggtacatcttttatgatgactccttacgtggtcacacgatattatagggcacctgaagttatattgggcatgggatataaagagaacgtggacatctggagtgtgggctgcatcatgggcgagatggtccggcacaagatcttgtttcccggtcgagattatatagaccagtggaacaaagtgatcgaacagttaggtacaccctgccccgaattcatgaagaaattgcagccaactgtccgcaactacgtggaaaaccgaccaaaatacgctggcctgactttcccgaaactgttcccagactctttattccccgctgacagcgagcataataaactgaaggccagtcaggcacgcgatctgctgtcaaaaatgttggtcatcgatccagcgaagaggatttccgttgacgatgctttgcagcacccctacattaacgtgtggtatgacccagccgaggtggaagctccccctccccagatttatgacaaacaacttgatgaaagagaacataccattgaggaatggaaggaactgatttacaaggaggtgatgaacagcgaagagaagaccaagaacggcgtggtgaaagggcagccatccccatccggagccgctgtaaatagtagcgaatcccttccacctagctcatctgtaaatgatatttcatcgatgtcaacggaccaaacactcgcctccgacacggatagtagcctggaggcatcagctggaccgttgggatgctgccggtag

SEQ ID NO: 124713 - DNA, 1269 bp, Artificial Sequence
  Description of Artificial Sequence: Synthetic coding sequence
atgagccttcacttcctgtattattgcagtgaaccaactcttgacgtgaagatcgcattctgtcagggctttgataagcaagtagacgtcagctatatcgccaagcattacaatatgtccaaaagtaaggtcgataaccagttctattctgtggaggtgggtgacagtacatttacagtgctcaaacgttaccagaacttaaagcctatcggaagcggcgcccaagggatcgtctgtgcagcctacgatgcagtcctggaccggaacgtcgcaatcaaaaagctgagtaggcccttccagaatcagacacatgccaaacgggcctaccgggagctcgtgctcatgaagtgcgtcaaccacaagaatatcatcagcctgctgaacgtgtttacacctcagaaaacacttgaggagttccaggacgtttatctggttatggagcttatggatgcaaacctctgccaggtcatccaaatggaactcgatcatgagcgcatgtcctacctcctgtaccagatgctgtgtggcatcaagcacttgcatagtgcgggtatcattcatcgggacctcaaaccatccaatatcgtcgttaagagcgattgtacccttaagattctggattttggcctggcgcggacggctggcacaagctttatgatgactccttatgtagttacgagatactatcgggctccagaagtgatactcggaatgggttacaaagaaaatgttgatatatggtcagtagggtgcatcatgggcgagatggtgcgacacaagatcctcttccctggccgcgattacattgatcagtggaacaaggtcatcgaacagctaggaaccccctgcccagaattcatgaaaaaactgcaaccgaccgtcagaaactacgtcgagaatcggcctaaatatgcaggattaacatttcctaagctctttcctgatagcctcttccctgccgactccgagcacaacaagcttaaggctagtcaagcccgtgacttgctgtccaaaatgctggtaattgatcctgctaaacgcatctcagtcgatgatgcgctacagcatccctatatcaacgtctggtacgatccagccgaagtggaagcacccccacctcagatttatgataaacagctggatgagagagaacataccattgaggagtggaaggagttaatttacaaagaagtgatgaattctgaggagaaaaccaagaacggagtggtgaagggccaaccctcgccctcagctcaggtgcagcaatag

SEQ ID NO: 124714 - DNA, 960 bp, Artificial Sequence
  Description of Artificial Sequence: Synthetic coding sequence
atggagcttatggacgccaatttatgccaagtgattcagatggaactggaccatgagcgcatgtcctacctcctatatcaaatgttatgcggcatcaagcacctgcacagtgccggcatcatacaccgggacctgaagcccagcaacatcgtggtgaaaagcgattgtactctgaaaatcttggacttcgggctcgccagaaccgctggtacatctttcatgatgacgccttatgttgtcaccagatattacagggccccagaggtaatcctaggcatggggtacaaggaaaacgtggacatatggtcagtcgggtgcattatgggcgaaatggttagacataagatactgtttccaggaagggactacatagatcaatggaataaagtaatagagcagctcgggactccttgtccagagtttatgaaaaaactgcagcctactgtgcggaactacgtggaaaacaggccaaaatacgccggattgaccttccctaagctgttccccgactctcttttccctgcagattccgagcataataaactcaaggcttcacaggcacgggatctgttgagtaaaatgctggtcatcgacccagccaaaaggataagcgtggatgacgctctgcagcacccctatattaatgtctggtacgaccctgcagaagtggaagcccctccaccacaaatttacgacaaacagctggacgagcgggagcatactattgaggagtggaaggaattgatatataaggaggtgatgaactctgaggagaagacgaagaatggggtggtgaagggacagcctagccctagcggagctgcagtgaacagcagcgaaagcctcccacctagctctagcgtgaatgacatctcctctatgtccactgatcagaccctggcctcagatacagactcttctctggaggcctcagccgggccattgggatgctgcaggtag

SEQ ID NO: 124715 - DNA, 834 bp, Artificial Sequence
  Description of Artificial Sequence: Synthetic coding sequence
atggagttaatggatgcgaacttgtgccaggtgatccagatggaattagatcacgaacgcatgtcctacctgctttatcagatgctttgcgggataaaacatctgcactctgcgggaattatccacagagacctcaagcccagcaacatcgtcgtcaagagcgattgtaccctgaaaattctggacttcgggctggcccgcacggccggtaccagcttcatgatgacaccatatgtggtgactcgctactatagggccccagaggtgatactgggaatgggctacaaggagaacgtggacatttggtccgtgggatgtatcatgggggagatggtccgccacaagattctattcccggggcgagattatatcgaccagtggaataaggtgatagagcagctgggaactccatgtcccgagttcatgaagaagctgcagccaactgtgcggaattacgtagaaaacagacctaaatacgccggtctgactttccccaaactttttcctgatagtctgttcccagccgattctgagcataataagctgaaggcaagtcaggctcgtgaccttctatctaaaatgctggtgatcgaccccgccaaacggatctcagtggacgacgcattgcagcatccttacataaacgtgtggtacgaccccgccgaagtggaagcaccccctcctcagatttacgataagcaactggacgagagggaacacacaattgaggagtggaaggagctgatttacaaggaggtgatgaatagcgaagaaaagacaaagaacggtgttgtgaagggccaacctagccctagtgctcaggtgcagcagtag

SEQ ID NO: 124716 - DNA, 1269 bp, Artificial Sequence
  Description of Artificial Sequence: Synthetic coding sequence
atgagcctacacttcctatattactgctcggagcccaccctggatgtgaagatcgccttttgccagggcttcgacaaacaggtagatgtgtcctacattgctaagcactacaacatgtccaagagcaaggtggacaaccagttttattccgtagaagtaggtgactcaacctttactgtcctgaagcgttaccagaatttaaagccaatcggttctggggcccaggggattgtgtgtgctgcctacgatgccgtgcttgaccgaaacgtggccatcaaaaagctgtcacggccttttcaaaatcagacacacgccaagcgagcctatcgtgagctggtgttgatgaaatgcgttaaccataagaatattatatcgctgcttaacgtatttacgcctcagaaaactctggaggagttccaagacgtctatttagttatggagcttatggacgcaaacctgtgccaagtgatccagatggaactggatcacgagcgcatgtcttacctgctgtatcagatgttgtgcggcattaagcacctgcacagtgccggcattatccaccgagaccttaagcccagcaacattgtggtaaagagtgattgtacccttaaaattcttgacttcggactggcacgcaccgccggaacctcattcatgatgacgccctatgtggtgactaggtattatcgcgctcctgaggttatcttgggaatggggtataaagaaaacgtggatatttggagtgtgggatgcatcatgggagagatggtcaggcataagatcttgtttcccggccgcgattatatcgatcagtggaacaaagtcatcgagcaactgggaacaccctgtccggagtttatgaagaaacttcagccgaccgtccggaattacgtggagaatcggcctaaatatgccgggttaacatttccgaagttatttcccgacagcctgtttcccgctgactctgaacataataaattgaaggcttcacaggccagggatctcctgtctaaaatgttggtgatagaccccgccaagcgcataagcgtggatgacgccctgcagcatccttacatcaatgtctggtacgatcctgcggaagttgaggcacctccgccacagatatatgataagcagcttgacgagagagagcatacaatcgaggaatggaaggagctgatttataaggaggtgatgaactctgaggagaaaacaaagaatggagtggtgaagggccagccgtccccatcagctcaagtccaacagtag

SEQ ID NO: 124717 - DNA, 1281 bp, Artificial Sequence
  Description of Artificial Sequence: Synthetic coding sequence
atgtccaagtctaaggtggataatcagttttacagtgtcgaagtgggggattctacgtttacagttttgaaaagataccagaatctaaagccaatcggatcaggagcacaggggattgtgtgcgccgcctacgacgccgtgctagaccgtaacgtcgctattaagaagctttccagaccatttcagaaccagacccatgccaagagggcgtaccgggagctcgtcctgatgaaatgcgtaaaccataaaaacattattagcctgctgaacgtctttaccccgcagaagacattggaagaatttcaggacgtctatctcgtcatggaactgatggatgcaaacctgtgtcaggtaatccagatggaattagaccatgagcggatgtcctacctcctgtaccagatgctgtgtgggattaaacaccttcattctgcaggtattattcacagggaccttaaaccctcaaacattgtggtcaaatcggattgcacactgaagatccttgattttggattagcaaggacagccggtacaagtttcatgatgacgccatacgtagtgacgaggtactacagagctcccgaagtgattttggggatgggatataaagagaacgtggatatatggtccgtgggctgcatcatgggagaaatggttcgccacaagattctcttccctgggcgggactatatcgatcagtggaataaggttatcgagcagctaggtaccccctgtccggaattcatgaaaaagctgcagcccaccgttcggaattacgtcgagaaccgaccaaagtacgctggtctgactttccccaaactgttccccgactctctgtttcctgccgattctgaacataataagctgaaggcttcacaggcccgcgatctgcttagcaaaatgctggtgatcgacccagccaaaagaatctcagtcgatgacgctttgcagcatccatacattaatgtctggtatgaccctgccgaagtcgaggcccctcccccgcagatctacgataagcagcttgacgagagagagcatacgattgaggagtggaaagagcttatctataaagaggtcatgaatagcgaagagaagaccaagaatggtgttgtgaaaggacagccatcaccttcgggtgctgccgtgaattcatctgaatcattaccgccctcctcatcagttaacgatatctcgtctatgagcactgatcaaactttagcgtccgataccgacagctctctggaggcctccgccggccccctgggttgttgtcgatag

SEQ ID NO: 124718 - DNA, 1281 bp, Artificial Sequence
  Description of Artificial Sequence: Synthetic coding sequence
atgtctaagtcaaaggtcgataaccagttttactccgtagaggtaggagattctacttttaccgtgctgaagcgttatcagaatctgaaacctatcggatcgggggctcaggggatcgtgtgtgcggcctacgacgcagttctggaccgcaacgttgcgattaaaaaattgtctcgccctttccaaaatcagacacacgccaaaagagcttaccgagagctcgttcttatgaaatgcgtgaaccataagaacataatctccttactgaacgtgttcaccccacagaaaacgctcgaggagtttcaggatgtttacttggtgatggaattaatggacgcaaacctgtgtcaggtgatccagatggagcttgaccacgagcgaatgtcttatttgctgtatcagatgctttgcggcatcaaacatctgcatagcgccggcatcatccatagggatctgaagcccagcaatatcgtggtcaaatccgattgcaccttaaagattctggacttcggactggccagaaccgcaggtaccagcttcatgatgacaccttacgtggttacccgatattacagagctcctgaggtgatcctgggaatgggctataaggagaatgtagacatttggtcagtcggttgcattatgggcgaaatggtgcggcacaagatcttgttcccaggccgtgattacatagaccagtggaacaaagtgatagaacagcttggcacgccgtgccctgagttcatgaagaaacttcaacctaccgtgcgaaactatgtggaaaataggccgaagtacgcgggcctcaccttccctaagctgttcccggacagcctctttccagccgatagcgaacacaacaagctcaaagcgtcccaggctcgggacttgctttccaaaatgctcgtgattgatcccgctaaaagaattagcgtcgatgatgctttgcagcatccatacataaacgtgtggtacgaccccgcagaggttgaggctccacctccgcagatctacgacaagcagctggacgagcgtgaacatacgattgaagaatggaaagagctcatttacaaagaggtgatgaactccgaagaaaaaacgaagaatggtgtggtgaagggtcagccgtcgccttctggcgccgctgtgaactcgtccgagagtttacctccctctagcagcgttaacgacatatccagcatgtccaccgatcagacactagccagcgacaccgacagtagcctggaagcctccgccggacccctgggctgctgtagatag

SEQ ID NO: 124719 - DNA, 960 bp, Artificial Sequence
  Description of Artificial Sequence: Synthetic coding sequence
atggagctgatggatgccaacctttgtcaagtgattcaaatggagctggaccatgaaaggatgtcctacctcctgtatcaaatgttgtgcggaatcaagcacctgcactctgcgggcatcatccaccgggatctcaaacctagcaatattgttgtgaagtccgattgtactctgaaaattctcgactttggcctggcgcgaacagctggcaccagctttatgatgaccccctatgttgtgacacggtattaccgggcccctgaggtgattctcggcatggggtacaaagagaacgtcgacatgtggtcagtgggatgtattatgggggaaatgatcaagggcgccgtcttgttccccggaactgaccacatcgaccagtggaataaggtgattgagcagttaggtaccccatgtcctgagttcatgaaaaagctgcagcccacagttcgtaactacgtggaaaatcggcccaagtacgcagggttgacctttcctaagttgtttcctgacagcctctttcccgccgactctgagcacaacaagctcaaggctagccaagcccgggatctgctgagtaaaatgctcgtcatagaccctgcaaagcgcatttccgttgacgacgccctccagcacccctacattaatgtgtggtatgaccctgccgaagtggaggccccgcccccacagatctacgataaacagctggatgagcgggaacacacgatagaggagtggaaagaacttatttataaggaggttatgaactctgaggaaaaaactaagaacggcgtggtgaagggtcagcctagcccatctggtgcagcagtcaatagctctgaatcgttgcctccctcttccagcgtgaatgatattagctccatgtcaacagatcagacccttgcatccgatacggattcaagcctcgaagcatcagccgggccgctcggctgttgtcgctag

SEQ ID NO: 124720 - DNA, 102 bp, Artificial Sequence
  Description of Artificial Sequence: Synthetic coding sequence
atgagcaagagtaaagtggacaatcaattttatagcgtagaggtgggggactcgacattcaccgtactgaagcggtaccagaatcttaaaccaatcgggtag

SEQ ID NO: 124721 - DNA, 156 bp, Artificial Sequence
  Description of Artificial Sequence: Synthetic coding sequence
atgtctctgcacttcctgtactactgtagtgagcctacactggacgtgaaaatcgctttctgccagggattcgacaagcaggtggatgtgtcttatatcgcaaagcattataatatgtcgaagagcaaggttgacaatcagttttactcagtgtag

SEQ ID NO: 124722 - DNA, 276 bp, Artificial Sequence
  Description of Artificial Sequence: Synthetic coding sequence
atgtcacttcactttttatattactgcagcgagccaaccctggatgtgaagatagccttctgccagggcttcgataagcaggtagatgtcagctacatcgccaagcactataacatgtcaaaaagtaaagtagacaaccagttttattcagtggaggtgggggactcaacattcaccgtgctgaagcggtaccaaaatttgaagcccatcgggtcaggtgcacagggcattgtgtgtgcggcctacgatgctgtgctagatagaaacgtggcctag

SEQ ID NO: 124723 - DNA, 225 bp, Artificial Sequence
  Description of Artificial Sequence: Synthetic coding sequence
atgagcaaatcgaaagtggataaccagttctacagcgtggaggtgggagactccacctttacagtgctgaagaggtatcaaaatttgaagccaattggcagtggcgcacagggcattgtgtgtgcagcgtacgatgctgtgctagatagaaacgtggccatcaaaaaattgagccgccctttccagaatcaaacacacgccaagcgtgcatacagggaactttag

SEQ ID NO: 124724 - DNA, 366 bp, Artificial Sequence
  Description of Artificial Sequence: Synthetic coding sequence
atgagcctgcatttcttatactattgttccgagccaacgttggatgtgaaaattgcgttttgtcagggctttgataaacaagtggacgtgtcctacatcgctaagcattacaatatgagcaaatctaaggtggacaatcagttctattctgtggaggtgggcgactcgacatttaccgtgctgaaaagatatcaaaacctgaaacccattggcagcggagcccaaggaatcgtctgcgccgcatacgacgccgtcttggatcgaaacgtagccataaagaaactttcccggccatttcaaaatcagacccacgccaagcgtgcctacagagaactcgtgcttatgaagtgtgtgaaccacaagtag

SEQ ID NO: 124725 - DNA, 354 bp, Artificial Sequence
  Description of Artificial Sequence: Synthetic coding sequence
atgtcgctccacttcctgtactactgttccgaaccaactttggacgtgaaaatcgcattttgccagggcttcgataagcaagtcgacgttagctatatagcgaagcactataatatgagcaagtcgaaagtggacaatcaattctatagcgtggaggtgggagactccaccttcacagtcctcaaaagataccagaacctgaaacccatcgggagcggggcgcagggaatcgtatgtgccgcatacgatgccgttctggaccgcaacgttgctattaagaagctctcacgcccatttcagaatcaaacccatgctaagcgagcctaccgcgaactcgtgctgatgaagtgttag

SEQ ID NO: 124726 - DNA, 426 bp, Artificial Sequence
  Description of Artificial Sequence: Synthetic coding sequence
atgagtctccattttctgtactactgcagcgagcctactctcgatgtcaaaattgccttctgccagggattcgataagcaggtcgacgttagctatatagcaaaacactacaacatgtctaagtccaaggtcgacaatcagttctattcagtcgaagtaggggatagtacttttaccgtgctgaagcggtaccagaatttgaagcctatcggttctggcgctcagggcatcgtgtgtgcagcctatgacgcagtgttggatcgcaatgtcgcgatcaagaagttgagtaggcccttccagaaccagacccacgcaaaacgcgcctaccgtgagttagtcctgatgaaatgtgtgaaccacaagaacatcatcagtttactgaacgtgttcaccccccagaagacacttgaggaattccaggattag

SEQ ID NO: 124727 - DNA, 255 bp, Artificial Sequence
  Description of Artificial Sequence: Synthetic coding sequence
atgagtaagagcaaagttgacaatcagttctattctgtggaggttggagattcaacgttcaccgtgttgaagcgctaccagaaccttaaaccaatcgggtccggagcccaggggatcgtgtgcgcagcctacgacgccgtgctggatcggaacgtggcgatcaaaaagctttcacggccctttcagaatcagactcacgctaaacgggcttatcgtgagctcgtattaatgaaatgcgtgaaccataaaaactag

SEQ ID NO: 124728 - DNA, 159 bp, Artificial Sequence
  Description of Artificial Sequence: Synthetic coding sequence
atgagtaagtcaaaggtggacaaccagttctacagcgtggaggtgggggactccacgttcaccgttctgaaacgctatcagaatctcaaacctatcgggagtggggctcaaggcatcgtgtgcgctgcttatgacgcagtgcttgaccggaatgtatag

SEQ ID NO: 124729 - DNA, 147 bp, Artificial Sequence
  Description of Artificial Sequence: Synthetic coding sequence
atgtccttacacttcctgtattactgttcagagcccacgctggacgtaaagatcgcattctgtcagggattcgacaagcaggttgacgtaagctacattgccaagcactacaacatgagtaagtccaaggtggacaaccagttctag

SEQ ID NO: 124730 - DNA, 1008 bp, Artificial Sequence
  Description of Artificial Sequence: Synthetic coding sequence
tagaacgtcgcgatcaagaagctgtctcgcccttttcagaatcagacacacgccaaaagggcatatcgtgagctggtactcatgaaatgcgtgaatcataagaacattatcagtctgcttaatgtatttactccacagaagacactggaagaattccaggacgtctacctggtcatggagctgatggacgcaaacctctgccaggtgatacaaatggagttggaccacgaacgaatgtcctaccttctctaccagatgctgtgcggcatcaaacacctccattccgccggaatcatacacagggacctgaaacctagcaacatcgtggtcaagtccgattgcacacttaagatcctggatttcggcttggccagaacagctggcaccagttttatgatgacgccttatgtagtgaccaggtattaccgtgcacctgaagtaattttgggaatgggttataaggaaaacgtcgatatgtggtcagtgggttgtataatgggggagatgataaagggcgcagtgctgttccccggcacagatcacatcgatcaatggaataaggtcatcgagcagctgggtacaccctgtccagagtttatgaagaagctgcaaccaaccgtgaggaactacgtggaaaatcgacccaagtatgccgggctcaccttccccaaactgttccccgactccctgttccccgctgacagcgaacataataagctaaaggcaagccaagcacgggatctcctgagcaaaatgctggtgatcgacccagctaaaaggatttctgtagacgacgcgttgcagcacccctacattaacgtgtggtatgaccccgcagaggtggaggctccgcccccccagatttacgacaaacagttggacgagcgagaacatactatcgaggagtggaaggaacttatttacaaagaggtgatgaatagcgaggaaaagaccaagaacggggtggtgaaagggcaacctagcccaagcgcccaagtccagcagtag

SEQ ID NO: 124731 - DNA, 1764 bp, Artificial Sequence
  Description of Artificial Sequence: Synthetic coding sequence
atggccgagaagggcgactgcattgcttcggtgtacgggtatgatctaggagggcgatttgtagacttccagcccttgggctttggcgtcaatggtctggtgctgagtgcggtcgatagccgcgcctgtaggaaggtggccgtaaagaaaatcgcgctcagcgatgcccgctccatgaagcacgcactcagagagataaagattataagacgcctggaccatgacaacatcgtaaaagtttacgaagtgttgggcccaaaaggcaccgatctccaaggtgaactgttcaagtttagcgtcgcctatatcgtgcaggaatacatggaaactgacctggccagactcctagagcaggggactctggccgaagaacacgcgaaactgtttatgtatcagctgctccggggactgaagtacatacacagcgcaaacgtactgcatcgggatctgaagcccgccaacattttcatctctaccgaagacctcgttctgaaaatcggcgattttggccttgccagaattgtcgatcagcattatagtcacaaagggtatctctccgaagggctggtgaccaaatggtatcgctctccacgacttctgctgagccctaacaactacacaaaagctattgacatgtgggccgcggggtgcattttggcagaaatgctgacaggtcgaatgctgtttgctggggcacatgaactggaacagatgcagttaatcttggagacgatccccgtgatcagggaagaggataaagatgaattactgagagtgatgccatctttcgtctcatctacctgggaggtgaagagaccactgaggaagcttttaccggaggtgaactctgaagctatcgattttctcgagaaaatcctaacattcaacccaatggacagattgaccgctgaaatgggcctgcaacacccatacatgtctccatactcttgcccggaggatgaaccaacttctcagcatccattccgtatcgaggacgagattgacgacatcgtgctaatggccgccaaccagtcccagctgagtaactgggacacgtgcagtagtcgttaccccgtatctcttagtagcgatctggaatggcgccccgatcgctgccaagatgcctcggaggtgcaacgcgaccccagagccggctccgcaccccttgcagaggacgtccaggtcgatcctcgaaaggacagccatagttccagcgagcgatttctggagcagtcccattccagcatggaaagggcgtttgaggccgactatgggcggtcttgtgattataaggtcggatcacctagctaccttgataagctgctctggcgggacaacaaaccccatcactatagcgagccaaaattaatactggatctgagccactggaagcaggcggcgggtgcccccccaacagccactggtctcgccgatacaggagctcgcgaggacgagcctgcatccctttttctcgagattgcccagtgggtaaagtccacgcagggcgggccggagcatgcctccccgcctgccgacgaccccgagagaaggctgtcagcaagtcccccgggtaggccggctcccgtcgatgggggggcatctccccaattcgacctcgatgtgttcatcagtcgcgccttgaagctctgtaccaagccagaagacttacctgacaataaacttggtgatttgaatggtgcgtgcatccccgagcatcccggcgatctagtgcaaacggaagctttctcaaaggagaggtggtag

SEQ ID NO: 124732 - DNA, 1131 bp, Artificial Sequence
  Description of Artificial Sequence: Synthetic coding sequence
atgtgggccgctgggtgtatcttggccgaaatgctcaccgggaggatgttgttcgcgggtgcacacgagctggaacaaatgcagctcatcttggaaaccattcctgtcatcagggaggaggacaaagatgagctgctgagggtcatgccaagtttcgtctccagcacatgggaggtcaagcgcccccttagaaaactcttacccgaagtgaactccgaggcaatcgattttcttgaaaaaattctaaccttcaacccaatggatcgcctgacagctgagatgggcctgcagcatccctatatgtctccctactcttgccctgaggacgagcctacaagccagcaccctttcagaatcgaggacgagattgatgatatcgtgctaatggctgccaatcagtcccaattgtctaactgggacacatgttcctctcgataccctgtttcactttccagtgatttggaatggaggccagacagatgccaagatgccagcgaagtccaaagggatccacgcgctggttcagcgcctctcgcagaggacgtccaggtggaccctagaaaagacagccattcaagctctgagcggttccttgagcaaagccattcatctatggagcgcgctttcgaggctgactatggaagaagctgtgactataaagtgggttctccctcttatctcgacaagctgttatggagagacaacaagccacaccactacagtgaacccaagttaatcctcgacctgtcacactggaaacaggctgccggagctccaccaaccgcgacaggattagccgataccggcgcccgcgaagatgagcctgcctcattgtttctggagattgctcagtgggtgaagtccactcaaggaggcccagaacacgcttctcctcccgcagacgatcccgagaggcggctgtccgcctctccccccggccggccagcccccgtggatggaggagcttccccacagtttgatttagacgttttcatctcaagggccctcaagctgtgcactaagccggaagatcttcccgacaataagctaggcgatctgaacggcgcctgtatccctgaacacccaggcgatctagttcaaaccgaagcattctctaaggaaaggtggtag

SEQ ID NO: 124733 - DNA, 2034 bp, Artificial Sequence
  Description of Artificial Sequence: Synthetic coding sequence
atggagtctgatctgcaccagattatccattctagtcagcccctgacccttgagcatgtgcgatacttcttatatcagctcctgagagggctgaagtatatgcacagcgcccaagtgatccacagagatcttaagcctagcaacctgctggtgaacgaaaattgtgagctgaaaatcggggactttggcatggctagaggactctgcacctccccagcggagcatcagtacttcatgaccgagtatgtcgcgacacgctggtacagggcccctgagttgatgttaagtctccacgaatacacccaggccatcgacctttggtccgtcggttgtatcttcggggagatgctggcaagaagacaactcttcccagggaagaactacgtgcatcagttgcagttgatcatgatggtcttaggaactccatcgcctgctgttatccaggcggttggagctgaacgtgtgcgcgcttacatccaaagtctcccccctcggcagccagtgccatgggaaacggtctaccccggcgccgatagacaggccctttctctgctgggaaggatgttaagatttgagccaagtgccaggatttctgccgcagccgctctgcgccacccctttttagctaagtatcacgaccctgatgacgaacccgactgtgcacctccattcgatttcgctttcgatagggaggccctcacacgggagaggatcaaagaggcaatcgttgctgaaatagaggactttcacgcacggcgggaggggatcaggcagcagatcaggttccagcctagtctgcaacccgtggcttcggagcccgggtgcccggatgtcgagatgcctagcccttgggctccttccggagattgtgctatggagagcccaccacctgctcccccgccttgccctggcccagcccccgataccatagaccttaccctacagcctcctcctcccgtctcagagcctgcccctcccaaaaaggatggagctatcagcgacaatactaaggccgccctgaaggccgccctgctgaaaagcctgcggtcccgcctgcgagatggcccctctgcgccactagaggcaccagagccaaggaagcccgtcaccgcacaggaaaggcagagagagagagaggaaaaacggaggagacgccaggagcgagctaaggagagagaaaagcgccggcaggagcgtgaacggaaggagcgcggggccggagcctcaggtggcccaagcacagatccgctcgccggtttggtcctgagtgacaacgacaggtccctcttagagcgttggactcgtatggccaggcctgcagctccagctctcacctccgtgccagccccagcacctgcccccacacccacccctactcccgtacagccaactagtccaccacccgggccagtggcccagccaacggggcctcagcctcagagtgcaggaagcaccagcgggccagtgccccaaccggcttgtcctccccccggccccgctccacacccaacaggtcccccagggccaatccccgtgccggctccacctcagatagctaccagcacttcacttctcgccgcccagtcgttggtgcccccccctggactccctggctctagcacacctggcgtgctgccatatttcccgccggggcttccaccgcctgacgctgggggcgcgcctcagagcagtatgagcgagagcccagacgtgaatctggtcacccagcagctgagcaaaagccaggtggaagatccactgccgcctgtgttcagtgggacacctaagggaagtggggcgggatacggggtaggttttgacctagaggagttccttaatcagtcttttgacatgggcgtcgctgatggaccccaggacggacaggcggattcagcatcattgagcgcatctctgctagctgattggctggagggtcacggcatgaatcctgcagatatcgagtcactccagcgggagatccagatggatagtcctatgctgctcgctgacctgcctgacctgcaggacccatag

SEQ ID NO: 124734 - DNA, 2451 bp, Artificial Sequence
  Description of Artificial Sequence: Synthetic coding sequence
atggcagagcctcttaaagaggaagacggagaggacgggtcagcagaacccccgggcccagtgaaagctgagccagcccataccgcggcctcggtggctgcaaagaaccttgcactgctgaaagctcggagctttgacgtaacatttgatgtgggggacgagtatgagattatcgagacgatcggaaacggggcctacggtgtggtgagtagtgcaagacgcaggctgactgggcagcaagtagccatcaaaaagattccaaatgctttcgatgtagtcaccaatgctaaacgaacactgcgcgagcttaaaatccttaaacactttaaacatgacaatattattgcaattaaagacattcttcgcccgacggttccttatggcgagtttaagtctgtctatgttgtcctagacctcatggaatcagacctgcatcagatcatccactcatcacaacccctcactcttgagcacgtgcgctacttcctgtatcagctcctgaggggactgaaatatatgcatagcgcacaggtgattcatcgggacctgaaaccctcaaacttgctggtgaacgaaaattgcgagctgaaaataggcgacttcgggatggctcggggcctctgtacatcccctgctgaacatcagtactttatgactgagtacgtcgccacccggtggtacagggcccccgagctgatgctatccctgcacgaatacacccaggcgatcgacctctggtccgtgggctgcatcttcggggaaatgcttgcgcggcgccaacttttcccgggcaagaattatgttcaccagctgcagctgatcatgatggtcttggggactccatcccccgctgtcatccaggccgtgggcgctgagagagtaagagcttacatccagagtctgccccccagacagcccgtgccgtgggaaactgtctaccctggagccgaccgccaagctttaagtttgctgggacgaatgctcaggttcgagccctctgcccggatctctgctgctgcagcactccgtcaccctttcctcgccaagtaccatgatcctgatgacgagccggactgcgcacctcctttcgacttcgcattcgatcgcgaggccttgacaagggagaggataaaagaggccattgtggccgagattgaggattttcacgcaaggcgagagggaattcggcagcagatcaggtttcagccaagcctgcaacccgtggcatcggagccagggtgcccggatgtagaaatgcccagcccatgggctccttctggtgactgtgctatggagtctcctccacctgctccgcctccctgtcccgggcccgctccagacaccatcgaccttacccttcagccccctcccccagtaagtgagccagcgccacccaaaaaggatggcgctatttcagataacaccaaggccgccctcaaagctgcgctgctcaagagcctccgcagccgtttacgggacgggccctcagcaccgctcgaggcccctgaacccaggaaaccagtgacagcccaggagcgacagagagaaagggaagaaaaaaggagaagaagacaggagcgagctaaggaaagagagaaaagaagacaagagcgagaacggaaagagcgtggagccggggcctcagggggcccaagtacggatcccttagccggtctcgtcctgagtgataacgatcgcagcttgctagagcggtggacacgcatggcacgacctgcggcgccagctctcacttcggtgcctgcccctgcaccagcacctacacctacacctactccagtgcagcccacctcccctccaccaggccccgtggctcagcctactggacctcaacctcagagcgctggcagcacctcgggtcccgtgccccagccagcctgcccacctccaggaccagcaccacacccgaccggtccacccggccctatcccagtgcccgcccccccgcagattgctacctccacatctctcttggccgcacagagcctggtcccacccccaggattgcctggctcaagcacgcccggagtgctgccatactttccccccggattacccccaccggatgctggaggcgcaccacagtcgtccatgtcggagtctcctgacgtgaaccttgtgacccagcagctctctaagagtcaggtggaggaccccctgcccccagtgttttcaggcacacccaaaggttccggcgccggctacggagtcggcttcgacctggaagagtttttaaatcagagtttcgatatgggcgtggcagatgggccccaagacggccaagcagacagcgctagcctcagcgctagcctgctggcggactggcttgaaggacacggaatgaaccccgcggacatcgaaagcctgcagcgcgaaatccagatggattctcccatgttactcgctgacctgccagatctgcaggacccttag

SEQ ID NO: 124735 - DNA, 2451 bp, Artificial Sequence
  Description of Artificial Sequence: Synthetic coding sequence
atggccgagcctctcaaggaggaagacggtgaagacggcagcgctgagccacctggccccgtcaaggccgagccggcacatacggctgcgagcgtggccgctaagaatttggctcttctaaaagctcgatcctttgatgtgacattcgacgtcggggatgagtatgagatcatcgagacgattggaaacggcgcttatggagtggtgagcagcgctcggcgccgtttaaccggccagcaggtggcgattaaaaagatcccaaacgctttcgatgtggttaccaacgcaaagcgaacgttgagggaactgaaaatcctgaagcacttcaagcatgacaatatcatcgccatcaaggacatcttgagacctacagtcccctacggagagtttaagagtgtgtatgtcgtgttggatcttatggagagtgatctccaccaaatcatccactcctctcagccactaaccttggagcatgtcaggtatttcctttatcaattgctgagaggactgaaatacatgcatagtgcacaggtaattcaccgagatctcaaacctagcaaccttcttgtgaatgagaactgcgaactgaagatcggcgacttcgggatggctcgtggactctgtacaagcccagccgagcatcagtatttcatgaccgagtacgtggctacacgatggtaccgagcccctgagctgatgctgtccctccacgagtatacgcaagcaattgatctatggtctgtgggatgcatttttggagaaatgctggcaagacgtcagctcttccctggcaagaattacgtgcaccagctgcagctgataatgatggtactgggaacccccagcccggccgttattcaagccgttggagctgagagagtgagagcctatatccagagtcttccccccaggcaacccgtgccttgggagaccgtctatcccggggcagacaggcaagcactgtctcttctcgggaggatgctccgattcgagccttcggcaaggatctccgctgctgcggctctgcggcatccctttctagcaaagtaccatgaccctgacgatgagcctgactgtgcacccccttttgactttgcctttgatagagaggccctgacccgggaaaggattaaagaggctatcgtcgcagagattgaggatttccacgccaggagggaagggatccggcagcagatcaggtttcagccctcactccagcccgtggcatccgagcccggctgtcctgatgtggaaatgccatcaccctgggccccttcaggggactgtgctatggagtctccaccccccgctccccctccgtgccccggcccagcaccagacacgattgacctgaccctgcagcccccccccccggtctcggagcccgctcctcctaagaaggacggcgccattagtgataataccaaggccgccctgaaagctgcgcttttgaagtctctaaggagtcggctgcgcgatggtccctcagcccctttggaggcacctgagccgcggaagcccgtgaccgcacaggaacggcagagagaaagagaagagaagcggcgtcggcgacaggagagagccaaagagcgcgagaagaggagacaggaaagggaacggaaggagcgaggagccggcgcctcgggggggccaagcacagacccattagccgggctggtactaagcgataacgatcgttccttgctggagcgttggacacgcatggcgaggcctgctgctcctgcactgacatcagttcccgctccagcgccggcccccacacccacacccacacccgtacagcccaccagccctcctccgggccccgttgctcaacccacaggcccgcagccacagagcgctggaagtacctctggtcccgtgcctcagcctgcatgtccaccacccggcccggcaccgcatcctacaggtccgccaggtcccatcccggttccagcccccccccagatcgccacttctacctctctgctggccgcgcagtctttagtaccaccccctggactgcctggaagcagcacaccaggcgtcttgccatattttcctcctgggctccccccacccgatgccggcggcgcccctcagtctagcatgtccgaatctcctgatgtcaatctggtaactcagcaactatcaaaatcccaagtcgaggatcccctaccgccagtgtttagcggcacccccaaggggtccggcgcagggtatggagtgggttttgatttggaggagtttttgaaccagtcctttgacatgggagtggccgacggcccccaggatggccaggccgatagcgctagcctgtcagcgagccttctcgccgattggctagagggccatggcatgaaccccgcagacatcgagtcactgcaaagagagatccagatggactcccccatgctgctggccgacctccccgatctgcaggacccttag

SEQ ID NO: 124736 - DNA, 2451 bp, Artificial Sequence
  Description of Artificial Sequence: Synthetic coding sequence
atggccgaacccctaaaagaagaggacggagaagacggtagcgccgagcctccagggcctgtgaaggcagagcccgcccacacggcagccagcgtggccgccaaaaacctcgctctgctgaaggcacggagttttgacgtaaccttcgacgtgggagacgagtatgagattatagaaacaattgggaatggagcctatggagttgtgtcttcagcgaggaggagattgactggccagcaggtggctatcaaaaagatccccaacgccttcgatgtagtcaccaacgcaaaacggaccctgcgggagctcaagatcctcaagcacttcaaacatgacaacatcatcgccataaaggacatcttgagacctaccgtgccatacggagagttcaagagcgtctatgtcgttctggatctgatggagtctgacttgcaccagataatccacagtagccagcctctgactctggagcatgtgagatattttctgtatcagttgctccgaggtctgaagtatatgcattctgcccaggtcattcacagagacctgaaaccatccaacctgctcgtgaatgagaactgcgagcttaaaatcggcgacttcggtatggcccgtggtttgtgtacaagcccagcagagcatcagtatttcatgactgagtacgtggctaccagatggtatcgagcacctgagcttatgctctcgcttcatgaatacacacaggctatcgacctgtggagcgtgggatgcattttcggagagatgctcgcgagaaggcagctctttccaggaaaaaactatgtgcaccaattgcagctgatcatgatggtgctgggaacccctagccccgcagtgattcaggctgtgggcgctgagagagttagggcctacatccagagtctccccccccggcaacccgttccctgggaaacagtttatccaggcgctgatagacaggcactgtcactcctgggacgaatgcttagattcgaaccttccgcccggatcagtgccgcagctgcattgcgtcacccatttctggccaaatatcacgatcccgatgatgaacctgactgcgcccccccctttgattttgcatttgatcgagaggctttaaccagagaacggattaaggaggctatagtggccgagattgaggacttccacgctcgcagagagggcatcagacagcagatcagatttcagccttccctgcagcccgtcgcgtctgagcctggatgtcctgatgttgagatgccgtcaccttgggctccctctggagactgcgctatggaatctccgcccccggctccaccaccatgtcctggaccggctccagacaccatcgatttaaccctccagccaccgccgccagtgagcgaacccgctccccccaaaaaagatggggctatctcggacaacacaaaagcggctcttaaggccgccctcctcaagtccttgaggtccagattgagagatggaccgagcgctcccctggaagctcccgagccccgcaagcctgttaccgcccaggagagacagcgggaaagggaggagaagcgccgacgaaggcaggagagggctaaggaacgcgagaagcgtagacaggagagagaacgaaaggagaggggggcaggggccagcggcggcccatccacagatccgctggcgggcttggtcctcagcgacaacgacaggagtttgttggagcgttggacacgaatggcccgccccgcagccccagccctgacctctgtgccggcccccgcaccggctcccacacccacccccacacccgttcagcccacgtctcctcctcccgggcccgtcgcccaaccaacaggccctcagcctcagtcagcaggcagcacctccggtcccgtccctcagcctgcgtgcccgccccctggtcctgccccacaccccacaggccctccgggaccgatcccggttcccgcccctccccaaatcgcaaccagcacttcccttctggccgcccaatctctggtgcccccccccggcctccccggttcttcaaccccaggtgtcctgccatacttcccgccgggactgccacctccagatgctggcggggctccacagtcctccatgagcgagtctcctgatgtgaacttagtgactcagcagctgtccaagtctcaagtggaggaccctctgccaccagtttttagtgggaccccaaaaggtagtggggccggttatggggtgggttttgacctcgaagaattcctcaaccagagctttgatatgggagtggccgatgggccacaagacgggcaggctgactcggcctcactgagtgcgagtcttctggcagactggctcgaaggccatggtatgaaccctgctgatatagagagcctccagcgcgaaattcagatggactctccgatgctgctagctgatctcccagacctccaggacccatag

SEQ ID NO: 124737 - DNA, 726 bp, Artificial Sequence
  Description of Artificial Sequence: Synthetic coding sequence
atggcagagcccctgaaggaggaggacggagaggacggttctgccgaacccccaggccctgtcaaggcagaaccggcccacaccgcagcaagtgtcgccgcaaagaatttggcacttttgaaagctagaagctttgacgtgacatttgatgttggagatgaatatgagattattgagacaatcgggaacggggcttacggagtggtaagtagcgcccgccgaagactgaccggccaacaggtcgctattaaaaaaatccccaatgcttttgatgttgtcacgaacgcaaaaagaacactgcgagagctgaaaattctgaaacactttaagcacgacaacatcatcgcaatcaaggacatcctgagaccaacggtgccatatggcgaattcaagagcgtgtacgttgtgcttgacctgatggagtctgacctccaccaaattattcactccagccagcctttaacccttgagcacgtgcgatacttcctgtaccagctgctgaggggattaaagtacatgcactccgctcaggtgatacacagggatctgaaaccatccaacctactggtgaatgaaaactgtgagctaaagattggtgactttggaatggcaaggggcctgtgtacatctcctgccgaacaccaatactttatgactgaatatgttgccactagatggtaccgcgcccctgagctcatgctctccctacatgaatacacccaatag

SEQ ID NO: 124738 - DNA, 2136 bp, Artificial Sequence
  Description of Artificial Sequence: Synthetic coding sequence
atggctgaaagagagagcggaggactcggcggcggcgccgcttctccccccgccgcctctcccttccttggtctgcatatagcctctccgcccaatttcaggttgacacatgacataagtttagaggagttcgaagatgaggatttaagtgagatcaccgatgagtgcggaatctctcttcaatgcaaggataccttgagtctgcgccctccgcgcgcgggactccttagtgccggtggcgggggtgcagggagcaggctgcaggctgagatgcttcagatggacctgattgacgcgaccggtgacaccccgggcgcagaagacgacgaagaggacgacgatgaagagagggcagcgagacgtccgggggccggtccaccgaaagcagaatcgggtcaggagcccgctagtcgaggccaaggccagtcacaaggccagagccaaggccccggatccggggatacctaccgccccaagaggccaacaaccttaaacctctttccacaagtgccgagaagccaggacactctgaacaataatagtctggggaaaaagcatagctggcaggaccgggtgagcagatcatcctctccattgaagaccggagagcaaaccccaccccacgagcacatctgcttgtcggacgaacttcctccccaaagcggacctgctcctactactgacagggggacatcaaccgactcaccgtgtaggcgcagcacagccacccagatggctcccccaggtggacccccagccgctccacctggaggaagagggcacagtcacagggaccgcatccactaccaagccgatgtgcggctggaagccaccgaagagatctatctgaccccagtgcaacggccaccagatgccgcagaaccgacaagcgcattccttccgcctacagagagccggatgagcgtcagttcggaccccgaccctgctgcctatccttctacagccggaaggccacacccatctatcagcgaggaggaagaaggctttgattgcctcagctctccagaacgcgctgagcccccgggcggaggatggcggggaagtctgggcgaacccccgccccccccccgggcctctctctctagtgatacttccgccctgtcgtacgatagcgtgaagtatacactggtggtcgatgaacacgcccagctggagctcgttagcctgagaccttgttttggagactattcagatgagtcagacagtgccacagtgtacgacaattgcgcgagcgtaagctcaccttatgagtccgcaatcggcgaagagtatgaggaagctccgcgccctcaacctcctgcctgcctcagtgaggacagtaccccggatgagccagacgtccacttttccaaaaagttcctcaacgtgttcatgagcgggagatcccgctccagttccgctgagtcctttggtctgttcagctgcatcattaacggtgaggaacaggaacagacacatagagccatatttcggtttgtgcctagacacgaggacgagcttgaactggaggtggatgatccacttctggtggaactgcaagccgaggattactggtatgaggcgtacaatatgagaacaggtgctcgcggggtgtttcctgcttattatgccattgaagtcactaaggagcccgagcacatggctgctctggccaaaaacagcgattgggtggaccagttcagagttaagttcttaggatcggtgcaggtcccctaccataaaggaaatgacgtcctgtgcgccgccatgcagaagatagcaactacgagacgtttaacagtgcattttaaccccccatctagctgcgtactggaaatctcggtgagaggagtgaagattggagtgaaagcagacgactctcaggaagctaagggcaataagtgtagccacttcttccagctgaagaacataagcttttgcgggtatcatcccaaaaacaataagtattttgggttcattaccaagcaccccgcagatcaccgatttgcctgtcatgtgttcgtttctgaagactcaacaaaagcactcgcggagtccgtgggcagagcattccagcagttctataagcagttcgttgagtatacatgccccactgaagacatctatctggaatag

SEQ ID NO: 124739 - DNA, 1797 bp, Artificial Sequence
  Description of Artificial Sequence: Synthetic coding sequence
atgttacccgattttccaagtccatccacttgggcacctgggttgcttcttcccagtggcccggccctattaagccctagcgtgcttcaggactctctctcattgggccggtccgaacagccacacccaatatgtagctttcaggacgactttcaagaattcgagatgattgatgataacgaagaggaggacgatgaagacgaggaagaagaggaggaggaggaggaaggtgatggtgagggtcaagagggcggagatcccgggtctgaggccccagcacccggcccccttatcccgagcccgagcgtggaagaaccacacaaacaccggcctactacactgcgcttaaccaccctcggagctcaggactcccaggaccctgaggcagcagccggccctgggggggtggaactcgtcgatatggaaaccttgaatcccacccgggatactatcaccccattgtgggcagcaccaggtcgggccgctcgaccaggcagggcgtgttctgccgcatgcagtgaggaagaggatgaggaagatgacgaggaggaagaggatgcagaagactcggccggatctcccgggggccgcggcactgggccctcggcccctcgtgatgcctcccttgtatatgacgcagttaagtacacactggtggtcgacgagcatacgcaacttgaacttgtgtcactccggagatgtgccggcctaggccatgattcagaagaagatagtggtggcgaggctagcgaagaagaggcaggtgcggcactgctcggcggcggacaggtctcaggggataccagtccggactccccagatctcacatttagcaaaaagttcttgaatgtttttgtcaactcgacaagccggtcctcttccacagaatcctttggcctgtttagctgtctggtgaatggtgaagagcgcgaacagacacaccgggcagtctttaggttcatccctagacatcccgatgaactcgaactagacgtcgatgacccagttctggtcgaagccgaggaagatgatttctggttccgcggcttcaacatgcgcacaggagaacgaggcgtgtttcccgccttctacgcccacgcggttccaggaccagccaaagaccttctgggaagcaaaagatctccctgctgggtggagcgctttgatgttcagtttctaggatctgtggaagtgccatgtcatcagggcaacggcatcttatgtgccgcaatgcagaagattgctacagcacggaagctcactgtgcatcttcggccacctgccagttgcgatctggaaatttccctgcggggggtcaaacttagtctctcaggcgggggccccgagttccagcgctgtagccatttctttcaaatgaaaaacattagcttttgcggctgccaccccaggaattcttgcgaggctccccagggcgccgcatttcagtgggagcgcggggtggatcgcaaacgagtcctccaaactcggggcaatgtgcagccacacctcggcgcaggccagggagccgcactgaacagggctactgaaggaagctctacgggctccgagaaaggcgaatggaccccactggttatcatggagcttactcaatccgtaaacagctgttacttcgggttcattaccaagcaccctttgctgagcagattcgcttgccacgtctttgtcagccaggagtcaatgaggccggtagcccaatccgtgggccgggctttcttagagtattatcaagagcatctggcctatgcctgccctacagaggacatctatctggagtag

SEQ ID NO: 124740 - DNA, 2472 bp, Artificial Sequence
  Description of Artificial Sequence: Synthetic coding sequence
atggccgatcgcgcggaaatgtttagtttgtcaacctttcattctttgagcccacctggatgccgccctccacaggacatcagcctggaggaattcgatgacgaagacctgtctgagattaccgacgattgcgggctaggactaagctatgactccgaccattgcgagaaggattccctgagcttgggcaggagtgagcagccacatccaatatgtagcttccaagatgacttccaggagttcgagatgatcgatgacaatgaagaggaagatgatgaagatgaggaggaggaagaggaagaggaagagggagacggcgaaggacaggaggggggcgacccaggatctgaggcaccagcgcccgggcccctcatcccctccccctcggtggaggagccccacaagcaccggccaacaacactcaggctgaccactctcggggctcaagattcacttaacaacaacggtgggttcgacctggtcaggcccgccagttggcaggagaccgccctgtgctcacccgctcccgaggcccttagagagctgccaggccccctgcccgccacagacaccggacccggcggagctcagagtcccgtgaggcccggctgcgattgtgaaggaaatcggccagccgaaccaccagccccgggcggaacatccccttccagcgaccccgggatcgaggccgatctgaggtcaaggtcctcaggcggaagagggggcaggaggagcagtcaggagctgtcatccccaggctctgattccgaggacgcaggtggccgactgggacgcatgatcagtagcatctctgagactgagctagagttgtcgtccgacgggggctcctcatctagtggccggtcttcgcacctcaccaactcgatcgaggaagccagttcaccagccagcgagcctgaacccccacgcgaacctccaaggagaccagcttttctgcctgtgggacccgatgatacaaacagtgagtacgaatctggatctgaatccgagcctgacctatcggaagacgccgacagtccgtggctcctcagtaatctggtatctcgcatgattagcgagggcagctcgccgatcagatgtccgggacagtgtctgtctcctgcaccaagacctcccggcgaaccggtgtcgcctgccggcggggccgcacaagactctcaggatcccgaggctgctgctggaccaggtggagtcgagcttgttgacatggagactctgtgcgccccccccccccccgcacctgcagccccccggccaggacctgcccagcctggcccttgcctattcctaagcaatccaaccagagacacaatcacgcccctttgggccgctcctggtcgagctgccaggcccgggcgggcctgctctgccgcctgcagcgaagaggaggatgaggaggacgacgaagaagaagaggacgcagaagatagcgcaggctcccctggcggccgaggcaccggtccctcggcaccacgcgacgcatctctcgtgtatgatgccgttaaatatactctcgtagtggatgaacatacccagctggagctggtcagccttcgccgatgcgccgggctcggacacgattcagaggaggatagcggaggagaggccagcgaagaggaggccggagccgcgttgctcggcggcggccaggtctccggggatacctctccagattctcctgatttgactttttccaagaaattcctgaatgtctttgtgaacagcacctcaagatcttcctctacagagtcctttggtctgttcagctgcttggttaatggagaggagagggagcagacacacagagctgtgtttcgattcatcccccgacaccctgatgagttggagctggatgtggacgacccagtgttagtggaggctgaagaggacgatttttggttccgtggattcaacatgcggaccggagagcgaggggtcttccccgctttctatgcccatgctgtgcctgggcctgctaaagatctactcggctcgaagcgctctccttgttgggtagaacgcttcgacgtgcagttcttgggtagtgtagaggtgccatgccatcagggaaatggtatcctttgcgccgccatgcagaagattgccaccgcacgaaagttaacagtccacttacggcctccggcctcatgtgacctggagatatcacttcggggcgtcaagctctctttaagcggcggggggcccgaattccaacgctgcagtcacttcttccagatgaagaatatttccttctgcggctgtcaccctcggaatagctgttatttcgggttcatcactaaacatccgctgctctccagattcgcctgtcacgtgttcgtcagtcaggagtcaatgcgccctgttgctcaatcagtgggcagggccttcctggagtattaccaggagcatcttgcgtatgcatgtccgacagaggacatttacctggagtag

SEQ ID NO: 124741 - DNA, 1335 bp, Artificial Sequence
  Description of Artificial Sequence: Synthetic coding sequence
atggctgatagggcggagatgttcagcctctcaacatttcattcccttagcccccctggctgtcgccctccgcaagacatcagcctggaagaatttgacgatgaagatcttagcgagataaccgacgattgtggtctggggttgtcatacgattctgaccattgcgagaaggacagtctgtccctcggtcgttccgaacagccgcacccgatttgctcttttcaggacgacttccaagaatttgagatgatcgatgataacgaggaggaagaggacgaggaagacgatgaggaagaggaagatgccgaagacagcgcaggaagccccggcgggaggggtacaggcccctcagcgcctagggacgcctcattggtctatgacgctgtgaagtacaccttggtggtcgatgagcatacacaactggagcttgtctctctgcgacgttgcgcaggcttaggtcacgattctgaggaggacagcggcggggaagccagtgaggaggaggcgggagcggctcttctgggaggagggcaagtctccggagacactagcccagattcacctgatttaacattcagtaaaaagttcctaaacgtgttcgtcaactcaaccagtcggagctcatccaccgaatccttcgggctattctcatgtctggtgaatggggaagaacgggagcagacccaccgagctgtgttcagatttatcccacgccatcccgatgagctagaactcgacgtggacgatcccgtgctagtggaggccgaggaggacgacttttggtttaggggcttcaatatgagaaccggggaacgaggcgtctttccggccttctatgctcatgccgtgccaggtccagccaaggatctgcttggctcaaagaggagcccatgctgggtggagcgcttcgacgttcagtttctgggctccgttgaagtaccatgccaccagggcaacggcatactttgcgcagccatgcagaaaatagcaacagcaagaaaactgacagtgcatctccgcccgcctgctagctgcgatttggagatttctctgcgaggcgttaaactgagcctgtccggaggcggccctgaattccaaaggtgctcacattttttccagatgaagaacatctcattctgcggatgtcaccccagaaattcgtgttacttcggatttatcaccaagcacccactcctgagcaggtttgcgtgtcacgtgttcgtttcccaggaatcaatgaggcccgttgcccagagcgtaggaagagcattcctcgagtattaccaggaacatttagcctacgcctgccccacagaggatatttatcttgagtag

SEQ ID NO: 124742 - DNA, 1677 bp, Artificial Sequence
  Description of Artificial Sequence: Synthetic coding sequence
atgatatccagcatctctgagacagagcttgaactcagtagtgatgggggcagcagcagctccggacgctctagccacctgacaaacagcattgaggaagccagctcccccgcctctgaacctgagcctcctcgggaaccccctagacggccagcattcctgccagtggggcctgacgacaccaatagcgaatatgagtcaggttctgagagcgaaccagacctgtctgaggacgccgattccccatggctactcagcaacttggtctcgagaatgatctccgaagggtcttcgcctatcagatgtcctggacaatgtctgagtcccgccccacggccgcccggtgagcccgtaagtcccgctggaggtgcggcccaggactcgcaggacccggaagctgctgctggtccaggaggagtggaacttgtggacatggagaccctgtgtgctccaccccccccagctccagcggcacctcgcccaggccctgctcaaccaggaccttgtctgttcttgtccaacccaacaagggataccataactcccttatgggccgctccaggcagggcagcaaggccagggcgtgcgtgttctgccgcttgtagtgaagaagaggatgaagaagacgacgaagaagaggaggacgctgaggactcagctgggtccccggggggacgtggaaccgggccctctgctcccagggatgcctctcttgtatatgatgccgttaagtataccctcgtggtggatgagcacacccagctggagctggtctctttgagaagatgcgcagggctggggcacgactcagaggaggactctggcggcgaggcctctgaggaagaggccggggctgctctgctgggcgggggccaggtctccggggacacatcacctgatagtcctgatctcacattctccaagaagttcctgaatgttttcgtgaactcaactagccggagctctagcacggagtctttcggactgttttcctgcctggtcaatggcgaggaacgcgaacaaacccatagagctgtatttagatttattcccagacaccctgatgagctcgagctcgatgtcgatgaccccgtactggtggaagccgaggaggatgacttctggttcaggggttttaatatgcgcaccggagagcgaggggtctttccagcattctacgcacatgccgtgcccggccccgccaaagaccttctcggctctaagaggtcgccatgctgggttgagcgctttgacgtgcagttcttggggtccgtcgaggtgccttgccaccaaggtaacggcattttgtgcgccgcaatgcagaaaatagccacagcccgcaagctgaccgtgcacctgcggccacccgccagttgcgacctggagatctctttacggggcgtcaagctctccctcagtgggggcggcccagagtttcaacgctgtagccatttctttcagatgaaaaacataagtttttgcggatgccatccgcgcaattcttgctactttgggtttattaccaagcaccctctcctctcaagattcgcttgtcacgtctttgtttcacaggaatctatgcgccccgtggcacaatccgtgggaagagccttcctggagtactatcaggaacacctcgcatatgcatgccctacagaggatatctatctggagtag

SEQ ID NO: 124743 - DNA, 1677 bp, Artificial Sequence
  Description of Artificial Sequence: Synthetic coding sequence
atgatatcatcaatctccgagaccgagcttgagctgagcagcgacggcggatcctcatcaagcggacggtcttctcacctgaccaatagcatcgaagaggctagcagcccagcttctgaaccagagcccccaagagaacccccgagacgtcctgctttcctgcccgttggacctgacgatacgaactctgagtacgaaagtggatctgaaagtgagcccgacctgtctgaggatgcagacagcccttggctcttatccaaccttgtttcccggatgatctccgaggggagcagcccaattcggtgcccagggcagtgcctttctccagctcccaggccacccggcgaacccgtgtcgcctgcgggcggagcggcccaggatagccaggatccggaagccgctgccggaccagggggagtggagttggtcgacatggagactctgtgcgcccctcccccccctgccccagccgccccaaggccgggcccagcccagcccggcccttgcctcttcttatctaacccgaccagagatactattacacctctctgggcagcgcccggcagagccgcacggcctggccgagcctgtagcgccgcctgctcagaggaggaggatgaggaagatgatgaagaagaagaggacgctgaagatagtgccggaagccctggcggtcggggaacagggccttccgctcctagagatgccagcctggtgtatgacgctgttaagtacactttagtcgttgatgaacatacacagcttgaactcgtatccttgcggagatgcgccggcctcgggcacgactctgaggaggatagcggaggcgaggcaagtgaagaagaagcaggcgctgctctcctgggtggcggccaggtgtctggggacacgagtcctgacagtcccgaccttactttcagtaaaaaatttctcaacgtgttcgtaaacagcacttctcgatcttctagtactgaaagtttcggcctctttagctgcttggtgaacggggaggagcgggaacagacccaccgcgccgtattcagattcatacccaggcacccagacgagctggaattggacgtcgacgatcctgtactggtggaggcggaggaagatgacttttggtttcgtggattcaatatgcgcacaggtgagcggggcgtgtttccagcattctatgctcatgccgtgccgggtccagctaaagatctgctaggaagtaaacgcagtccctgctgggtcgagaggttcgacgtgcagtttctgggttcagttgaggttccatgccaccaggggaatggcatcctttgtgccgctatgcagaaaattgcaacggcaagaaagctcaccgtgcacctgcggccccctgcttcctgcgacctggaaatcagcctacgcggcgtaaagttgtcgcttagcggcggtggcccagaattccagagatgcagtcacttctttcagatgaagaacatatctttttgtggttgtcacccccgtaacagctgttacttcggattcatcaccaaacatccgctcctgagtcgatttgcctgccatgtgttcgtttcacaggagagcatgagaccagtggctcagtctgtgggcagagccttcctggaatattatcaggaacacttggcatacgcctgcccgacggaagacatatacctggagtag

SEQ ID NO: 124744 - DNA, 1641 bp, Artificial Sequence
  Description of Artificial Sequence: Synthetic coding sequence
atggctgacagggccgaaatgtttagtctttcaaccttccattcgttgtctccccccggctgccggccaccacaggacatttccctcgaggagtttgacgacgaagacctgtcagagattacagacgattgtggacttggcctgtcatacgattccgaccactgcgaaaaagattctctcagccttggtcgaagtgaacagccacaccccatctgcagcttccaggatgacttccaggagtttgaaatgatagacgataatgaagaagaggatgatgaggacgaggaggaggaagaagaggaagaggaaggcgacggtgagggacaagagggcggcgatcccggttccgaagcacctgcaccgggtccactaattcctagtcccagtgtcgaagagccgcataaacacagaccgactaccctgcgactgaccacactcggggctcaagacagcctgaacaataacggggggttcgacctggtcaggcccgctagctggcaggagaccgccttatgcagccctgctcctgaggccctgagagagctgccaggcccacttcccgctacagatacaggccccgggggggctcaaagcccagttaggcccgggtgcgactgtgagggcaaccggcccgctgaacctccagcacctgggggaacctcaccctcatccgaccccggcatcgaggctgatctgcgatctcgatctagcggaggtaggggagggcgacgaagctcacaagagctgtcctctcctggatcagactccgaagacgccgggggccgactgggacggatgatctcatctatttcagagactgagctcgaactctcctccgacgggggtagttcatcctcaggacggtcatctcatctaaccttcagcaagaagttcctgaacgtgttcgttaattcaacgagcaggtcgtctagcacggagagctttggtctgttctcttgcttagttaatggtgaggaacgcgaacaaactcatcgggctgtgttccgctttattccacgacaccccgatgagttggaactagatgtcgatgatcccgtcttggtggaggccgaggaagacgacttctggtttcggggatttaacatgaggactggtgagaggggcgtgtttcctgctttttacgctcacgccgtgcccggaccagctaaagacctgctcggctctaaaagatctccctgctgggtagagcgctttgacgttcaattccttgggagtgttgaagtgccatgccatcagggtaatggaatactgtgtgcggccatgcagaagatcgcaaccgcaaggaaacttacagtacatctgcgacccccagcctcctgcgacctggaaatcagcttaagaggcgtcaaactctcgctatcaggcgggggcccagaattccagcgttgttcacattttttccagatgaagaatatttccttttgtggctgccaccccagaaatagctgttactttggattcattaccaaacaccctcttttgtccaggttcgcttgccatgtatttgtatcacaggagtcaatgagacctgtggcccagtcggtgggccgggcgtttctcgaatattatcaagagcacttagcttacgcatgccctaccgaggatatttatctggagtag

SEQ ID NO: 124745 - DNA, 1149 bp, Artificial Sequence
  Description of Artificial Sequence: Synthetic coding sequence
atgtctgatagtaagtgcgatagtcagttctattccgtccaggttgccgactccacctttacagtcttgaagcgctatcagcaactcaagccaatcggcagtggcgctcaaggaatagtatgtgccgcatttgataccgttctggggataaacgttgcggtcaagaagcttagcaggccattccaaaatcagacccatgcaaagcgcgcttacagagagttggtgttgttaaagtgcgtgaatcacaaaaacatcatctctctattgaacgtattcaccccgcagaaaacgctggaagaattccaagacgtgtaccttgtgatggagctcatggacgctaacctatgccaggtcattcatatggagctggatcatgagaggatgtcgtacctgctgtaccagatgctttgcgggatcaaacatctccactccgccggaattattcaccgggatctgaaaccttcgaacattgtggtcaagagcgactgtacgcttaagatactggactttggactggcaaggacagcctgcaccaattttatgatgaccccctacgtggtgacaaggtattatcgggcccccgaggtgatactgggcatggggtacaaggagaacgttgacatctggagcgtcggatgtatcatggctgagatggttcttcacaaagtcctctttcccggacgggactatatcgaccagtggaataaggtgatcgagcagctgggaactccatctgcagaattcatgaagaaattgcagccaacagtgagaaactacgttgaaaaccgcccaaagtaccctggtatcaagtttgaggaactgttcccagactggattttcccgagtgagagcgaacgggataaaattaaaactagtcaggctcgggacctcctctcgaaaatgctggtcatcgacccggataagcgcatttcggtggatgaggccctgaggcatccatatatcacagtgtggtacgatcccgctgaagcggaagcccccccaccacagatctatgacgcacaacttgaggaacgggaacacgccattgaagagtggaaggagctaatctataaagaagttatggattgggaagagagatctaaaaatggggtcgtgaaagaccagccaagcgcccaaatgcagcagtag

SEQ ID NO: 124746 - DNA, 1149 bp, Artificial Sequence
  Description of Artificial Sequence: Synthetic coding sequence
atgtccgactctaaatgtgatagccagttctacagcgtacaggtggcagacagcacctttacggttttgaagcgttatcagcagctcaaaccgatcgggtccggtgctcagggcattgtgtgcgcagcatttgatactgtgctcggcattaacgtagccgtgaagaagctttccagaccattccagaatcaaacacacgccaagagggcatatagagagctggtcctccttaagtgtgtgaaccacaaaaatataatttcccttctgaacgttttcaccccacaaaagacccttgaagaattccaggatgtgtacctcgtgatggagctgatggatgctaacctatgtcaggttattcacatggagctggaccacgagaggatgtcctacctgctgtaccagatgctctgtggaatcaaacatctacattccgcgggaattattcatcgcgatctgaaacctagcaatatagttgtgaaatctgattgcaccctgaaaattctggactttgggctcgccaggactgcctgcacaaattttatgatgacaccttacgtcgtgacgcgttactaccgcgcacccgaggtgatattgggcatgggatacaaggaaaatgtggatatctggtccgtgggatgtatcatgggggaattggtaaaaggatgcgtgatcttccaagggaccgaccatatagaccagtggaacaaggtgatcgaacagctagggacccctagcgccgaatttatgaagaaattacagccgacagtgagaaattacgtggagaaccgacccaagtatcctgggattaagttcgaggaactttttcccgactggattttcccttctgaatctgaacgggacaaaattaagaccagccaagcccgggacctgctatctaaaatgctcgttatcgatcctgacaagcgaatttcagtggatgaggccttgagacacccctatataacggtgtggtacgatcctgctgaagcagaagctcccccaccacagatttacgatgcgcagctggaggaaagggagcacgctatcgaagaatggaaggagttaatctacaaggaggtcatggactgggaggaacggtctaagaatggggtggttaaagatcagccaagcgcacagatgcagcagtag

SEQ ID NO: 124747 - DNA, 375 bp, Artificial Sequence
  Description of Artificial Sequence: Synthetic coding sequence
atgtcagacagcaagtgcgactcccaattctatagcgtgcaagtggccgatagtacctttacagtcctgaagagataccagcaactcaaacccattggatccggagctcagggcatcgtttggcgccatcactgttctgctctcccattcataggtcgcatgcgcccggtttctgtaattgtgactccttggattaatcaggaggggatgctgtgcgagggcctcgggtggccaagtttgccatggtgtctcacctcaaccgtgtgtcctgcccagaatgttaggattgtttccctcactctcaacgtatccctgctgcacggaaagaccgtaagccgacggtccatcactggacagctcaaatgctgcatctag

SEQ ID NO: 124748 - DNA, 729 bp, Artificial Sequence
  Description of Artificial Sequence: Synthetic coding sequence
atgtcagatagcaagtgcgactcgcagttttattctgtgcaggtcgccgactcgacttttactgtgcttaagcgctatcaacagctcaagccgattgggtcgggcgcccagggcattgtgtgtgccgccttcgacacggtattaggcatcaatgtggccgtgaaaaagctgagcaggccttttcagaatcagacccacgctaaacgggcctacagagaattggtattactcaagtgcgttaatcacaagaatatcatttccttgctcaacgtgtttactcctcaaaagacactggaggaatttcaggatgtgtatttggtgatggagttgatggacgctaacctgtgccaagtgattcacatggaactggaccatgaaaggatgagttacctgttgtatcagatgttgtgtggtatcaaacaccttcactcagccgggatcatccaccgagacttgaagccatctaatattgtagtgaagagcgattgtaccttgaagatccttgactttggtctagccaggacagcctgcactaatttcatgatgacaccatacgtggtgaccagatattaccgagctcccgaggtgatcctggggatgggatacaaagagaatgtagatatctggtcggtaggctgcattatgggggaactggtcaaaggatgcgtaatttttcaaggtaccgataggattctgccaagggatctgggccccgcgatgctgtcatag

SEQ ID NO: 124749 - DNA, 1275 bp, Artificial Sequence
  Description of Artificial Sequence: Synthetic coding sequence
atgtcagacagcaaatgtgactcacaattctattcggtgcaggtggctgattctacctttacggtgttgaaaaggtaccagcaattgaagcccattggttctggggcgcagggcattgtctgtgcggccttcgacacggtattaggaatcaacgtcgcggtcaaaaagctctccaggcctttccagaaccaaacacacgctaaaagggcgtaccgggagctggttttactcaaatgcgtgaaccacaagaacataatctcactcttaaatgttttcacacctcaaaagaccctcgaggaattccaagatgtgtacctggtaatggagctgatggatgccaacttgtgtcaggttatccatatggaattagatcacgaaaggatgtcctacctgctttaccagatgctgtgtggcattaagcatttacattccgcaggcatcatccaccgagacctgaagccgtccaatatagtcgtgaaatccgactgcactctgaaaatccttgatttcgggctcgctaggaccgcttgcactaattttatgatgacaccctacgttgtgacacggtactatagagccccggaagtgatcctgggaatggggtacaaggagaacgtggatatctggagtgtgggctgcatcatgggcgagctggtgaaaggatgcgtcattttccaaggtacagaccatatcgaccaatggaataaggttatcgaacagctcggtacgcccagtgcggaatttatgaaaaagctccagccaaccgtaaggaattacgtggagaaccgccctaaatatcccggcatcaaattcgaagaactttttcctgattggatctttccaagcgaatctgaacgggataaaatcaaaacttcccaagccagggatctcctgagcaaaatgctggtcattgatccagacaagaggatttccgtggacgaggcccttcgacacccatacattacagtctggtatgatcccgcagaagccgaggccccacccccccagatctacgatgctcagctcgaagaaagggagcacgccatcgaggaatggaaagagttgatctataaagaggtcatggactgggaggagcggtccaaaaatggggtggtcaaggatcagccttccgacgccgccgtcagtagcaatgcaacgccgagccagagcagttccattaatgacataagcagcatgtcgactgaacagaccctggccagcgataccgactcaagcctggacgctagcacgggcccactcgagggttgccgctag

SEQ ID NO: 124750 - DNA, 1275 bp, Artificial Sequence
  Description of Artificial Sequence: Synthetic coding sequence
atgtccgattcaaagtgcgacagccagttttattccgtccaagtggccgatagcacatttaccgtcctgaaacgttaccagcagttgaaacccattggttctggcgcccagggcattgtgtgcgccgcctttgacaccgtcctggggatcaacgtcgccgtgaaaaaactgtcaaggcctttccaaaaccaaacgcatgccaagagggcgtaccgggagctcgtccttcttaaatgcgtgaaccataaaaacatcatttctctgttaaacgtgtttacaccgcagaaaacactagaagaattccaagatgtgtatctggtcatggaattgatggacgcaaacctctgccaggtgattcatatggaactcgaccatgaaagaatgtcgtacctactatatcaaatgctgtgcggcataaaacacttgcactcggccggaatcattcaccgcgacctgaagccttccaacatcgtggtaaaatctgactgcaccttaaagatactcgacttcggactggcacgcacggcctgtaccaacttcatgatgaccccgtatgtcgtgacacggtattaccgtgctcctgaagtgattctcgggatgggatataaagaaaatgtagacatctggagtgttgggtgtattatggcagagatggtcctgcacaaggtgttgtttccgggcagagactacatcgaccagtggaataaagtaatcgagcagttgggaaccccatcggcagagttcatgaaaaaacttcagccaactgtgaggaactatgtggagaacagaccaaaatatccaggtattaaattcgaggagttgttccccgattggatctttccctccgaaagcgagagagataagattaaaacttcacaagccagggacctcctgtcgaagatgctcgtaatcgaccctgacaagcgtatttcagtcgatgaggctttaagacatccgtacattacggtttggtacgatcctgcagaagccgaggctccaccaccacagatatatgacgcgcagcttgaggaacgcgaacatgcaatcgaggaatggaaggaactaatctataaggaagtgatggactgggaagagagatcaaagaacggagttgtgaaggaccagcctagtgatgccgctgtttcgtccaacgctactccctctcaatctagttcaatcaacgacatttccagcatgtctactgagcagactttggcgtcagataccgactcttccctggatgcttctacaggtccgttggagggttgccggtag

SEQ ID NO: 124751 - DNA, 315 bp, Artificial Sequence
  Description of Artificial Sequence: Synthetic coding sequence
atgtctgacagcaagtgcgactcccagttttactcagtgcaggtggccgacagcacgtttaccgtcctgaagcggtaccaacaactgaagcctatcggctctggcgcccagggtatcgtctgcgccgcctttgatactgtcttaggcatcaacgtcgccgtcaagaagttgagccggccttttcagaatcagactcacgccaagagagcctaccgggagttggtgcttctgaagtgcgttaatcacaagaatatcatcagcttgcttaatgtctttacccctcagaaaactttggaggagtttcaggatgtttag

SEQ ID NO: 124752 - DNA, 645 bp, Artificial Sequence
  Description of Artificial Sequence: Synthetic coding sequence
atgtcggattctaagtgtgattcacagttttacagcgtgcaggtagccgactctactttcactgtcctgaagcggtatcaacaattaaaacccatagggagcggggcgcaaggaatcgtgtgcgctgccttcgataccgttttgggcataaacgtagctgtcaagaaactgtccaggccttttcaaaatcagacccatgccaaacgagcataccgggaactggtgctactgaaatgtgttaatcacaagaacatcatctcactgctgaacgttttcacccctcaaaaaacattggaggagtttcaggacgtgtatcttgtcatggaactcatggatgccaacttgtgccaggtgatccacatggagttagatcacgagagaatgtcctacctgctgtaccagatgctctgcgggatcaagcatttgcactcagctggaattatccatcgggacctcaaaccttccaatattgtggtgaagtcggactgtacgcttaagatattagatttcggcctcgccagaaccgcctgcaccaactttatgatgactccctatgtcgttacccgttattatcgggctccagaggtaatattgggcatgggatacaaggagaacgcaattaagtactggacattgtggcactag

SEQ ID NO: 124753 - DNA, 1347 bp, Artificial Sequence
  Description of Artificial Sequence: Synthetic coding sequence
atgctctggctggctctggggccgtttccggctatggagaaccaagtccttgtgattcgtatcaagattcccaattcgggagcagtggattggactgttcactctggtccgcagcttttgtttagagatgtgctggatgtcataggccaggtattaccggaggccaccaccactgcatttgagtatgaggatgaggacggcgatagaatcactgtgaggtcggacgaagagatgaaggccatgctaagttactattactcaactgtgatggaacagcaggtgaatggccagctcatcgagcccttgcagatctttccccgggcatgtaaacctccaggcgagcggaacattcacggactcaaagttaatacacgcgccggcccgagccagcactcctcaccagccgttagcgatagcctgcctagtaacagtcttaaaaaaagctccgccgagctgaaaaaaatcctagctaatggacagatgaatgagcaggacattcgataccgtgataccttggggcatgggaatggaggcaccgtgtacaaggcataccatgtacccagcggtaagatcctggccgtcaaggtgatcctgcttgacatcactctggagctgcagaagcaaataatgagcgaattggaaattttatacaagtgcgactcctcctacattatagggttttatggtgcattctttgtcgagaaccgtatttcaatatgcactgaatttatggacggaggttcacttgacgtgtatcggaaaatgcccgagcacgtcctaggtcggatcgccgtggccgtagtgaaaggccttacctacttatggtcactcaaaatccttcaccgggacgtcaagcctagcaacatgctcgttaatactcgaggacaagtgaaattgtgcgattttggtgtgtcaacacagctcgtgaatagcatagccaaaacctacgttgggacgaacgcatacatggccccagagcggatctctggcgaacagtacgggattcactcagatgtttggtcactgggcataagcttcatggagctagcattgggacggttcccatatccccagatccaaaaaaaccaaggctcacttatgcccctccagctattgcagtgtattgtcgatgaggattccccagttttgccggtgggagagttttctgaacctttcgtgcacttcataactcagtgtatgcgcaagcagcctaaggagagaccagcccctgaggagcttatgggccatccgttcattgtccagttcaatgacggtaatgcggctgtggttagtatgtgggtgtgccgggctttggaagaacgccgatctcagcagggaccaccttag

SEQ ID NO: 124754 - DNA, 1317 bp, Artificial Sequence
  Description of Artificial Sequence: Synthetic coding sequence
atgttatggcttgcgctggggccgttcccggctatggaaaaccaggtgttggtgatccgcatcaaaatcccgaactccggagcagtcgattggactgttcatagcggtccccaacttctatttcgggacgtcctcgatgttatcgggcaggtcctgcctgaggctaccaccacggccttcgagtatgaggacgaagacggcgaccgaattacagtaaggtccgatgaagagatgaaggccatgctgagctactactacagcacggtgatggagcagcaggtgaacgggcagcttattgaaccccttcagatcttccctagagcgtgcaagcccccgggagaacgaaacatacacgggcttaaagtgaacaccagggcagggccatctcaacacagttctcctgctgtgtcggacagcctcccaagcaatagcctgaaaaaatcatccgctgagttgaagaagattctcgccaacggtcagatgaacgagcaggatatcagatatagggatacccttggacacggtaacggtggcactgtgtataaagcttaccatgtaccatccgggaagatcttagccgttaaagtgattcttctggacattaccctggagcttcagaaacaaataatgagcgaactggagatcctgtataaatgtgattccagctacattatcggtttctacggagctttcttcgttgagaacagaatcagcatatgtacagaattcatggacggcggcagcctcgatgtgtacagaaagatgcccgagcatgttctgggaagaattgccgtggcggtggttaagggactgacctacctgtggtccctgaaaattttacatcgtgacgtcaagccgtcgaatatgctggtgaacaccaggggacaggtgaagttgtgtgattttggggtgtcaacgcagttggtcaacagcattgccaagacttacgttgggaccaacgcatacatggccccggagcgcatcagcggagagcagtacggcatccattctgatgtgtggtccctgggcattagctttatggaaattcaaaaaaatcagggaagtttgatgcctcttcaactcctgcagtgtattgttgatgaagacagcccggtccttcccgtgggcgagttctccgagccctttgtgcatttcattacccagtgtatgcggaaacaacctaaggaaagaccggcccctgaagaactgatgggccaccccttcattgtccaattcaatgacggaaatgcggctgtcgtaagtatgtgggtctgcagggcgctggaggagcgcaggagtcagcagggaccaccttag

SEQ ID NO: 124755 - DNA, 1335 bp, Artificial Sequence
  Description of Artificial Sequence: Synthetic coding sequence
atgctctggttggcgctgggccccttccccgctatggaaaaccaggtacttgtgatcaggatcaaaatccccaactctggtgctgtggattggactgtgcattccggaccgcagctgttgttccgggatgtactcgacgtgatcgggcaagttctgcccgaagcaacaacgaccgcctttgaatatgaagacgaggacggcgacagaattaccgttcggtccgatgaagagatgaaggccatgctttcttactattactccacagtcatggaacagcaggtgaacgggcagcttatagagcccctgcagatcttccctagggcctgcaaaccacccggcgaaagaaatattcacgggctaaaagttaataccagagccggaccatctcagcactcttcgccggctgtctctgatagcttaccctccaacagtctgaagaaatctagtgcggaacttaagaagatcctagccaacggacagatgaatgagcaggatatcaggtacagggacacactgggccatggaaacggcggcactgtgtataaggcataccacgtgccatcaggaaaaatcctggccgtgaaagtgattctgttggacatcacgctcgagctccagaaacaaattatgtcagaactggagatcctctacaaatgcgatagtagctatatcatcggattctacggggctttctttgtggagaacagaatttcaatctgcacagagttcatggatggggggtcattagatgtctatagaaagatgcccgagcacgtactggggcgaatcgcggttgcagtcgtgaagggtttgacctatctgtggagtcttaagatactacatagagatgtcaagccatcaaatatgctggtgaatacaagaggccaagtgaaactgtgtgatttcggtgtgtctactcagctggtaaactctattgccaaaacatatgttgggacaaacgcttatatggctcctgagcgtatctcaggcgagcagtacgggatacactcagacgtgtggtccctcggaatttcctttatggagatacagaagaaccagggtagtctgatgcccctgcagctcctgcagtgtatagtggatgaggattccccggtgctgccggtgggggagttctctgagccattcgtgcacttcataacgcaatgcatgagaaagcagcctaaggagcggcccgctccagaagaactgatgggacatcccttcatcgtgcaatttaatgacggcaatgctgcagttgtgtcaatgtgggtttgtcgggccttggaggagcgtagatcaccggcctccttgccgtcgccctcatccagcatttag

SEQ ID NO: 124756 - DNA, 1239 bp, Artificial Sequence
  Description of Artificial Sequence: Synthetic coding sequence
atgatggagggccatttcccccagtcagacgtgattggacaagttctcccagaagccactactacggcttttgagtacgaggatgaggatggcgaccgcattacagtgaggtcagatgaagagatgaaggctatgctcagttattattactctactgtgatggaacagcaggttaatggacaattgatcgagccgttgcagatcttcccacgggcctgcaaaccacctggtgaacgtaatattcacggcctcaaggttaatactcgggccggcccatcccagcattcctctcctgccgttagcgattctctccccagtaacagcctgaagaaaagcagcgccgagctgaagaaaattttggccaacggacagatgaatgagcaggatatcagatacagagacactctcggacatggaaacggaggcacagtgtataaggcttatcacgtgcctagcggaaagatcctggccgtgaaggtcatcctcctggacatcactctggagctccagaagcagatcatgtccgaacttgagatcttgtataagtgcgatagctcctacattattgggttctacggagccttctttgttgaaaacaggatctccatttgtacagagttcatggacggcggctctttggacgtttataggaagatgcctgaacacgtcttaggcaggatagccgtcgccgtggtgaaggggcttacctatctatggagcctgaaaatactgcatcgggacgtgaaaccttcaaacatgttagtaaacacacgaggacaggtgaagttatgtgactttggggtatcaacccagttggtgaactccatcgctaagacgtatgtgggcacaaacgcttacatggcgcccgagaggattagtggcgagcagtacggcatccattccgacgtgtggtctctcggcatctcatttatggagttagccttggggaggttcccctatcctcagatccagaagaaccaaggcagcctgatgcccctgcaattgctgcagtgcatcgtcgacgaagatagcccggtgttgccagtgggagaattctcagagccctttgtgcattttataacacaatgcatgagaaagcagccaaaggaaagacccgcccccgaagagcttatgggccacccttttatcgtccagtttaatgatggtaacgctgctgtggtgagtatgtgggtctgccgggctctggaggaaagacgctcccaacagggtcctccctag

SEQ ID NO: 124757 - DNA, 1005 bp, Artificial Sequence
  Description of Artificial Sequence: Synthetic coding sequence
atgagccagagcaagggcaaaaaaaggaatcccggcctcaagattccaaaggaggctttcgagcagccacagacgtctagcacccccccccgggatcttgattcgaaggcttgtattagcatcggcaaccagaattttgaagtgaaagccgacgacctggagccaatcatggagttgggacggggtgcatatggcgtggtggaaaagatgcgccacgtcccctctggccaaatcatggctgtgaaaagaattcgagcaactgtgaatagtcaggaacagaagagactgctgatggacttagatatctctatgcggaccgtcgattgccccttcactgtaactttctacggtgcactttttagggagggggacgtgtggatttgtatggagctgatggatacctctttagacaaattttacaaacaggtgatcgataagggtcagaccattccagaggacatcctgggtaagattgccgtgtccattgtgaaagcactcgaacacctccactccaagttatccgtgattcaccgggatgtgaaaccgtccaacgtcctcatcaatgcactgggccaggtcaagatgtgtgattttggcatctctggctaccttgtggacagtgttgccaagactatcgatgcaggctgtaagccttatatggcacctgagcgcatcaacccagagctcaaccagaaaggctattccgtaaagtcagatatatggagcctcggcataacaatgatcgaactggcaatcctacggttcccctatgatagctgggggaccccttttcagcagcttaagcaggtggtagaagagccgtctccacagctgcccgctgacaagttttccgcagaatttgtggattttactagccagtgcctaaagaaaaactcaaaagaaaggccaacttaccccgagttgatgcaacacccattctttaccctgcatgaatcaaaaggcaccgatgtggcctcttttgtcaagttgattctcggagactag

SEQ ID NO: 124758 - DNA, 1005 bp, Artificial Sequence
  Description of Artificial Sequence: Synthetic coding sequence
atgtctcagagtaaaggaaaaaaacggaatcccggcctgaaaatccctaaagaagcgtttgagcagccacagacgagttccactcctcccagggacctagatagcaaggcgtgcatcagtatcggaaaccagaatttcgaagtgaaagccgacgacttagaacccattatggagctaggaaggggagcatatggcgtggtggagaagatgaggcacgtccccagcggtcagattatggcagtcaaacgcattagggccaccgtcaactcccaggaacagaagagactgctgatggacctagacattagcatgagaactgttgactgtcctttcacagttaccttctatggcgcgctgttccgagaaggggacgtctggatatgcatggagctgatggacacaagcctggataagttttataagcaggtcattgataaagggcagacaatccccgaggacatccttggcaaaatcgccgtatctatcgtcaaggcgctggaacatctacattccaaactgagcgtgatccaccgcgatgtcaaaccgtctaatgtgctcattaacgcactggggcaggtcaagatgtgcgattttgggatctcaggatatctcgttgatagtgtcgcaaaaactatagatgccggatgtaagccttacatggctccggaaagaattaacccagagttgaatcagaagggctactccgtcaaatctgacatctggagtttggggatcacaatgatcgagctggcgatcctgagatttccgtatgactcctggggtaccccattccagcagttaaagcaggtagtggaggagccatctccccagcttcccgccgacaagttctccgcagagtttgtggactttactagccagtgcctgaaaaagaactcgaaagagcgacctacttaccctgagctaatgcagcaccctttttttacccttcatgaaagtaaagggactgatgtggcttcctttgtgaagctcatcttgggagattag

SEQ ID NO: 124759 - DNA, 2865 bp, Artificial Sequence
  Description of Artificial Sequence: Synthetic coding sequence
atggaagaggaagaaggtgcggttgcaaaggagtggggtacgactcctgccggacccgtgtggaccgctgtcttcgactacgaggcagcaggcgacgaggagttgacacttagacggggagatcgggtacaggtgctctcccaggattgcgcagtgtccggagatgagggatggtggacaggccagctgcccagtggaagagtgggagtctttccatcgaattatgtggcaccgggcgctcccgctgctcccgcagggctgcaacttccccaagaaataccctttcacgagctgcagttagaggaaataatcggcgtaggcggctttggcaaggtgtacagggctttgtggagaggagaagaggttgccgttaaggctgcacggcttgatcccgagaaagaccctgctgtcaccgcggaacaggtgtgccaggaggcacgtctgttcggagcactacagcaccctaacattatagctctaaggggagcttgtctaaaccctccccatctttgcctggtgatggagtatgcacgcggcggcgcactcagccgcgtgcttgccggtcgacgcgtgcctccccacgtcctggtgaactgggccgtccaggttgctcgcggtatgaattatctacacaatgacgccccagtccctatcatccacagggatcttaagagcataaacatcctcattcttgaggctattgagaatcataatctcgctgacaccgtgttgaagatcacggactttggcctggcaagggagtggcataaaactacaaagatgtcagctgccggaacctacgcctggatggctcctgaggtgatccgtctcagcttgttttccaaatcaagcgatgtctggtcgttcggggtgctgctgtgggagctgttgaccggggaagtcccctaccgggagatcgacgcgttagccgtagcgtacggcgtcgccatgaacaagcttaccctacccattccttcaacctgtccagagcctttcgctcgactccttgaagaatgctgggacccagacccacacgggagacccgattttggatccattcttaaaaggcttgaagtcatagagcaatccgcccttttccagatgcccctcgaatctttccactcgctccaagaagattggaagttggaaatccaacacatgttcgacgacctgcgaactaaggagaaagaactacgctccagagaggaggagctgctcagagctgctcaggaacagagattccaagaagagcagctgcgacgccgggagcaggaactagctgaacgcgagatggacatcgtggagcgagagctccatctgttgatgtgtcagctgtcacaggaaaaaccccgagtcagaaaacggaaaggaaattttaagaggagtcgcttgctcaaactgcgagaaggagggtcgcacattagtctgcctagcggctttgagcataaaatcaccgtgcaagcctctccaacactggacaagaggaagggatctgatggggcctctcccccggccagcccttccattatccctagactgcgcgctatacgcctgacccccgtggattgtggaggctcaagttcaggctcatccagtggtggttccgggacgtggtcccgaggcggcccaccaaagaaagaggagcttgtgggtgggaaaaaaaagggccgcacctggggccccagctccactctgcagaaagaacgggtgggcggcgaggaacgccttaagggtcttggcgagggctccaaacagtggtcctcatcggccccgaaccttggaaaatcgcctaagcacacgcccattgcacctggatttgcgtctctgaatgagatggaggaatttgctgaagcagaggatggtggaagtagcgtccccccctctccgtactctaccccatcctacctctctgtgccactccccgctgaaccaagtccgggagctcgcgcaccatgggagcctacaccgagcgcaccccccgcacgctgggggcacggcgccagaaggcggtgcgatctggcccttttgggatgcgccacactcttgggcgctgtgggattgggcgctgacgtggccgaggcgcgcgctgcagacggtgaagaacagcgaagatggctagacgggctctttttccctagagccggacggttcccacgaggactctcaccccccgccagaccccatggacgacgggaagatgttggcccagggttgggcctggcaccgagtgccacattggtgtcactatcttctgtgagcgactgcaacagcacaaggagcctattaagatcagatagcgacgaggcagccccagccgctccttccccccccccatcccccccagcccccacccccacacccagcccgtccaccaacccactcgtagacttagaactcgaatcatttaaaaaagacccgagacaatcacttacaccgactcacgtaacagccgcctgcgctgtcagtaggggccaccggagaacaccttcagacggcgcgctcggtcaacgcgggccaccagagcccgctggccacgggccggggccacgcgatctcctcgactttccgagactgcctgatccccaagcactctttcctgccaggcgacggccacccgagtttccaggccgccctaccacgcttaccttcgctcctaggccgaggcccgccgccagcagacctcggctggatccttggaagctggtatcgtttgggcggaccctaactatttcccctccctcccggccagatacacccgagtcacccggcccaccaagtgtccagccgacgcttttggatatggatatggaaggacagaaccaggactctaccgtgccactctgcggcgctcacggaagccactag

SEQ ID NO: 124760 - DNA, 2544 bp, Artificial Sequence
  Description of Artificial Sequence: Synthetic coding sequence
atggaaccactcaagagccttttcctgaagtctcccctcgggtcctggaatggaagtgggtctgggggggggggggggggcggcggcggacgtcccgagggctcacctaaagctgctgggtatgctaacccagtgtggactgccctctttgattacgaaccttcaggccaggatgagctagccctgcgcaaaggggatcgtgttgaagtactttctcgcgacgcagccattagtggcgacgaaggctggtgggccgggcaagtgggaggccaggtgggaatctttcccagtaattatgtgagtcgggggggcggccctcccccatgtgaggtggcgtctttccaggagttgagactggaagaggttatcggtataggggggtttggtaaagtgtaccgtggatcatggcggggtgagctggtcgctgtgaaggccgctagacaagatccagacgaagatatctccgtaaccgctgagtccgtcagacaggaggcgcgactcttcgccatgttggcacaccccaacattatcgctctgaaggccgtttgtctcgaagagcccaacctgtgtctagtcatggagtatgcagcgggggggcctctgagtagggccctcgcaggccgaagggtgccaccacatgtcctggtgaactgggctgtccagattgcacgggggatgcactacctgcactgcgaagccctggtcccggtcatccacagggacctgaaatccaataacatcttacttctccaaccaattgaatccgatgacatggaacataagactctgaagatcaccgattttggtttggccagagagtggcataagactacccagatgagcgccgccggtacgtacgcatggatggctccagaagtgatcaaagcgtcaactttttcaaagggcagcgacgtctggagctttggggtgctcctctgggagctgttgacaggggaagtaccctaccgtggaattgactgtttagcggtcgcatacggggtggcggttaataaactgaccctcccaattccatcaacttgccctgagccgttcgctcagctgatggctgattgctgggctcaagacccgcatcgccggcctgactttgcctctattttgcaacagttggaggccttggaggcacaggttttgcgagagatgcctagagactccttccactcaatgcaagaaggttggaagagggagatccagggtctgttcgatgaactgcgggcaaaggagaaggagttgttgagcagagaggaggagcttacccgggctgcgagagaacagcgcagccaggcagaacagctccgcagacgcgaacatttgcttgcacagtgggagctggaggtctttgagcgagaactgactctgctgttgcagcaggtagacagagagagaccccacgtcagaaggcggcggggcactttcaaaaggtctaagttgcgggcccgcgatgggggtgagaggatcagtatgccactggacttcaagcatcgcataacagtgcaggccagccccggtctcgatcgccgccgcaatgtgtttgaagtcggcccgggtgacagcccgactttcccaaggtttagagcgatacagctcgaacccgcagaaccagggcaggcctgggggcgccagtctcccagacgattggaggattcaagtaatggggagcgccgagcctgttgggcttggggtccttcctctccgaaaccaggagaagcccagaatggacgccggcggtctcgtatggacgaggccacctggtatctagattctgatgattctagccccctcgggagcccctctactccaccagcactgaacggaaacccaccgcggccttctctggaacctgaggaaccgaagaggccagtgccggctgaacgtggcagcagctccggcacccccaagcttatccagagagcattgctgcgggggaccgccttgcttgcaagcctagggctgggccgggacttacaacccccaggcggtccggggagagagagaggagagtcacccacaacaccacccacacctactcccgccccgtgccccacggaacctcctccctcccctcttatatgcttttctctgaagacaccagacagtcccccgacaccagctccactgctgcttgaccttgggatccccgtggggcagaggtccgcaaaatcccctaggcgcgaggaggagccccgaggtgggactgtgtccccacctcccggaacgtcccgatctgccccagggacaccaggtacccctcggagcccgcccctcggtctcattagccggccccgcccttccccactcagaagcagaattgatccttggagttttgtgtccgccggaccaagacctagccccctgccttctcctcagcctgcgccccgccgggccccatggacactgttccccgactctgaccctttttgggattcccctcctgccaatcccttccagggaggcccacaagattgcagggcgcaaacaaaagatatgggcgctcaggccccctgggtgccagaggctggcccttag

SEQ ID NO: 124761 - DNA, 1773 bp, Artificial Sequence
  Description of Artificial Sequence: Synthetic coding sequence
atggaacataaaaccttaaagattaccgatttcggactcgcgagagagtggcataagactacccagatgtccgctgctgggacttatgcttggatggcacccgaagtaattaaggcgtccacattttctaaagggtccgacgtgtggagttttggcgtactgttatgggaacttctgactggagaagtgccctatcggggcattgattgtctcgctgttgcatacggtgtcgccgtcaataagctgacacttccaattcctagtacatgtcccgagccatttgcccaattgatggccgattgctgggctcaggaccctcaccgcagacctgatttcgccagtatactccagcagctggaagctctcgaagctcaagtgctacgggagatgccaagagattcctttcattcaatgcaggagggttggaagcgggagattcagggactcttcgacgaacttagggccaaggaaaaagagctgttgtccagagaagaggagctgaccagagccgccagggaacaacgtagccaggccgagcaactgagacgaagggaacatctcctggctcagtgggagttggaggtctttgagcgggaactgacactgttgctccagcaagtagaccgtgagcgcccgcatgtacgtaggcggaggggaaccttcaaacggagcaagctacgtgccagagacgggggggagcgtatatctatgcccctcgatttcaaacaccgaataactgtgcaggccagtccaggtttagatcgtagaaggaacgtttttgaggtggggccaggcgactcacctactttcccccgtttcagagcgatccagctcgagccagcagagccaggacaggcttgggggcggcagagccctcgcaggctcgaggattcgtcaaacggcgaaagacgggcctgttgggcttggggcccctcttcccccaagccaggggaagctcagaatgggaggagaaggtcccgcatggacgaggccacatggtatctggactccgatgattcatctcccctcggctcccccagtactcccccagcactgaacggcaaccctcccaggccctcactcgagccagaagaaccaaagcgcccggtgccggccgagcgcgggtcgagcagcggtaccccaaaactgatccagcgagctttgctgcgggggactgctctgttagcttcgttaggactgggacgtgatcttcaaccccctggagggcccggcagggaaagaggcgaatcacccacaactcccccgacgcctaccccagccccctgcccaacagaaccccccccctcccctctgatttgcttttcgctcaagacccccgacagccctccgacccctgcacccttactcctggacctgggaataccggtgggccagcgctcggcaaagtcacccagacgggaggaggaacccaggggaggaacggtgagcccccctcccggcacctcccgctctgcccctggcacacctggaactccccggtccccccctctcgggttgatctcgcgtcctcgccccagcccactcaggtcccggatcgatccctggagtttcgtctctgctggcccgaggcccagcccgctgccttccccccagccagccccacgccgggccccatggactttgttccccgatagcgaccccttctgggattcccccccagccaaccccttccagggtgggcctcaggattgtcgcgcccagaccaaggatatgggagcccaggccccatgggtcccggaggccggaccatag

SEQ ID NO: 124762 - DNA, 2580 bp, Artificial Sequence
  Description of Artificial Sequence: Synthetic coding sequence
atggcctgtctgcacgagactcgcacccctagtccttcttttggcggcttcgtctcgactttgtcggaggcctcaatgcgaaagttggaccctgacacctcagattgcacacctgagaaagatttgacgccaacacacgtgctgcagctgcacgagcaggatgccgggggaccgggcggcgcagccggtagtcctgagtctagagccagccgggtgcgtgcagatgaagtgaggctccagtgccaatcgggttctggcttcctggagggacttttcgggtgcctgcgtcctgtctggacaatgattggaaaggcctatagtactgaacacaaacaacagcaggaagatctgtgggaggtccctttcgaagagatactagatctccagtgggtgggatcaggggctcagggagcggtgttccttggtcgatttcacggtgaggaggtggctgtgaagaaggtccgtgatctcaaagagaccgacattaagcaccttcggaaactgaaacaccctaacatcatcaccttcaagggggtgtgcactcaagccccttgctactgtatcctgatggaattttgcgcccaggggcagttgtatgaagttctgcgggccggcagacctgtcacacccagccttctcgtggattggtcaatgggaattgccggcggaatgaactatttgcatttgcacaagatcatccacagggatttgaaatctccgaatatgctgataacctacgacgatgtcgtcaaaataagcgactttgggacgagcaaagagttgtccgacaagtcaaccaagatgagcttcgcaggcactgtcgcgtggatggctcctgaagttattcggaacgagccagtgagcgagaaggtggatatttggtcttttggggttgtgttatgggagctgttaaccggcgagatcccttataaagatgtggattcttccgccatcatttggggggtcggttccaacagcttgcatctcccagtcccttcatcctgtcccgacggcttcaaaatcctgctgcgccaatgctggaattcaaagccccgtaaccgccccagttttagacagatactcctgcatttagacatcgctagtgccgacgtgttgtcgactcctcaagaaacttatttcaaatcacaggccgaatggagagaagaagtgaagcttcactttgagaagatcaaatcagagggaacctgtcttcacagacttgaggaagagctcgtcatgagacgccgtgaagaacttcgccatgccttagacataagagaacattatgagcgaaaattggagagagccaataatctctatatggagctcaacgcgctcatgctccagctcgagcttaaggaaagagagctcctgcggcgggagcaagccctggaacggaggtgccctgggctcctgaagccgcacccatcaagaggccttttgcacggtaataccatggagaagctgatcaaaaagagaaatgttcctcaaaagctctccccacactcgaagcgccctgatattcttaaaaccgaatctttactaccaaagctggacgccgccctctcaggcgttgggctacctgggtgccctaaagggccgccttcacctgggcggagccgtcggggaaagacccgccatcggaaggctagtgccaaaggcagttgtggagacctgcctggacttcgcacagcagtgccgccccacgaaccgggcgggccggggtcccccggcggactgggcgggggcccctctgcttgggaagcttgccccccagccctgcgcggcctgcaccacgacttgctactccgaaagatgtcatcctcctcgcccgacctgctgagcgcagccctgggttcccgtgggcggggagctactggcggagccggggatcccggcagtccccctcctgcccgtggtgacacgcctccttctgaaggtagtgctcctggctctacgtcccctgattctccaggcggtgcaaaaggagagcccccccctccagtcggacctggcgagggcgtcggcttattgggcacaggcagggaggggactagtggacggggcgggtcaagggccggaagccagcacctaaccccggccgccctcttatatcgcgccgccgtaactcgctctcaaaaaagggggataagctccgaggaggaagaaggcgaagtcgactcagaggtggagctgaccagcagtcagcggtggccccaatctctgaatatgcggcaatctttgtctacattctctagtgagaacccttctgatggggaagagggcaccgcctctgagccatccccctcaggcacccccgaggttggatccaccaatactgatgaaagaccagatgagagatctgatgacatgtgttcacagggcagtgagatcccactagatcctcccccctctgaggtgatccccggtcctgaaccttcgtctctccctattccacatcaggagctcctgagggaacgaggaccaccgaatagcgaagattcagactgcgattccacagagctggacaacagcaattctgtcgatgctctccggccccccgcctccctccctccatag

SEQ ID NO: 124763 - DNA, 2901 bp, Artificial Sequence
  Description of Artificial Sequence: Synthetic coding sequence
atggctaatttccaggagcatttgagctgcagctcctcaccccatctgcccttctccgagagcaagacctttaacggcctgcaggacgaactgaccgcaatggggaatcacccgagcccgaagctgttggaggatcaacaggagaaaggcatggtccggaccgaacttatcgaatccgtgcattcacctgttactactaccgtgctcaccagcgttagtgaggatagcagagatcagtttgaaaacagtgttttgcagcttagagagcacgatgagagcgagaccgcggtctctcagggcaattctaacaccgttgacggtgagtccaccagcggaacggaggacatcaaaattcagttctcccggagcggatccggttcagggggattcttggaaggtctgtttggatgtctcagacccgtgtggaatatcatcggcaaggcatactccactgactacaagctgcagcagcaggacacctgggaggtgccctttgaagagatcagcgaactccaatggctaggcagtggtgcgcagggggccgtgtttctggggaagtttcgtgccgaagaggtggcaattaaaaaagttcgtgagcaaaacgaaaccgacattaaacacctccggaagctgaaacaccccaatattatcgcttttaaaggagtttgcacccaggcaccttgctactgcattattatggaatactgcgctcacgggcagttgtacgaggtgttacgggcaggccggaagattactccgagactgttagtggactggtccactgggattgcgagcggcatgaattacctccacctccacaaaattatccaccgtgacctgaaatctccaaacgtcctcgtgactcacactgacgcagtcaagatatccgatttcgggacctctaaggaattatccgataaatctacgaaaatgtccttcgcaggcacagtggcctggatggctcccgaggtgattcgtaacgagccagtctcagaaaaggtcgatatctggtcctttggggtggtgctgtgggagttactgacgggtgagatcccgtataaggacgttgattcatctgctattatatggggcgttggctctaatagtctccacctgcccgtgccttcaacatgtcccgatggatttaagatactgatgaagcagacatggcagtccaagcctcgcaatcgccccagttttcgccagacattgatgcacctcgatatcgcctctgccgacgtgctcgcaactccccaggagacctacttcaaatcccaggcggaatggcgggaggaagtgaagaagcacttcgaaaagatcaagtccgagggtacatgtatccacagattagacgaagaactcattcggcggcgtagagaggagctgcgccacgctctggacatccgtgagcactatgagcgtaaactcgaaagggccaacaacctttatatggaactgtccgcaattatgttgcagctggagatgagagaaaaggaactgattaagagagagcaggcggtggagaagaagtatcctggaacttacaaacggcaccctgttagacccatcatccatccaaacgccatggagaagcttatgaagcggaaaggagtcccgcacaaatccggaatgcaaaccaagcgaccggatctcctccggagcgagggcattcctacaacagaggtagcacccacggcgagtcctctttcagggtcccccaaaatgtcaacctcatccagcaagtctcgctaccgctctaagccgcgccataggagaggcaacagtcgggggtcgcactctgattttgctgccatcctcaaaaaccagcccgcgcaggagaatagtccccacccaacatacctgcatcaggcgcagtcccagtatccgtctttacatcatcacaactctctgcaacagcaataccaacaaccacctcccgccatgagtcaatcacatcacccgcggctgaatatgcacgggcaggatatcgcaacatgcgcaaacaatttgcggtacttcggccctgcagctgctcttcggtcccctctcagcaaccatgcccagcgtcagctccccggatccagcccagatttgatcagcacagcaatggccgctgactgttggagatctagcgagccagacaagggtcaagctggaccctgggggtgttgccaggctgatgcttacgatccatgcttgcagtgtcgcccagagcagtacggcagcctcgacattcccagcgctgagccagtcgggaggagcccagatctgtctaaatcacctgcacataatcctttgcttgaaaacgcccaaagcagcgagaaaacggaagagaacgaatttagtggctgccggagtgaatcttcgttggggaccagccatcttgggactccccctgccctcccacgaaagactcgtccactgcagaaatccggggatgacagtagcgaagaggaggagggagaagtcgactctgaggttgaattccctaggcggcagcggccccatcgctgcataagttcttgtcagtcctactccacattcagttcagagaactttagcgtaagcgacggggaggaaggtaacacctctgatcacagcaactcccccgacgagcttgccgacaagctcgaggaccgacttgccgagaagctcgacgatttattgagccagacaccggagatccctatcgatattagctcacacagcgatggcctctcagataaagaatgtgccgtccgtagggtcaagactcagatgtccctgggcaagttgtgcgtagaggagagggggtacgagaatccaatgcagtttgaagaatccgactgcgactccagcgatggagagtgtagtgatgcgacagtgaggacaaacaaacactactcttctgcaacttggtag

SEQ ID NO: 124764 - DNA, 2901 bp, Artificial Sequence
  Description of Artificial Sequence: Synthetic coding sequence
atggccaacttccaagagcatctgagctgttcctccagtccccatttgcctttcagcgaatcaaagaccttcaacgggttacaagatgaattgacggccatgggaaatcacccaagccctaaactcctggaggatcagcaggaaaagggaatggtgcggactgaactgattgagtcggtccacagtcctgtgactacgacagttctgacaagtgtaagtgaggattcgagggatcagtttgagaacagtgtcctgcaactgcgtgagcatgatgagagtgagaccgcagttagccagggtaatagtaatactgtggatggagaaagcacatccggaactgaggacataaagatccagttttcgcgaagcggatccgggtcaggtggctttctggagggactattcggatgcctcagacctgtgtggaacatcatcggaaaggcttattctacagactataaactgcagcagcaagatacatgggaagtgcccttcgaggagatcagcgagctgcagtggttgggctcaggtgctcaaggagcagtcttcctgggaaaattccgagctgaggaagtcgccattaagaaggtccgcgagcagaacgagactgacattaagcacctgagaaagctgaagcatcccaatatcattgcctttaagggcgtctgtacacaggcaccttgctattgcatcatcatggaatattgtgcccacggtcaactgtacgaagttctcagggccggacggaaaatcacaccaaggctgctggtagactggtccactgggattgcatctggaatgaactatctgcaccttcataagatcatccatcgagatcttaagtctcccaatgtgctggtcactcacactgacgcagtgaaaatctcagactttggcactagtaaggagctttcagataagtctactaagatgagctttgccgggaccgttgcctggatggcccctgaggtcattcgtaatgagcccgtttctgagaaggtggacatatggtcatttggagtggtgctgtgggagctgcttacaggagagatcccctacaaagatgttgactcctccgctattatttggggcgtcgggagcaactctctgcacctccccgtgccatctacttgtcccgacggtttcaaaattctgatgaaacagacctggcagtcaaaacctcgtaaccgcccgtctttccggcagaccctcatgcacctggatatcgcctccgccgatgtcctcgccaccccgcaagaaacatatttcaaatcccaggccgagtggcgagaggaggtgaagaagcacttcgaaaaaattaagtcggaggggacatgcatccatcgcttagacgaggagttgatccgtaggagaagggaggagctgagacatgcactggacatccgggaacattacgaacggaagctggagcgagcgaataatctctatatggagctctccgccatcatgctgcaattagaaatgagggaaaaggagctgattaagcgtgagcaagcagttgagaaaaagtaccccgggacctacaaaagacaccctgttagacctatcatccaccccaacgccatggaaaagctgatgaagcggaaaggcgtgccgcacaaaagcggtatgcagacaaaaaggccagacctcttacgatccgagggaatacccactaccgaagtggcgccaactgcgtctcccctgtccgggtcccctaaaatgtccacttcctcctcaaaatccaggtacagatccaaaccaagacataggcgcggaaacagtagaggtagccactccgattttgctgcaatattaaagaaccagcccgcgcaggagaactccccccatcccacttatctgcatcaggctcaaagccagtatcctagtttgcaccaccacaactccttgcaacagcaataccagcagccaccacccgctatgtcccagtcacatcatccacgattgaacatgcatgggcaggacatcgctacatgtgcaaacaacttgcggtattttgggcccgcagctgccttgcgttcccctctgtccaaccacgcccagcgacagctgcccggcagctctcccgacttaattagtactgctatggcagccgactgctggaggagcagcgagcccgataaaggccaagctgggccctgggggtgttgccaggcggacgcatatgacccatgtctgcagtgccgccccgaacagtatggtagtctcgacattccaagcgctgagcctgtcggaaggagcccagacctcagcaagagccctgcacacaatccgctcctcgagaacgcccagagcagtgagaagacagaggagaacgagttcagcggatgtcgcagcgaatcctcccttggaacgagtcaccttggcacacctcccgccttacctcgaaaaactcggcctttgcaaaaaagcggtgacgattcttccgaagaggaagaaggagaggtggactccgaggtagaatttccccgacgccagagaccccacagatgtatcagctcctgtcagtcttattcaaccttcagcagcgagaatttttcagtttcggatggcgaggaaggtaatacgagcgaccactccaattctcccgatgaactggccgataaattagaggacagactggccgaaaaactggacgacttgctcagccagacgcctgagatccctatcgatatttcctctcacagcgatggcttgagcgacaaggaatgcgcggtgcgcagggtcaagacccaaatgtccctgggtaaactttgtgtggaggaaagggggtacgagaatcccatgcagttcgaggagagtgactgtgattcatcagacggcgaatgcagcgacgccactgtgcgcactaataagcactactcttctgcgacctggtag

SEQ ID NO: 124765 - DNA, 414 bp, Artificial Sequence
  Description of Artificial Sequence: Synthetic coding sequence
atggccaatttccaggagcacctttcctgctcttcatcaccccatctgccgttctcggagtctaaaacgttcaatggcctgcaagacgagttgacagctatgggaaatcatccatcccccaaactgctcgaagaccagcaagagaagggcatggttagaaccgagcttatcgagtctgttcactcccccgtcactacgactgtgttaacatcggtgtccgaggattccagggatcagtttgaaaacagcgttctgcagctgcgagaacatgacgagagcgaaactgccgtttcgcaaggaaattcaaacaccgtcgatggcgaaagcacatcagggacagaggatattaagatacagttttcccggtcagggtccgggtctggcggtttcctggagggtctgttcgggtgctag

SEQ ID NO: 124766 - DNA, 342 bp, Artificial Sequence
  Description of Artificial Sequence: Synthetic coding sequence
atggccaatttccaggagcacctgtcttgctcttcatcccctcacctgcccttctcggagagcaaaacgtttaacggcctccaggatgaactgacagctatgggcaaccaccctagtccaaagttgcttgaggatcagcaagagaaagggatggtacggacagagctgatcgagtccgtgcattcacctgtcaccaccaccgtcctcacttctgtgagcgaggactccagggaccagtttgagaactctgtgctgcaactcagagagcatgatgaatctgagaccgctgtctcgcagggaaacagtaacacggtagatggtgagtctacatccggtacctag

SEQ ID NO: 124767 - DNA, 2469 bp, Artificial Sequence
  Description of Artificial Sequence: Synthetic coding sequence
atgtcctacgtagaatgcaagtgcctgcagctggagaataaaaacacgtgggaagtaccgttcgaggagattagcgagctgcagtggcttggcagtggggcgcagggagcggtttttttagggaaatttcgggccgaagaggttgccatcaagaaagttcgtgaacagaacgagactgacatcaagcacttgaggaagctcaagcaccctaacatcatcgccttcaaaggcgtgtgtactcaggcgccgtgttactgcatcatcatggaatattgtgcccatggacagctttacgaagtccttcgtgccggccgaaagataacgcctagacttctggtggactggagcactggaatcgctagtggaatgaactatctacatctgcacaagatcatacacagggacctaaagtctccaaacgtcctagttacccacacagacgctgtcaaaatatccgacttcgggaccagcaaggagctgtccgataagagcactaagatgagcttcgccggcactgtcgcctggatggctccggaagttatcaggaacgagcccgtgtcagagaaagtggacatctggtccttcggggtggttctctgggagctgctgacgggggagatcccttataaggatgtggattcatcagctattatctggggggttggatccaattccctccatctgcctgtccccagcacatgtccggatggatttaagatattgatgaagcaaacctggcagtcgaagccccgcaaccgtccttcttttagacagaccctgatgcacttggatattgctagcgcagacgttctagcaactccccaagaaacctactttaagagccaggccgaatggcgtgaagaggttaaaaagcacttcgagaagataaagtccgagggcacttgcatacaccgactcgacgaggagctaatccgacgtcgtcgtgaagagctgagacatgctcttgatatccgagaacactacgagagaaaacttgaacgggccaataacctctacatggaactgagtgccataatgcttcaacttgagatgagagagaaagagctgatcaaacgggagcaggccgtggagaagaaataccccggcacttataagagacacccagtgcggcctattattcacccaaatgctatggaaaaactgatgaaacgaaagggcgtgccgcacaagtcgggcatgcaaacaaagcgtcctgacctccttcggtccgagggcatccccaccacagaagtagccccgacagctagccctctgtctggatctcctaagatgtctacaagctcatccaagtccaggtatagaagtaaaccgaggcaccggcgcggcaactccaggggctcgcactccgatttcgccgcgatcctgaagaatcagcccgctcaggagaattcaccacaccccacttacctccaccaggcacagagtcagtatcccagcctgcatcaccataacagcctccagcagcagtatcaacaacccccccccgctatgtctcagtctcaccacccaaggttaaacatgcacggacaggacatagccacatgcgccaacaaccttcggtacttcggccctgctgccgccctgcgatcccctctgtccaaccacgcacaacgccagctaccgggatcttcccctgacctgatctctacagctatggccgccgactgttggcggtcttccgagcccgacaagggacaggccggaccttggggctgttgccaggcagatgcctacgacccttgtctgcagtgccgtcccgaacagtatgggtcgcttgacatccccagcgctgagcccgtgggaagatctcccgacctttcaaaatctccagcccataatccccttttagaaaatgcacaatcatctgagaaaaccgaggaaaacgagttctccggatgcaggtctgagagtagtttgggtacctcacacctggggacccctccggcactgcccaggaagacccggcctctacagaaatcaggagacgatagtagcgaagaagaagaaggcgaagtggacagtgaggtcgaattcccacggcgtcagcggcctcaccgctgcatcagttcctgccaatcttactctacgttctcaagcgagaatttctctgtaagcgatggagaggaaggcaatacaagcgaccattccaacagccctgacgaactggcagataagctggaagatcgcctcgcggaaaagttggatgacctgctaagccagacaccagagatacccatcgacatcagcagccactccgatggactatcggataaggagtgcgcagtcaggcgggtgaagacccaaatgtccctgggtaaactgtgtgtagaagaacgaggctacgagaaccccatgcaatttgaggaatcagattgcgacagcagcgacggtgaatgctcagacgccacggttcgtaccaataagcactacagtagtgcaacgtggtag

SEQ ID NO: 124768 - DNA, 2280 bp, Artificial Sequence
  Description of Artificial Sequence: Synthetic coding sequence
atgtattgtggtattcagattctggcactctgggagcggggagtctgcacacaggctccatgctattgcataattatggaatactgtgcccacggccaattgtacgaagtcctcagggctggtcggaaaattacacctaggttactagtcgattggtccactggtatcgccagtgggatgaactacttacacctgcacaagattatccaccgtgatctgaagagcccaaacgtgctcgtaactcatacagacgcagtgaaaatcagtgacttcggcacttcaaaagagctgtccgacaaatctactaaaatgtccttcgcaggcacagtagcctggatggcacccgaggtcatcagaaatgagcccgtttctgaaaaggtcgacatttggtcattcggcgtggtgctgtgggagctcctcaccggagaaattccttacaaggatgtggatagctcagccatcatttggggagttggttctaatagtttgcatctgcccgtacctagcacctgtccagacggttttaagatcctaatgaaacagacctggcagagcaagccaaggaatcggccgagctttcgacagacccttatgcacctggacatcgcatccgccgatgtgctggccacaccccaggagacttatttcaagagccaagccgagtggcgcgaggaagtcaagaaacacttcgagaaaatcaaatcagagggtacctgcattcaccgattggacgaagagctgatcagaaggcgcagggaggagcttcggcacgccctggatattcgggaacactatgaacggaaactcgaacgtgccaataatttgtacatggagctaagtgcaattatgctccaactcgagatgagggaaaaggagcttatcaagcgcgaacaggcggtggagaaaaagtatccgggaacttacaaacgccaccccgttaggcctattatccacccaaacgccatggaaaagctaatgaagagaaaaggggtaccccataaaagcggaatgcagacaaagcggccggaccttctgcggagtgaggggatccctaccaccgaggtagcccctaccgcaagtccactgagcgggagccctaaaatgtccacgagttcatccaagagtaggtataggagcaaaccccgccaccgtcgtggcaactctagagggtcacattcagattttgcggctattctaaagaaccagccagcccaggaaaacagccctcaccccacctacctccatcaggcccagtctcaatatccctccctccaccaccacaactcactccaacagcaatatcaacagccaccgcccgctatgagccagtcccatcaccctcgcctgaatatgcatggccaggacatcgctacatgcgcaaacaatctgagatactttggccccgccgcagccctcaggagcccattgtctaatcatgcgcaacgccagctgcctgggtctagcccagatttgattagcacggcaatggctgccgactgttggcgaagttccgagccagataaagggcaagctggaccttggggttgttgccaggcagatgcttacgacccttgcctgcagtgtcgtcccgagcagtatgggtccctcgacataccttctgcggagcctgtaggacgctcccccgatctgtctaaatccccggctcacaatcccctgctagagaatgctcagtcgtccgagaaaacggaggaaaacgaatttagtggctgtcggagcgaatcctccttgggcacctcacatctgggcacacctcctgcactcccgaggaagactagacctctacagaaaagcggggatgacagttctgaagaagaagaaggagaagtggatagcgaagttgagttcccccgtaggcagcgtccccacaggtgtatttcctcttgccagtcatatagcaccttttcttctgagaacttttcggtctctgacggcgaggagggaaatacctctgaccatagcaatagcccagacgagttggcggacaaactcgaggaccggctcgcggagaaactcgacgatctgctgagccagacccccgagatccccatcgatatctcgtctcactctgatgggctcagcgacaaggagtgcgctgtgaggcgtgttaaaacacagatgagcctgggcaagctctgtgtggaagagaggggctatgagaaccccatgcagtttgaggaaagcgactgcgatagttccgatggggaatgttctgacgctaccgtccgcacaaataagcattatagcagtgccacttggtag

SEQ ID NO: 124769 - DNA, 2841 bp, Artificial Sequence
  Description of Artificial Sequence: Synthetic coding sequence
atggctgtcatggagatggcgtgccctggggcacctggatccgcggttggccaacaaaaggagctgcctaaagccaaggagaaaacacctcccctgggcaagaagcaatcctccgtctacaaactcgaagcagtggaaaagtctccagtgttctgtggcaagtgggagatattgaatgacgtgatcactaagggaactgcaaaagagggatctgaggcaggcccagccgctatttctatcatcgctcaggctgaatgtgaaaacagtcaggaattttctcctacatttagtgaaagaattttcatagccggatcaaagcagtattctcaaagcgaatccctggaccaaatccccaacaacgttgcacacgccaccgaaggcaaaatggctcgggtttgctggaaagggaaaagaagatctaaggcccggaaaaagaggaagaagaaatccagcaaaagcctggcccatgcaggcgttgcactggcaaaacctttgccaaggactccagaacaggagtcatgtaccatcccagtgcaggaggatgagtcgcctctgggggctccttatgttaggaatactccccagttcactaagccactgaaggagcctgggctcggtcaactgtgcttcaagcagctgggtgaaggcctgagggccttacctagaagtgagctgcacaaactgattagtccactgcagtgtctcaaccacgtttggaagcttcaccacccccaggatggcggtccactccctctgcccacccatccttttccatactctcgactgccccacccttttcctttccatcctctgcagccttggaagccccacccccttgaaagctttctgggaaagttggcatgtgtagatagccagaaacctctgcctgatccacacctctcaaagctggcctgtgtagactccccgaagccgctgcctggtccacatctggaaccatcatgcttgagccggggcgcccacgaaaagttcagtgtggaggaatacctggtccacgctctgcaggggagtgtgtccagcggccaagctcactccctcacctccctggccaaaacctgggccgcccgcggcagtagatcccgcgaaccttctcctaaaacagaggacaacgagggggtcttgctcacagaaaagctaaagccggtggactatgagtaccgcgaggaggtgcactgggcaacacaccaactgcgcctgggccgcggttccttcggcgaggttcataggatggaggataaacagacaggttttcagtgcgccgtaaagaaagtaaggctcgaagtgtttagggctgaggagttgatggcttgtgctggcctaacttctcccagaattgtaccgctgtatggcgcagtgcgcgaggggccatgggttaacatctttatggagctgctggaaggagggtctttgggccagctcgtcaaggagcaaggttgtctcccagaggatagagccctgtactatctgggccaggccctcgagggccttgaatacttacactcgagacgcattctgcacggcgatgtgaaagcagacaacgtgttgctatcaagcgacggctctcatgcggcactgtgtgattttggccacgctgtgtgcttgcagcccgacgggctggggaagtccctcttgacaggcgactacatacccggtaccgagacgcacatggcacccgaagtcgtgttaggccgttcatgtgatgcaaaggtggacgtatggtcctcatgctgcatgatgttgcatatgctgaacggctgtcatccttggacccagttcttcagaggtccactgtgtctgaagattgcttccgagccacctccagtgcgagagattcctcctagttgtgcacctctgacagcccaggccatccaggaaggactgcgtaaagagccaatacaccgggtgagcgcggcagaactgggaggcaaagtcaaccgggccttgcagcaagttggcggtctgaaaagcccttggagaggcgagtataaggaacccagacatccaccaccgaaccaggccaactaccaccagacacttcatgcccagccccgcgaattgagccctcgtgccccaggcccacgccccgccgaggagacaactggacgcgctcccaaattgcagccacccctgccaccagagccgcctgagccaaacaaatccccaccgctgaccctatccaaggaggagagtgggatgtgggagccattgcctttaagctctttagagcccgcgccagcaaggaatccttcttctccagagagaaaagccacagtacccgaacaggaactccagcaattggagatcgagttgttcctgaacagcctgtcgcaacccttctcactagaagagcaggagcagatactgtcgtgtctgagcattgatagtttgagtctgagcgatgactctgaaaagaacccgagtaaagcaagccagagctcccgcgataccctctctagcggcgtgcattcctggtcttcccaggctgaggccagatcctcctcttggaacatggtactcgccaggggacgtccgactgacaccccaagctacttcaacggggtcaaggtgcagatccagagcctgaacggagagcacttgcacatcagggagttccaccgcgtgaaggtcggcgatattgctacgggaatttccagtcagatcccagcagcagcctttagtctggtgactaaggacggccagcccgttcgttatgatatggaggtgccagactcaggaattgatctccagtgtaccctggctccagacggcagcttcgcgtggagctggagagtgaaacatggtcagcttgagaaccggccttag

SEQ ID NO: 124770 - DNA, 1302 bp, Artificial Sequence
  Description of Artificial Sequence: Synthetic coding sequence
tgcttcaagcaactgggagaaggattaagggcactgcctaggtcagagctccacaagctgattagtccactccaatgcctcaatcacgtatggaagctccaccacccacaggacggtggcccactgccgctgccgactcaccacccattcccatttcacccattgcaaccatggaagcctcatcccctcgaatcgttcctagggaagctggcatgcgttgattcccagaagccacttcccgatccacacttgtctaagctggcatgcgtggactccccaaagccactccccgggcctcatctggaaccgtcgtgtctgtcccgaggagcgcacgagaagttctcagtcgaagaatacttagtgcacgccttgcagggctccgtttccagcggccaggcacactcattaaccagcctagctaagacatgggctgcaaggggaagtcgcagccgagagccctctccaaaaacggaggacaacgaaggtgtcctcctcactgagaagctgaaacctgtagactacgaataccgcgaagaggttcattgggccacccatcagctgcgcctcggcaggggctcctttggagaggtacatcggatggaggataaacagacaggattccagtgtgctgtcaagaaagtgagactggaggtgtttcgggccgaggaacttatggcttgcgcgggcctgaccagtccacggatcgttcccctgtacggcgccgtgagggaaggtccatgggtcaatatcttcatggagcttctggaaggtggctcactagggcagctggtcaaagagcagggctgcctccccgaagatagggctctgtactatctcggccaggctctggagggactagagtatctccattctcggagaatactgcacggcgatgtcaaagcggataacgtgctgctctcctctgacggcagccacgccgccttgtgcgactttggacacgccgtgtgtctacagcctgacggactcggcaaatcacttctgaccggcgattacatacctggcaccgaaactcacatggcacccgaagttgtgctgggaaggtcctgtgatgccaaggtggatgtatggtcatcttgctgcatgatgctgcacatgctgaatggctgtcatccctggactcagttctttagagggccactttgtcttaaagtgggcgatggcacgcagcacgggcagcagggcgagctgcagggccctggcgctcaggccgccgggtggcggggctgctccgctgtggccgatggtgcccgagggggcctggtaattcacgtgggctcatag

SEQ ID NO: 124771 - DNA, 3942 bp, Artificial Sequence
  Description of Artificial Sequence: Synthetic coding sequence
atggagtcagggggtggaaacgctcccgcaggggccctgggcgcagcctcagagtccccccagtgcccaccacctccaggggttgaaggtgcagctgggccggcggagcctgacggcgcagctgagggagccgcaggcggaagcggagagggcgagagcggcggtgggcctcgacgcgcacttcgagcagtttacgtgaggtccgagtcttcacaaggaggggcggctggaggcccagaggccggggcccgacaatgcctcctgcgagcttgtgaggcggagggcgcccatctcacttccgtgccctttggcgagctggatttcggagagactgcagtgctcgacgccttctacgacgccgatgtggctgtggtggacatgagcgatgtgtctagacagccctctttgttttatcatctgggcgtccgtgagtcattcgacatggccaacaatgtgatattgtaccacgacactgatgctgatacagcactcagtcttaaggatatggtcacacagaagaatacagcttcatctggcaactattacttcatcccttacatcgtgaccccttgtgccgactacttctgctgcgagagcgatgcacaaagacgcgcatcagagtacatgcagcctaactgggataatatcctggggccactctgcatgcccctggtggatcgctttattagtctcctaaaggatatccatgtcacaagctgtgtgtactataaagaaacacttttgaacgatattcgcaaggccagagagaaataccaaggagaagaattggccaaagagttagctaggatcaaactgcggatggacaacacggaagtgttgaccagcgacataatcatcaacctacttctttcatatagggacatccaagactacgacgcaatggtgaaacttgtggaaactctcgaaatgcttcctacttgcgacctagcagatcagcacaatattaagtttcattacgcttttgcacttaatcgcagaaactctaccggcgacagagaaaaggctttgcaaatcatgctgcaagtgcttcagtcttgcgatcatcccggtccggacatgttttgcctctgtgggagaatttataaggatatctttctggactcggactgcaaggacgacactagccgcgatagcgcgattgagtggtatcggaaaggtttcgaattacagagcagcctgtattccggcattaacctagctgtgctgctgatagtggccgggcaacagttcgaaacatcactcgagcttcgcaagattggagtgcgtctgaactctctcctcggacggaaaggatcccttgaaaagatgaataactactgggacgtgggccaattcttcagtgtgtcaatgttggctcacgatgttgggaaggcagtgcaggcagccgaacggttgttcaaactcaagcctccagtctggtacctgcggtcactggtgcagaatctgcttctcattcggcgtttcaagaaaaccatcatagagcatagcccaaggcaggaaagactgaatttttggcttgacattatctttgaggctactaatgaggtgaccaacggactgcgtttccccgtgcttgtgatagaacctaccaaagtctatcagccatcatatgtttccattaataatgaggctgaggagaggacagtcagcctctggcacgtttcgccaacggaaatgaagcaaatgcacgagtggaactttactgcttctagcatcaagggcataagcttgtcaaaattcgatgagcgctgctgcttcctctatgtccatgacaacagtgatgacttccaaatttatttctctacagaggagcagtgcagccgattcttttcactggttaaagagatgatcactaacacagcgggatctactgtagagctggagggcgagactgatggcgacaccctggagtacgagtacgaccacgatgcaaatggtgaaagggtggtcctgggtaaaggcacatatgggatcgtgtacgccggacgcgacctctctaatcaggtacgaattgctatcaaggagattcccgaaagggactctcggtattcccagcctctacatgaggagatcgctctgcacaagtatctgaaacaccgaaatattgtgcagtaccttggtagtgtgtcagaaaatggatatattaaaatctttatggaacaagtgcccggtggttcactgtctgctttgcttagatctaaatggggccctatgaaggagccaacaattaaattctacaccaaacagatcctggaaggcctcaagtatctgcacgaaaaccagatagtgcaccgtgacatcaagggggataacgtgctggtgaatacttattcgggcgtagtgaaaatatcagactttggcacaagcaagcggctggcaggtgtaaatccctgtacggagacatttaccggaactttacaatacatggccccggaaataatcgaccagggaccccgcggctacggagcaccagcagatatctggtccctgggatgcactatcatcgaaatggccacgtccaagccacccttccatgagctcggagaaccacaggctgccatgttcaaggtgggcatgtttaagatccaccctgaaatccctgaggccttatcggcagaagcaagagctttcatcctctcgtgcttcgagcctgaccctcacaagcgtgctactaccgccgaactgctccgcgagggtttccttaggcaggttaacaagggtaagaaaaatcgaatcgcgtttaagcccagcgagggccctaggggggtcgtgctcgccctccccactcagggggaacccatggctacttccagttcagagcatggttccgtctccccagatagcgacgctcagccagacgcactgtttgaacgtacccgtgccccaaggcaccacctaggccatttactctcagtcccagatgagtcttcggcattggaagacaggggactggcctcaagtcccgaagatagggaccagggtttgtttctgcttcggaaggacagtgagagaagggcgattctgtataaaatcctctgggaagagcagaatcaggtcgcctctaacctccaggaatgtgtggcgcagtccagcgaagagctacaccttagtgttggccacatcaagcagattattggtatcttgcgggatttcattcgaagcccggaacatcgcgttatggcgactacaatttctaaactaaaggtggacttagacttcgacagcagtagcatctctcaaattcaccttgttctcttcggattccaggatgcagtcaacaaaatcctgcgcaatcacctcattcgcccccactggatgttcgccatggacaacataatccgacgggccgtccaggccgccgtaaccatactgatccccgagctgcgggcccactttgagcctacatgtgaaacagaaggagtggacaaagatatggacgaagccgaggagggttacccccccgccaccgggcctggccaagaagcgcagccccaccagcagcatctctctctgcagctcggcgaactccggcaggagacaaatcggctgttggagcacctggtggagaaggagagagagtaccagaacctgttacgtcagaccctcgagcaaaagacccaagaactctatcatctgcaattgaagttgaagtctaattgtatcacagagaacccggccggaccatatggccagcgcactgacaaagagctgatcgactggctgaggctccagggggctgacgccaaaacgattgaaaagattgtggaggaaggctacacactgtctgatatcttgaatgagatcaccaaagaggacttacggtaccttcgattgcgcggaggtctgttgtgccgcctgtggagcgctgtgtcacagtaccgtcgcgcacaggaagccagtgaaacaaaagataaggcctag

SEQ ID NO: 124772 - DNA, 4677 bp, Artificial Sequence
  Description of Artificial Sequence: Synthetic coding sequence
atgagagaggcagctgccgccttggtgcccccacccgccttcgctgtcaccccagctgccgctatggaggagccccccccacctccccccccccccccccctcctcccgagccagaaaccgagtccgagccggaatgttgcctcgctgcgcgccaagagggcacgctgggggattctgcttgcaagtcacctgaaagcgatctggaggacttctccgacgaaactaatacagagaatctttacggaacttccccaccttcaacccccaggcagatgaagcggatgagcactaagcatcagcggaacaacgtcgggcggccagcttcaaggagtaatctgaaggagaagatgaatgctccaaatcagcctccgcacaaagacacagggaagaccgtagaaaacgtggaggagtacagctataagcaagagaaaaagatccgagctgccctgagaactaccgagcgtgatagaaagaaaaatgtgcagtgctctttcatgttggattccgtgggagggtctctcccaaagaaatcaatacctgatgtggatctgaacaagccgtatttatcgctgggctgctccaatgccaagctccccgtcagcgttcccatgccaatcgcacggcccgctaggcagacaagccggacagactgccccgcagaccgcctcaaattcttcgagactctgcggctacttctgaagctaacttctgtgagcaaaaagaaggacagagagcagagaggtcaggaaaacactagtggattttggcttaacaggtcaaatgagttgatatggctcgaactgcaagcttggcacgcaggccgaactatcaatgatcaggacttttttttatacacagccagacaagccatccctgacattatcaacgaaatcctcaccttcaaggtagactacggatcttttgcctttgtccgagatagggcaggctttaacggcactagcgtagagggccagtgtaaagccactcccgggactaaaatcgtgggttacagcacacaccacgagcacttgcagcgacagagggtgagctttgagcaggtgaaacggattatggagctgcttgagtacattgaggcgctgtacccttcactgcaggcccttcagaaggactatgagaagtacgcagctaaggactttcaggatcgcgtccaggccctgtgtctgtggctgaatattacaaaggatttgaatcagaaactccgcatcatggggacggtgctgggtattaagaacctgagtgacatcgggtggcccgtcttcgaaatcccttcacccagacccagcaaagggaatgagccagaatacgagggtgacgacacagagggggagctcaaggagctggaaagtagcacggatgaatccgaagaagagcagatcagcgatccccgcgtgcctgagatccgccagccgatcgataactccttcgacatccagagccgggactgtatctccaagaagttagaaagacttgagtccgaagacgacagcttgggatggggtgctcctgactggagtaccgaggcaggattttctcggcactgtttgacaagtatctaccggccattcgttgacaaagccctgaagcaaatggggcttaggaaactcattctgaggctgcacaaacttatggacggctcactgcagagagctcgcatcgctcttgtgaagaacgataggccagtggagttttctgagtttccggaccctatgtggggtagcgattacgttcagctgtctcgcacccctccatcctccgaggagaagtgcagcgcagtgtcctgggaagagctgaaagctatggacttgcctagctttgaaccggcttttctcgtgctgtgtcgggtgctcttaaacgtgatccacgagtgcctgaaactgcgtctggagcagcgccctgctggtgagccatctttgcttagtatcaagcaactggtgcgggagtgcaaagaagtcttgaaaggcggcctgcttatgaagcagtactatcaattcatgctacaagaagtgctggaggacctcgagaagccagattgtaatatcgatgccttcgaggaagatcttcacaagatgcttatggtatacttcgactacatgcgttcctggattcagatgcttcagcagttaccccaggcctcccacagcctgaaaaacctacttgaggaggaatggaatttcacgaaagagatcacacattatatccggggcggcgaggctcaggctgggaagctgttttgcgacattgcaggaatgctactgaaatccacagggtctttcctggaattcggtctccaggagtcatgtgccgagttctggactagcgctgatgattcatctgcctctgatgagattcggcgctcagtgattgagatttcacgtgctctgaaggagctttttcacgaggcaagagaaagagcatctaaagcactgggctttgctaaaatgttaagaaaggacctagagattgctgcggaattcaggctctctgctcctgtaagggatctgctagatgtgctcaagtcaaaacagtacgttaaggtccagatcccggggctcgagaatcttcagatgttcgtgcccgacacactggccgaggaaaaatcgatcatcctccagctattgaacgccgcagcaggaaaggattgttctaaagacagcgatgatgtgttgatagatgcctatctcctcctgacgaaacatggagaccgagcccgagatagcgaggatagctgggggacttgggaggcccagcctgtcaaggtcgtgcctcaggtggaaacagtagacactctcagatcaatgcaagtggataacctactgctggttgtgatgcagtctgcccacttgacaatccagcggaaagcgttccagcagtctattgaaggccttatgactttgtgccaggagcagacttcctcacaacccgtcattgccaaggccttgcaacagctgaagaacgatgcactagaactgtgcaacaggattagcaacgccattgatcgtgtcgatcatatgtttactagcgagttcgatgcagaggtggatgagtcagagtccgtcaccctacagcagtactacagggaagccatgatacaaggctataactttggcttcgaatatcataaagaagtcgtgaggctaatgagtggcgagttcagacagaaaattggagataagtacatctcattcgcccggaagtggatgaactacgttttgaccaagtgtgagagcgggcgggggaccaggccccgatgggcaacccaaggcttcgatttcctacaggccatcgagccggcgtttatctcagccctacctgaagacgactttctgtctctgcaggccttgatgaacgagtgcatcggccacgtaattggaaagccacactctcctgtgacaggactttacctcgcaattcacagaaattcccctagaccaatgaaagtccctagatgtcattctgatccccccaatcctcatctgatcatccccacccctgagggattcagaggatcatccgtgccagaaaatgaccgactggcctcaatcgccgccgagctccagtttaggtcactgtcaagacactcctcacctaccgaggagagagacgagccggcctacccccgcggcgactcctccgggtctacgagaagatcttgggagctcagaactctcattagtcagagcaaagacactgctagtaaactcggtcctatcgaagccattcagaagagtgtgaggctcttcgaggagaaacgctaccgcgagatgcgccgtaaaaatatcattgggcaggtttgcgataccccaaagagctatgacaacgtgatgcatgttggccttaggaaggtgaccttcaaatggcaacgcggcaacaaaatcggtgagggacagtatgggaaggtgtacacgtgtatctcggttgacaccggggaactgatggcaatgaaggagatcaggtttcagcctaatgaccacaagactatcaaggagaccgcagacgaactcaaaattttcgagggcatcaagcacccgaatttagtgaggtattttggtgtggagctccatcgggaggaaatgtacattttcatggagtattgcgatgaaggaacgctggaggaggtgtcccggctgggactgcaagaacacgtgatcaggctctacagtaagcagattacaattgccataaacgttttacacgaacatggcatcgttcaccgagacattaaaggggccaacatatttctcactagctccggcctgatcaaattgggagatttcggttgttcggttaagctgaaaaacaacgcccagactatgccaggcgaagtcaactctactcttggaaccgcagcatatatggctccggaagtaatcactagggccaagggcgagggacacggtagagctgcagacatctggtctctgggctgcgtggtaatcgagatggtgaccggtaagcggccctggcacgaatatgaacataatttccagatcatgtacaaagtgggcatgggacacaagccacctataccagagaggttgagcccagaaggaaaagattttctgagtcactgcctcgagagcgatccaaagatgaggtggactgcctctcagttactggatcacagttttgtcaaggtctgcacagacgaggaatag

SEQ ID NO: 124773 - DNA, 4827 bp, Artificial Sequence
  Description of Artificial Sequence: Synthetic coding sequence
atgcgcgaggctgccgcggctctggtgcctcctcccgccttcgctgtgacccccgcggccgcaatggaggagcccccccctccgcccccaccccccccccctccaccggagcctgagacagagtccgaacctgagtgctgtctggctgcccgccaagaagggacactcggcgactctgcatgcaaatcccctgagtctgaccttgaagacttcagtgacgaaactaatacggagaacttgtatggcacttctccaccctcgacaccacgccagatgaagcgcatgagcacgaaacaccagagaaataacgttggccggccagcttccagatctaacctcaaggagaagatgaacgcgccgaatcaacccccacacaaagataccggcaaaacagtggaaaacgttgaagagtacagctacaagcaagaaaagaaaattagggctgctctgcggaccacagaacgtgatcggaaaaagaacgttcagtgcagttttatgctggattcagttgggggctccctgcccaaaaaatcaatccccgacgtcgatctgaataaaccttacttatcattaggctgctctaatgccaagctgcctgtgagcgtgcctatgccaatcgctcgccccgctagacagacttcccgcacagactgtcctgccgacagattaaagtttttcgaaacccttagacttctgttgaagctcacctctgttagcaagaaaaaagaccgcgagcagcgtgggcaggagaacacaagtggcttttggctgaatcgatctaatgagctcatctggctggagttacaggcttggcatgcaggacgcacaatcaatgaccaggacttcttcctctatactgcccgacaggcaattccggacattattaatgagatactcacttttaaagtcgattacgggtcatttgcctttgtgagagaccgggcaggcttcaacgggacttctgtggaaggtcagtgtaaggcaacgcctggaaccaagattgtaggctacagtacgcatcacgaacacttacagaggcagagggtaagttttgaacaagtgaagaggatcatggagctcctagagtacatcgaagccctatacccgtctttgcaagcccttcaaaaagactacgagaaatatgcggccaaggactttcaggaccgcgttcaggccctttgtttgtggttaaacattacaaaggacctcaaccaaaaactgaggattatggggacggtcctcggaataaaaaatttatctgacataggttggccagtgttcgagattccaagtccgaggcctagtaaaggcaatgagcctgaatacgagggcgacgatacggagggcgagctcaaggagcttgaatcatccactgatgaaagtgaggaggagcagatctcggaccctcgtgtgcccgaaattagacagccaatagataattctttcgatattcagtccagggattgtatctccaagaagctcgagaggctggaatctgaggacgactctctgggttggggcgcgcccgactggtctaccgaagctgggtttagcaggcattgtttaacgtcaatctacagaccttttgtggataaggccctgaaacagatgggcctgagaaagctgattctgcggctccacaaattgatggatggctccctgcaaagagctcggatcgctctcgtgaagaacgataggcccgtcgagttctcagaatttcctgatcctatgtgggggagcgattacgttcagctgagcaggactcccccctcttctgaagagaaatgttccgcagtatcttgggaagaactgaaggccatggaccttccctcattcgagccagccttcctggtactgtgcagagtgctcctgaacgtaatacacgagtgccttaaattgaggctggagcaaagacccgcgggagaacctagcctcctgagcattaaacagttggttcgagaatgtaaagaagtgctgaagggcggcctgctgatgaagcaatactatcagtttatgcttcaagaggtcctcgaagatttggaaaagccagattgcaatatagacgcattcgaagaagatttacataaaatgctgatggtgtattttgattacatgaggtcttggatccaaatgcttcagcagctccctcaggcctctcactcgttgaagaacctcctcgaggaggaatggaattttaccaaagagattacccactatattaggggtggcgaggcccaagctgggaagctgttctgtgacattgcaggtatgctgttgaaatccactggcagcttcctggagttcggattgcaggaaagttgcgcagagttctggacctcagccgacgactcatcagcctctgatgaaatccgaagatccgtgatagaaattagtcgggccctgaaggaactgttccatgaggcacgagaacgtgccagcaaagccctggggttcgcgaagatgctgcggaaagacctggagatcgcggctgaattcagactgtctgcaccggtacgggacctcctggacgtattgaagagcaagcagtacgttaaggtccaaattcccggattggagaacctgcagatgtttgttcccgacacgctggccgaggagaagtccattatactgcagttactgaacgcagccgctgggaaggattgctccaaggattccgatgacgtattgatagatgcatacctgctgctgaccaagcatggggatcgtgctagagactcagaggactcctggggcacttgggaagctcagcctgtcaaggtggtgccacaggtcgagacggtcgatacactgcgaagtatgcaggttgacaatttactgctggtcgtaatgcagtccgcccatctcaccatccagcgcaaagcctttcagcagtcaattgaagggctgatgacattgtgtcaggagcaaacctctagccagcctgtaatcgcaaaggcactgcaacagttgaagaatgacgccctggagctgtgcaatcgtattagcaatgctatcgatcgcgtcgaccatatgttcacttctgaattcgacgcagaagtagacgagagtgaaagtgtcactctgcaacaatattatcgagaagcaatgattcagggttataattttgggttcgagtaccacaaagaagtcgtgaggcttatgagcggggagttccgccagaagatcggcgacaagtatataagctttgcacgcaaatggatgaattacgtgcttactaaatgtgagtcaggacgggggacacgcccccggtgggccactcaaggattcgacttcttgcaggccatcgagcccgcctttattagtgccctccctgaggacgattttctttctctacaagccttgatgaatgaatgtatcggacatgtcatcggtaaaccccattcccccgtcactggtctgtatctcgccatccataggaatagtccgagacctatgaaagtcccgcgttgccactccgatcctccaaaccctcaccttattatccctacccccgagggtttttctacacgctccatgccaagtgatgccagaagccacggcagcccagccgccgctgcagctgccgctgcagcagccgtagctgccagcagaccatcaccctccggtggagatagtgtcttacccaagagcatctcatccgcgcacgacaccaggggctctagcgtcccggagaacgaccggttggcaagtatcgctgctgagctccagttccgctccctgtctcgtcactcctcaccgacagaagagcgcgacgaaccagcatacccacgcggggactcaagtggcagtacacggcgttcatgggagttgagaacccttattagtcaaagcaaggacactgcatctaagctaggccccatagaagccatacaaaagagcgtacggcttttcgaagagaagagataccgcgagatgaggcgaaaaaatatcatcgggcaggtttgtgataccccaaagtcctacgataacgtgatgcatgtgggcttgaggaaggtgaccttcaagtggcagcgcggaaacaagattggggagggccagtacggaaaagtttacacctgcatatcagtcgacactggggagttgatggctatgaaagagattaggttccagccaaatgaccataagaccataaaggagactgccgacgagctcaaaatatttgaaggcatcaaacaccctaacctggttcggtatttcggcgttgaactgcaccgggaggaaatgtacatcttcatggagtattgcgacgagggaacactggaggaggtgtccaggctaggcctgcaggagcacgtgattaggctgtacagcaaacagatcacaattgctatcaacgtgttgcatgaacacggcattgtgcaccgcgacatcaaaggagccaatatcttcctcacatcctcaggcctgatcaagctaggggacttcgggtgctcagttaaattaaagaataacgcacagaccatgcctggagaagttaattcaactctcgggacagctgcctacatggccccagaggtgataacccgcgcaaaaggggagggccacggccgggccgccgatatttggagcttaggatgcgtggtgatagaaatggtgaccgggaagcgtccctggcacgagtatgaacacaacttccaaataatgtacaaggtagggatgggccataagcccccgatccctgagaggttatcccctgaaggcaaagatttcctctcacattgtctcgagtccgacccgaagatgcgatggaccgcttctcagctgttagaccactcattcgtgaaggtctgcaccgatgaggaatag

SEQ ID NO: 124774 - DNA, 4497 bp, Artificial Sequence
  Description of Artificial Sequence: Synthetic coding sequence
atgcgtgaggctgctgcagccctggtgccacctccagcttttgctgtgacccctgctgctgccatggaggaaccccctccccctcctcctccacccccacctccccctgagccagaaaccgaatccgagcccgagtgctgtctggcagcccgccaggagggaactttgggggattcagcttgcaaatcgccggaatcggacctggaggattttagtgatgagactaacaccgaaaatctttacgggacctcccctccctctacacctcgccagatgaagcgcatgtccactaaacatcagcggaacaatgtgggtcggcccgccagcaggagcaacttgaaggagaaaatgaatgcacccaaccagcctccacacaaggataccggaaaaactgttgaaaatgtggaagagtattcttacaaacaggagaagaaaatccgcgccgcccttagaacaacagaaagggataggaaaaaaaacgtccagtgctcgtttatgctggattccgtcggaggttcactgcccaagaagtctattcccgatgtcgacttaaacaagccatacctgtcattaggatgttcaaacgccaagttacctgtcagcgtcccaatgcctattgcgagacccgcacgtcagacttctagaacggactgtccagcagacaggttaaagttctttgagaccctacgtctcctactaaaactgaccagcgtctctaaaaaaaaggaccgagagcagcggggtcaggaaaacacctccggcttttggctgaataggtccaacgaattgatctggctcgagctgcaagcatggcacgctggacgcactatcaacgaccaggactttttcctgtacaccgcaagacaggctatcccagacatcataaatgagatactgacgtttaaggtggactacgggagttttgccttcgtgcgagatcgggctggatttaatggaacaagcgtagagggacagtgcaaggctacacccggcacaaaaattgtaggatactccacacatcacgagcatctgcagcggcagcgggtgagcttcgagcaggttaaaaggatcatggagctgctagagtacatagaagcgctctacccgtctctgcaggcactgcagaaagattatgagaagtacgccgccaaagatttccaggatagggtacaggcactgtgtttatggctaaacattacaaaggacctgaaccagaagctgcggataatgggaacggtgctgggcataaaaaacctgagtgatattgggtggccggtgttcgaaataccctctcctcggcccagcaaggggaatgagcctgagtacgagggggacgacaccgagggagagctgaaggaactggagtctagcactgacgaaagcgaagaagaacagatctccgatcctcgcgtgcccgaaataaggcagcccatcgacaacagcttcgatattcagagtcgcgattgtatttccaagaagcttgagaggctggagagtgaagatgactccctgggttggggggcacctgactggagcacagaggctggcttttctagacactgcctaacatccatctacaggcctttcgttgataaggccctgaagcagatgggactgcgcaaactgatcctccgtctgcacaagctgatggacggcagcctccaaagagcccgcattgctctcgtgaaaaatgatagacccgttgaattctccgagttcccggacccaatgtggggatctgactatgtccagctatctaggactccacccagcagtgaggaaaaatgttcagccgtttcctgggaggagctaaaggctatggaccttcctagcttcgagccggccttcctcgtgctctgccgcgtgctgctgaacgttattcacgagtgcctaaaattgcgcctggagcagagacctgctggcgaacccagcctactgagcatcaaacagctggtgcgggagtgcaaagaagtgctgaagggcggccttcttatgaaacagtactatcagtttatgctgcaggaggtgttggaggacctcgaaaagccagactgcaacatagacgcgttcgaagaagacctgcacaagatgctgatggtttacttcgattatatgcgctcctggatccagatgctacagcagctgccacaggcaagtcactcactaaaaaacttgcttgaagaagagtggaatttcaccaaagagattacacattacattagagggggcgaagcacaagccggaaagcttttttgtgacatcgccggcatgcttctaaagtccacaggaagtttcctcgaatttggccttcaggaaagctgtgcagaattttggacatccgcagacgactctagtgcatcggatgagattagacggtccgtgatagaaatttcccgtgccctgaaagagttatttcatgaggcaagggagcgggctagtaaagccctggggttcgctaagatgcttaggaaggacctcgagatcgccgcggagtttagactctcagctccagttcgagatctgctcgacgtgctgaaaagtaaacagtatgtgaaagtgcagatcccaggattggaaaatttacagatgttcgtgcctgatactctggcagaggaaaaaagcatcatactgcagctgttaaacgccgctgcggggaaggactgctccaaggactcagacgatgttctaattgacgcttatctgctgttaaccaagcacggcgaccgggccagggacagcgaggactcctggggcacatgggaggctcaacctgtgaaagtcgtacctcaggtggaaacagtggacacgctccgaagcatgcaggtcgacaatctattgcttgtggtgatgcagtccgcccacctgactattcagcggaaggcatttcagcagtctattgaggggctcatgacgctgtgtcaagagcaaacatcttcccagcctgtcattgctaaagccctgcaacagctgaagaatgatgcccttgagctgtgtaaccggattagcaacgccattgaccgcgtggatcatatgttcacctccgaattcgatgcagaagtcgatgagagtgaaagtgtcactctgcagcagtattaccgggaggctatgatccagggttacaatttcgggtttgaataccacaaggaggtcgttcggcttatgagtggcgagttccggcagaagataggcgataagtatatctcctttgcccgcaagtggatgaattacgtcctgaccaagtgtgagtctggacgcggcacgcgacctcgctgggctactcagggttttgattttctacaggctatagaacctgcctttatatcagccttgcctgaggacgacttcctgtctctgcaggcactcatgaatgagtgcatcggacacgttatcggcaagccacacagccccgttacaggcttatatctggcaatacatagaaactcaccacgaccaatgaaagtccctcgatgtcattccgatcctccaaacccgcacttaatcattcccactcctgagggtttccgcggaagctccgtccccgaaaatgacagacttgcctctatcgctgcggagctgcagtttcgcagcctaagccggcactcttctccgactgaagagcgggacgagcctgcttacccacgcggcgatagtagtggatccacacggaggagctgggagctgcgcactttgatcagccagtcaaaggataccgcttcaaagctgggccctatcgaagcgatccagaagagtgtccggttattcgaggaaaaaagatacagagaaatgagacgcaagaatattataggacaggtgtgcgataccccaaagtcttacgataacgtcatgcacgtaggattaagaaaggtgacctttaaatggcagaggggtaataaaatcggagaaggacagtacggaaaagtctacacttgcatttctgtggataccggggaactgatggccatgaaagagataagatttcaacccaatgatcataaaaccattaaagagacagccgatgagctgaagatctttgaggggataaaacaccccaacctggttcgatattttggtgtcgagcttcacagagaagagatgtacatcttcatggaatactgtgatgagggtactctggaggaagtgagtaggctgggtttacaggaacacgtgatccggctttacagtaagcagatcaccatcgctatcaatgtactccacgagcatgggatagtgcacagggacatcaagggtgccaacatttttcttaccagcagcggcctgatcaagctgggtgactttgggtgtagcgttaagttgaaaaacaacgcccagacaatgcccggcgaggttaactccaccctggggactgctgcctacatggcccctgaagtgataactcgcgcaaagggagagggacatggccgagccgccgacatctggtccctgggatgcgtcgtgattgagatggttacaggaaaaatctgcaaggacaccgaatag

SEQ ID NO: 124775 - DNA, 324 bp, Artificial Sequence
  Description of Artificial Sequence: Synthetic coding sequence
atggaagagcctcccccgccaccacccccaccacctcccccaccggagccagagactgaaagtgaacctgagtgctgcctggctgccagacaggaagggacactgggggacagtgcctgtaagtcacctgagagcgacttagaggatttctccgacgagacgaacaccgagaacctttacggtacctcaccaccgtccactccaagacagatgaaaagaatgtcgacgaagcaccaaagaaataacgtgggtcgacccgccagtcgtagtaatttgaaaggtgtccggcagatttctcatgctgtttcttcttctctcaattag

SEQ ID NO: 124776 - DNA, 1866 bp, Artificial Sequence
  Description of Artificial Sequence: Synthetic coding sequence
atggaacaggtacccggcgggtcactgtccgcgcttctgcgctccaaatgggggccattgaaagataatgagcagactatcggcttttacaccaaacagatcctggagggattgaaatatctgcacgataatcagatcgtgcaccgagacatcaagggcgataacgtgctcatcaatacctatagcggagtcctaaagatcagcgacttcgggacatcaaagagactcgcaggaataaatccatgtaccgagactttcaccggaaccctgcagtacatggctcccgagatcatcgataaggggcctcggggctatgggaaggccgccgatatctggtcattaggttgtaccatcatcgagatggccacaggaaagccccccttttacgagctgggggagccccaggctgctatgttcaaagtcgggatgtttaaggtgcaccccgaaattcccgagtccatgtccgctgaggcaaaagccttcatccttaagtgttttgaaccagaccccgataaacgggcatgcgcaaacgatctgctggtcgatgagtttctcaaggtaagttctaagaaaaagaagactcaacccaagctgtcagccctgtcagctggcagtaatgaatatctgagaagcatcagcttgccggtgcctgtgctcgttgaggatacctcttcatccagcgagtacggctccgtctcacctgacaccgagctgaaggtcgaccccttcagtttcaagacgagagccaagagctgcggcgaaagggacgtcaaaggtattaggactctgttcctggggatccctgacgagaatttcgaagatcattctgcacctccctcccccgaagagaaagattccggcttctttatgctcagaaaagattccgagaggcgggctacactgcacagaatcctgactgaagatcaggacaaaattgtgagaaatctgatggagtctctcgctcagggagctgaagagccaaagctcaaatgggagcacatcacgaccctgatcgcctccctgagagaattcgtcagatcaaccgaccgaaagattatcgccaccaccctgtctaaactgaagctggagctggatttcgactctcatggaatttcccaagtgcaggtcgtgttattcgggttccaggatgctgtcaacaaagttctgcggaatcataacatcaaaccacactggatgtttgccctggactcaattatccgtaaagcagtgcagacggcgatcacaattctggttccagagctccgcccgcatttctctttagcctccgagagcgacactgccgatcaggaagacctagacgtggaagatgatcatgaggagcagccgagcaatcagaccgtgagacgcccccaggctgtgatcgaggatgctgtcgccacttctggcgttagcactctatctagcactgtgtcccacgattcacagtccgcccaccggagcctcaacgttcagttgggccgaatgaaaattgagactaatagactgctcgaggagctggttcggaaagaaaaggaattgcaggcgcttctgcatagggcgattgaggaaaaggaccaagagattaagcatctaaaactcaaatctcagcccatcgagatacctgagctgcccgtatttcaccttaactccagcggtacaaatacggaggacagcgagcttactgattggctcagagttaacggcgcggatgaggacaccatctctcggtttttggcggaagattatacgctgctggatgtcctatactacgtcacccgggacgacctgaaatgcctgcgccttcggggtggcatgttgtgtacactctggaaggctataatcgacttcaggaacaagcagacctag

SEQ ID NO: 124777 - DNA, 4125 bp, Artificial Sequence
  Description of Artificial Sequence: Synthetic coding sequence
atgagcaccgaagctgatgaggggattactttcagcgtgccacctttcgcaccgtccgggttctgcacgatacctgagggcggtatatgtaggcgaggtggagctgcagccgtaggcgagggggaagagcatcagctcccgccccctcctccagggtccttttggaacgtcgaaagcgctgctgcacccggcatcggatgtcccgctgccactagcagtagcagtgcaactcgggggcggggaagttctgtgggtggcgggagccgaagaaccaccgtcgcttacgtaatcaatgaggcctcgcaaggccagctggtagtggcagaatctgaggcattgcagagcctgcgcgaggcctgcgagacagtgggcgccacactggaaaccttgcattttggaaagctggattttggagaaacaaccgtgctggacaggttttacaatgccgacatcgccgtcgttgagatgagcgacgccttcagacagccctcattattctaccacctaggcgtcagagaatcattttcaatggctaacaacatcatattgtactgtgacaccaactctgactcactgcagagtcttaaggaaatcatatgccagaagaatacaatgtgcactgggaattacactttcgtgccttatatgattacaccacacaataaagtgtattgttgtgatagttcttttatgaaggggctgaccgagctcatgcaaccaaacttcgagctgctcctagggcctatatgtcttccactggtggacaggttcatccagttattaaaggtggcacaggcgtcatctagtcagtactttcgagagagcatcttaaatgacatccgcaaagcacgaaacttatatacaggcaaagaactggctgccgagctagcgaggatccggcagagggtagataacattgaggtgcttactgcggatatagtaattaatctccttttgtcttaccgtgacatccaagactacgattcgatcgtcaagctcgtggaaaccttagaaaagcttccaaccttcgatctggccagccaccatcacgtgaaatttcattatgcatttgcgctgaaccgacgtaatctccctggtgatcgggccaaagcattagatatcatgattcccatggttcaaagcgaggggcaagttgcttccgacatgtattgcctggtcggacgaatatacaaggatatgttcttggacagtaattttaccgacaccgagtcacgggaccatggggcttcatggtttaagaaggcgttcgagtcagagcccacactgcaatccggaattaactatgcagtactgttgcttgccgcgggacaccaattcgagtctagcttcgagcttcgaaaggtcggcgtgaagctttcctccctactgggtaaaaaaggcaacctagagaagctacagtcctactgggaggtcgggttctttcttggagcttcggtgttggccaatgaccatatgcgggttatacaagcctctgaaaagctgttcaagctgaaaacacctgcttggtacctgaagagtatcgtggagacgattttgatctacaagcactttgtaaagttgactactgaacagcccgttgccaaacaggaactcgttgacttttggatggattttttagtggaagccaccaaaaccgatgtgacggtagtcagattccctgtgctgatcctggagcctactaagatctaccagccatcttacctttctatcaacaatgaggtggaggagaagactatttcgatctggcatgttctccccgatgacaaaaaaggcattcacgaatggaacttcagtgccagtagcgtcagaggagtgtcaatttccaagtttgaagagcgctgttgcttcctctatgttctgcataactccgacgactttcagatctacttctgtaccgaattgcactgcaagaaattttttgaaatggttaatacaattacagaggaaaagggtaggagcacagaagaaggcgattgcgagtccgatcttttagagtacgattacgagtatgatgaaaatggagatcgggtagtcctgggtaagggcacctatggaatagtgtacgccggcagagacctgtctaaccaggtgagaatcgcaattaaggagatccccgagcgtgattcccgctactcccaacctctgcacgaggagattgctcttcacaagcacctgaagcataaaaatatagttcagtacctgggcagcttctccgaaaacgggtttataaaaatcttcatggagcaggtgcccgggggctccctttctgccctgttaagaagcaagtgggggcccctaaaggacaatgagcagaccattggattttataccaagcagatcttggagggcctgaagtaccttcacgacaatcagatcgttcacagggacattaagggagacaacgtcctgataaatacttactccggcgtgctcaagattagcgatttcggtacctcaaaacgcctcgctggcatcaatccctgcaccgagacctttaccggtacactccaatacatggcccccgaaattatcgataaggggccgagagggtacggaaaagcagcggatatatggtcactgggctgcactattatcgaaatggctaccggcaaacctcccttctacgagcttggtgagcctcaagccgctatgttcaaggttgggatgttcaaggtacacccggaaatccccgaaagcatgtctgctgaagccaaggcctttatccttaaatgttttgaaccagacccagataagcgggcgtgtgctaacgatctcctcgtggatgagtttctgaaagttagctctaaaaagaagaaaacacagcccaaactgtcggctctgtcagctgggtccaacgagtatctgcgatctatcagccttcctgtgcccgtcttagtcgaggatacatcatcttcttctgagtacggcagcgtatctcctgacactgagctaaaagtggacccctttagtttcaaaacaagagcgaagtcttgcggcgagagggacgttaaaggaatccggacactgttccttggcattcccgatgagaatttcgaggaccactccgctccaccctcgccagaagagaaggatagtggctttttcatgttgcgaaaggacagcgaacgccgcgcaaccctgcaccggattctgacagaggatcaggacaagatcgtcagaaacctgatggaatccttggctcagggggccgaagagccaaagctcaagtgggagcatattacaactcttatcgccagcctgcgcgagtttgttaggtccaccgaccggaagatcattgctacaaccttatctaagctgaagttggaactggattttgattcccatgggatcagccaggtgcaagtggtcctgtttgggttccaagatgccgtcaacaaggtgttgagaaatcataatattaagccacactggatgttcgccctggacagtattattagaaaagcagtgcagaccgcgattaccatcctggtgccagaactccgtcctcacttttccttagcttccgagagcgatactgcggaccaggaggacctcgacgtggaagacgatcacgaggagcagccaagtaaccaaaccgttcgcagaccccaagctgtgatcgaggacgccgtcgccacgtcaggagtttctaccctgtcctcaacggtttcccacgatagccagagtgcacacagatcactgaacgtccaactcgggcgaatgaagattgagactaatcggctgctagaggagctggtgaggaaagagaaagagctgcaggctctcctgcacagggctatagaagaaaaagatcaagaaatcaaacatttgaaactcaagtctcagcctatcgaaatacctgaactcccagtttttcatctgaactcctcaggcacaaatacggaagatagcgagttgacagactggctgagggtaaatggggcagatgaggacacaatcagtaggttcctagcggaagattacaccctgcttgacgtactgtactatgtcacccgagatgatctgaaatgcctaaggcttcggggagggatgctgtgcaccctgtggaaagccataattgattttagaaataagcagacctag

SEQ ID NO: 124778 - DNA, 3771 bp, Artificial Sequence
  Description of Artificial Sequence: Synthetic coding sequence
acattgcagcgagcctcaggagctgctactgaggcccccagaagaagcgagccacccccagggtcaggcgtgccaagcggcgagagagcccccgaacgtcggcggagacgaggaggagagggcgcagcacgcgacggctcttgcctggcacggagggcccgatcatctcccgagctttggctggcaaggagatgtggatgggccggagatgccgccgccgttgccgcgaggccaggtgagatgtccactgaagcggacgagggaatcacgtttagcgttcccccctttgccccctccgggttctgcaccattccagagggaggcatatgtagacggggtggtgccgcagcagtcggagagggggaggaacaccaacttcccccccccccacctggatctttttggaatgtggaaagcgctgcagcccctggaatcgggtgtccagctgcaaccagtagtagttccgcaacacgagggagggggtcatccgtcgggggtggatcccggagaacaaccgttgcctacgttatcaacgaagcctctcagggccagctcgtggtggcggagtctgaggcattacagagcctgagagaggcttgtgaaactgtcggggccactctcgagactctgcacttcggtaagttagacttcggcgagacaaccgtgctggatcgcttctataacgccgatatagctgtagttgaaatgagcgatgcatttagacagcccagcttgttttaccacctgggtgtgagggaaagcttctcgatggcgaacaacatcatcctctactgcgatacgaatagtgactccctgcagtcgcttaaagagataatctgccagaaaaacactatgtgcaccggaaattatactttcgtaccttatatgatcaccccccacaacaaggtttactgctgtgactcgtcgttcatgaagggcctgaccgaactgatgcaacccaattttgaactgctactcggtcctatttgtctcccgctggtcgatcgtttcattcagctgcttaaggtcgcccaggctagtagtagccagtatttcagggagtctattctgaatgacattcgtaaggctcgcaacctctacaccggcaaagaattagcagcagaactggcaaggatcaggcagcgcgtcgacaatattgaggtgctaaccgccgatatcgtgatcaacttgctgttgtcataccgtgacatccaggattatgacagtatcgtgaagttggtggagaccctggaaaaactgccaacatttgaccttgcatcacatcaccacgtcaagttccactacgccttcgccctaaaccgccgcaacctcccgggggaccgcgccaaggctcttgacattatgattcctatggttcaatcggaaggacaggtggcatccgacatgtattgtctcgtgggacgcatatacaaggatatgttcctggactctaactttacagacaccgagtcacgggaccacggagcgtcatggttcaaaaaggccttcgagagcgaaccaaccctgcagtcaggaataaactacgccgtgctcctgctagcggccggccatcagttcgagtcaagttttgagctccgaaaggtgggggtgaaacttagctccctgctgggcaaaaagggcaacctggaaaagctccagtcgtactgggaggtagggttcttcctgggcgcctccgtccttgcgaatgaccacatgcgcgtgattcaagcatccgaaaagcttttcaagctaaagacgcccgcctggtatcttaagtccatagtagaaactatcctaatctataagcactttgttaaattgaccaccgagcagcccgtagccaagcaggagcttgtcgatttctggatggatttcttggtcgaggcaacaaagacggacgtcaccgtggttagattccccgtcctgattctcgaacctacaaagatctaccagcctagctacttatctatcaataacgaggtggaagagaaaaccatcagcatctggcacgtgctgcctgacgataaaaaaggcatccacgagtggaattttagcgctagctctgtcagaggtgtctcgatctctaaattcgaagaaaggtgttgttttctgtacgtactccataattccgatgattttcagatatacttttgcacagagctccactgtaagaagttcttcgaaatggtgaacactattaccgaggaaaagggaagaagtacagaggagggggactgtgagtccgatttgctggaatatgactatgaatacgatgagaacggcgaccgggtagtgcttgggaaggggacatatgggatagtgtacgcaggccgggacctctcaaatcaggttcgcattgcaattaaggaaattcccgagcgtgactcacggtactcccagcctcttcatgaggagattgcgctgcacaagcacctgaaacacaagaacatagttcagtacctcggctccttctcggagaatgggtttattaaaatctttatggagcaggtgccaggcggctctctgtcagccctactacggtccaagtgggggcccctcaaggacaatgagcagacaatcgggttctataccaaacaaatcctggaaggtctgaaatacctgcacgataaccagatcgtgcatagggatattaaaggggataatgtgttaattaatacttactcaggtgtgcttaagatatcagactttggtacttccaagagactcgccggcatcaacccctgtacagaaacattcaccggcacacttcagtatatggcccctgaaattattgacaagggtccacggggctatgggaaggccgccgatatttggtcactcggctgtacgataattgagatggcaacaggaaaaccccctttctacgaactgggtgagccccaggccgccatgttcaaagtgggaatgtttaaggtgcatcccgaaatccccgagagcatgtccgccgaggcaaaggctttcatcctgaaatgttttgagcctgacccagataagagggcctgtgccaacgatctgttagtagatgaatttctcaaagtttcctctaaaaaaaagaagactcagcccaaactgtccgatctgagcatcgcccaggccgagtacctgcggtcaatcagcctgccagtcccagtgctcgtcgaggacacttcatcaagcagcgagtatgggtccgtcagccccgacacagagcttaaggtggaccccttttctttcaagactcgcgctaagtcttgcggggagagagacgttaagggtatcaggacactctttcttggcattccagacgaaaacttcgaggaccatagcgcccccccaagccccgaagaaaaggattctggcttttttatgctgcggaaagacagtgaacgacgggcaaccctgcaccggatcctaacagaggatcaggataagatagtgagaaatctaatggagtccctggcccaaggcgctgaggagcccaaattgaagtgggagcatatcacaaccttaatcgcctcactgcgtgaattcgttcggtccactgaccgaaaaatcatcgcaaccactctttcaaaactgaagctggagctggatttcgacagtcatgggatttcacaggttcaggttgtgttgttcggctttcaggacgctgtcaataaggttctgcggaatcacaacatcaagcctcactggatgttcgccttggattccattattaggaaagctgtccagactgccatcaccattttggtgccaggaattaagccctag

SEQ ID NO: 124779 - DNA, 3867 bp, Artificial Sequence
  Description of Artificial Sequence: Synthetic coding sequence
atggccgggccctgtccaagatcgggggccgagcgcgctggcagttgctggcaagaccctctagcagtggctctctccagaggtcggcaacttgccgcacctccaggccggggatgcgcacgctcccgcccgctctcggtagtgtacgttcttacacgcgagcctcagcccggtctggaacctagggaggggacggaggccgagccactgcccctgcgatgtttgagagaggcttgcgcccaggtgccaaggccccgcccacctccccaacttcggtccttaccattcggtacgctggaactaggcgacactgccgctctggacgcgttctataacgctgatgtcgtggtcctggaggtttccagctccttagttcagccctccctgttctaccaccttggagtacgcgaatcattttcaatgactaataacgtgctgctgtgctcccaggccgatttacctgatctgcaagccctgcgggaggacgtgtttcagaagaacagtgactgtgttgggagctacaccttaatcccttacgtggtaacagctaccggtcgggtcctgtgcggggacgctggcctgttgcggggcctggccgacggattggtgcaggccggagtcggcactgaggccttattaacccctttggtgggccgcctggccagactgctcgaagccaccccaacagatagttgtgggtacttccgggaaaccattcgtagggatatacgccaagctcgcgaacggttttccggaccccaactgaggcaggagcttgcaaggctccagaggcgcctcgacagtgtggagttgctgtcacctgatatcattatgaacttactcctgtcctacagagacgtccaggattatagtgcaatcattgaacttgtcgaaacactgcaggccctaccaacgtgtgacgtggcagagcagcacaacgtgtgcttccactacacattcgcattgaatagacgcaatcgcccaggagatcgggcaaaggccctgtccgtgctgttacccctggtccagctggaaggatcagtggcgcctgacctgtactgcatgtgcgggagaatatacaaggatatgttctttagtagtggcttccaggacgcaggccatcgggagcaggcgtatcattggtaccgcaaagcctttgatgtggagccctcactgcactcaggcatcaatgctgcagtgcttctcatagccgcaggccaacattttgaggacagtaaggaattaagactgattggtatgaaactgggctgcctgctggctcgcaaaggctgcgtagagaaaatgcagtactattgggatgtgggattttatctgggcgctcagattttagcaaatgacccaacccaggttgtgctggcagccgagcagttatacaaacttaatgcaccgatttggtatctggtatccgtgatggaaaccttcctgctgtatcagcattttcgcccaacccccgagcccccaggcggccctccaaggagggcccatttctggctgcactttttgctccagagttgccagcctttcaagaccgcctgtgcccagggcgatcagtgccttgtactggttttggagatgaacaaggttctgctgcccgcgaagctggaggtgagggggacagacccggtgtctacagtgacacttagccttttagagccggaaacccaggacattccgagctcttggacttttcccgtcgcctctatctgtggggtgtcagccagcaagcgagatgaacgctgctgttttttatacgcactgccccccgcccaggacgtgcagctttgcttcccctcagtgggccactgtcagtggttttgtggcctgatccaagcttgggtaactaacccagacagcaccgcgcccgcagaagaagctgaaggagctggcgaaatgctagagttcgactatgagtacactgaaacgggagaaaggctcgtcctgggaaaaggcacctacggagttgtttatgctggccgggacagacacacccgtgtgagaatcgccattaaggaaattccagaaagggattctcgcttttcacaacctttacacgaagagatagcgttgcataggagattgaggcataagaacatcgtgagatatctgggcagcgcgtctcaaggcggctatttgaaaatctttatggaggaggtgcccggcgggagcctttcctcactgctgcggtccgtgtggggccctctaaaggacaacgagtcaactattagcttttacacccgtcagattcttcaaggcctggggtatctgcatgataaccacatcgttcaccgcgatattaagggggataacgtccttattaatacgttcagtggcctcctgaaaattagtgacttcggtacctctaaaaggctggcgggcatcacgccttgcaccgaaacctttaccggtactctgcagtatatggctcccgagattattgatcaagggccaaggggatatggaaaggctgccgatatttggtcactaggatgcacggtgatcgaaatggcaacgggccggccacctttccatgagcttggatcccctcaagctgccatgttccaggtgggcatgtataaggtgcatccaccaatgcccagcagtcttagcgctgaagcgcaggcttttcttctgaggacctttgagccggatccccggctgagagctagcgcccagactctcttgggcgatccattccttcagcccggtaaaaggtctcggtctccgagctctccccgtcacgccccccgcccttctgacgccccctctgcgtcccccacgccctccgcaaactctaccacccagtcccaaactttcccctgtccacaggctcccagccagcacccaccctccccgccaaagcgttgcctgtcgtatggaggaacaagtcaacttcgtgtaccagaggagcccgccgctgaagagccagcatcccccgaggagtcatccggccttagtttactgcaccaggagagtaaacgccgggcaatgcttgccgccgtcctagagcaagaactgccagctctcgctgaaaacctccatcaggagcagaaacaggaacagggcgcgaggctgggcaggaaccacgtggaagagctcctccgctgcctgggcgcacacattcatacacccaatcgccgccagctggcccaggagttaagagcgctccaaggtcgccttcgggctcaggggctgggacccgccctgctgcaccgcccactgttcgcctttcccgacgccgtgaaacagattcttagaaagcgccagatacggccacactggatgtttgtccttgacagtttgctgtccagagcggtgagggccgccttgggcgtgctgggcccggaggtggagaaagaggcggtgtcccccagaagtgaggagcttagtaacgaaggagactcacagcaatcaccgggacagcagtcccctctgccggtcgagcccgaacagggccccgcaccactcatggtgcagctcagcttgctccgggcggagaccgatcgcctgcgagaaattcttgccggaaaagaacgtgagtaccaggctttggttcagagagccctccagaggttaaacgaagaggctagaacgtacgtgctggcaccagaacctccaacagccctgagtaccgaccaaggacttgtgcaatggctgcaagaactgaatgttgactcaggcactatccagatgcttctgaatcatagcttcaccttgcacactctgcttacctatgcgacccgagacgacctgatctacacaaggatacggggcgggatggtttgcagaatttggcgagcgatcctcgcccagcgtgcgggcagcacgcctgtcacaagcgggccttag

SEQ ID NO: 124780 - DNA, 315 bp, Artificial Sequence
  Description of Artificial Sequence: Synthetic coding sequence
atggttcagctgtcactcctgagagctgagaccgataggttacgagagattctggcaggcaaagagcgcgaatatcaggccttggtacagcgagcactccaacgcctgaacgaggaagcacgcacctatgtgttggcccctgagccgcccaccgctctgtctaccgatcaggggctggtgcaatggctgcaagaacttaatgtggacagcgggaccatccagatgggtcgcgacggcatgccacatctcgagggccacttgggcacagcatccagaatacatactagtcacctgtggactttgcgggccgagtag

SEQ ID NO: 124781 - DNA, 3843 bp, Artificial Sequence
  Description of Artificial Sequence: Synthetic coding sequence
atggctggcccgtgccctagaagcggcgcagagagggctggctcctgttggcaagatcccttggcagtagcactctcccgagggcgccagttggcagccccacccggccgagggtgcgcaaggtccaggcctcttagtgtagtgtacgtgttgaccagggagccccagccaggattggaaccaagggagggcaccgaggcagaaccgctccctttgagatgcctcagagaggcatgcgcccaggttcctcgcccaaggccacctccccagcttcgttcgcttcccttcgggacgctggagctgggcgataccgctgccctggacgctttctacaacgcggacgtcgtggtgttggaagtgtccagctccttagtacaacctagtctattctatcatctaggtgtgcgcgagtctttctcaatgacaaacaacgtactgttatgtagccaggctgacctcccagacctgcaagcactccgcgactgcgtcggctcttataccttgataccatatgttgtgaccgcgacgggccgagtgctatgcggcgacgccgggttactgcgcggtctagccgacggcctcgttcaagctggcgttggaacggaagccttgttgacacctctggtggggcgcctggcaagactgttagaggccacacccacggattcatgtggttatttccgggagactatcagacgggacatccggcaggcgcgcgaacgcttttccgggccacagctccggcaggagttggcccgcttgcagaggagactggatagcgtcgaacttctgtcgcccgacatcattatgaatttgcttctgagctacagggatgtgcaggattacagcgcgatcatcgaacttgtcgagaccctgcaggcactgcctacgtgtgatgtcgccgaacagcacaacgtgtgctttcattacaccttcgctttgaatcgaaggaatcggcccggagacagagccaaggccttaagtgtactcctaccattagtacagttggaaggttcagtggctccggatctgtattgtatgtgcggaaggatctacaaggacatgttcttttcgagtgggtttcaggatgccggtcatcgagagcaagcttatcattggtacagaaaggcctttgacgtcgaacctagtctccacagcggtattaatgctgctgtgttgttgatcgctgctggtcaacacttcgaggattctaaagaactcagactgatcggcatgaaactgggatgcctgctcgcgcggaaggggtgcgtcgaaaagatgcagtattactgggatgttggattctatctcggggcccagatcctggccaatgacccaacccaggttgtgctagcagctgagcaactttataagctgaacgcacctatatggtacttggtctccgttatggaaacgttcctgttgtatcagcacttccgaccaacgcctgaaccaccaggcggtccacctagacgggcccatttttggctgcattttctgctgcagagttgccagccattcaaaacggcctgcgcgcagggcgaccagtgtttggttctggttctggagatgaacaaagtccttctccccgccaagctcgaagtaagaggaacagatcccgtgtcaactgtgactctctcgctgttggagccagaaacgcaggatataccctcttcatggacttttccagtggcgtctatttgcggcgtctctgcctctaaacgggatgagcgttgttgtttcttgtacgccctgccacccgcccaagatgtccaactgtgctttccctcagtgggacattgtcagtggttctgcggcttgatacaagcttgggtcacgaatcccgattcgacagcccccgctgaggaagcagaaggggcgggtgaaatgttagaattcgattatgagtataccgaaaccggcgagcgcctcgtgctgggaaaaggtacatatggcgtggtgtatgcaggaagggaccgccacacacgtgtgagaattgcaatcaaagaaattcctgaaagagacagtaggttctctcagcctctccacgaagaaattgccctgcatcgacgattgagacacaaaaatatagtgcgatacctggggagtgcgtcacagggtggttacctcaaaattttcatggaggaggtccctggcgggtccctgagctctctgcttcggtctgtatggggccccctaaaggataacgaatcaactatcagcttttacacacgacagatcctgcagggactgggctacctacacgataaccatattgtgcacagggatatcaagggggataatgtcttgatcaataccttcagcggactcttaaagatctctgattttggaacatctaaacgcctcgcgggaattacaccctgtaccgagacattcaccggtaccctgcaatacatggctcctgagatcattgatcaaggcccaaggggatatggtaaagctgcggacatttggtcgctgggatgtacagttatagaaatggccacaggtcgcccgccctttcacgagctgggcagcccacaagcagcaatgttccaagtgggaatgtacaaggtgcacccaccaatgccttcatccctttctgccgaggcacaagcatttcttctcaggactttcgagccggatccgcgcctgagggcctccgcccaaacactgctgggggacccattcctccagccgggcaaaagatctcggtctcctagcagtccacgtcacgcaccccggccctcagatgctccatcagcctcgcctacaccatctgcgaactctaccacacagtcccagacatttccctgtccccaggcccccagtcagcaccctccaagtcctccaaagcgctgcctgagctatgggggtacatcgcagctccgtgtgccagaagaacccgctgccgaggaaccagcgtcacctgaagaaagttctggactaagcctactccaccaggaaagcaaacgcagggcaatgctggcggctgtgctagaacaggagctccctgccctcgccgagaacctgcatcaggagcagaagcaggagcagggcgctagactcggtcgaaaccatgtcgaggaactgctccgatgcctgggagctcatattcatactcccaaccggaggcagctcgcccaggaactccgagcacttcagggtcggcttcgagcgcagggactcggtccagctctactgcaccgacctcttttcgcattccccgatgcagtgaaacaaattctgagaaaacggcagatacggcctcattggatgtttgtgctcgattcgttgttatcgagagccgtacgggccgctctgggagtgttaggaccagaggtcgagaaggaagcggtgagtccccgcagcgaagagctctccaatgagggagattcacagcagagccctggacagcaatccccattgcctgttgagcctgagcaggggcctgctccactgatggtgcagctctctctgctcagagccgaaaccgacaggctccgcgaaatcttagccggaaaggagagagaatatcaggcgcttgtgcagcgggctctgcagaggcttaatgaagaggctagaacctatgtattagcacccgaaccccctaccgccctttctacagaccaggggctcgtgcagtggctacaggagctcaacgtggatagtggcacgatccagatgctgctgaatcattccttcactctgcacaccctactcacctacgctacccgggacgacctcatctacaccagaatccggggcggtatggtctgtagaatttggcgcgctatactggcccagcgggcaggaagtactcctgtgaccagtggcccttag

SEQ ID NO: 124782 - DNA, 2397 bp, Artificial Sequence
  Description of Artificial Sequence: Synthetic coding sequence
tgaatgaatctgctcttatcttatagggatgtgcaagattattctgcaatcatcgaactggtggagactctgcaggctctgccaacatgcgacgtggccgaacagcacaatgtgtgttttcactacacattcgccttgaatcgccggaaccgccccggtgatcgagccaaagcgctgagcgtgttgctaccacttgtccagttagaaggttctgttgccccagacctgtactgtatgtgcggaagaatttacaaggacatgttcttttcttcaggattccaggacgccggtcatcgtgaacaagcatatcactggtatagaaaagcctttgacgtcgagcccagtttacactcaggaatcaacgctgcggtgttgttgatagccgccggtcagcacttcgaggactcgaaagaattacgtctgatcggcatgaagcttggatgcctcttggccagaaaaggatgcgtggagaagatgcagtactattgggacgttggcttctacctgggagcgcaaattctggccaacgatccgactcaggttgtcctggctgccgaacagctgtacaagctcaatgcgccaatctggtatctggtcagcgtgatggagacattcctgctgtaccaacactttaggccaaccccggaaccccccggaggccctcccaggcgagcgcacttttggctacactttcttctacagtcatgccagccatttaaaaccgcctgcgctcagggtgaccagtgtttagtgctggtcctcgagatgaataaggttctgttgcccgcaaaactcgaagtacgggggaccgatccagtctccactgtgaccctgagcctcctcgagcccgaaacacaagacattcctagttcttggacatttcccgttgcttccatctgcggagtatcagcgagcaaaagagacgagcgctgctgtttcctgtacgcgctgccaccggctcaagacgtacagttgtgctttccatctgtcggtcactgtcagtggttctgtgggcttattcaggcatgggtgaccaaccctgacagtacagcccctgccgaggaagctgagggcgccggagagatgttagagtttgactacgagtatacagagactggagagagactagtgttgggcaaaggaacctacggcgtggtctatgctggtcgcgatcgacacaccagagtgcggattgccatcaaggaaattcccgaaagggatagtaggttttctcaacctctccatgaagaaattgcactccacagacgactgagacacaagaacattgttaggtaccttggatctgctagccaggggggttatctgaagatattcatggaggaagttccaggtggatctctgtcttctctgcttagatcagtatggggacccctcaaagacaacgaaagcactatttccttctatacaaggcagatactgcagggactgggttatctgcatgataaccatattgttcacagggacataaagggggataacgtgctcattaacacattcagcgggttgctgaaaatctctgattttggaacatctaaacgactggcgggcattaccccttgcaccgagaccttcaccggcaccctccagtacatggctcccgagattatcgatcaaggaccacgaggatatgggaaagctgctgacatttggtctctgggatgtactgtaattgagatggcgacaggccgccctccgtttcatgagcttggtagcccccaggcagcgatgttccaagtaggtatgtacaaagtgcatccgcctatgccaagtagcttgtctgccgaggcacaggcgttccttctccgcacattcgaacccgatcccaggctgagagcaagcgctcagacactcttgggggatccattcctgcagccaggcaagcgctcacggagtcccagctcccccagacatgcacccagacccagcgacgccccctccgcctcgcctacacctagcgccaattccaccactcagtcccaaactttcccatgtcctcaggccccatctcagcatccaccaagtccccctaaaaggtgtttgtcctatggaggcactagccaactacgggttcctgaggagcccgcagcagaagaacctgcctcccccgaagaatcctccggcctgagcctcctccaccaagagtctaaacgacgagccatgctggccgctgtcctcgaacaggagctcccagcgctggccgagaatctgcatcaggaacagaagcaggaacagggcgctcgattgggccgaaatcatgtcgaggagctcctcaggtgtctgggcgcccatatccacactcccaacaggcggcagcttgcgcaggagcttagagccctacaaggctggatgaatggcgaagacaaagggagcttctag

SEQ ID NO: 124783 - DNA, 249 bp, Artificial Sequence
  Description of Artificial Sequence: Synthetic coding sequence
taagaatatcaggccttggtacaacgagccctccagcggctgaatgaagaggcccggacctacgttctagcgcctgagccccccactgcgctgagcaccgatcagggtttagtccaatggctacaagagctcaatgtggactcgggtaccatacagatgggccgcgacggcatgcctcacctcgaagggcacctgggcaccgcctcccggatccacacgtcccacctgtggacactgcgtgcagaatag

SEQ ID NO: 124784 - DNA, 3867 bp, Artificial Sequence
  Description of Artificial Sequence: Synthetic coding sequence
atggccggcccctgcccccggagtggagccgaaagagctgggtcctgttggcaggatcctttagccgttgccttgtcaaggggcaggcagcttgctgccccccctggcagaggttgcgcacgctcacgcccgctttcggtcgtctatgtactgaccagggaaccccagccaggcttagaacccagagaaggaactgaggccgaaccgctaccgttacggtgcctccgcgaggcctgtgcacaggtgcctaggcctcgacctccgccacagttgcgatccctgccgttcggaactttagaactgggagatactgcagctctggatgcgttctacaatgcagatgtggtcgtgctggaagtctcttcgtccctagtgcagccctctctcttttaccacttgggcgtgcgggagagctttagcatgactaacaacgtgctactctgcagccaagcggatttacccgacctccaagctcttcgggaagatgtgttccagaagaattcagactgcgtgggctcctacactttgatcccttatgtggtaacagctactgggcgggtgttgtgcggagacgctggccttctgcgcggcctggcagatggcctcgtccaggcgggcgtgggcacagaggctctgttaacaccgctcgttggaagacttgcgagattgcttgaggcaacccctaccgactcttgcgggtatttccgtgagactattaggagagatattcgtcaggcccgcgagcggttcagtggcccccaactgcggcaggaactcgccagactgcagcgacgcctggattccgtggaactgctgagcccagacattattatgaatttgctgctgtcttatagagacgtccaggattacagcgcaattatagaactggttgaaactctccaggctctccctacttgtgacgtggcagagcagcacaatgtctgcttccactacacattcgccctcaaccgcaggaacagacccggggatagagccaaagccttgagtgttctgctccctctggtccagttggagggaagtgttgctccggacctctactgcatgtgtggcagaatctataaggacatgtttttttccagcggctttcaggacgctggccaccgggagcaggcttatcattggtaccgtaaggcattcgatgtcgagccgtctcttcactcaggcatcaatgcagcggttctgcttatcgcagcaggacagcactttgaggactctaaggagcttcgcctgatcgggatgaaattgggttgtcttctggcacgaaaaggatgtgtagaaaaaatgcaatactactgggacgtggggttttatcttggcgcccagatcctggctaatgacccgacccaagtagttctggctgccgagcagctatataagctaaacgcacccatttggtacctggtgtccgtgatggagactttcctattgtatcagcattttcgtccaactccggaaccgccaggcggcccccctcggcgggctcacttctggttgcattttctgcttcagagctgtcagccttttaagactgcatgcgcccaaggtgaccagtgcctggttctcgtgcttgaaatgaataaggtcctgctccctgcaaagcttgaggtgaggggcaccgatcctgtttccaccgtcactctcagcctgctcgaaccggagacccaagacattccgtcctcgtggacgttcccagtggcaagcatctgtggcgtgtccgcgagcaaaagggatgagagatgttgttttctgtacgccctcccacctgctcaggacgtacagctatgctttccttctgttgggcattgccaatggttctgcggcctgattcaggcatgggtgaccaaccctgatagcacagctccagcagaggaggctgagggggctggcgaaatgctggaattcgactatgagtacacggaaacaggcgagcgcctcgttctggggaagggaacctacggtgtcgtgtatgcgggccgggaccgacacactcgagttagaatcgcaattaaagagattccagaaagagatagtagattcagccagcccttgcacgaagagattgctctgcacaggcggctacgccataagaacatcgtgaggtaccttgggtcagccagccaaggggggtatctgaagatcttcatggaggaggttccaggtgggtcactgtcctcactgctcaggtcagtttggggaccccttaaggacaacgagtcaaccatttctttctatacacgccagatcctgcaaggacttggttatttacacgataatcacatcgtgcatagagatatcaaaggtgacaatgtgctgataaacacattctcaggcctcttaaagatctcggactttggcacatccaagcgcctggctggaattactccttgtactgagacattcacagggacactgcagtatatggccccagagataatcgaccagggtcccagagggtacggaaaggcagcagatatttggtcattaggatgtacagtgatcgagatggctaccggtcggcctcccttccatgagctgggtagcccccaggcagccatgtttcaggtgggcatgtacaaggtgcaccctccaatgcctagcagcttaagcgccgaagcacaggcctttctattacggacttttgaacctgatcctcggcttcgcgcgagcgcccagacattgttgggggacccctttctgcagccgggcaaaaggagcagaagtcctagctccccaagacatgctccccggcccagcgatgcaccatcagcgagcccaacccccagcgcaaactcaaccacacaatcccagacattcccttgtcctcaggctccatcacagcaccctccgtcccctccaaagagatgcctgtcatacggcgggacaagccaattgagggtcccggaagagcccgcggctgaagagcctgctagtccggaggagtcgtccggactgtccttgctccatcaggaaagcaagagacgggctatgttggcagcagtcctggagcaggaacttcctgcactcgctgagaatctgcatcaagagcagaaacaggagcagggagcgcgcctgggcagaaatcatgtcgaggaacttctgcggtgcctcggagctcacatccacacgccaaacagaaggcagttggctcaggaactgcgagccctccaggggcggctgagagctcaaggcttaggacccgcactcctgcaccgacccctatttgccttccccgacgcggtaaagcaaatactgaggaaacgccagatccgtcctcactggatgttcgtgttggactcccttctgagtagggcggtgcgagccgctctcggcgtgctgggacctgaagtcgaaaaagaagccgtctccccacgcagtgaagagttaagcaacgagggcgactcccaacagtcacctgggcagcagagccctctcccggttgagcccgaacaaggccccgctccgcttatggtgcagttgtcgctgcttagagcagagaccgacaggttacgcgagatcctcgctggtaaagagcgggagtaccaggcgctcgttcagagagcactccagcggctaaatgaggaagcacgaacctatgtcctcgccccagaacctcccacagctttgtctacagatcaaggacttgtgcaatggctgcaggaactgaacgtggactctgggaccatccagatgcttttgaatcattccttcacactgcacaccctgcttacttacgccactagggatgatctcatatatactcgcatcagaggcggtatggtatgcaggatctggcgtgccatcctggcgcagagagctggatcaaccccagtcacatctggtccctag

SEQ ID NO: 124785 - DNA, 2394 bp, Artificial Sequence
  Description of Artificial Sequence: Synthetic coding sequence
atgaatctgctccttagctacagagacgtccaggattattcagctattatcgaacttgtggagactctgcaggctctgcccacatgcgacgtcgctgagcagcataatgtctgctttcactataccttcgcactgaaccggcgcaaccgaccgggcgacagagcaaaggcgttatccgtgcttttgcccttagtccagctggaaggcagtgtcgctcccgacttatattgtatgtgcgggcgtatctacaaggacatgttcttttcttctggcttccaggacgccgggcaccgcgagcaggcgtaccactggtacaggaaggcttttgacgtggagcctagccttcatagcggcatcaacgccgccgtcctgcttatcgctgccggccaacacttcgaggatagcaaagagctgagactgattgggatgaaacttggatgcctgctggctcggaagggctgcgtcgagaagatgcagtactactgggacgtggggttctatcttggcgcccaaatactggccaacgaccccacacaagtggtcctggccgcagaacagctctacaagctgaatgcaccaatttggtacctggttagtgttatggagacctttcttctgtatcagcactttaggcctacacccgaaccccctggcggcccgcctcgcagggcccatttttggctccatttcttactgcagtcatgccaaccatttaagactgcgtgcgctcaaggggatcagtgcctcgtcctcgtgctggagatgaacaaggtattgttacctgcaaaactggaagttaggggaacggatccggtctcaacagtcactctgtcccttctggagccagagacccaggacattccctcttcatggaccttcccagtggccagcatctgtggtgtctcagcttcaaaaagagacgagcgctgttgcttcctatacgcattaccccctgcacaagacgtccagctttgctttccttcagtggggcactgccagtggttctgtgggttaattcaagcgtgggtaactaatcccgattccacagctcccgccgaggaggctgagggggcaggggagatgctggaattcgattacgaatatacagagacgggcgaacgactcgttctcggaaagggcacgtatggagttgtttatgccggtcgcgacagacataccagagttcggatcgctatcaaagagatcccggagcgggactccagattcagccagcctcttcacgaagaaatcgcgctgcatcgacggctcagacacaagaacattgtccggtatctaggatcagcctcccagggcggatacttaaaaatctttatggaagaagtccccggcggcagcctgtcatctctgctcagaagcgtttggggccctctaaaagataacgagagcactatctctttctacactcgacagatcctgcagggcctcggttacctgcatgataaccatatagtacacagggatatcaagggagacaacgtcctgatcaacacgttttcaggcttgctgaaaatctccgactttgggacttcaaagcgcctggctggaataaccccctgcacggagacatttaccggcactctgcagtatatggcacctgagattatagatcaaggtcctaggggttacggtaaagccgcggacatctggagtctggggtgtaccgtcatagagatggccaccggaagaccaccctttcatgagctcggatctcctcaggccgccatgtttcaggtgggaatgtataaagttcaccccccaatgccctcaagtctgtctgccgaggctcaggccttcctgcttcgcaccttcgagccagacccacggcttcgcgcgagcgcacagactctgctgggagacccgtttctgcaacccggcaaaagatcacgcagcccatcatctccgcgacatgccccgcggcctagcgacgccccctccgcctccccaactcccagcgccaattcaaccacacaatcccagacttttccttgtccccaggcaccctctcaacatcctccctctcccccgaaacggtgccttagttatgggggcacatctcagctccgggttccagaggagccggcagccgaggagccagcgagtcccgaggagagttcaggactttccttactgcaccaagagtctaaaagacgggccatgctggccgctgtcctggagcaagaattacccgccctcgccgagaatctccatcaggaacagaaacaggagcaaggggcaagactaggacgaaaccacgtggaggaactgctgaggtgcctcggggcccatatccacactccgaaccggcgccagctcgcccaagagctccgggccctgcagggatggatgaacggggaggacaagggatccttctag

SEQ ID NO: 124786 - DNA, 783 bp, Artificial Sequence
  Description of Artificial Sequence: Synthetic coding sequence
atggatatcgcttccacaaatacaagcaataagagcgataccaatatggaacaggtgccagcgaccaatgacacgattaaacgactggaatcgaagctgttgaagaaccaggccaagcaacaaagtgagagtggccgattgtctctaggagcatctagaggatcttccgtcgaatccttgccgcctactagcgaggggaaacgtatgtctgcagacatgtctgaaatcgaggcccgcattgctgcgaccacaggaaacggccagccacggcgccgcagtatccaagatcttaccgttaccggtaccgaaccaggtcaggtgtcttctcgtagtagcagcccttcggtaagaatgatcactacttctggtcccacctctgagaaaccgaccaggtctcacccatggacacccgacgatagcaccgacaccaatggtagtgataactctatccctatggcctatctcacccttgaccaccaactacagccgcttgcaccctgtcctaattccaaggagagtatggcggtgtttgagcagcactgcaagatggctcaggaatacatgaaagtgcagacagaaattgcgctgctgctccagaggaagcaagaattggttgcggagctagaccaggacgagaaggatcagcaaaacactagtcggctcgtgcaggagcacaagaaactgcttgacgagaataaatctttgtctacctactaccagcagtgtaagaagcagctcgaggtgatacgtagtcagcagcagaaacggcagggcacatcttag

SEQ ID NO: 124787 - DNA, 1557 bp, Artificial Sequence
  Description of Artificial Sequence: Synthetic coding sequence
atgagcacagctagtgccgcaagctccagtagttcctcttctgcaggagagatgatcgaagccccgtcacaggtgctgaacttcgaagaaatcgattacaaggaaatcgaggtcgaggaggtcgtggggcgcggggccttcggggtcgtctgcaaagcgaaatggcgagccaaagacgtggccattaagcagatagagtcagaatcagagagaaaggccttcattgtcgaacttcggcagctgtcccgggttaatcatcctaacattgtgaagctctatggggcttgcctgaacccagtctgtttggttatggagtacgccgagggtggatccctctacaatgtgttgcacggggcagagcctctcccttactacacagcggctcatgccatgagctggtgcttgcaatgttctcagggcgttgcatatttgcatagcatgcagcccaaggctctgatccaccgtgatctcaagccacccaacctgctcctggttgcaggaggcaccgtactaaagatctgcgattttggcactgcatgtgatatccagacccatatgacgaataataagggctcagccgcttggatggcccccgaggtttttgagggaagcaattatagcgaaaagtgcgatgtgttctcatgggggatcatcctgtgggaggtaatcacaaggaggaaaccatttgacgaaattggaggacctgctttccgtatcatgtgggctgtgcacaacggcacccgaccaccactgatcaagaacctgcccaaacctatcgaatcactcatgacaaggtgctggtctaaagacccaagccagaggccttcaatggaagagattgtaaagattatgacacacctcatgaggtacttccctggcgcagatgaaccactgcagtatccctgtcagtattctgatgagggccagagtaactctgccacctctactgggtcttttatggatatcgcaagcactaatacaagcaacaagtccgacacaaacatggagcaggtccccgctaccaacgacacaatcaagcggcttgagagcaaattacttaaaaatcaggcgaagcagcaaagcgagtcaggccgcttgtcgctgggggctagtaggggctcgagtgttgagtctcttcctcccacttcagaaggaaagcgcatgagtgctgacatgtcagagattgaagcgcgcatcgctgccaccaccgcctactccaagcccaaaagagggcaccgcaagaccgcctctttcgggaatatcctcgatgtcccagaaatagttatttcagggaacgggcaaccgcggagacgctctattcaggatctaactgtcaccgggacggagcccggccaggtgagctctagatcgagttctccatccgtgaggatgataactacctccgggcctaccagtgagaagccaaccaggtcccacccctggacgcccgatgacagtacagataccaacgggagcgacaactctatacccatggcatacctcactttagatcaccagctgcaggccagaacttcttgcagaacaggacctgggtag

SEQ ID NO: 124788 - DNA, 1476 bp, Artificial Sequence
  Description of Artificial Sequence: Synthetic coding sequence
atgtctactgcaagcgccgcctcctctagctcatcatcctctgctggcgaaatgattgaggcgccaagccaagttctgaactttgaagagattgactacaaggaaattgaggtcgaagaggtggtcgggcggggcgcattcggcgtagtttgcaaggccaagtggcgggccaaagatgtggcaattaagcagattgaaagcgagagtgagcgaaaggccttcatcgtggaactgagacaattatcccgcgtcaaccacccaaatattgtcaagctgtatggggcctgcctaaatcccgtgtgcttggtgatggaatatgctgaaggaggcagcttatacaacgtgctgcatggagctgagccactcccatattacactgctgcccacgccatgtcttggtgcctccagtgctcccaaggcgtggcctatctgcatagcatgcagccaaaggctttaattcatcgggacttgaaacccccaaaccttctgctggtggcaggggggacagtgttgaagatttgcgattttggaacagcctgtgatattcaaactcacatgaccaataacaagggttccgcagcttggatggcccccgaagttttcgaaggttctaactactccgaaaaatgcgacgttttcagttggggaatcattctctgggaagttattacccgaaggaaaccctttgacgagataggggggcccgcctttcgtattatgtgggcagttcataacggaacccgcccccccctcatcaagaatctcccgaaacccatcgagtccctgatgaccaggtgctggtctaaagatccttcccagaggccttctatggaggagattgtcaagattatgacacacctgatgcggtactttccgggcgctgacgaacctctgcaatatccatgccagtacagtgacgaaggccagtctaacagcgccacttcaacaggctctttcatggatattgctagcacaaacacatcaaacaaatctgacaccaatatggaacaagttcctgcaacaaacgacactatcaaacgcctagagtctaagctcctgaaaaaccaggctaaacagcaatccgagtcgggccggctatccctgggagccagcagggggagttccgtggaatcactccctccgacatcagagggaaagaggatgtctgctgacatgtcagaaatcgaagcccgtatcgcagccaccaccggcaatggtcagcccagacgtcgatcaatacaagacctaacagtgacagggaccgagcctgggcaggtgagttcccgcagctcctccccttcagttaggatgatcaccacatcaggtccgacctcagagaaacccacccggtctcacccgtggacgcctgacgacagtaccgacacaaatggctccgacaactccattccaatggcctatctgactctcgatcatcaattgcaggcccgcacctcctgtcgaacggggcctgggtag

SEQ ID NO: 124789 - DNA, 1821 bp, Artificial Sequence
  Description of Artificial Sequence: Synthetic coding sequence
atgtcgactgcatccgctgcttcgtccagctcctcctcttctgcaggcgagatgatcgaggcgccctcacaagtcctaaacttcgaggagatcgattacaaagagattgaggtggaggaggtggttggccgaggagcctttggggtggtatgtaaagccaagtggagggcaaaggatgtagcgataaaacagatcgaaagtgagtcggaacgaaaggcgtttatcgtcgaattacgtcagctaagcagagtgaatcatcctaacatcgtgaagctgtacggcgcatgcttaaatcctgtgtgtctggtaatggagtacgcagaaggcggcagtctgtataacgtcctgcacggagccgagcctctgccctactatacagctgctcacgcaatgagttggtgtttgcagtgcagtcagggtgttgcttacctgcatagcatgcaaccgaaagcactgatacaccgtgatctgaagccacccaatctgctcctggttgccggaggaaccgttctgaagatatgtgatttcgggaccgcatgtgatatccagacgcatatgactaacaataagggatccgccgcttggatggcaccagaagtgttcgaagggagtaattattccgagaagtgtgatgtgtttagctggggcattatcctttgggaagttattactcggagaaaacctttcgatgagatcggcggcccagcatttaggatcatgtgggctgtacacaacggcacacggcctcctcttatcaaaaatctccctaaaccaattgaatctctcatgactcggtgttggagtaaggaccccagtcaaagacccagcatggaggaaatagtgaaaattatgacacacctgatgcgatattttcctggggcagacgagcctcttcagtatccctgccaatactcagacgaaggtcagtctaattcagccacaagtacgggcagcttcatggatatagcctcaaccaacacaagcaacaaaagtgatacgaacatggaacaggttccagctaccaatgacacaattaaaaggctcgaaagtaagctcttgaaaaatcaggctaaacagcagagtgaatctgggcgcctgagtctgggcgcctctcggggatcctccgtcgagagtcttccccctaccagtgagggaaagcggatgtctgccgatatgtccgaaatagaggcaagaatcgctgcaactaccgcttattccaagccaaagagaggccaccgtaaaacagcatccttcggcaacattttggacgttcctgaaatcgtcatctccggcaatggacaaccccgcaggaggtccatccaggatctaaccgttacaggcacagagccagggcaggtgagttcacgatcatcctctccatctgtccgcatgatcactactagcggccctacatccgagaagcccactcggtctcacccttggactcccgacgattccactgacactaacggatccgacaacagtattcccatggcttatctaactctagatcaccagctccagccactggctccctgccctaattcaaaggagtccatggcagtcttcgagcagcactgcaaaatggcccaagagtatatgaaggtgcagacagagatcgccctcctgctccagcggaaacaggaactggtggccgagctagatcaagacgagaaggaccagcagaacacaagtagactggtgcaggagcataaaaagctacttgatgaaaacaagagcctgtcaacatactatcagcagtgtaaaaagcaattggaggttatcaggtcgcagcagcagaagcggcagggaacaagttag

SEQ ID NO: 124790 - DNA, 1740 bp, Artificial Sequence
  Description of Artificial Sequence: Synthetic coding sequence
atgtctacggccagcgctgcgagctcttcctcatcatcctctgccggcgagatgattgaggcaccgtcccaggtcctcaattttgaagaaatcgattacaaggagattgaagtggaagaagttgtgggtagaggcgcattcggtgtggtgtgtaaagcaaagtggagagccaaagatgtggccatcaagcagatcgaatctgagtctgaacgcaaagcttttatcgtcgagctgaggcagctttctcgggtaaaccatccaaatatcgtcaaactctacggcgcctgtctcaaccctgtgtgtttggtgatggagtacgctgaagggggctctctctataacgtcctccacggggcagaacctctgccatactacaccgcagcgcacgcaatgtcctggtgtttgcagtgttctcagggggtggcctacctgcacagcatgcaacccaaagcacttatacatcgggacctgaagcctccaaacctcctcctggtcgcaggcggaaccgtcctgaaaatctgcgattttggaaccgcgtgtgatatacagactcacatgaccaacaacaaggggtccgctgcttggatggcgcctgaggtgttcgaaggtagtaactatagtgaaaaatgcgatgtgttctcttggggcattatcctctgggaggtcatcacccgccgcaaacccttcgacgaaatcgggggccccgccttcaggatcatgtgggcagtgcataatgggactcgtcctcctttgattaagaatctgcctaagccgatcgaatcacttatgacaagatgttggtccaaggatccgtcccagagaccgtcaatggaagaaattgtgaaaatcatgacacatctcatgagatacttccctggggccgacgagccactgcagtacccatgccagtactccgacgaagggcagtcaaatagcgcaacttccaccgggtccttcatggatatcgccagcaccaatacatctaataagagcgatacaaatatggaacaggtgcctgccacaaatgacaccattaaacgtttagagagcaagcttcttaagaaccaggccaagcaacagagtgagtccggacgcttgtcactgggggctagcaggggctcctccgtggaaagtctgccaccaaccagtgaaggaaagcggatgagtgcggatatgtccgagatcgaggcgaggatcgcagcaaccactgggaacggacaacctaggcgccggtcaatccaagacctgactgtgacggggacagaaccgggtcaggtctcgtctcgctcatcgtcaccatccgtgagaatgatcacaacaagcgggcctacttcagagaagcccacccgatctcacccctggacgcccgacgacagcacagacactaatggaagcgacaactcaataccaatggcctaccttacgttggatcatcaattacaaccgctggccccctgccccaacagtaaagagtcaatggctgttttcgagcagcattgtaaaatggcacaggaatatatgaaagtgcagactgagatcgcactgcttctccaaaggaagcaggagctcgtggccgagcttgaccaggacgaaaaggaccagcagaacacgtcgagactggtgcaagagcacaagaagttgctcgacgagaacaaaagtctgtcgacgtattatcagcagtgcaagaaacaattggaggtcattaggtcccagcagcagaagcgccaggggacatcttag

SEQ ID NO: 124791 - DNA, 1257 bp, Artificial Sequence
  Description of Artificial Sequence: Synthetic coding sequence
atgtccaccgcatctgctgcctcatcatccagctccagctctgctggagagatgatcgaggccccatcccaagtactgaactttgaggagattgattataaggagatcgaggttgaggaagtcgtgggccgaggagcttttggggtggtatgcaaggctaagtggagggctaaggatgttgcaatcaagcaaatagaatcggagtcagaacggaaagccttcatcgtcgagctcaggcagctcagtagagtgaatcatcccaacctgcttctggttgcaggcggcactgttttgaaaatctgcgacttcggtacagcgtgtgatatacagacgcacatgacaaataataagggcagtgcagcatggatggccccagaggtgttcgaaggatccaattacagcgaaaaatgtgacgttttttcatggggtattatactctgggaggtgattactagacgaaaaccattcgatgaaataggtggtcctgcatttcggatcatgtgggccgttcataatggcactaggcctcctctgatcaagaacctcccgaaaccgattgagtccctaatgacccggtgttggagcaaagacccgtcacagcgcccttccatggaggaaatagttaagataatgacccacctcatgcgttacttcccgggggctgatgaacctctacagtacccctgtcagtactcggacgaggggcagagcaactcagccactagtaccggatcgtttatggacattgcatccacaaatacttcaaacaaaagcgatacaaacatggagcaggtccctgctaccaatgataccattaaacgattggagagcaaactgcttaagaatcaagctaaacagcaaagtgaatccggcagactgtccctcggcgcctcaagggggagttccgtggaatcacttccccccacttctgagggaaaaaggatgagcgcggatatgtcagagatcgaggcccggatcgctgccaccaccgggaatggacagccccgccgacgctccattcaagaccttaccgttactggcacggaaccaggccaagtctcatcgaggtccagctcaccgtccgtgcgtatgatcaccactagcggtcccacctctgagaagcccacgaggtcccacccttggacgcctgatgacagtactgatacaaatggcagcgacaactcaattccaatggcctacctgaccctggaccaccagctgcaagccaggacttcgtgtcgaactggaccaggatag

SEQ ID NO: 124792 - DNA, 1404 bp, Artificial Sequence
  Description of Artificial Sequence: Synthetic coding sequence
atggagtacatgtccactgggagcgacaacaaggaggagatcgatttgttaatcaagcatctgaatgtttccgacgtcatagatattatggagaacctgtacgcttccgaggagccagccgtttacgaaccgtcattgatgacaatgtgccaggattctaaccagaatgacgagaggtccaagagcctgcttctgagcggacaggaggtcccatggcttagctccgtgagatacggaacagtcgaagatcttctcgcgttcgccaaccacatctcgaacactgcgaaacatttttatgggcagcgcccacaggaatccggaatactcctcaatatggtcattacaccacagaatgggcgctaccagattgactccgacgtgctccttattccttggaagcttacctatcggaacatcggctctgattttattccgcgaggcgctttcgggaaagtgtatctcgctcaggacattaagaccaaaaagcggatggcctgtaagctcatacccgttgaccagtttaagccatctgacgtcgaaatccaggcatgttttcgccacgagaacattgccgaactctacggagcggtcctgtggggcgagaccgtgcacctgttcatggaggcaggagaaggtggaagcgtcctggaaaagctggagtcgtgtgggccaatgagggagtttgaaattatctgggtgaccaaacacgttcttaaagggctcgacttcctccactctaaaaaggtgattcaccacgacataaaaccaagcaacatagtttttatgtctacgaaggctgtgctggtcgatttcggtctcagcgtgcagatgacagaggatgtgtacttccctaaagatctgaggggaaccgaaatttatatgtcaccagaggttatcctgtgtaggggccacagcaccaaggccgacatctatagccttggggcaacattgatccacatgcagactgggacccccccgtgggtgaagagatatcctaggtccgcatacccctcttacctgtacatcatccacaaacaggcgccaccattggaagacatcgctgatgactgctcccctggcatgcgcgagcttatcgaggcctccctcgagcggaaccccaaccacagacctagagcggccgatctactaaaacacgaggcactgaaccccccacgggaagatcagccacgctgccagtcactagactccgcactcctagagcgtaagcgtctgctgtcgcgtaaggagttagaactgcccgaaaacatcgctgactccagttgcactggttccacagaagagagtgagatgctgaaacgccaacgttctctttacatagatttgggagccctggccgggtattttaacctcgtgcgggggccaccaacactggaatatggctag

SEQ ID NO: 124793 - DNA, 1404 bp, Artificial Sequence
  Description of Artificial Sequence: Synthetic coding sequence
atggagtacatgagtactggttcagataacaaagaggagattgatttgctgatcaaacacttgaatgtttcagatgttatcgacatcatggagaacttgtacgcctccgaagagccagcagtgtatgaaccttctctaatgacaatgtgccaggattccaatcagaacgatgaacgatccaaatcgctcttgctgtccggacaagaagtcccctggctgtctagcgtgcgttacggcacggtcgaggacctcctggccttcgccaatcatataagcaatacagccaagcacttttatggccagaggccccaggagagcggcattctccttaatatggtgattacaccccaaaacggtcgataccagattgacagcgacgtgctgctcatcccgtggaagctaacatacagaaatataggaagtgactttatcccccgcggggctttcggcaaagtgtacctggcacaagacatcaaaactaagaaacggatggcgtgcaagctgattccagtcgaccagttcaaaccttcagatgtcgagatccaggcctgctttaggcacgagaacattgcagagttatacggcgccgtcctttggggcgagaccgtgcatctgttcatggaggcaggcgaaggcggaagcgtgttagagaagttggagagctgcggtcctatgcgtgaattcgaaatcatatgggtcaccaagcacgtgcttaaaggcctggactttttgcattccaagaaagtcattcaccacgacattaagccttcaaacattgtctttatgtctacgaaagctgtgctggtagattttggcttatctgtgcagatgacggaggatgtgtactttccgaaggacctgcgcggaaccgagatctatatgtcacctgaagtcatcctgtgccgcggtcattctaccaaagccgatatttactctctgggcgccaccctgatccacatgcaaaccggaacaccaccgtgggtgaagagataccctcgctcggcgtacccatcatacctatacattattcacaaacaggccccccccctcgaagatattgctgacgactgcagtcctggaatgcgagaactgatcgaagcttccctagagcgaaatcccaaccacaggccccgcgcagctgacttattgaaacatgaagccctgaatcccccgagggaggaccagcctagatgccagagcctcgattccgccctgctggagcgtaagaggctcctgtcccgtaaggagctcgagctcccggagaatatcgctgactcctcttgtacgggatccactgaagaaagcgagatgctgaagaggcagcgtagtttatacattgacctgggagctctagctggctacttcaatttagtcagggggccccccaccctcgagtacgggtag

SEQ ID NO: 124794 - DNA, 399 bp, Artificial Sequence
  Description of Artificial Sequence: Synthetic coding sequence
atggagtacatgagcactggctcagataacaaggaagagattgatcttctgattaaacatctgaacgtgtccgatgtgatcgatatcatggaaaacctttatgcctctgaggagccagccgtgtatgagccctctctaatgacaatgtgccaagacagcaatcagaatgacgagcgctccaagtctctgttactgagcggacaagaggttccatggctgtctagcgtgcgctacggaaccgttgaggacctgctggcattcgctaatcacatctccaatactgctaagcatttttacgggcagcgcccacaagagtctggcattttactgaacatggtgcgcttctttccaatcagctgggtgctttgcgcgcaactctcctactgtagtttcatctag

SEQ ID NO: 124795 - DNA, 1404 bp, Artificial Sequence
  Description of Artificial Sequence: Synthetic coding sequence
atggaatacatgagtacaggctcagacaataaggaggagatcgacttactgataaagcatctaaacgtatccgacgtcatcgacattatggagaatttgtatgcatcagaagagcccgccgtgtatgaacccagtctgatgaccatgtgccaagattccaaccagaacgatgaacgttcaaagagtttactgctgagcggtcaggaagtgccatggctgagtagtgtcaggtatggcacagtggaagacctcctagctttcgcaaaccatatcagcaatactgctaagcacttctatggtcagaggccacaggaaagtggcatcctgcttaacatggtaatcactccacagaacggcagatatcagattgattcagacgtcctgctaattccttggaaactgacgtatagaaatatcggcagtgactttattccaaggggagcattcggcaaggtataccttgcccaggacatcaaaaccaagaaacgaatggcctgcaagcttataccggtcgatcagttcaagccttccgacgttgaaattcaggcttgcttccgacacgagaacatcgctgagctgtatggcgcagtgctctggggcgagaccgttcacctgtttatggaagcaggtgaaggtggcagcgttttggaaaagctggaatcatgcggcccaatgcgggagttcgaaataatttgggttacgaagcatgtcctaaaggggctggacttcctccactcaaagaaggtcatccaccacgatattaagccatctaacattgttttcatgagcactaaagccgtcctggtggacttcgggctaagcgtgcagatgaccgaggatgtatattttccgaaagacctgagaggaaccgaaatctatatgtcccccgaggtgatcttatgccgcggccatagtactaaggctgacatttattctctgggcgcaaccctgatccatatgcagaccggcacaccgccttgggtgaaaagatatcccagatccgcatatccatcctacttgtacataattcataagcaggcccccccactagaagatatcgccgacgattgctcaccgggcatgcgcgagcttatcgaggcctctctggaaaggaaccctaatcataggcccagggctgcggaccttcttaagcatgaggctctcaacccaccacgggaagatcagccccggtgtcaatctttggattcggcattgttagaacggaaacggcttctgagccgaaaagagctggaactgcctgagaacattgcggactcatcatgcacgggctccactgaagagtccgagatgcttaagcgccagcggtctttgtacattgatctaggcgccctcgccgggtattttaatctcgtccgcggccctccaactctggagtatggttag

SEQ ID NO: 124796 - DNA, 672 bp, Artificial Sequence
  Description of Artificial Sequence: Synthetic coding sequence
atggagtatatgtccaccggttcagataacaaagaggaaatcgatctactcatcaagcacctgaatgtcagcgacgtgatcgatatcatggaaaacctgtacgcaagcgaagagcccgcggtgtatgaaccctcgctgatgacaatgtgtcaggatagtaaccaaaatgacgagcggtcaaaaagcctcctgctgtcggggcaggaagtcccatggctctcatcggtcaggtatgggaccgtggaagatctcctcgcctttgccaatcatatctctaacacagccaaacacttctatggccagcgtccgcaagaaagcgggattttactgaacatggtaatcaccccccagaatggcagatatcagatcgactcagatgttctgctgatcccctggaaattgacctataggaacatcggtagtgacttcatacctcgcggagccttcgggaaggtatacttggcccaagatataaagaccaaaaagagaatggcctgcaaactgatccctgtcgaccagttcaagccttctgatgtggagatccaagcctgtttccgacatgaaaacattgctgaattgtacggggcagttctgtggggagagacagtccatcttttcatggaagcgggcgagggcgggtctgtccttgaaaagctggaatcgtgcggctag

SEQ ID NO: 124797 - DNA, 768 bp, Artificial Sequence
  Description of Artificial Sequence: Synthetic coding sequence
atggagtacatgagtacaggcagcgacaataaggaggaaatcgatctccttattaaacacctgaacgtgtcagacgtcattgacatcatggagaatctatatgcttccgaagaacctgccgtgtacgagcccagcctgatgaccatgtgccaggactccaatcaaaacgatgaaaggtcaaagagtctcctgctgtcaggccaggaagtgccctggctgagttctgtgcgttatggaacagtcgaagatctgttggccttcgctaaccacattagtaacacagccaaacatttttacggccagagacctcaggaatctggcatccttctgaatatggttatcaccccgcagaatggtaggtaccaaattgactctgatgtcttgttaattccatggaagctgacttatcgaaatataggctccgatttcataccccgtggagcatttggcaaagtttacttggcccaagacattaagacaaagaaacgcatggcctgcaagctgatccccgtcgatcagtttaagccttcggatgttgaaattcaagcctgctttcgccacgagaatattgctgagttgtacggtgcggttctgtggggagagaccgtccatctgtttatggaagcaggcgagggaggcagcgtgctcgaaaaactggagagttgcggtcctatgagggaatttgagatcatatgggtgacaaagcacgtattgaaaggactggatttcctgcactctaagaaggtgatacaccacgacatcaagtag

SEQ ID NO: 124798 - DNA, 573 bp, Artificial Sequence
  Description of Artificial Sequence: Synthetic coding sequence
taagtggaggacctgctagctttcgcaaaccatatatctaacactgccaaacatttctacggccagagacctcaggaatccggaatcctgctgaatatggtcatcacccctcagaatggaaggtatcagatcgactctgacgtgctgttaataccatggaaattgacctatcgcaatattggatctgattttatcccgaggggtgcattcggcaaggtgtacctggctcaggacattaagaccaagaagcgcatggcgtgtaagttaattcctgtggaccagttcaagccctccgatgtggaaattcaggcttgtttccgccatgagaacattgcggaactttatggagctgtattgtggggcgaaaccgtgcatctcttcatggaggctggcgaggggggaagtgtgctcgaaaagctggaaagctgcggcccaatgcgggaatttgagataatctgggtaactaagcacgttctgaaaggccttgactttctacacagcaaaaaggtcatacaccacgatattaagcggaaatacttgtggacctacacattccttgctcagcgcgattag

SEQ ID NO: 124799 - DNA, 1404 bp, Artificial Sequence
  Description of Artificial Sequence: Synthetic coding sequence
atggagtatatgtcaactgggtcagataataaggaagagatcgatctgttaatcaaacacttgaacgtgtcagatgtaatcgacattatggaaaacctatatgccagcgaggaacctgctgtatatgaaccttcgctcatgaccatgtgtcaggatagtaatcaaaacgacgagcggtctaaaagcctcttgttgtccggccaggaggtgccctggctgtcttccgtgcggtacggcactgtagaggacttactggcttttgcgaaccacattagtaataccgcaaagcacttttacggccagagaccacaggagtctggaattcttctgaatatggtgattacgccccagaacggaagataccaaatcgacagtgatgtccttcttatcccatggaagcttacttaccgaaatatcggctccgactttatcccgcgaggagcgtttggaaaggtatacctggcccaagatataaaaacgaaaaaaaggatggcgtgtaaactgatcccagtggatcagttcaagcccagcgatgtggaaatccaggcttgcttcaggcatgagaacatagcagaattgtatggcgccgtgctatggggggaaacagtgcacctttttatggaggccggagagggaggttcggtattggagaagctggagtcctgtgggccaatgagagagtttgaaatcatttgggtgaccaagcatgtactcaaaggactggacttccttcatagcaaaaaagtgattcatcatgatataaagccatctaatatcgtcttcatgtccactaaggccgttttagtggacttcggcctgagtgtgcagatgaccgaagatgtgtacttccctaaggatctacgcggcactgaaatttatatgtcccctgaagtcatcttatgtcggggacacagtactaaagcagacatctactcactgggcgctaccctaatccatatgcaaaccggcaccccgccatgggttaagagatatccacgatccgcatacccatcttatctgtacattattcacaaacaagcacctccactggaagacatcgccgatgattgttcaccaggcatgagggagttaatcgaagccagtctggagagaaaccctaatcaccgaccacgggcagctgacctgctgaaacacgaggccctcaatccccctcgtgaggaccaaccaaggtgtcagtcattggactcggccctgcttgagagaaagcggctcctctccagaaaagagctggagctgcctgaaaacattgctgactcctcttgtactggatcgactgaagagagcgaaatgcttaagaggcagcggtcattgtatatcgatttgggggcgctagccgggtactttaacctggttcgcggcccaccaaccctggaatatggctag

SEQ ID NO: 124800 - DNA, 3357 bp, Artificial Sequence
  Description of Artificial Sequence: Synthetic coding sequence
atggaaccttctcgtgccctgctgggctgtctagcctctgccgctgcggctgctccccccggtgaagacggcgccggtgcaggcgcggaggaggaggaagaagaggaagaggaggccgccgctgccgtgggcccaggagaacttggttgcgacgcaccactgccgtactggactgccgtgtttgaatatgaggcagccggtgaagatgagttgacgctcagattgggagacgtggtggaagtcctgagtaaggacagccaggtctcaggcgatgagggctggtggactggccagctcaatcagcgggtcggcatcttcccctccaactatgtcaccccaaggtcagctttcagcagtagatgtcagcccgggggagaggatccttcctgctatccccccatccagctgctggagatcgatttcgccgagctgactcttgaggagattattggtatcggtgggttcgggaaagtgtatcgagcgttctggatcggcgatgaggttgccgtgaaggccgccagacacgaccccgacgaagatattagccagaccatagagaacgtcaggcaggaagccaagctttttgctatgctcaagcaccctaatataattgccctgcgtggtgtgtgcctgaaagaaccgaacctgtgcctggtcatggagttcgcgagaggggggcccctcaacagggtgctgtccggcaaacgcatccccccagacatcctggtaaactgggcagtgcagatcgcgcgaggaatgaactacctgcacgatgaggccattgtcccaatcatccatagggatctgaaatcatcgaacatccttatcttacagaaggtcgagaatggtgacctgagtaataagatcttgaagatcactgacttcggacttgcgcgagagtggcacagaaccactaagatgtctgccgctggcacatatgcatggatggctcccgaggtcatcagggcctcgatgttttctaagggaagtgacgtctggagctacggagtacttctttgggaactcctgacaggtgaagtgccttttcgcggcatcgatggtctggcagtagcctacggggtggccatgaataaacttgccctgccaatcccaagtacctgcccagagccatttgcgaagctgatggaggactgctggaatccagatccccatagccgcccctcattcactaacatcctggaccagctaaccacaatcgaggaaagtggattttttgagatgccaaaggacagcttccactgccttcaggacaattggaaacacgagatccaggaaatgttcgaccagctaagagcaaaggaaaaggagctgcgtacctgggaggaggaactgaccagagcagcccttcagcagaaaaaccaggaggaattattgaggagacgcgaacaggagctagccgagcgcgagattgacattctcgaaagagagttgaatataataattcatcagctgtgccaggaaaagcctcgcgtgaagaagcggaagggcaagtttcgcaaatctagattaaaattaaaggacggcaacaggatctccctccccagtgatttccagcacaagtttacggtccaggcatctcccaccatggataagcgcaagagcctgataaattcacggtccagtcctccagcatctcccactatcattccgagactgagagctattcagctgacgcccggcgaatcgtccaaaacatggggccgctcctcagttgtacccaaagaagagggggaagaagaagagaagcgagctccaaaaaaaaaagggcgcacatggggccccggtacgttaggtcagaaagagctggcatctggagacgaaggcagcccacagaggcgcgagaaggccaatgggctgtccactcctagcgaatctcctcactttcatctaggtttgaaaagtttagtcgatggctacaaacagtggtcctctagcgcacccaatctggtgaaaggcccgcggtctagtcctgcccttccgggctttactagcctgatggagatggcacttctcgctgcgagttgggtggtccctattgatatcgaagaagacgaggattcagaaggccccggaagcggggagtccagattacagcacagcccgtcacagtcctacctctgtataccttttccacggggggaagatggagatggacccagtagtgatggaatccatgaagaacccactccagtgaactcagcgacttccacgccacagctgactccgaccaactcccttaagagggggggcgcacaccacagaagatgcgaggtcgcactcctgggctgcggagctgtgctcgccgccacgggtctgggttttgatctgctggaggccggcaaatgccagctcctgccccttgaagaacctgaaccaccggcaagggaagaaaaaaagcgcagagaaggcttgttccagagaagttccagaccgagacgatccacatcccccccgagtaggaagctctttaagaaggaggaaccaatgctactcctcggggatccatcagcctccctgacattgctcagcctttcaagtatttcagagtgcaactcaacccgaagcctgctgaggtctgatagcgacgagattgtcgtttatgaaatgcctgtctcaccagtggaagctccacctctctccccttgcacacacaatcccctggtgaatgttcgagttgaacgcttcaagagagaccctaaccagtcgctgacacccacacatgtgactctcacgacaccctctcaaccttcctcacataggagaacgccttcggacggggccttgaagcccgagacactcctggctagtaggagccctagctctaacggcctgagcccatcacccggcgccggtatgctgaaaaccccgtcaccaagtcgtgaccctggagagttcccgcggctgcccgatccaaacgtcgtcttccccccaacgccaagacgctggaacacccagcaagacagcacccttgagcgaccaaagactctcgaattccttccaagaccacggccctcggcaaacaggcagcggctcgatccgtggtggttcgtgagcccttcccacgctcgctccacctctcccgctaactcatcctctaccgagacgccatccaacctggattcctgctttgccagcagcagctctactgtggaggaaaggcctggactgcctgcccttctcccgtttcaggctggcccattgccacccacagagcgaaccttgctcgatctcgacgcagaagggcaatctcaagattcaaccgtacccctctgtagggcggagctgaacacccatcgtcccgcgccttatgagattcaacaagagttttggtcgtag

SEQ ID NO: 124801 - DNA, 2463 bp, Artificial Sequence
  Description of Artificial Sequence: Synthetic coding sequence
cttgtgcttatactgcagaaggtggaaaatggggatctgagcaacaagatcctcaagattaccgattttggccttgcacgagagtggcaccggaccactaaaatgtcagcagctggcacttacgcttggatggccccagaggttatcagagcttccatgttcagcaaaggtagtgacgtatggtcctacggggtgctactatgggagcttctgacgggggaggttccgttccgtgggattgatggcctggctgtcgcctacggagtggccatgaataaattagcactgcccatcccttccacatgtccagaaccgttcgccaagctgatggaggactgttggaaccctgatcctcacagcaggcccagctttactaatatcttggatcaactgaccacaattgaagagtccggctttttcgaaatgccaaaggacagttttcattgtctccaagacaactggaagcacgaaatccaggaaatgttcgaccagctgagagccaaggaaaaagagctgcgtacttgggaagaagagctgaccagggccgctctccagcagaaaaatcaggaagaactcctgaggcggcgtgagcaggagttagccgaaagggaaatcgacattcttgaaagagaactgaacatcatcatacaccagctgtgtcaggagaagccaagggtaaagaagcgaaagggcaaattccgtaagagcaggcttaagttgaaggacggcaatcgcatcagtttgcccagtgactttcaacacaagttcactgtacaggcctctcctacaatggacaaaaggaaaagtctgatcaatagccgctcctctccacctgcgtcaccaactataatacctcggttgcgtgctatacagctcactcccggcgagtctagtaagacatggggtagaagcagcgtcgttcctaaggaggagggcgaagaagaggagaagagggcccccaagaaaaaaggaagaacttgggggccaggcaccttagggcagaaggagctggcgagtggggatgaagggctcaaatccctcgttgatggatataagcagtggagttcaagcgcgcctaatctggtcaaaggaccacgttcatcaccggctctgcccggtttcacaagtcttatggaaatggcctgcttttcctccaccctggttatctttactgaagatgaagattcagaaggccctggttctggagagagtagattacagcactcccccagccagtcttatctgtgcattccttttccccggggtgaagatggcgatggccccagttccgatgggatacatgaggaacctacacccgtcaattcagcgacatccacgcctcagctcaccccaactaattccctgaaacgcggaggcgctcatcatcggagatgcgaggtggcactacttggttgcggcgcagtgctggcggctaccggactgggatttgatctgctggaagccgggaaatgccagctcctgcctctcgaggagcccgaaccccctgctagagaagagaaaaagaggcgcgagggcctgtttcagagatccagccgccccaggaggtccacaagtcctccttcaaggaaactctttaagaaggaagagccaatgctactcttaggggacccgtctgcaagcctgacactgctgagcctgtcctccatttctgagtgtaatagcaccagatccctgcttcggtcagattcagacgagattgtagtctatgagatgccagtgagtcctgtcgaagccccccctctgtcaccttgtacacataaccccctggtcaacgtgcgtgtagagcgcttcaaaagggatcccaaccagagcctgacccccacacacgtgacactgacaacaccatctcagccctcttctcatcgaagaactccaagtgacggcgcactcaagcctgaaactcttttagcatcccgatccccctccagtaatggtctgtcaccatcgcccggggctggcatgctcaaaacaccatcaccttcccgtgaccccggagagttcccccgcctgcccgatcccaatgtcgtgttccccccaactcctaggcgttggaacacgcaacaagattcgacgctggaacggcccaagacactggagtttcttcctcgtccacgtcccagcgcaaaccgacagcggttggacccttggtggttcgtgagcccctcgcacgctagaagcacaagcccagcaaatagctccagcactgaaacccccagtaatttagactcatgcttcgcaagttctagcagcaccgtcgaggaacggccaggacttccagcattgctgccgtttcaggccggcccactgccacccacggaacgaacgctgcttgatctggacgctgagggccagagtcaggacagcactgtccctctatgtcgagctgagctcaacacacatcggcctgccccatatgagatacagcaggaattttggagctag

SEQ ID NO: 124802 - DNA, 3315 bp, Artificial Sequence
  Description of Artificial Sequence: Synthetic coding sequence
atggagccgtccagagcacttctgggatgcctggcctctgcagccgccgctgctccaccaggggaagacggtgcgggggctggcgccgaggaagaagaagaggaagaagaagaagcggcggctgctgtaggacccggggagctgggatgcgatgccccacttccatactggacagctgtattcgagtatgaggctgccggggaagatgaattgaccttgaggttgggggatgtcgttgaagtgctgagcaaggacagccaagtgtcgggcgacgaggggtggtggacaggtcaactgaatcagagagtggggattttccccagtaactatgttaccccccgctcagctttcagcagcagatgccagccaggcggggaagatccaagctgttatccaccgattcaactcttggagatcgactttgctgaactcacactcgaggaaatcatcgggataggcgggtttggcaaagtgtatagggcgttttggatcggagacgaagtcgccgtcaaagctgcacgccacgaccctgatgaagacatctcccagacgattgagaatgtccggcaagaggcgaagttgtttgctatgctaaaacaccccaacattattgccctccggggagtctgtcttaaagaacccaacctgtgtctcgttatggagtttgctcggggtggccctctcaaccgagttctatctggaaagcgaatccccccagacatcctggtaaattgggcagtacaaatagccaggggcatgaattatcttcatgacgaggctatcgtacccatcatccatcgggaccttaagtctagtaatattctgatcctgcagaaagtcgaaaacggagacctgtcaaataagattctgaaaatcacagatttcggactggccagggaatggcatcgtaccacaaaaatgagcgccgccggaacatatgcctggatggcccctgaagtaatcagagcaagcatgttttctaagggctccgacgtctggtcttacggcgtgctcctatgggagcttctgaccggggaggttcccttcaggggcatagatggcttggcggtggcctatggcgtcgccatgaataagcttgcgctgcccatcccgagcacctgccccgagcctttcgccaagttgatggaagactgctggaaccccgatcctcactctagaccatcatttaccaacatcctggaccaacttacaacaatcgaggaatccggcttctttgaaatgcctaaggattctttccattgccttcaggacaactggaaacacgaaattcaagagatgttcgatcagctgcgcgcaaaggagaaggagctaaggacttgggaagaggaactgactcgcgccgccctacagcagaagaatcaggaagaattgctgagaaggcgggagcaggaactggctgaaagagaaatagacattctcgaaagggagctgaatatcattatccatcaattgtgccaggagaaaccgcgggtaaaaaagcgcaagggcaagtttagaaaatctagactgaagttgaaggacggcaacagaatcagtctgccgtctgactttcaacataaattcactgtccaggcctcaccgaccatggacaagcggaagtctctcatcaattcacgcagctccccacccgctagcccaacgatcattcctcgtttgagagcgatccaactgaccccaggcgagagtagcaagacatggggtagaagttcggtagtccccaaagaggaaggagaggaggaggagaagagggcccctaagaaaaaggggcgcacttgggggccaggaacgctgggtcagaaggagctggcctcaggagacgagggcagcccgcagagacgagagaaagccaacggactgtccacgccaagtgaatccccacactttcatttggggctcaaatccctggttgatggatacaaacaatggtctagtagcgcaccaaacctggtgaaagggccaaggtcaagcccagccctccccggttttacatcactgatggaaatggaggatgaggacagtgagggcccaggttcaggcgaatccaggctccagcattcacccagccagtcctatttatgtattcccttcccccggggggaagacggcgatggacccagctcagacgggatccatgaagaaccgacgccagtgaactctgccacttcaactccgcagctgacccccacgaactccctcaaacgcggcggggcgcaccaccgccggtgcgaggtggcactgcttggctgtggcgccgtgcttgcggcaactggtttgggcttcgacctgctagaggcagggaagtgccagcttctccctttggaggaacccgagcctccagctcgcgaggaaaagaaacggagagagggcctatttcagcgtagtagccgaccccgcagaagcacaagccccccaagtcgtaagctttttaagaaggaagagcccatgctcctgctaggcgatcccagtgcatctttaactctgctctctctgtctagcatctcggagtgcaactcaacacggtcccttctccgttccgactctgatgaaatcgtggtctatgagatgcctgtgagtccagttgaagctccacctctttctccatgcacacacaatccactggtgaatgtgcgcgtggaacgcttcaagcgagatccgaaccagagtttaactccgactcacgtgacgctgaccaccccgagccagccaagctctcaccggcgaactccaagtgacggtgctcttaagccagagacactcctggcttctcgttctcccagtagtaacgggctgagtcctagtcctggcgcaggcatgctgaaaacaccgtcccctagccgagatccaggagaattcccccgactacccgaccctaacgttgtgttccctcccaccccccgccgctggaatactcagcaagattccaccctggagaggccaaagacattggaattcctgcccagaccgcggcctagtgcaaacagacagcgattggacccttggtggttcgtgagcccgtctcatgcaaggtccacgagcccagctaattctagtagcacagaaacccccagcaacttggactcctgttttgcgtcctcttcctccacagtcgaggaaaggcctggcttaccggccctccttccctttcaagctggcccccttccccctaccgagcgtacccttttggacctcgatgctgaaggtcagtctcaagactcaacagttccactgtgcagggctgagcttaatacccatcggccagctccctacgaaattcagcaagaattctggtcctag

SEQ ID NO: 124803 - DNA, 1005 bp, Artificial Sequence
  Description of Artificial Sequence: Synthetic coding sequence
atggccctgaggtggggaatcgtatctgtcggactgatttcctctgactttactgccgtcctccaaacgttacctcgatccgaacatcaagtggtggcggttgcggcacgggacttgagtcgtgccaaggagtttgctcagaagcacgacattccaaaagcatatgggtcttacgaagagctggcgaaggatccttccgtcgaagttgcatacatcggaacacagcatccccagcacaaggctgccgtgatgctctgtctcgctgctggaaaggccgtcctgtgcgagaaacccactggtgtaaacgccgcagaggtgcgagagatggtggctgaggcccggagccgcgctctgttcctgatggaggccatttggaccagattcttccccgcgagcgaggccctgagatccgtgctcgctcagggcaccctgggggacctgcgggtggccagagccgagttcggaaagaacctgattcatgtgccccgtgctgttgatcgtgcccaggcaggcggcgcgcttctggacatcggaatctactgtgtgcagttcactagcatggtgtttgggggccagaagcctgaaaagatctcagtggtcggacggaggcacgagacaggcgtggatgatactgtgaccgtgcttcttcagtacccaggcgaagtacacgggtcatttacatgctctattactgtccagctgtccaacacagcctcagtatcgggtacaaagggaatggtccagctgctgaatccatgttggtgtcctactgaactggtggtcaaaggtgagcacaaagagtttccgctgccccccgtgcctaaggactgtaacttcgataacggcgcaggcatgagttacgaagccaaacatgtgtgggaatgcctgcgcaaaggcatgaaggaaagcccggtaattcccttgagcgaatcagagctattggccgacatcttggaggaagtcaggaaagctattggagtaactttcccccaagataagcgctag

SEQ ID NO: 124804 - DNA, 2466 bp, Artificial Sequence
  Description of Artificial Sequence: Synthetic coding sequence
atggacgtcgtcgatcccgacatttttaatcgagacccaagagatcactatgatttgctgcaacggcttggtggtggcacttatggcgaggtgttcaaagcaagggacaaagtatctggcgacttagtcgctttaaagatggtcaagatggaaccggacgacgacgtgtcaaccctgcaaaaggagatcctgatcctgaagacttgcaggcacgccaatattgttgcatatcatgggagctatctgtggctccaaaagctttggatctgtatggagttttgcggagccggctccctgcaggacatctatcaggttacaggtagtttaagcgaactgcagatttcctacgtttgtcgagaggtgttacagggactagcgtatctgcactcccaaaagaaaattcatcgggacattaagggggccaacatcctgatcaatgacgccggcgaggtacgtctggcagactttgggatttcggcccagatcggcgccaccctggcaaggcggctgtccttcatcggcacaccctattggatggctcctgaggtggcagccgtcgccctgaaaggaggctacaacgaactttgtgacatttggtcgctcggtattacggcaatcgagctggccgagcttcaacctcccctattcgatgtacatcctttacgggtactattcctgatgaccaaaagcgggtaccagccaccacggctgaaagagaaggggaagtggtcagcagcctttcacaattttatcaaagttacccttaccaagtcccctaagaaaagaccttcagctaccaagatgctgagccaccagctggtaagtcagcctggcttaaacagagggctgattctcgacctgctggacaaacttaagaaccccggcaaggggccctctatcggagacattgaggacgaagagcctgagctgcccccggcaattccccgtagaattagaagtacccacagatcatcatccttgggcatcccagacgcagactgttgtaggcgtcatatggagttccggaaactgaggggaatggagacgcgcccacccgccaatactgcaaggctccaaccacctagagatctacgttcctcatcccccagaaaacagctgtccgaatcctccgacgacgactacgacgatgtggatatccctacccctgccgaggatactccaccgcctctgccccctaaacccaaattcagaagcccttcggacgaaggccccggttcaatgggggacgacggtcagctctcccccggtgtcctcgtccgctgcgcatcaggtccaccgccaaattcgccccgtcctggacccccaccttccacctcctcaccacatctcacagctcactctgaaccctctctgtggaacccgccaagcagggagttggataaaccgcctctgctgcctcctaagaaagagaaaatgaagcggaaaggctgtgctttgctggtgaaattgtttaacggctgccccctgcgaatacacagtactgctgcttggactcatccgagcacgaaggatcagcacctgttactgggggcagaggaggggatttttattctgaaccgtaacgaccaggaagctacattggagatgctcttccctagccggactacttgggtatacagcataaacaatgtcctaatgtccctatctggcaagacgccccatttatactctcactctatcctgggactactcgagaggaaggaaactagagcgggtaaccccatcgcccatatctctccacacaggctcctggcacgaaaaaatatggtctccaccaagattcaggacacgaaaggctgtcgggcctgttgtgtggccgaaggcgctagcagcggcggcccctttctttgtggggcacttgaaacaagcgttgttttgctgcagtggtaccaaccgatgaataagtttcttttggtgcgacaggtgctgttcccactaccaacacccctatctgtgttcgccctgttgacaggccccggctcggagttgcccgcagtttgtatcggagtgagccccgggaggccaggtaaaagcgttctcttccatacggtccgctttggtgcactttcctgttggcttggggaaatgtctacggaacatcggggccccgttcaagtgacccaagtcgaagaagacatggttatggtgctgatggacgggtcagtcaagctggtgaccccggaggggagcccggtaagggggttgcgcacccccgagatacctatgactgaagccgtggaagccgtggccatggtcggcggccagctgcaggccttttggaaacacggagtccaggtttgggccttggggagcgaccagcttctgcaggaacttcgcgatcctacccttactttcaggctgctgggctcacccagacccgttgtggtagagacacggcctgtggacgatcctacagcaccatccaacctctacatccaggagtag

SEQ ID NO: 124805 - DNA, 720 bp, Artificial Sequence
  Description of Artificial Sequence: Synthetic coding sequence
atggaattcagaaaactccgcgggatggaaacccgccctccagccaacaccgccagattacagccccccagggacttgaggtcatcatccccacgcaagcagttgtctgagtcaagcgacgacgactatgatgatgtggatatacctacacctgcagaggacaccccgcccccactcccaccaaagccaaagttcagatcccccagtgacgaagggcccggctcaatgggagacgatggtcagttgtctcctggtgtgctggtgaggtgcgccagcggcccacccccaaactctcccaggcccggcccgccacctagcacaagttctccgcacctgactgcacatagcgagccctccctgtggaaccccccttcccgggagctcgataaaccccctctgctgccacccaaaaaggagaaaatgaagaggaaaggctgcgcccttctggttaaactcttcaacgggtgtccattgcgtattcacagcactgccgcgtggacccacccaagcaccaaagatcagcatctgcttctcggcgcagaggagggcatctttatcttaaatagaaacgatcaggaagctaccttggagatggagaggcctcccacctgtattcttatcgccagtcttgcctgttggaatgggaaacgccctgagcaggagacgccttcactgacactcgcccccacagcctattggcaaggaacatcatcacagtag

SEQ ID NO: 124806 - DNA, 2502 bp, Artificial Sequence
  Description of Artificial Sequence: Synthetic coding sequence
atggatgtagtcgatccagatattttcaaccgggatccccgggaccattatgacctactgcaaagactggggggagggacgtatggcgaagtgtttaaggcaagggacaaggtctctggcgacctcgtcgccctgaagatggtgaagatggagcctgacgacgacgtgtctacactgcagaaggagatcctgattcttaagacctgccgccatgccaatatagtcgcctatcacggcagttatctgtggcttcagaaactgtggatttgcatggagttttgtggagcaggctcccttcaagacatttatcaggttaccgggagcctgtcggagctgcagatctcttatgtttgccgggaggtccttcagggcttggcatacctgcactcccagaaaaaaatacatagggatattaaaggggcaaacatcttgatcaatgatgcaggagaggtacgcctggcagacttcggaatctccgcccaaatcggtgccactttagcccggagactgtcttttattggcacgccatattggatggcgcctgaggtggccgccgtggcactgaaaggcggctacaatgaactttgcgacatatggtccctgggaattactgctatcgagttggctgagctccagcctccccttttcgacgtccacccccttagagtgctctttctgatgacaaaatccgggtatcagccacctcggctaaaagaaaaaggcaaatggtctgccgcatttcataatttcatcaaggtgaccttaacaaagagccccaaaaaaagaccttcggctactaaaatgctgtcacaccaactggtctcccagcccggcctgaatcggggcctgatcttggacctgctggacaagctgaagaatcctgggaagggaccatccatcggtgacattgaggacgaggagccagaattacctccagctatcccccgtcggataaggagcactcatcgctcgagctctctgggtataccagatgctgactgctgccgtaggcacatggagtttagaaagttaaggggcatggaaactagaccccctgctaatacagcccggcttcaacctccgcgagacctgagatctagctcaccacgcaaacaactcagtgaaagtagtgatgatgactacgatgatgtagacatccccacacctgccgaggatactccaccgccacttccaccaaaacctaagttccggagcccttctgacgagggaccaggatccatgggcgacgacggccaactatcccctggagtcttggtgcgttgcgcttctggacctccgccaaattctccacgccccggaccgccgccctccacgtcttccccacacctcaccgcgcactctgaaccttctctgtggaatcccccatctcgtgagttggataagcctcccctgttgcctcctaaaaaggaaaaaatgaaaagaaagggctgcgccctgctggtaaagctcttcaatggctgccccctcaggatccattccaccgccgcctggacacacccatcaacgaaagaccaacacctgctgctgggagccgaggagggtatctttattctgaaccggaacgatcaggaggccaccctcgaaatgctgttccctagtaggacaacatgggtgtactctatcaataatgttcttatgtctctcagcggaaagacaccccatctctatagtcactccattctcggactcctcgagaggaaggagacccgagctgggaacccaatcgcacatatctctccgcacaggctgctggcccggaagaacatggtttccactaaaatccaggatacaaaaggctgtcgggcctgttgtgtggcagagggagcatcttcaggtggacctttcctctgcggagcactcgaaaccagtgttgttctgctacagtggtaccagccaatgaacaaattcctgttggttcggcaggtgctatttcccctgcctacacccctgagcgttttcgcattgctgaccggccctgggtcagagttgccggcggtatgtatcggcgtgtcaccaggacggccaggtaagagcgttctttttcacacagtgaggtttggtgccttgtcatgctggctaggagagatgtctacagagcatagaggccctgttcaagtcacgcaagtggaggaagacatggttatggtgctgatggacggcagcgtgaagctggtcacccctgagggatctcctgtgcggggcctgcggacaccagaaatcccaatgaccgaggctgttgaagccgttgcgatggtggggggacagctccaggccttttggaagcatggcgttcaagtgtgggcgttagggagtgatcagttgctgcaggaactcagagacccaacgctcacgtttagactgctggggtccccccggcttgagtgctccggtactatctccccacactgtaatctgttgcttcccgggagttctaacagtcctgcctcagcaagccgcgtcgccggaattacgggattgtag

SEQ ID NO: 124807 - DNA, 2463 bp, Artificial Sequence
  Description of Artificial Sequence: Synthetic coding sequence
atggccctgctgcgcgatgtatctctccaagacccgcgcgataggtttgagcttttacaacgtgtcggtgccgggacttatggggacgtttacaaggctcgcgatacagtgacaagtgagttagccgcggttaagattgtgaagctagacccaggtgacgacatctcttccctgcaacaggaaataactatactgcgcgagtgtcggcacccaaacgtggtggcttacatcggctcatatctacgcaatgacaggctgtggatttgtatggagttttgcgggggaggctcattgcaggagatttaccatgcgacaggacccctggaggagcgccagatagcatatgtatgtcgagaggcactgaaaggactgcatcatctgcactctcaaggcaaaattcatcgggatatcaagggtgcaaatctcctcttaaccttgcagggagatgtgaagctggctgattttggtgtgagtggagagttaacggcaagtgtggcgaagcggcggagttttattggtactccttattggatggccccagaagtcgctgcagtggagcggaaaggtggttacaatgaattgtgtgacgtctgggctcttgggatcactgcaatcgagctgggagagctccagcccccccttttccacctccacccgatgagggctcttatgctcatgagcaagtccagtttccagcctcccaagctgagagacaagacgcggtggactcagaattttcaccatttcctgaagcttgccctgacgaaaaatcccaagaagcggccaacagccgagaagttacttcagcacccttttacgacacagcagctgccaagagccttattgactcagctgctagacaaggccagcgatcctcacctcggaactccttctcctgaggattgcgagctggagacatacgacatgttcccagacactattcactctcgggggcagcacggccctgctgagaggacaccaagcgagattcagtttcatcaggtgaagttcggggcacctcgaagaaaggagaccgatcctctaaatgaaccttgggaggaggagtggacccttcttgggaaggaggaactgtctggctcactgttacagtccgttcaagaggccctcgaggagagatcactgaccattaggtccgcgagcgagttccaggaattggacagtccagatgatacaatggggaccataaaaagagccccttttctaggaccgctgcccacggaccctcctgcagaagaacccctcagtagccctcccggcactttgcccccaccgccttcaggaccaaatagcagccccttattgcctacagcctgggcaaccatgaagcaaagagaggacccagaacgctcgtcttgccacggtctccccccgacccccaaggtccacatgggagcttgcttttctaaagtgttcaatggctgtccactaagaattcatgctgcggtgacctggatacatcccgtcacacgcgaccaatttctcgtcgtgggcgctgaagagggaatttacactctcaacctccatgagctccatgaagacacattagagaaactcatcagccaccgatgcagctggctctattgcgtgaataatgtgctcctgagcctttccggaaaatcaacccatatatgggcacatgatctgccaggattgttcgaacaacgcaggctacagcaacaggtgccactatctattcctacgaaccggctgacccagcgtataatccctagaagattcgcgctcagcacgaaaattcccgacaccaaagggtgtctacagtgcagggtcgtgcgaaacccatacaccggggccactttcctgcttgccgccctgccaacctctcttctactcctgcagtggtatgagcctcttcagaagtttcttctcctaaaaaacttcagctcccccctgccttccccagcagggatgttggagccgttggtactcgatggaaaagagctgccacaggtctgtgtaggagcagaaggacccgagggtccgggatgtcgggtgctgttccacgtgctgcccctagaagccggtcttacaccagatattttgattcctccggaaggcatccccggatctgcccagcaggtgattcaggtagatcgggataccattctggtctctttcgagcgatgtgttcgaattgtgaacatgcagggcgaaccaaccgcgaccctagcccccgagctgaccttcgattttcccatcgaaacggtcgtttgcttacaggactccgttctcgccttttggtcccacggaatgcaggggagatccctggacactaacgaggttacacaggaaataacagatgaaaccagaatctttcgggtcctcggggcacacagggatattattctggaatccattccaaccgataacccagaagctcatagcaatctctatatcctgacgggccaccaatctacatactag

SEQ ID NO: 124808 - DNA, 2541 bp, Artificial Sequence
  Description of Artificial Sequence: Synthetic coding sequence
atggaagctcctttacggccagccgccgacattctcagaaggaatccgcagcaggattacgagctggtccagcgcgttggctcagggacctatggtgacgtctacaaggctaggaatgtccacacaggtgagctggccgcagtaaaaatcataaagctggaacccggagatgatttctcccttatacagcaggaaatctttatggttaaagagtgtaagcactgtaatatcgtggcttattttggctcctacctgtctcgcgagaaactctggatctgtatggaatactgcggtggtggcagcctccaggacatctaccacgtgaccgggccgctctcggaactgcaaattgcctatgtctgccgcgaaactcttcagggtttggcatatctccataccaagggcaagatgcacagggacatcaagggcgccaacatcctgttgaccgaccatggagacgtgaaactggccgacttcggagtcgccgcaaagataactgctacaatcgccaagcggaagtctttcattggcaccccctattggatggcgcctgaggtcgcagcagtggagaaaaatggggggtataaccaactgtgtgacatctgggctgtcggaattaccgccattgagcttggcgaacttcagcccccgatgtttgatctgcatcctatgcgggcattgttcctgatgtccaaatctaactttcagccaccaaagctaaaggataagaccaaatggtcatccacctttcataacttcgtaaagattgcccttaccaagaaccctaagaagagaccaactgctgagcgtttactcactcacacgttcgtggctcagccgggcttgagcagggcgttggcggtggagctgctggataaggtaaacaatccagacaatcatgctcattacacagaggcagatgacgatgacttcgaaccacacgcgattatccgacacacaatacgctcgactaaccggaacgcacgtgccgagagaactgcttccgagatcaattttgacaaattgcagttcgaaccccccttgagaaaggagacggaggcaagggacgaaatgggactgagctctgacccaaactttatgcttcagtggaacccttttgtggacggtgcaaatactgggaagagcacaagcaagcgggctatcccacccccactgccaccaaagccacgtattagctcttaccccgaggacaattttccagatgaggagaaagcctccacgatcaagcattgtccggattccgagagcagggcccctcaaattctgagaaggcagtcttctccttcctgtggccccgtggcagaaacatcatccattggaaacggtgacggcatctctaaacttatgtctgaaaatactgagggaagtgcccaggcaccgcagctgcccagaaagaaggataaacgggattttcccaagcctgccattaatggtctacctccaacacctaaggttctcatgggggcctgtttttcaaaagtgttcgatggatgccccttaaaaattaattgcgccacctcatggattcaccctgataccaaagatcaatatatcatcttcgggacagaggatggtatttataccctaaatctgaacgaacttcacgaggccaccatggagcagctctttccaagaaagtgcacatggttgtacgttataaataatactctgatgagtttatcagtgggaaagacattccaactctattcccataatctcattgccctgtttgaacacgccaaaaagcccgggctggcagcacatatacagacccaccgcttccctgatcgcatcctgcccaggaaatttgccctgaccactaagatccctgatactaagggctgccataagtgttgtattgttcgaaatccatataccggtcacaaatacttatgcggggccttgcagagtgggatcgtgcttttgcagtggtacgaacccatgcaaaagtttatgttgataaagcactttgatttcccccttcccagtcccctgaatgtgtttgaaatgctggttatacctgaacaagaatatcccatggtctgcgttgcaatttctaaaggtaccgagtctaaccaggtcgttcagttcgaaactatcaacctgaactctgcgagtagttggttcaccgagatcggagcagggtcccagcagctcgacagcatacacgtgacacagcttgaacgcgacactgtcctcgtgtgtcttgacaagttcgtgaaaatcgtcaacctgcaagggaaattgaaatcaagcaagaagttggccagtgagctcagcttcgatttcagaatcgagagtgtggtttgtcttcaggactctgtactcgccttctggaaacacggaatgcaaggaaaatcattcaagagtgacgaggtcacacaggaaatcagcgacgagaccagggtctttcgactgcttggcagcgaccgcgtggtggttctggagagccgaccgaccgaaaaccccacagcccactcaaatctgtacattctggcaggccacgagaatagttattag

SEQ ID NO: 124809 - DNA, 699 bp, Artificial Sequence
  Description of Artificial Sequence: Synthetic coding sequence
atggctacggcggagtcacgggctttgcagtttgctgaaggggcggccttccctgcttatagagctccccatgctggtggcgccctgctgccacccccttcccccgcagccgccctgctgcctgctccacccgccgggcctggaccagcaacttttgcagggtttctgggtcgcgacccgggaccagcaccacctccccccgcctccctggggagccctgcgccaccaaagggggccgcagcaccctcagcctcacagagacgcaaacggaccagtttttccgctgaacaactgcagttgttagaactggtcttccgcaggactcgttacccagatatccacctccgggagaggttggccgctctgacactgttacccgagtctcgcatccaggtctggtttcaaaatagaagagctaagtcaaggaggcagtcaggcaagagctttcaacctctagcccgccctgaaatcatcctaaatcactgcgcaccgggaactgagacgaagtgcctgaagccccagctccccctggaggtggatgtaaactgcctgcctgagccgaacggggttggaggtggcatcagcgatagctcttcacaggggcagaattttgagacatgttctcccctaagtgaggatatcgggagcaagcttgacagttgggaggagcatatcttctccgcctttggcaacttctag

SEQ ID NO: 124810 - DNA, 723 bp, Artificial Sequence
  Description of Artificial Sequence: Synthetic coding sequence
atggccactgcggagtcaagagcactgcagttcgccgagggggccgcctttcccgcctatagagccccacacgctggcggcgccttgctcccgcccccatcacccgccgccgctctgttacctgcccctccagcgggcccgggacctgccacctttgcgggattcctcggtagggatccgggtccagcacccccacctcccgccagtttgggcagccctgctcctcccaaaggtgctgccgccccctctgccagccagcgccgtaagcgcacctcgttcagtgctgaacagctgcagttgctagagctagtgtttcgtcgaactaggtaccccgatattcacttgcgtgaacgattggccgccctcactttgcttcctgagagtcgcatacaactgctctttagtcccctgttccaggtgtggttccaaaaccggcgggcgaagagccgccgacagagcggtaagtcctttcagcctttagcccggccggaaatcatactaaaccactgtgctccaggtactgagactaagtgcttgaaacctcagttgcccctggaagttgacgtgaactgcctccccgaaccgaatggggttgggggcgggatctccgatagctcatcacagggccaaaactttgaaacgtgttcacctctcagcgaggatattggtagcaagctagattcttgggaagaacatatattttctgcttttggcaacttttag

SEQ ID NO: 124811 - DNA, 882 bp, Artificial Sequence
  Description of Artificial Sequence: Synthetic coding sequence
atggccacattcagcgggcccgcaggtcccattttgtccctcaacccgcaagaagacgtcgagtttcaaaaagaagttgcccaggtccgaaagcgcatcactcagcggaaaaagcaggagcaattgacgcccggcgtcgtgtatgtgaggcaccttcctaacctgttagacgaaacccagatctttagctacttttcacagtttggaactgtcacccgcttcaggctcagcagatcaaaacggacaggtaattcgaaaggctacgcatttgtggagtttgagtccgaggacgttgcaaagatagtcgctgaaaccatgaacaactacctgttcggagaaagattgctggaatgtcactttatgccccctgaaaaggtgcacaaagaattgttcaaggactggaatattcctttcaagcagccatcctacccatcggtgaagcgctataacagaaacaggactctcacacaaaagctgcggatggaagaaaggttcaaaaaaaaagaaaggctcctacggaagaagcttgccaagaaagggattgactatgacttcccgtcactgattcttcagaaaaccgagagcattagtaagacgaacagacagacaagcactaagggccaggtcctccggaagaagaaaaagaaagtaagcgggaccctggatacaccagagaaaacggtcgattcacagggccccacgcccgtgtgtaccccaacgttcctggagcgcaggaaatcacaagttgccgagcttaacgatgacgacaaggacgacgaaattgtatttaaacaacctatttcttgtgtcaaggaagagatccaagagacacagacgcctacccacagtagaaagaagaggcggcgaagctctaatcagtag

SEQ ID NO: 124812 - DNA, 1257 bp, Artificial Sequence
  Description of Artificial Sequence: Synthetic coding sequence
atggcccctagaggacggcgccgccccagaccacacagatctgaaggagcccggaggtctaaaaacactttagaacggactcatagcatgaaagacaaagccggacagaaatgcaagccaattgatgtgtttgacttcccagacaactcagatgtgagctccatcggacggctcggggaaaatgaaaaggatgaagagacttatgaaaccttcgacccaccgctacactctaccgccatctatgctgacgaagaggagtttagtaagcactgcggtctgagcctgtcttcaacacccccagggaaagaagccaagcggagttcagataccagcggtaacgaggcctctgaaatcgagagcgtgaagatctcagcaaaaaaacccgggagaaaactcagaccaatcagcgatgactcagaaagcattgaggaatctgatacgcgaaggaaagtcaagtccgcagagaaaattagtacacaaaggcacgaagtgattagaacaactgcaagttctgagctgtctgagaagcctgcagaatccgtcacatccaagaagaccggccccctgtctgcacagcccagcgttgaaaaagaaaacctagccattgaaagtcagagtaagacccaaaaaaaaggcaaaattagtcatgacaaacgaaaaaagagccgctcaaaggcaatcggatccgacacttcagatatcgtgcatatatggtgtccagagggaatgaagacgtcagatatcaaggaacttaatatcgtgctgcccgagtttgaaaagacccatttggagcatcaacagagaatagaaagcaaagtctgtaaagctgcgatagccaccttctatgttaatgtgaaggaacaatttatcaaaatgctgaaggagagccagatgcttaccaatctgaaaagaaaaaatgctaaaatgattagtgatatcgaaaaaaaacggcaaaggatgatagaagtgcaggacgagctgctacgtcttgagccccagctcaaacagctgcagacaaagtacgacgagctcaaagaacggaagtcatcgctcagaaacgctgcctacttcttgtccaatcttaaacagctctaccaggactattcagatgtccaagcacaggagccaaacgtgaaggagacctatgattctagttcattacccgcactccttttcaaggccaggacacttctcggagccgaatctcatttgcggaatattaatcatcagctggaaaagttactggatcagggatag

SEQ ID NO: 124813 - DNA, 963 bp, Artificial Sequence
  Description of Artificial Sequence: Synthetic coding sequence
atggcacctagaggcagaaggaggccacggccccacaggtccgagggcgccaggagatcaaaaaataccttagaacgcactcactcaatgaaagacaaagccggccagaagtgcaagcctatcgacgtttttgattttcctgataattcggacgttagcagtattgggcggctgggggagaatgaaaaagatgaagaaacatatgaaacttttgatcctccactccatagtaccgctatatacgccgacgaggaggaattttcaaaacactgtggactcagcctttcatcaacacctccgggaaaagaggccaaaaggagctcagataccagtggcaacgaagccagcgaaattgagtctgtgaagatttccgctaagaagccgggcaggaaactccgccccattagcgatgactccgagtcaatagaggaatcagatactcgccgcaaggtgaagagcgcagagaaaatcagcacccagcgtcatgaggtaattcgcaccacggcttcctccgaattgtccgaaaagcccgcagagagcgtgacatcaaagaagactggacccttgagtgcacaaccgtccgtggaaaaggagaacctagcaattgagagtcaatctaaaacccagaagaaaggtaagatttcccacgataagagaaagaaatcacggtccaaggccattgggagtgatacgtccgatatcgtccatatctggtgcccagaagggatgaaaacctcagatatcaaggaactgaatatcgtgttaccagagtttgagaagacacatctcgagcaccagcagcgcatcgaatcgaaggtatgtaaggccgccatcgcaaccttctatgtcaacgtgaaagaacagttcataaagatgctgaaggaaagccaaatgctcaccaatcttaagcgcaagaatgctaaggtaagagctactgctgaaacaacaaccaataaaatctag

SEQ ID NO: 124814 - DNA, 963 bp, Artificial Sequence
  Description of Artificial Sequence: Synthetic coding sequence
atggccccgaggggccgtcgccggcccaggcctcaccgatccgagagtgctcgcaggtccaagaacaccttggagcgcacacactctatgaaggataaagctggccagaaatgtaaacctatagatgtcttcgacttccccgacaactctgacgtctcctctattggcaggttgggagaaaacgaaaaggacgaagagacttacgagacattcgatccaccactgcacagtacagctatttatgcagatgaagaggagttctcgaagcattgtggactttctctttcctcaactccccccggcaaggaggctaaaaggagtagcgataccagcggtaacgaggcctcggagatagagtccgtcaagatctcggctaaaaagccgggccggaaattgagacccatcagcgatgattctgaatcgatcgaagagtcagataccaggagaaaggtcaaatccgctgagaagatatccacgcaaaggcacgaagttattcggaccacagcctccagcgaactgtccgagaaacctgccgagagtgtgacctccaaaaaaaccgggcctttgtcagcacaaccctcagttgagaaagaaaacctggctattgaatcccaatccaaaactcagaagaaggggaaaatcagccacgacaagcgcaaaaaaagcagatccaaagctatcggcagcgacacatccgatatcgtccatatctggtgtcctgagggtatgaaaacttcagatatcaaggagctgaacatcgtcctgcctgaattcgagaagacccatttagagcaccagcagcgcattgagtccaaagtttgcaaggctgcaattgccactttttatgtgaatgtgaaggagcagtttattaagatgcttaaggagtcccaaatgctcaccaacctgaaaagaaaaaatgctaaagtcagagcgacagccgagaccacaacaaataagatttag

SEQ ID NO: 124815 - DNA, 1014 bp, Artificial Sequence
  Description of Artificial Sequence: Synthetic coding sequence
atggctccccgcggacgacgacggccccgcccccacagatcagagggagcccgccgaagtaaaaacacactggaacgcacacactctatgaaggacaaggctggccagaagtgtaaacccattgatgtgttcgacttccccgataacagcgatgtcagcagcatagggcggcttggtgaaaatgaaaaagatgaggagacatacgaaactttcgatcccccactgcatagcacggcgatctatgcggacgaggaagaattctcaaagcattgtgggttgtcactcagtagtacccccccaggaaaggaggccaaacggagttctgacacgtccggcaatgaagccagcgagatagagtcagttaaaattagcgcaaagaaacctggacggaaacttcggcctatttcagacgactccgagtcgatcgaggagtcggacacccggaggaaggtgaaaagcgccgaaaaaatctctacccagagacacgaagtgatccggacaactgcatctagcgaactgtctgagaagcccgccgagtctgttacgtctaagaagaccggcccattgtcagcccaaccatcagtggaaaaagaaaatctagctatcgaatcacagagtaaaactcaaaaaaagggaaagatctctcacgacaagaggaaaaagtcaagatccaaagctatcggctcagacacttccgacatcgttcacatttggtgccccgagggaatgaagactagtgacatcaaggaactgaacattgtcctgcccgagtttgagaaaacccatctggagcatcaacaacgcatcgaatccaaagtctgtaaagcggcaatagctaccttttatgttaacgtgaaggaacagtttattaagatgctgaaggaatcgcagatgctgaccaacttgaaaaggaaaaacgcgaaaatgatttctgacatcgaaaagaagcgacaacgtatgatagaggtgcaagacgagctgctacgcctttggactggggctggcctctggtag

SEQ ID NO: 124816 - DNA, 2760 bp, Artificial Sequence
  Description of Artificial Sequence: Synthetic coding sequence
atggcggccgatgtctttatgtgctctcccaggaggcccagaagcagaggtcgtcaggtgctgctcaaaccccaagtctccgaggatgatgacgattcagataccgacgagcccagtcctccacccgcaagcggggccgccacgcctgctcgggcccatgcatctgccgctccacctcccccccgcgctggccctggacgcgaggagccaccccggcgccaacaaataatccattctggtcattttatggtgtccagcccccatagggaacaccctcctaagaagggttatgattttgacaccgtcaacaaacagacctgtcagacctattccttcggaaagacctcttcttgccacctgtctatcgacgcttccctcacaaagctctttgagtgtatgacactggcgtactcaggaaagctcgtctcccctaaatggaagaatttcaagggtctgaagttgcagtggagggataagatccgacttaacaacgccatctggcgagcttggtatatgcagtacttggagaagcggaagaaccccgtgtgtcatttcgtgacccctctggacgggagcgttgatgtggatgaacaccggagacctgaagcgataactacagagggcaaatactggaagagtcgaattgagatagtgatccgggaataccataagtggcgcacctactttaagaaacgattgcagcagcacaaggatgaggacctgtcaagcttggttcaggatgatgacatgctttactggcataagcacggcgacggatggaagactccagtccctatggaagaagatccactgttagatactgacatgttaatgtccgaattttccgacacactgttctccactctgtccagccaccagcccgttgcctggcccaacccgagagaaatcgcacacctggggaacgccgacatgattcaaccaggtctgatcccactccaaccaaatctggatttcatggacacattcgagccatttcaggaccttttctcaagctccaggagtatttttgggagcatgttacccgctagcgcaagtgcccccgtgccagacccaaataatccacccgcccaggagagtattcttcccactactgctctgcctacagtttcacttcctgatagcctgatcgctccgcctacagcaccctccctggcccatatggacgaacaaggctgtgaacatacatctcgcacggaggatcccttcatacaaccaacagactttggacctagcgagccacctctgtccgtgccacagcccttcctcccggtgttcaccatgccactgctgagcccgagtccggcccctccacctatttcacctgtgctccccctggtgccaccacctgctacagctcttaacccaccagcgcctccaacgttccaccagccccagaagttcgccggagtaaataaagctccctccgtcatcacacacactgcctctgctacactcacccatgatgcgcctgctactacattttcgcagagccagggcttggtcatcacgacccaccaccctgcccccagcgccgccccttgcggacttgccctgtcgcctgtgactcgccctccgcagccacggctgacctttgtgcacccaaagcctgtttcacttaccggcggccgcccaaagcaacctcataagatcgtgcctgctcccaagcctgagcctgtgagcctggtcctaaaaaatgcccggattgccccagcggccttcagcggacagccccaagccgtgattatgacgtccgggcctctgaagcgagaaggaatgctagccagtacggtctcacagagcaacgtcgtcattgcccccgccgcaatcgcccgcgctcctggagtgcctgaattccattcgagtatcctcgtaaccgatctgggacatgggacttcatcacccccagctccagtatcccgtctgtttccttccaccgcccaggacccactggggaagggagagcaagtccctcttcatggtgggtcaccacaggttacagtcacaggccctagccgcgactgccctaactctggccaggctagtccgtgcgcgagcgagcagtcgccttctccccagtccccccagaacaattgtagcggaaagtctgacccgaaaaacgtggccgctctgaagaaccggcagatgaagcacatttcggctgagcaaaagcgccgcttcaatatcaaaatgtgcttcgacatgttgaactccctcataagcaataattctaagttgacgtctcatgcgataactctccagaagactgtggagtacattacaaagctgcagcaggaacggggccagatgcaggaggaggcccggcgcctgagggaagagatcgaagagttaaacgcaacaattatctcctgccaacagctgctgcctgcgacaggtgtccctgtgacccggcgtcaattcgaccacatgaaagacatgtttgacgaatacgtgaaaactcggaccttgcagaattggaaattttggattttttccataatcataaagcccttgttcgagagctttaaaggaatggtctctacttcttctctggaggaactgcaccgcaccgctctgtcctggctggatcagcattgcagcttgccaatcctgcgaccaatggtcctgagcacacttcgccagctgtctacttccacttctatcctcaccgaccccgcccagctgccagaacaggcatcaaaggctgtcacgagaatagggaagcgtctcggcgaaagctag

SEQ ID NO: 124817 - DNA, 657 bp, Artificial Sequence
  Description of Artificial Sequence: Synthetic coding sequence
atggatgagcaaggatgcgagcacactagccgaacagaagacccattcatccagccaacggactttgggccctctgagccaccgctttcagtacctcccccccctatttcccctgtgttaccactcgtgcctccccccgctacagcgctgaacccccccgcgccccctacgtttcaccagcctcagaagttcgcaggcgtgaacaaggctcccagtgtcatcacccataccgcctctgcgacccttactcacgacgcccctgcgaccacctttagtcaatcacagggtctggttattaccacccaccaccccgcaccctcagccgcaccatgtggtcttgctcttagccctgtcactagaccccctcagccaagacttactttcgtgcacccaaaacctgtctcactgacgggaggacggcctaagcagccccacaagattgtccccgcaccaaaaccggagcctgtgtcactggtgctgaagaacgcaagaatcgcccccggtgagcccggcggtgaaacgcagtgcggagccccgcctgatccagagggatgctttcctatcccaaaagccttcaagcttgtgaccactaccactaccctcgtgtgtacgtgcatgaggactcacatccatctgaacgagacgaaagtgtcatag

SEQ ID NO: 124818 - DNA, 1581 bp, Artificial Sequence
  Description of Artificial Sequence: Synthetic coding sequence
atggacgaacaaggctgtgaacacacatccaggactgaggatcccttcatccagccaacagattttggcccctcagagccccccctttcggtaccccaacctttcctacccgtgttcaccatgccccttctttcccccagccctgcacctccacccatatctccagtgttgcccctcgtgccaccacctgcaaccgctttgaaccccccagcccctcccactttccaccagcctcaaaagttcgctggagtgaataaagcaccatccgtgatcactcatacagcctcggccacacttactcacgatgctcctgcgaccactttttcacagtctcaaggacttgtgatcacaacacaccaccctgccccatctgcagctccatgtgggttggcactgtctccagtgaccaggccccctcagccgcgattaacttttgtgcaccctaagcccgtttctttaactggtggccgtcccaagcagccgcacaaaatcgttccagcacctaagcctgaacccgtctcgctggttctgaagaatgctcgaatcgctcctgctgccttctctggtcagccccaggcagtcataatgacttctggcccccttaaaagggaggggatgttagcatcgacagtcagccagtccaacgttgtgatcgctcctgctgcaatcgctcgagcaccaggagtgccagaatttcactcaagtattctggttacagatctgggccatggcactagttcaccgccagccccagtgagtaggctgttcccatcaaccgcacaagaccctctaggtaagggcgaacaggtacccctgcacgggggtagtccccaggtgaccgtcaccggccctagccgtgactgtccaaattccggccaggcctccccttgcgcttcggagcagtccccgagcccccagtctccccagaacaactgcagtggtaaatcggacccgaagaacgtggccgccttgaaaaaccgacagatgaagcatatcagcgcagagcaaaagcggcggtttaacatcaagatgtgcttcgacatgctgaactccctgatatcaaataattccaagctgacttctcacgctattaccctgcaaaaaaccgtcgagtacatcacaaaattgcagcaagagcgcggacagatgcaagaagaggcccgacgactccgcgaggagatcgaagaactgaatgcaactattatctcctgtcaacaactcctccctgcaactggcgtccccgtgactaggaggcagttcgaccacatgaaggacatgttcgatgagtacgtgaagacgaggaccctccagaattggaaattctggatcttctccatcattatcaagcccctgttcgagtctttcaagggaatggtgtctacgtcatcactcgaggagctgcataggactgccttgtcctggctcgaccaacactgctcacttccaatcctgcggccgatggtgctctcgactcttcgccagttgagcaccagcaccagtatcctgactgatccggcccagctccctgaacaagcatccaaagccgtgacccgaatcggaaagcggctgggagaatcttag

SEQ ID NO: 124819 - DNA, 2559 bp, Artificial Sequence
  Description of Artificial Sequence: Synthetic coding sequence
atggcaggtgccctggctggtctggctgccggcctccaggttccacgggtggccccctcccccgattcagattcagatacagattcagaggatccttctctccggcggagcgcgggggggctgcttagatcgcaagtaatccattccggccactttatggtgagcagcccgcatagtgactcattgcctcggagacgggaccaggaggggtctgtgggcccgtcagacttcggacctaggagcattgatccaaccctgacgaggctgtttgagtgtttgagtcttgcttatagcggcaagcttgtgtccccaaaatggaagaattttaaaggcttgaagttattatgcagagataaaatcaggctgaataatgctatctggcgggcctggtacatccaatacgtgaagagaaggaaaagcccagtgtgcggatttgtgaccccactccagggaccagaggcagacgcccaccggaagcccgaggcagtcgtacttgagggtaactattggaagcgtcgaattgaggtggtcatgcgcgaataccataagtggcgaatctactacaagaaaagattaaggaaaccatccagggaagacgatctgttggcccccaagcaggccgagggtagatggcctccccctgaacagtggtgtaagcaacttttttcttccgtggtgccggtgctgctgggagacccagaggaggaacctggaggtaggcaactgttagatctgaattgttttctgtctgatatcagcgacaccctctttaccatgactcagtcaggcccatcccctctgcagctcccacccgaggacgcatatgtgggcaatgccgatatgattcagcctgatttgacacccctgcagcctagtctggacgacttcatggacatctccgacttcttcactaattctcggctgcctcagcctcccatgccttccaattttcctgagcccccctccttttccccggtagtggactcgttgttttcctctgggactcttggtcccgaagttccccctgccagctccgcaatgactcacctctccggccacagcagactccaagccaggaatagctgtcccgggcctttggactcaagcgcattcctcagctcagactttctcctgccggaggaccccaaacctcgcctgccacctccccccgttccccctcctctgctgcattatcctcctcctgcaaaggtccccggtttagagccctgcccacccccccccttcccccctatggctcctccaactgctctgctacaggaagaacccctgttctccccacggttcccatttcctaccgttccacctgcccccggcgtctcccccctgccggcgccggccgccttcccgcccacgcctcagagcgtccccagccctgctcccactccattccccatcgaactgctccccctcgggtattctgaaccggcttttgggccatgttttagtatgccccggggaaagccccccgccccttcacctagaggccagaaggcgtctcctcctaccctggccccagccaccgcttcacctcctaccactgctggaagcaataatccatgtctgactcagctcctgactgcagccaagcctgagcaagcactcgaaccacccctggtcagctcaacccttttacgttctcctggatcaccccaggaaaccgtcccggagtttccatgcacctttctgcctccaacccctgctcctacaccacctcgccccccacctggacctgctaccctggctccctctcggccactgctggtaccgaaggccgagcgactgagtccacccgcacctagcggcagcgagcgcagattgtccggggatctctccagcatgccaggccccggtactctcagcgttcgcgtgtctcctccccaacccattctgtcaagaggccggccggatagtaacaagaccgaaaataggagaattacgcacatttccgccgaacagaagagacggttcaacatcaaacttggctttgataccctgcacggcctagtgagcacactttccgcacaacctagtctaaaagtttcaaaggccacaaccctccagaaaacagctgaatatatcttgatgctgcagcaagaaagggccggcctgcaagaggaggcacagcagctgagggacgaaatcgaggagctaaacgcagctatcaatttgtgccaacaacaactgccagctacaggcgtacctatcacacaccaacgcttcgatcagatgagagacatgttcgatgactacgtgagaacacgcacactgcacaattggaaattctgggtgttttcaatcctgattcggcccctgtttgagtccttcaacgggatggtgtccacagcgagtgtccataccctcagacaaacctccctggcctggcttgatcagtactgtagcctgcccgctctcaggcccaccgtgctcaattctctgcgtcagcttggcacaagtacctccattctgaccgaccctggccgcattcccgaacaagcaacgcgcgccgtcaccgaggggacacttgggaagccactgtag

SEQ ID NO: 124820 - DNA, 2496 bp, Artificial Sequence
  Description of Artificial Sequence: Synthetic coding sequence
atggccggagctctggccggcttggctgccggcctgcaggtgcccagagttgcgccatctcctgacagtgattctgacacagattctgaagacccttcattaagacggagtgctgggggcctactgcgttcccaggtgatacattctggccatttcatggtgtctagtcctcactcagattccctccccaggcgacgagatcaagaggggtccgtaggaccctctgatttcggtccacggagcatagaccctacattaacacggctctttgagtgtttatcattggcttactctggtaagttagtgtccccaaagtggaagaattttaagggactcaaattgctttgccgggataagattaggctcaataacgctatctggcgcgcttggtacatacaatacgtgaaacggagaaaaagcccagtgtgcgggttcgtgacgcctttgcaggggcctgaagccgacgcccacagaaaacctgaggctgtggtgttagagggcaattattggaaacggcgaatagaggtggtgatgagggagtaccacaaatggcgcatctactacaaaaagcgtctccgaaagccctcccgggaagacgacctgctggcgccgaagcaggcagaagggaggtggccccctccagaacagtggtgtaagcagctcttcagctccgtcgtcccggtgctgctgggagatcctgaagaagagccaggaggcaggcagcttctcgatttgaattgtttcctgtcggatatatctgacaccctgttcaccatgacccaatcgggaccttcccctctgcagttacctcctgaggacgcctacgtgggcaacgctgatatgatccagccagacctgactcctctgcagcccagcctggatgacttcatggatatctccgacttttttaccaattctagactacctcagcctcccatgccctccaatttccccgagccccctagtttttcccctgttgttgactccctcttctccagcggcaccttgggtcccgaggtgccgcctgcctcttctgccatgactcatctctcaggacatagtaggctccaagcaaggaactcttgccctggtcctctcgatagtagcgcttttctgtcctccgattttttgttacctgaggacccgaaaccgcggctaccacctccgcccgtcccgccccccttgctacattaccccccgccagcgaaggtgcccggtcttgagccttgccctccccccccctttcctcctatggcccctcccacagcattacttcaagaagaacccctgttttcaccccgcttccctttccccactgtcccaccagcccctggagtttctccattgcctgccccagcagccttccctccaacaccccagagtgtgcccagtcctgcacccacgcctttccctatcgagctccttccgctgggctattctgagcccgccttcgggccttgtttctcaatgcccagagggaaacccccagcgccaagcccacgaggccagaaggcaagccccccgacacttgccccggccaccgccagtcccccaactaccgccggttccaacaacccatgtctgactcagctactcacagctgccaagccagagcaggccctcgaacctccgctggtgtcatcgactctgctacggtctcccgggtcccctcaggagacagtaccggaatttccttgtactttcctcccacccacccccgcacctacccccccccggcctcctcctgggcctgcaacacttgcaccttcacgtcctctgctggtcccaaaggctgaacggttaagtccacctgccccatcgggctccgagaggagactgtccggtgatttgtctagtatgccaggccccgggaccttgtctgtgagggtgtcgcccccgcagccaatcctgtcacgcggtcgccccgactcaaacaaaaatcgacggatcactcatattagcgccgaacagaagaggaggtttaacattaagctgggttttgataccctgcatggactggtgagtacccttagcgcccaacccagcctcaaagagcgcgctggacttcaggaagaggcacagcagctccgtgacgaaatcgaagagttgaacgctgccattaacctgtgccaacaacaactccccgcaacaggcgttcccattacccatcagcgctttgatcaaatgcgtgacatgtttgatgattacgtccgaaccaggaccctgcataattggaaattttgggtgttcagcattctaatccgccctctgttcgagtccttcaacggcatggtaagcacagcttccgttcacaccctgcgccagaccagtctggcctggcttgaccagtactgctctttgcctgcccttcgtccaaccgtattaaacagtctgcgccaattaggtacctctacgtccatactgaccgatcccggcaggataccagagcaggcaacaagggccgttactgaagggacgttgggaaagcctctttag

SEQ ID NO: 124821 - DNA, 2280 bp, Artificial Sequence
  Description of Artificial Sequence: Synthetic coding sequence
atggcaggcgccctggctggcctggctgcagggcttcaggtgccgagggtcgccccttcgcctgacagcgactcagacacggacagcgaggacccgagcctgcgcaggagcgctggaggcctgctgcgctctcaggtgatccacagcggccactttatggtgagctccccacattccgatagcttgcccagaaggagggatcaagagggatcggtcggacctagtgactttggccccaggtccattgatcccactcttacgcggctgtttgagtgcttgtctctggcctatagcggaaagcttgtaagccccaaatggaaaaacttcaagggtctgaagctgttgtgccgcgataagatacgcctcaacaacgcgatttggcgagcttggtacatccaatatgtaaaaagacgcaagtccccagtgtgcggattcgtgaccccccttcagggccccgaggcagacgcccaccgcaaacctgaggccgtagtgctcgaggggaactattggaaaagacggatcgagttaccccccgaagacgcttacgtggggaacgcagacatgattcaacctgacttgacgccattacagccctcccttgatgattttatggatatttccgatttttttacaaattcaaggctacctcagcccccaatgccctctaatttcccagagcccccaagttttagccccgtggtcgacagcttgttcagcagcggaacattggggcccgaggtgccacccgcctccagcgccatgactcatctaagcgggcacagccgactacaggcccggaacagctgccccggccccctggacagttcggcgtttctcagttcagactttcttttgccagaggatccgaaacccagactacctccgcctccagtcccaccaccattgttgcattaccctcccccagcaaaagtccctggtctggaaccctgcccaccgcccccatttcccccaatggctcctcctactgcccttttacaggaagaaccacttttctccccccggttcccgtttccaactgttccaccagcaccgggggtttcccctctgccagctcctgctgcgttccccccaacccctcaatctgtcccctcccctgcaccaaccccttttcccatcgaactactgcccctaggttacagcgagcctgcattcggcccttgcttttctatgcccaggggtaagcctcccgcaccctctccccgagggcaaaaggccagtcccccgacactggcccctgcgactgcgtcacccccaaccactgccggcagcaataatccctgtcttacccagctactgacagctgctaagcctgagcaggcgctggaaccgccactggtgagttccaccctgctgcgaagccccggatccccccaggaaaccgtgccagagtttccctgcacctttctgcccccaactcccgcccccacccctcctagaccccccccaggccccgcgacactggctccctcaaggcccctcttggtgcctaaggcagaacgactgtctccacccgcaccatccggcagcgaacgtcgcttatcaggggacctatcttccatgccagggccaggtaccttatccgtccgggtgtctccccctcagcctatcctcagcagaggtcgccctgactcaaataagactgaaaatcgacggatcacccatatctcggcggaacagaaaaggaggttcaatataaaattgggatttgatacgctgcacggcctggtcagtacgctcagtgcacaaccttccctcaaggtctctaaagctactacccttcagaaaacggccgaatatattctgatgctccagcaggagagggcggggcttcaggaggaagctcagcaacttcgggatgagattgaggaactgaacgccgcaatcaatctctgtcagcagcaacttcctgcaactggggtgcccattacgcaccagagatttgatcagatgcgcgacatgttcgatgactatgtacgcacaaggactcttcataattggaaattttgggtgttttccattttaatcaggcctctgtttgaaagcttcaatgggatggtgagtacagctagtgtgcacacactacgacaaactagtctggcctggttagaccaatattgtagcctgcccgccttgcggccaaccgtgttgaattctctgcgccagctcggcacgtccacgagcattcttaccgaccccggacgtattccagagcaggctactagagcagtcactgaaggcacccttggcaagcccctttag

SEQ ID NO: 124822 - DNA, 2553 bp, Artificial Sequence
  Description of Artificial Sequence: Synthetic coding sequence
atggctggcgccctggccggcctagccgctggcctgcaagtacctcgggtcgcacctagtcccgacagtgattcagacacggattctgaagacccttctttgcgccgttcggccggtggtctgctacgctctcaagtcatccactctggtcatttcatggtttcgtctccccattcagactccctcccgcgacggcgagaccaagagggctccgtcggacctagtgacttcgggccccggtccatcgatcctacgctgacgagactgttcgagtgcctcagcctcgcttattccgggaaacttgtctcaccgaagtggaaaaatttcaaaggcctcaagctgctttgtcgggataaaattcgactgaacaacgcaatttggagagcgtggtacattcaatatgtcaaacgacgcaaaagccccgtctgcgggtttgtgacacctctgcagggccccgaggcggacgcccaccggaagcctgaagccgtggtgctcgagggcaattattggaaacgtcggattgaagtggtgatgcgcgaatatcataaatggcgtatatactataaaaaaagactaaggaagcctagcagggaggacgatttgttggcccccaagcaggctgagggaaggtggccaccaccagaacagtggtgcaagcagctgttctctagtgtggtgcccgttctcctcggcgatcctgaagaagagcccggcgggcgccaactactggatctgaactgcttcctttccgatatcagtgacacactgttcacgatgactcagtctggaccttcccccctccagctgccacccgaagacgcctacgttggaaacgcagatatgatccaaccagacctgaccccgcttcagccaagtctggacgacttcatggacattagcgacttcttcaccaacagtaggctaccccagccaccaatgccatctaattttccagagccgcccagcttcagccccgtcgttgattccttatttagcagtggtactctgggtccggaagtccccccagcatcttccgctatgacacatttgtccggccactctcgattgcaagctcgaaacagctgtccaggtcccctggacagtagcgcgttcctcagtagcgattttctgttaccagaagatcctaagccccgcctgcctcctcccccagtgcccccgccactcctccattacccgccacccgcgaaggtcccgggactcgagccttgtccgcctcccccattcccaccaatggcccctccgactgcccttcttcaggaggagccactgttctcaccgcgattccctttccccacagtgcctcctgccccaggagtgagtcctctgcccgcgcctgcagccttcccccccactccgcaatcagttcccagcccagccccaacgccgttccctatagagcttctgccgctgggatactccgagcccgcttttggcccatgcttctccatgcctagggggaaaccccccgcaccaagtcccagggggcaaaaggctagtccaccaacattggcccctgcaacagcctccccccccactactgcgggatcgaataacccctgcctaacccagctgctgactgctgccaagcccgagcaggctctggagcctcccctcgtctcatctacgctccttcgttccccgggctcacctcaggaaactgtgcctgaatttccttgcacctttctgccgcctacccccgcacctacacccccccgtcccccaccgggcccagcaacgctggcgccatctcggcctctactcgtgccaaaagcagaacgcttatcaccccctgccccaagcggctcagagagacggctgagtggagatttgagctccatgcccgggcctggaacattatcggttcgggtcagccctccacagcctatcttgtctcggggcaggccggatagcaacaaaaaccggcgcataacccatatctctgcagaacagaaacgcaggttcaatatcaagctaggttttgataccctgcatggcctggtgagcacactctccgcacagccgtctctcaaagtgtcgaaagctacaactcttcagaaaactgctgagtatatcctaatgctacagcaggagcgggccggactccaggaggaggcacagcagctgcgggatgaaattgaagagctgaacgccgccatcaacctgtgtcagcagcaattaccagccaccggggtccctatcacccatcagcgctttgaccagatgagggacatgtttgacgattatgtgaggactcggacactgcataactggaaattctgggtattctccatcttaatccggcccttgtttgagtcctttaacggcatggtgtcaactgcctccgtgcataccctccggcaaactagcttggcttggcttgatcaatattgttcactgcccgccttgcggcctactgtactcaacagccttagacagctggggacatcaaccagcatcctcacggaccccggccggattccagaacaggccacaagagcagtgactgagggcacgctggggaagccgttgtag

SEQ ID NO: 124823 - DNA, 2502 bp, Artificial Sequence
  Description of Artificial Sequence: Synthetic coding sequence
atggccggcgctcttgctggcctggccgctggtttacaggtccctagagtggccccaagccctgacagcgacagcgacacagacagcgaagatccaagcttacggaggtcagctggaggcctgctgaggtctcaggttattcattctggacacttcatggtgtcttccccccacagcgacagcctgccccgccgacgcgaccaagaggggtctgtgggaccctcagacttcggacctaggtccatcgatcctacattgaccaggctgttcgaatgtctgagcttggcgtactcaggcaaattggtgagccctaaatggaaaaattttaagggcctgaagctcctctgtcgggataaaatccgacttaacaatgcgatttggagggcgtggtacattcagtacgtgaagcgtcggaagtcacccgtttgtgggtttgttacccctttgcagggccccgaggcagacgcgcaccgcaagccggaggccgtggtcttagaggggaactactggaagcgcagaatcgaagtcgtgatgagagaatatcacaaatggagaatttattacaagaagagactgaggaagccgtcacgggaagacgacttacttgctcctaagcaggccgaggggaggtggccaccgcccgaacaatggtgtaagcagctcttttcctctgtggtccctgttctcttgggcgatcccgaagaggagcccgggggacggcaactgctggacctgaattgcttcctgtccgacattagcgacacactgtttaccatgacccaatccgggccttcacctttacagctaccaccagaagacgcgtacgtcggtaatgctgatatgattcagccggacctcacccctctgcagcctagcctggatgattttatggatatatccgacttcttcactaattcccgactgccacagcccccaatgccctccaactttccagagcctccatcgtttagtcccgtcgtcgactccttgttctcttccggcactttaggacctgaagtaccgcccgcatcctccgccatgacacacttaagtggccacagtaggctgcaggcgagaaattcctgcccgggaccgctggatagttctgcattcttatcgtccgacttcctactgcccgaagatcccaaaccacggctgcctcctcctcctgttcctcctcctctgttgcattacccccccccggctaaagtgccgggcctggaaccttgccccccacccccctttcctcccatggcaccccccacagcactgctgcaggaagagcctctgtttagtccgcgatttcccttccccactgtacctccagcacccggagtcagccctcttcccgcgcccgccgctttccccccgacacctcagagcgttccaagtccagcccctactcccttccccatcgagctattacctcttggatactcagaacccgcctttggtccctgcttctcaatgccgcgaggaaagccgccagccccttcccccagaggacagaaagcgtctcctcccactttagcccccgctacggccagtccccctaccactgccgggtctaataatccctgtctgacccagctgctcactgctgctaaaccagagcaggccctcgaacctcccctggtgtccagtactctgctgcggagccccgggagccctcaggaaaccgtgcccgagtttccatgcacattcctaccaccaactccagcaccaacacccccacggcctcctccaggacccgctacattggcaccgtctcgcccactcttggttcccaaagccgaacgactcagccccccagccccgagcgggtctgagaggcggctgtcaggggatctgtcaagcatgccgggacccgggaccctctcggtgagagtctctccccctcaacccattctgagtcggggccggcctgactccaacaagacagaaaatcgaagaatcacacacataagcgctgaacagaaacggagatttaatattaagctgggattcgataccttacacggcctggtttctactctttctgcccagccaagcctgaaggagcgggccgggcttcaggaggaggcccagcagcttagggacgagattgaggaattaaatgccgccattaatttgtgtcaacaacagctccctgcaaccggggtgcctatcacacatcagcgattcgatcaaatgcgtgatatgtttgatgattacgtcagaaccagaaccctgcacaactggaagttttgggtgtttagcatccttatcagacctctgttcgaaagcttcaatggtatggtgtccacagcctccgttcataccctgcggcagacaagtctggcgtggctggaccagtactgtagtttgcctgctctgcgacctactgttctcaacagtctgcgccagctaggaactagcacgagcattttgaccgatcccggccgcattccggagcaggcaaccagagctgttaccgagggcacattggggaagccgctctag

SEQ ID NO: 124824 - DNA, 1059 bp, Artificial Sequence
  Description of Artificial Sequence: Synthetic coding sequence
atgaacacgattgtgttcaacaaactctcaggcgcagtactgttcgaggacggaggggccagcgaacgggagaggggagggcggccttatagcggcgtactcgacagtcctcatgcgaggccggaggtggggattccggatggcccacccctgaaagacaacttgggacttaggcacagacggactggagcccgacagaacgggggaaaggtcaggcacaaaagacaggcacttcaagacatggcacgcccactcaagcaatggctttacaaacatcgggataacccgtatccaaccaagacagagaaaattctactggccctggggagtcaaatgactcttgtgcaggtttctaactggtttgcaaatgcgcgccgcaggctgaagaacaccgtccggcagcccgacctttcttgggcactccggattaaactttacaacaagtacgtacaggggaatgccgaacggctttcagtatcatcagatgacagctgtagcgaagacggggaaaaccccccacgaactcacatgaacgaaggcggatataacactcctgtccaccatccagtgatcaagagcgaaaactccgtgattaaagccggggtgagaccagagtcccgggcttccgaggattacgtcgcccctccaaaatacaaaagctcactgctgaataggtatcttaatgatagcctgagacatgttatggccacgaataccacaatgatgggcaaaactcggcaaagaaaccactccggatctttcagctcaaacgagttcgaagaggaactggtcagtccctcttccagcgagactgaaggaaacttcgtctaccgaacagacacccttgaaaacggatctaacaaaggagagagtgccgccaaccggaagggaccatcaaaagacgatacctattggaaggagattaacgccgcaatggccctcactaacctcgctcaggggaaggacaagttgcagggcaccacatcttgcataatccagaagtcctctcatattgcagaagttaaaaccgtgaaggtgccactcgtccagcagttctag

SEQ ID NO: 124825 - DNA, 1059 bp, Artificial Sequence
  Description of Artificial Sequence: Synthetic coding sequence
atgaacactattgtttttaacaagctatccggggctgtattgttcgaggacggcggagctagcgaacgtgagcgcggcggcagaccatatagcggcgtgctggactctccccacgcccgccctgaggtcggcatccctgatgggccccctctcaaagacaatctgggattgagacaccgacggaccggggcccggcagaacgggggaaaagtgagacataagcggcaagctctgcaggacatggctcgtcccttgaagcagtggctgtacaaacatcgggacaacccgtatcccactaagaccgagaagattttgttggcactaggctctcaaatgacactagtacaggtatcaaactggtttgccaatgcccgtcgcagactcaagaacacagtcagacagcctgacctgagctgggcactccggataaaattatataataaatacgtccaggggaacgctgagagactatccgtaagttcggacgactcttgttctgaagatggcgaaaatcccccccggacacatatgaatgaagggggatataatacgccagtacaccatcccgttatcaagtcagaaaattcagtgatcaaggccggagtgagaccggaaagtagagcttcagaggattatgtggcccccccaaagtataagtcctccctgctcaatagatacctgaacgactcacttaggcatgtaatggcaaccaatacaaccatgatggggaagacacggcaacggaaccattccggcagcttctcaagtaatgagttcgaagaggagctggtttcccccagcagtagcgagacagagggcaactttgtttaccgcactgacaccctcgagaatggaagcaataagggtgaatccgccgcgaatagaaagggacctagtaaagatgacacctattggaaagagattaacgctgccatggccctgactaacttggcccaggggaaggataaactgcaagggaccacctcctgcatcattcagaaatcctcgcatatcgcagaggtgaagacagtgaaagtcccactggtccagcagttctag

SEQ ID NO: 124826 - DNA, 177 bp, Artificial Sequence
  Description of Artificial Sequence: Synthetic coding sequence
atgaataccatcgtgttcaacaaactttcaggcgccgtgctctttgaagacgggggcgccagtgagcgggaacgaggcgggcgtccatattccggcgttttagattcaccccatgcacgacctgaggtcgggatccctgatggtccacccctgaaggacaaccttggacttaggtag

SEQ ID NO: 124827 - DNA, 288 bp, Artificial Sequence
  Description of Artificial Sequence: Synthetic coding sequence
atgaactttgacttcccttttaagaagggctccggcattccactcctcaccaccaatctttcgccccagtgtctatctttgctgcacgccatggtggcttacgatcctgacgagaggatcgccgcccatcaggctctgcagcatccctattttcaggaacagcgaactcaaaatggatctgaggatgaggcttccgccgtacttctgcctatccagaccagatcaagtttgaatcctttgctaagcacatgcatgctgcccggtaggagcgtgaccctgctggtctag

SEQ ID NO: 124828 - DNA, 1260 bp, Artificial Sequence
  Description of Artificial Sequence: Synthetic coding sequence
atgaagaattacaaagcaatcggtaaaattggagaaggcacgtttagcgaggtgatgaagatgcaaagcctcagagatggaaattactacgcatgcaagcagatgaagcagcgattcgagtctattgaacaagtcaataacctcagggagattcaggccttgaggagactaaatccacacccgaatatcctcatgctccatgaggttgtcttcgatagaaagtctggatccttggcactcatttgcgagcttatggatatgaatatatacgaactgattcggggacgcaggtatcccttgtcggaaaagaagataatgcattatatgtatcagctctgtaagagcctggatcatatccaccggaatggaatcttccatcgcgacgtcaaacccgagaacatcttgataaaacaggacgtcttgaaactaggtgatttcggatcttgcaggtctgtctactctaaacagccctacacagagtatatcagtaccagatggtaccgagcccccgagtgtttacttaccgacgggttctacacctacaagatggatttgtggtctgccggatgcgtgttttatgagattgccagcctccagcccctctttcctggggtcaacgagcttgatcagattagcaaaattcacgacgtgatcggaaccccagcacagaaaatcctgactaagtttaagcagtctcgggccatgaatttcgattttccttttaaaaagggctctggcattcctctccttaccacaaacctatccccccagtgtctctctcttctgcacgcaatggtcgcatacgatccagacgagcgcatagcagctcaccaagctctccaacacccctactttcaggagcagagaaagacagaaaagcgcgccttaggatcacatagaaaagccggcttccctgaacaccccgtggccccagaaccgctgagtaattcctgtcagatttcaaaggaggggagaaagcagaagcagagcctgaagcaggaggaggatagacctaaacggcgcggacccgcctacgtcatggaactgcccaagttgaaactgtctggcgtggtgagacttagctcctactcctccccaacgttgcagagtgtcttgggatctggcactaatggtcgagtgccggttctgagacctctgaagtgtatccctgcttcaaagaagactgacccgcaaaaagatctgaagcctgcgcctcagcagtgtaggctgcctaccatcgtaagaaaagggggccgctag

SEQ ID NO: 124829 - DNA, 2667 bp, Artificial Sequence
  Description of Artificial Sequence: Synthetic coding sequence
atggccggcgccgctgccgagtctgggcgggagctgtggacattcgctggatcccgcgacccatctgcacccagattggcctatgggtatgggcctgggtctctgcgggagttgcgagcccgtgagttctccagattggctgggacagtgtacctggaccacgcaggagctaccctattcagtcagagccagctggaaagctttacctccgatctgatggaaaatacatatgggaacccccattcacaaaatattagcagtaagctgacccacgatactgtggaacaggttcgttataggattctcgcccactttcacacgacggctgaagactacaccgtgatttttactgctggctccacagctgctctgaagctggtcgccgaggcttttccatgggtgagccaagggcctgaatcctcaggcagtcggttttgttatttgacagattctcacacgagcgtggtgggcatgagaaatgtgactatggctattaatgtgatttcgactccagtgaggcctgaagacctgtggtccgcagaagaacgctcagcctccgcatccaatcctgattgccagctgcctcatctgttctgttatcctgcccagagcaactttagcggcgtgaggtatcctctgtcttggatcgaagaagtaaagagcggccgactacaccctgtctcaacccccggaaaatggtttgttttgctcgatgccgctagctacgtctcaacatccccactagatttgtccgcccatcaggccgacttcgttccaatttctttctacaaaatcttcggatttccaacaggcttaggagccctactcgtgcataaccgcgccgctccgctcttaaggaagacctattttggaggcgggactgcctcagcctacctcgccggggaagatttttatataccgcgccagagtgtggctcagaggttcgaggacgggacaatttcttttctggacgtgatcgccctgaagcacggattcgatactcttgaacgcctcacaggggggatggagaatattaagcagcacaccttcactttagcgcaatacacatacgtcgccttgtctagccttcagtatcccaatggggctccagtagtccgcatatactctgactcggagttttcatctcccgaagttcaaggaccaatcatcaattttaatgttctcgacgacaaaggcaacattatcggatatagccaagtagacaagatggcctctctctacaacatccacctcagaaccgggtgcttttgcaatacgggggcatgccaaaggcacctgggtatctcaaatgagatggtgcggaagcactttcaggccggccacgtctgtggggacaacatggatttgatcgatgggcagcccactggaagtgtgcggatttcattcgggtatatgagtaccctggacgatgtgcaagcgttcctccgctttatcatcgacactaggctccatagtagcggagattggcccgtgccccaagcgcacgctgacactggagagactggagcaccttctgccgattctcaggccgacgtgatccccgctgtgatgggtaggagaagtttgtcccctcaagaggatgctctcacggggtcgagagtctggaataacagcagcacggtgaacgctgtgcctgtggcgcctcccgtgtgcgatgtggctaggacacagcctacaccatctgaaaaggccgcgggcgtactggagggggccctgggacctcacgtcgttaccaatctctacctgtaccccatcaagtcatgtgccgctttcgaagttaccagatggcccgtcgggaatcagggtttgttgtacgaccgcagctggatggttgtgaaccacaatggagtgtgcctgtctcagaaacaggagcctcgtctatgtttgattcagccttttattgatctaaggcagagaattatggtcataaaggccaagggaatggagccaatcgaggtccctctggaggagaattccgagagaacacaaattcgtcaatcaagggtgtgcgccgaccgcgtttccacttacgattgcggagaaaagatcagctcttggctgagtacattcttcggtcgcccctgtcatttgatcaaacagtctagtaacagccaaaggaacgccaaaaagaagcacgggaaagaccagctcccaggcacaatggccacattatccttagttaacgaggcccaatacctgttgattaacacatcatccatcctggagttacataggcagctgaacacatctgacgaaaatgggaaagaagaactgtttagtttaaaagatctcagcctgagattcagagctaatatcattatcaacggaaagcgggcgtttgaggaggagaagtgggatgagatctcaataggcagcctgaggtttcaggtcctgggcccgtgccatcggtgccagatgatatgcattgaccagcagacgggtcagagaaaccagcatgtcttccaaaaattgagcgagtcaagggaaacaaaggtcaactttggaatgtaccttatgcacgcaagtctggatctgagctcaccctgctttcttagcgtgggcagccaagtactgcccgtgctgaaggagaatgtggaggggcacgacttgcccgccagtgagaagcaccaggacgtgacctcatag

SEQ ID NO: 124830 - DNA, 1863 bp, Artificial Sequence
  Description of Artificial Sequence: Synthetic coding sequence
atggcagctcgcccgctctcccggatgcttcgacgactgctgcgcagctctgccaggtcctgtagctcaggagccccagttacacagccttgccctggagagtccgcaagagccgcgagcgaagaagtctcacgaaggagacagtttttgagggagcatgcagcgccatttagtgctttcctcacggacagcttcggaaggcagcacagctacctgagaatatccctgacggagaaatgtaacctgaggtgccagtattgcatgcccgaggagggggtccctctcacacccaaagcgaatctcctaacaacggaagagatactcacgcttgctcgcttatttgttaaggagggtatcgacaagatccgcctgacagggggagagcctttaatccgacctgatgtcgtcgacatagtagcccagctgcaacgcttggagggcctcagaacaataggcgtgactaccaacggcataaatctggcacggctcctgcctcagctgcagaaagccgggttatcagctatcaacatctcgctggacactctcgtgcccgccaaatttgagttcatagtaaggcggaagggctttcataaagtcatggagggtatacataaagccatcgagctcggctacaatccggtgaaagtcaattgtgtggttatgcgcggactgaacgaagatgaacttctggacttcgccgcactgaccgaagggttgccactcgatgtgcggtttatcgaatacatgcccttcgacgggaacaaatggaacttcaaaaaaatggtgagttacaaagagatgctggacacggtacgtcaacagtggcctgagctagaaaaagtccctgaagaggaatcgtctaccgccaaggcatttaaaattcctggctttcagggccagatatcattcataacctctatgtcagaacatttttgcggtacatgtaatcgcctgcgcattacagcagacggcaaccttaaggtctgcctctttggcaatagcgaagttagcctgagggaccacctccgggcaggagcatcagaacaggaacttctaagaatcatcggagcagccgtcgggcggaagaagaggcagcatgccgagctttttctgatgttcccaaatagtccaccggccaacccctcaatcttctcctgggatcctcttcacgttcagggcctgcgccctcgcatgtctttcagcagccaggtcgcaaccctgtggaaaggatgcagagtccctcaaacacctcctcttgcgcagcaaagactcgggtcgggaagctttcagaggcactacaccagcagagctgattctgatgccaattcaaagtgcttgtcaccaggctcatgggcatccgccgctcccagcggcccccaattgacatctgaacaactcacacacgtagattctgagggacgagcggctatggtggacgtgggccggaagccggacacagagagagtggcagtcgcatcagccgtcgtgctgctcggtccggtagcatttaaacttgtccagcagaatcagctgaaaaaaggcgacgcactggtcgtcgcccaactggcaggggtgcaagctgctaaggttacctcacagctcattcctttgtgtcatcacgtcgccctgtcgcatattcaggtgcagctcgagctggatagcacccgtcacgcggtgaagatccaggcatcatgcagagctcggggtcctaccggggtggagatggaggcactcacttcagccgccgttgccgccctgacactgtatgatatgtgcaaggccgtttctagagacatcgtgctagaggaaatcaagctgatctcaaaaaccggaggacagagaggagactttcacagggcctag

SEQ ID NO: 124831 - DNA, 1911 bp, Artificial Sequence
  Description of Artificial Sequence: Synthetic coding sequence
atggctgcgagacctcttagcagaatgctgcgtcggctgcttagatcttctgcacgcagctgcagcagcggggcccctgttacacagccatgcccgggagaatcagctagggcagcttccgaggaggtgtcacggcgccgacaattcttgcgcgaacatgcggccccattctctgcctttttgacagattccttcggtaggcagcacagctatttgagaatctctctcacggaaaaatgcaatttgcggtgtcagtattgcatgccagaggagggtgtccccctaacccccaaggccaacctcctgactactgaggaaattctcactctggcgagactctttgtgaaagagggtatcgacaagatacgtctgaccggcggcgagccccttatacgccccgatgtcgtggacatagtcgctcaactacagcggctggaagggctccgtacgataggggtgaccactaacggaatcaacctggctcggcttctgccacagctccagaaagccggattgagcgcaatcaatatctccctcgatacacttgtgcctgctaagtttgagttcattgtgcgccgaaaaggattccacaaagttatggaaggcatacataaggcaattgagctcggctataatccagttaaggttaattgcgtggtcatgaggggattgaatgaggatgaattgcttgatttcgcagctctaactgaagggctgccattagacgtgagatttatcgagtatatgccattcgacggtaacaaatggaacttcaagaaaatggtgagttataaggagatgttagacactgtgaggcaacagtggccagaattggaaaaagtccccgaagaggaatccagcaccgccaaagctttcaagatccccggcttccaggggcagatctccttcatcacctcaatgtccgaacatttttgcggaacttgcaatcgcctaagaatcacagccgacggcaacctcaaagtgtgcctgttcggcaattcagaagtcagcctgagagaccacctgcgcgcaggcgcatccgagcaggaactgctgcggattatcggggccgccgtggggcgcaagaagcggcaacacgctggcatgttttctatctcccagatgaaaaatcggccaatgatcttgattgaacttttcttgatgttcccaaattctccacccgcgaatccatctatcttctcgtgggatccattacacgtgcagggcctgcgaccccgcatgtccttcagcagtcaggtggctaccctgtggaagggctgccgggttccccaaacccccccactcgcacagcagcggttgggaagtggtagttttcaaaggcattacacttctcgggccgatagcgacgccaactccaaatgtctgtctccaggctcctgggccagcgccgctccctctggacctcaattaacctcagagcaattaactcatgtggactctgaaggaagggccgcaatggtagacgttggacgcaagccagatacagaacgggtggccgttgccagtgccgttgtgttgcttggccctgtggcctttaagctcgtgcagcagaatcaactgaaaaagggcgacgctctggtggtcgctcagctggccggggtgcaggctgccaaagttacaagtcagttgatccctttgtgccatcacgtggcactgtcccacatccaggttcaactcgaacttgactccacacggcatgcagtgaagatccaggcatcctgtcgggcccgcggacctacaggggtggagatggaagccttgacctccgccgccgtagccgccttgaccctgtatgatatgtgtaaagctgtgagccgggatatcgttctggaggagattaaactcattagcaagacaggaggccagaggggagatttccaccgggcatag

SEQ ID NO: 124832 - DNA, 456 bp, Artificial Sequence
  Description of Artificial Sequence: Synthetic coding sequence
atgccctttgatgggaacaagtggaactttaagaaaatggtcagctacaaagagatgctcgatacagtgagacagcagtggcccgagctcgaaaaagtcccggaagaagagagcagtactgccaaggctttcaagattcccgggtttcagggacagatttcatttattacctctattttgacagttgcgagatcctgctggccacttttcctctggcctccgtctagcgagacaggctgcgctcacatgggtcactcacccaaggattcctgccaaaccactcagccaactccaggcccagtgcacggctgttccactcatccttctcttttctggagcatcagcgggaaagagaaacttatgattgactgcctgcacccacatagtgcccagattaagctgagatgccagctgtgtaggtgtaaaaacgaggacacagtctgggtgggtcattag

SEQ ID NO: 124833 - DNA, 1071 bp, Artificial Sequence
  Description of Artificial Sequence: Synthetic coding sequence
atgtggaaatcttggaagcttcgaacagatgtgcgcgaggtttcccgacgcagacaattcttacgcgagcacgcggctccattctccgcctttctgaccgactcatttggccgccagcacagctacctacggatttccctaacagaaaaatgtaacctgcggtgccaatactgcatgcctgaagagggtgtgccattaaccccaaaagccaatctgttaacaaccgaagagattttgactttagcccgtctgtttgtgaaagagggcatcgataagatccgcctcacgggcggggaaccattgattagacccgatgttgttgacatcgttgcccagctgcagcggctggaaggtcttcgtacgatcggggtcactactaatggcataaacctggccaggttgctgccacaactgcagaaagctgggctttccgcgataaacatctctctcgataccctcgtgcccgcaaaattcgaattcatcgtcagaagaaaaggtttccacaaggtgatggagggtatccataaggctattgagttaggatacaaccccgtgaaggtgaactgtgtggtcatgcggggtctgaatgaagatgaactgctggatttcgccgctctgaccgaagggctaccattggacgtccgcttcatcgaatacatgccttttgatggcaacaaatggaacttcaaaaagatggtaagctacaaggagatgttagatacagttcgccagcagtggccagaattggaaaaggtcccagaggaagagagtagcacagcaaaagcattcaagattcctggatttcagggccaaatctccttcatcacttcaatgtctgagcatttctgcgggacatgtaaccggctgaggataaccgctgatggaaacctcaaagtttgtcttttcggaaactcagaggtcagcctccgagaccatttgcgcgccggcgccagtgagcaggaactgttacggattattggagccgctgtcggtcgcaagaaaaggcagcacgcgggtatgttcagcatttcccagatgaaaaaccggcctatgatcttaattggggggtag

SEQ ID NO: 124834 - DNA, 1158 bp, Artificial Sequence
  Description of Artificial Sequence: Synthetic coding sequence
atgtggaagtcgtggaaactgcgtacagacgtgcgggtaagggaaggtgctgggggctctccatgtgcatcatcacagcccggatcccgaggaccgtgctttctgccaggactctcatcccaagaagtgtctaggaggagacagttcttgagggaacacgcagctccattctccgccttcctcaccgactcctttggacgccagcacagctaccttagaatctctctcacggagaaatgtaatcttcgatgtcaatactgtatgccagaggagggagtgcctctgacccccaaggccaatctcctgaccacagaagagatcctcaccctggctagacttttcgtaaaggagggaatcgacaagatcagactcacgggcggcgagcccttgatccgaccagatgtggtggacattgtggcccagttgcagcgactcgagggtttgagaaccatcggcgttacaactaacggaattaacctggcacgcctgctacctcaactgcagaaggccggactttcggccatcaatatcagcttagatacgctcgtgccggctaaatttgagttcattgtccgccggaagggatttcataaggtgatggaggggatacataaggctatcgagttgggctataacccagtcaaggtcaactgtgtggtcatgagaggtctgaacgaggatgagctcctggatttcgcagccctgacagaggggttacccctcgatgtgcgatttattgaatatatgcctttcgatggaaacaagtggaattttaaaaagatggtttcctacaaagaaatgctggacaccgttcggcagcagtggccggaactagagaaagtccccgaggaggaatcatctaccgccaaggctttcaagattcccggttttcagggacagatcagctttatcacctcaatgagcgagcacttctgcgggacatgtaaccgcctgaggatcacagccgatggcaacctcaaagtctgcctgttcggcaacagtgaggtgtctcttcgtgaccatctcagagcgggtgctagcgagcaggagctcctgaggatcatcggcgccgccgtggggcgaaagaaaaggcaacacgccgggatgttctcaattagtcagatgaagaaccgccctatgatacttatcggaggctag
